United States Patent 8,999,380 (MODIFIED POLYNUCLEOTIDES FOR THE PRODUCTION OF BIOLOGICS AND PROTEINS ASSOCIATED WITH HUMAN DISEASE) - sequence listing, part 5

SEQ ID NO: 6691 - DNA, 966 bp, Artificial Sequence
  Description of Artificial Sequence: Synthetic coding sequence
atgtctgccaaaagtaggacaatagggattatcggggccccctttagtaaaggccagcctcgcgggggggtcgaagagggccccacagtgcttcgaaaggcaggtctgttggagaagctaaaggaacaggagtgtgacgttaaggattacggggatctgcccttcgccgacatccctaacgactcgccctttcagatcgtgaagaacccccgatccgtgggtaaggcatccgagcagttggccgggaaggtagccgaagttaagaagaacgggcgaatctccctggttctggggggggatcactccctagctatcgggtcaatttccggtcatgctcgggtccaccctgatcttggtgtgatttgggtggacgcccatacagatattaataccccgctcaccacgacatccggaaatttgcacggtcaacctgtgagcttcttgctgaaggagctgaagggcaaaatccccgacgtaccagggttttcctgggtgaccccttgtatttctgccaaggacatcgtgtacatcgggctgcgggacgtggacccgggcgaacactacattctgaagacactaggcatcaagtatttctccatgaccgaggtggatcgtttaggcatcggcaaggtaatggaggagaccctctcctatctactggggagaaaaaagaggcccatacacctgtcattcgacgttgatggcctggatccctccttcactcccgccacagggactccagtggttggtggcctgacatacagagaaggtctgtacataacagaggagatttataaaactggtttattgtccgggctggatatcatggaagtgaatccttccctggggaaaacccctgaagaggtgaccagaacagttaacaccgccgtcgcgattacactagcgtgcttcgggctcgcccgggagggtaaccacaagccaattgactatttgaacccccccaaa

SEQ ID NO: 6692 - DNA, 966 bp, Artificial Sequence
  Description of Artificial Sequence: Synthetic coding sequence
atgtcggccaaaagcagaactatcggtattatcggggcgccattcagcaaaggccaaccacggggaggcgtggaagaagggcctacggtgctgcggaaggcaggattgctggagaagttgaaggagcaggaatgtgacgtcaaggattatggagatctgccgttcgcagacataccgaacgattcaccttttcagatagtgaaaaacccaaggtccgtgggaaaagcgtcggagcagcttgcgggaaaagtggcggaagtcaagaagaacggacggatttccctcgtgctcggtggggatcattccctggcaattggtagtatctcaggacatgcgcgcgtgcatcccgacctgggcgtaatttgggtggatgcacataccgacatcaacactcctctgaccactacctcaggaaatctgcacggacaaccagtctcctttcttctcaaagagctcaagggaaagatacctgatgtgcctgggttcagctgggtgacgccttgtatctccgcaaaagatattgtgtacattggtctgagagacgtggatcccggggaacattacattcttaagactctgggcattaagtactttagcatgactgaagtggatagattgggaattggcaaggttatggaagagactctttcgtaccttctcggaagaaagaagaggccaatacatctttcgtttgatgtggatgggttggatccctcttttacccctgcgactggcactcctgtcgtgggaggacttacctaccgggaaggactttacataactgaagaaatctacaagaccggtctgctttcaggcctcgatatcatggaggtcaatccttcgctcggaaaaactcctgaagaagtgacccgtactgtcaacactgcagtggctattactctcgcgtgctttggactggccagagaaggcaaccacaagcccatcgattaccttaaccctccaaaa

SEQ ID NO: 6693 - DNA, 966 bp, Artificial Sequence
  Description of Artificial Sequence: Synthetic coding sequence
atgtcggcaaaatcgaggactatcggcatcattggagccccattttccaaaggccaaccccgtggaggagtggaagagggaccaacagttctgcgaaaggccggtctcttggaaaaacttaaagaacaagagtgcgatgtgaaagattacggagaccttccgtttgcagatatacctaacgactctcctttccaaattgtcaagaatccgagaagtgttggaaaggcgtcggagcagcttgctggaaaggttgctgaagtaaaaaagaatggccgaatatcccttgttttaggaggagatcattctcttgcgataggatccatttccggacacgcgcgcgttcatccagatctcggtgttatttgggtagatgcgcatacagatattaatactccactgacgactacctctggaaatctacacggccaaccagtttccttcctgcttaaggagttgaaaggaaagattcctgacgttcccggtttcagttgggtgacaccatgcatctccgcaaaggacatcgtttatattggtctccgagacgtcgatccgggtgaacattacatcctgaaaacactgggtatcaaatacttttctatgactgaggtcgatcggttgggcatcgggaaggtgatggaagaaactttgagttatcttttggggcgtaagaaaagaccaatccatctttcgtttgatgtcgatggactagatccatcgtttacaccagctacggggactcctgtagttggtggacttacttatcgagaggggctttatatcacggaagaaatatacaaaacaggtctcctttccggactcgacattatggaagttaacccctcactggggaaaacaccagaagaagttactcgaactgtaaacacagctgtcgcgattacactcgcttgttttggtttagctcgagaaggtaaccataagcctattgattatctcaatccgccgaaa

SEQ ID NO: 6694 - DNA, 966 bp, Artificial Sequence
  Description of Artificial Sequence: Synthetic coding sequence
atgtccgctaagtcgcgcaccatcggaatcatcggagccccattcagcaagggacaacctcggggcggggtggaggagggaccgactgtgcttcggaaggctggactcctggaaaaactcaaagaacaggagtgcgacgtgaaagactacggcgacctcccctttgcggatattccgaacgactcccctttccagatcgtcaagaacccaagatcggtcggcaaggcgtccgagcaactggccggaaaggtggctgaggtcaagaaaaacggcaggatctcgctggtgcttggaggagatcactccttggcaatcggaagcatttcaggacatgcgcgcgtgcatccagacctgggagtgatctgggtcgatgcacacaccgacatcaatactccacttaccacgacctccggaaacttgcacggacagccggtcagcttcctcctcaaagagctcaaaggcaaaatccctgacgtcccgggcttcagctgggtcactccctgcatctcggcgaaggatatcgtgtacatcgggctccgggatgtggatccgggggagcactacattcttaagactcttgggatcaagtacttctccatgactgaggttgaccgcctcggtatcgggaaagtgatggaagagactctgagctacctcctgggacggaagaaacgtccgatccatctgagcttcgacgtggatgggctcgacccgtcgttcactccagcaaccggaaccccggtggtgggaggattgacctacagagaaggtctgtacatcaccgaagagatctacaaaacgggcctgttgagcggactcgacattatggaagtcaatcccagcctgggcaagaccccagaagaagtgactcgcactgtgaacaccgccgtggccattactctggcctgcttcgggctcgctagagaaggcaaccacaaaccgatcgattatctgaatccaccgaaa

SEQ ID NO: 6695 - DNA, 966 bp, Artificial Sequence
  Description of Artificial Sequence: Synthetic coding sequence
atgtctgcaaaatcacggaccatagggattattggcgcaccgttttctaaaggtcaaccgcgggggggagtcgaggagggtccgaccgtgctgcggaaagctggcctgttagaaaagttaaaagaacaagaatgtgacgtgaaggactatggagacttgccctttgcagatattccgaacgatagcccgttccaaattgtaaagaatcctcgaagtgtgggaaaagcttcagagcagttagcaggcaaagtagcggaagtaaagaaaaatggccgcatttccctggttctgggaggcgatcattccttagccatcggctcaatatcaggccacgcgcgagtacatcccgaccttggagtcatatgggtcgatgcacatacggatattaacacaccgttgacaacaacgtcaggaaacttgcacggccagccggtaagttttctgctcaaggagctgaaaggcaagattcctgatgtcccgggcttctcatgggtcactccgtgcatttcggcgaaggacattgtttacatcggtcttcgagacgtggaccctggggaacactacatcctgaaaactttgggcatcaagtatttctctatgacagaggttgacagactcggcattggtaaagtaatggaagagacgctgtcttatctgttgggcaggaaaaagcgtccgatccatctgtcttttgacgttgacggccttgatcccagcttcacccctgcgacaggtacaccggtggtagggggactgacataccgtgaaggtctgtatatcacggaagaaatttataagactgggttgctctctggccttgacattatggaagttaatccttcactgggaaaaacgccagaggaggtgactcggacggttaatacagcagttgcgattacgctcgcatgcttcggcctggcacgggaggggaaccacaaaccgattgattatttaaatccgcctaaa

SEQ ID NO: 6696 - DNA, 966 bp, Artificial Sequence
  Description of Artificial Sequence: Synthetic coding sequence
atgtccgctaagtcccgcaccatcggaatcatcggtgcgccgttctcgaagggacagcctcggggaggtgtcgaagaagggcccaccgtgctcaggaaggctgggctgctcgagaagctcaaggagcaagaatgtgatgtcaaagactacggggatctgcccttcgctgacattccaaatgactcgccgtttcagatcgtgaaaaacccgcgctccgtcggaaaggcgagcgagcagctggccggaaaggtcgctgaggtgaagaagaatggtcgcatctctttggtgttgggaggcgaccacagcctggccattggctccatcagcgggcacgcccgagtgcaccccgacctcggagttatttgggtggatgcccacactgacatcaacactccgctgactactacgtcgggaaacttgcatggacagccagtgtcattcctgcttaaagagctgaaaggaaagatcccagatgtcccgggattctcctgggtgaccccgtgcattagcgcaaaggacatcgtctacataggtctgcgggacgtcgatccaggcgaacactacatcttgaaaacgctgggtattaagtacttctcaatgacggaagtcgaccgcctcggtatcggaaaggtgatggaggagactctctcctacctccttgggaggaaaaaacggccgatccatctgtcatttgacgtggacggtctggacccatccttcactccagccaccgggacccctgtggtgggcggactgacctaccgtgagggactctacatcactgaagagatctacaagactggactgctttcgggactcgacatcatggaagtgaatccgtctctgggaaagacccccgaagaagtgaccagaactgtgaacaccgccgtggccatcacgctcgcttgcttcgggcttgcgcgagagggcaaccacaaaccaatcgattatctcaacccgccaaag

SEQ ID NO: 6697 - DNA, 966 bp, Artificial Sequence
  Description of Artificial Sequence: Synthetic coding sequence
atgagtgcaaagtcacggaccattggcatcattggagccccctttagcaaaggccagcctagaggcggagtggaagaaggacctaccgtgctgaggaaggcaggactgcttgaaaagctgaaggagcaggagtgtgacgtcaaagactacggagatcttccttttgccgacattcccaacgattcgccattccaaattgtgaaaaacccccgctccgtggggaaggcgtcagaacaactggccggaaaggtggcagaagtgaagaagaacggacgcatatcgttggtcctcggtggggatcactcccttgccatcggcagcatctctggacacgcccgggtgcacccagaccttggggtcatttgggtcgacgcacacactgacataaacactccactcactaccacctccggaaacctgcatggacaaccggtgtcatttctccttaaagaacttaagggcaagattcccgatgtgccaggtttttcctgggtgaccccatgtatttctgccaaggatattgtgtatatcgggctgcgggatgtcgatcctggcgaacattacatactcaagactctcggtatcaagtacttttccatgaccgaagtcgatagacttggaattggaaaggtgatggaggagactctctcgtatcttctgggcaggaagaagcgtccaatccaccttagcttcgatgtcgacggccttgacccatcattcaccccagcgaccggaactcctgtcgttgggggtctgacctacagagaaggtctgtacatcacggaagagatatacaagaccggacttctgtcaggactggacataatggaggtgaacccatcgcttggtaagactcccgaggaagtgacccgtaccgtgaacactgcagttgcaatcacccttgcgtgctttggtcttgcccgtgagggaaaccataagcccatcgattacctgaatccaccaaag

SEQ ID NO: 6698 - DNA, 966 bp, Artificial Sequence
  Description of Artificial Sequence: Synthetic coding sequence
atgtccgcaaagtccaggactattggcattatcggggcgccattttccaagggacaacccagagggggagtggaggaaggaccgaccgtcctcagaaaggccggactgctcgaaaaacttaaggagcaagaatgtgatgtgaaggattacggagatcttccgtttgcggatatacccaacgactcgccctttcaaatagtcaaaaaccctcggtccgtggggaaggccagcgaacaactggcaggcaaggtcgcagaggtgaagaaaaacggccggattagcctggtccttggtggagatcattcgctggccataggcagcatatcaggacacgcaagagttcatcctgacctcggagtgatatgggtcgacgcccataccgatatcaacacccccctgaccaccacgagcggaaatctgcacggccagcccgtgtcctttctcctgaaggaactgaagggtaagatccccgatgtgccaggattttcatgggtgaccccttgtatttcggcaaaggacatagtttacattggtctgcgtgatgtggatcctggggaacattacatcctgaaaaccctcgggattaagtacttttcgatgacggaggtggatagacttggcatcggaaaggtgatggaagaaaccctctcctacctccttggcaggaaaaagcgccctattcatctgtcgttcgacgtggatgggctggatccttcatttactccagcgactggcactccagtggtgggaggacttacgtacagagaagggctttacattacggaagagatctacaagactgggctgctctccggtctggacattatggaagtgaacccttcgctgggcaagacccctgaggaagtcactcggaccgtgaacactgcagtggccatcactctcgcctgtttcgggcttgcgagggaggggaaccacaagccaattgactacctcaatccacctaag

SEQ ID NO: 6699 - DNA, 966 bp, Artificial Sequence
  Description of Artificial Sequence: Synthetic coding sequence
atgagcgcaaagtcccgtaccatcggaatcattggtgcaccattctccaagggtcagcctcggggcggtgtggaagaggggcctaccgtcttgaggaaagcaggccttcttgaaaaactcaaagaacaagagtgtgacgttaaagattacggcgatctgccattcgcagacattccaaacgattcaccttttcaaattgtcaaaaatcccaggtccgtgggaaaggcttcagaacaacttgcgggaaaggtggccgaagtcaaaaagaacggacggatatcactggtgctgggaggtgaccatagccttgccatcggttccataagcggtcacgctagggtgcatccggatcttggtgtcatctgggtggatgcccacactgatatcaacacgccacttactacgacttcgggtaaccttcatggacaacccgtgagctttctcctgaaggaacttaagggcaaaattccagatgtgcccggattttcctgggtgacgccgtgcattagtgctaaggacatcgtgtacattggcctgcgcgacgtagacccaggagagcattacattctcaagactctgggaattaagtacttctcgatgactgaagtggatcgcctgggtataggtaaggtcatggaagaaaccctgtcgtatctccttggtcgaaagaagcgacccatccatctctcgtttgatgtggacggacttgatccttcttttactcccgcaaccggaacccctgtcgtgggtggtttgacttacagagagggtctttacattacggaagagatttacaagactggacttctcagcggcctcgacattatggaagtgaacccttctctcggcaagaccccagaagaagttaccagaaccgtgaacactgcggtagccattactctggcgtgttttggccttgcacgagagggaaatcacaagcctattgactaccttaaccccccaaaa

SEQ ID NO: 6700 - DNA, 966 bp, Artificial Sequence
  Description of Artificial Sequence: Synthetic coding sequence
atgtccgccaaaagtcgcaccatagggatcatcggggccccattcagcaaggggcagccacggggtggcgtagaggagggccccaccgtgcttcgaaaggccggcctactggaaaagctgaaggaacaagagtgtgacgtcaaagactacggcgacctcccttttgccgatataccgaacgatagtccttttcagatcgtgaaaaaccctaggagcgtgggtaaagctagcgaacagttggcgggaaaggtggcagaagtcaaaaaaaacggcaggataagtctcgtgttgggaggggaccattccctcgcaatcggaagcatttccggccacgcccgggtccaccccgatctgggagtcatttgggtggacgctcacaccgatattaacacccctctgacaaccaccagcggaaatttacacgggcagcccgtctccttcctgctgaaagagctgaagggcaaaatccccgacgtacccggcttctcttgggtcactccatgcatctcagccaaggatattgtgtatataggcttacgggacgttgatccaggcgagcactatattctgaagacccttggaataaagtatttctccatgacagaggtcgatcggctgggcattggtaaggttatggaggagacattgtcctatctgctgggccgcaagaaacggcccatccatctttccttcgatgtcgacggcctcgaccctagttttacgcctgccaccggcacaccagtggtgggaggtctgacttatagagagggcctgtatattactgaagagatctacaaaaccggactgctgtctggcctggatataatggaggtgaaccccagtttaggaaagacaccagaagaggtcaccagaaccgtcaacactgctgtggcaataaccctggcttgcttcgggttagctagagaagggaaccacaagcctatcgactacttgaatcctcccaag

SEQ ID NO: 6701 - DNA, 966 bp, Artificial Sequence
  Description of Artificial Sequence: Synthetic coding sequence
atgtcagcaaagtccaggactatcgggatcattggcgcaccgttttcgaagggacaacctcgcggaggcgtcgaagagggaccgacggtcctgaggaaggccggactgctggaaaaactcaaggagcaggaatgtgatgtgaaagactacggggacctcccattcgctgacattccgaacgactccccgttccaaatcgtgaagaacccacgctccgtgggaaaggcgtcggagcagttggcgggaaaggtggcggaggtgaagaagaacggtcgcatctcactggtgttgggcggggaccattcgcttgccatcggttcaatctcgggtcacgcgagagtgcaccccgacctgggagtcatatgggtcgatgcccacaccgatatcaataccccactcacgactacttcgggcaatttgcacggacaaccagtctcattccttctgaaggaactgaagggaaagatccctgacgtgccaggcttctcgtgggtcactccgtgcatctctgccaaggacattgtgtacatcgggctgagagacgtcgatccaggcgaacactacatcctgaaaaccctgggtatcaagtacttctcgatgactgaggtggatcgactcggaatcggcaaggtcatggaagagacgctgagctatctcctggggcgcaaaaagcgccctatccacctttcttttgacgtggatggacttgatccgtcgttcacgccggccaccggtactcccgtggtgggaggactgacctatcgtgaagggctctacatcactgaagagatttacaagaccggactgttgtcaggactggacatcatggaagtaaacccgtcgctcggcaagaccccggaagaagtcaccaggaccgtgaacaccgcggtcgccatcaccctggcctgcttcggactggcgagagagggaaatcacaagccgatcgattaccttaatccgccaaag

SEQ ID NO: 6702 - DNA, 966 bp, Artificial Sequence
  Description of Artificial Sequence: Synthetic coding sequence
atgtcagcgaagtctaggaccatcggaatcataggtgctccgttctctaagggccagccgaggggaggcgtcgaggagggcccaaccgtgctgagaaaggcgggactgctggaaaagctgaaagagcaagaatgcgatgtcaaagattatggtgatctcccgttcgcagatatccctaacgacagcccgttccaaatcgtgaagaaccctcgctccgttggaaaggccagcgagcagctggccggaaaggtggccgaggtcaagaagaatggacggatatccctggtgctgggaggggaccactcgctcgccatcggatcgatctccggacacgcacgtgtgcacccggacttgggtgtcatctgggtggacgctcacaccgacattaacactcctctgaccactacttccggtaatctgcatgggcagcccgtcagcttcctgctcaaggaactcaagggaaaaatcccagacgtgccgggcttctcctgggtcactccttgtatctcggcgaaagacatcgtttacatcgggctgcgcgatgtggatccaggagaacattacattcttaagacgttgggtatcaagtacttttcgatgacggaagttgatcgccttgggatcggcaaggtgatggaagagactttgtcgtacctgctgggaagaaagaaaagaccgattcacctctcatttgacgtggacgggcttgacccctcatttaccccagcgactggaaccccagtggtgggcggcttgacttaccgggaaggactgtacattaccgaggagatatacaagaccggactgcttagcggactcgacatcatggaggtgaacccgtctcttggaaaaacccctgaggaagtcactcgtactgtgaataccgctgtggcgatcactctcgcctgcttcggactggcccgagaagggaaccataaaccgatcgactaccttaacccgccaaag

SEQ ID NO: 6703 - DNA, 966 bp, Artificial Sequence
  Description of Artificial Sequence: Synthetic coding sequence
atgtccgcaaaatcgagaaccataggcatcataggcgcaccttttagcaagggtcaaccacgtggaggtgtggaagaaggaccaacggtgctccgcaaggctggactgctggaaaagctgaaagaacaggaatgtgatgtgaaggattacggagatctgccgtttgcagacattccaaacgatagcccatttcagatcgtgaaaaatcctagaagcgtcggcaaagcctccgaacaactggcaggaaaagtggcagaagtcaagaaaaatggacgaatctctctggtcctcggcggtgatcacagtttggcgatagggtcaatttcgggtcatgcacgcgtccacccggatcttggtgtgatatgggtggatgcacatactgacattaacactccattgaccactacttcgggtaacctccacgggcagccagtgtcgtttctgcttaaggaacttaagggaaagatacccgatgtgcctggattttcgtgggtgactccctgtattagcgctaaggatatcgtgtacatcggcctccgagacgtcgatcctggcgagcattacattctgaaaaccctcgggatcaaatacttctccatgactgaagtagacagactgggaattggtaaggtgatggaagaaaccctgtcgtacttgctggggcgtaagaagcgccctattcatctttcattcgatgtggatggtcttgatcccagctttacccctgccactggaactccagtggtcggcggacttacttatcgagaaggattgtacattaccgaagaaatctacaagactgggctcctgtctggattggatatcatggaagtgaacccttcgctgggtaagactccagaagaggtgacccgcaccgtcaacaccgcagttgcgattacgctggcctgtttcggcctcgctcgggaaggcaaccacaagcctattgattaccttaacccacctaag

SEQ ID NO: 6704 - DNA, 966 bp, Artificial Sequence
  Description of Artificial Sequence: Synthetic coding sequence
atgtcagctaaatcaagaactattggtattataggagctccatttagtaaaggacaaccaaggggtggagtggaggaaggaccaactgttttacgaaaggctggattattagaaaaattaaaagagcaagaatgtgatgttaaggattatggagatctaccattcgcagatattccaaatgattcaccatttcaaattgttaaaaatccaagatcagttggaaaagcatctgaacaattagcaggaaaggttgcagaagttaaaaagaacggaaggatttctcttgttttaggaggagatcatagtcttgcaattggtagtatttcaggacatgctagagttcatccagatttaggagttatttgggtagatgcacatacagatatcaacacacctttaaccactacatcaggaaatttgcatggacaacctgtatcatttttacttaaggaactaaaaggtaaaataccagatgttcctggattttcatgggttacgccttgtatcagtgcaaaagatattgtgtatattggtttaagagatgttgacccaggtgaacactacattcttaaaacattagggattaagtattttagtatgactgaggttgatagattaggtattgggaaggttatggaagaaactctttcctacttattaggacgtaaaaaaagaccaattcatttatcattcgatgttgacggacttgatccatcatttacaccagcaacaggaactccagtagttggaggacttacttatagagaaggattatacattactgaagaaatttataaaactggtttattatctggtttagatattatggaagtaaatcctagtcttggaaagacacctgaagaagttacaagaacagttaacacagctgttgcaattacattggcttgctttggacttgcaagggaaggtaatcataaacctattgattatcttaatccaccaaaa

SEQ ID NO: 6705 - DNA, 966 bp, Artificial Sequence
  Description of Artificial Sequence: Synthetic coding sequence
atgagcgcgaaaagccgcactatcggcatcattggggcaccattttccaaaggacagcccagggggggcgttgaggaaggccctacagtgttgcgaaaagccggattactggaaaagctcaaagaacaggaatgcgatgttaaggactatggcgatctgccattcgcggacatccccaatgacagcccctttcagatcgtgaaaaatccaagaagcgttggaaaagcctccgaacagctggctggaaaggtcgctgaggtgaagaaaaatggaaggattagtctggttctggggggagaccactccctcgcaatcgggtcaatctcagggcacgccagagtacatcctgatctcggcgttatctgggtcgacgcccacacagatattaacactcccctcactaccaccagcggcaacttacatggccaaccagtgagctttctgctgaaagaactcaagggcaagattcccgatgtgccagggttctcttgggtgaccccctgcatcagcgccaaagatattgtgtacattgggctgagagacgtggatcctggagagcactacattcttaagactctaggaatcaaatatttctcaatgactgaagtcgatagacttggcattgggaaagtaatggaggaaaccctgtcttatcttctgggccgaaaaaagcggcccatacatcttagctttgacgtggatgggctggacccatctttcaccccagcaaccgggacaccagtcgtgggcggcctaacctatcgtgaaggtctgtacatcactgaagagatttacaagacaggcctgctgtctggccttgacatcatggaagtgaatccctccctcggcaaaactcccgaggaggtgaccaggacggtcaatactgccgtggcaattacgctagcctgcttcggcctggcccgggaagggaaccataagccaatcgattatctgaatccacccaag

SEQ ID NO: 6706 - DNA, 966 bp, Artificial Sequence
  Description of Artificial Sequence: Synthetic coding sequence
atgagcgcaaaaagccggacaatcggcattatcggagcaccattttctaaaggacagcctcggggaggagtcgaggaaggcccaactgtgctccgaaaagccgggcttctggaaaagctgaaggagcaggagtgtgatgtgaaagattacggcgatttgccattcgccgacattcccaacgactcgccattccagatcgtgaaaaacccccggtccgtcgggaaagctagcgagcaacttgctggcaaggtagcagaggtgaagaagaatggccgtatcagtttggttctagggggagatcacagtctggccatcggctcgattagtggccatgctcgcgtgcacccagacctgggcgtcatttgggtggacgctcatactgacatcaataccccactaacaacaacatctggcaatctgcacggtcaacccgtgtccttccttctcaaagagctcaagggcaaaatccctgacgtgcccggcttttcctgggtcacgccgtgtattagtgcaaaagatatagtgtacatcggtttgcgcgacgtcgatcctggcgagcattacatcttgaagactctgggcatcaagtattttagcatgacggaggtagataggctcggaattgggaaagtcatggaggaaaccctgagctacctgttagggagaaagaaacggcctatccacctgtcctttgacgtcgacggcctggacccttctttcacacctgcaacaggtacaccggttgtcggcggactgacttaccgtgagggactctacatcaccgaagagatatacaaaacagggctcttgtccggattggatattatggaagtgaacccctccttgggcaaaacccccgaagaggttacgaggactgtgaataccgccgtagctatcacgttagcttgttttggattggctcgagagggaaatcataaaccaatagactatttaaaccctcctaaa

SEQ ID NO: 6707 - DNA, 966 bp, Artificial Sequence; identical to SEQ ID NO: 6686
  Description of Artificial Sequence: Synthetic coding sequence

SEQ ID NO: 6708 - DNA, 966 bp, Artificial Sequence
  Description of Artificial Sequence: Synthetic coding sequence
atgtcggctaagagtcggacgattggtattatcggcgcacccttttctaagggccagccgaggggaggtgtggaagaaggccccaccgttcttcgcaaggcgggcctccttgagaaactcaaggaacaagaatgcgacgtcaaagattacggtgatctccccttcgcggatatacccaacgactctcccttccaaatcgttaagaacccccggtctgtgggaaaggccagcgagcaacttgcggggaaggtcgctgaagtcaagaagaacggacgcatcagccttgtcctcggcggagatcattcattggctattggttcaatctctggacatgcacgggtgcaccctgacctaggagtgatatgggtggacgctcacactgatatcaacacgcctctcacaactaccagcggcaatttgcacggccagcccgtctccttcttgttaaaagagctgaagggcaaaattccagacgtccccggatttagttgggtaaccccttgcatatcagcgaaagacatagtttatattggcctccgagacgtggacccaggagaacactatatcctcaagaccctaggtattaagtacttctctatgacagaggttgaccggctgggcatcggtaaagtaatggaggaaacgctgtcttacctgctcggtagaaagaagcgccccatccatctttcctttgacgtcgatgggcttgacccttcattcactccggcgactggtacgcccgtagtcggaggattgacatacagagaagggctttacatcacagaagagatctataaaaccggcctgttgagcggattggatataatggaagtgaatccgagcctcgggaagaccccggaagaagtcacgaggacagttaatacggcagtcgcaatcaccctggcatgcttcggcctggcacgagagggtaatcataagcctattgactacttgaacccccctaag

SEQ ID NO: 6709 - DNA, 966 bp, Artificial Sequence
  Description of Artificial Sequence: Synthetic coding sequence
atgtcagcaaaatctcgtacaatagggatcatcggtgccccgttctcgaagggccagcctagaggcggcgtagaggaaggcccgactgttctcagaaaggcaggcctgctggaaaagttgaaagaacaagaatgcgacgtaaaagattacggggacctcccattcgctgacatacccaatgactctccattccagatcgtgaagaacccaaggagcgtgggaaaggcatccgagcagttggcgggtaaggttgcggaggtgaagaagaacggtcgcatttccttagtgctcgggggagatcactcccttgccatcggttctatctccggacatgcacgcgttcacccggaccttggcgtgatttgggtggatgctcacactgacataaacacccctttgacaaccacgtcgggaaacttacacgggcagcccgtctcttttctgctgaaggaattaaaaggaaagattccagatgtgcccggtttctcctgggtgacgccatgcatttcggcaaaggacatcgtgtatattggacttcgggacgtggatcccggtgaacattatatactgaagactctgggaatcaagtacttctcaatgaccgaagtggacagactcggaatcggtaaagtaatggaggaaacgctttcttacttgctgggccggaagaagcggcctatccacctctctttcgatgtcgacggcctggatcctagttttactcccgctactggtactcccgtcgtcggaggactgacttaccgagaaggcctgtacattaccgaggaaatatacaagactggcctactaagcgggttggatatcatggaggttaatccatccctgggtaaaacacctgaagaagttacgcgaaccgtgaacactgccgtggctatcacactcgcttgtttcggattggcacgggagggtaatcacaagcctatagactacctgaatcctccaaag

SEQ ID NO: 6710 - DNA, 966 bp, Artificial Sequence
  Description of Artificial Sequence: Synthetic coding sequence
atgtccgcaaagtctaggacaattgggataatcggtgcaccttttagcaagggccaaccaaggggcggcgtggaagagggacctactgtactgaggaaagcagggctgctcgagaaactgaaagagcaggagtgtgatgtgaaggactacggagacctgccttttgccgatatccccaacgactcgccttttcaaattgtcaaaaaccctagaagcgtgggcaaggcatctgagcagttggcaggaaaagtcgccgaggtaaaaaagaacggaaggatatcccttgttcttggtggagaccactcgctcgccatcggttccatctccgggcacgctagggtgcatcctgatctgggggttatctgggtggacgctcatacggatatcaatacacccctgaccactactagcggtaatttgcacggccagcccgtgtcattcttgctgaaggagctcaagggcaagatacctgatgttcctggcttttcctgggttacaccctgtatcagtgcgaaagatatcgtttacatcgggctcagggacgttgatccaggggaacattacattcttaaaactttagggatcaaatacttttcaatgaccgaggtggacagacttggcatcggcaaagtaatggaagaaacactgtcttatcttcttggaaggaaaaagcgtcctatccacctctcctttgatgtcgacggcctggacccaagtttcacacctgcgaccggaacccctgtggttggaggcctgacttaccgtgagggcctatatattacggaagaaatctacaagaccggcctgttgagcggactcgacattatggaagtcaaccccagtctggggaagactccagaggaggtaacacgcactgttaataccgccgtagcaattactctcgcctgctttgggctggcccgcgaaggaaaccacaagccaatcgactatctgaatccaccaaaa

SEQ ID NO: 6711 - DNA, 966 bp, Artificial Sequence
  Description of Artificial Sequence: Synthetic coding sequence
atgtcagcaaagtccaggaccatcgggatcattggagcgccctttagcaagggacagcctagaggaggcgtggaggaaggacctactgtgctgagaaaggcagggctgctggagaagctgaaggaacaagaatgtgatgtgaaggactacggcgacctgccattcgccgatatccccaatgactcacctttccaaattgtgaagaaccccaggtctgtcggtaaagcttcagaacaactcgccggtaaggtggcggaggtaaagaaaaacggtagaatttcgctagttttaggcggcgaccactccctggcaattggctctatcagcggccatgccagggtgcacccagacctcggcgtcatatgggtagacgcccacaccgacattaacacacccctgaccactacttctggcaacttacacgggcagccagtgtccttcctcttgaaagagcttaaaggcaagatacctgacgtgccaggatttagttgggtcaccccttgtatttctgctaaggacattgtgtacattggtctgcgggacgtggaccccggcgaacactacattctgaagactctgggcatcaagtacttttctatgactgaggtcgatcgacttggcatcgggaaagttatggaggagactctatcataccttctcggcagaaagaaaaggcccatacacttgagttttgacgttgacggactggatccttctttcacacctgccacgggtacacctgttgtgggaggtcttacataccgcgaaggactctatattaccgaggagatttacaagaccggtctcctctccggcctcgacatcatggaggttaacccttcgctgggaaagactcccgaggaagtgacccggacagttaacaccgccgtcgcgatcactctcgcgtgctttggacttgctcgcgaaggaaatcataagcccattgattacctgaatcctccaaag

SEQ ID NO: 6712 - DNA, 966 bp, Artificial Sequence
  Description of Artificial Sequence: Synthetic coding sequence
atgagtgccaagagcaggaccattggaattatcggggccccattctcaaaggggcagcctcggggcggagttgaggaaggacccaccgtgctgcggaaagctggcctgttggaaaaactgaaagagcaggaatgcgatgtgaaggattatggcgatctccccttcgccgacatacccaacgattcaccgtttcaaattgtcaagaaccctcgctcagtcgggaaggctagtgaacagctcgcaggcaaggtggcagaagtcaaaaagaatgggaggatatctctggtcttgggcggggaccattcactcgctatcggatctatatctggtcatgctagagtgcacccggacctgggcgtgatatgggtggatgctcacaccgacatcaatactccactgacaaccaccagcggtaatctgcatggccagccagtgagttttttacttaaggaactcaaaggcaaaatccccgacgtgcccggtttttcttgggtaaccccctgcatcagcgccaaagatatagtgtatatcgggctgcgagatgtggatcccggggaacattatatcctcaaaaccctgggcatcaagtatttctcaatgactgaggtagaccgtctgggcattggtaaggtcatggaagagacactgtcttacttgctgggccggaagaagagacccattcatctctcatttgacgtcgacgggctagacccttcatttacccccgccacaggaacccccgtggtgggagggcttacgtacagagaaggcctgtacataaccgaggaaatctacaaaaccggactgcttagtggtctagatatcatggaggttaacccatccttgggaaaaacccccgaagaggtgactcggaccgtgaatacagctgtggccatcacgctggcttgtttcgggctggcccgggaaggaaatcataagcccatcgactatctaaatccccccaag

SEQ ID NO: 6713 - DNA, 966 bp, Artificial Sequence
  Description of Artificial Sequence: Synthetic coding sequence
atgtccgccaagtcccgcactattgggatcatcggtgctccattctcaaagggacagcccagaggaggagtggaggaggggccaaccgtccttcgtaaagcgggcctgttggagaaactgaaggaacaggaatgcgatgtgaaggactacggggacctccctttcgccgatatcccgaacgacagcccgtttcagatcgtgaagaatccccggtcggtgggaaaggcatcggagcagcttgcggggaaggtcgccgaggtgaaaaagaatggacggatctcactggtcttgggcggtgaccattctctcgccatcggatcgatctcaggacacgcacgggtccatcctgatctgggagtgatctgggtggacgcgcataccgacatcaacaccccattgaccaccacctctggaaatctgcatggccaaccggtgtcgttcctcctgaaggaactcaaggggaaaatcccggatgtgccggggttctcgtgggtgacgccgtgcatctcagcaaaggatatcgtgtacatcggactgcgcgacgtggaccctggagaacactacatcctgaaaactctcgggatcaagtacttcagcatgaccgaggtcgaccggcttggaatcggtaaggtcatggaggaaactctgagttacctgctcggccgcaaaaagcgcccaatccatctgtcgtttgatgtggatggattggacccgtccttcacccccgcgaccggaacgccggtcgtcggcggcctgacgtacagggaaggactgtacatcaccgaagagatctacaagactggcctcctctcggggctggatatcatggaagtgaacccgtcgctgggtaagacccccgaggaggtcactcggactgtgaatactgccgtggccataactctggcttgcttcggactggcacgggaagggaatcacaagccgatagactacctgaacccgccaaaa

SEQ ID NO: 6714 - DNA, 966 bp, Artificial Sequence
  Description of Artificial Sequence: Synthetic coding sequence
atgtccgccaaatctaggacaattggaataattggggcccctttttctaaaggtcagccgcgggggggagttgaggaggggccaactgtcctgaggaaggcaggcctgctggaaaagttgaaggagcaggaatgtgatgttaaagattacggggacttgccctttgcggacataccgaatgactctcctttccagattgtgaagaatcctaggagtgtgggaaaggcatccgaacaactagctgggaaagtggcagaagttaagaagaatggacgcatctctctcgttctggggggagatcattcattggccatcggatccatttccggccatgcgagagttcatccagacctcggagtcatatgggttgacgcccataccgatatcaatactcctctgacaactacctccggcaatttgcatggacaacctgtctcttttctgctgaaggaattgaaaggaaagatcccagacgtgcctggattctcttgggtgaccccctgcatttcagccaaggatattgtgtacatcgggctacgcgacgtggacccgggagagcattatatcctgaaaacactgggaatcaaatacttcagcatgacggaggtagatcggcttggcatagggaaagttatggaagagacgctgtcatatttgctggggcggaagaagagaccaattcacctgtctttcgacgtggatggcttggacccatcttttacccccgcgacaggaacacccgtggtaggggggctgacttatcgtgaaggcctctacatcactgaggaaatttacaaaaccggtctcctctcagggctggatatcatggaagttaacccttctctgggtaagactcctgaggaagtcaccagaaccgtcaacacagcagtggctattactcttgcttgtttcgggctggctcgagaagggaaccacaaacctatcgactatctcaaccctccaaag

SEQ ID NO: 6715 - DNA, 966 bp, Artificial Sequence
  Description of Artificial Sequence: Synthetic coding sequence
atgagtgccaagagcaggactataggcattatcggagcccctttcagtaagggacagcccagaggaggcgttgaagagggtcctactgtgctcaggaaggcgggcctgttggaaaaactgaaggagcaggaatgcgacgttaaggactatggagatcttccatttgccgacatacctaacgacagtccgttccagatcgtgaagaacccccgctctgtgggcaaggctagtgaacaattggcaggaaaggtcgctgaagtcaagaagaacggtaggatctctctcgtgctgggtggagaccactctctggccattggttcaatatctggccacgcaagagtccaccccgacctgggcgtcatctgggttgatgcccacactgacataaatacgccactgaccacgacctccggtaatctgcacggacagcctgtttctttcctgctgaaggagctgaagggtaagatacctgatgtgccaggcttcagctgggtgactccctgcatatccgctaaagacatcgtctacatcggcctgagggatgttgatcctggagaacactacatcttgaaaacactgggcatcaagtacttctctatgacagaagttgatcgcctgggcatcggtaaggtaatggaggagactctcagctatttgctcggacgcaagaaaaggccaatacacctgagcttcgacgtggacggtctcgatccttcattcacaccggccaccggaactcccgttgtaggtggtctcacgtacagagagggcctgtacatcactgaagagatctacaagacaggactcttgtccggtctggacattatggaagtgaatccgtcactgggcaagaccccggaggaagtgaccaggaccgtgaataccgctgtggctattacccttgcgtgcttcggactggcaagggagggcaatcacaagcccatcgactacctgaaccccccaaag

SEQ ID NO: 6716 - DNA, 966 bp, Artificial Sequence
  Description of Artificial Sequence: Synthetic coding sequence
atgtctgcgaagtcgcgcaccattggtatcattggcgcacctttttcaaagggtcaacctcgaggtggtgttgaagaaggtcccactgttctgcggaaggctggccttctcgaaaaacttaaagagcaggaatgcgacgtgaaggactacggtgatctcccatttgccgacattcctaatgattcgccctttcaaatcgtgaaaaatccgcgatcagtgggtaaggcctccgaacagcttgcaggcaaggtggcggaagtcaagaagaacgggcgcatctcccttgtgctgggcggagatcattcgctcgctattggttcaatctctggtcatgcccgagtgcatcctgacctgggagttatatgggtagatgcccatacggacattaacactcctcttaccactacttcggggaatctccacggacaaccggtgagctttctcttgaaggaactcaagggaaagatacccgatgtgccaggattttcctgggtcactccctgtatctcggccaaggacattgtctatatcggactcagagacgtcgatcctggggaacactacattcttaagactctgggtatcaaatacttttccatgactgaggtggatagattgggaattggaaaagtcatggaagaaactctttcgtatctgctcggcagaaagaaaaggccgatccacttgtccttcgacgtggatgggctggatccttcatttactccagcaactggaaccccagtggtgggcggtctgacctaccgcgaagggctttacattaccgaggagatctacaagacgggactcctctctggcctcgacattatggaagtcaacccttccctcggaaagaccccagaggaggtgaccagaaccgtgaacactgccgtggcaataactctggcttgttttggactcgcaagagagggaaaccataaacctatcgattacctgaacccaccaaag

SEQ ID NO: 6717 - DNA, 966 bp, Artificial Sequence
  Description of Artificial Sequence: Synthetic coding sequence
atgagcgctaagtcccgtaccattggaatcattggtgctcccttctcgaagggccaaccccgtggtggcgtcgaagaaggacccaccgtgttgcgaaaggccggcttgctggagaagctgaaggagcaggagtgcgacgtgaaggactacggtgacctgccattcgctgacatcccaaatgacagtccatttcagatcgtcaagaaccctcgtagcgtgggtaaagccagcgagcagctggccggcaaagtggctgaggtcaagaagaacggtcggatctcgctcgtgctcggcggtgaccacagcctggcgattggatcaattagcggccacgcccgggttcaccctgatcttggcgtgatttgggtggacgctcacacggatatcaatactcccctgacgactaccagcggcaacctgcatggacagcccgtgtcctttcttttgaaggaactcaagggtaagatccccgacgtacctggtttctcttgggtaaccccttgtatctctgccaaggatatcgtgtatattggcctcagagatgtcgatcctggtgagcactacattctcaagaccctcggaataaagtacttctccatgaccgaggtcgataggttgggcatcggtaaagtcatggaggagacactctcgtacctgctgggcaggaagaagaggcccattcacctcagctttgacgtcgacggtctggacccgtcttttacccccgcgacgggcaccccagtggtcggcggtcttacttaccgggagggcctgtacattaccgaagagatctacaaaaccggactgctgagtggcttggacatcatggaggtgaacccctctcttggtaagactcccgaggaggtcacgcgcaccgtcaacaccgcagttgcgatcaccttggcctgcttcggacttgcacgcgagggcaaccacaagcctattgactatctcaaccctcccaag

SEQ ID NO: 6718 - DNA, 966 bp, Artificial Sequence
  Description of Artificial Sequence: Synthetic coding sequence
atgagcgccaagtcccggacgatcgggattattggggcccctttctctaaagggcagccacggggcggcgtggaggaagggccaactgttctgcggaaggcgggcttgctcgaaaaactcaaggaacaggaatgtgatgtgaaagattacggagatcttccgtttgctgacatccctaacgatagtccgtttcaaatcgtcaaaaacccccggtctgtaggcaaggcatccgaacagctagccggcaaagtggccgaggtgaagaagaacggtaggatatctctggtgctcggaggagaccactctttggcaatcggcagtatcagcgggcatgcacgggtgcatcctgacctgggcgtgatctgggtggacgcccacactgatatcaatacccctcttactaccaccagcgggaacctccacgggcagcccgtcagcttcctgctgaaagaactgaaaggaaaaattcccgatgtgcccggcttctcatgggtcacaccctgtatttctgccaaagatatcgtgtatatcggcctgagggatgtggacccaggtgagcactatatactaaagactcttggtattaagtatttctcaatgaccgaggtcgataggttaggcattgggaaagtgatggaggagacgttaagctacctgctggggcgaaagaagcggcctatacaccttagtttcgacgtcgacggtctggacccctcctttactcccgcgacgggtacccccgtagtgggtggcctgacctaccgagaaggattgtacattaccgaggaaatttacaagaccggactgctgtctggcctggacataatggaggtcaaccctagcctgggaaaaacccctgaggaggtcacgaggacagtgaacactgcagtggccatcaccctggcctgcttcggactggccagggagggaaaccataagcctattgactacctgaatccccctaag

SEQ ID NO: 6719 - DNA, 966 bp, Artificial Sequence
  Description of Artificial Sequence: Synthetic coding sequence
atgtccgccaagtcgcgcactatcggcatcatcggagccccgttctcgaagggccagccacgcggaggggtagaagagggtcccaccgtccttcgcaaggcagggcttttggagaagctgaaagaacaagaatgtgacgtgaaagattacggagatcttccatttgcggacatccccaacgattcgccttttcagatcgttaagaacccgagatccgtgggcaaggcatcggaacagctcgctggcaaggtggcggaggtgaagaagaacggacgaatcagcctggtgctcggtggagatcacagcctggccatcggtagcatctcggggcacgctagagtccaccccgacctgggagtgatctgggtggacgctcatactgatatcaatacccctctcaccactaccagcggaaatctgcacggacaaccagtgtcattcttgctcaaggaactcaaaggaaaaatcccggacgtgccgggattctcctgggtaactccgtgcatatccgcaaaggatattgtgtatatcggactgcgcgacgtcgatcctggagaacattacattttgaaaaccctcgggatcaaatactttagcatgaccgaggttgataggctgggcattggaaaggtcatggaagagactctcagttacttgctggggagaaagaaaaggccgatccatctgtcgttcgacgtcgacggtctggacccttcgttcactcctgcgaccggaactccggtcgtgggtggccttacctacagagaaggtctttacattactgaggagatctacaagacgggcctgctgagcggactcgatatcatggaggtgaaccccagtctgggcaaaactccagaagaagtgacgagaaccgtgaataccgccgtggcaatcaccctggcatgcttcggtctggctcgcgaggggaaccacaagccaatcgactacctgaaccctccaaag

SEQ ID NO: 6720 - DNA, 966 bp, Artificial Sequence
  Description of Artificial Sequence: Synthetic coding sequence
atgtctgccaagagccgcacaatcgggataatcggcgctccattctctaaaggccagcctcgcggcggtgttgaagaaggcccaacagttcttcggaaggcgggcttactggaaaaattaaaggagcaggagtgcgacgtaaaagactatggcgacctgccgtttgcggatatccctaatgatagccccttccaaattgtcaagaaccccagaagcgtaggcaaggccagtgagcagctggcagggaaagtagcagaagtcaaaaagaatggacgcatatctctcgtattggggggtgatcattcattagctatcgggtctattagcggccatgctagagtgcaccctgacctgggcgtgatctgggtcgacgcccatactgatataaataccccactgactacgaccagtggaaatctgcacgggcagccagtttctttcctgcttaaagagctgaaaggcaagatcccggatgtgcccggtttcagttgggtcacgccctgtatttcggccaaggacatcgtatatattggcctacgggatgtcgacccgggagagcactatatcctcaagaccttgggaatcaagtatttctctatgaccgaagtggatcgactcggaattggaaaggttatggaagaaaccctgtcttacctactggggcggaagaagcggcccattcatctctccttcgatgtggatgggctggaccccagcttcacgccagcgacaggaacccctgtcgtaggaggcctgacctatcgtgagggcctttacatcaccgaggaaatttataagactggcctgctttcaggactggacattatggaggtgaacccaagtctcggcaagacaccagaagaggtgactaggacagtaaacacggcagtcgctattacactcgcttgtttcggattggcccgggaggggaatcataaacccatcgactaccttaaccctcccaag

SEQ ID NO: 6721 - DNA, 966 bp, Artificial Sequence
  Description of Artificial Sequence: Synthetic coding sequence
atgagtgccaagtcacggactatcggtattataggcgcacctttttccaagggccaaccaaggggcggcgtggaagaggggcctacagtgttacgtaaggctggcctgctggagaaacttaaggagcaggaatgcgatgtcaaagactacggcgacctgccttttgctgatattcctaacgattctcctttccagattgttaagaatcctcgctccgtgggcaaagcaagtgagcaactggccggcaaagtggccgaggtgaaaaagaatggccgtatttcactggtgctgggcggagaccatagcctagctattggctcaatttctggccacgcccgcgtgcatccagatttgggagtgatctgggtcgatgctcatacagacatcaacacacccttaaccaccaccagcgggaacctgcacggacaacctgtttcttttctcctgaaggagctcaagggtaagatccctgacgtgccagggtttagttgggtcaccccttgcatctctgccaaagacattgtttatatcggcctgagggatgtggacccaggggaacattacatactgaagacccttggaatcaagtacttctctatgaccgaagtggaccgtctgggcataggtaaagtcatggaggagactctgagctacttgctaggaaggaagaagagacctatacacctgagcttcgatgtcgatggcctggacccaagttttacccccgccaccgggactccagtggttggcggacttacatatagggagggtctatacattaccgaggaaatctataaaacaggactgctgtctggattagacattatggaagttaacccatctctcgggaagaccccagaagaagtgacccggacagttaacaccgctgtggctattaccctagcttgtttcggcctggcccgggaaggcaatcacaagcctatcgattatctaaatccccctaaa

SEQ ID NO: 6722 - DNA, 966 bp, Artificial Sequence
  Description of Artificial Sequence: Synthetic coding sequence
atgtcagccaaaagccgcaccatcggtattatcggggctccgttttcaaagggccaacctagggggggtgtggaggagggacctaccgtgctccggaaggccggattactagagaagcttaaagagcaagaatgtgatgtgaaagactatggtgatctgccatttgctgacatacctaacgacagcccgttccagattgtgaaaaacccaaggtcggtcggtaaagcgagtgagcaacttgccggcaaggtggccgaggtcaaaaagaacggacggatatctctcgtcctcggcggggatcactcgctggcaatcggctcaatctctgggcatgctagagtgcatcccgatctcggtgtaatctgggtcgacgcccatacagacattaacacgccattgactacgacttcgggtaatctccatggtcagcctgtgtctttcttgcttaaggaactaaagggcaaaattcccgacgtccctggattttcctgggtaactccatgcattagtgccaaggacatagtgtatatcggccttcgggatgtagaccctggagaacactacattctcaaaacactgggcataaagtactttagcatgactgaggtcgatagactcggaataggaaaagtgatggaggagaccctctcctatctcctgggtcgcaagaaacggcctattcacctgtcttttgacgttgacggtttagatccgtcctttacaccagcaacaggaaccccagtagttgggggactgacttaccgggaggggctttacattacagaggaaatctataagacaggcttgttgtccgggctggatatcatggaggttaatccctctcttggcaaaacacccgaggaggtcacgagaaccgtcaataccgccgtggctatcaccctagcctgcttcggtctggcccgggagggtaaccataaacctatcgactatctaaaccccccaaaa

SEQ ID NO: 6723 - DNA, 966 bp, Artificial Sequence
  Description of Artificial Sequence: Synthetic coding sequence
atgtccgctaaatcacgtaccattggcataatcggggctcctttttccaagggccagcctagaggcggtgtggaagagggacccacggtgttgcgtaaggccggactgctggagaaattgaaggagcaggagtgtgacgtgaaagattacggggacttgcccttcgcggacatcccaaacgacagcccgtttcaaatcgtgaaaaatcctaggtccgtggggaaagccagcgagcagcttgctggtaaagttgccgaggtaaagaaaaatggacgtatcagcctggtgctcggaggcgatcattctttggctattggctctatttcaggtcatgcacgagttcatccggatcttggcgttatctgggtggacgctcacacggatattaacacacccctgactacgaccagcggtaacctgcatggacaacctgtgtcatttctcttgaaagaattgaagggtaaaataccagacgtaccagggtttagctgggtcaccccatgtatctccgcaaaggacatcgtttacattggcctccgggacgtagatccaggtgagcactacattctgaagacacttggaataaagtactttagtatgacggaagtggacaggctcgggatcggaaaggttatggaggaaaccctgtcgtacctcctggggaggaaaaagcgccctattcacctgtcattcgacgtggacggcctggatccaagctttactcctgcaacagggacacctgtggttgggggattgacttatagggagggtctatatattaccgaggaaatctacaaaaccggcctgctcagtgggctggacattatggaagttaaccccagtttgggcaagactcctgaagaggttactagaaccgtcaacacggcggtggccattacacttgcctgctttggattggcacgggagggcaatcacaaacccatcgactatctcaatccacccaag

SEQ ID NO: 6724 - DNA, 966 bp, Artificial Sequence
  Description of Artificial Sequence: Synthetic coding sequence
atgagtgcaaagagccgtacaattggtataattggcgcccccttttcgaaaggacagccccgtggcggagttgaagagggaccaactgtgttacgaaaagccggcctacttgagaagctcaaagagcaggagtgcgatgtcaaggattacggagacttgcccttcgccgatattccgaacgactccccctttcaaatagtcaaaaacccgaggtctgtgggaaaggcttcggaacagctggccggaaaggtggccgaagtgaagaagaacggccgtatctctcttgtgttaggaggcgaccactcgttggccattggcagcatctcgggtcacgcccgtgtacatccagatttgggagtcatttgggttgatgcacatacagacataaatacaccgctaaccaccacctcgggcaaccttcacggccagccagtctcctttctcttgaaggagcttaaaggcaagatccccgacgtgccaggcttttcctgggtgaccccatgtatttccgccaaggatattgtgtacatcggtctgagagacgtggaccctggcgagcattacatcctgaagacgctgggcattaagtattttagcatgacggaagttgaccggttgggtatcggaaaggtgatggaggagacgctttcctacctcctgggccggaaaaagcggccaatccatctaagctttgatgtagatggcctggacccctccttcacaccggccacgggcactcccgttgtgggcggtctcacttatcgtgaaggcctttatataacggaggagatttacaaaacagggctcttatcgggtctggatatcatggaagtgaatccatcactgggcaagacgcccgaggaagtgactcggactgtgaacaccgccgtggccataacgttggcctgtttcggactggcccgcgaaggaaaccacaagcccatcgactatctaaatccaccgaaa

SEQ ID NO: 6725 - DNA, 966 bp, Artificial Sequence
  Description of Artificial Sequence: Synthetic coding sequence
atgtcggccaagtcaaggactatcggcatcatcggtgcgccgttctcaaagggacagcctaggggaggcgtggaagaagggcctaccgtcctgcggaaggcaggccttcttgaaaagctgaaagaacaagagtgcgatgtcaaggactacggcgacctgccgtttgcggacattcctaacgactcgccgttccaaatcgtgaagaacccgcggagcgtggggaaggcatcggagcagctggctggaaaggtggcagaggtgaagaagaacggacggatctccctggtgctgggcggcgaccattccttggccatcggctcaatcagcggacacgcccgcgtgcatcccgacctgggggtcatttgggtagatgcgcacaccgacatcaacactccgcttaccacgacttccggtaacctccatggacagccggtgtcgttcctcctcaaggagctcaaaggcaagattccggatgtgccgggcttctcttgggtcactccgtgcatctcagccaaagacatcgtgtacataggactgcgagatgtcgaccctggggaacactacatcctgaaaacgttgggtatcaagtatttcagcatgactgaggtggataggctcggaatcggaaaagtgatggaggaaaccctttcatacctgctgggtcggaagaagcgtccaatacacctgtcgttcgatgtggacggcctggatccgtcctttacccctgccactggaaccccagtggtgggcggactcacctaccgggaaggactctacatcacggaggaaatctacaagaccggcttgcttagcggcttggatatcatggaagtgaatccgtccctgggaaaaaccccagaggaagtcacgcgcaccgttaataccgccgtggccatcactcttgcttgctttggccttgcgcgagaaggcaatcataagccgatcgactacctgaacccaccgaaa

SEQ ID NO: 6726 - DNA, 966 bp, Artificial Sequence
  Description of Artificial Sequence: Synthetic coding sequence
atgtcagccaaatccagaactatcggtatcattggagcgcctttttccaaggggcagccccgtggaggagtggaagagggacctactgtgttgcgcaaagctggcctgctggagaaactaaaagagcaggaatgtgatgtgaaagactacggagaccttccatttgcagatatccccaacgactcaccttttcaaattgtaaaaaaccctcggagcgtcggtaaagcaagcgagcaattggctgggaaggttgccgaggtcaagaaaaatgggcgcatctctctagtgctggggggagaccattccctagcaattggctctattagcggacacgcaagagtgcatccagatctgggggtgatctgggttgacgcccataccgatatcaacactcccctgacgaccacgagtggaaacctgcacggacagccggtgtctttcttacttaaggagttgaagggcaaaattcccgacgtcccaggattttcctgggtcactccttgcatctccgctaaggacatagtttacatcggcctcagggacgtggatccgggtgaacactatattctcaagacgctcgggatcaagtacttcagcatgaccgaagtcgaccggctcgggatcggaaaggtcatggaagaaaccctgagctacctactcggccgcaagaaaagaccaatccacctgtcctttgatgtcgatgggctggaccccagctttacacccgcgacaggcacaccagtagtaggcggcctcacctatcgcgagggcctgtatattacggaagaaatttacaagacgggtctcctgagcggattagatatcatggaggtgaatccctcattaggaaagacacctgaagaggttactaggaccgttaataccgcagtagcaattacgctggcttgcttcggactcgctagggaagggaaccataagcctattgattacctaaaccccccaaag

SEQ ID NO: 6727 - DNA, 966 bp, Artificial Sequence
  Description of Artificial Sequence: Synthetic coding sequence
atgagcgctaagagccgaacgattggcatcattggtgcaccttttagcaaggggcagccgcgcggaggtgtcgaagagggcccaacagtgttacgaaaagcaggactacttgagaaactgaaagaacaggagtgtgatgtaaaggactacggcgacctaccgtttgcagacatcccaaatgattcgccctttcagatagtgaaaaatccccgctcggtgggaaaagcttctgagcagctggctggaaaggtggcagaagtcaaaaagaacgggaggatctccctggtgctcggaggggatcatagtctggcgattggttccatttcagggcacgcccgcgtgcaccccgaccttggcgtcatctgggtcgacgcccacacggatataaatacacccctgacaactacatctgggaacctgcacggacagcctgtgtccttcctcctgaaggagctgaaaggaaaaattccagacgtgcccggattttcttgggtcaccccttgtatctccgccaaagacattgtctacatcggtctgagagacgtggatcctggagagcactacatcctgaagacactaggcatcaaatactttagtatgactgaggttgaccggctgggtataggaaaggtgatggaggagactctgtcatatttgctcggtaggaagaaaaggcccatccacctatcattcgatgttgatggacttgatccaagcttcaccccggccaccgggactccagttgttggcggactaacgtatcgtgaaggcctttatataacagaggaaatctataagactggactcctgtctggcttggacataatggaggtcaaccctagcctgggaaagacacctgaagaagtgacacggaccgtcaacaccgccgtggcaattacactggcatgcttcggtttggccagggagggaaatcacaagcccattgattatcttaatccacctaaa

SEQ ID NO: 6728 - DNA, 966 bp, Artificial Sequence
  Description of Artificial Sequence: Synthetic coding sequence
atgtctgcaaagagtcgaactatcggcattatcggggcgcctttctctaaggggcagcccagggggggggtggaagaggggcctactgtgttgcggaaagctggcctgcttgaaaaactgaaagagcaagaatgcgacgtgaaggactatggcgacctcccattcgccgacatcccgaatgatagcccatttcagatcgtgaaaaatcccagatcagtgggcaaagcatctgagcaactcgcagggaaagtggcggaggtgaagaagaatggaaggattagtttagttctggggggtgaccatagtctggcgattgggagtatatctggacacgcgagagtgcaccccgacctcggcgtcatctgggtagatgcacacaccgacattaacactccacttaccaccaccagtggcaatctgcacggacagcctgtctcgtttctgttgaaggaacttaagggtaagatcccggatgtcccgggattcagctgggtgacaccttgtattagtgcgaaggacattgtgtacatcggtctgagggacgtggatcccggggagcattatattctgaaaacactagggatcaaatacttcagtatgacagaagttgacaggctgggcatcgggaaagttatggaggagacactcagctatttgctgggccgaaaaaaacgaccgattcacctcagcttcgacgtggacggtttggacccctcatttactccggccaccggaaccccagtcgtgggaggcttgacttaccgtgagggtctatatattactgaagagatttacaagacaggactgttgtccgggctggacattatggaagtgaacccaagcttagggaagacgccggaagaagtaacaaggacagtgaacacagccgtggcaataacattggcctgtttcggtctggcgagggagggcaatcacaagcctatagactacttgaaccccccaaaa

SEQ ID NO: 6729 - DNA, 966 bp, Artificial Sequence
  Description of Artificial Sequence: Synthetic coding sequence
atgagcgctaagtcgcgcaccatcgggatcataggggccccatttagcaaaggacagccgagaggaggtgtggaggaaggaccaactgtgctgcggaaggctggactccttgagaagctcaaggaacaggagtgcgatgtcaaagactacggggacctgccctttgctgacatcccgaacgattcaccgttccaaatcgtgaagaacccgagatctgtcgggaaggcgtccgagcaacttgcgggcaaggtggctgaagtgaagaagaacgggaggatttctttggtcctcggaggtgatcactccctcgcgatcggaagcatcagcggtcatgctcgggtgcaccctgatctgggggtgatctgggttgatgcgcatacggatatcaatactccacttacgaccacgtccggcaacctccatggccagcccgtctccttcctgctcaaagaactgaagggaaaaatcccggatgtgccgggattctcatgggtgaccccatgcatcagcgccaaggatatcgtgtacatcggccttcgggacgtggatccgggagaacactacatcctgaaaaccctgggcatcaaatacttctcgatgacggaagtggaccgcctgggaatcggcaaggtgatggaggagactctctcctacctcttgggtcgcaagaagcggcctatccacctctccttcgacgtggacggcctcgacccgagcttcactcccgcaactggaactcctgtcgtgggaggcctgacttaccgggaaggtctgtacattaccgaagagatttacaaaactgggctgctgagcggactcgacatcatggaggttaatccgtctctgggcaagaccccggaagaagtgactcggacggtgaacactgcagtcgctatcaccctggcatgcttcgggctggcacgggagggaaaccacaaaccaatcgattacctcaaccctccgaag

SEQ ID NO: 6730 - DNA, 966 bp, Artificial Sequence
  Description of Artificial Sequence: Synthetic coding sequence
atgagcgccaagtcccgcacgatcggaatcatcggagcccctttctctaaaggccagccgcgcgggggtgtggaggaaggaccaaccgtgctgagaaaagctggtctgctcgaaaagctcaaggagcaggagtgcgatgtgaaggactatggtgacctgccgttcgccgacattccaaatgattccccatttcaaatcgttaagaaccctcgctcagtgggaaaagctagcgagcaactggccggcaaagtggcggaggtcaagaaaaacggacgcatctcgctcgtcctgggaggtgatcattccctggcgatcggctcaatatcgggacatgcgagagtccacccggaccttggcgtgatctgggttgatgcccacactgacattaacaccccgttgactaccacctcgggcaacctgcatgggcagcctgtttccttcctcctgaaagaactgaaaggtaagattccagacgtgcccggcttcagctgggtgaccccttgcatttcggcgaaggatatcgtgtacatcggactccgggatgtggacccgggcgagcactatatcctgaaaactttggggattaagtatttctcaatgacggaggtggaccggctcgggatcgggaaggtgatggaagaaaccctcagctatctgctgggacgtaagaagcgcccgattcacctctcgtttgacgtggacgggctggacccatccttcactccggctaccggaaccccggtagtcggagggctcacctaccgggaagggctctacatcactgaggagatttacaagactgggctcttgagcggactggatatcatggaggtgaacccgtccctgggcaaaaccccagaggaagtcacgcggacggtcaacaccgccgtggccattactctggcatgtttcggactggcacgggaaggaaatcataagcctattgattacctcaatccgccgaag

SEQ ID NO: 6731 - DNA, 966 bp, Artificial Sequence
  Description of Artificial Sequence: Synthetic coding sequence
atgagcgcgaagtcccgcactatcggtatcatcggcgctccattcagcaagggccaacctcgcggaggcgtcgaagagggaccgaccgtcctgcgaaaggccggcctcctggaaaagctgaaggagcaagaatgcgacgtcaaggactacggtgacctgccgttcgcggacataccgaacgattcgccattccagatcgtgaagaacccccggtccgtcggaaaggcatcggagcagttggcgggaaaagtggccgaggttaagaaaaacggacggatctcactcgtgctcggaggggaccactccctcgctatcggatccatcagcggacacgcccgggtgcaccccgatctcggagtgatttgggtcgacgcacataccgatatcaacaccccactcaccaccacctccggaaatctgcacggtcagccagtgtcgtttcttctgaaggaactgaagggaaagatcccggatgtccccggctttagctgggtgaccccatgcatttccgcaaaggacatcgtgtacatcggactgcgggatgtggatcctggggagcactatatcctgaaaactctggggatcaagtacttctcgatgactgaagtggaccggttgggaatcggaaaggtcatggaggagactctgtcgtatctcttgggaaggaagaagcggccaatccacttgtccttcgatgttgatggtctggatccttcattcactcctgcaactgggactccagtggtgggagggcttacttaccgggagggattgtacatcaccgaagagatatacaagaccggactccttagcggcctggacatcatggaagtgaacccgagcctgggtaaaactccagaggaagtgaccaggactgtcaataccgccgtggccatcactctggcctgctttggtctggcccgggagggcaaccataagccgatcgactacctgaatccaccgaag

SEQ ID NO: 6732 - DNA, 966 bp, Artificial Sequence
  Description of Artificial Sequence: Synthetic coding sequence
atgtctgcaaagagcaggacaatcggaattattggagcccccttctccaagggccagcctcgcggtggcgtcgaagaaggccctactgtgcttaggaaggctggcctgcttgagaagctcaaggagcaagagtgcgatgtcaaagattacggcgatctcccattcgccgacatccccaacgacagtcctttccagattgtaaagaatcctaggagcgtgggaaaggcctctgagcaactggcaggaaaggtggctgaggttaagaagaacggcaggatttctcttgttctcggtggtgaccacagcctggctatcggaagtatctccggacatgccagggttcacccagacctgggagttatctgggtcgatgcacacacggacatcaatacaccactcaccaccacctccgggaaccttcacggccaaccagtatccttcttgctgaaggaactcaagggcaagattcctgatgtaccaggcttcagctgggtaaccccatgtatctctgcaaaggatattgtgtatatcggtctgcgcgatgtggacccgggcgaacattacatccttaagactctggggatcaagtacttttcaatgacagaggtggaccgcctgggcatcggtaaggtgatggaggagacgctgtcatatctgctcgggagaaagaagcgaccaattcatctttcttttgatgtcgacggtttggacccaagtttcactccggccacggggactcccgttgtgggaggtctgacatacagagaggggctctatatcactgaggagatctataagacaggccttctttccggcctcgacattatggaggtcaaccccagtctcggaaagactcctgaagaagtgaccaggactgtcaacacagcagtggccataactcttgcatgctttggacttgcaagggaggggaatcacaaacccattgactatctgaacccccctaag

SEQ ID NO: 6733 - DNA, 966 bp, Artificial Sequence
  Description of Artificial Sequence: Synthetic coding sequence
atgtctgccaagagtcgcaccatcggcattattggggcgcccttttctaagggccagccacgaggtggcgtggaggaggggccaaccgtgctacgcaaagcagggctcttggaaaagctgaaggaacaggagtgcgacgttaaagattatggagatctgccttttgcagatatccccaatgattccccgtttcaaatcgtgaaaaaccccagatcagtagggaaagcctcagagcaattggccggtaaagtggccgaagtgaaaaaaaacggcaggattagcctcgttcttggaggcgaccactcgctggccattggttccatctctggacacgcgcgggtgcatccggacctgggcgtgatctgggtggacgcccataccgacatcaacaccccgctcacaactacaagcgggaaccttcacggacagccagtgtcattccttctgaaagaactcaaaggtaagatacccgatgttcctggtttctcgtgggtcactccctgtatttccgcgaaagatatcgtgtacatcggcctgagagatgtagatccaggggagcattatatcctgaagactcttggtattaagtatttctccatgactgaagtcgataggctgggtattggaaaggtaatggaagagaccctctcctatctactgggccggaagaagcggccaatacatttatccttcgatgttgatggtctggatccttctttcacacccgccacaggaaccccagtggttggagggctgacttatcgagaaggtctctatattacagaggaaatctacaagactggtctgctgtcaggactggatataatggaggtcaaccccagccttggcaaaacgcccgaagaagtgacgcggactgtaaataccgcggtcgccatcacccttgcttgtttcggcttggcccgggaggggaaccataaaccgattgactatctaaacccccccaag

SEQ ID NO: 6734 - DNA, 966 bp, Artificial Sequence
  Description of Artificial Sequence: Synthetic coding sequence
atgtctgctaaatcccgcacgatcggtattataggggcccccttttctaaaggacaacctaggggtggagtggaggaaggtccaactgtgctgcggaaagccggtctgttggaaaaattgaaagaacaggaatgtgatgttaaagactacggtgatcttccctttgcagatatccctaacgactccccctttcagattgtcaagaaccccagaagcgtcggcaaggcctctgaacagttggccggaaaggttgccgaagtgaagaagaacggtaggatctccctcgtcctgggcggagatcatagcctggccattggcagcatttccggacacgctagagttcaccccgacctcggagtgatctgggttgatgcacacactgacatcaatacacccctgaccactacctctgggaacttgcacgggcagcctgtgtccttcctcctcaaagagcttaagggtaaaatccctgacgtgccagggttttcttgggtgaccccatgtatcagcgctaaggacattgtgtatattggtctgcgcgatgtggacccgggtgaacattacatcttaaagacattaggcataaagtatttctccatgaccgaagttgatcgcctgggcatcggaaaagtaatggaggaaacactctcctacctgctgggaaggaaaaaaagacctatacacttgtccttcgacgtggatggcctagacccgagcttcactcctgccaccgggacccctgtggtgggagggttgacatatagagagggattgtatatcaccgaagagatctataaaactgggttgctgtcagggttggacatcatggaagtcaatccctccctgggtaaaacacctgaggaagtgaccagaacagtgaatacagctgtggctattaccctggcctgctttggcctggccagagaggggaaccacaagcctatcgactatttgaatcccccgaag

SEQ ID NO: 6735 - DNA, 966 bp, Artificial Sequence
  Description of Artificial Sequence: Synthetic coding sequence
atgtctgctaaaagcagaaccatcgggatcattggtgcacccttctctaagggccagcctcggggaggcgtcgaggagggtccgactgtcctcaggaaggctggcttgctggagaaactgaaagaacaagaatgtgacgtcaaggactacggggacctgccgttcgcagatataccaaacgattcaccgtttcagatcgtgaagaacccacgatctgtgggcaaagccagcgagcagttggccggtaaagttgcagaggtgaagaagaacggcagaatcagccttgtccttggaggagaccattcactagcgatcggttctatctcgggccatgcacgcgtgcaccctgacctaggagtgatttgggtcgatgcccacacggacataaacacccccctgaccaccacaagcgggaatttgcatggccaacctgtgagttttctgcttaaggaacttaaaggtaagattccagacgtccctggattttcctgggtgaccccctgcatatcagcgaaggatattgtttacatcggactcagggatgtcgatccgggggagcattacattttaaagaccttaggcattaaatacttctcaatgactgaggttgatcgactgggtatcgggaaggtgatggaagaaacacttagttacctactcggtcgaaagaaacgtcccatacatctcagctttgatgtagacgggctggatcccagttttacccctgccactggcaccccggtggtggggggactaacctacagagaaggattgtacattaccgaggagatatataaaaccggccttttgtcgggtctagacattatggaggtgaatccgtctctgggaaaaacgccggaagaagttacacgcactgtgaatacagccgtggccatcactttggcatgctttggacttgcccgcgaaggcaatcacaaaccaatagactatctgaatccgcccaag

SEQ ID NO: 6736 - DNA, 966 bp, Artificial Sequence
  Description of Artificial Sequence: Synthetic coding sequence
atgtcggcaaagagccgtactatagggattattggagcacctttctcaaaaggacaacctcgcgggggcgtcgaggaaggtccaaccgtgctcagaaaggcgggactcctcgagaaactgaaagagcaggaatgtgacgtgaaagactacggagatctcccatttgcagatataccgaacgattcaccatttcagattgtgaagaacccgaggtcggtgggtaaggcatcagaacaacttgcggggaaagtggcagaagtgaaaaagaatggtagaatctccctcgtgcttgggggtgaccattccttggcaatcggatcgatctccgggcatgcacgggtgcatcccgatctgggtgtgatttgggtcgacgcacacaccgatatcaacactcctctgaccactacttcgggtaacctgcatggtcagccagtctcatttctcctcaaggaacttaaggggaaaatccccgacgtgcctggattttcgtgggtgaccccatgtatctccgcaaaggacattgtgtacatcggtctgcgcgatgtggatccaggcgaacactacatactgaaaactctgggcatcaaatacttctctatgactgaagtggatcggctgggaatcggaaaggtgatggaagaaactctctcctaccttcttggacgtaagaagcggcccatacatctgtcattcgacgtcgacggtcttgatccttcatttactccggcaaccggtactcctgtggtgggcggattgacctaccgcgaaggactgtacattactgaagaaatctacaagacgggccttctgagcggattggatatcatggaggtgaacccttcgcttggcaagactcctgaagaggtgacccgcaccgtcaatacggcagtcgcaatcacgctggcatgcttcgggctggcacgtgaggggaatcataaaccaattgactaccttaatccacccaag

SEQ ID NO: 6737 - DNA, 966 bp, Artificial Sequence
  Description of Artificial Sequence: Synthetic coding sequence
atgtcagcaaagagcagaactatcggaataatcggtgccccattctcgaagggacaacctcgaggaggggtggaggaaggtccgaccgtgctgcgcaaggcagggcttctcgaaaagctgaaagaacaggaatgtgacgtcaaagattacggagatctgcctttcgccgatatccctaacgactccccatttcaaatcgttaagaaccctcgttcggtcgggaaggcttccgaacagcttgctggtaaggttgcggaggtgaaaaagaacggtcgtatttccttggtgctgggtggagatcatagcttggcaatcggctcgatttctggacatgcacgagtccatccagatctgggagtcatttgggtggacgcgcacactgacattaacacccccctcactaccacttccggcaaccttcatggtcaaccagtgtccttcctgcttaaggagttgaagggaaagataccagatgtccctggattttcgtgggtcactccctgtatttccgcaaaggatatcgtctatattggactgagagacgtggatccaggagagcactacattcttaagaccctgggtattaagtactttagcatgaccgaggtcgatcgccttggaattggaaaggtgatggaagaaactttgtcctacctgctgggcaggaagaagcgaccgattcacctttcctttgatgttgatggcctggatccgagcttcaccccagcaactggaactcccgtggtcggagggctcacttatcgtgaaggactttacataacggaggagatatacaaaaccggccttctctctggtctggacattatggaggttaatccctcgctcggcaagacgcccgaagaagtcaccagaaccgtgaacaccgcagtggcaatcactcttgcctgctttgggcttgcacgggagggtaatcacaaaccaatcgattacctgaatcctccaaaa

SEQ ID NO: 6738 - DNA, 1392 bp, Artificial Sequence
  Description of Artificial Sequence: Synthetic coding sequence
atggcttcggaatcagggaagctgtggggcgggagattcgtgggcgcagtcgaccctattatggagaagtttaacgcatccatcgcttatgatcgccatctgtgggaagtggacgtgcaaggttctaaggcctacagccgaggcctggagaaggcaggtctgctgaccaaggcagaaatggaccagatactgcatggtttagataaggtggcagaggagtgggcacagggaacttttaagcttaattccaacgatgaggacatccataccgcaaatgaacgtcgcctgaaggagctaatcggagctacagccggcaaattgcacacaggacggtctcgcaatgaccaagtcgtgacggacctgcggttatggatgaggcagacttgctctacgctcagcgggctattgtgggagctcatccggacaatggtcgaccgcgccgaggccgaaagggacgtgctttttcccgggtacacacacctgcagcgtgcacagcccattcgttggtcgcattggatcttgtctcacgctgttgcattgacgcgcgacagtgaaaggctgctggaagtgaggaagcgcataaatgtgctgccgctcggttctggtgcaatagcaggtaacccacttggagtggatagggagctactaagggctgagctgaatttcggggcaattacccttaattccatggacgctacaagcgagcgagattttgtggctgagttcctcttctgggcctcactgtgcatgacccatctgagtcgaatggccgaggaccttattctctattgtacaaaggagtttagctttgtacagctgtcggatgcatatagcacgggcagcagcctgatgccgcagaaaaaaaaccctgattcattagaattgatacgcagcaaagcaggccgcgtcttcgggaggtgtgcgggcctgttaatgaccctgaaaggcctcccctctacatacaacaaggatctgcaggaagataaagaggccgtgtttgaagttagcgatacaatgagcgctgtcctgcaagtggctactggagtgatcagcaccctgcagatccaccaggagaatatgggccaggcactgtccccagacatgctggctactgacctcgcgtactacctcgtgcgcaagggcatgccttttcggcaggctcacgaagcctcagggaaagcggtgttcatggctgagacgaagggagttgccttaaatcagctgtctttgcaggaattgcagacaatctctcccctctttagcggagatgttatctgcgtgtgggattatggccattctgtcgagcagtatggcgccctgggaggcacagcgcggtcctcagtagactggcagattcggcaggtgagagcgctcctccaggcccagcaggcc

SEQ ID NO: 6739 - DNA, 1392 bp, Artificial Sequence
  Description of Artificial Sequence: Synthetic coding sequence
atggcatcggaatcgggtaagctgtggggtggccgctttgtcggcgccgtggatcctatcatggaaaagtttaacgcatcaattgcctacgatcgtcatctttgggaagtggatgtccaagggtctaaggcatactcacgggggcttgaaaaggcaggacttctgaccaaggcagaaatggaccaaatcctccacggccttgacaaagtggcagaagaatgggctcagggtactttcaaactgaactccaacgatgaggatatccataccgccaatgaaaggagactcaaggagctgatcggggcgactgccggtaagctgcataccggaaggtcgcgcaacgatcaagtggtcaccgacctgcggctctggatgcgtcaaacctgcagcacgctgtcaggtctgctgtgggaactgattcgcacgatggtggacagagcggaggccgagagagacgtgttgttcccaggatacactcatctgcagagagcacaaccaataagatggagccattggattcttagccacgccgtcgctcttaccagggactccgagaggcttctggaggtgagaaagagaattaacgtgctgccactgggctccggagcaattgccgggaaccctctgggcgtggacagggaattgctgcgggcagaactgaacttcggtgcgattacgctcaactcgatggatgccacctcggaaagggattttgtggcagaatttctcttctgggcctccctgtgtatgactcacctctccaggatggcagaggatctgattctgtactgtactaaggagtttagctttgtgcaactttctgacgcatactcgaccggaagctcactcatgccacagaaaaagaacccagattccctggagctcattcgctcgaaggcagggagagtgttcggccggtgcgccggtctgctcatgacccttaaagggctcccatccacttacaacaaagatctccaggaggataaggaagcagtgttcgaagtgagcgatacgatgtcggcagtcctgcaagtggcaactggcgtgatctcgaccctgcaaattcatcaagaaaacatgggtcaagctctctcccctgacatgctggctaccgatctggcatactaccttgtgagaaaagggatgccctttcgccaggcccacgaagcgtccggaaaggcggtgttcatggcagaaaccaagggagtggcactcaatcaactgtcacttcaggaactgcaaacgatatctcccctgttctcgggtgacgttatttgtgtgtgggattacggacattccgtcgagcagtacggcgcacttggtggcaccgcacggtcctccgtggactggcagattcgccaggtacgcgcacttcttcaagctcagcaggca

SEQ ID NO: 6740 - DNA, 1392 bp, Artificial Sequence
  Description of Artificial Sequence: Synthetic coding sequence
atggcctcagaatccggaaagctgtggggaggaagatttgtgggagctgtcgacccaatcatggaaaagttcaacgccagcatcgcatacgaccgacacctgtgggaagtggatgtgcaggggtctaaagcctactctcggggactggagaaagcgggactgctgaccaaggctgagatggaccaaatcctccatggattggataaggtcgcggaagaatgggcccagggcactttcaagctgaactcgaacgacgaggacatacatacggcaaatgagcgccgcctgaaggagctcatcggagccaccgccggaaaactccatacgggacggtccaggaatgaccaagtggtgactgatctgagactgtggatgcggcagacttgctcgacgctcagcggcctcctctgggaattgatcagaactatggtggaccgcgctgaggctgagcgggacgtgctgtttcctggatatacccacctccagagagcacagccgataaggtggagccactggatcttgtcacacgcggtggcgctcacgagggattccgaacggctccttgaggtccgcaagagaatcaatgtgctccccctcggatcgggagccatcgcggggaacccacttggagtggaccgtgaactgctgcgcgcggaactcaatttcggggccatcaccctgaactcaatggatgccacctcggaacgggactttgtcgcggaattcctcttctgggcctcgctctgcatgacccacctgagtcggatggccgaggatctgatcctctactgcactaaggagttcagcttcgtgcagctgagcgatgcttactcgaccggaagctcgttgatgccacaaaagaaaaacccggactcactggagctcatcaggagcaaggcaggtcgggtgttcgggaggtgtgctggtctgctgatgaccctgaagggactcccatctacttacaacaaggatttgcaggaggacaaggaagctgtctttgaagtcagcgacacgatgtccgctgtcctccaagtcgccaccggcgtcatttccaccttgcagatccatcaagagaacatgggacaggcgctgtccccggacatgctggctactgacctggcttattaccttgtgcgaaaaggcatgccgttccggcaagcacatgaggcttcaggaaaggccgtgttcatggccgagactaaaggtgtcgccctgaatcaactgtcactgcaggaattgcaaactatcagcccgctcttcagcggggacgtgatctgtgtgtgggactacgggcacagcgtcgaacagtacggtgccctcggcgggaccgcacgatccagcgtggattggcagatcaggcaagttcgggcactgcttcaggctcagcaggca

SEQ ID NO: 6741 - DNA, 1392 bp, Artificial Sequence
  Description of Artificial Sequence: Synthetic coding sequence
atggcctctgagtccggaaaactatggggcggaagattcgttggggctgtcgatccaattatggagaaattcaacgcttccatcgcttacgatcgacacctctgggaagtggacgtgcagggtagcaaagcctattctagaggacttgagaaggccggtctgctgaccaaagcagaaatggatcagattctccacggcttggacaaggtggctgaagagtgggctcagggtacctttaaacttaatagcaacgacgaggacatacatacagctaacgaacgacggctcaaggagttgataggggcaaccgccgggaagttgcacacagggcgctctcgaaacgatcaggtggtcacagatcttcggctgtggatgaggcagacatgctctacattaagtgggctcctttgggagttaattcgtactatggtggacagagccgaggccgagagggatgtcctgttccccgggtacactcatctgcaacgggctcagccgattcggtggtctcattggatactgtcacacgctgtcgccttaactcgtgattccgaacgacttctggaagtcaggaaaagaatcaatgttctgcctttgggttcgggtgcaattgccgggaatcccttaggggtagatagggagcttctgagggcagagctcaacttcggcgccataactctcaactcgatggatgcgacctctgaacgcgatttcgtcgccgaattcctcttctgggcgtctctgtgcatgacccatttgtcacggatggctgaagatcttatactgtactgcactaaagaattcagctttgtccagttgtctgatgcttatagcaccgggagtagcctgatgccccagaagaagaaccctgattccctggaactgatccgctccaaagccggcagagtatttggtagatgcgctggtttactcatgacacttaaaggccttccgtccacatataataaggacctgcaggaagacaaagaagccgtctttgaagtcagcgacacaatgagcgccgtgctccaagtggctacaggggtgatttccactttgcagatccatcaggagaacatgggtcaagctttgagtcctgatatgctggcaactgatctggcctattatctagtaaggaaaggcatgccattcaggcaggctcatgaggcatctggcaaggctgttttcatggccgaaactaaaggcgtcgccctgaatcagctctcactgcaggagttacaaacgatcagtcctttgttttctggggacgttatatgtgtctgggattatggccactccgtcgagcagtacggggctttggggggtaccgcgagatcatcagtcgactggcagattcgtcaggtccgagctctgctgcaggctcagcaggcc

SEQ ID NO: 6742 - DNA, 1392 bp, Artificial Sequence
  Description of Artificial Sequence: Synthetic coding sequence
atggcctcagagtccggcaagctctggggtggccgctttgtgggcgccgtggatcctataatggagaagttcaacgctagcatcgcctacgaccgccacttgtgggaggttgacgttcagggttccaaggcctacagccgcggtctcgagaaggcaggtctgttgaccaaggccgagatggatcagatcctccacggacttgataaggtcgctgaggagtgggcgcagggaacattcaagctcaatagcaacgacgaagacatacataccgcgaacgaacgccgcttgaaagaactgatcggtgctactgccggcaagcttcatacaggtagatcacgcaacgatcaagtggtaaccgatctgaggctgtggatgcgccagacctgttccaccctgagtggattgctgtgggaactcattaggaccatggtagaccgcgccgaagcggagagggatgtcctgtttcctggttacacacacttgcaacgcgctcagcccatcaggtggtcccattggatcttgtcccatgccgtggccctcacacgcgatagcgaaagactgttggaggttagaaaaaggatcaatgtgctcccacttggcagcggagctatcgctggcaaccccctgggcgtagatagagagctgctgagagccgaactcaattttggcgctataacactcaattcaatggacgctacttccgagagggattttgtggcagagttcttgttttgggccagcttgtgcatgacacacctttcccgcatggctgaggacctcattctgtattgcactaaggagttcagtttcgtccaattgtcagacgcttattcaacgggctctagcctgatgccgcaaaaaaaaaaccctgacagtctggagctcatcaggagcaaggcgggcagagtgttcggaaggtgtgctggtctgctcatgaccttgaagggactgccaagcacctacaacaaagacttgcaggaagacaaggaagccgtgttcgaagtctctgacacaatgtcagccgtgctgcaggtcgcaacaggtgtcatcagcacgttgcaaatccatcaggagaacatgggtcaggcattgtcccctgacatgctggccacagacttggcctattacctggttagaaagggcatgccattcagacaagcccatgaagcctcaggtaaggccgttttcatggctgaaacaaagggcgttgccctgaaccaactgtcactgcaggaacttcaaacaatctctcccctcttctccggagatgttatctgtgtctgggactacggtcactctgtagaacagtacggcgctctcggtggcaccgcgcgcagttcagtggattggcagatccgccaggttagggctttgctgcaggcacaacaagct

SEQ ID NO: 6743 - DNA, 1392 bp, Artificial Sequence
  Description of Artificial Sequence: Synthetic coding sequence
atggcatcagaaagtggtaagctctggggaggacggtttgtgggcgccgtcgatccgatcatggagaagttcaacgcctccatcgcttacgacagacacctctgggaagtggacgtgcagggatccaaggcgtatagccgcggacttgaaaaagctggcttgctgacgaaggccgaaatggaccagatccttcacggcctggacaaggtggccgaagagtgggcacaaggaactttcaaattgaactcgaacgatgaggacatccataccgcgaacgaacgccgcctcaaagaactcatcggggcaaccgcaggtaagctccataccggccggtcgagaaatgatcaggtggtcactgacctccggctgtggatgcggcagacctgctcgactctcagcggcctgctttgggaattgatccgcaccatggtggacagggcagaggcagagcgggatgtgctgttcccagggtacacccacctgcaacgagcccagcctatccggtggagccactggatcctgtcgcacgccgtcgcattgacgcgcgattccgaacggctgctcgaagtccgaaaaagaatcaatgtgctcccactgggctccggagcgatagcaggaaacccccttggcgtggatcgcgaactcctgagagccgagctcaacttcggtgccattacgctcaactcaatggacgccaccagcgagagagacttcgtggctgaatttctgttctgggcctcactgtgcatgacccatctctcgcggatggctgaagatctcatcctctactgcaccaaagaattttcctttgtccaattgtctgatgcctacagcaccggctcatccctgatgcctcaaaagaagaatccagactcgttggagctcattcgttccaaggctggacgcgtattcggtcgctgtgcaggactcctgatgactctgaaaggactgccttctacctataacaaagacctgcaggaggataaggaagcggtgttcgaagtctcagacactatgtcggcagtgctccaggtggctacgggagtgatctcgactcttcagatccaccaggagaatatgggccaggccttgtcgcctgacatgctcgccactgacctggcatactaccttgtccggaagggaatgccgttccgccaggcacatgaagccagcggtaaagcggtgttcatggccgaaactaagggagtggcacttaaccagctcagcctccaggagctgcagactatctcgccgctttttagcggtgacgtgatttgtgtgtgggactacgggcattcagtggaacagtacggtgccctgggaggcaccgctagatcgtcggtggactggcagatccggcaagtgcgcgctctcctgcaagcgcagcaggcc

SEQ ID NO: 6744 - DNA, 1392 bp, Artificial Sequence
  Description of Artificial Sequence: Synthetic coding sequence
atggcttcggagtcgggaaaactgtggggaggtcggttcgtcggagcagtggatccgatcatggagaagttcaacgcttccatcgcgtacgaccggcacctgtgggaggtggacgtgcagggatctaaggcctactcgcgcggcctggaaaaagcaggcctcttgactaaagctgaaatggatcagatcctgcatggactggacaaagtggctgaggagtgggcacaaggcactttcaagttgaattccaatgacgaggatatccatacggccaacgaacggcgtcttaaagaactgattggagccaccgcaggcaagttgcacacgggccgctctcgcaacgaccaggttgttacggatctgagattgtggatgaggcagacctgttcaacgctctccggactgctctgggagctcattcgtaccatggtggatagggctgaagcggaacgcgatgtgctgttccctggatacactcacttgcagcgcgcgcaaccaatccgctggtcgcattggatcctctcacatgcggtggcactgactcgcgactcagagagactgctggaagtcaggaagaggattaatgtactgccgctcggatccggggcaattgcgggcaacccgctgggtgtcgacagagaactgctgcgcgccgagctgaattttggagcgatcacgctcaactccatggatgctacttcggaacgggattttgtcgccgaattcctgttttgggccagcctgtgcatgactcatctgagcagaatggcagaggacctgatcctttattgcaccaaagagttctcgttcgtgcaactctcggacgcttacagcactggctcctcactcatgccgcagaaaaagaaccccgactcactggaactcataaggtcgaaggcgggccgggtgttcggtagatgcgcgggactgctgatgactctgaagggccttccatccacctacaataaagacctgcaagaagataaggaggcagtattcgaagtcagcgacaccatgagcgcggtgctgcaagtggccaccggggtcatctccactctgcagatccatcaggaaaacatgggacaggccctgtcccccgacatgctcgccacggatctggcgtactaccttgtgcgcaagggcatgccattcaggcaggcgcacgaggccagcggaaaggccgtctttatggccgagactaagggggtggctttgaatcagctgtccctccaagaattgcaaactatctccccactgttcagtggtgatgtgatttgtgtctgggattacggacactcggtcgagcaatacggagcactgggagggaccgcccgatcctccgtggactggcagatccgccaggtgcgcgctttgctgcaggcgcaacaggcc

SEQ ID NO: 6745 - DNA, 1392 bp, Artificial Sequence
  Description of Artificial Sequence: Synthetic coding sequence
atggcatcagagtcaggcaagctgtggggggggcgattcgtgggcgccgtggatcctatcatggagaagttcaacgcttccatcgcttacgacaggcatttgtgggaggtggacgtacagggatccaaagcctactcaagaggcttagaaaaggccggtctcctgaccaaggccgagatggatcagatactccacggtctcgacaaggttgccgaggagtgggctcagggaacatttaagctgaatagcaatgacgaggatatacacacagccaatgaaagacggctgaaagagctgatcggtgccacagccggcaaacttcataccgggagaagtagaaacgatcaggtggttacggatctgaggttatggatgagacaaacctgtagcactttatctggcttactctgggaattgattaggaccatggtggaccgtgctgaggcagagcgtgacgttctgttcccaggctatactcacttacagagagcacagccgatccggtggagtcattggatcctgtcccacgccgtcgccctcaccagggattcagagcgactgcttgaagttagaaaacggatcaacgttctcccgttgggaagcggtgctatagccggcaatccacttggagttgaccgggaactgttgcgagcagagcttaacttcggggcgattaccctcaactccatggacgccacttctgagagggacttcgtggccgaattcctgttttgggccagcctgtgtatgactcatctctcacggatggctgaggacttgatattgtattgcaccaaagaatttagttttgtacagctgagcgatgcctattccacaggcagctctctaatgccacagaaaaagaacccagacagtctggagctcatccgcagtaaagctggtcgcgtgttcggcaggtgcgcgggtctgcttatgacccttaagggccttccttcgacatacaacaaggacctgcaagaagataaagaggcagtattcgaggtgagcgacacgatgagtgccgtgctgcaggtcgccaccggtgtgatctcgacgttgcaaatccaccaggaaaacatggggcaggcactgagccctgatatgttagccactgatctggcttactatctggtgagaaagggtatgcctttccgccaggcccacgaggcttctgggaaagccgtgttcatggccgagaccaagggggtggcgctaaatcaactgtctctgcaggagttgcagacaatcagcccccttttcagtggggatgtgatatgtgtttgggactatgggcacagcgtggaacagtacggcgcccttggggggacagctagatcttctgttgattggcagatccgccaggtgagggcactgctgcaggcccagcaggct

SEQ ID NO: 6746 - DNA, 1392 bp, Artificial Sequence
  Description of Artificial Sequence: Synthetic coding sequence
atggcgagcgagtcaggcaaactttgggggggtcgattcgtcggagccgtggatcccatcatggagaaattcaacgccagtattgcatatgaccggcacctgtgggaggtcgacgtgcaaggaagcaaggcttatagtaggggcctcgagaaagctggactcctgacaaaggctgaaatggaccagatccttcacggcctggacaaggtggccgaggaatgggcgcagggtacgtttaagctcaacagtaacgatgaggatatccatactgccaacgaacggcgtttaaaggaactgatcggagcgactgccggcaagctgcacacaggacgttctagaaacgatcaagtcgtgaccgacttacgtttgtggatgaggcaaacctgctcgaccttgagtggacttctctgggaactcataagaaccatggtcgaccgcgcagaggctgagcgcgatgtgttgttccccggatatacacatctgcagcgggctcagccgatcagatggagccactggatcctgtcgcatgccgtggcccttactagagattctgaaagattgctggaggtccgaaagcgcatcaacgtcctgccgctcgggtcaggggccatagccggaaacccactgggagtagacagggaattacttcgcgctgagctgaacttcggtgccatcactctcaactccatggatgccacttctgagcgggatttcgttgctgaattcttattttgggcttctctgtgcatgacacatctctcccgtatggccgaggacttgatcttgtactgtacaaaggagttttcctttgtccagctgagcgacgcctactccacggggtcttccctgatgccacaaaagaaaaaccccgacagtcttgaattgataagaagtaaggcaggcagggtgtttgggagatgcgcggggctgctgatgacgctgaagggactccctagtacatacaataaagatctccaggaagacaaagaagccgtatttgaagtgagcgacactatgtccgccgtgttgcaggtcgcaacaggcgtaatctccacactccagatccaccaggagaacatgggccaagctctgtcaccagacatgcttgccacagacttggcatattacctggtccgaaaaggcatgccctttcgacaggcacacgaggcaagcggcaaagccgtgtttatggcagagacaaagggggtggctctgaatcagctctcacttcaggagctgcagaccataagtccgctcttctctggggacgtcatttgcgtgtgggattacggacattcggtggagcagtatggggcgctgggcggcacggcgagatctagcgtggattggcagatccggcaggttcgggcgctgctacaggctcagcaggca

SEQ ID NO: 6747 - DNA, 1392 bp, Artificial Sequence
  Description of Artificial Sequence: Synthetic coding sequence
atggcttctgagtccggcaaactgtggggcggccgtttcgtcggcgctgtggacccgatcatggagaagttcaatgccagcattgcttatgatagacatctgtgggaagtcgatgttcagggttccaaggcttatagtcgtggtctggagaaagcgggacttctcaccaaggctgagatggatcagatcctccacgggttagacaaggtggctgaagaatgggctcagggtacattcaagctcaactctaacgacgaagatatacatactgccaacgagcgacggttgaaggagctgatcggagccacagctggcaagctgcatactggtagatctaggaacgatcaagtggtgacagacctgaggttgtggatgcgccagacctgctctaccttatcaggacttctctgggagttgatacgcacaatggtggatcgggcggaagccgagcgggatgtcttgtttcccgggtatacgcacctgcagagagcgcaaccgatccgatggtcccattggatactgagccacgctgttgcactcacacgggattccgagcggctactggaagtgaggaagaggattaacgtcttaccgctgggctcaggcgcaatcgcaggaaatccactgggcgtcgacagggaactcctgagggccgagctgaatttcggagccataactctgaactccatggatgccacaagtgaacgagactttgtcgcagagttcctgttctgggcttcactttgtatgactcatttgtctcgaatggccgaggatctcattctttattgcacaaaggagtttagcttcgttcagctgagtgacgcctactccacgggttcatcactgatgccccagaagaaaaaccccgatagcctggagctcatccggagtaaggccggacgcgtctttggtagatgcgccgggctactgatgacattgaagggcctcccatcgacctataacaaggacttacaggaggataaagaggccgttttcgaggtgagcgataccatgtccgccgtcctgcaagtggctacaggcgtcatatctacgctccaaatccaccaggagaatatggggcaagctctgtcgccggatatgcttgcaactgacctggcctactaccttgtccgaaaagggatgccattcaggcaggcccacgaggcatccggcaaggctgtctttatggcagagacaaagggggtggccctcaaccagttgtcattgcaggagctgcagacaatatctccattgttcagcggcgatgtcatttgcgtttgggattatggccattctgtcgaacaatacggtgccttgggagggacagctcggtcttcagtcgactggcaaatccgccaggtgcgagcactcctgcaggcccagcaggct

SEQ ID NO: 6748 - DNA, 1392 bp, Artificial Sequence
  Description of Artificial Sequence: Synthetic coding sequence
atggcatcggaatcaggaaagttgtggggcggacggtttgtgggtgcagtggaccccatcatggagaagtttaatgcttccattgcatatgatcgtcatctttgggaagtcgatgtccagggaagcaaggcatattcgcggggactcgaaaaagctgggctgctcaccaaggccgaaatggaccaaatcctgcatgggctcgacaaggtggccgaagaatgggcccaaggtactttcaaacttaacagcaacgatgaagatattcataccgcgaacgaaagacggcttaaagaacttatcggagcgaccgcgggaaagttgcacacgggaagatcaaggaatgaccaagttgtcaccgatcttcggctttggatgagacagacctgcagcactctgtcggggctgctttgggagcttattcgtactatggtcgatagagccgaggcagaaagagacgtgctgttccccggttacactcatctccaacgggcgcagcctattagatggtcccactggatcctgtcccatgcagtcgcactgacgcgggattcagaaaggcttcttgaagtgcggaagcggatcaatgtgcttcccctcggatcaggggcaattgccggaaacccgctcggagtggacagggagctccttcgggcagaacttaactttggggcaattacccttaacagcatggatgcaactagcgagagggattttgtggcggaatttctgttttgggcatctttgtgcatgacgcatctttcgagaatggcagaagatctgatactgtactgtactaaggaattctcgttcgtgcagctgagcgatgcatacagcactggctcatcgttgatgccgcagaagaaaaatcctgattcactcgagctgattcgatcgaaggcaggtagggtttttggccgatgcgcagggcttctgatgactctcaaaggactcccatccacctacaataaggatctccaagaagataaggaggcagtgtttgaagtctccgacaccatgtctgcggttcttcaagtggcaaccggggtcatttccactctgcaaatccatcaagaaaacatgggtcaggcattgtcgccagacatgctggctactgacctcgcatactacctcgtgcgaaagggtatgccattcagacaagcacacgaagcatcaggaaaagctgtgttcatggctgagactaagggagtcgccctcaaccaactctcgttgcaggagttgcaaaccatttcacccttgtttagcggagatgtgatctgtgtgtgggactacggtcactccgtggaacaatacggtgcactgggaggtaccgcgcgttcgtccgtggattggcaaatccgccaagtgcgcgcgcttctgcaagcacagcaggcg

SEQ ID NO: 6749 - DNA, 1392 bp, Artificial Sequence
  Description of Artificial Sequence: Synthetic coding sequence
atggcgtcggaatcgggaaaactttggggaggacgctttgtgggggcagtcgatccgatcatggaaaagtttaacgcttcaatcgcttacgaccggcacctctgggaggtggatgtgcaaggatccaaggcgtactcgcgcggtctggagaaggcggggctcctgactaaagcagagatggatcaaatcctgcacggtttggacaaggtcgcggaggaatgggcgcagggaactttcaagctcaacagcaatgacgaggacatccacacggcgaacgaacggaggctcaaggaactgatcggagccaccgccggaaagctccataccgggcgctcccgcaacgaccaggtggtgactgacctgcgcctctggatgcggcagacttgcagcaccctctccgggctcctgtgggaattgatccgcaccatggttgacagagccgaggccgagagggacgtgctgtttccgggatatacccacctccagcgagcgcaacctatccgctggtcacattggatcctcagccacgccgtcgccctgaccagagacagcgagcggctgttggaggtgaggaaacgcatcaacgtgttgccgctcgggagcggagcaatcgccggaaatccactgggagtggacagagaactcctccgcgccgaactgaatttcggcgccatcaccctcaactccatggatgcgacctccgaacgggattttgtcgccgagttcctgttctgggcctccctgtgcatgacccatttgtcgcggatggccgaggacctgatcctgtactgcactaaagagttttcgttcgtgcagctctcggatgcatactccaccggatcctccctgatgccgcagaagaaaaatccggattcgctggaactcattcgctctaaagccggcagggtgttcgggcggtgtgcaggactgcttatgactctgaagggcttgccgtccacctacaacaaagacctccaggaagataaggaagccgttttcgaggtcagcgataccatgtcggccgttctgcaggtcgcaacgggggtgatctccactctccagatccaccaggaaaacatgggacaggccttgagccctgacatgctggccaccgacctcgcctactacttggtccggaaaggcatgcccttccgccaggcccacgaggcctccggaaaagccgtgttcatggcggaaaccaagggggtggctcttaatcagctctctcttcaggagctgcaaaccatctcccccctgttctcgggagacgtgatctgcgtgtgggactacggccacagcgtcgagcagtacggggccctcggaggcaccgcaagaagctccgtcgattggcagatcagacaagtgagagccctgcttcaggcacaacaagca

SEQ ID NO: 6750 - DNA, 1392 bp, Artificial Sequence
  Description of Artificial Sequence: Synthetic coding sequence
atggcctctgagagcgggaagctttggggcggtcgctttgtcggggcagttgatcccatcatggagaagtttaacgcatctatcgcttacgatcgccacctgtgggaggtggatgtccaggggagcaaagcgtattcaagagggctggaaaaagcgggccttctcactaaagctgaaatggaccaaatcctccatggtctcgacaaagtggcagaggagtgggcacaagggaccttcaaactgaacagtaacgacgaggatatccataccgcaaatgagcggaggcttaaggaactaatcggagccaccgctgggaagctgcatacaggtcggtctaggaacgatcaggtcgtgactgacctaagactgtggatgagacagacctgttcaaccctgtctgggctgctttgggagctgatacgcacaatggtggatagagctgaggccgagcgagacgtgttattccccggatatacccacctgcaaagagctcagcccatccgctggtcacattggatcttgagtcacgccgtggcattgaccagggacagcgaacggctgctcgaagtacggaaaagaatcaacgtcctcccgctcgggagcggtgccattgccggcaaccctctcggcgttgaccgggagctcctccgcgcggagttgaattttggtgcaattactttgaattccatggatgccactagtgagagagacttcgtagcagaattcttattttgggcatcgctatgcatgacccacttgtcccggatggctgaagatctgattctgtactgcacgaaggaattctcctttgtacagctgtctgatgcctactcgactgggtcaagcctgatgccccagaagaagaatccagactcactggagctcattcggagtaaagctggtcgggtcttcgggaggtgcgccggtttgctcatgacacttaaggggctgccttctacctacaacaaagatctgcaggaggacaaagaagccgttttcgaggtttctgataccatgagcgctgtgctgcaggtagcaaccggtgtcatatccaccctccaaatccaccaggaaaacatgggccaagctttgtcaccagacatgttggctaccgaccttgcctactatctcgtgaggaaggggatgccattcaggcaggcacacgaagcgtccgggaaggcagtgtttatggctgagacaaaaggggtcgctctgaaccaactaagcctgcaggaacttcaaacaatctctccgcttttttcaggggacgtgatctgtgtgtgggattatggacacagcgtggagcagtacggagcgttgggaggcacagctaggtcctccgttgattggcaaatccgacaggttcgggccctgctccaagctcaacaggct

SEQ ID NO: 6751 - DNA, 1392 bp, Artificial Sequence
  Description of Artificial Sequence: Synthetic coding sequence
atggcgtctgagtcaggaaaactttggggaggccggtttgtgggagcggtggaccccatcatggagaagtttaacgcgtcgatcgcttatgatcgccatctctgggaagtggacgttcaaggatcgaaggcctactcacgcggactggagaaggcaggactgctgaccaaagcggagatggatcagatcctgcacggactcgataaggtggccgaagaatgggcacagggcactttcaagctcaatagcaatgacgaggacatccacactgctaacgagagacgcctcaaggaactgatcggagcgactgcaggaaagttgcacaccggacgctcacggaacgaccaggtggtgaccgacctgaggctgtggatgcgccagacttgctccaccctgtcaggactgctctgggagttgatcagaacgatggtggaccgagctgaggcagaacgggatgtgctgttcccggggtacacccacctgcaacgcgctcaacctatccgctggtcgcactggatcctgtcccatgccgtcgcactgaccagggactccgagcgcctcctcgaggtgcggaaacggatcaacgtgctgccgctgggaagcggcgccatcgccggaaatccgttgggagtggaccgggagctgctccgcgcagagctgaacttcggcgcgattacgctcaattcgatggatgccacctcagagagggattttgtcgcggagttcctcttctgggcgagcctgtgcatgacgcacctgtcgcggatggcggaagatcttatcctttactgcaccaaggaattctcgttcgtgcagctgtcagacgcgtacagcactggaagctccctgatgccgcagaagaagaacccggactcgctggaactcatccggtcgaaggcgggacgggtgttcggccgctgtgccggacttcttatgaccctgaaaggtctgccaagcacctacaacaaggacctgcaggaggacaaggaggccgtgttcgaggtgtcggatactatgtcggccgtgctccaagtggccaccggagtgatctcgacgttgcagatccatcaggaaaacatgggacaggcactgagcccagacatgctcgcgactgatttggcctactacctggtgcgcaagggcatgccgttccgccaggcccacgaagcgtcgggtaaagcggtgttcatggcagaaaccaaaggagtggccctgaaccagctgtcgctgcaagagctccagactatcagccctctcttcagcggcgacgtgatctgtgtgtgggattacggccactcggtcgaacaatacggcgcactgggagggactgcccggtcgtctgtcgattggcaaatccgccaggtaagagctctgctccaagcccagcaggcg

SEQ ID NO: 6752 - DNA, 1392 bp, Artificial Sequence
  Description of Artificial Sequence: Synthetic coding sequence
atggccagcgaatccggtaagctctggggtgggaggtttgttggcgcagtcgatcccatcatggagaaattcaacgcatcgattgcatacgatcgacacctttgggaggttgatgtgcagggatcgaaggcctactctcgcggactcgagaaggctggccttcttaccaaggcagagatggaccagatcctccacggccttgataaggtcgccgaagagtgggcccagggaacgttcaagttgaactccaatgatgaagatatccatactgctaacgagaggaggcttaaggaactgattggagctactgcagggaaactgcatactggtaggtcaaggaacgatcaagtcgttaccgatctcaggctttggatgaggcaaacctgtagcaccctttcgggtttgctctgggaacttatacgaactatggtggatcgtgccgaagccgaacgagatgtgctgtttccgggttacactcatcttcaacgcgcccagcccatacggtggtcgcactggattctgagccatgccgtggcacttactcgcgattccgagaggcttctggaagtgagaaagagaattaacgtgctgcccctcggatcaggagccattgcgggtaatcctctgggagtggatcgagaattgttgcgcgctgagctgaacttcggcgcaattactctgaactcaatggatgcgaccagcgagcgtgatttcgtcgcagaatttcttttttgggcatctctttgtatgacccatctttcaagaatggccgaagatctgattttgtactgcactaaggaattctcgtttgtgcaactgtccgacgcatattccacggggtcgagcctgatgcctcaaaagaagaatccagatagcctggaactgattcgatccaaggcggggagagtgttcggaagatgtgctggactgctgatgacgctgaagggattgccttccacgtacaacaaggacctccaagaagataaagaggcagtgttcgaagtgtccgacaccatgagcgcagtgctgcaggtggcgaccggcgtgatatcgacccttcagatccaccaggagaatatggggcaagcactgtcacccgacatgcttgcaactgatctcgcgtactacctggtgagaaagggcatgccatttagacaagcacacgaggcatcaggtaaagcagtctttatggcagaaaccaaaggtgtggccctgaatcagctttcgctgcaggaactccaaaccatttcgccacttttctccggtgatgtgatttgtgtgtgggattacgggcatagcgtggaacagtacggagcactcgggggcaccgccagaagctccgtggactggcagattagacaggtccgcgcactgcttcaagcccagcaggcg

SEQ ID NO: 6753 - DNA, 1392 bp, Artificial Sequence
  Description of Artificial Sequence: Synthetic coding sequence
atggcctctgaatctggcaagctctggggaggccgctttgtcggggcggtagacccgattatggaaaagttcaatgctagcatagcttacgatcgccatctatgggaagtggacgtgcaggggtctaaggcctactccaggggccttgagaaggcaggcttactaactaaggccgaaatggatcagatattgcatggtcttgacaaggtcgctgaagagtgggcccagggaacatttaaactgaatagtaatgacgaggatattcataccgccaatgagcgccgtcttaaagagctaatcggagctaccgccggcaagttgcacaccggccgctcgcgaaacgatcaggtagtgacggatctgaggctgtggatgcgacagacgtgctctaccctttctggcctactgtgggaactcatacgaaccatggtggacagagcagaagctgaaagggatgtgctgttcccagggtacacacaccttcagcgtgctcaacccattaggtggtctcactggatcctctctcacgccgtggcactgacccgcgacagtgaaagattgttagaagtccgcaaaagaattaatgtactccccttgggcagtggggctatcgccggcaaccccttgggtgttgatcgggagttgttacgggcagagttgaacttcggagccattacactaaactctatggatgcaacctctgagcgggatttcgtggctgagttcttattctgggcttccctttgtatgactcacctttcacgcatggcggaagacttaatcctgtattgcaccaaggagttcagctttgtgcaattgtctgatgcctactctacaggttcttcactgatgccacaaaagaaaaaccccgattccctcgaattgatccggtccaaagctggcagagtctttggaaggtgtgcaggtctactgatgactctgaaagggttgcctagcacctataacaaggacttgcaagaggacaaggaggcagtcttcgaggtcagtgacaccatgtccgccgttctgcaagtggccacaggagttatctcaactttacagatccaccaagagaatatgggacaggcgctgagcccagatatgctggcgactgacctcgcctactatctagtgcgcaagggaatgccctttaggcaggcccacgaggcctcaggcaaagccgttttcatggctgagaccaagggtgttgcccttaaccagttgtccctccaagagctccagacgatatctcccctttttagcggcgacgtgatttgtgtgtgggactatgggcacagcgtggagcagtacggcgccttgggaggaaccgcccgctcatcagtcgactggcaaattcggcaggtgagagccttgttgcaggcccaacaggcg

SEQ ID NO: 6754 - DNA, 1392 bp, Artificial Sequence
  Description of Artificial Sequence: Synthetic coding sequence
atggcatcggagagcggaaaactctggggtggacgctttgtcggggccgtggatccaattatggaaaagttcaatgcctcgatcgcgtacgacaggcacctctgggaagtggacgttcagggctctaaagcctactcaagaggccttgagaaggcaggacttctcacgaaggctgaaatggaccaaattctgcacggcctggataaggtggccgaagaatgggcacaaggaaccttcaaactgaattcaaatgatgaggatattcacactgcaaacgagcgcaggcttaaagaactgattggagcaaccgctggtaagctccataccggccgcagccgcaacgatcaagtggtgactgatcttcgcctgtggatgaggcaaacgtgttccaccctgtcgggcctgctttgggaacttatccgaactatggtggaccgtgcggaggcagaacgcgacgtcttgttccctggatatacccatttgcagcgtgcacagccaatccgctggagccattggattctttcgcacgcagtggcgctgacgagggattcagaacgcctgctcgaggttagaaagcggattaacgtcctgccactgggttcgggggcaattgcaggaaaccccctgggggtcgaccgcgaactcttgagagcagaacttaactttggtgcaattactctgaattctatggatgcaacctcggagcgagatttcgtggcagaatttcttttttgggcgtcactctgcatgacccacctgagccgcatggcggaagatcttatcctgtattgtaccaaggagttttctttcgtccagcttagcgacgcatactcaaccggatcatcgctcatgcctcagaaaaagaaccctgattcgcttgaactcattagatcgaaggcgggtcgggtctttggaaggtgtgccgggcttttgatgacgcttaagggtctgccgtccacctacaataaggaccttcaggaagataaggaagcagtgttcgaagtgagcgacactatgagtgccgtgttgcaagtcgcaactggcgtgatttctaccctgcagatccatcaggaaaacatgggacaagcactctcgcctgatatgcttgccacggacctggcctactacctcgtccgcaagggaatgcccttcagacaagctcacgaggcctcgggaaaggccgtgttcatggccgaaaccaagggagtggcgctgaaccaactgtcactgcaagagctgcaaactatttccccgcttttttccggtgatgtgatttgcgtctgggactacggacattcggtggaacaatacggggctctgggaggtactgccagatcctctgtcgactggcaaattagacaggtccgagcccttctgcaggcacaacaggca

SEQ ID NO: 6755 - DNA, 1392 bp, Artificial Sequence
  Description of Artificial Sequence: Synthetic coding sequence
atggcgtcagagagtggaaaactgtggggaggacgcttcgtcggagccgttgatcctatcatggagaagttcaatgcgtccatcgcctatgatcgccacttgtgggaggtggacgtgcagggatctaaggcgtatagtagggggctggagaaggctggactcctgacaaaggcagagatggatcaaatcctccatggtctggacaaggtggcggaggagtgggcacagggaacgttcaaactgaactctaatgatgaagatatccacacagctaacgagcgacgactgaaagaactcattggggcaacggcagggaagctgcacactggcaggagccggaatgatcaggtcgtgactgacttgcggctgtggatgagacagacgtgcagcacgctgtccggattgctgtgggaactgatccgcacgatggtggaccgcgccgaagcggaacgcgacgtgctgttccccggctacacccacctgcagagggcccaacccatcaggtggtcacattggattttgagtcatgccgtggcactgacacgagactctgaaaggctgctcgaggtgcggaagcgcatcaacgtactgcccctcgggagtggagcaatcgccggaaacccactcggggtggacagggagctgctcagggccgaactgaatttcggggccattaccctgaatagcatggacgccacatcagaaagagacttcgtagctgaatttctcttctgggcctctttgtgcatgactcacctgagtagaatggccgaagatctgattctttattgcacaaaggagttctccttcgtgcaactcagcgacgcttactctacaggcagctcactcatgccacagaaaaagaatcccgatagcctggagctcattcggtcaaaagccggacgcgtattcggcaggtgtgcgggattgctgatgactcttaaaggtcttcctagcacctataacaaggatctgcaagaggataaggaggccgtgttcgaggtgtcagataccatgagtgcagtcctgcaggttgccaccggagttatatccactcttcaaatccaccaggaaaacatggggcaggcacttagccccgatatgctggccaccgatctggcatactatctcgtgcgcaagggcatgccgttcagacaggctcacgaagcttccggtaaggcggtgttcatggccgaaacgaagggagtcgctcttaaccagctgagtctgcaagagctgcagacaattagcccactcttcagcggggatgtcatctgcgtgtgggattacgggcacagcgtggagcaatacggcgcgctcggtgggacggcccgatcaagtgtagactggcagatacggcaggtaagggctttgcttcaggctcagcaggct

SEQ ID NO: 6756 - DNA, 1392 bp, Artificial Sequence
  Description of Artificial Sequence: Synthetic coding sequence
atggcttcagagtctggtaaactttggggtggacggtttgtgggcgctgttgaccccattatggagaagttcaacgcgtctattgcatatgataggcatttatgggaggtcgacgtccaggggtctaaagcctattcgaggggtctggagaaagccgggttgctcactaaggcagaaatggatcaaattcttcacgggctggacaaagtcgcagaggaatgggctcagggcacttttaaactcaattctaatgacgaggatatccacaccgccaacgagaggcggttaaaggagctaatcggtgcgaccgctggtaagctgcacacaggccgcagccgaaacgatcaggtggtgacggatctgcgactctggatgagacagacctgctctaccctgtcaggcctgctgtgggaactgattaggaccatggtggatagagctgaggctgaaagagatgttctgttccctggctacactcatctacagagggctcagccgataagatggtcacattggatcctgtcacatgcagttgcactgacgcgcgactcggagaggctactggaagttaggaaacgcatcaatgtcctgccgctaggaagcggtgcaatcgcgggaaatccgctcggcgtggatcgagaactgctcagagctgaactgaacttcggcgcaattacactgaacagcatggacgctacatctgaaagagacttcgtggccgagttcctgttctgggcctctctctgtatgactcaccttagcagaatggccgaagacctcatactatattgcaccaaggagttttcctttgtccaactgtctgacgcctattccactggaagttctctaatgccacagaagaaaaaccctgacagtttggagttgatcaggtcaaaggctggaagagtgttcggtaggtgcgctggcctgcttatgacactgaagggccttcctagtacctacaacaaggaccttcaggaagacaaggaggccgtgttcgaggtgtccgatacaatgtcagccgtactgcaggtggctactggagtgatcagcacgcttcaaatacatcaagaaaacatgggccaggccctcagccccgacatgcttgccaccgatctcgcctactacctggtgagaaagggtatgcctttcaggcaggcgcacgaagccagcggtaaggccgtattcatggccgagactaagggggtggctctcaaccagctcagtctacaagagctgcagaccatatcccctctgttttctggtgacgtgatctgtgtctgggactacggtcattctgtggagcaatatggggcactcggtgggaccgctcgttcttccgttgattggcagatcagacaagtgagggccctgttgcaagcccagcaggct

SEQ ID NO: 6757 - DNA, 1392 bp, Artificial Sequence
  Description of Artificial Sequence: Synthetic coding sequence
atggcctcggagtccggaaagctctggggcggacggttcgtgggtgccgtcgacccaatcatggagaagtttaacgcgtccatcgcttacgatcggcacctgtgggaggttgatgttcagggatctaaggcttattcgcgaggactggaaaaggcgggcctgttgaccaaagccgaaatggaccagatcctgcacggcttggataaagtggccgaagaatgggcccaaggaacttttaagctgaactctaatgatgaagatatccatacggccaacgagagacgattgaaggagctcatcggagccactgcgggtaagttgcacactgggcgtagccgcaacgaccaggtggtgactgacctgaggctctggatgcgtcagacttgctcgaccttgagtggactcttgtgggaactcatccgcactatggtggaccgggcagaagccgagagagacgtgctcttccctggatacacgcacctccaaagggcacagccgatccgatggagccactggatactgtcacacgccgtcgcactgaccagggactcggaacgcctcctcgaggtccgcaaacggatcaatgtgctcccgttgggatcgggggctatcgctggaaatccgctcggagtcgatcgggaactgctcagggccgaactgaactttggcgcaattaccctgaacagcatggacgccacttccgagcgcgatttcgtggcagaattcctgttctgggcatctctgtgcatgacccatctgagcaggatggcagaagatctcatcctgtactgcacgaaagagttctcctttgtccagttgtccgacgcctactcgacggggagttccctgatgccacagaagaaaaatccagattcacttgaacttattagatcgaaggctggacgcgtgttcggcaggtgtgccggactcctgatgactctgaagggactgccgtccacctacaacaaggacctgcaagaggacaaggaagccgtgttcgaggtgagcgataccatgtcggcggtcctccaagtcgctaccggagtcatttcgaccctgcaaatccatcaggagaatatgggtcaagcccttagcccggatatgctggctaccgacctcgcatactaccttgtgcggaaggggatgcctttccgccaggcgcatgaggcgtcaggaaaagcggtgttcatggcagaaaccaagggcgtggcactgaaccagctctcgctgcaagagctgcagaccatttcaccccttttctccggagacgtaatctgcgtgtgggactacggtcattcagtagagcagtacggcgcgctgggtggcactgcacgctcatcagtggactggcagatccggcaagtccgcgcccttttgcaggcgcagcaagcc

SEQ ID NO: 6758 - DNA, 1392 bp, Artificial Sequence
  Description of Artificial Sequence: Synthetic coding sequence
atggcctcggagtccggaaagctgtggggcggacggttcgtcggagcagtcgacccgattatggaaaagttcaacgcctcgatcgcatacgatcgccatctgtgggaagtggacgtgcaaggctcgaaggcttactcccggggactggagaaggcagggctcctcaccaaggctgagatggaccagatcctgcacggacttgataaggttgccgaagagtgggcccaaggcacctttaaactcaatagcaacgatgaagatatccacactgccaatgaaagaagactcaaagagctgatcggagcgactgccgggaagctgcacaccggaagaagccggaacgatcaggtcgtgaccgacctccggctctggatgcgccagacctgctctaccttgtccgggctgttgtgggagctcatccgcaccatggtggaccgcgccgaagccgagagagacgtgctcttccctgggtacacccatctgcagagagcacaacctatcagatggtcgcactggatcctttcccatgcggtggctctgacccgcgacagcgagaggctcctcgaggtccggaagcgcatcaatgtgctgccgttggggtcgggagctattgcaggaaaccccctgggagttgaccgagaactgctgcgcgcagaactgaattttggagctatcacgctcaactcgatggatgctacctccgagcgggatttcgtggcagaattcttgttctgggcgtcactgtgcatgactcatctgtcccggatggctgaggaccttattctgtactgtactaaggaattctcatttgtccaactgagcgacgcttacagcaccggatccagccttatgccgcagaagaaaaaccccgattcattggaactgatccgctccaaagctggacgggtcttcggcaggtgtgcagggctcctgatgactctcaaaggcctgccgtccacttacaataaagacctgcaggaggacaaggaggccgttttcgaagtcagcgacacgatgtcagccgtgcttcaggtggctacgggagtgatcagcactctccaaatccaccaagaaaatatgggacaggccttgtcgcctgacatgctggcaaccgacctcgcctactacctcgtgcgtaagggcatgcctttccgccaggcacacgaagcctcgggaaaggcagtgttcatggccgaaaccaagggagtcgcactgaatcaactttcccttcaagagctccaaactatatctccactgttctctggagacgtgatctgcgtgtgggactacggtcactcagtcgagcagtatggagctctcgggggcactgcccgctcgtcggtggactggcagatcaggcaggttcgggcccttctgcaagcccagcaggcg

SEQ ID NO: 6759 - DNA, 1392 bp, Artificial Sequence
  Description of Artificial Sequence: Synthetic coding sequence
atggcatccgaatcgggaaaactttggggaggacgttttgtcggggcagtggaccctatcatggaaaagtttaacgcatcaatcgcatatgaccgacatctgtgggaagtggatgtgcagggaagcaaggcatactccagaggtctggaaaaggctggtctgttgaccaaggcagaaatggatcaaattcttcatggtcttgataaagtggcagaagagtgggcccagggaaccttcaagctgaactccaacgacgaggatatacataccgccaatgagcggagactgaaagaacttattggtgcaactgcaggtaaattgcacactgggaggtcccgcaacgatcaagtggtgaccgacctgcggctgtggatgagacagacttgtagcactctttccgggcttctgtgggagcttataaggaccatggtggaccgggcggaggcagaacgtgatgtcctgtttcctgggtacactcatctgcaaagggcacagcctattcggtggtcccattggatcctttcacacgcagtggcactgacccgagattcagaaaggcttctcgaagtgaggaagaggattaacgtgctgcccctcggttcgggggcaattgcaggtaaccccctgggagtggatagagagctgctccgtgccgagctgaatttcggagcaatcactctgaattccatggatgcgacttcagaaagagatttcgtggcagaattcctgttttgggcgtcgttgtgcatgacccatctgagccgaatggccgaagatcttattctttactgtaccaaggagttttccttcgtgcaactgtccgatgcctacagtaccggttcgagcctgatgccacagaagaaaaaccctgattcactcgagcttattcgcagcaaagcaggacgggtctttgggcgctgcgcaggtctgctgatgaccctcaagggtctgccgtcgacttacaacaaagacttgcaggaggacaaagaggcagtctttgaagtcagcgacaccatgagcgcggtgctgcaagtggccactggagtcatctccactctgcaaatccaccaggaaaacatgggacaggccctctccccggatatgcttgctaccgatctggcatactacctggtgagaaaaggtatgccatttaggcaggcccacgaggcgtccggaaaggctgtctttatggcggaaactaagggcgtggcgctgaaccagctttcgctgcaggagcttcaaactattagccctctcttcagcggagatgtgatctgtgtgtgggattacggccattccgtggaacagtacggagcactgggaggaaccgccaggagctcagtggactggcaaattcgtcaagtgagggcattgttgcaagcgcagcaagct

SEQ ID NO: 6760 - DNA, 1392 bp, Artificial Sequence
  Description of Artificial Sequence: Synthetic coding sequence
atggccagcgagagcggaaagctctggggaggccgcttcgtcggcgccgtggatcccataatggagaagttcaacgcctccatagcttatgacagacacctgtgggaggtcgacgtgcagggatctaaggcctatagcaggggcctggagaaggccgggcttctgacgaaggcagagatggatcaaattctacacggacttgacaaagtggcagaagaatgggctcaaggaacctttaaactgaatagcaatgacgaggatattcataccgctaacgagagacgcctgaaggaactcattggcgccaccgctggtaaactgcacaccggtagaagccggaatgatcaagttgtgacagacctgagattgtggatgcgccagacctgtagtactctgtccgggcttttatgggagctcatccggactatggtagacagagcagaggcagaaagagacgtcctcttcccaggatacacccatctacagcgcgcccaacctattcgatggtcccattggatactgtcccacgctgtggccctgacgagagactcagagcggctgctcgaggttcgtaaacgtatcaatgtgttaccgctgggctccggcgcaattgccggcaatcctctcggggtggaccgtgaactcctgcgggccgaactgaattttggagctatcacactgaactctatggatgctacgagcgaacgcgactttgttgctgaatttctgttttgggcctctctgtgtatgacccatttatccaggatggccgaagacttgatcttgtactgcacaaaagagttttcatttgtgcaattaagcgatgcgtattctacgggttctagcctgatgccacagaagaaaaaccccgatagtctggaacttatcagatcaaaggcaggaagggtgttcggcaggtgcgcgggactgctcatgaccctcaagggacttccaagcacttacaacaaagatttgcaagaagacaaggaggccgtctttgaggtgagcgacacaatgagtgctgtgctacaggtggcaaccggtgtgatttcaactctgcagatccaccaggagaatatggggcaggcactgtctcccgacatgctggcaactgatttagcctactatctggtcagaaagggaatgcccttcaggcaggctcacgaagcctctggaaaagctgtgttcatggccgagaccaaaggcgtggctctgaaccaactgagtctccaagagcttcaaactatctcccccctgtttagcggagacgtgatttgtgtctgggattatgggcactccgttgagcagtatggcgcattgggcggcaccgcgcgttcaagcgtcgattggcagatacgacaggtgagagcgctattgcaagctcagcaagcg

SEQ ID NO: 6761 - DNA, 1392 bp, Artificial Sequence
  Description of Artificial Sequence: Synthetic coding sequence
atggcttccgagtccggaaagctttggggaggaagatttgtgggcgctgtcgaccctatcatggaaaagttcaacgcatccatcgcctacgatcgtcatctctgggaggtggacgtacagggttccaaggcctactcccgcggtcttgaaaaggctggcctcttgaccaaagctgagatggaccagattcttcacggacttgataaggtggctgaggagtgggctcaaggtacttttaagttgaacagcaacgatgaggatattcatacagccaatgaaagacgcctgaaggagctgatcggcgctacagccggaaagctgcacaccggacgctccaggaacgatcaggtcgtgaccgatcttagactttggatgagacaaacctgttctaccctgtctggactcctgtgggagctgattaggactatggtcgaccgcgcagaagccgagagagatgttctcttcccaggttacacccaccttcaaagggcccaacccatcaggtggtcccattggatattgtctcacgcagtggcactcacccgcgacagcgaacgcctgctggaagtcaggaagcgtatcaacgtcctgcccctgggcagcggagctattgccggcaaccctctgggagtggaccgtgagctgttgcgtgctgagttgaattttggagctatcaccttgaattcaatggatgctaccagtgaaagagatttcgtggcagaatttctgttttgggcatctctttgtatgacccatctgagtcgtatggctgaggatcttatcctctattgtacaaaggagttcagctttgtacagctgtcagatgcttattctaccggctcttcccttatgccccagaagaagaatccagattctctcgagctcatacgctccaaggccggtcgtgtgttcggacgttgtgccggcctgcttatgactcttaaaggtctgccctctacatataacaaggatctccaagaggacaaggaagctgtcttcgaagtctccgacactatgagcgccgtccttcaggtcgctaccggcgtgataagcaccctgcagatccatcaagagaatatgggtcaggccttgtcacctgacatgctggctacagatctcgcctactaccttgtaagaaaaggaatgccttttaggcaggcacatgaagcaagtggcaaggctgtttttatggcagagacaaagggagtagctctgaatcagttgagtctccaagagctccaaacaatctctcctctgttctctggtgatgtcatctgcgtttgggattacggtcacagcgttgagcagtacggcgcccttggtggcaccgctcgttctagcgtggactggcagatcagacaagtgcgcgcactccttcaagcccagcaggct

SEQ ID NO: 6762 - DNA, 1392 bp, Artificial Sequence
  Description of Artificial Sequence: Synthetic coding sequence
atggcatccgagtccgggaagctctggggaggccgctttgtgggcgctgtggatcctattatggaaaagttcaacgcgtcaatcgcctacgaccgccacctgtgggaagtggatgttcaggggtcaaaggcgtattcacgcgggttagaaaaagcggggctgttaacaaaggccgaaatggatcaaatcctgcacgggttagacaaagtggccgaggagtgggcccaagggacatttaagcttaattctaacgacgaagatatacacacggctaacgagaggcgactcaaggaattgataggagcaaccgccgggaaactccataccgggaggagcaggaacgaccaggtggtcacagacctgcgtctttggatgcgtcagacctgttccaccttgtctggactcttgtgggaattgatacgaactatggtagaccgggccgaagcagaacgggacgtactgttcccgggctacacccacttacagcgagctcaaccaatccgctggagccattggattctttctcacgctgtggcccttactagagactccgagcgcctgttagaggtcagaaagagaattaatgtgttacctttggggtccggagcgatcgccggaaaccccctcggcgtggacagggagctgttgagagcagagctgaatttcggcgcaattacattaaattccatggacgccaccagcgaacgggatttcgttgcagagtttttattttgggctagcttgtgtatgactcatctttcccgaatggccgaggacttgatcctgtactgtaccaaggagtttagtttcgtccaactgtctgatgcatactcaaccggcagcagcctgatgccccaaaagaagaatcctgatagtctagagcttatcagatccaaggctggaagggtgtttggcaggtgtgccggcctgctcatgactttaaaaggcctccccagtacttacaataaagacctccaagaagacaaggaggccgtgttcgaggtgtctgatactatgagcgcggtgctccaggtggccacaggcgtgatttccaccctccagattcatcaggagaatatgggtcaggccctgtcgcctgacatgctggccaccgacctggcctactatctcgttcggaaggggatgccgtttagacaggcccatgaggcatctggcaaggccgtctttatggctgagacgaagggggttgcactcaaccagttgtccctacaggagttgcaaactatctctcctctattcagcggggatgtgatctgcgtctgggactatggccactctgtggaacaatacggtgcccttggaggcaccgccaggagctccgtggactggcagattcggcaggtccgcgcccttctgcaggctcagcaagcc

SEQ ID NO: 6763 - DNA, 1392 bp, Artificial Sequence
  Description of Artificial Sequence: Synthetic coding sequence
atggctagtgaaagtgggaaactttggggcggaagatttgtgggggccgtcgatcccattatggagaaatttaatgcttccatcgcgtatgatcgacacctgtgggaagttgacgtccagggatctaaagcctattcacggggactggagaaggccggtttgctgacaaaggctgagatggaccagatacttcacggattggataaagtagcagaggaatgggcacagggaacgtttaaattaaattccaacgacgaagacatccacaccgcgaacgagaggagactcaaagagctgatcggagctacagccggcaagctccatacagggcgatcccgtaacgatcaggtagtgacagatttgcggctgtggatgcggcagacctgctccaccctgtctggattgctttgggagctcattcgaaccatggtggaccgcgccgaagctgagcgggacgtcctgttccccggatatacacacctgcagcgcgcacagcctattcggtggagccattggatcctgagtcatgccgttgcactcacccgcgacagcgaacggctgctggaggtgcggaaacggatcaatgtcttgcccctggggagcggtgccatcgcaggtaatcccctcggggttgatcgggaattgctgagggcagagttgaacttcggtgccattacactaaatagtatggacgccacatcggagagggacttcgtcgccgagtttctgttctgggcttcactgtgcatgacgcatctttcccggatggctgaagacctcatactctattgcaccaaagaatttagctttgtccagctcagtgatgcttatagtactggaagttccctaatgccacaaaagaagaaccctgactcgttggagctgataaggagcaaggcgggcagagtcttcggccgctgtgctgggcttttaatgactctcaaagggttaccaagcacctataacaaggacctccaggaggacaaggaggccgtgttcgaggtgtcggacaccatgtccgctgtgctccaggtggcgaccggcgttatcagtaccttgcagatccatcaagagaacatgggtcaggccctcagtcctgacatgctggccactgacctggcatactatctcgttaggaagggtatgcccttcagacaggctcacgaggcatccgggaaggctgtcttcatggctgagacaaaaggggtcgcgctgaaccagctgtcccttcaggaattacagacgatatctccgctgttttccggggacgtgatttgtgtgtgggattatggccattcggtggagcagtatggcgctttggggggcaccgctcgttcatcggtggactggcagatccgccaggtcagggccctgctacaggcgcagcaggcc

SEQ ID NO: 6764 - DNA, 1392 bp, Artificial Sequence
  Description of Artificial Sequence: Synthetic coding sequence
atggcatctgaatcgggaaagctctggggtggtcgtttcgtgggagccgtcgatccgatcatggagaaattcaacgcttcgattgcctacgatagacatctttgggaagtggatgttcagggctcgaaggcatatagcagggggcttgaaaaagcaggcctgttgaccaaggctgaaatggaccagattcttcatggacttgataaggtcgcagaggaatgggcccagggcacctttaagctgaactccaatgatgaggatatacacactgcaaatgaaagacgcctcaaggagcttatcggcgcaactgcaggcaaattgcacactggaaggtcgaggaacgatcaagtggtgactgatttgaggctttggatgcgacagacctgttccactctgtcgggactgctgtgggagctgattcgcactatggtcgatagagcagaagcagaacgcgatgtcctgttccccgggtacactcatcttcagcgtgctcagcccatcaggtggagccactggattctgtctcacgcagtcgcattgaccagagattcggaacgcctgctggaagtgaggaagcgaattaacgtgctcccactgggatcaggagcaatagctggaaatccactcggggtggatcgcgaacttcttcgggccgagcttaactttggagcgattaccctgaactcaatggatgcaacttccgagagggatttcgtagccgaatttcttttttgggcctctctgtgtatgacccatctgtcaagaatggcagaggacctgattctttactgtaccaaggagttttccttcgtccagctcagcgatgcttactcaaccggttcgtcattgatgccacaaaagaagaatcctgattcactggaactgattagaagcaaggcaggacgggtgtttggaaggtgcgcaggtctgctgatgactcttaagggcttgccatcgacgtacaacaaggatcttcaagaagataaggaggccgtgttcgaagtgtcggacaccatgagcgcagtgcttcaggttgcaacgggagtgattagcacgctgcaaattcatcaagagaatatgggtcaggcgctgagcccagatatgctggcaaccgatttggcttactacctcgtgcgcaaagggatgccatttcgccaagcgcatgaagcatcgggtaaggcagtgttcatggcggagactaaaggtgtggcactcaaccaacttagccttcaggaacttcagaccatctcgcctctctttagcggagatgtgatttgcgtgtgggattacgggcattcggtcgaacaatacggggcacttgggggcaccgcacgctcatcagtggactggcaaatccgacaggtccgtgcgctgcttcaagcacagcaagca

SEQ ID NO: 6765 - DNA, 1392 bp, Artificial Sequence
  Description of Artificial Sequence: Synthetic coding sequence
atggcatccgaatccggcaagctgtggggcggacgattcgtcggcgctgtggaccctatcatggagaagtttaacgcctccatcgcttatgatagacacttgtgggaggttgatgtccagggcagcaaggcatattctcgaggtctcgaaaaagcgggattgttgacaaaagcggaaatggaccagatccttcacggactggataaagttgcagaggaatgggcccaaggtacctttaagttaaacagtaatgacgaggacattcatactgctaacgaaaggcgactgaaggagctgatcggcgcaacggccggcaaactccacacaggacgcagtagaaatgatcaagtggtcaccgacttgcggctgtggatgaggcagacctgttcgacactgagtggattgttgtgggagttaataaggaccatggtcgacagggcggaagcagagcgggatgttcttttccccggctacacccaccttcagcgcgcacagcctatacgctggtctcactggattctaagccatgcagtggcccttacccgtgattcagagcgactgctagaggtgaggaaacgaataaacgttctgccacttggctcaggagcgatagcggggaaccctttgggagtcgacagggagttactgagggctgaactgaactttggcgctattactctgaatagtatggatgctacctccgaaagggatttcgtagccgaattcctgttttgggcatccttgtgcatgacacatctgtctagaatggctgaagacctgatcttatactgcactaaagagttttcgttcgttcagctatctgatgcatattcgaccgggtctagtctgatgccgcagaagaagaaccccgacagcctggagttgatcagatctaaggccggtagggtctttggcagatgcgctgggctgcttatgacacttaaaggcctgccaagtacctacaataaggatctgcaggaagataaagaggccgtctttgaagtatctgacacgatgagtgctgtgctgcaggttgcgactggcgtcatctcgaccctgcaaatccaccaggagaatatggggcaggcactgtcacccgacatgctcgctacagacctggcttactacctagtccggaagggcatgccttttcgacaggctcacgaggcatcaggaaaagctgtcttcatggctgaaacaaagggcgttgcattgaatcagctaagcctccaggagctccagacgatttcccccctgttttcgggtgatgtaatctgcgtgtgggattatggtcactctgtcgagcagtatggtgcattgggtggcacagcccggtcatccgtggactggcagatccgccaggtgcgcgccctgctgcaagcgcagcaggcc

SEQ ID NO: 6766 - DNA, 1392 bp, Artificial Sequence
  Description of Artificial Sequence: Synthetic coding sequence
atggcatcagaaagtggcaagttgtggggaggcagatttgttggagccgtggacccgatcatggagaaatttaacgcgtctatagcatacgatcgacatttgtgggaggtggatgtgcagggctcgaaagcttactcgagaggcttggaaaaagcaggcctcttgacaaaggcagaaatggaccagattcttcacggccttgacaaggtcgccgaggagtgggcccaaggtaccttcaagctcaactctaacgacgaagacattcatactgcaaacgaacggaggcttaaagagctgattggggctacggcgggaaagctgcatactggacgcagcagaaacgatcaggtcgtcactgatttgagactgtggatgcgtcagacctgctccactctctcagggctgctgtgggagttgattcgcaccatggtagatcgtgccgaagcagagagagatgtgcttttcccagggtacactcatctccagcgagcccagccaattcgctggagtcactggattctgtctcacgcagtggcactgacccgagattctgaaagactgctcgaagtaagaaaacggatcaacgtacttcctctaggctctggtgcaatagccggaaatccgcttggcgtggatcgcgaactgctgcgggccgagctgaacttcggggcaattaccctgaactctatggacgctaccagtgagcgggacttcgtggctgaattcctgttttgggcatcactctgcatgacacatttatccagaatggctgaagacctgatcctgtattgcactaaggagttttctttcgtccagctctcggacgcctacagcaccggatccagcctaatgccacagaaaaagaaccctgattcgctggaactcatccgatccaaggctggccgcgtcttcggccggtgtgctggcctacttatgactctcaaaggtctcccctcaacatacaataaggatctgcaggaggacaaggaagccgtctttgaggtttcagatacaatgtccgcagtactgcaggtcgccacgggcgttatcagcacactgcagatacaccaggaaaacatgggacaagccctgtcacctgacatgctggctaccgacttggcctactatttggtcagaaaggggatgccttttcgccaagcccatgaagcatccggaaaagccgtctttatggccgagacgaagggagtcgccctcaaccagctgtctcttcaggaacttcagacaatcagcccactcttttctggagacgtgatttgcgtctgggattacgggcacagtgtagagcagtatggagcgttaggcggcaccgctaggtcatcagtggactggcagatacggcaggtaagagcactgctgcaagcacagcaggcc

SEQ ID NO: 6767 - DNA, 1392 bp, Artificial Sequence
  Description of Artificial Sequence: Synthetic coding sequence
atggcgtcggaaagcggaaaactgtggggaggccggttcgtgggagcagtggatccaattatggagaagtttaatgcttccattgcatacgatagacatctttgggaagtggatgtgcagggtagcaaggcgtactcgagaggcttggagaaagctgggttgcttactaaggccgagatggatcaaatcctgcatggcctcgacaaggtggcagaggaatgggcacaaggaacttttaagctgaactcaaacgacgaggacatccacacggcgaacgagaggcgcttgaaggaactgattggggcgacggcagggaaactgcatacgggtagatcgcggaacgaccaagttgtgacggacctccgtctttggatgcggcaaacctgttcgaccctgagcggacttctctgggaactcataaggactatggtggatagggcagaagcagaacgcgatgtgctttttccaggatacacgcacctgcaacgggcacaacctattagatggtcacactggatccttagccacgcagtcgcacttactcgggactccgaacggttgcttgaagtgaggaagcgaattaacgtgcttcctctcggaagcggtgcaattgctggaaatccgcttggggttgacagagaactgttgagggcagagctcaactttggtgccatcactcttaacagcatggatgcgacttccgagcgcgattttgtggcagagttcctgttttgggcgtccctctgtatgacccatcttagccgcatggcagaagatctcatcctttactgtactaaggaattctcctttgtccaactgagcgacgcatactcaaccggatcctcactgatgccgcaaaagaaaaatccagattcgctggaacttattaggagcaaggctggacgtgtgttcggtcgatgtgcagggcttctcatgacccttaaaggcctgcctagcacttacaacaaagatcttcaagaagataaggaggccgttttcgaagtgtcagataccatgtcggcggtcctccaggtcgcaaccggagtgatctcaactctgcagattcaccaggaaaacatggggcaggcactttcgcccgatatgttggctactgacctcgcgtactacctggtgcgaaagggtatgccattcaggcaagcacatgaagcaagcggaaaagccgtgtttatggcagagactaagggagtagcgctgaaccagctttcgcttcaagaactccagacgatctctccactcttctcaggagacgtcatctgtgtgtgggattatggacattcagtggaacagtacggagcacttggcggcactgcacgaagttccgtggattggcaaatcagacaggtcagagcattgctgcaggcacaacaagca

SEQ ID NO: 6768 - DNA, 1392 bp, Artificial Sequence
  Description of Artificial Sequence: Synthetic coding sequence
atggcgtcagaatcgggaaagctgtggggaggacgatttgtgggcgcggtcgaccctatcatggagaagttcaatgcctccatcgcttacgatcgccatctttgggaagttgacgtgcagggatcaaaggcttattcacgaggtttggaaaaggctggccttctcaccaaggcagagatggaccaaatcctgcatggactggataaggtggccgaagaatgggcgcagggaaccttcaaactcaactccaatgatgaggacatccatactgccaacgagcggcggctcaaagaactgattggtgcaaccgccgggaaactccacaccggccggtcccgcaacgaccaggtggtgacggaccttcggctgtggatgcgacaaacctgctcgacgctcagcggactgttgtgggagctgatccgcactatggtggatcgggcggaagccgaacgggatgtcctgttcccaggttacacccacttgcagcgcgcccaaccgatcaggtggtcgcactggatcctgagtcacgcagtcgcccttacccgggactcagagagactgctggaggtgcggaagcgaataaacgtcttgccgctcgggtccggagccatcgctggaaaccccctgggagtcgatcgcgagctgctccgcgctgagctgaatttcggagcgatcactctgaattccatggacgctacttcagaacgggacttcgtggcagaattcctcttctgggcatcgctgtgtatgacccatctttcccgtatggcggaagatctgatcctctactgcaccaaggaattttcattcgtgcaactgtcggacgcgtactcaaccggctcgagtctcatgccacaaaagaagaatccagactcgctggagctgatcaggtcgaaggccggtagagtgttcggaagatgcgctgggctgttgatgactctgaagggacttccttccacttacaacaaagatctccaggaggacaaggaggccgtgtttgaagtctcagacactatgtccgcagttctccaggttgccactggggtcatctccaccctgcagattcaccaggaaaacatgggacaggcactgtcaccagatatgctcgcgactgatttggcctactacctggtccgcaaaggtatgccgtttcggcaggcccatgaagcctcgggcaaggccgtgttcatggcggaaacgaaaggtgtggcccttaaccagctgtcactgcaggaactgcaaaccatatcacctctcttctctggagacgtcatctgcgtgtgggactatggtcactcagtcgaacaatacggggcgctgggaggaaccgctagaagctcggtggactggcaaatccgccaggtgagagcacttctgcaagcccagcaggcc

SEQ ID NO: 6769 - DNA, 1392 bp, Artificial Sequence
  Description of Artificial Sequence: Synthetic coding sequence
atggctagcgaaagtgggaaactgtggggaggtcggtttgtaggcgcagtggaccccatcatggaaaaatttaatgctagtatcgcttacgatcgacatctgtgggaagtcgacgttcagggttccaaagcatattctagggggctggaaaaggctggcctgctgacaaaggctgagatggaccagatcctgcacggactggacaaagtagctgaggagtgggcccagggtacgtttaagctcaattccaacgacgaggacatacacactgctaacgaaagaagactgaaggaacttatcggagcaacggcaggcaagctgcacaccggtagatctcgcaatgaccaggttgtgactgacctgcggctttggatgagacagacatgttccacactgtctggactgttgtgggagctgattcgaaccatggtggatcgggccgaggcagaaagagatgtactgttcccgggatatactcacctccaacgcgcgcagcctattcgctggagccactggattctctctcacgcggttgctctcacccgcgacagcgagcggttacttgaggtgagaaaacgaattaatgtactaccactcggaagtggcgctatcgccggtaatccacttggtgttgaccgcgagctcctgcgggcagagctgaattttggagccataactttaaatagcatggatgctacgagcgagcgagattttgtcgcagaattcctgttctgggccagcttgtgtatgacccatttgagccggatggcggaggatttgatattgtattgtactaaggaattctcatttgtgcagttgagcgacgcttacagtaccggcagctcgcttatgcctcagaaaaaaaatcccgactctctggagttgatccgaagtaaggcgggacgagtattcggtaggtgtgctggcctgctgatgacgctgaaaggtcttccctcaacatacaataaggatctgcaggaagacaaagaagccgtcttcgaagtcagcgatacaatgagtgctgtgctccaggtggctaccggcgtcatttctaccctccagattcaccaggagaacatgggtcaggctctcagccccgacatgctggcaacagatctagcatactatctggtgaggaaggggatgccctttcggcaggcccatgaagcgtccgggaaagccgtattcatggccgagacaaaaggtgtggccctaaaccagctttcactgcaagagttgcagaccatctccccgctgttcagcggagatgtaatctgcgtgtgggattacggtcattcagtcgaacagtacggcgctctagggggtacggcaaggagcagcgtcgactggcagatacggcaggtgcgggccctcctccaggcccagcaagca

SEQ ID NO: 6770 - DNA, 1392 bp, Artificial Sequence
  Description of Artificial Sequence: Synthetic coding sequence
atggcctcagagtcgggaaagttgtggggtggccgcttcgtgggagccgtcgatccaatcatggagaaattcaatgcatctattgcgtacgatcgccatctgtgggaggtggacgtgcagggctcgaaagcgtactcacgtggtttggagaaggctggtcttcttaccaaggcggaaatggatcagatactacacggtcttgataaggttgcagaagaatgggcccaggggacgttcaagctcaatagtaacgacgaggacattcacactgcgaatgagcgtcgattgaaagagctgatcggcgcgacggcaggtaagctgcacacgggccgttcccgaaacgatcaagtcgtgacagacctacgtctgtggatgcgtcagacatgctcaacgctgtcgggcctgctgtgggaattgatccgtaccatggtggaccgcgcggaggccgagagggacgtcctcttccccggatatactcacttgcagcgcgctcagcccatacgctggtcgcactggatactcagccacgcagtggctctgacgagggacagtgaaaggctgctggaggtacgtaagcgaattaacgtgctccccctgggatcgggtgccatcgcgggaaacccactaggcgtagatcgcgagcttctgcgtgccgagctgaacttcggcgcaatcactctcaactccatggacgccactagcgagcgcgatttcgtggcagagtttctattctgggcctcgctgtgcatgacacacctttccaggatggcggaagatctgatcctttattgcaccaaggaattctccttcgtccaactgtctgatgcctactcgacgggctcgtccctgatgccgcaaaagaagaaccccgattctttagagctaatccgatctaaggctggcagggtgtttggtcgttgcgcaggactgctgatgaccctgaagggcctccccagtacctacaacaaggacctgcaggaggacaaggaggctgtgttcgaagtaagtgatactatgtcggctgtactacaggtggccaccggcgtgatatccaccctccagatccatcaggagaacatgggacaggccctgtccccagacatgttggctacagatctagcctactatctggttagaaaaggaatgccctttcgccaggcacatgaggcctcgggcaaagctgtgttcatggcggagactaagggtgttgctcttaaccagctgagtttgcaagagctacagaccatctcgcctctgttcagcggcgacgtgatatgcgtttgggattatggccatagcgttgaacagtacggagccttgggaggtacggctcgaagttcagtcgactggcaaatccgacaagtgcgcgcgctgctgcaggcgcagcaggca

SEQ ID NO: 6771 - DNA, 1392 bp, Artificial Sequence
  Description of Artificial Sequence: Synthetic coding sequence
atggcgtcggaatcgggtaaactatggggtggtcgatttgttggtgcggttgatccgataatggaaaaatttaatgcgtcgatagcgtatgatcgacatttatgggaagtagatgttcaaggttcgaaagcgtattcgcgtggtttagaaaaagcgggtctattaacgaaagcggaaatggatcaaatattacatggtttagataaagttgcggaagaatgggcgcaaggtacgtttaaattaaattcgaatgatgaagatatacatacggcgaatgaacgacgactaaaagaattaataggtgcgacggcgggtaaactacatacgggtcgatcgcgaaatgatcaagtagtaacggatttacgactatggatgcgacaaacgtgttcgacgttatcgggtctactatgggaactaatacgtacgatggtagatcgagcggaagcggaacgtgatgtattatttccgggttatacgcatttacaacgagcgcaaccgatacgttggtcgcattggatattatcgcatgcggtagcgctaacgcgtgattcggaacgattattagaagttcgaaaacgtataaatgttctaccgttaggttcgggtgcgatagcgggtaatccgctaggtgtagatcgtgaactattacgtgcggaattaaattttggtgcgataacgctaaattcgatggatgcgacgtcggaacgtgattttgtagcggaatttttattttgggcgtcgctatgtatgacgcatttatcgcgtatggcggaagatctaatactatattgtacgaaagaattttcgtttgtacaactatcggatgcgtattcgacgggttcgtcgctaatgccgcaaaaaaaaaatccggattcgctagaactaatacgatcgaaagcgggtcgagtttttggtcgatgtgcgggtctactaatgacgctaaaaggtttaccgtcgacgtataataaagatttacaagaagataaagaagcggtttttgaagtatcggatacgatgtcggcggtattacaagtagcgacgggtgtaatatcgacgttacaaatacatcaagaaaatatgggtcaagcgctatcgccggatatgttagcgacggatctagcgtattatctagtacgaaaaggtatgccgtttcgacaagcgcatgaagcgtcgggtaaagcggtatttatggcggaaacgaaaggtgtagcgctaaatcaactatcgctacaagaattacaaacgatatcgccgttattttcgggtgatgtaatatgtgtatgggattatggtcattcggtagaacaatatggtgcgctaggtggtacggcgcgatcgtcggtagattggcaaatacgacaagtacgtgcgttactacaagcgcaacaagcg

SEQ ID NO: 6772 - DNA, 1392 bp, Artificial Sequence
  Description of Artificial Sequence: Synthetic coding sequence
atggcgtcggaatcaggaaagctgtggggagggcgcttcgtgggcgcagtggacccaatcatggaaaagttcaacgcgtcaatagcctacgaccggcacctctgggaggtggatgtgcagggcagcaaggcgtacagccgtggcttggagaaggcaggactcctgactaaggccgaaatggatcagattcttcatggacttgataaagtggcggaggagtgggcccaggggacctttaagctgaattcgaacgacgaggacatccataccgcaaatgagcggcggctcaaagaactcatcggtgcgactgccgggaagctgcatactggacgctccagaaacgaccaggtcgttactgatctgcgactgtggatgagacagacgtgttccaccctgagcggactcctctgggaactcatccgcacgatggtggaccgcgccgaagcggagcgggacgtcctgttccctggatacactcatctgcagcgcgcacagccgatccggtggagccactggatactgtcacacgccgtggcgctgactcgagattcggaacgccttctggaggtccgcaagcgaatcaacgtcctgccgctcggctccggtgccatcgctggtaatccgctcggcgtggaccgggagctcctgcgcgcggagttgaacttcggagcaattactttgaactcgatggacgcaacctccgaaagagatttcgtggccgaattcctcttttgggcgtcactgtgcatgacccaccttagccgtatggctgaggacctgatcctgtattgcaccaaggaattctccttcgtgcagctgtccgacgcgtactcgactggatcgtcgctgatgccgcagaagaaaaacccggacagccttgaactcattcggtcgaaggccggacgggtgtttggccggtgcgctggtctgctcatgactctcaaaggactcccgtcaacctacaacaaggacctgcaagaggataaggaagcagtctttgaggtgtccgatacgatgtccgccgtgctccaggtggctactggcgtgatttccaccctgcaaatccaccaggaaaacatgggacaagcactttcacccgatatgctggcgaccgacctggcctactaccttgtgcgcaaaggtatgcccttcaggcaagcccatgaagcaagtgggaaggccgtgttcatggctgaaactaagggagtggcactgaatcagctgtcgctccaggagctgcagaccatctcgccgctgttctcgggagatgtgatctgcgtgtgggattacggccactcggtggagcaatacggagcactcggtggtaccgcacgctcatctgtggactggcagatccgacaggtgagggcacttttgcaagcccaacaggca

SEQ ID NO: 6773 - DNA, 1392 bp, Artificial Sequence
  Description of Artificial Sequence: Synthetic coding sequence
atggcctcggagtcggggaaactgtggggcggccggtttgtgggagcagtggacccgattatggagaaattcaatgcgtcgattgcctatgacagacacttgtgggaagtggacgtgcaaggctcaaaggcttactcgcggggattggagaaggccgggctgcttactaaagccgaaatggatcagattctgcacggactggataaggtggccgaggagtgggcccaaggaacctttaagctcaactcgaacgatgaagatatccatactgctaacgagagacgcctcaaagagctgatcggagctactgccggtaaactgcacaccgggcgatccagaaatgatcaagtggtcaccgacctgcggctgtggatgcggcagacctgtagcactctttcaggactgctgtgggagcttattcgtactatggtggatcgggcggaagcggaaagagacgtcctctttcccggatacactcatctgcaacgagcccagccgatcagatggtcgcattggattctgtcccacgccgttgccctgacccgcgactcagaacgcctgctggaagtccggaaaagaatcaatgttctgcctctgggatcgggagccatcgctggaaatccactgggagtcgaccgcgaactgcttcgcgccgagctgaattttggtgccatcactctgaacagcatggacgcgacctccgaaagagatttcgtggctgagtttctcttttgggcatcgctgtgcatgactcatttgtcccgcatggccgaagatttgattctgtactgcaccaaggaattcagcttcgtgcaactcagcgacgcatactcgacgggaagctccctgatgccacagaagaaaaacccggactccctcgaactgatccggagcaaggccggacgcgtgtttggaagatgcgctggcctcctcatgacgctgaaaggcctgcctagcacttataacaaggatctgcaggaagataaggaagccgttttcgaggtgtcggacaccatgtctgccgtgctccaagtcgcaaccggcgtgatcagcaccctgcaaatccaccaggagaatatgggccaggccctgtctcctgatatgctggcgaccgacctcgcctactacctcgtgaggaagggtatgccattcaggcaagcacacgaggcatcagggaaagcagttttcatggcggaaactaagggtgtcgccctcaatcaactgtcactgcaggagctccagactatcagcccgcttttctcaggagacgtcatctgcgtgtgggattacggtcatagcgtggagcagtacggagccctcggcggaaccgcacggtcgtcggtggattggcaaatacgacaagtgcgcgccctgctgcaggcccaacaggct

SEQ ID NO: 6774 - DNA, 1392 bp, Artificial Sequence
  Description of Artificial Sequence: Synthetic coding sequence
atggccagcgaatcgggaaagctctggggtggacgctttgtgggcgcggtcgacccaatcatggagaaattcaacgcatctatcgcatacgaccgccacctgtgggaggtggatgtgcagggatcgaaggcgtactccagaggattggaaaaggccggtctgctgaccaaggcggaaatggaccaaattctgcacggactggacaaggtcgctgaggagtgggcccaaggaactttcaagctgaactccaacgatgaggacatccataccgccaacgaacggaggctgaaagagcttatcggggcgaccgcaggaaagctgcacaccggacgctcaagaaatgatcaagttgtgactgacctccgcttgtggatgcggcagacttgctcgactctgtccggcctgctctgggaactcatcaggactatggtcgaccgtgcagaggcagagagagatgtgctgtttcccggatacacccacctccagcgggctcaaccgattcggtggtcccactggatcctttcgcacgcggtggctctgacccgggactccgagcgccttctcgaagtccggaagcgaatcaatgtccttcctctcggtagcggggctatcgccggaaatccactgggtgtggatcgggagctcctgagagcggaactgaacttcggagctatcaccctgaactcgatggacgccacctctgaacgcgactttgtggcagagttcttgttctgggcttccctgtgcatgacgcatctctcacggatggctgaggacttgatcctgtactgcaccaaagagttctcatttgtgcaactgtcggacgcatacagcacgggaagttcgctgatgccgcagaagaagaatccagattcactcgaactgattcgcagcaaagcgggccgcgtgttcgggagatgtgccggcctccttatgacgctgaaagggctgccgtccacctacaacaaggatcttcaggaagataaggaagccgtgttcgaggtcagcgacactatgtccgcggtgctccaggtggcaactggagtgatctcgactctccagatccatcaggaaaatatgggacaagccttgtcgcctgatatgctggccactgacctcgcctactacctggtgcgcaaaggcatgccgttcaggcaggcccacgaagccagcggcaaggccgtgttcatggccgaaaccaagggcgtagcgctgaaccagctgtcgctgcaagaactccaaaccattagcccgctgttctcaggcgacgtcatctgcgtgtgggactacgggcattcagtggaacaatatggagctctcggaggcactgcaaggagctccgtcgattggcagatccgccaggttagagccctgttgcaggcccagcaggcg

SEQ ID NO: 6775 - DNA, 1392 bp, Artificial Sequence
  Description of Artificial Sequence: Synthetic coding sequence
atggcatcagaatcagggaaactttggggaggaagatttgttggagcagtggaccccattatggagaagtttaatgcgagcatcgcatacgatagacatctttgggaagtcgacgtgcagggatccaaggcttacagccggggtttggagaaggcaggtctgctcaccaaggcagaaatggaccaaattcttcatggacttgataaggtcgctgaagaatgggcacagggaaccttcaagctcaattccaatgatgaggacattcataccgcgaacgagagacgccttaaggagctgatcggagcaactgccggcaagctgcataccgggaggtcacgaaacgaccaagtcgtgactgatttgagactgtggatgaggcagacgtgcagcacgctctccggacttctgtgggaactgatcagaactatggtggatagagcagaggcagaacgggatgtgctctttcctggttacacccaccttcaaagagcccagcctattagatggtcccattggattctgtcccatgccgtcgcacttactagagattccgaacggctgcttgaagttagaaaacggattaatgtgctgcccctggggtcgggggcaattgccggcaacccgctcggggtcgatcgggaactgcttcgtgcggaattgaattttggggcaattactcttaactccatggatgcaacctcggagcgggattttgtcgcagagttcctgttctgggccagcctttgtatgacccacctgtctcggatggcggaggaccttattctttactgtaccaaggaattctcgtttgtgcaactttcggatgcgtactccaccggctcctccctcatgcctcagaagaagaacccggactccctggagcttattcgcagcaaggccggacgtgtctttggaagatgcgccggtttgttgatgacccttaaaggccttcctagcacgtacaacaaggatctccaagaagataaggaggcagtgtttgaagtctctgatactatgagcgcagtccttcaggtggcaaccggtgtcatctcgaccctgcaaatccatcaggaaaacatgggacaagccctcagcccagacatgctggcaactgacctggcatactacctggtgagaaaggggatgccttttagacaagcacatgaagcatccggtaaggcagtgttcatggctgaaactaagggtgtggccctgaatcaactttccctccaagaacttcaaaccatctcgccactgttttcgggtgacgtgatctgtgtgtgggactacggtcatagcgtcgagcagtatggagcacttggaggcaccgccaggtcctcggtggattggcagatcagacaagtcagggccctgctgcaagcacaacaggca

SEQ ID NO: 6776 - DNA, 1392 bp, Artificial Sequence
  Description of Artificial Sequence: Synthetic coding sequence
atggcctccgagtccgggaagctctggggtggacgctttgttggagccgtggatcctattatggaaaagtttaacgcgtctatagcttatgaccgacacctgtgggaggtggacgtgcagggatccaaggcctactctagaggactcgagaaagccggtctcttaaccaaggcagagatggatcagattttgcatggcctagataaggttgcagaagagtgggcccagggcacttttaagttgaattctaatgatgaagacattcatacagccaatgaaaggagactcaaggaactgattggggctaccgccggaaagctacacacgggacgttccaggaacgaccaagtggtcaccgatctgagactctggatgagacagacttgcagtaccttaagcggtcttttgtgggagctgattagaaccatggtcgatcgcgctgaggcggagcgagacgtgttgtttccaggttacacccacctccaacgcgcccaaccaatacggtggtcacactggatactctcccacgccgttgctctcaccagagattccgagagactcctggaggttaggaaaaggatcaatgtactcccactgggatctggagccattgctggcaatccactgggggtcgatcgggagctgctccgcgctgagctgaatttcggcgccattacactgaattccatggacgccacatccgagcgcgacttcgtggcagaatttctcttctgggcctctctttgcatgacacacttatcccgcatggctgaggacctcatcctttattgtaccaaggagttctctttcgtgcagttgagcgacgcctattcaaccggctcttccttgatgccgcagaagaaaaaccctgactctctagagctcattcgtagcaaagcaggcagagtattcgggcggtgcgctggacttctgatgaccctgaagggattaccctccacctataacaaggacctacaagaggacaaggaagccgtatttgaggtatcagacacgatgtctgcggttctccaggtcgcaaccggcgtgatctcaactcttcagatccaccaggagaatatggggcaagccctttcaccggatatgctcgcaaccgacttggcgtattacctggtgaggaaagggatgcccttccgacaggctcatgaagcaagcggaaaggccgtgttcatggctgagacgaagggcgtagctttgaaccaattaagtctccaggagctgcaaacaatcagccctttgttctccggcgacgtaatctgcgtgtgggattatgggcactccgtggaacagtacggtgccctgggaggaaccgcaaggtcctctgtcgattggcagattcggcaggtacgagctctgctgcaggcacaacaagca

SEQ ID NO: 6777 - DNA, 1392 bp, Artificial Sequence
  Description of Artificial Sequence: Synthetic coding sequence
atggcgtccgaatctgggaagctgtggggtggaagatttgtgggagcagtggatccaatcatggaaaagtttaatgcttccattgcctacgatagacatctgtgggaggtggacgtgcaaggctcgaaggcgtactcgagggggttggagaaagcaggactgctcactaaagccgaaatggatcaaattcttcatggtctggacaaggtcgcagaggaatgggcacaaggaacttttaagctgaattccaacgacgaagatatccataccgcaaacgagcgaaggcttaaggaattgatcggagctacggcagggaagctccatactgggaggtcgcgtaatgatcaagtggtgactgaccttagactctggatgcgacaaacctgttcgactcttagcggtttgctctgggaactcatccgtaccatggtggatcgcgcagaggcagagagagatgttctttttcccggatacactcatctgcagagggcacaaccaatcagatggtcgcactggatcctgagccatgcggtggcgcttacccgagattcagaacgcttgcttgaggtgagaaagcggattaatgtccttccgcttgggtcaggtgcaattgccggaaaccctctcggggtggatcgggaacttctccgggcggaactgaactttggagcgattacgctgaattcaatggatgcaacctccgaaagagatttcgttgccgaattcctgttctgggcgtccctttgcatgacgcatctgtcacgaatggcagaagatttgattctgtactgtacgaaggaatttagctttgtccaactgtccgatgcctactccaccgggtcctcactgatgcctcaaaagaagaaccctgattcgctcgagctgatcagatcgaaagcaggacgcgtgtttggacgatgtgcgggccttctcatgaccttgaaaggactccctagcacttacaacaaagatctgcaggaagataaagaagcagtgttcgaagtctcagacactatgtcagcagtgttgcaggtggcaactggtgtcatttccactttgcaaattcatcaagagaatatgggacaagccttgtcgccagatatgttggcaactgacctcgcttactaccttgtccgtaagggaatgccctttcgccaggcacacgaggcatcaggtaaagccgtgtttatggccgaaacgaagggcgtagcacttaatcagctgagcctccaagaacttcagaccatttcgccgcttttttccggtgatgtgatctgtgtctgggattacgggcattcagtggaacaatacggtgcccttggcggaactgcaagaagctccgtggattggcagatacggcaggtccgcgcactcttgcaggcgcaacaggca

SEQ ID NO: 6778 - DNA, 1392 bp, Artificial Sequence
  Description of Artificial Sequence: Synthetic coding sequence
atggcaagtgagtctggaaagctttggggcggccggttcgtaggagccgtggaccccatcatggagaagtttaacgcttccattgcttatgaccgacatctatgggaagtggacgtccaggggagtaaggcgtatagtcgagggctggaaaaagctggccttctcacaaaagctgagatggaccagatactgcatggcctagataaggttgctgaggagtgggcccagggtacctttaaactgaacagcaatgacgaagacatacacactgcaaatgaacgccggcttaaggagctaattggggcaacggcgggtaagctacatactggaagatcccgtaatgatcaggtggtgactgaccttaggctctggatgcgccaaacctgtagtaccctttcagggctcctttgggagctcattagaacaatggtcgaccgggcggaggctgagagagatgtgttgttccctgggtatacccaccttcaaagagcccagccgattcgctggtcacattggatcctcagccacgccgtggcccttacgagggatagtgagcggttgctagaggtgcggaaaagaattaatgtcctgcccctcgggagtggtgccatcgccggcaaccccctcggagttgatagggagttgctgcgcgccgaattaaactttggtgctatcaccctgaattccatggacgccacgtcagagagagactttgtggccgagtttctcttttgggcgtccctgtgcatgacacacctctcgcgcatggccgaggatcttattctatattgcaccaaggaattcagcttcgtgcagctctcagatgcgtactcaacaggatcttctttaatgccgcagaaaaagaaccccgactctctggaactgatcagatcaaaagctggcagggtgttcggaagatgtgctggcttgctgatgaccttgaaagggctgcccagcacatacaataaggacctgcaagaggacaaagaggccgtctttgaggtgtcagacacaatgtccgcggttctgcaagtggctacgggggtaatcagtacccttcagattcatcaggagaacatggggcaggctctgtcacctgacatgctggccacagacctggcctattatctggtgcggaaaggcatgcccttccgacaggcacacgaagcgagcgggaaggccgtgttcatggcagaaacaaagggcgtggctttgaaccagttatctctgcaagagctccagacaataagccccctattttcaggtgacgtcatctgcgtgtgggattacggccattccgtcgaacagtatggggctctcggtgggaccgcacgcagcagcgtagactggcagattcggcaggtgcgagctctgcttcaggcacagcaggcc

SEQ ID NO: 6779 - DNA, 1392 bp, Artificial Sequence
  Description of Artificial Sequence: Synthetic coding sequence
atggcaagtgagtctggcaaactttggggcggacgttttgtcggtgcagtcgatcccattatggaaaaatttaatgctagcatcgcatatgatagacacctctgggaagtggatgtccaaggttcgaaggcctatagtaggggattggagaaggcaggcctattgacgaaagctgaaatggaccaaatcttgcatggacttgataaagtggcggaagaatgggcacaaggcacgttcaagctaaattcgaacgatgaggatatacatacggctaatgagcgtcgactcaaggagctgattggagcgaccgctggaaagctgcacacgggacgttcgagaaacgatcaagttgttaccgatcttaggctttggatgcgtcaaacgtgctcaacgctgtcaggcctgctttgggaacttatccgtaccatggtcgatcgggctgaagctgaaagagatgttctcttccccgggtatacacatctccaacgtgcgcagccgattaggtggagtcactggattttgtcacatgctgtggcactcaccagggattctgaacggttacttgaagtacgtaaacgtattaatgttcttcctcttggatcaggagccatcgcgggcaacccactgggcgtggaccgcgaacttctgcgtgccgaactgaattttggtgcgattaccctcaattccatggatgcaacgtccgaaagagatttcgttgcggagtttttgttttgggcatccttgtgtatgacacatctgtccagaatggccgaagacttgattctatactgcacaaaagagttttctttcgtccaattgtcagacgcttattctacaggttcatcacttatgccgcagaagaaaaatccagattcactagagctcataagatctaaggccggcagagtattcggacgttgtgcaggactcctgatgactctaaaaggtttaccgtctacatataataaagatcttcaggaggacaaggaagcagttttcgaagtttcggacactatgtctgcagtgttgcaagttgcaacgggagtcataagcacgctgcagattcaccaagagaatatgggacaggcactatcaccggacatgctcgctacagaccttgcttattacctagtaagaaaggggatgccgtttcgtcaagctcatgaggccagtgggaaagctgtttttatggctgaaacaaagggagttgcgttgaatcagctgtccctccaggagcttcaaacaatatcgccacttttttcaggggatgttatttgtgtgtgggattacgggcacagtgtcgaacaatacggtgcgctaggaggaacagctcgctcgtcagttgattggcagatcagacaagtccgcgctctgcttcaagcacaacaggcc

SEQ ID NO: 6780 - DNA, 1392 bp, Artificial Sequence; identical to SEQ ID NO: 6776
  Description of Artificial Sequence: Synthetic coding sequence

SEQ ID NO: 6781 - DNA, 1392 bp, Artificial Sequence
  Description of Artificial Sequence: Synthetic coding sequence
atggcctctgaaagcggcaagttgtggggtggcagattcgttggggctgtggatccaattatggagaaatttaatgccagcatcgcctacgacagacacttgtgggaggtggacgtccaagggtctaaggcttactcaagaggcttagaaaaagccggtttgctcacgaaagcagaaatggaccagatattgcacggattggataaggtagcagaagagtgggcgcaggggactttcaagctgaattcaaatgacgaagacatacatacagcaaatgaacgacgattaaaggagctcattggggccaccgcagggaagcttcacacaggcaggtctagaaatgaccaagtggtcactgacctgaggctgtggatgcgccagacgtgctccaccctgagcggtctcctgtgggaattaatcagaaccatggtggaccgtgcagaagccgaacgcgatgtgctcttccccgggtatacccatctacaacgggctcagccaatcaggtggagccactggattctctcacacgcggttgctctaactagagatagtgagcggcttctggaggttcgaaaacgcatcaatgtgctgccacttggcagcggtgctattgctggcaaccccttaggggtggaccgggagctattgagagcggagctgaatttcggtgccattaccctcaatagtatggacgcaacctctgagcgggattttgtagccgaattcttgttctgggccagcctctgcatgacgcatttaagccgaatggccgaagacctcatcctctattgtacaaaagagttctcatttgtacagttgtcagatgcttatagcacaggaagcagcctgatgccccaaaagaaaaatcccgattctctcgagctcataaggtctaaggcgggaagggtattcgggagatgtgccggtttgttgatgactctgaaagggttaccatcgacctacaacaaggacctgcaggaggataaagaggcagtattcgaggtgtccgatactatgtccgccgtgctccaggttgcaactggtgtcatttccactctccaaattcatcaggagaacatgggacaggccctgtcgcctgacatgctggcaactgacctggcgtattaccttgtgaggaagggcatgccctttaggcaggcccacgaagctagcggaaaggctgtgtttatggctgaaacgaagggcgtcgcattaaaccagttgtctctgcaggaactccagactatctcaccactgttctctggggatgtcatatgcgtgtgggattacggccactctgtcgaacagtacggcgctcttggcggcacagcgaggagctccgtggattggcagatacgacaggttagagccctgctgcaggcgcagcaggct

SEQ ID NO: 6782 - DNA, 1392 bp, Artificial Sequence
  Description of Artificial Sequence: Synthetic coding sequence
atggcctctgagtccggaaaactttggggagggagatttgtcggagccgttgatcctatcatggagaagttcaatgcaagtatagcatatgatcggcacctgtgggaagttgatgtacagggatctaaagcatattctagaggattagagaaggccggactgctgactaaggcagaaatggatcagatcctacacgggctcgacaaagtcgctgaggaatgggcacagggaacatttaaactaaactctaacgatgaggatatacatacagccaacgaacggagacttaaagaacttataggagcaactgctggaaaattacatactgggaggtctcgaaacgatcaggtcgtgacagacctcagactatggatgagacagacttgctcgacactgtcggggctgctatgggaactaatacggactatggtggatcgggccgaagcagaacgcgatgtgctgtttcccgggtatactcatttacagagagcgcagccaatccgttggtcccattggatcctcagtcacgcagtcgcactgactagggattccgaaaggctcctcgaagttagaaagcggataaacgtgctgcccctagggtcaggagcaatcgcgggaaatccccttggagtcgatcgagaactgctgagggctgaactcaatttcggagctatcacacttaactccatggatgcaacttcagaacgggatttcgtggctgagttcctattctgggcctccctgtgcatgacacacctatccagaatggcggaagacctaatcctctactgtactaaagaattctcattcgtccagctgtctgatgcttattcaactggaagttcactcatgccccagaagaaaaaccccgactccctcgaactgatacgctctaaagctggacgggtgttcggacggtgtgctggactgctcatgactcttaaaggactcccttctacatacaacaaagatctccaggaagataaggaagccgtatttgaagtaagtgatactatgagtgcggtgcttcaggtggctacaggagtcatctccacactccagatccatcaggaaaatatgggacaggctctctcccccgacatgctcgccacagacttagcttattatttagttcgaaaagggatgccattcagacaggcccatgaggcctccgggaaagctgtctttatggccgagacaaaaggagtagccctaaaccagttgtccctccaggaactccagacaatctcgccactattctcgggagatgtgatatgcgtttgggactacgggcattccgtggaacagtatggggccttagggggaactgctagaagtagtgtggattggcagatccgccaggttcgcgccttgctccaggcccagcaagct

SEQ ID NO: 6783 - DNA, 1392 bp, Artificial Sequence
  Description of Artificial Sequence: Synthetic coding sequence
atggccagcgagtcaggaaagctttgggggggccgtttcgtaggagctgtggatccaatcatggagaagtttaatgcttccatcgcatatgataggcacctttgggaggttgacgtgcaaggtagtaaagcctattcaaggggtctggagaaagccggccttctaacaaaagctgaaatggaccagatactacatggactggataaagtggcagaggaatgggcacaaggtacgttcaaattgaactctaatgacgaggatatacataccgccaacgagcgtagactaaaagaattgattggtgcgaccgctggtaagttgcatacagggaggtcgcgaaatgatcaagtcgtaaccgacctgaggctttggatgagacaaacttgttctacattgtcaggattgttgtgggaactcataagaaccatggtggatagggcagaggcagaacgtgacgtactattccctggttacactcacctccaaagagcacagccgatcaggtggtcgcactggattctctctcatgccgtcgcactcacaagggactctgaaaggttactcgaggtgagaaagcgcataaatgttttgccactgggttctggtgccattgccggaaacccattgggcgtagatcgggaacttcttcgagctgaattgaattttggtgctattaccttgaattctatggatgctacaagcgagcgtgattttgtggccgagttcttgttttgggcttctttatgcatgacccacttatctcgaatggcggaagatcttatcctgtattgtacgaaagaattctctttcgtccaattgtcggatgcatatagtactggaagcagcttaatgccacagaaaaagaaccctgatagtctagaattgattcgttccaaggctggacgagttttcggaaggtgtgctgggttattgatgacattgaagggtctgccgagcacttacaataaggaccttcaagaggataaagaagcagtgttcgaggttagtgataccatgtccgcagtgctacaagttgccactggagttatttcgaccttacaaattcatcaagagaacatgggtcaagcactctctccagatatgctagcaacagacttggcttactatctggtacgaaagggcatgccctttagacaggcacatgaggctagcgggaaggcagtgtttatggcagaaacaaagggtgtcgcactaaatcaactgtcactgcaggagctgcaaaccatatcacctttgttttctggtgatgttatatgtgtttgggactacggtcacagtgttgagcagtatggggcacttgggggtacagctagaagttcggtcgattggcaaatacgccaggtcagagctcttctccaagcccagcaggct

SEQ ID NO: 6784 - DNA, 1392 bp, Artificial Sequence
  Description of Artificial Sequence: Synthetic coding sequence
atggcttcggaatcagggaagttgtggggcgggagattcgtcggcgctgtcgatcctatcatggagaaattcaacgcctctatcgcttatgatcgccatttgtgggaagtggacgtgcaggggtcgaaggcctactcccggggcttggagaaggcggggctgctgaccaaagcagagatggatcagattctgcacggactggacaaggttgcggaggaatgggcacaaggaaccttcaagttgaattctaacgacgaagatatccacactgcaaacgagcgcaggctgaaggaactgatcggagcaactgccggaaaattgcacacgggaagatcccggaacgatcaggtcgttaccgacctgaggctctggatgcggcaaacctgctcaactttgtcgggactgttgtgggagttgatcagaactatggtggatcgcgcagaggccgaacgggacgtcctttttcccggttatacccatctgcagcgagcgcaaccgatccggtggtcgcattggattttgtcacacgccgtcgcgctcacccgggactccgagcgcctgctggaagtgcggaagcggatcaatgtgctgccgctcggaagcggcgccatcgccggaaatccactcggtgtcgatcgggagttgctgcgtgcagagcttaacttcggtgcaattactctgaactcgatggacgccactagcgaacgggattttgtggccgaattcctcttctgggcctcactctgtatgacccaccttagccgcatggcggaggacctgatcctctactgcacgaaggaattcagctttgtgcagctgtccgacgcgtacagcaccggctcaagcctgatgccgcagaaaaagaatcctgactccctggagctcatccgcagcaaggctggacgggtgttcggcagatgcgccggcctgcttatgacgctgaagggactgccgtcgacgtacaacaaagacctccaagaagataaagaagccgtgttcgaagtcagcgacaccatgagcgcagtgctgcaggtggctaccggggttatctcgaccctccagattcaccaggagaatatgggacaggctctgtcgcctgatatgctcgcgaccgacctggcgtactaccttgtgagaaagggaatgccatttagacaagcccatgaggccagcggaaaggctgtgttcatggcggaaaccaaaggagtcgcactcaaccagctgtcgcttcaggaacttcaaactatctcgccgctgttctcgggagacgtgatatgcgtctgggactacggtcacagcgtggaacaatacggcgcgctgggcggtacggcccgctctagcgtggactggcagatccggcaggtccgggcgctgttgcaagctcaacaggcg

SEQ ID NO: 6785 - DNA, 1392 bp, Artificial Sequence
  Description of Artificial Sequence: Synthetic coding sequence
atggcctccgaatcgggaaagctgtggggcggccgattcgtgggtgccgtcgatccgatcatggagaaattcaatgccagcatcgcatacgaccggcacctgtgggaggtggacgtccagggctcaaaggcgtactcgagaggactggaaaaggctggcctcctgacgaaggctgaaatggatcagattctgcacgggctggataaagtggcagaggagtgggcccagggtaccttcaaactgaattctaacgacgaggatattcacactgcgaatgaacggcgcctgaaggagctgattggtgccactgctgggaaacttcacactggacgctcgcggaacgaccaggtcgtgactgacctccggctgtggatgcgccagacctgctcaaccctgtccggactgttgtgggaactgattaggaccatggtggaccgcgccgaagccgagcgggatgtcctcttcccgggctacacccatctgcagcgggcgcagccaatccgctggtcccattggatcctttcccatgcagtcgcgctcacccgggactcagagcgtctgctcgaagtgcggaaacgaatcaatgtgctcccgctgggctcaggcgccatcgcaggcaaccccctgggagttgacagggaactcctgcgggccgaactcaacttcggagcaataacgctgaatagcatggacgcaaccagcgagcgggacttcgtggcggagtttttgttctgggcctccctgtgtatgacccatttgagccggatggccgaagatttgatcctgtactgcaccaaggagttcagcttcgtgcaactgtccgacgcgtacagcactggatcgtcgctgatgccacaaaagaaaaacccagactcactggaactgatccgtagcaaggcaggaagagtgtttggaagatgcgcgggacttctcatgaccctcaagggccttcctagcacttacaacaaggacctccaggaagataaggaagcggtgttcgaagtttccgacaccatgtctgcagtcctgcaggtggcaaccggagtgattagcaccttgcaaatccaccaggagaacatggggcaagccctgagcccggacatgctcgccaccgacctggcatactacctggtccggaagggaatgccattcagacaggcacatgaagcatcggggaaagccgtgtttatggccgagactaagggtgttgctttgaaccaactgtccctgcaggagctccaaaccatcagcccactcttttccggagatgtcatatgcgtttgggactacggtcactccgttgaacagtatggagccctgggagggactgcccgctcttccgtggactggcaaatccggcaggtgcgggcgttgctccaggcccaacaggct

SEQ ID NO: 6786 - DNA, 1392 bp, Artificial Sequence
  Description of Artificial Sequence: Synthetic coding sequence
atggccagcgagtcagggaagctgtggggcggccgcttcgtcggcgcagtggacccaattatggagaagtttaatgcttctatcgcttacgataggcacctgtgggaggtggatgtgcaggggagcaaagcttattcccggggattagagaaggctggtttactgactaaggccgaaatggatcaaatccttcatggactcgataaagtagccgaggaatgggctcaggggacctttaagctcaactctaacgacgaagatatccacactgccaatgaaagaaggctgaaggagctgatcggagctaccgctgggaaactacacaccgggagaagtcgcaatgaccaggtggtcaccgacctgcgtctgtggatgagacagacctgctctaccctgagtgggctcctgtgggaactgatcagaaccatggtggatcgggctgaggcagaacgggatgtgctatttccaggatatactcatcttcagcgggctcagccaatccgctggagtcattggattctgtctcatgccgtggccttaaccagagatagcgaacggctgctagaggtgcggaagagaatcaatgtgctccccctgggctcaggcgctatagccggtaaccctctgggcgtcgaccgagaactgctacgagccgagctcaacttcggcgctataaccctgaattccatggacgccaccagcgaacgggactttgtcgctgagttcttattctgggccagcttatgcatgacccatctgtccagaatggccgaggaccttatactctactgcacaaaagaatttagttttgtccaactgtccgacgcatattccacaggctcttccctgatgccacagaaaaagaaccctgactccctagaactgatcaggtctaaagctgggcgggtgttcggccggtgcgcagggctgctgatgacactcaaagggctcccaagtacatataacaaggacctccaagaagataaagaagcagtctttgaggtgtctgacactatgtccgctgtcctgcaggtggccaccggcgtgataagcaccttacagatacaccaggagaacatgggccaggctctctctccagatatgctggcaaccgatcttgcctattatttggtcaggaaggggatgccttttaggcaggcccacgaagctagcggcaaggccgtgttcatggccgagactaaaggcgtggctctaaaccagttgagcctgcaggagctccagacaatcagtccactgtttagtggcgatgtcatttgtgtttgggattacggccattctgtggagcaatacggcgctctgggtggtaccgcaagaagcagcgtagactggcagataagacaggtccgtgccctgttacaggcacagcaggct

SEQ ID NO: 6787 - DNA, 1392 bp, Artificial Sequence
  Description of Artificial Sequence: Synthetic coding sequence
atggcctccgagagcggtaagctgtggggaggtagatttgtgggggcagtggatccaattatggagaaattcaacgcaagcattgcttatgaccggcacctgtgggaagtggacgttcaaggctccaaggcttactcaagaggactggaaaaggcaggactgcttaccaaagccgaaatggatcagattctccatggccttgataaggtggccgaggaatgggcccaaggaacctttaagctgaactcgaatgacgaagatattcacactgcaaacgagcgcagacttaaggaactcattggagccaccgcggggaagttgcataccgggcggtccaggaacgaccaggtcgttaccgatctgagactttggatgcgacagacctgctcaactctttctggacttctttgggagctgatacggaccatggtggatagggcagaggcagaaagagatgtgctctttcctggatatacccatcttcagagagcccaaccaattcggtggtcccattggattctgtcacacgctgtcgcattgacccgcgactcggaaagacttctggaggtgagaaagagaattaacgtacttccacttggatcgggcgccatcgcaggaaacccgcttggtgtggatagggagcttctgagagcagaactcaactttggtgccatcaccctcaactcaatggacgcaacgtcagaacgcgatttcgtcgcagagttcctgttttgggcttcgctgtgtatgactcatctgtcccgcatggcagaggatcttattctttactgcaccaaagagttttcgtttgtgcaactgtcagatgcatacagcaccggttcatcactgatgccacaaaagaagaaccccgattccctggagttgattagatcgaaagcaggaagagtctttggcaggtgtgcaggtttgcttatgactctgaaaggactgccttctacctacaataaggatctgcaagaggacaaggaggccgtgtttgaagtgtcggataccatgtcggccgtgcttcaggtcgcaactggcgtgattagcactctgcaaatccatcaagagaatatgggtcaagcattgtcccctgatatgctcgcaactgacctggcatactaccttgtgcgaaagggcatgccttttcgtcaggcacacgaagcatcaggtaaggccgtgttcatggctgaaaccaagggagtggctcttaatcagctgtcgctccaggaactccagactatttcgcctctgttttccggggatgtcatatgtgtttgggactacggacattcagttgagcaatacggagccctgggcggaacggcccgttcgagcgttgactggcaaattagacaggtgcgggcactgctccaagcccaacaggcc

SEQ ID NO: 6788 - DNA, 1392 bp, Artificial Sequence
  Description of Artificial Sequence: Synthetic coding sequence
atggcttccgagtcaggcaaattgtggggaggcagattcgtgggcgctgtggaccctataatggagaaattcaatgctagtattgcctatgatagacatctatgggaggtggacgttcagggatctaaggcctattcacgaggccttgagaaggcgggtttgcttactaaggcagaaatggatcagattttgcacggactggataaagtcgcggaggagtgggcccaagggactttcaaactgaacagcaatgacgaagatatccacaccgcaaacgagcggcgtctgaaggaattaatcggcgctactgccggaaagctgcatactgggcgctccagaaacgatcaggttgtcaccgatctgcggctgtggatgcgtcagacctgtagtaccctaagtggcttgctgtgggagctaatccggacaatggtcgacagagctgaggctgagagggacgtactgttcccaggctacacccatctgcagcgggctcaacccatccgttggagccactggatactctcccacgctgttgctctgactcgggattctgaacgcttgctcgaagtgagaaagagaattaacgtgttgcccctgggctctggcgcaattgctggtaacccactgggcgtggatagggagctgctgcgcgccgaacttaatttcggtgcaattaccctgaattctatggatgcgacctccgagagggacttcgtggccgagttcttgttttgggcctcactctgcatgacccacttatcacggatggccgaggatctgattctctattgtacaaaggagttctcattcgtccagctgtcagacgcctatagcaccggatcgagtctgatgccccagaaaaagaatcctgattcccttgagctgatccgaagcaaagccggaagggtgtttgggcggtgtgctggcctcctgatgacactcaagggactgccctcaacttacaataaagacctacaggaggataaggaagcggtgttcgaggtgagtgacacaatgagcgctgtactgcaggtggccacgggagtgatatcaactcttcagatccaccaggagaatatgggacaagccctgtcacccgacatgctcgcaacagacctggcgtactacctagttcgcaaagggatgcccttccgccaggcccacgaggcatctggtaaagccgtgtttatggcggagaccaaaggcgttgccctcaaccagctcagtctccaagaactgcagactatcagcccgctgtttagtggtgatgtgatttgcgtgtgggactatggacattcagtggagcagtacggggccttagggggaacagctaggtccagcgtggactggcagataaggcaagtacgcgcccttctgcaggctcagcaggcc

SEQ ID NO: 6789 - DNA, 1392 bp, Artificial Sequence
  Description of Artificial Sequence: Synthetic coding sequence
atggcttcagaatcaggaaaattatggggtggacgattcgttggagcagtcgatcctataatggaaaaatttaatgcatctatagcatatgatagacatttatgggaagtggatgtacaaggatcaaaagcttattctcgtggattagaaaaagcaggtttattaactaaagctgagatggatcaaattttacatggattagataaagtagccgaagaatgggcacaaggtacttttaaattaaattcaaatgatgaagatatacatactgcaaatgaaagaaggttaaaagaattaattggtgccactgctggaaaactacatactggaagatctagaaatgaccaagttgtaactgatttgagactttggatgagacaaacatgctccacactttcgggtcttctttgggaattaattagaactatggttgaccgtgcagaagcagaaagggatgttttattcccaggatatacacatttacagagagcacaacctattagatggagtcattggattttgtctcatgctgtcgcacttacacgtgattcagaacgacttttagaagttagaaagagaattaatgttctaccattaggaagtggagcaattgcaggaaatccattaggtgttgatagagaattacttcgtgcagaattaaatttcggtgctattactcttaattctatggatgcaacttcagaaagagactttgttgctgaatttcttttttgggctagtttatgtatgacacatttatcaagaatggcagaagatcttattttatattgtactaaagaattctcatttgttcagctttcagatgcatattcaacaggatcttctcttatgccacaaaaaaaaaatccagattctttagaacttataagaagcaaagctggaagagtttttggaagatgtgcaggtcttttaatgacattaaaaggacttccatcaacttataataaggacttacaagaagataaagaagctgtctttgaagtttcagatacaatgtctgctgttttacaagttgcaacaggagttatatctactttacagattcatcaagagaatatgggacaagcacttagtccagatatgttagctacagatcttgcatattatcttgtcagaaaaggaatgccttttcgtcaagctcacgaagcatcaggaaaagcagttttcatggcagaaactaagggagtagctcttaatcaattatccttacaagaacttcaaactatttcaccacttttctctggagacgtcatttgtgtttgggattatggacacagtgtagaacaatatggagctttaggtggaactgcaagatcaagtgttgattggcaaattcgtcaagttcgagcattattacaagcacaacaagca

SEQ ID NO: 6790 - DNA, 1392 bp, Artificial Sequence
  Description of Artificial Sequence: Synthetic coding sequence
atggcctcggaatcaggtaaactctggggtggtcggtttgtcggtgcggtggaccctataatggagaaattcaacgcgtcgatcgcatacgaccggcacctctgggaggtggacgtgcaaggatccaaagcatactcccggggtctggaaaaggcgggacttctcaccaaggccgaaatggatcaaattctgcacggtcttgataaggttgcagaggaatgggctcaaggaacctttaagctgaattcaaacgatgaggatatacataccgcaaacgaacgcaggctgaaagaactgattggcgcaactgcaggaaagctccatactgggagatcccgtaacgaccaagtcgtcaccgatcttaggctttggatgaggcaaacttgtagcactctctctggactcctttgggagcttatccgaactatggtcgatcgggcagaggcagaaagagacgttcttttccccggatacacgcatctgcaacgggcacagcctatccgctggagccattggatactgtcacacgccgtggcgcttactcgtgattccgaaagacttcttgaagtgaggaagcgcattaacgtcctcccactgggatcaggagctatagcgggaaatccgcttggcgtggaccgtgagctgctccgtgccgagctgaactttggagcaattactctgaactctatggatgcgacttcggagcgtgattttgtcgcagaatttctgttttgggcaagcctttgcatgacccacctgagccgcatggcagaagatctgattctttactgtaccaaagagttcagctttgtgcaactgtctgatgcatactcaacgggtagctcgctcatgccacagaagaagaatcctgactcgctggaacttattagatccaaggcgggtagagtgttcggaagatgtgcaggactgctgatgacccttaagggactgcccagcacgtacaataaggatcttcaagaggataaagaagccgtgtttgaagtgtccgatactatgtctgcagtgttgcaggttgcaacgggagtcattagcacccttcaaatccatcaagaaaacatgggacaggcactctcgcccgacatgttggccacggatctggcgtactacctcgtgagaaaaggcatgccatttagacaagctcatgaagcatccggcaaggcagtgttcatggccgagactaagggagtggcattgaatcaactttctctgcaagaactgcaaaccatttcgcctcttttttcgggtgatgtgatttgcgtgtgggactacgggcattccgtggaacagtatggcgctctgggtggaacggcacggtcgtcagtggactggcagattaggcaggtccgggcactcctccaagcacagcaggcc

SEQ ID NO: 6791 - DNA, 1392 bp, Artificial Sequence
  Description of Artificial Sequence: Synthetic coding sequence
atggcctctgagtctggtaaactgtggggaggcagattcgtcggtgccgtcgatcccattatggagaaattcaatgcctctatcgcctacgaccggcacctgtgggaggtggatgtccagggctccaaagcttacagtagagggctcgagaaggctggtctgctcactaaagcggaaatggatcagatcctgcatggtctggacaaagtggctgaggagtgggcccagggcaccttcaaacttaacagtaatgacgaagatatccataccgctaacgaacggcgcctcaaagaactgatcggtgcaaccgccgggaaattgcacaccgggcgctctaggaatgaccaggtcgtgactgatctcaggctctggatgagacaaacttgcagcacacttagcggccttctgtgggagctcattaggaccatggtagatcgggcagaggcagaaagagatgtcctgttcccgggatacacgcacctgcaacgggcccaaccaattagatggtcacattggatcctgtcacatgcagttgccttgactagagattcagagcggctgctggaggtgcggaaacgcatcaatgtcctgcctctcgggtccggagccatcgccgggaacccccttggggtggatcgagagcttctccgcgccgagcttaactttggggcaataacattgaattccatggacgccacatccgaacgagactttgtcgctgaatttttgttctgggccagtctgtgtatgacccaccttagtcgaatggctgaggaccttattctctactgcactaaggagttctcattcgttcaactgagcgatgcttactccactggctcttcactgatgccccaaaaaaaaaatcccgactccttggagcttatccggtcaaaggccgggcgcgtatttgggcggtgtgcaggattgttgatgacccttaagggtctgccctccacttacaacaaggacctgcaggaggacaaagaggcggtgttcgaggtgagcgacaccatgtctgctgtgctgcaagttgccactggggtaatctccactctgcagatacaccaggaaaacatgggtcaagcgctttctccagacatgctggctaccgaccttgcttactacctggttcgaaaaggcatgccatttcgccaggcacacgaggcatccggtaaagctgtgtttatggctgagacaaagggtgtggcgctgaaccagctgtctctgcaggagctgcaaacgatcagtccgctgttttccggtgacgttatctgcgtttgggactatgggcatagtgtggagcagtatggcgctctgggaggcacggcccgcagcagcgtggactggcagatccggcaggtgagagctctcttgcaggcacaacaagcc

SEQ ID NO: 6792 - DNA, 1392 bp, Artificial Sequence
  Description of Artificial Sequence: Synthetic coding sequence
atggcttccgagtctggcaagctatggggaggtagattcgtgggagctgtcgatccaatcatggagaagtttaacgcgtcgatcgcatatgataggcatctgtgggaggtggacgtccagggatctaaggcatacagtcgcggcctggaaaaagccggcctgcttacaaaggctgagatggatcagatcctccacggtttggataaggtcgcagaagagtgggctcagggcacattcaagctaaattcaaatgatgaggacatccacaccgccaacgaacggaggttgaaggagctcataggggcaacagcaggcaagttacacaccgggagaagcaggaacgaccaggtcgtaaccgacctacgactgtggatgcgacagacctgctccactctttccgggctcctgtgggaactgattcgcacaatggtcgacagagccgaagctgaacgggatgtcttattccctggctatacgcatctgcaacgtgcccagcccatcaggtggagccattggattttgtcccatgcggtggccctcacaagagatagtgagagactgttggaagtgaggaagaggatcaacgtgctgccgttgggctccggagctattgccggcaacccattaggggtggatcgcgagctcttgagggctgagctgaatttcggcgctatcaccctgaattccatggacgccacctccgagcgagactttgtggccgaatttcttttctgggcaagcctctgcatgacacacttgtcccgaatggccgaggatttgatcctctattgcacaaaggaattttcattcgtgcagttatccgatgcttactccaccggctcctccctcatgcctcagaagaaaaatccagactctctcgaactgatcaggagcaaggctgggcgagtttttggccgttgtgctgggctcctgatgacactcaaagggctgcccagcacctataataaggatctccaggaggataaagaagcagtatttgaggtctccgataccatgtccgccgtattacaggtcgctactggagtcatcagtacacttcagatacatcaggagaatatgggccaggccttgtctccagatatgcttgccaccgatttggcatactacttagtgcgaaaaggcatgcccttcagacaggctcatgaggcatcggggaaggcagtgttcatggctgagaccaaaggagtagcccttaaccagctctcccttcaggagctacaaacgatcagcccactgttttcaggggatgtcatatgtgtgtgggactatggccatagcgtcgaacagtatggtgccttaggaggaacagccagatccagcgtggattggcagattagacaagtccgagcactgttgcaggcccagcaagct

SEQ ID NO: 6793 - DNA, 1392 bp, Artificial Sequence
  Description of Artificial Sequence: Synthetic coding sequence
atggctagcgaaagcggtaagctgtggggtgggaggttcgtgggcgctgtagatcctattatggaaaaattcaacgcctccatcgcatacgaccgtcacctgtgggaggtggatgtgcagggctccaaggcctatagccgcgggcttgagaaggccggtcttctcactaaggctgaaatggatcagattcttcatgggttagacaaagttgccgaagagtgggcccagggcacattcaaactgaattcaaacgatgaggacatacacacagcaaacgaaagaaggctgaaggagctcattggagccacggcgggcaagctccacacaggacggagtcgcaacgatcaagtcgtaactgacctgcgtctctggatgcggcagacctgttcaaccttaagcggattgctttgggagcttatccggaccatggtagaccgggccgaggctgaacgggacgtgctattccccggctatacccatctgcagcgggctcagcccattcgctggtcccattggattttgagccacgccgtggcactaacgagggactctgaacggcttctggaggttcggaagcgcattaacgtgctaccacttggatccggcgcgatagctggcaacccactgggggtcgatcgggagctactcagggcggaactgaacttcggagctattacgctgaactccatggacgccacaagcgagagggactttgtggctgagtttctgttctgggcctcactctgtatgacccatctgtctaggatggctgaagatttgatcttgtactgcactaaggaattctccttcgtgcagctcagcgatgcatattccactgggagcagtctcatgccacagaaaaaaaaccccgatagcctcgagcttatcagatccaaggccggccgtgtgttcggtcgatgtgccggattgctaatgacgctgaagggcttgccatccacctacaataaggaccttcaggaagacaaggaagccgtgttcgaagtgagcgacactatgtctgccgtattacaggtggctacaggggtgatctccactctgcagatccatcaggaaaacatgggccaggcactgagccctgacatgctggcgactgatctggcatattacctggtgcggaaaggtatgccattccggcaggctcacgaagcctcaggcaaggctgtttttatggccgagaccaagggagtagctctcaatcaattgtccctgcaggaactccagacaataagccctttgtttagtggagatgttatctgtgtctgggattacggtcatagcgttgaacagtacggtgccctgggaggaacagcccggtcgagtgttgattggcagatccggcaggtgcgagccctcctgcaggcacagcaggcc

SEQ ID NO: 6794 - DNA, 1392 bp, Artificial Sequence
  Description of Artificial Sequence: Synthetic coding sequence
atggcgtcagaatccggcaaactctggggcggtcggttcgtgggagccgttgacccaatcatggaaaagttcaacgcaagcattgcgtacgataggcacttgtgggaggtggatgtccaggggtccaaggcctattcacggggactcgagaaggcagggctccttaccaaagccgagatggaccagattttgcatggattggacaaggtcgcagaagagtgggcccaaggcacttttaagctcaactccaatgacgaggatattcacacggcgaacgaacgtagactgaaggagctgatcggagccaccgcaggtaagctgcacactggacgctcgagaaatgaccaagtggtgaccgatctcagactgtggatgagacaaacctgttccacgttgtccggattgctctgggaattgatcagaactatggtggaccgcgctgaggccgaacgcgacgtgctgtttcccggctacacccacctgcaacgggctcagcctatccgctggtcccattggatcctgtcgcacgcagtggcactcactcgggactcggaaaggttgctcgaagtcagaaaacgcatcaatgtgctcccgttggggagcggagcgatcgcaggaaacccgctcggagtcgatcgggagctgctgcgggctgaactcaatttcggcgccatcactctgaattcaatggatgccacttcggaacgggatttcgtggcagaatttctcttctgggcctcactgtgcatgacccatcttagccgcatggcggaggacttgattctctattgcactaaagaatttagcttcgtccagctctccgacgcctattctaccgggtcgtccctcatgccacagaaaaagaacccggacagcctggaactgatcaggtcaaaggcgggaagagtgttcggccggtgtgcagggctcctgatgaccctcaagggtctgccgtcaacctacaacaaggatctccaagaggacaaggaagccgtgttcgaagttagcgacactatgtccgctgtcctccaagtcgccacgggcgtgatcagcacgcttcagatccaccaggagaacatgggccaggctctttcgccggatatgttggctactgatctggcatactacttggtgcgcaagggaatgcctttccggcaagctcacgaagcatcaggaaaggcagtctttatggcggagactaagggtgtcgctctgaatcaactgtcactccaggaactgcagaccataagccctctgttctcgggcgatgttatctgcgtgtgggactacggacatagcgtggagcaatacggcgcgctggggggtactgcccgctcaagcgtggactggcagatccgccaggtgcgcgctctgctgcaagcccagcaggct

SEQ ID NO: 6795 - DNA, 1392 bp, Artificial Sequence
  Description of Artificial Sequence: Synthetic coding sequence
atggcgtcggagtcgggcaagctctggggtggacgcttcgttggagcagtcgaccccattatggagaagttcaatgcaagcatcgcatacgatcgccacctctgggaggtggatgtgcaaggatcgaaggcatactcgcggggacttgagaaggcagggcttcttaccaaggccgagatggatcagattctgcatggcctcgataaggtggcagaagaatgggctcaaggcacctttaaactgaacagcaacgatgaggatattcataccgcaaacgaacgtaggctcaaggaactgattggtgcaacggcaggcaagctgcataccggaagatcccgaaacgatcaggtggtcacggacctgagactctggatgcgacagacgtgtagcacccttagcgggctgctgtgggagctcattcgcacgatggtcgatcgtgcagaagccgagcgcgatgtgctctttcctggttacactcatcttcagagggcccaaccgattagatggtcccattggattctttcacatgcagtggcgcttacgagggactccgaacgactcctggaggtccggaagagaatcaatgtcctgccactgggatccggtgcaattgccggaaaccctttgggagtggacagagagctgcttcgcgcggaactcaacttcggagcaattactctgaactccatggacgcaacctcggaaagggattttgtcgctgaatttctgttctgggcgtccctctgcatgacccacctgtcccgcatggcggaggatctgatcctttactgcaccaaggaattctcctttgtgcaattgtcggacgcctacagcaccggatcatcgctcatgccacaaaagaaaaatcctgattccctggagcttatccgcagcaaggcaggaagagtgtttggacggtgtgcagggctgctgatgaccctcaagggacttccttctacttacaacaaagatctgcaggaagataaggaagcagtgtttgaagtgtcggataccatgtccgccgtgcttcaggtcgcaaccggagtgatatcgactctgcagatacaccaggagaatatggggcaggcactctcgccagatatgctggcaaccgacctggcttactacctcgtccggaagggtatgccttttcggcaagcacatgaggcgtcaggcaaagcagtgtttatggctgagactaagggggtcgcccttaaccagctttcgttgcaagagctccagactatcagcccactgttttccggagatgtgatttgtgtgtgggactacggacattcagtcgaacaatacggagcacttggcggtacggcaagatcatcggtcgactggcagatccggcaggtgagagcccttctgcaagcccaacaagca

SEQ ID NO: 6796 - DNA, 1392 bp, Artificial Sequence
  Description of Artificial Sequence: Synthetic coding sequence
atggccagcgagagtggcaaactgtggggaggtaggtttgtgggcgctgtagaccccataatggagaaattcaatgcctccatcgcctatgaccggcacttgtgggaagtggatgtgcaggggagcaaggcatactcaagaggcctggaaaaggcgggcttactgacaaaagcagagatggatcagattctgcacggattggataaagtggccgaagagtgggcacagggtacttttaagctgaattccaacgatgaggacatccatacggctaatgaacgccggcttaaggaactgatcggcgctaccgctggcaaattgcataccgggaggagtcgaaacgatcaggttgtgactgacctgaggctgtggatgaggcagacctgttctacactgtcaggtctcctctgggagctcatcaggaccatggtcgatcgggctgaggccgagcgagacgtcctcttcccaggctatacccatctgcaacgggcccaaccaataaggtggagtcattggattttgagtcatgctgtggcactgactagggactccgaaaggctgctcgaagttaggaaaagaattaacgttcttcccctgggatccggcgctatcgcagggaaccccctcggggttgacagggagctccttcgggctgaacttaacttcggcgctattaccctgaactccatggatgccacctccgaacgagacttcgttgccgagtttcttttctgggctagcctgtgcatgactcacctctcccgaatggccgaagacttaatactgtattgcaccaaggaattttcctttgtacagctctctgacgcctactcaacaggatcttcactgatgccacagaagaaaaaccctgactcactggagctaattagaagcaaggccgggagagtgttcggtaggtgcgccggactgcttatgaccctgaaagggcttccaagtacatataacaaggaccttcaggaggataaggaggccgtatttgaagtttccgatacgatgagcgccgtgttacaagtggcgacaggagtaattagcacgttgcagatccatcaggaaaacatgggtcaggccctctcacctgatatgctcgccaccgacctcgcctattacctcgtgaggaagggtatgccgttccggcaggcgcacgaagcatctggcaaggccgtgttcatggctgaaacgaagggcgttgccctaaatcagctctctctgcaggaactgcaaacaatctctcccctctttagcggcgacgtgatatgcgtatgggattatggccacagtgtggaacagtacggagcgcttggggggacagcacgtagctctgtggattggcagatccggcaggtccgcgctttgctgcaggcgcagcaggcc

SEQ ID NO: 6797 - DNA, 1392 bp, Artificial Sequence
  Description of Artificial Sequence: Synthetic coding sequence
atggcgtcggaatcgggaaagttgtggggagggaggttcgtgggagctgtagacccgatcatggaaaagttcaatgcctccatcgcatacgaccgacatctctgggaagtcgacgtgcagggaagtaaagcatacagccggggtctggagaaggcgggtctgctgactaaagcggaaatggaccagatcctgcacggactggacaaggtggcagaagagtgggcgcagggcacttttaagctcaactccaatgacgaggatatccatacggccaatgagcgtcggctgaaagaactgatcggtgctactgctggtaaactgcataccggtcgctccagaaacgaccaagtggtgaccgatcttcgcctctggatgcgacaaacctgcagcactctctccgggctgctctgggaactgattcgcactatggtcgaccgagcagaagcggagcgcgacgtcctgttcccgggatacactcacctccaaagagcccaacccattagatggtcccactggattctgagccatgcagtggctttgacccgcgactcggagagactcctcgaagtccggaagaggataaacgtgcttccattgggttctggcgcgatcgcgggaaacccactgggagtcgatagggaactcctgcgcgccgaattgaacttcggcgccattacgttgaactcgatggacgcaacttccgagagagatttcgttgccgaattccttttctgggcttctctgtgcatgacccacctgagccggatggcggaggatctgattctgtactgcactaaggaattttcattcgtccagctgtccgatgcgtattcgacggggagcagcctgatgccgcagaagaagaatccagattcgctggagttgatcagatcgaaggccggacgggtgtttggacggtgcgccggtctgcttatgaccctgaaagggctcccgtccacgtacaacaaagacctgcaggaggacaaggaggctgtgttcgaagtctccgataccatgtcggctgtcttgcaggttgccaccggcgtgatatcaaccctccagatccatcaggaaaacatgggccaagccctgtcaccagacatgctcgcgactgatcttgcatactacctggtgagaaagggaatgccgttccgccaagcgcacgaggcatcaggaaaggccgtgttcatggctgaaacgaaaggagtagcactcaatcagctgtcgctgcaagaactccagactatctccccgctttttagcggagacgtgatctgtgtctgggattacgggcactcagtggaacagtacggagcactcggggggaccgcgcgctcctcagtggactggcagatccgccaggtgagagctctgttgcaagcgcaacaggcg

SEQ ID NO: 6798 - DNA, 1392 bp, Artificial Sequence
  Description of Artificial Sequence: Synthetic coding sequence
atggcttctgaaagtggcaaactgtggggaggaaggttcgtgggagctgttgatcctataatggagaaatttaacgcctctatcgcttacgatagacacttgtgggaagtggacgtgcagggcagtaaagcgtattctcgcggcttagaaaaagccggcttgttgaccaaagccgagatggatcaaattttgcacggccttgacaaggtcgcagaggaatgggctcagggtacctttaaactgaactcaaatgatgaagacatccacacagcaaacgaaagaagattgaaggaacttattggagcaaccgctggaaagctgcacacaggccgctcaaggaatgatcaagtggtgactgatctgcgcctgtggatgcggcagacctgcagcacactgtctggcctgttgtgggagctcattagaacgatggtggacagggccgaagccgagcgggatgtcctgtttcccggatacacacatctccagcgggctcaacctatcaggtggtcacattggatcctgtcccatgctgttgcattgacacgcgattcagagcgactgctagaagtacgcaagcgaatcaacgtgttgccactgggcagcggagcgatcgcaggcaacccactgggtgtggatcgcgaactcctgagggcagagctcaatttcggagctataacgttaaactccatggacgccacctctgaaagggacttcgtggctgaatttctgttttgggccagcttgtgcatgacccacctaagcaggatggcggaggaccttatactttattgcaccaaggagttcagttttgtgcagctcagcgatgcatattccaccggtagcagcctgatgccccaaaaaaaaaatccagatagccttgagttgatccggagcaaggcaggtagggtcttcggcaggtgcgcaggactcctgatgaccttaaagggcttgccgagcacctacaacaaagatctacaggaagataaggaagctgtgtttgaggtttccgacactatgtctgctgtgttacaggtggcgactggcgtgattagtactctgcaaatccaccaagaaaacatgggccaagcattatcaccagacatgcttgctactgacctcgcatactatctcgttaggaaaggcatgcctttcagacaagcgcatgaggcttccggaaaggcagtcttcatggcagaaacaaaaggcgtggccctaaaccaactgtctcttcaagaacttcagacaataagccccctgttctctggagatgtgatttgtgtctgggattacggccacagcgtggagcaatacggcgctctgggcggaaccgcgagatctagtgtggattggcaaatccgtcaagtgcgcgcgttgctgcaggcgcagcaagcc

SEQ ID NO: 6799 - DNA, 1392 bp, Artificial Sequence
  Description of Artificial Sequence: Synthetic coding sequence
atggcttccgaaagtggcaaattgtggggaggacgctttgttggagcagtggatcctatcatggagaaatttaatgcatcgattgcatacgataggcatttgtgggaggtcgacgttcaagggagtaaagcctattcgcgtggactagaaaaggctggcctgttgacgaaagctgagatggatcaaattctgcatggtcttgataaagtcgctgaagaatgggcccaaggtacattcaaactgaattctaatgatgaagacattcatacagctaacgaacgtagacttaaagaacttattggtgcgacggctggcaaactgcacacgggcagaagcaggaacgatcaagtcgtcacagacttgagattatggatgcgccaaacgtgtagcactttatccggcttgttgtgggaactcattcgtacaatggtagatcgtgctgaagctgaaagagatgttctttttccgggatacacacatcttcaaagggcacaacctattagatggagccattggattttatcccacgccgtcgctctaactcgcgactcagagagacttttagaagtaagaaagcgtatcaacgtactcccgttgggctcgggtgcaatcgctggcaatccgcttggcgttgatcgggaactgttaagagcggagttgaactttggggccatcactctgaattcaatggatgcgacctcagagcgggattttgttgctgagtttcttttttgggctagcttatgcatgactcatctgagccgcatggcagaggacttaatcttgtactgcacaaaagaattttcttttgttcaactcagcgacgcatatagtactggaagctcgcttatgccgcagaaaaagaatccagactccttagaattgatcaggtcaaaagctggccgcgtttttggaaggtgtgcgggtttacttatgacattaaagggtttgccaagcacgtacaacaaggaccttcaagaagataaagaagctgtttttgaggtgagcgatacaatgtccgctgtgctgcaggtggccactggtgttattagtacattacaaattcatcaagaaaacatgggacaagcgctttctccggatatgttagcgacagatttagcatattatcttgtcagaaaggggatgcctttcagacaagcgcacgaggcttctggaaaggccgtctttatggctgagactaaaggcgtagctttgaaccagctgtctctgcaggagctgcaaacgatctcacccctgttttcaggagatgtcatatgtgtgtgggattatggacattccgttgaacagtatggggctttgggcggtacagcacgcagctccgttgattggcaaatacgccaagttcgcgcattgctacaagcccagcaggca

SEQ ID NO: 6800 - DNA, 1392 bp, Artificial Sequence
  Description of Artificial Sequence: Synthetic coding sequence
atggcaagcgaatctggaaagctgtggggaggacggttcgtaggggctgttgatcccataatggagaagtttaacgctagcattgcatacgataggcatctatgggaggtggacgttcaaggttctaaagcttactcaagaggcctcgagaaagctggtcttctcaccaaggccgaaatggaccagattttgcacggcctggacaaggtcgctgaagagtgggcccaaggaacattcaagctgaattctaatgacgaagatatccacacagctaatgagagaaggctcaaggaactgataggagctacggcaggcaagcttcataccggcagatcacgcaatgatcaggtggtgaccgatctcagactgtggatgcgccagacctgcagtacactttccgggctcctgtgggagcttatccgtacaatggttgatagggcagaggctgagcgcgacgtgctgttccccggatacacacacctgcaacgtgcccagcccattaggtggagccactggattcttagtcatgcagtggccctgaccagggactccgaaagattgttggaagtgaggaagcggataaacgttcttccccttggatctggagcgatcgcaggaaatccattgggcgtcgacagagagttgcttagagccgagctgaactttggggcaatcaccttgaactccatggatgccacctcagaaagagattttgtagccgagttcttgttctgggcaagcctctgcatgacacatttaagtaggatggctgaggatctgatcttgtactgcaccaaagaatttagttttgtgcaacttagtgatgcgtacagtactgggtctagtctcatgccccaaaagaagaatcctgactcactggagttgattagaagcaaggctgggagagtgttcggaaggtgcgctggcctgctgatgacgctgaagggattgccttcaacttacaataaggacttgcaggaagacaaagaggctgtgttcgaagttagcgacactatgagtgctgtattgcaggtggccaccggagtgattagcacactgcagatacaccaggagaatatgggtcaggctctcagcccggacatgctcgcgactgatttggcctactatctagttagaaagggaatgccatttcgccaggcacacgaggcctcgggtaaagctgtctttatggcagaaacaaaaggcgtggccctcaaccagctctctcttcaagaattgcagaccatcagcccacttttttccggtgacgtgatttgcgtgtgggactacggacattccgtagagcagtacggcgcgctcggaggcaccgcgcgatccagcgttgattggcaaattaggcaagtcagggctctcctccaagcccaacaggct

SEQ ID NO: 6801 - DNA, 1392 bp, Artificial Sequence
  Description of Artificial Sequence: Synthetic coding sequence
atggccagtgaatctggaaagctgtggggagggaggtttgtgggtgccgtggacccgatcatggaaaagtttaacgcatccatcgcctacgaccgccacttgtgggaggtggatgtgcaaggcagcaaggcatactcgagaggcctcgaaaaagccggactgctcaccaaagcggagatggatcagattctccacggattggacaaggtggcggaggagtgggcccagggaaccttcaagctgaactctaatgatgaggacatccacaccgccaacgagagacgccttaaggagctgataggagctaccgcgggaaagctgcatactggaagatcccggaacgaccaagtggtgaccgatctgagactgtggatgcggcaaacgtgtagcactttgtcgggcctgctgtgggaattgatccggaccatggtggaccgcgcagaagcggaacgggacgtgctctttccgggatacacccacttgcagcgggcacagccgatccgctggtcccactggatcctgagccatgcggtggccttgacgcgcgactcggagagactcctcgaagttaggaaaagaatcaatgtcctccccctgggaagcggggcgatcgctggaaaccctctcggggtggacagggaactgctccgggcggaactgaattttggagccatcaccctcaattccatggacgccacctcagaacgcgacttcgtggccgagttcctgttctgggcctccctgtgcatgacccacctgtcacggatggccgaggacctgattctctactgtaccaaggaattctccttcgtccaactgtctgacgcctactcgactggctcctcactgatgccgcagaagaagaacccggattctttggagctgatccgctcgaaggcgggccgggtctttggacgctgtgctggccttctgatgaccctcaagggcctgccttcgacttataacaaggacttgcaggaggataaggaagcggtctttgaagtttccgatactatgtcggccgtgcttcaggtggccaccggagtcatcagcactctgcaaatccaccaagaaaacatgggacaggccctttcgccagacatgttggccactgatctggcttactacctggtccgcaagggaatgcccttccggcaagcccacgaagccagcggaaaggcagtattcatggcggaaaccaagggcgtcgctctgaatcaactctcgctgcaggaactgcagacgatctcaccactgttcagcggagacgtgatctgcgtgtgggactacggtcactctgtggagcagtacggagctctgggaggcacggcaagaagcagcgtggactggcaaatccgccaagtgcgagcacttctccaagctcagcaagct

SEQ ID NO: 6802 - DNA, 1392 bp, Artificial Sequence
  Description of Artificial Sequence: Synthetic coding sequence
atggcctccgaatctggaaaactttggggggggagatttgttggagctgtagatccaatcatggaaaagttcaacgcctctatcgcctacgatcgccacctctgggaagtggatgttcaggggtctaaagcttattctaggggattagagaaagctggattattgacaaaagccgaaatggatcagatcctccacggattggacaaagtggcagaagaatgggcgcaggggactttcaagctgaattccaacgacgaggacattcatacagcaaatgagcgccggctcaaggaattaattggagctacagctggaaaactccatacagggaggtcacgaaacgatcaggtagtaacagatttgaggctctggatgagacagacttgttcaactctcagtgggctcctgtgggaattgatccggactatggtggatagagctgaagcagagagggatgtgctgttcccaggatatacacatctccaacgcgcccagcccattcggtggtctcattggatcctttctcacgctgttgctctcactcgggattccgaacggctgctcgaagtgcgaaagcgcatcaatgttctaccactcgggtctggagcaatcgccggaaaccctctcggagtcgatcgggaactcctacgcgctgaacttaatttcggggctattacattaaactccatggatgccacatccgagcgggactttgtcgcagagtttctcttctgggcatccctttgcatgacacatcttagtagaatggctgaagatctaattctatattgtactaaagaattctccttcgtacagctgtctgatgcctattcaacggggtcctcattaatgccacagaaaaaaaaccccgattctctcgaactcattcgatcaaaagccgggcgggtatttgggagatgtgctggactcttaatgacactgaaaggactcccctcaacttataataaagatctgcaggaagataaagaagccgtgtttgaagttagtgatacaatgtccgctgttctacaggtggctactggggtcatcagtacactccagattcatcaggaaaacatggggcaggccctgtctcctgatatgttagctactgatctagcatattaccttgtgcgaaaagggatgccattcaggcaggcgcacgaagcatccgggaaagctgtttttatggctgaaactaaaggggtggcactgaaccagctcagtcttcaggaactgcagactataagtcctctgttttcaggagatgtgatatgtgtatgggactatggacacagtgtggaacagtatggagccctgggaggaactgctcggagttctgtcgattggcagatcagacaggtaagggccttactacaggcacagcaagca

SEQ ID NO: 6803 - DNA, 1392 bp, Artificial Sequence
  Description of Artificial Sequence: Synthetic coding sequence
atggccagtgagagtggtaaattgtgggggggacgatttgtcggcgcggttgaccctatcatggagaaatttaatgcctcaatcgcctacgatcgccacctgtgggaggtggacgtgcagggatcgaaggcttactctcgcggactcgagaaggcagggctgttgaccaaagccgagatggaccagatcctgcatggtctggataaggtagccgaggagtgggcccaggggacattcaaattaaattctaacgatgaggacattcatactgccaatgaacgccgtctgaaggaactcattggggccactgccggaaagttgcatactgggaggtcaagaaatgatcaggtagttacagatttgcgcctatggatgcgccagacatgctccacactttccgggctgctgtgggagctcatcaggactatggtcgatagagccgaggcagagagagatgtgctcttcccgggatacacacacctgcagcgggcccaacccatcagatggtcacactggattctttcacatgccgttgccctgacgagggattccgaacggctgctggaggtccggaagaggataaatgtcctccctctagggtccggagctatcgccggtaatccactcggagtggaccgggagcttcttcgtgccgagctcaatttcggtgctataacactgaacagtatggacgccacctcagaacgggattttgtggcagagttcttattctgggcatccctgtgcatgactcacctaagtaggatggcagaagatctgattctgtactgcacaaaggagttctcgtttgttcagctgtcagatgcgtattccaccggctccagcctgatgccacaaaaaaaaaaccccgattctctggagttgatccggtctaaggcaggccgcgtcttcgggcgctgcgccggactgctcatgactctcaagggcttgccttccacctacaataaagacctgcaagaagataaggaagctgtatttgaggtgagcgacacgatgagtgcggttcttcaggtggcgacgggcgtgatttcgacactgcagatccaccaggagaacatgggtcaggcactctcaccggatatgttggctaccgatctggcatactatttggtaagaaagggcatgccttttcggcaggcacatgaggctagcggaaaggcggtgtttatggccgagaccaagggagtagccttaaaccagctaagcctgcaggagctgcagactatttcccctctgttttcgggtgatgtaatctgtgtctgggattacggtcactcagttgagcaatatggcgctctgggcgggactgcccgttcctccgttgattggcagatcaggcaggtcagagctctcctccaggcgcaacaggcc

SEQ ID NO: 6804 - DNA, 1392 bp, Artificial Sequence
  Description of Artificial Sequence: Synthetic coding sequence
atggcttctgaatcgggaaaactgtggggtggacggttcgtcggcgccgtagaccctataatggagaaattcaacgccagtatcgcttacgacaggcacctgtgggaggtcgacgtgcagggctcgaaggcgtatagccgaggtcttgaaaaagcgggcctgcttaccaaggcggagatggaccaaatcctgcacggactggacaaagtcgcagaggagtgggcgcagggaaccttcaagctgaattcgaacgacgaagatatccacaccgccaacgagcgccgcctgaaggaactcatcggggctaccgctggaaaactgcataccggacgctcgaggaacgatcaggtcgttacggacctccgactgtggatgagacaaacttgttcgacgctgagcgggctgctctgggaactgattcgtactatggttgaccgggcagaagctgaacgcgacgtgctctttcctggctacactcacctccagcgcgcgcagccgatccgctggtcccattggatcctgtcccatgctgtggcgctcaccagggatagcgagagactccttgaagtcagaaagcggatcaatgtgctcccactgggatccggggctatcgccggcaacccgctcggagtggatcgcgaactgctcagagcggaactcaatttcggagccattaccctgaacagcatggatgccacctcagagagagatttcgtggcagaatttcttttctgggcgtcattgtgcatgacccacttgagtagaatggctgaggatctcattctgtattgcacgaaagagttctctttcgtccagctctcagacgcctattccacgggatcgtcccttatgccgcagaagaagaatccggacagcttggaactgatccgttcgaaggcgggccgcgtgttcggtcgctgcgctgggcttctcatgactctcaagggattgcccagcacttacaacaaggacttgcaagaagataaggaggctgtgttcgaggtgtcggacaccatgtcggcagtgctccaggtggccacgggtgtcatcagtactctccagattcatcaagagaacatgggacaagccttgtccccagatatgttggccactgatctggcctactacctggtccgaaagggaatgccttttcggcaggctcacgaagccagcggaaaagccgtgttcatggccgaaactaagggagtggccttgaatcagctgtcactccaagagctccaaaccatctcgccactgtttagcggagacgtgatctgcgtgtgggattacggtcactcggtggagcaatacggagctctgggaggaaccgcccggtcctcggttgactggcaaatcaggcaggtgcgggccctgctgcaggcccaacaggct

SEQ ID NO: 6805 - DNA, 1392 bp, Artificial Sequence
  Description of Artificial Sequence: Synthetic coding sequence
atggcctctgagtctggtaagctctgggggggccgctttgttggcgccgtagaccctatcatggagaagttcaatgcttcgatcgcatacgaccgccacctgtgggaagtggacgtgcagggctcaaaggcttactcacggggactggaaaaagccgggctgctcactaaagcggaaatggatcagatcttacacgggctcgataaagtcgctgaagaatgggcccagggaaccttcaaattaaactccaatgacgaagatatacacacagctaatgagagacgcctcaaagagctgatcggggcgactgcaggcaaactgcatactggacgcagtagaaatgatcaagtggtgactgatctgaggctctggatgaggcagacatgcagcacactgtctggactactctgggaacttatccgtaccatggtcgaccgggcagaagcagagcgcgacgtgctcttccccggctatacccatcttcagagagcccaaccaatccgttggagtcactggattttgagccatgctgtggcacttacccgggactctgagcgcctcctagaagtgcgcaaaagaataaatgtgctcccactcggatcaggggccatcgccggcaaccctcttggagtggatcgggagctgttgagagccgagctcaacttcggggcgatcacccttaacagcatggacgcgacgtctgagcgagacttcgtggctgaattcctcttctgggcctcgctgtgtatgacacacctgtctagaatggcagaggatctcattctctattgtaccaaggagttctcattcgtccagctctccgatgcctactccacaggctcttcgctaatgcctcaaaagaaaaaccccgattcactggagctgatacgaagcaaggctggaagggtctttggcagatgcgctggtctgctgatgaccctgaaggggctaccctccacgtacaataaagatctgcaggaggataaggaggccgtgtttgaggtgtctgatactatgtctgccgtgttgcaagtcgcaactggcgtcatttccacacttcagatccatcaagagaatatgggacaggcgttgtcccccgacatgctggcgacggaccttgcctactatctggtaagaaagggcatgcccttccgtcaggcacatgaggctagcggtaaggccgtctttatggcagaaacgaaaggtgttgctctgaaccaattatcactgcaggaactgcagaccatcagccccctcttttctggagacgtgatttgcgtctgggattacgggcattcggtggaacagtatggggccctgggcggaaccgctaggtcgtcggtagattggcagatcaggcaggtacgagcgctgctgcaggcccagcaggcc

SEQ ID NO: 6806 - DNA, 1392 bp, Artificial Sequence
  Description of Artificial Sequence: Synthetic coding sequence
atggctagcgaatccgggaaattgtggggcggccggtttgtaggagcagtggaccccattatggagaaatttaatgcgtcgatagcatatgacagacatctgtgggaggtcgacgtgcagggtagtaaagcttactccagaggcctcgagaaggcagggctcctgaccaaagctgagatggaccagattctccatggtctcgacaaggttgctgaagagtgggcgcaaggtacctttaagctgaacagtaacgatgaggatatccatacagccaatgaaaggagattgaaagagttgattggagccacagcaggaaagttacatactgggcgcagtcgtaacgaccaggttgtcactgacctgcggttgtggatgcgccagacatgttcaacgctgtccgggcttctgtgggaactgatcaggaccatggtggatagggcggaagctgagcgggacgtcctgtttccaggttatacacatctacaacgggcacaacctatcagatggtcccactggatcctttcccatgctgtcgctctcacacgggactctgagaggctgcttgaggtgaggaagcgcattaacgttttgcccctcggctccggtgcaatcgctggcaaccctctgggtgttgatcgcgaattactgagagctgaactcaatttcggagccatcaccctgaacagtatggatgctacctcagagcgcgattttgttgccgagttcctcttctgggcatcgctctgcatgactcacctctccagaatggcggaagatctcattctttattgtacgaaagaatttagctttgtccagctttcggatgcgtacagcacagggagttcacttatgccacagaagaaaaatcccgacagcctggaactgatccgcagcaaggccggacgggtgttcggccgttgcgctgggttgcttatgacgctcaagggactgcctagcacgtacaataaagacctacaagaggacaaagaggcggtgttcgaagtatcagatacaatgtctgccgtgttacaggttgctaccggcgttatctctacactccaaatccaccaggagaacatgggacaggctcttagccctgatatgctggccaccgatctggcctactaccttgtgaggaaaggaatgccgtttaggcaagcacacgaggcctcaggcaaggctgtgttcatggcagaaacaaagggggtggcactgaaccagctttccttgcaagagctgcagacaatcagcccactcttcagcggtgacgttatctgcgtctgggactatggccacagcgtcgaacagtacggggccctgggcgggaccgctcgttccagtgtcgactggcaaattcggcaagtgagggccctcctccaagcacaacaggca

SEQ ID NO: 6807 - DNA, 1392 bp, Artificial Sequence
  Description of Artificial Sequence: Synthetic coding sequence
atggcaagcgagtccggtaagctgtggggaggtagatttgtgggggcggtggaccctattatggaaaagtttaacgcaagcatcgcatacgatagacatctctgggaagtggatgtgcagggttccaaggcatacagcaggggtcttgaaaaagcaggccttctgaccaaggcggaaatggatcagattcttcatggtttggacaaggttgcagaagagtgggcacaagggacctttaaacttaacagcaatgatgaggacattcacactgcaaacgagaggagattgaaggaacttatcggtgcaactgccggcaagctgcacaccggccgttcaagaaatgatcaagtggttaccgatcttcgcctttggatgcgtcagacttgttccactctgtcgggacttctctgggaactcatccggacgatggtggatagagcagaggcggaaagagatgtgctttttccaggttacacgcaccttcaacgagcacaacctattagatggtcacattggatcctttcgcatgcggtggcacttactcgggatagcgaacgcctgctcgaagtcagaaaacgaattaacgtccttcctttgggatcgggggcaattgcgggaaatccgctgggcgtggatagagaactgctgagagccgaacttaacttcggagcaatcaccctgaacagcatggatgcaacctctgagagagactttgtcgcggaatttcttttctgggcctcactgtgcatgactcatctgtcgcggatggcggaagatctcatcctttactgcacgaaggaatttagcttcgtgcaactgagcgatgcctactcaaccggatcatcattgatgccacaaaagaaaaacccggactcccttgaactcattcggtcaaaggcgggacgggtgtttggtagatgcgccggacttcttatgactcttaaaggacttccatccacgtacaacaaagatctgcaagaggacaaggaagcagtctttgaagtcagcgacactatgtccgccgtcctgcaagtggcaactggagtcatatcgacccttcaaatccatcaagagaatatgggacaggcactttcccctgatatgttggctacggatcttgcatactacctggtccgaaagggaatgccttttcggcaagcacatgaagcatctgggaaggccgtgtttatggcggaaactaagggcgtggcactgaaccagctctccctccaagagcttcagactatttctccacttttctccggtgacgtgatttgtgtgtgggattacggtcattcggtggaacagtacggggcccttggggggaccgcaagaagctcggtcgattggcagatccggcaggtgagggcgctcctgcaggcacaacaggca

SEQ ID NO: 6808 - DNA, 1392 bp, Artificial Sequence
  Description of Artificial Sequence: Synthetic coding sequence
atggcgtcggaatcggggaaactgtggggaggcagatttgtgggtgccgtggacccaatcatggagaagttcaacgcgtccatcgcatacgacagacatctctgggaggtggacgttcagggctcaaaagcctactcgcggggactggaaaaggcggggctcctgacgaaggccgagatggaccagattctgcacggcctggataaggtggccgaagaatgggctcagggtaccttcaagctgaactccaatgacgaagatatccatactgcgaacgagagacgcctcaaggaacttatcggagctaccgccgggaagctgcacactggacgcagccgcaacgaccaggtcgtgactgatttgcgcctctggatgcgccaaacttgctcgaccctctccggactgctgtgggaactcattcgcaccatggtggatagggccgaggccgagcgcgacgtcctgttcccgggatacacccatctgcagcgcgcgcagcctatcaggtggtcccattggattcttagccacgccgttgcgcttacgcgggactcggaaagactgctcgaagtcaggaagcgtatcaatgtgctgccactgggatctggagcaatcgcgggcaacccgctcggagtggaccgggagctgctgagagcagaattgaacttcggagcgattaccctcaatagcatggatgcgacttccgagcgggactttgtcgctgaattcttgttctgggcttccctgtgtatgacccacttgtcgagaatggcggaggacctgatcctgtactgcaccaaggaatttagcttcgtgcagctgagcgacgcctacagcactgggagctcgctgatgccgcaaaagaaaaaccctgactccctggaactgatccgcagcaaggcaggacgcgtgttcggccggtgcgcagggctcctgatgactctcaaggggttgccgtcgacctacaacaaagatctgcaagaggacaaggaggccgtctttgaggtgtcggacactatgtccgcagtgctgcaagtggcaacgggcgtgatcagcaccctccagatccaccaagagaatatggggcaggcactctctccggatatgctggccactgatctggcgtactacctcgtgcgcaagggaatgcccttccggcaagcccacgaggcgtcgggaaaggcggtgttcatggcggagactaaaggagtggcgctgaatcagctgtctctccaggaactgcagactatctcgcctctctttagcggggacgtgatttgcgtctgggactacgggcatagcgtggagcagtacggagcactcggaggaactgccagatcgtccgtggactggcagatccgccaggtgcgcgccctgctccaggcgcagcaggca

SEQ ID NO: 6809 - DNA, 1392 bp, Artificial Sequence
  Description of Artificial Sequence: Synthetic coding sequence
atggcatcagaatcgggcaaactttggggaggccgattcgtgggggcagtcgaccccatcatggaaaagtttaacgcatccatcgcgtacgatcgacatctgtgggaagtggacgttcagggttccaaggcatactccaggggactggaaaaggcaggacttcttactaaggccgagatggatcaaattctgcacggactggacaaggtggcagaggaatgggcacaaggtacgtttaaacttaacagcaatgacgaggacattcatacggcaaatgagagacgactgaaggagctcataggagcgaccgcaggaaagctgcatactggacggagcagaaacgatcaagtggtaaccgaccttcggttgtggatgcgccaaacctgttccaccctgtcgggccttctgtgggagctgatccgcaccatggtcgatcgggccgaggcagaacgggacgtgctgtttccaggttatacccatttgcaaagagcgcaacccatcaggtggtcgcattggattctttctcacgcagtcgcattgactcgggattcggaacgtctgctggaagtgcggaagaggataaacgttctcccccttggatcaggagcgattgcggggaatccgctgggcgtcgatcgcgaactgcttcgcgccgagcttaacttcggtgcaatcacgcttaatagcatggatgcaacctcggaacgcgatttcgtggcagaattcttgttctgggcaagcctgtgtatgactcacctctcgaggatggccgaggacctcattctgtattgtactaaggaattctcatttgtgcaattgtcggatgcatactcgaccggctccagcttgatgcctcaaaagaaaaacccggacagtctggaattgatccgctccaaggccggcagggtgtttggacgctgtgccggcctccttatgacccttaaagggctgccatccacttacaacaaagaccttcaagaagataaggaagccgtgtttgaagtctcggacactatgtcggcagtgctccaggtggctactggtgtgatttccactctccagatccatcaagagaatatggggcaggcgctgtcccccgacatgcttgcaaccgatctcgcatactaccttgtgagaaagggaatgccttttagacaggcacacgaagcatcgggcaaggcagtgttcatggcggaaactaagggggtggcccttaaccaactctccctgcaggaacttcagaccatttcccctctcttttccggtgatgtgatttgtgtgtgggactacggacactccgttgaacagtacggtgcccttggtggtaccgctcgatccagcgtcgactggcagataagacaagtaagggcacttctgcaagcgcaacaggca

SEQ ID NO: 6810 - DNA, 1392 bp, Artificial Sequence
  Description of Artificial Sequence: Synthetic coding sequence
atggcctcagagtccggtaagctgtggggcggcagatttgttggggcagtggacccgatcatggagaaatttaacgcctctattgcctatgatcgccacctgtgggaggtggatgtccagggaagcaaagcgtacagccgtggactggagaaggccggcctgcttaccaaggccgagatggaccagattttacacggactggacaaagtggccgaggagtgggctcagggaacgtttaagctgaactctaatgacgaagatatccatacagccaatgagcgtaggcttaaagaactgattggagctacggcagggaagctgcatactggccggtctcggaatgaccaagttgtgaccgatctccggctctggatgcgtcagacctgttcaacattgtcaggtctgctgtgggagttgatcagaactatggttgatagagcggaggccgaacgggatgtcctgttcccagggtatacccacctgcaacgtgctcaacccatcaggtggtcccactggatactttcacacgcagtggccctcacgagagattcagagcggttgctcgaggttaggaaaagaatcaatgtgctccccctcggaagcggagctatcgcaggcaacccgctcggggtggatcgggagctcctacgagctgagttgaattttggcgccattaccctcaacagcatggacgctacaagcgaacgggactttgttgccgaatttctattttgggcaagtttgtgcatgactcacctcagccgcatggcagaagacttgattctatattgtaccaaggagttctcgtttgtccagttgagcgacgcttacagtacaggatcatcccttatgcctcagaaaaaaaaccccgacagtcttgagttgattcggagtaaggccgggcgggtctttggaagatgcgctggcttgttgatgacgctaaaaggtcttccatcaacgtacaacaaggacctgcaggaggataaggaggctgtctttgaagtttctgacaccatgtcagccgttctgcaggtggcaaccggcgtgatttcaacattgcagattcatcaggaaaacatgggacaggccctgagccctgatatgctcgcgactgatctagcgtactatttggtcagaaagggcatgccctttcgacaggcgcacgaggcctccggcaaggccgttttcatggcagagaccaaaggcgtggcgctgaaccaactgtctctgcaggagcttcaaactatctcccccttattcagcggggacgttatctgcgtgtgggattatggacattctgtcgagcagtatggggccctgggtggcaccgcccggagttccgtggattggcaaattaggcaagtgcgtgcgctattacaggctcagcaggcc

SEQ ID NO: 6811 - DNA, 1392 bp, Artificial Sequence
  Description of Artificial Sequence: Synthetic coding sequence
atggctagcgagagcggcaaactgtggggcggacgcttcgtaggtgcggtggacccgataatggagaagttcaacgcctccatcgcgtatgatagacatctgtgggaggtggatgtgcagggatcaaaggcctattcgagagggctcgagaaggccggcctcctgacgaaggccgaaatggaccagatattacacggccttgacaaagtggccgaggagtgggcccaggggacgttcaagctgaatagcaatgacgaagatattcacaccgcaaacgagcgtcgtttgaaggagctgataggcgcaacagccggcaaattacataccgggcggtcacggaacgatcaggtggttactgacctaagactgtggatgcggcagacttgtagtacgctgagcgggttgctgtgggagttaatccgaaccatggtggatcgggcggaagctgaacgcgatgtgctgtttccgggatacacccatctgcagcgcgcccaacctatacggtggtcccactggatcttgtctcacgcggtggccctgactcgagatagtgagcggctccttgaggttcgaaaaagaatcaacgtgctgccgttagggtctggtgccattgctggtaatccccttggggtggatagggagcttctgcgcgctgagctgaatttcggggccatcacattgaactctatggacgctacctctgaacgagatttcgtggcagagtttcttttttgggcctctctctgtatgactcacctcagtcggatggccgaggaccttatactgtactgcactaaggagttctcctttgtgcagctgtccgacgcctatagtactgggtcctcactcatgccgcagaagaagaaccctgacagcttagagttgattaggagtaaagccgggagggtatttgggagatgtgccggcctcctcatgacgctgaagggactgcctagcacttataataaggacctgcaagaggacaaggaagctgtttttgaggtcagtgatactatgagcgccgtactgcaggtggccactggcgtcatcagcactcttcagatacatcaagagaacatgggacaagccctcagtcctgacatgttggccaccgaccttgcttattatctagtgcgcaagggtatgccattccgccaagctcacgaggcttctggaaaagccgtcttcatggctgagacaaaaggggtcgctttgaaccagctgagcctgcaagagttgcagacaatcagccctcttttctccggagatgtcatatgcgtgtgggactatggtcattccgttgagcagtacggcgctttgggggggaccgcacgcagctccgttgactggcagatccgacaggtgagggccctgctacaggcccagcaggct

SEQ ID NO: 6812 - DNA, 1392 bp, Artificial Sequence
  Description of Artificial Sequence: Synthetic coding sequence
atggcatcggagtcaggaaagctgtggggaggaagatttgtgggcgcggtggaccccattatggagaagttcaacgcatcgattgcatacgaccgtcatctgtgggaggtggatgtgcaagggtccaaggcatacagccggggcctggaaaaggcaggattgttgactaaggcagagatggatcagattcttcacggactcgataaagtggcagaagaatgggcacagggaacctttaagctcaattcaaatgacgaggacattcatactgccaatgaacgccgactcaaggaacttattggagcaaccgccgggaagctgcataccggtagatcaaggaacgaccaagtcgtcacggatttgaggctgtggatgagacaaacgtgttcgaccctttcggggcttctctgggaactgataagaaccatggttgatcgcgcagaggcagagagagatgtgctctttccaggttacacccacctgcaaagagcgcaacctattagatggtcgcactggattctctcccatgcagtggcactgactcgggactcggaaagacttctcgaggtgaggaaaagaataaacgtgcttcccttggggtcgggagccattgcaggaaacccgcttggagtcgaccgtgagcttcttcgggcagaactgaacttcggggcaattacccttaattctatggatgcaacttcggaacgcgacttcgtggcggaattcctgttctgggcctccctgtgtatgacgcatctctcgcgcatggctgaggatttgattctttattgcacgaaggaatttagcttcgtgcaactttccgatgcatactccaccggatcctcgctgatgccgcagaagaaaaaccctgattcacttgaacttatcagatctaaagcaggacgggtgtttggacggtgcgcaggcctcctgatgactctcaaggggttgccctcgacttacaacaaggatcttcaagaagataaggaggcagtctttgaggtcagcgacaccatgtccgcagttctgcaagtcgcaaccggggtgatatcgacccttcagatccatcaagagaacatgggacaagcgctgtcccctgatatgcttgccactgatctggcatactacctcgtgagaaagggaatgccttttagacaggcacatgaggcgtcaggaaaagcagtctttatggcagaaacgaagggagtcgcccttaaccagctttctcttcaagaattgcaaactatatcccctcttttttcaggtgacgtgatctgtgtgtgggattatgggcattccgtggaacaatacggtgcactgggtggcactgcccggagctcagtcgattggcagatcaggcaggttagagcgcttcttcaagcacagcaagca

SEQ ID NO: 6813 - DNA, 1392 bp, Artificial Sequence
  Description of Artificial Sequence: Synthetic coding sequence
atggccagcgagtcaggtaaactgtggggtggtcgcttcgtgggagcagttgatcctattatggagaagttcaatgcctcaatcgcctacgatcgacatctgtgggaagtggacgttcaaggaagcaaggcctatagtcggggtctcgagaaggcaggtttgctgaccaaagcggaaatggatcagatcctgcacggacttgacaaggtggcagaggaatgggcccagggtaccttcaaactgaattccaacgacgaggatatccacactgcgaacgagcgtcgtctgaaggagctgatcggcgctacggcaggcaaattgcataccggccgcagccgtaatgatcaggtggtaaccgacctgcgactgtggatgcggcagacctgttctacgctgagcggactgctgtgggagctgatccgcacgatggtggatcgcgctgaagccgaacgggacgtcctgttccctggttatacccacctgcaaagagcacagcctatccgctggtcacactggatcctctcccacgcagtggccctgactcgcgatagcgagcgccttctggaagtgaggaaacgcatcaacgtgctacctttaggcagcggtgcgattgcagggaaccctctaggtgtggatcgtgaattgttgagagcagaactgaatttcggtgctatcacactaaactccatggatgccaccagcgagcgcgattttgttgcagaatttctgttttgggcgagcctgtgcatgactcacttgagccgcatggctgaggatctaattctgtactgcacgaaggagtttagctttgtccaactgagtgatgcctacagcacggggtctagtctgatgccacagaagaaaaatccagatagcctggagctcattcgctccaaagcagggcgcgtgtttggccggtgtgcaggactgctgatgaccctgaaaggcctcccgagcacgtataacaaggatctgcaggaagacaaagaggcagtcttcgaagtcagcgacaccatgtccgccgtgctacaggtcgctaccggtgtgatcagcactctccagatccaccaggagaatatgggtcaggccctgtcccctgatatgctggcgacggacctggcctattatctggttcgcaaaggcatgccttttcgtcaagcccacgaagccagcggcaaagcggttttcatggccgagaccaagggtgtagctctgaaccaactgtctctgcaagagctgcaaaccatcagcccactcttcagcggggatgtaatttgcgtgtgggactacggtcacagcgtggagcaatacggtgcgcttggtggcacagcacgcagctctgtggattggcaaattaggcaggtccgcgccctgctgcaggcgcagcaggct

SEQ ID NO: 6814 - DNA, 1392 bp, Artificial Sequence
  Description of Artificial Sequence: Synthetic coding sequence
atggcctcagagagcggcaagttatggggtggccgttttgtgggggccgtagaccctattatggagaaatttaacgctagcatcgcctacgataggcatctgtgggaggtcgatgtgcagggaagcaaggcgtacagcagaggcctggagaaggccggcctgttgacaaaggcagagatggaccaaatcctacacggattggacaaagtggccgaggagtgggcacaggggacttttaagctgaattccaacgacgaggacatacataccgccaatgagcggcggcttaaagaattgattggcgctactgctgggaagctgcatacgggaaggtcaagaaacgaccaggtggttactgatctccggctctggatgagacagacctgcagcactctgtcaggcttactgtgggaactgattcgtaccatggttgatcgcgctgaggcagagcgcgatgtccttttcccagggtatacacatctccagagggcccagcctatacggtggtcccactggatattgtctcacgctgttgcgcttacgcgggactccgaacgcctgttagaggtgcgcaaacgcattaatgtcctccctctcgggtcgggcgctattgcagggaaccctctcggcgtggaccgagagctcctgcgagctgaacttaatttcggggctatcactctgaattcgatggacgccacaagcgaaagggactttgtggcagagttccttttttgggcttcattgtgcatgacccatctgagtcgtatggccgaagatctgatcttgtattgcacaaaggaattctccttcgtgcagttgtccgacgcatatagcactggtagcagtcttatgccacaaaagaaaaatccagattccctcgagctcatcaggagcaaagcaggtcgggtgtttggcaggtgtgcgggcctgttgatgacactgaagggcctaccctcgacatacaataaagatctgcaggaggacaaggaggccgtattcgaagtgagtgatacaatgagcgcggtgctgcaggtggccacgggggtgataagtaccctccagatccatcaggagaatatgggacaagctttatctccagatatgcttgccacggatttggcctactatctggttcggaagggcatgcctttccgccaagcgcacgaggcttctggcaaagccgtcttcatggcagaaacgaagggcgttgctctcaaccagcttagtctgcaggaactgcagaccataagcccactatttagcggggacgttatctgcgtgtgggactacggccactctgtcgagcaatatggcgccctcggggggacagccaggtcttccgttgactggcagatccgccaagtgcgagccctacttcaggcacagcaggct

SEQ ID NO: 6815 - DNA, 1392 bp, Artificial Sequence
  Description of Artificial Sequence: Synthetic coding sequence
atggcatcggagtccggtaagctgtggggaggacggttcgtgggcgctgtggacccgattatggaaaagttcaatgcatcaatcgcctacgaccgccatctgtgggaagtcgacgtgcaagggagcaaagcctactcccgcggacttgaaaaggccggtctgctgaccaaggctgagatggaccaaattctgcatggacttgataaagtcgccgaagaatgggcccagggaactttcaagctcaactcgaacgacgaggacatccacactgctaatgaacggcgcctgaaggagctcatcggcgcgaccgccggaaaactccataccggccggtcacgcaatgaccaggtcgtgaccgatctgcgcctttggatgcggcaaacctgctcgaccctttccggacttctgtgggagttgatccggaccatggtcgatcgagccgaagcggaaagggatgtgcttttccctggatacacccatctgcagagagcgcagccaatccgctggtcgcattggatcttgtcccacgcggtggcacttacccgtgactcggagcgcctcctggaggtgcgcaaacgcattaacgtgctgccgctgggctccggggccattgctggcaatccgctgggagttgacagagaactcctccgggccgaattgaacttcggagccatcacgttgaatagcatggatgccaccagcgaacgcgacttcgttgcggaatttctcttttgggcctcactctgtatgacccacctcagccggatggcggaagatctgatcctctactgtaccaaggaattcagctttgtgcagctgtccgacgcctacagcactggatcttccttgatgcctcagaagaagaatcccgactccctcgaactgatccgatcaaaggccgggcgcgtgttcggtaggtgcgccgggctgctgatgacccttaagggactgccttctacctacaacaaggacctgcaggaggataaggaggcggtctttgaagtcagcgataccatgtcagcggtgctgcaggtggcaaccggagtcatctcgactctccagatccatcaggagaatatgggacaagcgctctcgccggacatgctggcgactgacctcgcgtactacctcgtccgcaagggtatgccttttcgccaggcgcacgaagcgagcggaaaagcggtgtttatggctgaaactaagggagtggcccttaatcagctgtcactccaagagctgcaaaccatctccccactgttctccggagatgtgatttgcgtgtgggattacggccactcggtggagcagtacggagcccttggaggaacggctcggagcagcgtggattggcaaattcgccaggtcagggcccttttgcaagcgcagcaagca

SEQ ID NO: 6816 - DNA, 1392 bp, Artificial Sequence
  Description of Artificial Sequence: Synthetic coding sequence
atggcatcggagagtgggaagctatggggcggaagattcgttggagccgtggaccccatcatggagaagttcaacgccagcattgcttacgacagacatctgtgggaagttgacgtgcaggggtccaaggcatactccagaggactggagaaggcaggactcctaacaaaagctgaaatggaccagattctgcatggtttggacaaagtggcagaggaatgggcccaagggaccttcaaactgaactctaatgacgaggacatccataccgctaacgaacggaggctgaaggaattgattggtgctaccgccggcaagctgcataccggaaggagtcggaacgaccaggtagtgaccgatttgaggctttggatgaggcagacatgcagcacattgtctggattgttgtgggaactgatcaggacgatggtcgaccgggcggaagccgaaagagatgtactttttcctggctacacacacttacaaagagcccagcctatccgatggtcacattggatcctctcccatgccgtagccctgaccagggacagcgaacgtctcctagaggtccgaaaaagaatcaacgtgctacctctgggcagcggcgccattgcaggcaatccactcggtgtagatagagagttgttgagggctgaactgaactttggggctatcacgctgaactcaatggacgcgacctctgagcgggacttcgtggcggagtttttgttctgggcctccctgtgtatgacccatctttcgcggatggctgaggacctgatcctgtactgcacgaaggaattcagctttgtgcagctcagtgacgcttactctaccgggagctcgctaatgccccagaagaagaaccccgacagcctagagctcatcagatccaaggccgggagagtcttcggtaggtgtgccggcctccttatgaccttgaaagggctcccctcgacctacaataaagacctccaggaggataaggaggccgtctttgaggtgagcgatactatgtccgccgttctgcaagtggctactggagtcattagcaccctgcagattcaccaggagaatatgggccaggcactctcacccgatatgctggccacagatcttgcttattacctagttcgaaagggtatgcctttccgacaggcccatgaagctagcggtaaagctgtgtttatggcagagacgaagggtgtggctctcaatcagctgagtctgcaggagctgcagactatatcgccgctcttcagtggggacgtcatttgcgtgtgggattatggccactccgttgaacagtatggggccctggggggtactgccaggagctccgtggattggcagatcaggcaggttcgcgccctgctgcaggctcagcaggcc

SEQ ID NO: 6817 - DNA, 1392 bp, Artificial Sequence
  Description of Artificial Sequence: Synthetic coding sequence
atggctagtgagtctggaaaactgtggggcgggcggtttgtcggtgcagtcgaccccataatggaaaagtttaacgcttcaatagcatacgacagacatttgtgggaggtcgacgtgcagggtagtaaggcgtactccagaggtctcgaaaaggcggggcttttgacgaaggcagagatggatcaaatattgcacgggcttgacaaggtagctgaggagtgggcccagggaactttcaaactaaatagcaatgacgaggacatccacacagccaacgaacgaagactgaaggaattgatcggtgccactgccgggaaactccataccgggcgatctagaaatgatcaggtggtgacagatctccgcctatggatgagacagacatgctctacgctttctggcttgctgtgggagctgattcgcactatggtggacagagccgaggcagaaagagacgttctcttcccaggttatacacacttacagcgcgcacagcccatcaggtggtcgcactggatcctgtcgcatgcagtggctcttactcgagactcggaacggctgctcgaggtccgcaaaagaatcaacgtgctgccgctgggatcaggagcaatcgcaggcaatcctctcggcgtagacagagagctcttaagagcagagctgaatttcggcgccattacactgaacagtatggacgctacgagcgaacgtgattttgtggctgaatttctcttctgggcctcactttgcatgactcacctgagcagaatggcggaggaccttattctctattgtacaaaggaattttctttcgtgcagctgtcagatgcttattccactgggtcttcacttatgccccagaagaaaaatcccgattcccttgagctgatccgtagcaaagccggccgagtctttggacgatgtgcaggcctgctgatgacactaaaagggctcccctcgacttataataaggacttgcaggaagacaaagaggctgtatttgaggtgagcgatacaatgtccgctgtgctccaggtggccacaggagtaataagcacattacagattcatcaggaaaacatggggcaggcccttagtccagacatgttggcaacagatttggcctattaccttgtcaggaaggggatgcctttccgtcaagcacatgaggcaagtggtaaagcggtattcatggccgagaccaagggagtcgccctgaatcagttgtctcttcaggagctacagacgatttctccattattttcaggggatgtcatctgcgtttgggactacggccactcagtggagcagtacggtgctctgggcggaacagcccggtccagcgtggactggcagatcaggcaggttagagccttgctgcaggcacagcaggcc

SEQ ID NO: 6818 - DNA, 1392 bp, Artificial Sequence
  Description of Artificial Sequence: Synthetic coding sequence
atggcatcggagtctggtaagctctggggaggtcgtttcgtgggtgcagtggatccgattatggagaagttcaatgcaagtattgcttacgatcgccatctgtgggaagtggatgtgcagggatctaaagcatacagcagagggctcgagaaggcaggacttctgactaaagcagaaatggatcagatactgcacggcctggacaaggtcgctgaagaatgggcacaagggacttttaagctgaacagcaacgatgaagatatccatacggctaacgaacgacgcttgaaagaacttattggagcaactgcggggaagctgcacactgggcggtccagaaatgaccaagtggtcacggatctgagactgtggatgagacaaacttgctcaactctgtcaggccttctttgggagcttatccgaaccatggtcgacagagcagaagcagagcgtgatgtgctgttccccggttacacccatctccagcgcgcccaacctatccgatggtcccattggatcctttcacacgcagtcgccttgacccgggattccgaacgcttgcttgaggtgcgtaaacggataaatgtactgccactcggctcgggcgcaattgcagggaaccctctgggtgtggaccgcgaacttcttagagctgagctgaatttcggtgcaattaccctgaattcaatggacgccacctcggaacgggactttgtcgcagaatttctgttctgggcatccctgtgtatgactcatctttcaagaatggcagaagatctgattttgtattgtactaaggaattttcatttgtgcaactgtcagacgcatactcgaccggcagttcgcttatgccacagaagaagaacccggattccctggaactgatacggtcgaaggcgggccgcgtgtttggtcgctgcgcagggctcctcatgaccctcaagggtttgccatcgacctacaataaggatctgcaagaagataaagaggccgtgttcgaagtgagcgacactatgtccgccgtccttcaagtggcaaccggtgttatttccacccttcaaatacatcaggaaaacatggggcaggcattgagccctgacatgctggcaactgatctggcttactaccttgtgcgcaagggcatgccttttagacaagcgcacgaggcatcgggtaaggccgtgtttatggccgaaacgaagggtgtggcgctcaaccaactcagcctccaagagctccagaccatttcacctctttttagcggggatgtgatctgtgtctgggattacggacattccgtggaacagtacggtgctctcggaggcactgcacgttcgtctgtcgactggcagataagacaggtgagggcgcttctccaggcacaacaggcc

SEQ ID NO: 6819 - DNA, 1392 bp, Artificial Sequence
  Description of Artificial Sequence: Synthetic coding sequence
atggcatctgaatctggcaaactgtggggaggtcgctttgttggagccgttgaccccataatggagaagttcaacgcttctattgcctacgatcgtcacctctgggaggtggacgtgcagggcagtaaggcttactcccgcgggctggagaaggcgggtttgttgaccaaggctgaaatggaccagattctgcacggcctcgataaggtcgctgaggagtgggctcaaggtaccttcaagcttaattcaaacgatgaggatatccacaccgcaaacgagcgtcgcttgaaggagctgattggagcgaccgctggtaagctccatacgggccgttcccgtaacgatcaggtggtgacggacttgcgcctttggatgcgccagacgtgctcgacgttgtccggcctgctgtgggagctcattcgcaccatggtcgaccgtgccgaagcggagcgtgatgtccttttccccggatacacccacctccagcgcgcccagccaatccgctggtcgcactggatcctttctcatgctgttgctctcactcgcgattccgagcgcttacttgaggttcgcaagcgcattaacgtccttcccttgggttccggcgctattgctggaaatccgcttggtgtcgacagagagctgctccgtgccgagctgaatttcggcgccatcacgctgaactcgatggatgcgacctcggaacgcgattttgtcgccgagttcctcttctgggctagtctgtgcatgactcatctctcccgtatggccgaggacttgatcctttactgtacgaaggagttcagcttcgtccaactgtccgacgcctactccaccggtagcagcttgatgcctcagaaaaagaacccagacagcctggagttgatccgaagcaaggctggccgtgtctttggccgttgcgcagggcttctcatgacccttaagggcctccccagcacctacaacaaggatttgcaagaggataaggaagcagtattcgaggtctcggacacgatgagcgccgtcctgcaagttgcgaccggtgttatttcgaccctccagattcaccaggagaacatgggacaggctctctcacctgacatgctggctaccgacttggcctattacctggttcgtaagggcatgcccttcaggcaggcccatgaggctagtggcaaggctgttttcatggctgagaccaagggtgttgctttgaaccagctgagcctgcaagagctgcaaaccatttctcccttgttctctggtgacgtgatctgcgtgtgggactatggccactccgttgagcagtatggtgccctgggcgggacggcccgttcgtcggtagattggcagatccgtcaggtgcgggcccttctgcaggcccagcaggcc

SEQ ID NO: 6820 - DNA, 1392 bp, Artificial Sequence
  Description of Artificial Sequence: Synthetic coding sequence
atggcttccgagtcgggcaagctgtggggtggtcggtttgtgggagcagtcgatcccatcatggagaagttcaacgccagtatcgcatacgatcggcacctctgggaagtcgacgttcagggcagcaaagcttactcacgcgggttggagaaagccggacttctgaccaaggctgaaatggaccagatcctccatggtctggacaaggtggcagaggagtgggctcaagggactttcaagttaaattcaaatgatgaggatatccatacggccaatgaaagacggcttaaagagttaattggtgcaacggcgggtaagctacacaccggccgatcgagaaacgatcaagttgtaacagatctgcgcttgtggatgcgccaaacctgctccaccttgtcgggtcttctttgggaacttatcagaaccatggtcgatcgcgcggaagccgagcgggatgtcctattcccgggatacactcatctgcagagggctcagccaatccgatggagccactggattcttagccacgctgtggcgttaaccagagattcagagcgcttgttggaagtgcgcaaacgaatcaatgtgctccctctgggctccggagccatcgccggtaaccccttaggtgttgatagagagctgctgcgtgccgaactgaactttggagccattactttgaacagtatggatgccactagtgaacgagactttgtcgctgagtttttgttttgggcgtctctgtgcatgactcacctcagtcgtatggctgaagacctaatcctgtactgcaccaaggaattctcttttgttcagttaagcgacgcctacagcacgggcagttcgttgatgccccagaagaagaacccagattcccttgagttaatccgatctaaagctggacgcgtcttcggccgatgcgccgggctcttgatgactctcaagggtttgcctagtacctataacaaggatttacaggaggataaagaggccgttttcgaggtcagtgacaccatgagcgctgttctccaggtggctacaggtgtgatcagcacgttgcagattcatcaggagaatatggggcaagctctgtcccctgatatgctggccactgatctcgcctattatttggttcgtaagggaatgccctttcgccaagcacacgaggccagcgggaaagctgtgtttatggctgagacaaagggcgtcgcattgaaccagctatctttgcaggaactccaaacgatctcgccccttttttccggggacgtgatttgtgtgtgggattatggtcacagcgtggaacagtacggggcgctgggaggtacggcacggtcaagtgttgattggcagatccgacaagtaagggccttactacaggcacagcaggcg

SEQ ID NO: 6821 - DNA, 1392 bp, Artificial Sequence
  Description of Artificial Sequence: Synthetic coding sequence
atggccagtgaaagcgggaagctctggggggggcggtttgtcggggcagtagatccaattatggagaaattcaatgcctcaatcgcatacgacagacacctgtgggaagtggatgtgcagggttccaaagcctactcacgcggactcgaaaaggctggacttctcacaaaggctgagatggaccagatcctccatgggttggataaggtggctgaggagtgggctcagggaacttttaagctcaattccaacgacgaagacattcacactgctaacgagaggcgacttaaggaactgatcggggctaccgccggcaagctgcatacagggcggagccggaatgatcaggtggttacggatctgaggctgtggatgagacagacctgttctacactgtcagggttgctgtgggaactcataagaacaatggtcgacagggctgaagcagaacgcgacgtgctgttcccgggctatacccatctgcagagagcccaacccatcaggtggagccattggatcctgtctcatgcggtagctctgacaagagattcagagcgcctcctggaggtgaggaaaagaatcaacgtattgcctttgggatccggcgctatcgcgggaaatccgctgggcgtggaccgggaacttctgcgagccgagctgaactttggcgcaattaccttgaattccatggacgccacatccgagcgcgactttgtggcagagttcctcttttgggcatccctgtgtatgacacatctctctcgaatggctgaagacctcatactgtattgcactaaggagttctctttcgtgcagctgtccgatgcatacagcaccgggtcttccctgatgcctcagaagaagaatcctgatagcctggaacttatccgatcaaaagcaggacgggttttcgggcgctgtgctggccttctcatgacattgaagggtctgccctcaacttacaataaggatctccaggaggacaaggaagccgtatttgaagtcagcgataccatgagtgccgtccttcaggttgctactggtgtcatttctacattgcagattcaccaggaaaatatgggacaggccttgagccctgacatgctcgcgacggatctggcttattatttggtccggaaaggcatgccgttcaggcaagcacacgaggcctctgggaaagcagtgttcatggcagagaccaagggggtagccctgaaccagctttctctgcaggaactgcaaaccatctcccccctgttcagcggagatgtaatatgcgtgtgggactatggccactccgtcgaacaatacggcgccttgggcgggaccgccaggtcctccgtggactggcaaatacgccaggtccgagcactgcttcaggcacagcaggca

SEQ ID NO: 6822 - DNA, 1392 bp, Artificial Sequence
  Description of Artificial Sequence: Synthetic coding sequence
atggcctctgaatctggcaaactttggggaggtaggttcgtgggtgctgtggatcccatcatggaaaagttcaacgcatccatcgcctacgaccgtcatctgtgggaagttgacgtgcagggtagcaaggcctattctcggggactggaaaaggccggcctcctgacaaaagccgaaatggaccagattctgcatggtctcgataaggtggcggaggagtgggcgcagggcacatttaagctgaactccaatgacgaagatatccacaccgctaatgagcgccgactgaaggagctcatcggggctacggccggaaagctgcacactggtcgaagccgcaacgaccaggtggtgaccgatcttcggctttggatgagacaaacctgttctacactctccgggcttctgtgggaactgatcagaaccatggtggaccgcgcggaagccgagcgggacgtcctctttccaggctatacccatctccagcgtgcccagcctatccggtggagccactggattctgtcacacgccgtcgctttgaccagagatagtgaaaggctgttggaggtgaggaagagaatcaatgtgctcccccttggcagtggcgccatcgcaggtaaccctctaggcgtggatagagagttgctgagggccgagctgaactttggagcaataacgctgaacagcatggacgctaccagcgaaagagacttcgtggcagagttcctattctgggcatctctctgcatgacacacctttcacggatggccgaggatctcatcctctattgtaccaaagagtttagctttgtccaactgtccgatgcctatagcacagggtcctcccttatgcctcagaagaagaatcctgactccctagaactcatcaggtccaaagctggcagggtttttggccggtgcgctgggctcctgatgactttgaaaggactgccttcaacatacaacaaggatcttcaggaggacaaagaggctgtgttcgaggtgtctgatacaatgtctgcagtcctgcaagtggcaacaggtgtgatctctactttgcagattcaccaagagaacatggggcaggccttatcccctgatatgctcgccactgacttagcctactacttggtccggaagggtatgccgtttagacaggctcatgaagcttccgggaaggccgtcttcatggccgaaacaaagggggtcgccctgaaccaactgtctctgcaagaactccaaacaatatccccactcttctccggagatgtaatctgcgtgtgggactatggccacagcgtcgaacagtacggcgccttagggggcaccgcccggtccagtgtggactggcagatccggcaagtacgggccctcctccaagcacagcaggcc

SEQ ID NO: 6823 - DNA, 1392 bp, Artificial Sequence
  Description of Artificial Sequence: Synthetic coding sequence
atggcaagtgaaagtggcaagctgtggggcggtaggttcgtgggagccgtcgatccaatcatggaaaagtttaatgccagtatcgcttacgatcgccacctgtgggaggtcgatgtccagggcagcaaggcatacagcagaggactcgaaaaagcagggctcctcacaaaagcagaaatggatcaaatcttacatggcctggataaggttgccgaagagtgggcccaaggcaccttcaaacttaactccaacgacgaagatattcacaccgcaaacgaacgccgcttgaaggagctaatcggggctactgcagggaagctgcacacgggaagatctcgaaacgaccaggtggtgacggaccttcgattatggatgcgacagacctgctctactttgagcggcctgctgtgggaattaatccgtactatggtcgaccgcgcagaagccgaacgggacgtgctgttccctggatacacccacctgcagcgggcccagccaatcaggtggagccactggatacttagccatgcggtggcactcacgcgagattccgaaaggctacttgaggtccgcaagcggataaatgtgctgccacttggaagcggagcgattgcaggtaacccactgggtgtggacagagagctactgcgcgcagaacttaacttcggggcaatcaccctgaatagcatggatgcaacctccgagagagatttcgtggctgaatttcttttctgggcgtctctgtgcatgactcacttatcacgcatggctgaggatttaatactgtattgtaccaaggagttcagtttcgtgcagctgagtgacgcttattctaccggatcctctctgatgccccagaagaaaaaccccgatagcctggagctgatcaggtcaaaggccggtagagtttttgggcgatgtgctgggctgcttatgactctgaaaggcctcccttcaacctataataaagatttgcaggaggacaaggaagccgtctttgaggtgagtgataccatgtctgcggttctccaagtggctacaggggtgatatcgacactccaaattcatcaggagaatatgggccaagccctatcacctgatatgcttgccactgacttagcatactatctggtaaggaaggggatgccatttaggcaggcccacgaggcatcggggaaggcggtgttcatggctgaaaccaagggtgtggcactgaatcagctgagcctgcaggagcttcaaaccattagccccctcttctccggcgacgtgatatgtgtttgggattacgggcatagcgttgagcagtacggagctctagggggcacagcacgcagtagtgttgactggcagattaggcaggtacgcgccttgctgcaagctcagcaggca

SEQ ID NO: 6824 - DNA, 1392 bp, Artificial Sequence
  Description of Artificial Sequence: Synthetic coding sequence
atggcaagcgagtccggaaagctgtggggtggacggtttgtcggggcagtcgatccaatcatggagaagttcaatgcttcgatagcttacgacagacatctgtgggaagtggatgtccagggttcaaaggcatattccagagggctcgaaaaagcaggactgcttactaaggctgaaatggatcagattcttcacggtcttgacaaggtggcagaagaatgggcgcaaggaacttttaagctcaactcaaatgatgaagatatccatactgctaacgaaaggaggctgaaagagctgatcggagccaccgcaggaaagttgcacactggcagatctaggaacgatcaggtcgtcaccgatctgcgtctttggatgcggcaaacctgttctacgctttcgggactgttgtgggagctcatcaggactatggtggaccgagcggaagcggaacgagatgtcctgttccctggttacacccatctgcaacgagcccagccaatccgttggagccattggatactcagccatgcggtcgctcttacccgggactcagaaaggctcctcgaggtgcgaaagaggataaacgtgctgcctttgggttcgggggccatcgcaggcaatcctctcggagtcgatagggaacttctgagagcagaactgaacttcggggccatcactcttaactccatggacgcgactagcgaaagggattttgtggcagaatttctcttttgggccagcctttgtatgactcacctctcccgtatggctgaggatctgattctctactgcactaaggaattctcatttgtccaacttagcgatgcatacagcacgggatcttcactgatgcctcagaaaaagaaccctgattcactcgaattgattcgctcgaaggctggtcgcgttttcggccgctgtgcgggccttctcatgacgcttaaggggctgccttcaacctacaacaaggaccttcaggaggacaaagaagcagtgtttgaagtttccgacacgatgtctgcagtgctccaggtggcaaccggagtcatttcgaccctccagattcaccaagagaatatgggccaagcgctgtcccccgacatgctcgcaactgacctggcttactatctggtgagaaaaggtatgccctttcggcaagcacatgaagcctccggtaaagcagtctttatggccgaaaccaagggagttgcccttaaccagctcagccttcaggaactgcaaaccatctcgcccctgttttcgggcgatgttatatgcgtgtgggattacggtcattcggttgagcaatacggagcgttgggaggtactgcacggagcagtgtggactggcagatacgtcaagtgagagcacttttgcaagcacaacaagcc

SEQ ID NO: 6825 - DNA, 1392 bp, Artificial Sequence
  Description of Artificial Sequence: Synthetic coding sequence
atggcttccgaatctggcaaactgtggggcgggcgattcgtcggcgcggtcgacccaatcatggaaaagtttaacgcttcaatcgcatacgatcgacatctttgggaagtcgacgtccaggggtctaaagcctacagccgtgggctcgagaaagctggtttactgactaaggcagagatggatcagattctgcatggcctagacaaggttgctgaggagtgggcacagggaacctttaaactgaacagtaatgacgaggacattcacaccgctaatgaacgccggctgaaagaacttataggtgcaactgcgggcaaactgcataccggccgttctaggaacgaccaggtcgtgactgacctgaggttatggatgagacaaacttgtagcactctcagcggtctgctgtgggagttaataagaaccatggtggatcgcgcagaggccgaaagggacgtgctcttcccagggtacacccatctacagcgggcccagccgatacggtggtcacactggatcctgtctcacgccgtggcactgacgcgcgacagcgagcggctgctggaggtgagaaaaagaattaatgtgctgcccctaggttcaggggcgatagcaggaaaccctctcggggtcgacagagagctactgcgcgcagagctaaacttcggtgccatcaccttgaattccatggatgctacatcggagcgggattttgtggctgagttcctgttctgggctagtctttgtatgacacacctctcaagaatggccgaagatctgatcttgtattgtacgaaggagtttagtttcgtgcagttgagtgatgcctactctacagggtccagcctgatgccacagaaaaagaaccctgactccctcgagctgattcgctccaaagcaggcagggtatttggacggtgtgcaggactgctcatgaccttaaaggggttgcctagcacctacaacaaagatttgcaggaggacaaagaggctgtgttcgaggtgtcagacacaatgtccgctgttctgcaggtcgccacgggggtgatctctacactccagatccaccaggaaaatatggggcaagctctctctccagatatgcttgcgactgatctggcctattatctggtgcggaagggcatgccattcagacaggcccacgaagctagtgggaaagcagtcttcatggcggaaactaaaggcgtcgcactgaaccagctctctctccaggagttgcagacgatctcacctctgttcagcggcgacgtgatctgtgtttgggactacggacattcagtggaacaatacggtgctctcggagggactgcccggtcctcagtggactggcagataagacaagtcagagccttgcttcaagcccagcaggca

SEQ ID NO: 6826 - DNA, 1392 bp, Artificial Sequence
  Description of Artificial Sequence: Synthetic coding sequence
atggcatctgagagtggcaagctttggggaggccgttttgtaggcgcagtggaccctatcatggaaaagttcaatgccagtatcgcctacgacagacatctgtgggaagtagacgtccaggggtcaaaagcttattcaagggggctagagaaggcaggcctgttgacaaaggctgaaatggatcagatcctgcacggactggacaaggtggccgaggagtgggcgcaggggactttcaagctaaacagtaatgatgaagacatccacaccgctaacgaacgacggctgaaggaactgatcggcgccacagcagggaagctccacacgggtagaagccgcaacgaccaggtggtgaccgatcttcgactgtggatgcgccaaacatgctccactctgtctggattgctttgggaactgatccgaaccatggttgaccgagcagaggcagagcgagacgtgttattcccagggtacacccacctgcaaagggcacaaccaataaggtggtcacactggattctcagccatgccgttgctctgacacgggactccgaacggctgctggaggtcagaaagcgaattaatgtcttgccactgggatctggtgctattgcaggcaatccactcggtgttgaccgggagctgttaagggcagagttgaactttggagcgataaccctgaattccatggatgctacatctgagagggattttgtcgccgagttcctcttttgggccagtctatgtatgacccacctgagtcgaatggccgaagatctgatcttatactgcaccaaagagttcagcttcgtgcagctgagcgacgcctattccactgggtcatctctgatgccccagaagaaaaaccccgattcacttgagctgattcgatcaaaagcaggcagggtcttcggacgttgtgcagggttactgatgaccctgaaaggccttccatctacctacaacaaagatctccaggaggataaggaggccgttttcgaggtctcagatacaatgtcagcagtattgcaggttgccaccggcgtcatcagtaccttgcaaatccaccaagagaacatgggtcaggcactaagtcccgacatgctggcgacggacctggcatactacctagttagaaaaggaatgccctttcgacaggcgcacgaagcttccggcaaagcagtgtttatggccgagaccaagggcgtggcactgaatcagctgtctttgcaggaactgcagacaatctcacctctgttttctggggacgtcatctgcgtgtgggattacggacacagcgtggagcagtatggggccctgggcgggaccgcgcggtcttccgtcgactggcagatcagacaagtccgtgctctccttcaggcccagcaggca

SEQ ID NO: 6827 - DNA, 1392 bp, Artificial Sequence
  Description of Artificial Sequence: Synthetic coding sequence
atggcctctgaaagtgggaaactttgggggggacgctttgtaggggctgtggatcctataatggaaaaatttaatgcctctatcgcctatgatcgccacttgtgggaagtggacgtgcagggaagtaaagcctatagtcgggggctcgaaaaggctgggctccttacaaaagccgagatggatcagatcctgcacggattggataaagtagcagaagaatgggcgcagggaactttcaaactcaactccaatgatgaagacatacatacagcaaatgaacggcgattgaaagagctaatcggagccactgccgggaaactgcacacagggcggtctcggaatgatcaggtggttactgatctcaggctttggatgaggcagacttgttctacactgagtgggcttttatgggaactaattagaacaatggttgatcgagccgaagccgaacgcgatgttctttttccaggatatacacatttgcagcgcgcccagcctatcagatggagtcattggattctctcacacgctgtggctctcactcgggatagtgaaaggttgctggaagtaagaaaacgcatcaacgtcttgcccctcgggtccggggcaatagcagggaaccccctgggagtggatcgggaactccttcgggcagaacttaatttcggagcaatcactctgaactctatggatgcgacatccgaacgggattttgtggctgagtttctgttctgggctagtctatgcatgactcacctgtctcgcatggccgaggatctaattctctactgcacaaaagagttttcatttgtccagctctccgacgcttacagtactggatcgagtctgatgccccagaagaagaacccagattcacttgagctgatacgaagtaaagcagggcgcgtcttcgggcgctgtgctgggctgctcatgactctgaaaggactgccttcgacatataacaaagaccttcaggaagataaagaggctgtatttgaagtaagtgatacaatgtccgccgtgttacaggtggctacaggagtgatttctactctacagatccaccaggaaaacatggggcaggccctgtctccagatatgctagctacggacctggcttactacctcgttaggaaagggatgccattcaggcaggcacacgaagccagtggaaaggctgtttttatggctgaaacaaaaggggtggcccttaaccagttatctctccaggagcttcagactatctctcccctgttttccggagatgtgatctgtgtgtgggattacgggcattccgttgaacagtatggagcactgggaggaacagcaagatctagtgtggactggcagattcgacaggtcagagccctcctgcaggcgcagcaggcc

SEQ ID NO: 6828 - DNA, 1392 bp, Artificial Sequence
  Description of Artificial Sequence: Synthetic coding sequence
atggcttctgaaagcggaaaattgtggggggggcgctttgtcggagcagtggaccccatcatggaaaagttcaacgcctctatcgcttacgaccggcatctgtgggaagtggacgtgcagggtagcaaggcatatagccgcggcttggaaaaggcaggattgctaacaaaggccgaaatggaccagatactccatggattagataaagttgctgaagaatgggctcaaggcaccttcaagctcaacagcaacgacgaagacatccacaccgctaacgagaggaggttgaaagagctgatcggggctactgctggtaaacttcatacgggccgcagtagaaacgaccaggtggtgaccgacctgagattatggatgaggcaaacatgctcgacccttagcggactgctctgggaattaatcaggacaatggtggacagagcagaagctgaacgcgatgttctgttcccgggatacactcatctgcaaagagctcagcccatccgctggtcccactggattctgtctcacgctgtggcgctcacaagggatagcgagcgactgctggaggtcaggaaaaggatcaacgtgctgcccctcggaagcggtgccatcgcaggaaacccattgggggtcgacagggaactgctccgcgcggagctgaattttggagccattactctcaatagcatggacgctacaagcgaaagggacttcgtggctgaatttctcttttgggcgagcctgtgtatgacccacctgagccgaatggccgaggacctgattctgtactgcaccaaagaatttagcttcgtacagctgtctgatgcgtactcaactgggtccagcctgatgcctcaaaaaaagaaccccgatagcctggagctcatacgctccaaagctggcagggtgttcggcaggtgcgcgggactcctcatgacgctgaagggcctgccaagtacatacaacaaggatttgcaggaggacaaagaggccgtgtttgaggtgagcgatacaatgagcgcagtgctccaagtagcgaccggagttatctccactctccagatccatcaagaaaatatgggacaagcccttagtcccgatatgttggcgactgatctcgcttattacctagtcaggaaaggaatgcccttcagacaggctcacgaggcttccggaaaagctgtgtttatggctgaaaccaagggagttgctctgaaccagctgagtctgcaagaactgcagactatcagccctctgttttcaggggacgtcatctgcgtgtgggactatgggcactctgtcgaacagtacggtgcgctgggcggaaccgcccgctcttccgtcgattggcagatccgtcaagtccgtgctctcctgcaggctcaacaagca

SEQ ID NO: 6829 - DNA, 1392 bp, Artificial Sequence
  Description of Artificial Sequence: Synthetic coding sequence
atggcctcagagagcggaaagctatggggaggaagatttgtgggagctgttgaccctattatggaaaagtttaacgcgtctatagcatacgaccggcatctatgggaggttgacgttcaggggagtaaagcttactcccgagggctggagaaggcggggctgctcacaaaagccgagatggatcaaatcctgcacggactggacaaggtggctgaagagtgggctcaaggaactttcaaacttaactctaatgatgaggatatccacaccgcgaatgagaggaggctgaaagaactgatcggtgccacagcaggtaaactccatactgggcgctctaggaacgaccaggtcgttaccgacctgcgtctatggatgcgccagacctgtagcacgttatcaggacttttatgggagctgatccggaccatggtggaccgcgcggaggccgaaagagacgtgctcttccccgggtacacacatctgcagcgcgcccagccaattaggtggagtcattggattctgagtcacgcagtggcactcacacgggactccgaacggctgctagaggtcaggaagaggattaacgtactaccactaggatcaggggccatcgcggggaacccgttgggggtcgaccgcgagctgctcagggccgagctcaatttcggggccatcacattaaatagcatggacgcaacatcagaacgggattttgtggccgaatttctattttgggcctccctttgtatgactcacctgtcccggatggcagaagacttaatcttatactgcaccaaagagttctctttcgtgcaattatccgacgcctactccaccggtagctccctcatgccacagaaaaagaatccggactcccttgagctgatacgaagcaaagctggtagggtgttcggtagatgtgcaggcctactgatgaccctcaagggcctgcccagcacgtacaacaaggacctacaagaagataaggaagccgtgtttgaggtatctgacacgatgtcagccgtgctccaggtagccaccggggtcattagtactctccaaattcaccaagaaaatatgggccaggcgcttagccctgatatgctcgcgacagatctggcctactaccttgtgaggaagggaatgcccttccgccaggcccacgaagcgtctgggaaggcagtgttcatggccgagacaaagggtgtggccttgaaccagctgtcgttacaggagctccagaccatctctcctctattcagtggagacgtgatctgcgtctgggactatggacactctgtggaacagtatggggctttaggaggcaccgcacggagcagtgtggactggcagatccgccaagttcgcgccttgctgcaggcccagcaggca

SEQ ID NO: 6830 - DNA, 1392 bp, Artificial Sequence
  Description of Artificial Sequence: Synthetic coding sequence
atggctagtgagagcggcaagctgtggggcggccggttcgtcggcgctgtggatccgataatggagaaattcaacgcaagtattgcatacgaccggcacctatgggaggtggacgttcagggaagcaaggcgtactctcgcgggcttgaaaaggcaggacttctgactaaagccgaaatggaccagattctccacggccttgataaagtcgccgaggagtgggcacagggcacttttaagttgaacagcaacgatgaggatatccacaccgctaacgagcgccgactgaaggagctgatcggtgccaccgcaggaaaattacatactggacggagtcgcaacgaccaagtagttacagacttgcgattatggatgagacaaacatgctctaccctctcaggcctgctctgggagctcatccggactatggtcgacagagcagaggcggagcgcgatgttttgttcccgggctacactcatctccagcgcgctcaacccattcggtggtctcactggattctgtcccatgcagttgccctcacgagggatagcgaaaggcttctcgaggtgcggaagagaatcaacgtactcccattgggcagtggagccatcgcaggtaacccactaggcgtggaccgtgaactcttgcgcgctgagctcaactttggcgccatcactcttaattccatggacgctacttccgagcgggacttcgtcgctgaatttctgttttgggccagtctctgcatgacccacctctctcgcatggctgaagacttgatcctttactgcaccaaagagtttagcttcgtgcaactcagcgacgcctactccaccggcagcagcctaatgcctcagaaaaaaaatcctgacagcctcgagctaatacgaagcaaggcgggcagagtgtttggacgatgtgccggtctgctgatgaccctcaagggcctcccatctacatacaacaaggacctgcaggaggacaaagaggcagtgttcgaagtctctgacacgatgtcagcagttctccaggtggctacaggcgtgatatcaactctgcagatccaccaggagaacatggggcaggccctttctcccgatatgctggctaccgatcttgcctactatctcgtccgcaagggcatgccatttaggcaggcgcatgaagcctctggtaaagccgtatttatggctgagaccaagggcgttgctctcaaccagctgtcactgcaggaattgcaaacaatctcacctctgttcagtggcgacgttatttgcgtctgggactatggacacagcgtggagcaatacggagccctgggagggactgccagatcatctgtggattggcagatcagacaggtgcgggctttgcttcaggctcagcaagca

SEQ ID NO: 6831 - DNA, 1392 bp, Artificial Sequence
  Description of Artificial Sequence: Synthetic coding sequence
atggcatcagagtctggcaagctatgggggggacgcttcgtgggggccgtggaccctatcatggaaaaattcaacgctagcattgcttacgataggcacctctgggaggttgatgtccaaggatcaaaagcctattctcgaggcctggagaaagcaggactgctaacaaaggccgagatggatcaaatcttgcatggtctggacaaggtggccgaggagtgggcacaggggacatttaaattgaactccaacgatgaggatatccatactgctaacgaacgacggcttaaggagctcataggcgccaccgccgggaaacttcatacaggaagatccaggaatgatcaggtagtgaccgacttgaggctgtggatgcgccaaacttgctcgaccctgtctggcctgctgtgggagctgatcaggacaatggtggatagggcagaggctgagagggacgttctctttccgggatatacacatttacagcgggctcagccaatccgatggagtcactggatcctctcccacgctgtggccctgacccgcgattctgagaggttactggaagtgcggaaaagaatcaatgttctgccacttgggagtggggctattgcgggaaaccctctgggggtggatcgagagctgctgagagccgaattgaacttcggagctataactctcaacagcatggatgccactagtgaaagagatttcgtggccgagtttttgttttgggcttccctttgcatgacgcacctgagtagaatggcggaggaccttatactgtactgtacgaaggaattttcattcgtgcagctttctgatgcttacagtactgggtctagcctcatgcctcaaaagaagaacccggattcgctggagctgattagaagtaaagctggtagggtcttcggacggtgcgcagggctgctgatgaccctaaaggggctaccaagtacatacaataaggacctgcaggaggataaggaagcagtatttgaagtgtccgatactatgagcgccgtcctgcaggtcgcaacaggagtaatcagcacccttcagatccaccaggagaatatgggccaggcgttgtcgcccgatatgttggctactgatctggcgtactacctagttcgaaaggggatgcctttccgccaggcccatgaggcatctggcaaggctgtgtttatggcagaaaccaagggcgtcgccctgaaccagttaagcctgcaggagctgcagactatttcgccgctgtttagtggagatgtgatttgcgtgtgggactacgggcactcagtcgagcagtacggagctcttgggggtaccgcccgcagctccgtggattggcagattcgtcaggtcagagcccttcttcaggcacagcaggcc

SEQ ID NO: 6832 - DNA, 1392 bp, Artificial Sequence; identical to SEQ ID NO: 6825
  Description of Artificial Sequence: Synthetic coding sequence

SEQ ID NO: 6833 - DNA, 1392 bp, Artificial Sequence
  Description of Artificial Sequence: Synthetic coding sequence
atggcttcagaatctggcaaactgtggggaggaaggttcgtaggcgctgttgaccccataatggaaaaattcaacgcttcaatcgcatacgatcgtcatctgtgggaggtagacgttcagggctccaaggcatattctagaggcttggagaaagccggtcttcttactaaagctgaaatggaccagatccttcatggtctggacaaagtggcagaggagtgggcccagggtacttttaaactgaacagtaacgatgaagacatccacacagctaacgagcgtcgtctgaaggagttgatcggagctacagccggcaagctccatactggtcgttcacgcaacgaccaggtcgttactgatctcagactgtggatgaggcagacctgttccactctctccggcctcctctgggaactgattagaaccatggtggatcgtgccgaggccgagagggacgtcctcttcccaggctacactcaccttcagcgcgcccagccaatcaggtggagtcactggattctgtctcatgctgtggcacttacaagagactctgagaggctcctggaagtaagaaagagaattaacgtgctccctctcggctccggcgccatcgccggcaaccctttgggagtggaccgcgagttgctcagggccgagctgaacttcggtgcaattaccctcaactcaatggatgctacatccgaacgtgacttcgtggctgagttcctcttttgggcttccctctgtatgacacacctgtcaaggatggctgaggacctgattctgtactgcactaaggagttttcatttgtgcagcttagcgacgcctactctactggctccagcctcatgccccagaaaaaaaacccagactcactggagcttattaggtccaaggctggaagggttttcggccgttgcgctggcttgctgatgaccctcaagggtctgcctagtacctacaataaggatctgcaggaggataaggaagccgttttcgaagtgagcgacaccatgtcagctgtgctgcaggtggctacaggagtcattagcaccctccagatccaccaagaaaacatgggacaggccctctccccagacatgctcgccacagatctggcctattacctggtgcgtaagggaatgccttttcgtcaggctcatgaggctagcggaaaggcagtgttcatggcagaaactaaaggtgttgctctgaatcagctgagcttgcaggaactgcagactattagtcctttgttctccggagacgtgatttgcgtttgggactacggtcattcagtcgagcagtacggagctttgggaggtactgctcgttcttcagtcgactggcagatccgtcaggtgagagctctgttgcaggcacaacaggcc

SEQ ID NO: 6834 - DNA, 1392 bp, Artificial Sequence
  Description of Artificial Sequence: Synthetic coding sequence
atggcttcagaatctggaaaactgtgggggggacggtttgtcggggcagttgaccccattatggagaaatttaatgccagtattgcctatgacaggcatctgtgggaagtagatgttcaggggtcgaaagcctactctcgcggacttgaaaaagccggacttctgacaaaagctgagatggatcagatactacacggacttgacaaagtcgcagaagaatgggcccaaggaacattcaaactgaattccaacgacgaagatattcatactgccaatgaaaggcgcctcaaagaacttataggagctacagctggaaaactgcatacagggcgatccagaaatgatcaggtggttacagatctgagattgtggatgcggcagacttgctctactctcagtgggttactgtgggagctcatacgtactatggtagatcgggcagaagccgaacgagatgtactctttcctggatatactcacctgcagagggcccagcccataaggtggagtcattggatcctgtcccatgcagtggctctaacaagggactctgaacgcctcctggaggtgagaaaaaggataaacgtcctcccattaggatctggggccatcgccgggaatcctctcggggtagatagggaactccttcgggcggaacttaactttggggccattactctaaatagtatggatgctacatctgaaagggatttcgtggccgaattcctcttctgggcttcactgtgcatgactcacctctcgaggatggccgaagatctcattctgtattgcactaaagaattttcatttgtacagctctctgatgcttattccactgggtcttctctaatgccacagaaaaaaaaccccgattcactggaactaataaggagtaaggccggacgcgtcttcggaaggtgcgccgggctactcatgactctgaaagggttaccatctacatataacaaagatctccaggaagataaagaagccgtctttgaggtgtcagatactatgtccgctgtgttgcaggtcgctacaggagtgatctcaactctccaaattcatcaggaaaatatgggacaggctctgtcacctgatatgctagccacagacctagcatattatctagtccgaaaaggaatgcctttcagacaggcccatgaagcttccgggaaggctgtattcatggccgaaactaaaggagtcgctctgaaccagctctcacttcaggaacttcagactatctccccactgttctccggggatgtaatctgtgtctgggattatgggcattccgtggaacagtacggagcccttgggggaacagctcgatcttccgtggattggcagatcaggcaggtgagggctctccttcaggcacagcaggcc

SEQ ID NO: 6835 - DNA, 1392 bp, Artificial Sequence
  Description of Artificial Sequence: Synthetic coding sequence
atggccagcgaatcaggaaaactgtggggcggacggtttgtcggcgctgtggatccaattatggaaaagtttaacgcgagcattgcgtatgatagacacctgtgggaagtggatgtgcaaggatctaaagcatatagccgaggtcttgagaaagccggcttgctaaccaaggcagaaatggatcagatcttgcatggattagataaagtggccgaggaatgggctcaggggacttttaaactgaactccaacgacgaagatatccacactgcaaacgagcggcggctcaaggagctcatcggagctactgctggcaaactccacacagggcgatcacgtaatgaccaggtcgtaaccgatctacgcctgtggatgcgccagacatgtagtactttgtctggcctgctgtgggagttgattcggacgatggtggacagagcagaggctgaaagggatgtcctctttcccgggtacactcatttgcagagagcacagcctatcagatggagccactggatactgtcccacgccgtggctctaactagggattcagaacgtctgttggaagtcaggaagcgcatcaatgtgctgcccttaggctcgggggccatcgccgggaaccctctgggcgtcgatagggagctactccgagcggagctgaactttggtgcaattaccctgaatagcatggatgccactagtgagcgagattttgtagcggagtttcttttttgggcgagcttgtgcatgacccacctgagcaggatggctgaggaccttattctgtactgcaccaaagaatttagtttcgtacagttgtccgatgcctacagcaccggcagtagcctgatgcctcaaaagaagaaccccgacagcctggagcttataaggtctaaggccggacgcgtctttggacggtgcgccggactgctaatgacgctcaaagggctgcccagcacctataataaggacctgcaggaagacaaagaggcggtttttgaggtctctgacacaatgtcggccgtgttgcaagttgccaccggagtgatttccacattacaaatccatcaagagaacatgggccaggccttaagccctgatatgctggcaacggatttggcttattatctagtgaggaaaggaatgccattccggcaggcccacgaggcaagcggtaaagcagtgtttatggccgaaaccaagggggtagccctcaatcagctctcactgcaggagctccagactatttcaccgctatttagcggcgacgttatctgcgtgtgggactacggtcactccgttgagcagtacggcgccctgggggggaccgcccgttcatctgtggactggcagattcggcaggtgagggcactgctgcaggctcagcaagcc

SEQ ID NO: 6836 - DNA, 1392 bp, Artificial Sequence
  Description of Artificial Sequence: Synthetic coding sequence
atggcatcagaatccgggaagctatggggcggcagatttgtaggcgcagtggatcccatcatggaaaaatttaatgcctccatcgcctacgatcggcacctttgggaggttgatgtgcagggttcaaaggcgtacagcaggggcctcgagaaagcgggtctcttgactaaagccgagatggatcagatcttgcacgggcttgataaagtggccgaggaatgggctcagggcaccttcaaactcaacagtaatgatgaagacatccatacggccaacgaacgaaggctcaaagaactcattggtgcaactgccggaaagctccacacagggcgctctcggaatgaccaggtggtgacagatctaaggctctggatgcgacagacctgctccaccctgagcggactcctgtgggagcttatccggaccatggtggaccgcgctgaggcggagagagacgtcttgttccctgggtacacccatttgcagagggcccagcccatccggtggagccactggatcctatcccatgctgtagctctgacacgcgactctgagagactactcgaggtgcgcaaacgaatcaacgtgttgccactgggatccggcgccattgccggcaaccccctaggcgtagatagggaattgcttagggctgaattgaattttggtgctatcacactcaactcgatggatgccacatccgaaagagacttcgtggccgagtttctcttctgggctagcctgtgcatgacccacttgagtagaatggctgaggatctcattctgtactgtacgaaagagttttcatttgtacagctgtccgacgcctacagtaccggctcaagtctcatgccacagaagaaaaacccagatagcctggagctgatcaggtcaaaggccggtagggtattcggtaggtgtgcggggctgctgatgactttaaaaggccttcctagcacctacaacaaggacctgcaggaggacaaggaagcagtattcgaggtcagcgacacaatgagcgcagtcttgcaggtggccacaggtgtgatttctacactgcagattcatcaggaaaatatggggcaggcactgtcacctgatatgctcgcgaccgacctcgcctattatttggtccggaagggaatgccattcagacaagcccacgaggcctcagggaaagccgtcttcatggccgagaccaagggagtggcactgaaccagctttctcttcaggagttacaaacaattagtcccttgtttagtggcgatgtgatctgtgtgtgggattatggacacagtgtggagcagtatggcgctcttgggggaacagctcgctcctccgtggattggcagatcaggcaggtgagggctctgctgcaggcacagcaagcc

SEQ ID NO: 6837 - DNA, 1392 bp, Artificial Sequence
  Description of Artificial Sequence: Synthetic coding sequence
atggctagtgaatctggcaagctgtggggcggacgcttcgtgggtgccgtcgacccaattatggagaaattcaacgcatctatcgcttacgacaggcacctatgggaggtcgatgtccagggttccaaggcatatagccgaggactcgagaaggcaggtctgctgactaaggcggagatggaccagatactccacggtctggataaggtcgctgaagagtgggcccaaggaactttcaaactgaactccaatgatgaggacattcacactgctaatgagcgccgcctcaaggagctgatcggcgctaccgctggtaagcttcataccggccgcagccggaacgatcaggtcgtcactgacctgagactttggatgcgccagacctgttccactctcagcggtcttttgtgggagttgatccgtaccatggtcgaccgtgctgaggccgagcgtgatgtcctgttcccgggctacactcacctgcagcgtgcccagccaatccggtggtcccactggatcttgtcccatgccgttgctcttactcgtgactccgagcgtctcctggaagtgaggaagcgcatcaacgttctaccgctgggctccggcgctatcgccggaaaccccctgggtgttgaccgcgagttgctgcgcgctgaattgaatttcggcgccatcaccctcaactccatggatgcaactagcgagcgcgacttcgtcgccgagttcctgttttgggcctccctttgcatgacccatctcagcagaatggcggaagacttgatcctctattgcaccaaggagttctccttcgtccaactctccgacgcctactcgacaggaagctccctgatgccacagaaaaagaaccctgatagtttggagctaatccgctcgaaggccggtcgggtgttcggccgctgcgctggacttttgatgaccttaaagggtttgccctccacctacaacaaggaccttcaggaagataaggaggcggttttcgaggtatcggacaccatgtcggctgtcttgcaggttgctaccggcgtgatttcaacactgcaaatacaccaggagaacatggggcaagctctctccccagacatgcttgctaccgatcttgcctactatcttgtccgcaagggaatgccttttcgccaagcgcacgaggccagcggcaaggctgtcttcatggcagagaccaagggcgtcgcgttgaatcaactgtcgctccaggaactccagaccatctcgcccctgttctccggcgacgtgatctgcgtgtgggattacgggcacagtgtcgagcaatacggcgcactgggcggcactgcccgttcttccgtggactggcagatccgccaggtccgtgctttgctccaggcgcagcaagcc

SEQ ID NO: 6838 - DNA, 1392 bp, Artificial Sequence
  Description of Artificial Sequence: Synthetic coding sequence
atggcgagcgagtcaggcaaactgtggggcggccgctttgtaggcgccgtggaccctataatggaaaaatttaatgcatccatcgcgtatgaccgacatctgtgggaagtggatgtacaaggctcgaaagcgtattcaaggggactcgaaaaagccggcttactgaccaaagccgaaatggatcaaatcttgcatggtctggacaaagtggcagaggagtgggcgcaaggaacattcaaactcaactctaacgatgaggatatccatacagccaacgaaaggagattaaaagagcttattggagctacagctggcaaactgcacactggtcgctcgagaaatgaccaggtagtgacagacttgcgtctctggatgcgacagacatgctccacactgagcggtcttttatgggagttgatccggaccatggtagatcgcgccgaagcggaaagagatgtgttatttcccggatatacccatttacaacgcgcgcagcctattcgctggtcgcattggatactgtcccatgcagtggctctgacaagagacagcgaaaggctgttggaggtgcgaaaaagaatcaatgtgttgccgcttggatctggcgccattgcgggtaatcctcttggggtcgatagagaactgctcagggctgagctgaattttggggccattacattgaactcaatggatgctacaagcgagcgcgattttgtggctgaatttcttttttgggcgtcgctgtgcatgacgcacctcagccgaatggcagaggacttgattctttattgtacgaaagaattctcttttgtgcaacttagtgatgcgtatagcacgggttcaagcttaatgccgcaaaaaaaaaatccagattcccttgagctcatccgctctaaagctggacgagtatttggcagatgcgcaggattgctgatgacattaaaagggcttccctcaacgtataataaagatctgcaagaagataaggaagcagtttttgaagtttcagatacgatgtctgcggtactgcaggtagcaacaggagtcatttcaacattgcagatacatcaggaaaacatggggcaggccctgtcacccgatatgctggctacagatcttgcctattaccttgttagaaaagggatgccctttagacaagcgcatgaagcgagtggtaaagccgtgtttatggctgaaactaaaggcgtagccttaaatcaactgtctttgcaggagctgcaaacaatttcaccgctctttagtggagacgtgatctgcgtttgggattatggccactctgtcgaacaatatggcgcgcttggcggaacagcccgatcttcggtggattggcagatcagacaggttcgcgcgctgctgcaagcccaacaagcc

SEQ ID NO: 6839 - DNA, 1392 bp, Artificial Sequence
  Description of Artificial Sequence: Synthetic coding sequence
atggcgtccgagagcggcaagctttgggggggacgttttgtgggggctgtcgaccccatcatggaaaagttcaatgcttccatagcctatgaccgtcacctgtgggaagttgatgtccagggaagtaaggcctacagccgtggtctggaaaaggccggactcctgacaaaggctgaaatggaccagatcctgcacggactcgacaaagtcgcagaggagtgggcacaggggacttttaaactgaattccaatgacgaggatatacacaccgctaatgaacgtcgactgaaggaacttattggtgccactgccgggaagctccatacaggtaggtcccgcaacgatcaggtcgtcaccgatttgaggctgtggatgcgacagacctgcagcacattatccggcctgctttgggagctgattagaaccatggtcgatcgtgcagaagcagagcgagatgtgctgttccccggctatacccacctgcaacgagcccagccaattcggtggtctcattggattctgtcacatgccgttgccctcacgcgtgacagtgagagactgctggaggttaggaaacgaatcaacgtattgcccctgggcagcggagccatagccggaaaccccttgggtgtggatagagagctcctccgcgcggagctgaacttcggcgccattaccttaaatagtatggatgcgacttcggagcgggatttcgtagccgagtttctgttctgggcctcactctgtatgacgcatctttcccggatggcagaggacctcattctgtactgtactaaggagttcagttttgttcagctctccgacgcctacagtaccggatcgtccctgatgccacagaagaaaaatccagactccctggagctcattaggtccaaggccggacgtgttttcggccgctgtgccggcctgttaatgacgttgaagggtctcccttcgacgtacaacaaggatctgcaggaagacaaggaggctgtctttgaagtgtccgacacaatgagcgcagtgttgcaggtggcaacaggagtcatttccacgctacagatccaccaggaaaacatgggccaagccctgagcccagacatgctcgccaccgatctggcatactatttggtgcggaagggtatgccgtttagacaggcgcacgaggcctcggggaaagctgtcttcatggcggaaaccaaaggagtggcccttaaccagctgagcttgcaggagctccagacgatctccccactgttctctggggacgtaatatgcgtctgggactacggtcactcggtggagcagtacggggctttggggggcaccgcaagaagctccgtggattggcagatcagacaggtgcgcgcactgctgcaagcccagcaggct

SEQ ID NO: 6840 - DNA, 1392 bp, Artificial Sequence
  Description of Artificial Sequence: Synthetic coding sequence
atggcttccgagagcggtaagctatggggaggacggttcgtgggtgctgtagaccctatcatggagaagtttaacgccagcatcgcctacgatcgccacctgtgggaggtggacgtacaaggttcaaaagcctacagtcgcgggctggaaaaggccggactgctcactaaagcagagatggaccaaatcttgcacggccttgacaaagtggctgaagagtgggcacaaggcacttttaagctcaattcaaacgacgaggatatacacacagcaaacgaaagacgtttgaaggagcttattggcgctacagccggtaaactgcataccggaagatcacggaatgaccaggtggttaccgacctgaggctgtggatgagacagacctgtagcacactgagtggattattgtgggaactgatccggactatggtggacagagcggaagctgagagagatgtgctgttccccgggtatacgcacctccaacgagcccagcctatccgttggagccactggattttgtcccacgctgtggctctgacaagggactcagaacgtctgctcgaggtgcgaaagcgaatcaacgtcctgcccctgggctccggcgccatcgccggaaatcctctcggtgtagaccgggaactgctgagggccgagctgaacttcggggccattaccctgaactccatggacgccacttccgaacgtgactttgtcgccgagttcttgttttgggccagtttgtgcatgacccacttgagccggatggctgaggatctgatcctatactgtaccaaggagttcagtttcgtgcaactcagcgacgcttacagtactggctccagtcttatgccacagaaaaagaacccggatagcctagaactcattcgtagtaaagcagggcgcgtgtttggaaggtgtgcaggcctgctcatgacccttaagggactaccctctacatacaataaagacctccaggaggataaggaagctgtatttgaagtgtccgacactatgtccgcagtccttcaggtggcaaccggggttatcagcactctgcaaatacaccaggagaatatggggcaggcgctgtccccagacatgctggcgacagacctcgcctactatcttgtgagaaagggaatgcctttcaggcaggcacacgaggcttctgggaaggccgtgtttatggcagaaactaaaggggtggccttaaatcagcttagcctgcaggaattgcagaccataagcccactatttagcggggatgttatttgcgtttgggactacggacattcagtggaacagtatggggcactgggcggcactgcacgttcaagtgttgattggcagatcagacaggtgagggccctgctgcaggcacagcaagcc

SEQ ID NO: 6841 - DNA, 1392 bp, Artificial Sequence
  Description of Artificial Sequence: Synthetic coding sequence
atggcttctgaatcaggaaaattatggggagggagatttgttggggctgttgatcctataatggaaaaatttaatgcttcaatcgcatatgatagacatctttgggaagttgatgttcaaggatctaaagcatattctagaggattagaaaaggctggattattaactaaagccgaaatggatcaaattttacatggattagataaagttgctgaggaatgggctcaagggacttttaaattaaatagtaatgatgaagatattcatacagctaacgaaagaagattaaaagaattaattggggcaacagctggaaaattacatacaggaagaagtagaaatgaccaagttgttacagaccttagactttggatgcgtcaaacatgttctacacttagtggattgttatgggaattaattagaacaatggttgatagagctgaagctgaaagagatgttttatttcctggatatactcatcttcaaagagctcaaccaatacgttggtctcattggattttatctcatgctgtggctctaacaagagattcagaaagattgttagaagtaagaaaacgtattaatgtattaccattaggaagtggtgcaatagcaggaaacccattgggagtagatagagaattattaagagctgaacttaattttggagctattactttgaatagtatggatgctacaagtgaaagagatttcgtagctgaatttttattttgggcatcattatgtatgacacatttatctcgaatggctgaagacttaattctttattgtacaaaagaattctcatttgtacaactttcagatgcctattcaacaggaagttcattaatgcctcaaaaaaagaatccagatagtttagaacttattagatcaaaagccgggagagtttttggaagatgtgccggattattaatgacattaaaaggattaccttcaacttataataaagatttacaagaagataaagaagctgtttttgaagtttctgatactatgagtgctgttttacaagttgctactggtgttatatctactttacaaattcaccaggaaaatatgggacaagctcttagtcctgatatgttagctactgatttagcttattatttagttagaaaaggtatgccatttagacaagcacatgaagcttctggaaaagctgtatttatggctgagacaaaaggagtggctttaaatcaattatcattacaagagttgcaaaccatttcaccattattctcaggagatgttatatgtgtatgggattatggacattcagtagaacaatatggtgcattaggaggaactgctagatcaagtgtagattggcaaattagacaagtcagagcattattacaagcacaacaagca

SEQ ID NO: 6842 - DNA, 1392 bp, Artificial Sequence
  Description of Artificial Sequence: Synthetic coding sequence
atggcctcggagagcggaaagctctggggagggagattcgtgggggccgtggatccgatcatggagaagttcaatgcctcaattgcttacgacagacacctctgggaggtggacgtgcaggggtcaaaggcctactcccggggactcgaaaaggctggactgctcactaaagcagaaatggatcagattttgcacggactcgacaaagtggcggaagagtgggcccagggaaccttcaagctgaattccaacgacgaagatatccatacggctaacgaacggcgcctcaaggaactgatcggcgccactgctggcaaactgcacaccggacggagccgtaacgaccaggtggtgactgacctgcggctgtggatgcgccaaacctgctccactctgagcggactgctctgggagctcattcgcacgatggtggacagggccgaggcagaaagagacgttctgtttccgggctatacccacctccagcgcgcacagccaatccggtggtcacattggatcttgtcacatgcggtcgcccttaccagggactccgagcgccttctggaagtccgcaaacggatcaatgtgctgccgctgggttcgggagcaatcgccggcaaccccttgggtgtggatagagagctgctgcgcgcggagttgaacttcggagccatcacgctgaattcgatggatgcgacctcagagcgggatttcgtggcagagttcctgttctgggcatccctctgcatgacccacctgtccaggatggctgaagatctcatcctgtactgcactaaagaattttccttcgtccagctctcggatgcctactcgactggcagctcgctgatgcctcagaagaagaacccagattccctggagctcatccgctctaaggcgggccgcgttttcggaaggtgtgcgggtttgctgatgaccctgaaggggcttcctagcacctacaacaaggacttgcaagaggacaaagaagctgtctttgaggtgagcgacaccatgtcggccgtcctgcaggtcgccactggagtgatctcaaccctgcaaatccaccaagaaaatatggggcaagccctgtcaccggatatgcttgcaactgacctcgcatactacctcgtgcgcaagggtatgccgttccgacaggcgcacgaagcctcggggaaggcagtgttcatggcggaaaccaagggagtcgctctgaaccagctgtcccttcaggaactgcagactatctctccactcttttcgggcgacgtgatctgcgtctgggactacggacatagcgtcgaacagtacggagcccttggaggcactgcgagatcgtccgtggactggcagattagacaagtgcgggccctgcttcaagctcaacaagcg

SEQ ID NO: 6843 - DNA, 1392 bp, Artificial Sequence
  Description of Artificial Sequence: Synthetic coding sequence
atggcatcagaaagcggcaaactctggggggggcgattcgtgggagctgtggacccaattatggagaagttcaacgcaagcattgcctacgatagacacctctgggaagtagatgtgcaaggctccaaagcttatagccgtgggctcgagaaagcgggtttactcactaaggccgagatggaccagattctccatggccttgacaaggtggctgaagaatgggcacagggtaccttcaagctgaacagcaatgatgaggatatccacactgcaaacgaacgcagattgaaggaattgattggagccacggcagggaagttgcataccggccggagcagaaacgatcaggttgtcacagatttgagactatggatgcgtcaaacttgtagtacgctctctgggttactgtgggagctgatccggacgatggttgatcgcgctgaggccgagagagatgtcctgttccccggctacacacacttacaacgagctcagcccattagatggtcgcactggatcctgagtcatgctgtggcgctcactagagatagtgaacgacttctggaagttcgaaaaaggataaacgtcctgcccctgggatcgggcgccatcgcaggaaatcctttgggcgtggacagggagcttctacgcgccgagctgaactttggggccattacattgaactctatggatgccacctctgagcgcgattttgtagccgagttcctcttctgggccagcctatgtatgactcacctttctcgtatggccgaggacttgatcttgtattgtacgaaggaattttctttcgtgcagctgagcgatgcttactctaccggttcttctctaatgcctcaaaaaaagaaccccgacagccttgaattaattaggagtaaagcgggcagagttttcggacgttgcgctggactgctgatgaccctaaaggggcttccgagtacttacaataaagaccttcaggaggacaaagaagctgtgttcgaagtgtctgacactatgtccgcagtgctgcaggtggcaaccggtgtgatttctacacttcaaatacaccaagaaaacatgggccaagctctctctcccgacatgctggctacagatttagcatattatctcgtccggaaaggaatgccctttcggcaagcacacgaggcctcaggaaaagcagtttttatggcagagaccaaaggagtggccctgaaccagttgtccctacaagaattgcaaacaatctccccactgttcagcggagacgtaatctgcgtctgggattacggtcactccgttgaacagtacggtgctctcggcggcactgccaggagctccgtggactggcagatacgacaagtccgggctctcctgcaagcacagcaggcc

SEQ ID NO: 6844 - DNA, 1392 bp, Artificial Sequence
  Description of Artificial Sequence: Synthetic coding sequence
atggcttccgaatccggtaagctgtggggtggtcggtttgtgggcgctgtggacccaataatggagaagtttaacgcatctatagcgtatgaccggcatctgtgggaagttgatgtgcagggatctaaagcctacagccgcggcctggagaaggctgggttgcttactaaagctgagatggatcagattctgcacggattagataaggtcgctgaggagtgggcacaaggaactttcaagctcaatagcaatgatgaagatatccacacagccaatgagagacgcctgaaagagctcatcggtgcgaccgcaggtaagctgcacacaggtcggtccagaaacgaccaggttgtcacggatttaagattatggatgcgacagacgtgctcaactctgagtggactcttatgggagctgataaggactatggttgatagagccgaagctgagcgggacgtcttattccccggttacacccatctgcagagggctcagcctattcgttggtcacactggattctgtctcatgcagtagccctgacaagggattctgaaaggctactggaggtcaggaagcgcatcaatgtgctaccactgggcagcggtgctatagcaggcaaccccctcggcgttgatcgagagttgctccgcgctgagctgaacttcggtgccattacgctaaacagcatggacgccacatctgaaagggacttcgtcgctgaatttctcttttgggcttccctctgcatgacccatctctcgcgtatggctgaggacctcatcctctattgcaccaaagaattctcttttgtccagctgtccgacgcatacagcaccggttcttctttgatgccacaaaaaaagaacccagactcattggagttgatccgatccaaggcaggccgcgtgtttggcagatgcgccgggctgttaatgacactgaaagggctcccgtctacctacaacaaagacctgcaggaagacaaagaggccgtgtttgaagttagcgacacaatgagcgctgtcctacaggtggcgactggagtgatatccaccctgcaaatccaccaggaaaatatgggacaagctctgagtcccgacatgcttgcaacagaccttgcatactatctggtgcggaaaggcatgccctttaggcaagcccacgaagcttctggcaaggccgttttcatggctgagacgaaaggggtggcactaaatcagttgtccctgcaggaacttcagacaatctcccccttgttttcgggagatgttatctgcgtctgggattacgggcactcagtggaacagtacggagcactgggcggaactgctcgaagctcagttgactggcagattcgccaggtgcgcgctctgttgcaggctcagcaggct

SEQ ID NO: 6845 - DNA, 1392 bp, Artificial Sequence
  Description of Artificial Sequence: Synthetic coding sequence
atggccagcgagagtgggaagttgtggggcggaagattcgtgggagctgtggatccgattatggaaaaattcaatgcttcaatcgcttacgataggcacttgtgggaggtcgatgtgcagggttccaaggcctactcccggggtctcgaaaaagccggcctcctgaccaaggctgagatggatcagatacttcatgggctagacaaagtggctgaagaatgggcccagggaacttttaaactcaactccaatgacgaggatattcatactgcaaacgagcgcaggctaaaggaacttattggagccaccgcgggtaagctgcataccgggagaagccggaatgatcaggtggtcacggatctgcgtttatggatgcgccagacttgttccaccttgtccggactgttgtgggaattgatcaggaccatggtggaccgtgcagaagcggagcgggacgtgctctttccaggctacacccatctccaaagggcccaacccattcggtggagccattggatcttgtcccatgccgtggcgctcaccagggacagtgagcggttgctagaagtgcgcaaaagaatcaacgtgctaccactggggtccggtgcgattgcaggcaacccactaggcgtggaccgcgaattgcttcgggcagagctgaatttcggggcaattaccctgaatagtatggatgccacttccgagcgcgatttcgtggctgagtttttgttctgggcctctttgtgtatgactcatctgagcagaatggctgaagaccttattctgtactgcacgaaggaatttagttttgtgcagctgagtgatgcctacagcaccggttcaagcttgatgccccaaaagaagaacccagacagcttggagctgatacgaagcaaagccggccgcgtctttgggcgttgcgccgggctgcttatgactctgaaaggcctgccctccacatacaataaggatctgcaagaggacaaggaagccgtgtttgaggtgtcagataccatgagcgccgtgctgcaggtggcaaccggcgtgatctccacattgcagatccaccaggaaaatatggggcaggctttaagccccgatatgctggcaacagatctggcgtactatttagtgagaaaaggaatgccttttcggcaggcccacgaggccagcggcaaggccgtattcatggcggagaccaagggagtggctctcaatcagctgtcactgcaggaactgcagacaatctctcctctgttttccggagacgtcatttgtgtgtgggattacggccactctgttgaacaatacggcgccctcggtggtacagcaaggtccagcgtggactggcagatcagacaggtgagagcccttttacaggcccaacaagcc

SEQ ID NO: 6846 - DNA, 1392 bp, Artificial Sequence
  Description of Artificial Sequence: Synthetic coding sequence
atggccagtgagtccggcaaattatggggcggccgatttgtgggcgctgtcgaccccatcatggagaagtttaacgcatccatcgcttacgatagacatttgtgggaggtggatgtgcaaggttcaaaagcctattcaagaggccttgagaaggccgggctgcttaccaaggccgaaatggaccaaatccttcatggattggataaagtcgcggaggaatgggcgcaaggaactttcaagctgaactcaaacgatgaggatatccatacagcaaacgagcggcgactaaaggagctgatcggagctactgcggggaagcttcacactggacgatcccgcaacgatcaggtggtcaccgatctgagactgtggatgagacagacttgctcgacgctgtccggcttgctgtgggagctcataagaactatggtagatcgtgccgaggcagaaagggatgttttatttcctggatatacacaccttcagagggctcaacccatcaggtggtcccactggatattgtcacatgccgtggccctaaccagggactcagagagattgctcgaggttaggaagaggattaacgtgctacccctgggatcaggagcaatcgccggtaatcccttaggggtggatcgggagcttcttcgggcagaacttaatttcggcgccatcactctcaacagcatggatgccacatcagagcgcgacttcgtcgctgagtttctgttttgggcatcactttgcatgactcacctgagtagaatggccgaggatctcatcttgtattgtaccaaggaattcagcttcgtccagctttcagatgcatacagcactgggtcctccctgatgccccagaagaaaaatcctgactcgctggagttgatcaggtctaaggccggaagagtgttcggaagatgcgccgggctgctgatgacgttgaaaggacttccatctacgtataacaaagatcttcaggaggacaaagaggcagtgtttgaggtatcagatactatgtcagcggtactccaggtggctaccggagtgatatctactctgcagatccaccaggaaaacatggggcaggccctgtcccctgacatgctggctacagacctcgcatattacctggtgcgtaaagggatgccatttagacaagcacacgaggcttcagggaaggcggttttcatggcagagaccaaaggtgtggccctaaaccagctgtccctgcaggagctgcagacgatctcaccgctatttagtggagacgtgatatgtgtttgggattacggccattctgtcgagcaatatggcgcgctgggcggaaccgccaggagcagtgtggactggcagatacggcaggttcgcgctctcctgcaggcacaacaggca

SEQ ID NO: 6847 - DNA, 1392 bp, Artificial Sequence
  Description of Artificial Sequence: Synthetic coding sequence
atggctagcgagtccgggaaactttggggaggacgattcgttggagccgttgatccgattatggagaaatttaatgcgtctatcgcatacgatcgccatctctgggaggttgatgttcagggttcaaaggcgtactctcgtgggcttgagaaagcgggcctactgacgaaggcggagatggatcagatcctgcatggattggacaaggttgcagaggaatgggctcaaggcacttttaagctaaatagtaatgatgaggacattcataccgccaacgaacgaagactgaaagaactgattggagcaacggccggaaagttgcatacaggtcgttctaggaatgaccaagtcgtgaccgatctcaggctctggatgagacaaacttgtagtacactgtctggattgctttgggagcttatccgcaccatggttgaccgggctgaggctgagagagatgtgctatttccagggtacacccatctgcagagagctcaacccattcgttggagccattggatcctctcgcacgcagttgcattaacccgcgatagcgaacgtctgctcgaggtacgcaagcggattaatgtactcccactcggttctggcgctatcgcgggcaaccctttgggtgtggatagagaactcctgcgagctgaactcaatttcggggccattacgttaaactccatggacgcaacatctgagcgagatttcgtggccgaattcctgttctgggcctcgctttgcatgacacacctctctcgcatggccgaggatctaatcttgtactgtacaaaggagttctctttcgttcagctctccgacgcgtactcaaccggctcctccctgatgcctcagaagaagaatccagattctctagaactaatacgctctaaggctggtcgtgtttttgggcgttgcgcaggcctacttatgacactcaagggtttaccatcaacttataacaaggacctccaggaagacaaggaggcagtttttgaagtcagcgacacgatgtctgctgtcctccaggttgcaactggcgttatatctaccctgcagattcaccaagagaacatgggccaggcgctaagtccagacatgttagcaaccgacctcgcgtattacctggtcagaaaaggcatgccctttcgccaagctcatgaggcctctggtaaggccgtttttatggctgagacaaaaggtgttgcattgaatcaacttagcctgcaagagcttcaaacaatctctcctctctttagtggtgacgtaatttgcgtttgggattacggtcacagcgttgagcaatatggggcgctgggcggaacggcccggagttcagttgactggcaaattcggcaggttcgagcattgcttcaagcgcagcaagcc

SEQ ID NO: 6848 - DNA, 1392 bp, Artificial Sequence
  Description of Artificial Sequence: Synthetic coding sequence
atggcctcggagtctggtaagctatggggaggacgattcgtcggcgccgttgatcctattatggagaaattcaatgcctccattgcctacgaccgacatctgtgggaagtggacgtgcagggctcgaaagcctacagtaggggactcgaaaaagcaggattgttgacaaaggctgaaatggatcagattctgcacggactggataaggtcgcagaagagtgggcgcaggggacattcaagttaaatagcaatgatgaggacatccatactgccaatgagcgacgcttgaaagagttgatcggagctactgccggaaagttgcataccggtcggtcaaggaacgatcaggtggtgacagatcttcggctgtggatgcgacagacatgtagcacactaagcgggctcctgtgggagctcattcgcacaatggtggatagagccgaagctgaacgtgatgttctttttcccggctacacccacctccagcgagcgcaaccaattcgatggtctcattggattctttcccacgcagtggctctgactagggatagcgagaggcttttggaggtccggaagcggattaacgttcttccccttggctcaggagcaattgctggcaaccctttaggcgtggacagagaacttctcagagcggaattaaattttggtgccatcacactgaactccatggacgctacttccgaaagggactttgtagctgaatttttgttttgggcctctctatgcatgacacacctgtcacggatggctgaagatctgattctttactgtacgaaggaatttagctttgtgcagctgagcgacgcgtattctactgggagttcactgatgccccagaaaaagaaccctgactccttagagctgataagatcaaaagcaggtcgggtgttcggacgctgtgcaggtctgctgatgacactcaagggtctgccatctacttacaataaagatctgcaagaagataaagaggccgttttcgaggtatcagacacgatgagcgccgttctccaggtggctaccggggtcatctcgacgttgcagattcaccaagaaaatatgggccaggctctgtcaccggatatgctggcaacggatctcgcctactacttagtcaggaaaggcatgccgtttaggcaggctcacgaggcgtcgggcaaggccgtgttcatggccgagactaagggggttgccctcaatcagctttcacttcaggagctccagaccatctcacccctgttttccggcgatgttatctgcgtgtgggactacggacactccgttgagcagtatggtgcgctgggcggaacagcaaggtcgtccgtagattggcaaatcagacaggtgcgggcactgcttcaggcacaacaggct

SEQ ID NO: 6849 - DNA, 1392 bp, Artificial Sequence
  Description of Artificial Sequence: Synthetic coding sequence
atggcatcagaatcaggcaaactttggggtggtcgattcgtgggggccgttgacccaattatggaaaagtttaatgctagcatcgcttatgatcgtcatctatgggaagttgatgtgcagggcagcaaggcctattcacggggactggaaaaagcagggctgctcacaaaggctgaaatggatcagatcctacacggattagataaggtggcggaagagtgggcacagggtacttttaaactgaattcgaatgatgaagacattcacactgcaaacgagaggcgccttaaggagttaataggagctaccgccggcaaattgcacactggaaggagcagaaatgaccaggtggttaccgatttgcgcctgtggatgcgacaaacttgttcgaccttatcgggccttttgtgggaattgattaggaccatggtcgaccgcgccgaggccgagcgggatgttttattccctgggtacacccacctgcagcgcgcacagcctataagatggagccattggatcctctcccatgccgttgccctgacgagagactccgagaggttgctggaggtgcgcaaacggatcaatgtgttgccattgggaagtggtgctattgccggcaatcccctgggcgtcgaccgtgaacttctgcgggctgaactgaatttcggtgcgataacattgaacagcatggacgctacttcggagcgcgacttcgtggccgaatttctgttttgggcctccctgtgtatgactcacctaagtagaatggctgaggacttgatcctgtactgtacaaaagagttcagttttgtgcagttatccgacgcatattccacgggatcgtccctcatgccacagaagaagaatccagattctctggaactcataagaagcaaggccgggcgcgtgtttggtaggtgtgccggtcttcttatgaccctcaaggggcttccctccacctacaataaagatctccaagaggataaggaagccgtttttgaggtgtcggatacaatgtcagcagtcctgcaggtggcgacaggagtgataagcacgctgcagatccaccaggagaatatgggccaggccctttcgcccgacatgcttgcgactgacctcgcatactacctggttaggaagggaatgcccttccgccaggcacatgaggcatcaggaaaggccgtttttatggccgagaccaagggagtagccctgaaccagctgtccctgcaagagttgcagaccatctctcccctgttttctggcgacgtaatatgtgtgtgggactatggccatagcgtagagcagtacggagcccttgggggaacggccagatcttctgtggactggcagatcagacaagtgcgcgcgctgctacaggcccaacaggca

SEQ ID NO: 6850 - DNA, 1392 bp, Artificial Sequence
  Description of Artificial Sequence: Synthetic coding sequence
atggctagtgaatccggtaagttgtgggggggaagatttgttggcgccgttgaccctattatggagaagttcaacgcttctatcgcatatgatagacatctgtgggaggtagatgtccaaggatctaaggcatattcgcgtggtctcgaaaaggcaggattactgaccaaagcagagatggatcaaatcttgcatggtcttgacaaagttgcggaggagtgggcacaaggaaccttcaaattgaactctaatgatgaggatattcatacagccaatgagcggagattgaaagaactcatcggtgcaactgccggtaagttgcacactggcaggagtagaaatgaccaggtcgtgaccgatttgcgattatggatgagacaaacctgttctaccttgtctggtttgctttgggaattaattcgtaccatggttgatagggctgaggcagagagagacgtgttgttcccagggtatactcatctccaaagagcacaaccgatacgttggtctcactggatcttgtcgcacgctgtggccctgactagggactcagagcggctattggaagttagaaagagaattaatgtattgcctttgggttcaggtgctatcgcaggtaatcctcttggagtcgatcgagagttgttaagggcagaacttaatttcggagccataaccttaaacagcatggacgccacgagcgaacgtgatttcgtggccgagttcttgttttgggcttctctctgcatgacacatctgtccaggatggccgaagatctcatactttactgcacgaaggagttcagctttgtgcaattgtctgatgcttactctaccggttcctctcttatgcctcagaagaaaaaccctgacagtcttgagctcatcaggtctaaagcaggtagagttttcgggcgctgtgctggcttactcatgactttgaagggacttccaagtacctacaacaaggacctccaagaggacaaagaggctgtgttcgaggttagcgacacaatgtctgctgtccttcaagtggctactggcgttatttcaacccttcagatccatcaagagaatatgggtcaagctttgtctccagatatgttagcaacagatctggcatattatttagttagaaaggggatgccatttaggcaagctcatgaggcttccggaaaagctgtttttatggcagagaccaagggtgttgctttgaaccagctgtctctccaagaacttcaaacaatctcaccactcttcagtggagatgttatttgtgtatgggattatggtcactctgtggagcaatatggagcactcggaggaacggcaaggtcctccgtagattggcagatccgacaggtcagagctcttttacaggctcagcaagcc

SEQ ID NO: 6851 - DNA, 1392 bp, Artificial Sequence
  Description of Artificial Sequence: Synthetic coding sequence
atggcctcggaatctggaaagctatgggggggacggtttgtgggagcagtcgatccaatcatggagaagttcaacgcatcgatcgcgtacgatagacacctctgggaagttgatgtgcaaggatcgaaggcatacagccggggattggagaaagcaggacttcttacaaaggcagagatggaccaaatattacatggattggacaaagtcgccgaagagtgggctcagggaacattcaaattgaatagcaatgatgaagatatccacacagctaatgaacgacgcttgaaggaactcattggagctactgctggtaaactccataccggaagatcgcgaaacgatcaagtcgtaacagatctgaggttatggatgcgacaaacctgttcgactttgtccgggctgctctgggaacttatcagaaccatggtcgaccgagcagaagccgaaagggatgttctcttcccagggtacactcatctccaaagagcgcaacctattcgatggtcgcattggattttgtcgcacgcagttgctctcacaagagattccgagagactacttgaagtgaggaagcgtattaatgttcttccacttggaagtggagctatcgccggaaatcctttgggagtggatcgggaattgcttagagcagagcttaattttggagctatcacactaaattctatggatgctacgagtgaaagagacttcgtcgctgagtttctcttctgggcatctttatgcatgacccacttaagtagaatggcggaagacctcattttgtactgtactaaagagttttccttcgtccaactctccgatgcttattcaaccggatcatcactgatgccacagaaaaagaatccagattcacttgaattaattcgttccaaagctgggcgcgtttttggacgatgcgcgggtctactgatgacactgaagggactgccgtcaacttacaacaaagatctacaagaagacaaggaagcagtctttgaagtatcagatactatgagtgcagttctgcaagttgctactggagtgatttcaaccctccaaattcatcaggaaaatatgggacaagctctttccccagacatgctcgccacagacttagcatattacttggttagaaaaggaatgccgtttagacaggcacacgaagcttcgggcaaagctgtttttatggctgagactaaaggtgtagcattgaatcaactctccttacaagagttgcaaacgattagcccattattttcgggagacgttatctgtgtttgggattacggacactccgtggagcagtatggagccctgggaggaacggctcgaagttcagttgattggcaaatacgccaggtcagagctttgcttcaggcacaacaggcc

SEQ ID NO: 6852 - DNA, 1392 bp, Artificial Sequence
  Description of Artificial Sequence: Synthetic coding sequence
atggccagtgagtctggcaaactgtggggagggcgcttcgtgggcgccgtcgatccaattatggagaaatttaacgcctccatcgcctacgatcgtcatctgtgggaagtcgatgtccaaggtagtaaagcttacagtcgaggtttagaaaaggccgggctgctcaccaaggccgagatggatcaaatcctgcacggcctcgataaggtagctgaggagtgggcccagggtacctttaagctgaatagcaatgatgaggatatccataccgctaacgagaggagactcaaggaactgattggagccaccgcagggaaactgcacactgggcggagccgaaacgaccaagtcgtgactgacctgaggctgtggatgcggcagacatgttccaccctctccggcctgctgtgggagctgattagaaccatggtggaccgggccgaggccgaaagggatgttctgttcccagggtacactcatttacagagggctcaaccaatccggtggagccactggatactgtcacatgcagtggccctcacccgggattccgagagacttctggaagttagaaagaggatcaatgtcctgcctctgggctccggggccattgccgggaatccactgggtgtggatagagagctattgagagccgagctaaatttcggcgccattacactaaattcgatggacgccaccagtgagcgagactttgtggccgagtttttattttgggcatctctttgtatgacccacttgtcacggatggccgaagatctcatcctttattgtacaaaggaattttctttcgtgcaacttagtgacgcttactcgacaggcagtagcctgatgcctcagaaaaaaaatcctgacagtctcgagttgatccgctctaaggccgggagggtttttggacgctgtgctggcttgttgatgaccctgaagggcctgccatcaacttacaataaggacctccaggaagataaggaggcggtgtttgaggtatcggacacgatgtccgcagtgctgcaggtcgccacgggagtgatttccacccttcaaatccaccaagaaaacatgggccaggctttgtcaccagatatgctggcaaccgacctggcatattatctggtgcgtaagggtatgccttttagacaggcccatgaagcaagcgggaaagctgtgtttatggctgaaaccaaaggcgtggcactgaatcagttatcgttacaagagctccaaaccatttcacccttgttctctggcgatgtaatttgtgtgtgggactacggccactcagttgaacagtacggagcccttggcggcacagcacggtcatccgtggactggcagatacgccaggtgcgagcccttctgcaggcacagcaggcc

SEQ ID NO: 6853 - DNA, 1392 bp, Artificial Sequence
  Description of Artificial Sequence: Synthetic coding sequence
atggcttctgagagcggcaagctgtggggagggcgctttgtaggcgcggtggatccgatcatggagaagtttaacgcatcaattgcatatgatagacacctctgggaagtggacgtccaagggtctaaggcctatagcaggggacttgagaaagccgggctcctgacgaaggctgaaatggatcagattctgcacgggctggacaaggtagctgaggagtgggctcaagggacttttaagttgaattctaacgacgaggacatccacacagccaacgaacgacgactgaaagaactgatcggagcaactgcaggaaaactgcatacaggacgctcaagaaacgaccaggtggtcaccgaccttagactttggatgaggcagacatgtagcactctctctggcctcctgtgggaactgattagaaccatggtcgatagggcagaggccgaacgcgacgtgcttttccctgggtatacacacctccagagagcccaacctatccgctggagtcattggatcctgtcccacgccgtggccctgaccagagattcagagcgactcctggaagtgaggaaaagaatcaacgtgctgccccttgggtccggcgccatcgccggtaaccctctgggtgtggatcgagagctgctccgcgcagagctcaacttcggcgccattacattgaacagcatggacgccacaagtgagcgggactttgtggccgaattcctgttttgggcttccctgtgcatgacacacctgtccaggatggcagaggacctgattttgtactgtaccaaagaattcagttttgttcagctcagtgatgcctatagcaccgggagctctcttatgccgcagaaaaagaatccagatagcttggaactgattcgctctaaggccggtagagtctttgggcgctgcgcgggcctgctgatgacactcaagggcctgccgtccacttacaataaagatctccaggaagataaggaagccgtctttgaggtcagcgacaccatgtccgctgtgctgcaggtggcaaccggtgtgatttccactttgcaaatacaccaggagaatatgggacaggccttgtcccccgatatgctcgctacagacctggcatattacctggtgcgcaaaggtatgccttttcggcaggcccatgaagcgtctgggaaggcggtttttatggccgaaactaaaggcgttgctcttaatcagctgagtcttcaggagctccagactattagcccactgttctcaggagatgtgatttgtgtttgggactacggacattccgtggagcagtacggtgctttggggggaactgcacgctccagtgtggactggcaaataaggcaggttcgagctctgcttcaggcccaacaagcc

SEQ ID NO: 6854 - DNA, 1392 bp, Artificial Sequence
  Description of Artificial Sequence: Synthetic coding sequence
atggcaagcgaaagcggcaagctctgggggggtcgattcgtcggggccgtggaccccatcatggagaagtttaatgcctccattgcgtacgatcggcacctctgggaggtagacgtgcaggggagcaaagcgtattcacgtggactggaaaaagcggggcttctcactaaagcagagatggaccagattcttcacggtctggataaagtcgctgaagagtgggcacagggcacgttcaagctgaactctaacgatgaagatatccacactgcaaatgagcgcaggctgaaggagttgataggcgctacagccgggaagctccacacgggcagatcacgaaacgaccaggtggtgacagatttacggttatggatgcgtcaaacgtgttccactttatcagggctcttgtgggaattgattcgcactatggtcgatagggccgaagcggaaagagatgtgctgttcccgggctacactcacttgcaacgggcacagccaatccgctggtctcactggatcctcagccatgccgtagccttgacgagagattcagagaggctcctcgaggtgcgcaaacggattaatgtactgcccctgggcagtggcgccattgctgggaatcccttaggtgttgacagggagctgctccgagctgagcttaatttcggtgctatcactcttaattcaatggacgctactagcgagcgcgatttcgttgctgagtttctattctgggcctctctttgtatgacccatctttctagaatggcagaggatttaatcctctattgtacaaaagagttttcatttgtccaactgtcagatgcctactcaaccggctcttcgctgatgccacagaaaaagaaccccgactctcttgagctgattagaagcaaggcggggagggtgtttggtcgatgtgcaggtctgctgatgacattgaagggcttgccgagtacttacaataaagacctccaggaggataaagaggctgtatttgaagtgtctgatacgatgtccgccgtgttacaagtggctactggggtcatctctaccttgcagatacaccaagagaatatggggcaggcactgagtcccgatatgttggctaccgatttagcctactatctggttcgaaaaggtatgcctttccggcaggcccacgaggcctccggaaaggctgtcttcatggccgaaaccaagggtgtcgctctaaaccagttgtcgctgcaggagctccagactatctccccactatttagtggcgacgtgatctgcgtgtgggattacggccactcagtggaacagtatggagctctgggcggcactgcccgctccagcgttgactggcaaatcaggcaagtccgagcgttgctgcaagctcaacaagcc

SEQ ID NO: 6855 - DNA, 1392 bp, Artificial Sequence
  Description of Artificial Sequence: Synthetic coding sequence
atggcttccgagtccggaaagttatggggaggacgtttcgtaggcgcggtggaccccatcatggaaaaatttaatgcctctatcgcatacgacagacatctctgggaggtggatgtccagggctccaaagcttactcaaggggcctggaaaaggccggccttcttacaaaggctgagatggaccagatcctgcatggcctcgacaaggtggcagaagagtgggcccaggggacattcaagttgaacagtaatgacgaggacattcacaccgccaatgagcgtcggttgaaggagctgattggcgcaacagcaggcaagcttcatactgggagatctcgtaacgatcaggtggtgacagacctgcgcctgtggatgcggcaaacatgttccacacttagcggattactgtgggaactgatcagaaccatggtggatagagctgaggcagaaagagatgtgctcttcccaggctatactcacctgcagcgcgctcagccaatccgatggagtcactggattttgtcacatgcagtggctttaaccagagattccgaacggctgcttgaggtgagaaagagaatcaatgtcctgcccctgggttccggggccattgcaggcaatcctctgggggtggatcgggagctgctcagagccgagctgaatttcggggctatcactctgaattctatggacgcaacaagcgaacgggacttcgtggccgaatttttgttttgggctagtttgtgtatgacccatctgagtaggatggcggaagacctaattctgtactgcaccaaagaattctcttttgttcagctgtctgacgcatactctacagggtcaagcctgatgccccagaagaagaaccctgattccttggagctaatccggtccaaagcaggccgggtttttggtagatgtgctggactgctcatgaccttgaagggcttgccaagcacctataacaaggacctgcaggaggacaaagaggctgtctttgaggtgtccgacactatgtctgcagtcctgcaggtcgctactggtgtaatctccacattgcagatccaccaggagaacatggggcaggcattgtcccctgatatgctggcaactgatttggcttactaccttgtgcgtaaaggaatgccctttcggcaggctcacgaggcttcggggaaagctgttttcatggccgaaacgaaaggcgtggctctgaaccaactgtctctacaggagctccagacgatcagcccattattcagcggtgacgtaatctgcgtgtgggactacgggcattcggtagagcagtacggagctctggggggcacggccaggagttccgttgactggcagattcgacaggtgcgcgccctgctgcaggcccagcaagcc

SEQ ID NO: 6856 - DNA, 1392 bp, Artificial Sequence
  Description of Artificial Sequence: Synthetic coding sequence
atggcgtcggaatcgggtaaattatggggtggtcgttttgtaggtgcggttgatccgataatggaaaaatttaatgcgtcgatagcgtatgatcgacatttatgggaagtagatgttcaaggttcgaaagcgtattcgcgtggtttagaaaaagcgggtctattaacgaaagcggaaatggatcaaatactacatggtttagataaagtagcggaagaatgggcgcaaggtacgtttaaactaaattcgaatgatgaagatatacatacggcgaatgaacgtcgattaaaagaattaataggtgcgacggcgggtaaattacatacgggtcgttcgcgaaatgatcaagttgttacggatctacgtctatggatgcgtcaaacgtgttcgacgctatcgggtctactatgggaattaatacgaacgatggttgatcgtgcggaagcggaacgtgatgtattatttccgggttatacgcatttacaacgtgcgcaaccgatacgatggtcgcattggatattatcgcatgcggttgcgttaacgcgtgattcggaacgtctactagaagttcgtaaacgtataaatgtattaccgctaggttcgggtgcgatagcgggtaatccgttaggtgtagatcgagaattactacgagcggaactaaattttggtgcgataacgttaaattcgatggatgcgacgtcggaacgagattttgttgcggaatttttattttgggcgtcgctatgtatgacgcatttatcgcgtatggcggaagatctaatattatattgtacgaaagaattttcgtttgtacaattatcggatgcgtattcgacgggttcgtcgttaatgccgcaaaaaaaaaatccggattcgctagaattaatacgttcgaaagcgggtcgagtatttggtcgttgtgcgggtctattaatgacgttaaaaggtttaccgtcgacgtataataaagatttacaagaagataaagaagcggtttttgaagtttcggatacgatgtcggcggtactacaagttgcgacgggtgtaatatcgacgttacaaatacatcaagaaaatatgggtcaagcgctatcgccggatatgctagcgacggatttagcgtattatttagttcgtaaaggtatgccgtttcgtcaagcgcatgaagcgtcgggtaaagcggtatttatggcggaaacgaaaggtgtagcgttaaatcaattatcgctacaagaattacaaacgatatcgccgctattttcgggtgatgtaatatgtgtttgggattatggtcattcggttgaacaatatggtgcgttaggtggtacggcgcgttcgtcggttgattggcaaatacgtcaagtacgtgcgttattacaagcgcaacaagcg

SEQ ID NO: 6857 - DNA, 1392 bp, Artificial Sequence
  Description of Artificial Sequence: Synthetic coding sequence
atggccagtgagtctggtaagctgtggggggggcggttcgtgggagccgttgaccccattatggagaaatttaatgctagtatcgcttacgacagacatctgtgggaagtggatgtgcagggctccaaggcttacagccgggggctggagaaggccgggctgcttaccaaggccgaaatggaccaaattcttcatggcttagataaagtggctgaggagtgggcccaaggaacctttaagctaaattccaacgacgaagacatacatacagcgaacgagagaaggctaaaggaattgatcggagccacagccggaaagctccataccgggcgaagtagaaatgatcaggtggtgaccgacctgagactatggatgagacagacctgcagcaccctgtctgggcttttatgggagttgatccgtacaatggtagacagagccgaagctgagcgggacgtgctcttccccggttacacgcacctccaacgcgcacagcccattagatggtcacactggattttatctcacgcggttgcactgactcgtgattcagaacgactgcttgaagtccgtaaacgcattaacgtgctacccctcggtagcggggccatcgcaggcaatcctttgggggtggatagggagctgctacgggcagagctcaatttcggagccatcaccctgaatagcatggatgcaactagtgaaagagacttcgtcgcagagttcctgttctgggcctcactgtgtatgactcatctttcccggatggctgaggacctcatattgtactgtactaaagaattcagcttcgtccagctgagcgatgcctacagcactgggagcagcctgatgccacaaaaaaagaatccggacagcctggaactgatacgctccaaagctgggcgggtcttcggacggtgcgccggactgctgatgaccctaaaaggcctacctagtacctacaataaagacttgcaggaggacaaagaggctgtattcgaggtcagtgatacaatgtccgcggttttacaggtggccacaggcgtgatctcgacattgcagattcatcaggaaaacatggggcaggctctttcccctgacatgttggctactgatctggcttattatcttgttcgcaagggaatgccttttcgacaggctcacgaggccagcggcaaagccgtgttcatggccgagacgaaaggtgtcgccctgaaccagttaagcctccaggagctacagacaatttcccccttattcagtggagacgtgatatgtgtctgggactacgggcattctgtggaacaatacggcgcactcgggggaacagcccgtagcagtgtagactggcagatcaggcaggtgcgggcactcctgcaggcacagcaggct

SEQ ID NO: 6858 - DNA, 1392 bp, Artificial Sequence
  Description of Artificial Sequence: Synthetic coding sequence
atggcctccgagtcggggaagctgtggggtggacgattcgtgggagcagttgacccaattatggagaagttcaacgcatccatcgcatatgaccgccatctctgggaggttgatgtacaagggtctaaggcatattctaggggtttggagaaggcaggcctgctaaccaaagcagagatggaccagattcttcacggtctggataaagtggccgaggagtgggctcaagggacattcaagctgaacagcaacgacgaagatatccataccgcaaatgagcgtcggcttaaagagttgatcggagctaccgcaggaaagctgcacactggtaggagccgaaacgatcaggtggtgacggacctccgtctatggatgcgacagacgtgtagcaccctgtccggcctgctctgggaactgatccggacgatggtggacagggcagaggccgagcgtgatgtgctttttcccggttacactcatctgcaaagagctcaaccaatacggtggagccactggatcctgtcccatgcggttgcgcttactagagacagtgaaaggctgttggaggttaggaagaggatcaacgttctgcctctcggatcaggggcaattgccggaaaccccctcggcgttgatcgggaactgctcagggctgagctgaattttggggcaattactctgaactctatggacgccacatcagaacgggatttcgtggctgagtttttgttctgggcttccttgtgtatgacccatctgtctcgcatggctgaggacttgattctctattgtactaaggagtttagcttcgtgcagcttagtgatgcttactccaccggatccagcctaatgcctcaaaagaaaaaccccgattcactcgagctgattcgcagtaaagccgggagagtctttggcagatgcgcaggcctcctgatgacactcaaggggctacccagcacttataacaaggatcttcaagaagataaagaagcagtcttcgaagtttccgatactatgagcgcagtcttgcaagtggcaaccggagtcatttcaactctgcagatccaccaggagaatatgggccaggccctatctccagacatgctcgctacagacttagcctattatttggtgcgcaagggcatgccttttaggcaggcgcacgaagccagcggcaaggccgtttttatggctgaaacaaaaggcgtggctctcaaccagctctcactacaggagctgcagacaatatctccactgttttcaggggatgtcatatgcgtctgggactacgggcactcagtggagcagtatggtgccctgggcggaactgcgcgatctagcgtggactggcagattcggcaagttagagcacttttgcaggcccagcaagca

SEQ ID NO: 6859 - DNA, 1392 bp, Artificial Sequence
  Description of Artificial Sequence: Synthetic coding sequence
atggcgtccgagtccggcaagttgtggggcggccggtttgtcggagctgtggaccccatcatggaaaaattcaacgcttcaattgcctacgaccggcatctctgggaggtagacgtgcagggtagtaaggcgtattcccggggtctggaaaaagccgggctgcttacgaaggcagagatggaccagattctgcatggcctcgacaaagtagccgaagaatgggctcagggaaccttcaaacttaacagtaatgatgaggacatacatactgccaatgaaagaaggctgaaggaactaataggtgctacggcggggaagcttcatactggaaggtcgcggaatgaccaagtcgttaccgatctgaggttgtggatgcggcagacttgctccacactgagcggacttctgtgggaattgatcagaaccatggttgatcgcgccgaagccgagcgtgacgtgttattccccggatacactcaccttcagcgcgcacagccaattcgctggtcccactggattctgtcacacgctgtcgcactgacaagggattcagagcgactgctggaggtaaggaagagaatcaacgtactacccctgggctccggcgccatcgctggaaatccgcttggggttgaccgcgagctcctgcgagccgagttaaacttcggggctataactctgaattctatggacgctacgtccgagcgtgacttcgtcgcagagtttttgttttgggcatctctgtgcatgacacatctaagccgcatggccgaagatttgatcctctattgcactaaagagttctcttttgtccagttgagtgacgcatatagtaccgggagctccctgatgcctcagaagaagaatccagactctctggaacttattcggagcaaagctggaagagtattcggccgatgtgcagggctgctgatgactctgaaaggcctgccatccacttacaacaaagatcttcaagaggacaaagaagctgtgttcgaggtgtctgatacgatgtcagctgtactacaggtggctaccggagtgatttctacactccagattcaccaagagaatatggggcaagctctcagtccggacatgctcgccaccgacctcgcctactatctggtgcgtaaggggatgcctttcagacaggcccatgaggcaagcggcaaagccgtgtttatggcagaaactaagggtgtggctctcaaccagctcagcctgcaagaacttcaaaccatcagtccgctattttctggagacgtgatatgcgtctgggattatggacactccgtggaacagtacggcgctctcggaggcacagctcggagcagcgtggactggcagatacggcaggtgagagccctcttgcaggcccagcaagca

SEQ ID NO: 6860 - DNA, 1392 bp, Artificial Sequence
  Description of Artificial Sequence: Synthetic coding sequence
atggcatctgagtccggaaaactgtggggcggcaggttcgtaggggccgtagacccaatcatggaaaagtttaacgcgtcaattgcatatgacagacacttgtgggaggtggatgtgcaggggagcaaagcatatagtagagggctggagaaggccggcctactgacaaaagcagagatggaccagatactacatggactggacaaggttgctgaggagtgggcccagggcaccttcaaactaaactcaaacgatgaggacatacatacggcgaacgaacgcagactgaaggaactaattggtgcaactgctggtaaattgcatacggggcgaagcaggaacgaccaggtcgtaacagacctgcgtctgtggatgcgacaaacatgctccacgttgtcagggctgctatgggaacttatccgaacgatggtggatcgcgccgaggcggagcgagatgtcctcttccctggatatactcaccttcagagagctcagcctattcgctggagtcactggatcctctctcatgccgtggctttgactagggatagtgagagactgctggaggtcagaaaaagaatcaacgtgcttcccctgggtagtggcgcaattgccggtaatccacttggggtagaccgagaattacttagggcagaactcaactttggcgcgatcaccctcaatagcatggacgctaccagcgaacgagactttgtggctgagttcctgttctgggcatctctatgtatgacgcacctgagtagaatggccgaggatctaattctgtattgcaccaaggagttctcattcgtgcaactgtccgatgcctactccacaggctcatcgctgatgccccaaaagaagaacccggacagtctggaactgattagaagtaaggcaggaagagtgttcggccgttgtgcaggactcctgatgaccctgaagggactcccgtccacttataacaaagacctgcaggaggacaaggaggccgttttcgaggttagtgacactatgtctgccgttctccaggtcgcaacgggtgtgatctcaactttgcagattcaccaggagaacatgggacaggcactttccccagacatgttggccacagatctggcctactatcttgtgcgtaagggcatgcctttccgacaggctcacgaagcaagcgggaaggccgtgtttatggccgaaactaagggagtagcattgaatcagttgtcgctgcaggagctgcaaaccatctctccgctattttcgggagacgtgatctgcgtctgggactatggtcacagtgtcgaacagtatggagcgttgggtggcaccgcaagatcatcggtggactggcaaatccgacaagtcagagccctgctgcaagcccaacaggct

SEQ ID NO: 6861 - DNA, 1392 bp, Artificial Sequence
  Description of Artificial Sequence: Synthetic coding sequence
atggcttctgagagcggaaagctgtggggcggcaggttcgtgggagccgttgaccccataatggagaagttcaacgcgtcgatagcatatgatcggcacctgtgggaggtggacgtccagggctccaaggcctactcacgaggacttgagaaagcaggactcctaacaaaggctgaaatggaccagattttacatgggctcgataaggttgccgaagagtgggcccagggtaccttcaagctgaactctaatgatgaagatatccataccgcgaacgaaagaaggttgaaggagttaatcggggcgactgctggcaaactccacacgggcagaagccggaacgaccaagtggtcacagatctgaggctttggatgcggcagacatgttctactctcagcggtttgctttgggagctgataaggactatggtggaccgcgcagaggctgaacgagatgtgctgtttcccggctatacacacctacagcgggcccagccaatccgctggtcacactggattttatctcatgcggtagctctgactcgcgacagcgagaggctgttagaggtgaggaaacggattaatgtgctgcctctcggctcgggggctatagctggcaatcccttgggcgtggatagagagctgctgcgcgccgaacttaatttcggtgccatcaccttgaactcaatggacgccacaagcgagagagacttcgtggctgaattcttgttctgggctagtttgtgcatgacacatctgtcccgtatggcagaggaccttattctgtattgcaccaaggaattcagtttcgtgcagctctccgacgcttattctactggaagtagcctgatgccgcagaagaagaaccctgatagcctggaattgatcaggtctaaggctggacgcgtgttcggtagatgtgcaggactattgatgacgctgaagggcttgccctctacgtacaataaggacctgcaggaagataaagaagccgtgtttgaagtgagcgatacaatgtctgccgtcctccaggtggcaactggggtgatctctacgctgcaaatccatcaagagaacatgggccaagccctgtctcctgacatgctggctacagacctcgcgtattaccttgtgaggaaggggatgcccttcagacaagcccacgaagcgtctggtaaggctgtattcatggccgaaacgaagggagttgctctcaatcagttaagcttgcaggagttgcagacaatcagtcctctgttttctggagacgtaatatgtgtttgggattacggacattccgtagagcagtatggtgcgcttggcgggactgcccggtctagtgttgactggcagatcagacaggtccgagccttgttacaggctcagcaggct

SEQ ID NO: 6862 - DNA, 1392 bp, Artificial Sequence
  Description of Artificial Sequence: Synthetic coding sequence
atggccagcgaatcagggaagctgtggggcgggcgattcgttggtgccgtggatcctatcatggagaagttcaacgcctctattgcctacgaccgccatctgtgggaagtcgatgtacaaggctctaaagcatacagcagaggcctggagaaggccggtctgttaaccaaggcagagatggatcagattctacatggcttagataaggtcgccgaagagtgggcccaaggaacattcaaactcaacagcaacgacgaggatatccatactgcaaacgagcgccggcttaaagaattaataggggctacggcgggtaagttgcataccggccggagccgcaacgaccaagtcgtgacggatctgcgcttgtggatgcgccagacttgtagtactcttagcggactgctttgggaacttataagaactatggttgaccgtgctgaggcagagagagacgtgctattcccaggttatacacatctacaaagagcacagcccattcggtggagtcattggatattgtctcacgctgtggctctgacaagggactcagagagactgttagaggtgagaaaacgcatcaatgtgcttccgttgggctccggtgccatagcaggcaacccactgggcgtggatcgggaactactgagggcggaactaaattttggagctataacacttaactctatggatgcaaccagcgaaagggattttgtggcggagttcctattttgggctagcctatgcatgacacatcttagcagaatggcagaagatctgattctttactgcactaaagagttctcatttgtccagttgagcgacgcttattcaacaggatccagtttaatgcctcaaaaaaagaaccccgacagtctggaactgattagatctaaggctggccgcgtctttggcaggtgtgctgggctattgatgacattgaagggcctgcccagcacttataataaggacttacaggaggataaagaggctgtttttgaagtgagtgatactatgagtgcagtgcttcaggtcgccacaggggttatttcaacattgcagatccaccaggaaaatatgggacaagctctgtctccggatatgctggccaccgaccttgcttattaccttgttcgtaaagggatgccatttaggcaggcccacgaggccagtggcaaggcagtattcatggcagagaccaaaggggtcgccctgaaccagttgtccctgcaagaactccagacaatctccccactgttcagtggcgacgtgatatgcgtgtgggattatggccatagcgtggagcagtacggggctctgggaggcacggctcggtcaagtgtggactggcaaattagacaggtgagggcactactacaagctcagcaagcc

SEQ ID NO: 6863 - DNA, 1392 bp, Artificial Sequence
  Description of Artificial Sequence: Synthetic coding sequence
atggctagcgagagcgggaagctgtgggggggaaggttcgtgggtgctgtagatcctataatggaaaaatttaacgcatctatcgcttacgatagacatctgtgggaagtggacgttcagggatctaaggcctactctagggggctggagaaggctggcttgctgactaaggctgagatggaccagattcttcacgggttggacaaggtagccgaagagtgggcacagggcacctttaaactaaacagcaatgatgaggacatccataccgccaatgagaggaggctaaaagagctgataggagccacagcagggaagctgcataccggcagatcccgaaacgaccaggtcgtgacagatctgaggctttggatgcggcagacttgtagcacattgtctggactgctgtgggagctgattcgcacaatggtcgatagggctgaggctgaacgggacgtgctattccctggttacacgcatttacaacgagctcaacctatccgttggagccattggattttaagccacgccgtggctcttactagagattccgagcgattattggaggtcaggaagcgtatcaatgtcctgcctcttggcagtggcgccattgctggcaatcccctgggcgtggacagagagttgcttagggctgagttgaattttggcgctatcaccctgaactcgatggatgcaactagtgagagagacttcgtggcagaattcttgttctgggcctcactttgtatgacccacttgagccggatggcggaagacctgatattgtactgcaccaaggaattctccttcgtccagttgagtgacgcttattcgaccggttcaagtctgatgccccaaaagaaaaacccagacagcctggaactcattagatcaaaagcagggcgcgtcttcggccggtgtgccgggctactgatgaccctcaaaggtttaccaagcacttataacaaggatctgcaagaagacaaggaagcggttttcgaggtgtccgacacaatgtctgctgtgctgcaagtggccacaggcgttatctctacccttcaaatccatcaggagaacatgggccaggctctcagcccagatatgctcgccaccgaccttgcttactacctggtcagaaagggcatgccctttcggcaagcacatgaggcttcgggaaaagccgtgttcatggccgagactaagggcgtggcattgaatcagttgagtctgcaggagctccagactataagccccctctttagcggcgacgtgatttgtgtctgggattacggacactccgtggagcaatatggggccctcggaggcactgcaaggtctagcgtcgactggcagatcagacaggttcgggcgctgctgcaggctcagcaggct

SEQ ID NO: 6864 - DNA, 1392 bp, Artificial Sequence
  Description of Artificial Sequence: Synthetic coding sequence
atggcttctgaatccgggaaactgtggggcggtagatttgtgggtgccgttgatccaattatggagaaatttaacgcatctatcgcctatgatagacacctatgggaggtggacgtccagggatcaaaggcgtatagtagggggctcgagaaggctggactgcttactaaagcggagatggatcagattttgcacggcctggacaaggtcgcagaggaatgggcacagggcactttcaagctcaatagtaatgacgaagatattcatacagcaaacgagcggagacttaaggaattgatcggagccaccgcaggcaagctccatactggtcggtcccggaacgatcaggtcgtcactgatctaaggctgtggatgcgtcagacatgcagcacactgagcggcctgttgtgggaacttatccggaccatggttgaccgagccgaagctgagagggacgttctttttcccggctacacccatctccaacgcgcccagcctattaggtggagtcactggatactgagccatgccgtggccctgacaagggattcggagcgcttgctggaggtgcgcaaacgaataaatgtcctacccctgggctcgggcgcaatagcaggcaaccctctgggggtagacagagagctgttgcgggcagagctgaacttcggcgcaatcactctgaactcgatggatgccacgtccgagagggacttcgtggcagaatttcttttctgggcatcgctctgcatgacccatttgagccggatggctgaagacttgatcctgtactgtactaaagagttctctttcgttcagctctcagacgcctattccaccggatcttctctgatgccgcagaagaagaatccagattcactggagctcatccggtctaaggcaggcagagtgtttggaaggtgtgccggcctgttaatgaccctcaaaggcctccctagcacatacaacaaggaccttcaagaagacaaagaagcagtgttcgaagttagcgacacaatgagtgccgttctccaggtggctacaggagtaataagcactttgcagatccaccaggaaaatatgggccaggcgctctcccccgatatgctcgcgactgacctggcatattatctggtacgtaagggtatgccttttaggcaagctcacgaggcctctggtaaagcagtttttatggctgagaccaaaggagtcgctctcaatcagctgagtctccaggagctgcaaactattagcccactgttcagcggagatgtaatctgcgtctgggattatgggcattccgtagaacagtacggcgcgctaggggggaccgcaaggtcctccgtggattggcagatccgtcaggtgcgcgccctcctccaagcccaacaggca

SEQ ID NO: 6865 - DNA, 1392 bp, Artificial Sequence
  Description of Artificial Sequence: Synthetic coding sequence
atggcctccgaaagtggcaagctttgggggggaagatttgtgggagccgtggacccaattatggaaaagttcaatgcctcaatcgcgtacgaccggcatctctgggaggttgacgttcagggaagcaaggcctattcccgcggcctggagaaggccgggctcctgaccaaggcagagatggaccagattctgcatgggctggacaaggtggccgaagaatgggcccaaggaacttttaagttgaatagtaatgacgaggacattcacacggccaatgagcgccggttgaaagaactcatcggagctacagcaggaaagctccacaccggccggtcaagaaacgatcaggttgtgacagacttgcggctgtggatgagacagacctgctcaactttgtctgggcttctgtgggagctgatccgcaccatggtcgaccgcgctgaagcggagcgcgatgtcctgttccccggctatactcatctgcagagagcgcagccgatccgatggtcccattggatactgagtcatgcagtcgctctcactcgagacagtgagcggctgctggaggttaggaaacgaatcaacgtgctccctttgggttccggagccattgccggaaatcccctgggagtggatcgcgaactccttcgggccgaactgaatttcggagcgatcacgctgaactctatggacgcaacttctgagcgggactttgtggctgagttcctgttttgggcctccctgtgcatgacacatctgagccggatggctgaggatctcattttgtattgtacgaaggagttttccttcgttcagctttcagatgcttatagcacgggatccagcttgatgccccagaaaaagaaccctgactctttggaactgattcggagcaaagccggtcgagtgtttggcaggtgtgccggcctgctcatgacactcaaaggcttgccatccacatataacaaggatttgcaggaagacaaggaagcagtgtttgaggtgagcgacactatgtccgcggtgctgcaagtggccactggggtaatcagcaccctgcagattcaccaagagaacatgggtcaggctctgtcacccgatatgctggctacagatctggcttattatctcgtgagaaaagggatgccctttagacaggcccacgaggctagcggcaaggccgtgttcatggcagagacgaagggagtcgccctcaatcagttgtccttgcaggaactgcagaccatttctcctcttttctccggtgacgtaatctgtgtctgggactatgggcatagtgtggaacagtacggggcactcggcggaactgccagatcatccgtcgactggcagattcggcaggtgagggcgctcctgcaggcccaacaagcc

SEQ ID NO: 6866 - DNA, 1392 bp, Artificial Sequence
  Description of Artificial Sequence: Synthetic coding sequence
atggccagcgaaagcgggaagttatgggggggaaggttcgtaggagcagtagatcctattatggaaaagtttaacgcatccatagcatatgacagacacctgtgggaagtagatgtgcagggaagtaaagcttactcaaggggtttggaaaaggcaggacttttgactaaagctgagatggaccagattcttcatggactcgacaaggtggccgaagaatgggctcagggcacattcaaactcaattcgaacgatgaggatatccataccgcaaacgagcggaggctaaaggaactaatcggtgcaacagcaggtaagctccacaccggaaggtcacgaaacgaccaggtggtaacagacctccgcttatggatgcgacagacgtgtagcacgctaagcggcctgctgtgggagctgatccgcactatggtggacagggcggaagccgaacgtgatgttctcttccccggctacacgcacctgcagagggctcagcccatcaggtggagtcactggatcctttcccacgccgtggccttgaccagggacagcgaaaggctgctggaagtgaggaagcgtattaatgtgctcccactgggatcaggagccatcgcaggcaatcccctgggcgtagacagagagcttttgagggcggagctaaatttcggtgcgattacacttaattcgatggacgccaccagtgagcgtgacttcgtcgcggaattcctgttttgggcttcgttgtgcatgacccatctgagtagaatggcagaagacctgattctgtactgcactaaagaattcagctttgtgcagctctcagacgcttattcaacaggctcgagtttgatgccacaaaagaagaacccagattctctcgaacttatccgctcaaaagctggcagagtgtttggcaggtgcgctggcttactgatgaccttgaaaggcctgccctctacatacaataaagatctgcaggaagataaagaggccgtatttgaagtgtccgatacgatgtctgccgtactgcaagtggctacaggcgtcatctccactttgcagatccatcaagaaaatatgggccaagcacttagtcccgacatgctcgctacagatctggcctattacctggtaagaaagggcatgccgtttcgccaagcccacgaagcctcaggcaaagctgtttttatggctgaaacgaaaggagtggcacttaaccagctctcccttcaggagttgcagacgattagccccctgttctcaggcgacgtcatctgcgtgtgggattatggacactcagtggaacagtacggcgctctgggcggaacagcaaggagcagcgtagattggcagatccgccaggtccgcgcactattgcaagcccaacaagct

SEQ ID NO: 6867 - DNA, 1392 bp, Artificial Sequence
  Description of Artificial Sequence: Synthetic coding sequence
atggcgagcgagagcgggaagctgtgggggggccggttcgtgggggctgtggacccgatcatggaaaagtttaacgcatccattgcctacgataggcacttgtgggaagtggatgttcaaggctcaaaggcttactcccgcggcctggaaaaagccggcctgctgacaaaagcggagatggaccagattttgcacgggcttgataaagttgcagaggaatgggctcagggaacattcaagctgaactccaacgatgaagacatacacactgccaatgaaagacgactgaaggagctcatcggggccactgcaggtaaactgcataccggcaggtcccggaatgaccaggtggtcactgatctgcggctgtggatgcgccagacctgcagcacactgtcagggcttttatgggaactgatcaggaccatggtcgatagagctgaggcagagcgcgatgtgctttttccagggtatactcacctgcaacgcgcccagccaattagatggagtcactggattcttagtcacgctgtcgccttaacccgcgattctgaacgcctcctggaggtcaggaagagaatcaacgttctgcctctgggttccggtgccatcgccggcaatcccctgggggtggatcgagagctcctcagggccgaattgaattttggagcaatcacccttaactcaatggatgcaacatctgaacgtgattttgtggccgagtttctcttctgggcttctctgtgcatgactcacttatccaggatggccgaggacctgatactgtactgcacaaaggaattctcatttgttcaactgtcagacgcctactcaactggatcatctttaatgcctcagaagaaaaacccggacagtctcgaactcatccgcagcaaggcagggcgggtttttggacgatgcgctggcctgctgatgacgctgaagggcctgccttctacgtataataaggatctgcaggaagacaaggaggcagtattcgaagtctccgacacaatgtccgccgtccttcaggtcgctacgggagtgattagtaccttacagatccaccaggagaacatggggcaggctctttcccccgacatgctagcgactgatttggcgtattatctcgtgaggaaaggcatgccttttcggcaggcccacgaggcctctgggaaggccgtgtttatggccgagacaaagggagtcgccctgaaccagctttccctccaggagctgcagactatcagcccactgttttcaggggatgtaatttgtgtttgggattatgggcactcagtcgagcagtatggtgccctaggtggcacagctaggtctagtgtagattggcagatccgccaggtccgcgctctgctgcaagcccagcaggcc

SEQ ID NO: 6868 - DNA, 1392 bp, Artificial Sequence
  Description of Artificial Sequence: Synthetic coding sequence
atggcctccgaatctggaaaactgtggggcggacgcttcgtgggagccgtggaccccattatggaaaagttcaacgcctctatagcttatgatcgacacctgtgggaggtggatgtccaggggtcaaaggcctattctcggggactggagaaggcaggcctactgactaaggccgagatggaccagatcctccacgggctggataaagttgctgaggagtgggcacaaggcacattcaaactgaattcaaacgacgaggacatacacactgccaacgagcgtcgactcaaggagctgataggcgctactgccgggaagttgcatacagggaggtccaggaacgaccaggtcgttactgacctgcgcctgtggatgcgccagacttgttcaactctgagcggtttactctgggagctgattcgcactatggtggaccgcgctgaggctgaaagggacgtgttattcccagggtatacccacctccagagagcccagcccataaggtggagtcactggattctgtctcacgctgttgctctgaccagagactctgagcgactgctggaagttcggaagcggataaacgtattaccactgggctccggcgcaatcgctggcaaccctttgggggttgaccgggagcttctgagggctgagctgaatttcggggccattactctaaattccatggacgctacctccgagcgggacttcgttgccgaattcttgttctgggccagtctttgcatgactcacctgtctcgcatggccgaggatctaattctgtactgcacaaaggaattcagcttcgtgcagctgagcgacgcttactctaccggatcttccctaatgccccaaaaaaaaaatcccgattctttagagctgatacgcagtaaggccggtagagttttcgggaggtgtgctggcctgctgatgactctgaagggcctgccttcaacttataacaaggacctgcaggaagataaggaagcagtgttcgaggtgtccgacaccatgtccgccgttctccaggttgccactggcgtcatctccactttgcagatacaccaggagaatatggggcaggccctgtcccctgacatgttggctactgacctagcctattatcttgtacgcaaaggcatgcctttccgccaggcacacgaggccagtggcaaggccgtgttcatggcagagactaagggcgtcgccctcaatcagctgtccctgcaggagttacagactatctcaccactatttagcggggatgtcatctgcgtttgggactacggacattcagttgaacagtacggcgccctgggtggcaccgccagatcaagcgtcgattggcagattcgtcaggttagagctctgctccaggctcagcaagca

SEQ ID NO: 6869 - DNA, 1392 bp, Artificial Sequence
  Description of Artificial Sequence: Synthetic coding sequence
atggctagtgagtctgggaagctctggggagggcgcttcgtgggtgcagtggatccgattatggagaaatttaatgcatccatagcttacgatcgtcacctgtgggaggtggatgtccaaggtagcaaggcttactcacgcggcctcgaaaaggctgggctgctcaccaaagcagagatggatcagattctacacggacttgataaagtcgccgaagagtgggctcagggtaccttcaagcttaatagtaatgatgaagacattcacacagcgaatgagcgccgactgaaagagctgattggggccacagccggaaagctccacacaggaagatccagaaatgaccaggtagtgacggatctcagactgtggatgaggcaaacatgctccactctcagcggcctgctgtgggaactaatacgcacgatggttgatagggccgaggcggaacgcgatgtactgttccccggctacacccatttgcaaagagctcagcccatcaggtggtcgcactggattctgtcgcacgcagtggcattgactagggactccgaacggttgctcgaggtccgaaagcgcataaacgtgcttccactgggctccggcgctatcgccggtaaccccctcggagtggaccgcgaattactgcgcgctgaattaaacttcggagctattaccctaaattctatggatgccacttcagaaagagattttgttgccgaattcttgttttgggcaagcttgtgtatgactcacctgtcacgaatggccgaggatctgatcttgtattgtactaaagagttttctttcgtacagctgtctgacgcttattctaccggcagctcactcatgcctcagaagaagaatcccgattccctcgagttaatccgctccaaagctgggagggtttttggacggtgcgccggattgctcatgacactgaaaggccttccgagtacctataataaagacctccaagaggacaaggaagcagtttttgaggtgtcagacacgatgagcgccgtactgcaggtggcgactggagtcatcagtacacttcagatccatcaagagaatatgggtcaggccctctcaccagacatgctggctactgacctggcatactatcttgtgaggaaagggatgccctttcgccaggcgcatgaggcctcgggaaaggccgtgtttatggccgagactaagggtgtggctctgaaccagctttctctgcaggagctccaaactatctcacctttattctctggagatgtaatctgcgtttgggactatgggcactctgtcgagcagtatggggcgctcggcggcacagctcgttcgagcgtggactggcagatcagacaagtgcgggctctactgcaggcccagcaggcg

SEQ ID NO: 6870 - DNA, 1392 bp, Artificial Sequence
  Description of Artificial Sequence: Synthetic coding sequence
atggcttctgagagcggcaagctgtggggcggtcgatttgtaggcgccgttgatccaatcatggaaaaattcaatgccagtatcgcctatgacaggcatttgtgggaggttgatgtgcaggggtcaaaggcatatagccgcggactcgagaaagccggtctgctgacaaaggcagagatggaccaaatcttgcacggactggacaaggtcgccgaggagtgggcccaggggacctttaaactgaattcaaatgatgaggatatccatactgccaacgagcgccgcttgaaggaactcattggggcgacggccggcaagctgcacaccggtaggagccggaatgaccaggtggtgaccgatctccgcctgtggatgcggcagacttgcagcactctgagcgggctgctgtgggaactgataagaacgatggttgatagggcggaggctgaaagagacgtgctgtttcctggatacacccatctgcagcgggcccagccaattagatggagccattggattctctctcacgctgtggcacttacccgggactccgagaggttgctggaggtgaggaaaagaattaatgtcctcccattgggctcaggcgcgattgccggcaaccccttgggggtggatcgagagctccttagagcagagctgaactttggagccataacattgaattcaatggacgctacaagcgaacgcgacttcgtcgcagagtttctcttttgggcctctctttgtatgacccaccttagtcgcatggccgaagatctcatcctgtactgcactaaggaattttccttcgtgcagttgtccgatgcatactccaccggctcaagcctgatgccccagaagaagaacccagattccctggagttgataagatcaaaggcgggtagagtatttggtagatgtgccgggctgcttatgacgctcaaaggactgccgagcacgtacaataaggacctgcaggaggataaggaggccgtttttgaggtgtccgacacgatgtccgccgtgctgcaggttgccaccggggtgatcagtacactccaaatccaccaagagaacatggggcaagctctctctccagatatgctggccactgatctggcgtattatctggtgagaaaaggcatgccctttcggcaggctcacgaggcctccggcaaagcggtcttcatggccgaaacaaaaggtgtggcgttgaaccagctcagtttgcaggagctgcagacgatctcacctctgttttctggggatgttatctgcgtatgggattacgggcattcagtggagcaatacggtgccctcggggggacggccagaagctccgtggattggcagatcaggcaggtcagagcattgctgcaagcacagcaggcc

SEQ ID NO: 6871 - DNA, 1392 bp, Artificial Sequence
  Description of Artificial Sequence: Synthetic coding sequence
atggcttcagagagtggcaagctttggggcggcaggtttgttggagcggttgaccctattatggagaaatttaatgcaagtatcgcctacgacagacatctttgggaagtggacgtgcagggtagtaaggcctacagcagggggcttgagaaggctggactgctcacgaaggcagagatggaccagatcctgcacgggcttgacaaagtcgccgaggagtgggcccagggaaccttcaaactgaactcgaatgacgaggacatccatacagcaaacgagcgaagactgaaggagctcatcggggcgacagctggtaaattgcacacaggtcgcagtcgtaacgaccaggttgtcacagatcttagattgtggatgaggcagacatgctccactctctcgggcctgctctgggaactcataagaacaatggttgatcgggcggaagccgaacgggatgtgctgtttcccggctacactcacctgcagagggctcagccaatccgatggtctcactggatattaagtcacgccgtcgctctgacacgcgactcagagcgactgcttgaagtcaggaaacggattaacgtgcttcctctcggatccggcgccatagcagggaatcctctgggggtggatcgagaattgctacgggcagaactgaatttcggagccatcacactcaactccatggacgcaacctcagagagggactttgtggctgagttccttttttgggcttcgctgtgcatgacccatctctcgaggatggccgaggacttgatcctctactgtaccaaagagttctctttcgtgcaactttctgatgcctattccacagggtcgagtttaatgccacagaagaagaacccagacagcctagagctgattcgcagcaaggccgggcgggtgtttggacggtgcgcagggctgcttatgaccctcaaggggcttccgagcacatataataaggacttgcaggaagataaggaggccgtctttgaagtgagcgatactatgtccgcagttctccaggtggccacaggcgtgattagcaccctgcagatccatcaggagaacatgggacaggccctcagtccagacatgctggctaccgacctagcctattaccttgtgagaaaggggatgccatttcggcaggcgcacgaggcctcagggaaggcagtgttcatggccgaaaccaagggtgttgctctgaatcagttgtccctgcaggaactccagaccatatcaccacttttctccggggatgtaatatgtgtgtgggactatggacactccgtggaacaatatggcgccttaggaggaacagcccgcagcagcgtggattggcagattcgccaagtgagggcactcctccaagcccagcaagcc

SEQ ID NO: 6872 - DNA, 1392 bp, Artificial Sequence
  Description of Artificial Sequence: Synthetic coding sequence
atggcaagcgagtccggcaaactgtggggtggccggttcgttggggccgttgatccgatcatggaaaaatttaatgcgtccattgcctacgaccgtcacctgtgggaggttgatgttcagggcagcaaggcctactcacgcggtttggagaaagctggcctcctgaccaaagcagagatggaccaaatccttcacggactggataaagtcgccgaagagtgggcgcaaggtacctttaagctcaactccaacgacgaagatatccacacggcgaacgagaggcggctgaaagaactgatcggagccaccgccggtaagcttcacacaggcagatcacgtaatgaccaagttgtcacggatctgcgactctggatgcgccagacttgcagcaccctaagcggcctactttgggagctgattagaaccatggtagatcgcgcggaagcggagcgtgacgtgttgtttcctggttatactcatctgcagcgcgcacagccgattaggtggtctcactggattttgtcgcatgccgttgctttgacccgcgatagcgaacgccttctggaggtccggaaaagaattaatgtgctgccgctgggcagcggtgccattgcgggcaacccactgggggtcgatcgcgagctgctgcgcgctgagctcaactttggagctattactttgaattccatggatgcaacctctgaacgggactttgtggctgagttcctattctgggcctcactgtgtatgacgcacttgtctcgtatggcggaagatctgattctctactgtaccaaagagttttcgttcgtgcaactgtctgacgcctattcaactggtagcagcctgatgccgcagaaaaaaaaccccgactcactggagttgatccgtagcaaagctggtcgcgtgttcggcaggtgtgccggattactgatgacgttgaaaggcctgccaagcacgtacaacaaggatttgcaggaagataaggaagctgtctttgaggtatccgatactatgagtgctgtgttgcaagtcgcaactggggtgatcagtactcttcagatccaccaggagaacatgggtcaagcactgagcccagatatgctagctaccgacttagcgtactaccttgtgcgcaaaggaatgcctttccgccaggctcatgaagcgtctggtaaagcggtgtttatggcagaaacaaagggcgtggcccttaaccagctgtccttgcaggagttgcagactattagtccgctctttagcggtgacgttatttgcgtttgggattacggccattcagtggagcagtatggggcgctaggtggcaccgctcggagcagcgtggattggcagatccggcaagtgagagcactcctgcaagcccaacaggca

SEQ ID NO: 6873 - DNA, 1392 bp, Artificial Sequence
  Description of Artificial Sequence: Synthetic coding sequence
atggcatccgagtcaggaaagttgtggggcggcagattcgtcggagcagtggatccgattatggagaagtttaacgcaagcattgcttacgacaggcatttgtgggaggtagacgtccagggctctaaggcatattccagaggactggagaaggcgggccttctgactaaggccgagatggatcagatcttgcacggattggataaagtcgcagaggagtgggcgcagggcaccttcaagctgaacagcaacgacgaagatatccatacagctaatgagcgcagattgaaggaacttattggcgccacggctggcaagttgcacaccggtaggagcagaaacgatcaggtcgtcactgacctgagactttggatgagacagacgtgctccaccctgagcggcttgctctgggaactgattcgcacaatggtagacagggccgaggcagagagggacgttttgtttccaggatatacccacctgcagagggctcaacctatcaggtggtctcattggatcttgtcccacgccgtggcgcttactagggactccgagcgcttgcttgaagtccgcaagaggatcaatgtgctgccattgggatctggcgcaattgccggcaatcctctgggagtcgacagggagctcctgagggctgagcttaactttggagctataacattgaattctatggacgccacaagcgagagagatttcgtagcagaattcttgttctgggcttccctttgcatgacccaccttagtagaatggctgaagacctgatcctgtactgtaccaaggaattttctttcgtccaactctccgacgcttacagtactggctcctcactcatgccacagaagaaaaaccccgactccctggagctgatccgcagcaaggccggtagagtcttcggacgctgcgccggccttctgatgacgttgaagggattgccctcaacatataataaggaccttcaagaagacaaagaggcagtgtttgaggtctccgacacaatgtcagcagtgctgcaagtggctactggcgtcatctctacactgcagattcaccaggaaaacatgggacaggcactgtctcccgatatgctggctacagatctggcgtattacctcgtacgcaagggcatgccatttcgccaggctcacgaggcctctggcaaggcagtctttatggccgagacgaagggagttgcgcttaatcaattgtccctccaggagctgcagactatctcccctctcttctccggagacgtcatatgcgtgtgggattacggacacagcgttgagcaatatggtgctcttggtggaacagcacgctcttctgtcgactggcagatcaggcaggtgagagccctgctccaagcacagcaggcc

SEQ ID NO: 6874 - DNA, 1392 bp, Artificial Sequence
  Description of Artificial Sequence: Synthetic coding sequence
atggcgtccgaaagtgggaaactctgggggggcagattcgtaggagccgttgaccccattatggagaaattcaacgcctctatcgcctacgacagacatttatgggaagtagatgttcagggctctaaggcttacagccgtggcctggaaaaagccgggctgctcaccaaggcagagatggaccagatactccatgggctggataaagttgctgaggagtgggctcagggcaccttcaagctgaattccaatgacgaagatattcacaccgcaaacgagcggagattaaaggaattaatcggtgccacagccggtaaactccacaccggaagatcaagaaatgaccaggttgtgacggacctgagattgtggatgcggcagacctgttctacgctgtccggacttctgtgggagctgattcgcacaatggttgatcgggccgaagcagaacgggatgtgctgttccctggatatacccacttgcagagagcgcaaccaatccgatggagccactggattcttagtcatgctgtagcactgactcgggacagcgagcggctgcttgaggtccggaagagaatcaatgtattacccctcggcagtggcgcaatcgcaggaaaccccctgggggtcgaccgtgagttgctgcgggcagagctgaattttggcgcgatcacactgaattctatggacgcaaccagcgagcgtgattttgtggccgagtttcttttctgggcctctctctgtatgacccatctgagtaggatggcagaggatttaattttatattgcaccaaagagttttctttcgtccagctgtcagacgcttactcaaccggatcaagcctgatgccccagaaaaaaaaccccgactcactcgaactgatcagaagcaaggctgggcgagtcttcgggaggtgtgctggcctgttgatgacgctcaaagggctcccttctacttacaacaaagatctgcaggaggataaagaggccgtatttgaagtgagcgacacaatgtctgcggttctgcaggtggcaaccggggtcataagcaccctgcagattcaccaagagaacatgggccaggccctcagtccagatatgctggccacagacctggcatattacctcgtgcggaagggtatgccctttaggcaagctcacgaagcctccggcaaagctgtgtttatggcggagaccaagggggtcgcgctgaatcagcttagcttacaggagttacagaccatttctccattattcagcggcgacgtgatctgcgtgtgggactacgggcacagcgttgaacagtatggcgctctcggaggcactgcacgttcctcagtcgactggcagatccgccaggtgcgcgccctgttgcaggcgcaacaagcg

SEQ ID NO: 6875 - DNA, 1392 bp, Artificial Sequence
  Description of Artificial Sequence: Synthetic coding sequence
atggcttcggaatctggtaagctgtggggaggtcgcttcgttggagcagtggacccaattatggagaaattcaacgccagcattgcgtatgatcgccacctgtgggaagttgacgtgcaaggctcgaaggcatacagtaggggcttggagaaggcgggcctcttgacaaaggcggaaatggatcaaatattgcacggcctggacaaagttgcagaggagtgggctcaaggtactttcaagctgaactcgaatgatgaggatatccataccgcgaatgagaggagactgaaggaactgataggcgcgacggctggcaagctgcacaccggccggagtcgcaacgatcaggttgtgaccgacttgcggctgtggatgaggcagacttgctccacgttgtcgggtctgctttgggaattgatacgcaccatggtggatcgcgccgaagccgaacgggatgtactgtttcccggctatactcatctgcagagagcgcaacctattcgttggagtcattggatcctgtcgcatgcggtagccctgacgagagattctgagcgcttgctagaggtgcgaaaacgaattaatgtacttccactaggaagtggtgccatcgccggtaacccactgggagtcgatagagagctcttgcgagcggaactgaattttggagcgataacactgaactccatggatgcaacctcagagcgcgacttcgtggccgaatttctgttttgggcaagcctctgcatgacccacctgtctcgcatggctgaagacctgatcctctactgcaccaaggaattctcgtttgttcagctcagcgacgcgtactcgaccggatcgtctttgatgccgcaaaaaaagaatccggatagtctcgagcttatccgttcgaaggcgggccgcgtctttggaaggtgtgctgggctcctgatgactctgaaaggcctgccttccacttacaacaaggatcttcaagaggataaggaggccgttttcgaggtgagcgacactatgagtgcagtcctgcaggtcgccacgggcgtgatcagtacactgcagattcatcaggaaaacatgggccaggcattgtcccccgacatgctggcaacggatctggcctactatctggtacgcaagggtatgcccttcaggcaggcacacgaagcgagcggaaaagcggtgttcatggcggagaccaaaggagttgccttaaaccagctgagcctacaggaactccagacgatcagtcccctatttagtggagatgtgatctgtgtttgggattatgggcatagcgtggagcagtacggagccttaggaggaactgctcgttcctcagtggattggcagatacggcaggtacgagccctgctgcaggcccaacaggcg

SEQ ID NO: 6876 - DNA, 1392 bp, Artificial Sequence
  Description of Artificial Sequence: Synthetic coding sequence
atggcttctgagagcggaaagctgtggggagggcggttcgtcggtgcggtggaccccatcatggaaaagtttaatgcctcaatcgcgtatgataggcacctatgggaggttgacgtacagggtagcaaggcttacagtagaggcctagaaaaagcaggcctgctgaccaaagcagagatggatcagattctgcacggcctggataaagtggctgaagaatgggcacaggggaccttcaaactgaactcaaatgacgaagatattcatactgccaacgaaaggcgcttgaaagagttgatcggcgcaacagcgggtaagcttcacaccggacggtccagaaacgatcaggtggtgacagacctgcgtttgtggatgagacagacgtgctccaccctgtctgggttgttgtgggagctgatacgaaccatggttgaccgagccgaggccgagcgcgatgttctgtttccaggttacacacatctgcagagggcacagccaataaggtggagccactggattttaagccacgcagtggctctgacacgggactctgagcgcttgctggaagtgcgaaagcgtatcaacgtccttcctttgggctctggcgcaattgcaggaaaccctcttggtgttgatagagagctcctgagagccgagctgaattttggggctatcaccttgaatagcatggatgccacaagcgagcgcgatttcgttgccgagttcttattctgggcatcactctgtatgacacacctttctcgcatggctgaggatttgatactttactgcactaaggaattttcatttgtgcaactgagcgacgcctatagcactgggagcagcctgatgccacagaaaaagaaccccgactcattagaacttattcggtccaaagccggacgggttttcggaagatgtgcaggactcctgatgaccctcaagggccttccatcaacgtataataaggacctgcaggaagacaaggaggccgtcttcgaagtatctgatacaatgagcgcagtgctgcaagtggccacaggagtcatatccacactgcaaattcatcaggaaaatatgggacaagctctttcaccagacatgctggctacagacctggcttactaccttgttcggaaaggaatgccgttccggcaagcccacgaagcgtccgggaaggctgtcttcatggctgagacaaagggcgtagctttgaaccaactgtccctgcaggagctccagaccatatcccctttattctccggagatgttatttgcgtttgggattatggccatagcgtggaacagtatggagcattggggggtacagctagatctagcgtcgactggcagatccggcaagtgcgggccttgctgcaggcacagcaggcc

SEQ ID NO: 6877 - DNA, 1236 bp, Artificial Sequence
  Description of Artificial Sequence: Synthetic coding sequence
atgtcctccaagggatccgtcgtcctagcctactcgggagggttggatactagctgtattctggtgtggctcaaggagcagggctatgacgtcattgcttatttggcaaatatcgggcagaaggaggatttcgaagaggcccgtaaaaaagccctaaaacttggggctaagaaagtcttcatcgaagacgtatcacgagaattcgtggaagaattcatatggcccgccattcaatccagtgcgctttatgaggaccgatatctgctagggacgagccttgcccggccttgcatcgcacgcaaacaggtggaaatagcacagagggagggggcaaagtatgtttctcatggcgctacaggtaagggaaacgatcaggtcagatttgaactcagctgctattccctggccccacagattaaggtcatcgccccctggcgcatgcccgagttctataacaggttcaagggacggaatgatctgatggagtacgccaagcagcacggcatacccatccccgtcacacccaaaaatccttggtccatggatgagaatcttatgcatatctcctatgaggccggcattctcgaaaacccaaaaaatcaagcacctcctggactctatacgaagactcaagatcccgctaaggcccccaatacaccggacatacttgagattgagtttaagaaaggagttccagtgaaagtcacgaatgtcaaggacgggaccacccatcagacctccttggagcttttcatgtacctaaacgaggtggcgggtaagcatggagtgggccgcattgacattgtggaaaaccgttttataggaatgaagtccaggggcatttacgaaaccccggctggtacgatcctgtaccatgcccatcttgacattgaggcatttaccatggaccgggaggtgcgaaagatcaaacaagggctgggacttaaatttgcggagctagtttacacgggcttctggcactccccagaatgcgagtttgttcggcattgcatcgcaaagagccaggaaagggttgagggtaaggttcaggtgtctgtgctgaagggacaagtctacatattaggacgtgaaagtcctctgtcactgtacaacgaggaactggtgagtatgaatgtacagggtgactatgagccgactgatgcgaccggattcatcaatatcaacagcctgaggctcaaagaatatcacaggctgcagtcaaaggtgactgccaaa

SEQ ID NO: 6878 - DNA, 1236 bp, Artificial Sequence
  Description of Artificial Sequence: Synthetic coding sequence
atgagtagtaaaggcagcgtggtgcttgcatattccggcggacttgatacctcttgcattctcgtgtggcttaaagagcaaggctacgacgtgatcgcatacctggctaatattgggcagaaggaagactttgaagaggccaggaagaaggctctcaaattgggcgcaaagaaggtcttcatcgaagacgtcagtcgtgagttcgtagaggaatttatctggcccgcaattcagtccagtgctctttacgaggaccgctatttacttggaactagtctggctagaccctgcatcgctagaaaacaagtcgagatagctcagagagaaggggcaaagtacgtctcacacggtgcaaccggaaaggggaatgaccaggtccgtttcgaactcagctgctattccctcgctccccaaatcaaagtgattgcaccgtggcgcatgcccgagttttataacaggttcaaaggaaggaatgaccttatggaatatgccaagcaacatggaatccctatccccgttacacccaaaaatccatggagcatggatgagaacctgatgcatatttcatatgaagccggtatcctggaaaaccctaaaaaccaagccccgcccggcctgtacacaaagactcaggaccctgctaaagcccctaatacccccgacattttggagatcgaatttaagaaaggggtgccagtcaaggtgaccaacgttaaggacgggacaacccaccaaactagtctcgaacttttcatgtacctcaacgaggtggcaggaaaacatggcgtgggaagaatcgatatcgttgaaaacagatttatcggtatgaaaagcagggggatctatgagacaccggcaggcactatcctctatcacgctcacctggatattgaggcctttaccatggacagagaagtgcgtaaaattaagcagggcttgggcctgaaatttgccgagctcgtgtataccggcttttggcattcacctgaatgcgagttcgtgaggcattgtatcgctaagagtcaggagagagtggagggtaaggtacaggtttccgttttgaagggccaagtgtatattctgggaagagaatcgccactctcgctctacaacgaggaactcgttagcatgaacgtgcaaggagattacgaacctaccgacgctaccggtttcatcaacatcaacagcttgagactgaaggaataccacagacttcaatccaaagtcaccgctaag

SEQ ID NO: 6879 - DNA, 1236 bp, Artificial Sequence
  Description of Artificial Sequence: Synthetic coding sequence
atgtcatctaaggggtcagtggtattggcctatagtggagggctggacaccagctgtattctcgtttggctgaaagagcaaggttatgatgtgatcgcttaccttgcgaacataggccagaaggaggattttgaggaggcaaggaagaaagccttgaagctgggcgctaagaaagtttttatagaggatgtaagccgcgaatttgtcgaggagttcatttggccagcaatccagagttcggccctttacgaagatagatatttattgggcacctccctggctcggccctgcattgctcggaagcaagtggagattgcccaacgcgaaggagccaagtatgtgagtcatggagcgaccgggaagggcaatgaccaggttcgttttgaactctcctgttattcgctggcacctcaaataaaggtcatcgcgccgtggcggatgcccgagttctacaatagattcaagggcaggaacgatttgatggagtatgccaagcagcacgggatccccattcctgtcacccccaaaaacccctggtcgatggacgagaatctgatgcatatctcctatgaggctggaattctggagaatcctaagaaccaggctccgcctggcctgtatactaagacccaggatcccgctaaggcgcccaacacacccgacattctcgaaattgaatttaagaaaggggttcctgtcaaggttactaacgttaaagatggcactactcatcagacctccctcgagctttttatgtaccttaatgaggttgctggtaaacacggcgttggccgcattgatattgtggagaaccgcttcatcgggatgaagtcacgaggaatttacgagactccagctggtaccatactctaccacgcccacttagacattgaggcatttaccatggatagggaggtgcggaagattaagcagggcctcggcctgaagttcgcagagttagtgtatacgggcttttggcacagtccagagtgcgaattcgtgcgtcactgcatcgccaagagccaagaaagagtggaggggaaggtccaagttagtgtgctgaagggccaggtgtacatcttaggccgagagtcccctttgtccttgtacaacgaggagctggtgagcatgaatgtccagggcgactatgaaccaacagacgccactggctttatcaacattaactcgcttagactcaaagagtatcatcggctccagtctaaagtcaccgcaaag

SEQ ID NO: 6880 - DNA, 1236 bp, Artificial Sequence
  Description of Artificial Sequence: Synthetic coding sequence
atgagtagcaagggctccgttgtgttggcatacagcggaggcctggacacctcatgtattctcgtgtggctcaaggagcaaggctacgatgtgatagcctacctggccaacattgggcagaaagaagactttgaagaagcaaggaaaaaggctctgaagctgggagccaagaaggtgtttattgaggatgtctccagggaatttgtcgaggagtttatctggccagccattcagtcttccgcgctttacgaagatcgctatttactggggacctcgttagcccggccttgtattgcccgcaaacaggtagaaatcgcccaaagagagggcgccaagtacgtgtcccacggcgccaccggaaagggaaatgaccaggtgagattcgagctcagttgttactccctggcacctcagatcaaggtgatcgctccatggcgtatgcctgagttctataaccgctttaagggacgtaacgatctgatggagtatgccaagcagcatgggatccccatccccgtaacccccaagaatccttggagtatggatgaaaatcttatgcacatttcgtatgaggcggggatactggagaatcctaaaaaccaggcaccacctggcctgtatacaaaaacacaagaccctgccaaagcccctaacacacccgatattctggaaattgagttcaaaaaaggcgtgccagtgaaagtcacaaatgtaaaagacggcaccacacatcagacgtcactggaattgttcatgtatctcaatgaagtggcagggaaacatggggttggtaggatcgatatagtggagaatcgcttcatcggaatgaaatccagaggaatctatgaaacaccagccggtacaatactttatcatgcccacctcgacattgaagcattcaccatggacagggaagttcgcaagattaagcaaggtcttgggttgaaatttgctgaactggtatatacgggattttggcactcacctgaatgcgagttcgttaggcattgtatagcaaagtcccaggaacgcgtggagggcaaagtccaggtctccgtgctgaaaggacaggtttatattttggggagagagtcccctttgagcctttataatgaggagctggttagcatgaacgtgcagggcgattacgaacctacggatgccaccggttttatcaacattaactccctccgcctaaaggagtatcaccgattgcagagcaaagtgactgccaag

SEQ ID NO: 6881 - DNA, 1236 bp, Artificial Sequence
  Description of Artificial Sequence: Synthetic coding sequence
atgtcgtctaaggggagcgtcgttctcgcctatagcggtgggttggataccagttgcattcttgtctggctgaaggagcagggctacgatgttattgcttacctggccaatatcggtcagaaggaggattttgaggaggcacgaaaaaaggcactgaaactgggggccaagaaggttttcattgaagacgtgtcacgcgagttcgtggaggaattcatatggccggccattcagtcgagcgccctctacgaagaccggtatctcctaggtacctcactcgccaggccctgtatcgcccgaaagcaggtggagatagcccaaagggagggagcgaagtacgtgagccacggagccaccgggaaggggaacgatcaagtgcggttcgaattaagctgttacagtctggccccccagattaaagtcatagcgccctggcggatgccagaattctacaatcggtttaaagggaggaatgacctaatggagtacgcgaaacaacacggtattccaattcccgtgactccgaagaacccgtggtctatggatgagaaccttatgcatataagctacgaagcgggtattctggagaatccgaagaatcaggccccaccaggactgtacacaaaaactcaggatccggccaaggcccccaatacaccagacatcctggaaatagagttcaaaaaaggcgtgcccgttaaggtgacaaatgtgaaggatggaacgacccatcagactagcttagaattgtttatgtacctgaatgaagtcgccgggaagcatggggtcggtagaatagacattgttgagaatcgtttcatcgggatgaaaagccgtgggatatatgagacacccgctggtaccattctgtatcacgcccacctcgacatcgaggccttcaccatggaccgcgaggttcgaaaaatcaaacaggggcttggactgaagttcgctgaactggtgtacaccgggttttggcacagccccgagtgcgaattcgtgaggcattgtattgcaaagagccaggaacgggtggaggggaaggtgcaggtaagcgtactcaagggacaggtttatattttgggacgcgagtccccgctatctttgtacaatgaggagctcgtctcaatgaacgttcagggagactacgagcccactgacgcaacgggctttattaatattaattcgctgagactgaaagaataccaccgcctacaatcaaaggtgacggctaag

SEQ ID NO: 6882 - DNA, 1236 bp, Artificial Sequence
  Description of Artificial Sequence: Synthetic coding sequence
atgtcctcgaaggggtcagtggtgttggcatactccggcggcctcgacacctcctgtatcctggtgtggttgaaggagcagggatacgacgtgatcgcctacctcgctaacattgggcaaaaggaagatttcgaagaggcccgcaagaaagccctgaaactgggggcgaaaaaggttttcatcgaggatgtgtcgcgcgaattcgtcgaggaattcatttggccggccatccaatcctcggccctgtacgaagatcggtacctgctgggcacgtctctggcgaggccgtgcatcgcccggaagcaggtggaaatcgcccagcgcgagggagctaagtacgtgtcgcacggtgcgaccggaaaagggaacgaccaggtgcggttcgagctctcctgctactctctggctccgcaaatcaaggtcatagcgccgtggagaatgccagagttctataatcgctttaaaggaaggaacgacctcatggaatacgcaaagcaacatggaatcccaatcccggtaacgccgaaaaatccgtggtccatggatgaaaacctcatgcatatctcctacgaggcgggaattctggagaaccctaagaatcaggcaccgccgggactgtacaccaagactcaggatccagcaaaggcacctaacacccccgacattcttgaaatcgagtttaagaaaggagtgccagtgaaggtgactaatgtgaaggatggaaccactcatcagaccagcctcgaactgttcatgtatctgaacgaagtagcgggtaagcacggtgtcggccgaatcgacatagtggagaatagattcataggcatgaaaagcagaggcatctacgagacgcctgcgggaactatcctctaccatgcacatttggacatcgaggcttttactatggatcgggaagtgcggaagatcaaacaaggacttgggctgaaatttgccgaacttgtctacactgggttctggcactcgcccgaatgcgaattcgtgcgccactgcatcgctaaatcgcaggaacgggtcgaaggtaaggtgcaagtgtccgtgctgaagggccaggtctacatcttgggtcgcgagagcccactgtcgctgtacaatgaggaacttgtctcgatgaacgtccagggtgactatgagccaactgacgccaccggttttatcaacatcaacagtctgagactcaaggaataccaccgtctgcaatcgaaggttactgccaaa

SEQ ID NO: 6883 - DNA, 1236 bp, Artificial Sequence
  Description of Artificial Sequence: Synthetic coding sequence
atgtcgtccaaggggagtgtcgtgttggcctatagtgggggactcgatacttcctgtatccttgtatggctgaaagaacaagggtatgatgttatcgcttatctcgcaaacattggacaaaaagaggatttcgaggaggcacggaaaaaagcactaaaactcggagcgaaaaaagtgtttatagaagatgtgtcccgagaattcgtagaagagtttatctggcctgctatacagtcatcagctttgtatgaggatcggtatttactgggaacatctctagcaagaccttgtatcgctcgaaaacaggtggaaatagcacaaagggagggggccaaatacgtgtcacacggagcgacaggaaaaggaaatgaccaggtccggttcgaattgtcctgttattcgctggcccctcagataaaagtaatcgctccctggaggatgcctgaattctacaatcgcttcaaggggcgcaatgatcttatggaatatgctaaacagcacggaattcctatccctgtgactcccaaaaatccatggtctatggacgagaatcttatgcacatcagttatgaagcagggatcctagagaacccaaaaaatcaggcacctcccgggctttatactaaaacacaggatcccgctaaggcacccaatacaccagatatcctcgaaatcgaatttaaaaaaggagtacccgtcaaagtcactaacgtgaaagatgggacaactcaccagacatctttggagcttttcatgtatctgaacgaagtcgcagggaaacatggagtaggaagaatagacatcgtggagaatcggtttattggaatgaaatcacgggggatatacgaaacacccgctggaactatcttgtatcatgcccatctcgatatagaagcttttacaatggatcgggaagtgcggaaaattaaacagggattagggctaaaattcgctgagctggtttatacaggattctggcattcccctgagtgcgaatttgtacgccactgtatagccaaatctcaggaacgggtagagggaaaagtccaagtcagtgtgctgaaagggcaggtgtatatactcggacgtgaatcacccttatctctgtataacgaagaactcgtcagtatgaatgtacagggggattatgaacctacagatgcaactgggtttataaatattaattctctgcggctgaaggaataccacaggctgcagagtaaagtgacagctaaa

SEQ ID NO: 6884 - DNA, 1236 bp, Artificial Sequence
  Description of Artificial Sequence: Synthetic coding sequence
atgtcgtcgaaggggtcggtggtgctggcatactcaggtgggctcgatacttcctgcatcctggtgtggcttaaagagcagggttacgatgtgatagcgtacctggcaaatatcggtcaaaaggaagattttgaggaggctagaaagaaagccctgaaactgggtgcgaagaaagtgtttattgaggacgtgtcgagagaatttgtggaagaattcatttggcctgccatacagtcatccgctctttacgaggacagatacctgcttgggacgagccttgccagaccttgtatagccaggaaacaagtcgaaattgcccagagagaaggcgcaaaatacgtgtcccatggtgcaactgggaagggaaacgatcaggtccgctttgaactctcctgctactccctcgcaccccagatcaaggtgatcgccccttggagaatgccagagttttacaatagattcaaggggaggaacgacctgatggagtacgcaaagcaacacggaattcccatcccagtgactccaaagaacccgtggtcgatggacgagaacctgatgcatataagctacgaggcgggaattctcgaaaacccaaagaaccaggctccacctggattgtacaccaagactcaagatccggcgaaggcacctaacactcccgatattctcgaaattgagttcaaaaagggagtgcctgtgaaggtcactaacgtcaaggatgggactacccaccaaaccagtctcgaactgttcatgtatctgaatgaagtcgcgggaaagcatggggtcgggagaatagacatagtggaaaaccggtttattggtatgaaaagccgaggcatttacgagactcccgccggaaccattctttaccatgcgcacttggatatcgaagcatttactatggatcgagaagttcgcaagattaagcaaggacttggcctgaagttcgcggaacttgtctacaccggattttggcattcccctgaatgtgagtttgtgaggcactgtattgcaaagtcccaggaaagggtcgaaggtaaagtacaagtgtcggtacttaaggggcaggtgtatattcttggacgggaatcgcccctttctctgtacaatgaagagctcgtgagcatgaatgtccaaggagattacgaacccaccgacgcgactgggtttatcaacataaacagcctgcgtctcaaagaatatcatcgccttcaatctaaagtgaccgccaag

SEQ ID NO: 6885 - DNA, 1236 bp, Artificial Sequence
  Description of Artificial Sequence: Synthetic coding sequence
atgtcttctaaggggtccgtcgtactggcctattcagggggtcttgacacttcttgtatcctggtctggctcaaggaacagggatacgatgtgatcgcctacctcgccaacatcgggcagaaagaagacttcgaagaagcccggaagaaggctctcaagctaggcgccaagaaggtattcattgaggatgtctctagggagttcgtcgaagagttcatttggccagccattcagagctctgcgctgtacgaagatcgctacctccttggcacttctttggcccgcccatgcatcgcacggaagcaagtcgagatcgcacaaagggaaggcgccaaatatgtgtctcacggcgccaccggaaaggggaacgatcaagttcgtttcgagctttcttgctattcactggccccgcagatcaaggttatcgctccttggcgcatgccagaattttataaccgctttaagggaagaaacgatctcatggagtatgccaaacagcacggaattcccatccccgtgacgccaaagaacccatggagcatggacgagaaccttatgcacatttcttatgaggccgggatcctggagaatcccaagaaccaggcaccgcccggtctgtatacaaaaacccaggacccggccaaggcccctaacacaccagacatcttggaaatcgaatttaagaaaggtgttcctgtgaaagttactaatgtaaaggatggcaccacacatcagacatccttggagctcttcatgtacttaaacgaagtcgcgggcaagcatggtgtgggacgcatcgacatagtggagaataggttcattgggatgaagagcagggggatttacgagactccagctggcacgattttataccacgcgcacctcgatattgaggcgtttacaatggacagagaggtccgcaaaatcaaacaagggctcggcctgaaatttgcagaactggtttataccgggttttggcactcacccgagtgcgagtttgtgcggcattgcattgctaaatcccaggagcgcgtggaagggaaggtgcaggtgagcgtgctgaagggtcaggtttacattttaggaagggaaagcccgctcagcttatacaatgaggaacttgtgagtatgaacgtgcagggcgactacgagcctactgacgcaaccggctttatcaacatcaacagccttaggctgaaggaataccatcggttgcagtccaaagtcactgcaaag

SEQ ID NO: 6886 - DNA, 1236 bp, Artificial Sequence
  Description of Artificial Sequence: Synthetic coding sequence
atgtctagcaaaggctccgtcgtgctggcctactcaggaggacttgacacttcgtgcatcttggtgtggctcaaggaacagggctacgatgtcatagcatacctggcaaacatcggacagaaagaggattttgaagaagcccgcaagaaagccctgaaactcggagccaagaaagtctttatcgaagatgttagccgggagttcgtggaagaattcatttggccggcgatccagtcgagcgcgctctacgaggaccgatacctgctgggtacttcactggcgcggccatgtatcgcgagaaagcaagtggaaatcgcacagcgcgaaggcgcaaaatacgtgagccatggagcgaccggaaagggaaacgaccaggtgaggttcgagctgagctgttactccctggcacctcagatcaaggtgatcgccccgtggaggatgccggagttctacaatagattcaagggacggaatgatttgatggagtacgcaaaacagcacggaatcccgatccctgtgaccccaaagaacccctggtccatggacgaaaacctcatgcatatttcgtacgaggctggtatcctggaaaacccaaagaaccaggccccgccagggctgtacactaagacccaagatccggcgaaggcgccgaatacgccggatattctcgagatcgaattcaagaaaggagtccctgtgaaggtcaccaatgtgaaggacggaacgacccatcagacctcattggagctctttatgtacctgaatgaggtcgctgggaagcacggtgtgggacgcatcgatatcgtggagaatcggtttatcggtatgaagagccgggggatctacgaaaccccagccggtaccatcctgtaccatgcccaccttgatattgaagccttcactatggaccgggaagtgcgaaagatcaagcagggactgggactgaagtttgctgaactggtctacactgggttctggcactccccggaatgcgaattcgtgcgccactgcatcgcgaagtcgcaagaacgggtcgagggaaaagtgcaggtgagcgtgctgaagggacaggtgtacatcctcggaagagaatcgccactgagcctgtacaacgaagagttggtgtctatgaacgtgcaaggagactacgaacccactgatgcaactggattcatcaatatcaattcgctgaggctgaaagagtaccaccgcctgcaatcgaaagtcacggccaag

SEQ ID NO: 6887 - DNA, 1236 bp, Artificial Sequence
  Description of Artificial Sequence: Synthetic coding sequence
atgtcgagcaagggttccgtggtgttggcctacagcggcggtcttgacacctcctgcatcctggtctggctgaaggaacaggggtacgacgtgatcgcatacctggctaacatcggacagaaggaggacttcgaagaagcacgcaagaaggccctgaaactgggcgccaagaaggtgttcattgaagatgtgtccagggaattcgtggaagaattcatctggccggccatccaatcgtcggcactctacgaagatcgctacctgctcggaactagcctggcacgaccttgtatcgctcgcaagcaagtggaaatcgcgcagcgggagggcgctaagtatgtgtcccacggtgcgactgggaaaggcaatgatcaagtgagatttgaactctcgtgctactcactggcaccacaaatcaaggtgatcgcgccttggagaatgcctgaattctacaaccggttcaagggccgaaacgatctgatggaatacgccaagcagcacggcatcccgatccctgtcaccccgaagaacccgtggagcatggatgaaaatctgatgcatatctcctacgaagccggtatcctggagaatcccaaaaaccaggcgccgccgggactgtacactaagacccaagacccggctaaggccccaaatacccctgacatccttgagatcgaattcaagaagggagtgccagtcaaagtcactaacgtcaaagacgggaccacccaccagacttcactggaactcttcatgtaccttaatgaggtggcaggaaagcatggcgtggggcggattgacattgtggaaaaccgattcatcggaatgaagtcgcggggaatctacgagactccagctgggaccatcctctaccacgcgcacctggatatcgaagccttcaccatggaccgcgaagtgaggaaaatcaagcagggactcggactgaaatttgctgaactcgtgtacactggattctggcattcgccggagtgcgaatttgtgcggcactgtatcgccaagtcacaagaacgcgttgaaggtaaagtgcaggtgtcggtgctgaagggacaggtgtacatcctgggccgcgaaagcccactgtcgctgtataacgaggagcttgtgtccatgaacgtccagggcgattacgagccgactgatgctaccggtttcatcaacatcaactccttgagactcaaggaatatcatcgactccaaagcaaggtgaccgccaag

SEQ ID NO: 6888 - DNA, 1236 bp, Artificial Sequence
  Description of Artificial Sequence: Synthetic coding sequence
atgagtagcaaaggctcagtggtcctcgcttattccggtgggctggacactagttgcatcttggtgtggctaaaagaacaggggtatgacgtaatagcttacctcgccaacatcggtcaaaaggaagattttgaagaggccaggaaaaaggctctgaaactaggggcaaaaaaggtgttcatcgaggatgttagccgagaatttgtggaggagttcatctggccagccattcagagcagtgcgctctatgaggatcggtacctgctgggcacaagcttggcgcgtccctgtatcgctcgcaagcaggttgagattgcccagcgcgagggcgctaagtatgttagccacggggctactggcaaggggaacgatcaagtgcggtttgagttgtcgtgttatagcctggctccccagatcaaagtgatcgctccttggcgtatgcctgaattctacaaccgtttcaagggccgcaatgacctcatggagtacgctaagcagcacggcattcctatccctgtgaccccgaaaaatccttggagcatggatgaaaacctgatgcacatttcttacgaggccgggattctcgagaatcccaagaaccaggcacctccaggactctacacaaagacacaggatccagccaaggccccaaacacacctgacatactcgagatcgagtttaaaaaaggggtccccgtgaaggtgacaaatgtgaaggacgggacaacacaccagacctctctcgagctgtttatgtacttgaatgaagtcgccgggaagcacggtgtcggcagaatagatatcgttgagaatcgcttcatcggcatgaaatcacgaggaatttatgaaactcccgccggcactatcttgtatcacgcccacttggacatcgaagctttcactatggacagggaggtgcgcaagatcaaacaggggctcggtctgaaatttgcagagctcgtctacactggcttctggcatagccccgagtgcgaattcgtccgacactgtatcgcaaagagccaggaaagggttgagggcaaagtgcaggtcagtgtacttaagggtcaagtctatatcctcgggcgcgaatccccattgagtttgtataacgaggagctggtgtctatgaacgtgcagggcgactatgagccgactgatgccacaggatttattaacatcaactcgttgcgactgaaggaataccaccggttgcagtccaaggtgacagctaag

SEQ ID NO: 6889 - DNA, 1236 bp, Artificial Sequence
  Description of Artificial Sequence: Synthetic coding sequence
atgagcagcaagggctcggtcgtactggcatatagcggagggctcgatacaagctgtatcttggtctggctgaaggaacaaggatacgatgtgatcgcctatcttgctaatatcggccagaaggaggacttcgaggaggcccggaaaaaggcactcaagcttggagccaagaaggttttcatagaggacgtatcccgcgagtttgtggaggagtttatttggccggccatacagagttctgcactctatgaggaccgttacttgctggggacctctttagctaggccttgtatcgcgcgaaaacaggtggagatagctcaacgggagggcgctaaatacgtcagccacggcgccacaggcaagggcaatgatcaagtccggttcgagctgtcatgctattcgctcgcgccacagataaaagttatagccccatggcgcatgcctgaattttataaccgcttcaagggcagaaatgatcttatggaatatgcaaagcagcatggaattccaattcccgtaaccccaaaaaatccctggtctatggatgaaaatctgatgcacatctcatacgaggcaggcattcttgaaaatcccaagaaccaggcaccccccggcttgtacacgaaaacacaagatccagccaaggcaccgaacacccccgacattttggagatcgaatttaagaagggagtgccggtgaaggtcacaaatgtaaaggatggcaccacccatcagacctctcttgagctctttatgtatttgaacgaggtggctggcaagcatggagtgggacggatcgacatcgtggagaatcgcttcattggaatgaaatctcggggcatctatgaaacccccgccggcacgatcctctaccatgctcaccttgatatcgaagccttcacgatggaccgggaagtgcgaaagattaaacaaggattggggctcaaatttgccgagctggtgtatactgggttctggcatagcccagagtgtgagtttgtgcgccactgcatcgccaagtcccaggagcgggtggaagggaaggtccaggtcagtgttctcaagggtcaggtttacatcctaggccgcgagagcccgctgagcctgtacaacgaggaactggtgtctatgaatgtgcagggggattacgagccgactgacgcaaccggcttcatcaatattaacagcctgcgactaaaagagtaccaccgcctccagtccaaggtaaccgcaaag

SEQ ID NO: 6890 - DNA, 1236 bp, Artificial Sequence
  Description of Artificial Sequence: Synthetic coding sequence
atgtcatcaaaggggtccgtagtcctggcctattcaggcgggctcgatacttcttgcatcctcgtctggttgaaggagcaaggttatgatgtcatcgcttacctggccaatattgggcagaaagaggattttgaggaagcccgcaagaaagctcttaaacttggagctaagaaggtattcatagaagacgtttcacgagaattcgtcgaagagttcatctggcccgccatccagagttcagccctctatgaggaccggtacttgctcggcacatcacttgcccgcccatgcattgcacggaagcaggtggagatcgctcagagagagggggctaaatacgtgtcacacggggccacaggcaagggaaacgatcaagtacgatttgagctgagctgctattctcttgcccctcagattaaggtcatcgctccatggaggatgcctgagttttacaatcgatttaagggacgaaacgacctgatggaatacgcgaagcagcatggtattcctatccccgtaacccccaaaaatccttggagcatggacgagaacctgatgcacatctcatatgaagcaggcatacttgaaaaccctaaaaatcaggcgcctcctggtctctatacaaaaacacaagatcccgctaaagctcccaatacccccgatattctggaaatcgaattcaaaaaaggcgtccctgtgaaagtgaccaatgtgaaggatggtacaacccatcaaacaagcttggagctgttcatgtacctgaacgaagtggccgggaagcacggcgtgggacgcatcgatatcgtggagaatcgatttatcggcatgaagtctagaggaatctacgaaacaccggcaggaactattctctatcacgctcacctggacattgaagcttttaccatggaccgggaggtccggaaaattaaacaaggactgggcctcaaatttgcagagctggtgtatactggcttctggcattcccccgagtgcgagttcgtaagacactgtatagcgaaatctcaggagagggtcgaaggcaaggtgcaggtgagcgtgctgaaaggacaggtttatatcctcgggagggagagccctctctctttgtacaatgaggagcttgtgagcatgaacgtccagggagattatgagccaacggatgccaccggatttataaatatcaacagcctccgattgaaggagtaccaccgattgcagagtaaagtgacagccaag

SEQ ID NO: 6891 - DNA, 1236 bp, Artificial Sequence
  Description of Artificial Sequence: Synthetic coding sequence
atgtcctcgaagggttcggtggtgctcgcatattcaggcggccttgacacctcttgcattctggtctggctcaaagaacaaggatacgacgtgatcgcgtacctcgccaacatcgggcaaaaggaagatttcgaggaggctcgcaaaaaggccttgaaactcggcgcgaagaaagtgtttatcgaggacgtctccagagagttcgtcgaagaattcatttggccagctatccaatcttccgcgctctacgaggataggtatctgctcggcacgagcttggcccggccgtgtatcgcccggaagcaggtcgaaattgcgcagcgcgagggagcaaagtacgtgtcacacggagctaccgggaaggggaacgaccaggtgcggttcgagcttagctgttactcgctcgccccgcagataaaagttatcgctccttggcggatgcctgagttctacaatcgattcaagggacgaaacgacctgatggagtatgctaagcaacacggaatcccgattccggtcacccctaagaatccttggtcaatggacgaaaatctgatgcatatttcctacgaagccggaatcctggagaatccaaagaaccaggctccgcctggattgtacaccaagacgcaagacccagccaaggcgcccaacacgcccgatattctggagatcgaattcaaaaagggagtgcctgtgaaggtcaccaacgtgaaggatggtaccactcaccagactagcctggagctgtttatgtacctgaacgaggtggctggcaaacacggggtgggacggatagacatcgtggaaaatcggtttatcggcatgaaatcgcgaggaatctacgaaaccccagctggcactatcctgtaccatgcacatctggacatcgaagcatttaccatggatcgcgaagtgcgcaaaatcaaacagggactggggctcaagttcgccgaactggtctacactggtttctggcattcccccgaatgcgaatttgttcggcactgcattgcaaagagtcaggaaagggtggagggaaaggtgcaggtgtcggtcctgaagggtcaggtgtacatccttggacgcgaatcgccactgtcgttgtacaatgaggaactcgttagcatgaacgtgcaaggagactacgaaccaactgatgcaactggcttcataaacatcaacagtttgaggctgaaggagtatcacagactgcaatccaaggtgactgcaaag

SEQ ID NO: 6892 - DNA, 1236 bp, Artificial Sequence
  Description of Artificial Sequence: Synthetic coding sequence
atgagttccaaaggatcagttgtcttagcttactctggaggtcttgatacaagttgtattttagtttggcttaaagaacaaggatatgatgttattgcttatctagcaaatattggtcaaaaggaagattttgaagaagctagaaaaaaagctctaaaattaggagctaaaaaagttttcattgaagatgtaagtagggaatttgttgaggaatttatttggccagctattcagtcatcagctttatatgaagaccgatatcttttaggaacttcacttgctagaccttgtattgctagaaaacaagttgaaatagcccaaagagaaggtgctaaatatgtttcacatggagctactggtaagggaaatgatcaagtaagatttgaattaagttgttatagtttagctccacaaattaaggttattgcaccatggagaatgccagaattttataatagatttaagggtagaaatgacttaatggagtatgctaaacaacacggtattcctattccagtaacgccaaaaaatccatggtcaatggatgaaaatttaatgcatatttcatatgaagctggtattttagaaaatccaaagaatcaagcaccaccaggattatatacaaaaactcaagatccagctaaagcaccaaatactccagatattcttgaaattgaatttaaaaaaggagttccagttaaagttacgaatgttaaagatggaactacacatcaaacatcattagaattattcatgtatttaaatgaagttgctggtaaacatggtgtaggacgaattgatattgttgaaaatagattcattggaatgaagtcaagaggaatttatgaaactccagcaggaaccattttatatcatgctcatttagatatagaagcattcactatggatagagaagtaagaaaaattaaacaagggttaggtttaaagttcgctgaacttgtatatacaggattctggcatagtccagagtgtgaattcgttagacattgtattgcaaaatcacaagaacgtgtagaaggtaaggttcaagtttctgtattaaaaggacaagtttatattttaggacgtgaatctccattatcactttataatgaggaattagtttcaatgaatgtacaaggagattacgaaccaactgatgctactgggttcattaatattaatagtttaagattgaaagaatatcatagattacaatccaaagtgactgctaaa

SEQ ID NO: 6893 - DNA, 1236 bp, Artificial Sequence
  Description of Artificial Sequence: Synthetic coding sequence
atgagctcaaaggggtcggtggtgctggcatactccggcggactggatacgtcgtgcatccttgtgtggctgaaagagcagggatacgatgtcatcgcctacctggcaaatatcgggcaaaaggaggatttcgaggaagcccgaaaaaaggcgctcaaacttggggcgaagaaggtgttcatagaagatgtctcgcgcgagttcgtggaagagttcatctggccggctatccagagctcggccctgtacgaagatcgatacctgctgggcacttcgctcgcacggccttgcatcgcgcgcaagcaggtggaaatcgcccagcgggaaggggcaaaatacgtctcccatggagcgaccggaaagggcaatgaccaagtgcgcttcgaactgtcctgctactcactggcaccacaaatcaaggtcatcgccccatggcgcatgcctgaattctacaaccggttcaagggacgaaacgaccttatggagtacgccaaacagcatggaattccgatcccggtgaccccgaagaacccctggtccatggatgaaaacctgatgcacatcagctacgaagccggaatcctggaaaatcccaagaatcaggctcctcctggcctgtacactaagactcaagatccggccaaggcgccaaacactccggacatccttgaaatcgagttcaaaaaaggagtcccggtcaaggtgaccaacgtgaaggacggaactacccatcagacttcactggagctgttcatgtacctcaatgaagtggcgggaaagcacggcgtgggaagaatcgacatcgtggagaatcggttcattggaatgaagtcgcgcggaatatacgaaactccagcgggaactatcctgtaccacgcacatttggacatcgaggctttcactatggaccgggaagtgaggaagattaagcagggactcggactcaagtttgccgaactcgtgtacactggcttctggcactcacccgaatgcgagtttgttagacactgcattgctaaatcccaggagcgcgtggaggggaaggtgcaagtctcagtgcttaagggacaggtttacattctgggccgagagtccccgctctccctctacaacgaagaactggtcagtatgaacgtacagggtgattatgagccgaccgacgctaccggattcattaacatcaactcgctcaggctgaaagaataccaccgcctgcagagcaaagtgaccgcaaaa

SEQ ID NO: 6894 - DNA, 1236 bp, Artificial Sequence
  Description of Artificial Sequence: Synthetic coding sequence
atgagttccaagggctccgtggtccttgcgtactccggcgggttggatacgtcatgcatactggtgtggctaaaggaacaggggtatgatgtgattgcctacctagccaatattggccagaaggaggacttcgaagaagcacgtaaaaaagcactgaaactgggtgccaagaaggtgtttatagaagatgtgtcacgggagtttgtagaggaatttatctggccagcaatccagtcatccgcactctacgaagatcgatacttgctcggcacaagtcttgcccgcccctgtatcgcccgcaagcaagtcgagatcgcacagagggagggggcaaaatacgtgtcacacggtgcaactggaaaagggaacgatcaggtgcgctttgaattgtcgtgctactccctggctccacagatcaaggttatcgcaccgtggagaatgcccgagttctacaaccgctttaaagggagaaacgatctgatggaatatgcaaaacaacatggtataccaataccagtgacaccgaagaacccgtggagcatggacgaaaatctgatgcacatctcctacgaagcaggtatcctggagaatcccaaaaaccaagcccctccaggtctgtacacaaagacccaggaccccgccaaagcccccaacacaccagatatcctggaaattgagtttaagaagggagtacccgtgaaagtgacaaacgtgaaggacggaaccacacatcagacctctctggaactgtttatgtacttaaacgaagtggcagggaagcatggagttggtcgcattgatatagtggaaaacaggttcatcggaatgaagtcaagaggaatatacgagacgccggcaggaactatcttgtaccacgcccatctggacatcgaagcgtttacaatggaccgagaggtgcgcaagattaaacaaggattgggtttgaaattcgccgaactcgtgtacactggattttggcatagccctgagtgtgagttcgtccggcattgcattgctaagtctcaggaacgtgtggaggggaaagtacaggtttctgtcttgaaaggacaggtgtacatcttgggaagggagagcccactcagcctgtacaatgaagaactagttagtatgaacgttcagggggactatgagcctacggacgcaaccggtttcattaacattaactcgctgcgactgaaggaataccaccgcctccagagcaaggtgaccgctaag

SEQ ID NO: 6895 - DNA, 1236 bp, Artificial Sequence
  Description of Artificial Sequence: Synthetic coding sequence
atgtcttccaagggtagcgtggttcttgcctactccggtgggcttgacacttcctgtattcttgtctggttgaaggaacagggctacgatgtcatcgcctatttggctaatatcggccagaaagaggattttgaagaggcgcggaagaaagcactgaagctgggcgccaaaaaggtgttcatagaggacgtctccagagaattcgtggaagaattcatctggccagcgatccagagcagtgccctgtacgaggacaggtatctgttgggcacaagcctcgctcgcccatgtatcgccaggaagcaggtggaaattgcacagcgggagggggccaaatacgtctctcacggcgccactgggaaggggaacgaccaggtgcgcttcgaactctcttgttattcccttgcccctcaaattaaggtgatcgcaccttggaggatgcccgagttctacaataggtttaaagggcgcaacgatctgatggaatatgctaaacagcatggaatcccaatccctgttacacctaagaatccttggtccatggacgagaacctgatgcatatctcctatgaggcaggaattctggaaaatcccaaaaaccaggcaccaccgggcctttacaccaagacccaagatccagcaaaggcccctaatactcctgacattctcgaaattgaattcaaaaaaggagtgccagttaaggtgaccaacgtaaaggatggaacaacgcaccagaccagtctcgaactgtttatgtatctgaacgaggtcgcaggcaagcacggggttggaagaatcgacatagtagagaaccggttcatcggcatgaaaagccggggtatatatgagactcccgcaggaaccattctgtaccatgcccatctggatattgaggctttcactatggaccgggaagtgagaaaaatcaagcaggggctcggattgaagttcgccgagttggtatacacaggcttctggcacagtccagagtgtgagtttgtgaggcattgcatcgctaaatcccaggagcgggtggagggaaaggtgcaggtgagcgtgctgaaaggtcaggtgtatatcttgggccgcgagtctccgctgagtctctacaatgaagaactggtcagcatgaacgtgcagggtgactatgaaccaaccgatgcaaccggttttattaacattaattctctgagattgaaggagtatcaccgactccaaagcaaggttacagctaaa

SEQ ID NO: 6896 - DNA, 1236 bp, Artificial Sequence
  Description of Artificial Sequence: Synthetic coding sequence
atgtcgtcgaaaggttcggttgtactagcgtattcgggtggtctagatacgtcgtgtatactagtttggctaaaagaacaaggttatgatgtaatagcgtatctagcgaatataggtcaaaaagaagattttgaagaagcgcgtaaaaaagcgttaaaattaggtgcgaaaaaagtatttatagaagatgtttcgcgagaatttgttgaagaatttatatggccggcgatacaatcgtcggcgttatatgaagatcgttatctattaggtacgtcgttagcgcgaccgtgtatagcgcgtaaacaagtagaaatagcgcaacgagaaggtgcgaaatatgtatcgcatggtgcgacgggtaaaggtaatgatcaagttcgttttgaattatcgtgttattcgctagcgccgcaaataaaagtaatagcgccgtggcgtatgccggaattttataatcgttttaaaggtcgaaatgatttaatggaatatgcgaaacaacatggtataccgataccggtaacgccgaaaaatccgtggtcgatggatgaaaatttaatgcatatatcgtatgaagcgggtatattagaaaatccgaaaaatcaagcgccgccgggtttatatacgaaaacgcaagatccggcgaaagcgccgaatacgccggatatactagaaatagaatttaaaaaaggtgtaccggtaaaagtaacgaatgtaaaagatggtacgacgcatcaaacgtcgctagaattatttatgtatctaaatgaagtagcgggtaaacatggtgttggtcgaatagatatagttgaaaatcgatttataggtatgaaatcgcgaggtatatatgaaacgccggcgggtacgatattatatcatgcgcatctagatatagaagcgtttacgatggatcgagaagtacgtaaaataaaacaaggtttaggtctaaaatttgcggaattagtttatacgggtttttggcattcgccggaatgtgaatttgttcgacattgtatagcgaaatcgcaagaacgagtagaaggtaaagttcaagtttcggttttaaaaggtcaagtatatatactaggtcgtgaatcgccgttatcgctatataatgaagaactagtatcgatgaatgttcaaggtgattatgaaccgacggatgcgacgggttttataaatataaattcgttacgtttaaaagaatatcatcgactacaatcgaaagttacggcgaaa

SEQ ID NO: 6897 - DNA, 1236 bp, Artificial Sequence
  Description of Artificial Sequence: Synthetic coding sequence
atgtcttctaagggaagcgtggtcctggcttatagcggtggcttagatacgtcctgtattctggtctggctaaaggaacagggctatgacgtcattgcctatttagccaacattggccagaaggaggatttcgaagaggccaggaaaaaggccctgaagctcggagcaaaaaaagtttttatcgaagacgtatcacgagaattcgtggaggaatttatatggccagccatccagtctagtgctctgtacgaagaccgatacctgttgggaacctcactagctagaccttgtatcgcccggaagcaggtggaaatcgctcagagggagggcgccaaatacgtgagccacggcgcaacagggaaaggcaacgatcaggtacggtttgagctatcctgctattccctggctccgcagatcaaagtaatcgcaccatggagaatgcctgaattctacaatcgtttcaaagggagaaatgacttgatggagtatgctaaacagcacggtatcccgatcccagttactccaaagaacccgtggtcaatggacgaaaacctcatgcacatctcttacgaggcagggattctggagaatcccaagaatcaggcccctcctggactgtacaccaaaactcaggatcccgccaaggcgccaaatacaccggatatcctagagatagagtttaaaaaaggagtccccgttaaggtgacaaatgttaaagatgggaccacacaccagacctctcttgagctatttatgtaccttaacgaggtagcgggtaagcatggagtcggaagaattgacattgtggagaacaggttcatcgggatgaagtcacggggtatttatgagacacctgctggaacaatattgtatcacgcccacctggatattgaggcatttacaatggacagagaagtgcggaaaatcaaacaaggtctggggctcaagtttgcagagctggtctatacagggttctggcatagtccggaatgcgaattcgtgcgacattgcatagccaaatcccaggagcgtgtggagggtaaagtgcaggtgtccgttttaaagggccaagtgtacattctggggcgggaatcccccctgagtctctataatgaagaattagtctccatgaacgttcagggcgactacgagcccacagatgccacaggattcatcaatattaacagtctgcgcctaaaagagtatcacaggctgcagtccaaggtgacagcaaag

SEQ ID NO: 6898 - DNA, 1236 bp, Artificial Sequence
  Description of Artificial Sequence: Synthetic coding sequence
atgtcgtcaaagggttcagtggtgctcgcatactccggcggactggatacgtcctgtatcctggtgtggctgaaagaacagggctacgatgtgatcgcataccttgcaaacattggtcagaaggaggattttgaggaagcaagaaagaaagcacttaaacttggcgctaagaaggtgtttatcgaagatgtctcgcgggaatttgtggaagagttcatatggcccgcaattcagagctccgcactctacgaggaccgctacctgctcggcaccagcctggcgaggccatgtattgcccgaaagcaagtggaaatcgcacaacgcgaaggtgcaaaatacgtctcgcacggagcaaccggaaagggaaatgatcaagtgagatttgagctgagctgttactcgcttgcgcctcagattaaggtcattgcaccttggcggatgcccgaattctacaacagattcaaaggaagaaatgatttgatggagtacgccaagcaacatggaattccaattcccgtgactccaaagaacccttggtccatggatgaaaaccttatgcacatctcctacgaagccggtattctcgaaaatcctaagaatcaagctccccctggactgtacactaagactcaggacccagctaaggcacctaacacgcctgatattctcgaaattgaattcaagaaaggagtccctgtcaaggtgaccaacgtgaaggacggcactactcatcagacgtcactggaacttttcatgtaccttaatgaagtggcaggtaagcacggtgtgggtagaattgatattgtggaaaacagatttatcggcatgaagtcccgggggatttacgaaacccctgccggtactatcctttaccacgcacacctcgatattgaggcatttaccatggaccgggaggtccgaaagatcaagcaagggctcggccttaagtttgcggaactggtctacactggattttggcatagcccagagtgcgaatttgtgaggcattgtatagcaaagtcgcaggaacgtgtggaggggaaggtccaagtgtcggtccttaagggacaggtgtacatcctgggaagagaatcgcctctttccctgtacaatgaagagctggtgtcaatgaacgtgcaaggagattacgaacccaccgacgccaccggctttatcaacatcaacagccttcggcttaaagagtatcatagactgcagtcaaaggtcactgcaaag

SEQ ID NO: 6899 - DNA, 1236 bp, Artificial Sequence
  Description of Artificial Sequence: Synthetic coding sequence
atgagctccaagggctcagtggtgttggcttactcaggtgggcttgatacctcgtgcatcctggtctggctgaaagagcaaggatacgatgtcattgcttaccttgcaaatatcggacaaaaagaggacttcgaagaagcccggaagaaggccctgaaactcggcgctaagaaagtctttatcgaagatgtctctagggaattcgttgaagaattcatctggcctgcaatccagtcctcagcgctgtatgaagatcggtacctgctcggcacttcgctcgccaggccgtgcatcgctagaaagcaggtggaaattgcccagcgagagggagccaaatatgtctcccacggtgcgactggcaagggcaatgatcaggtgcggttcgagctgtcatgctactctctggcaccgcaaatcaaagtcatcgccccgtggcgcatgccggaattctacaaccgcttcaaaggacggaatgacctcatggagtatgcgaagcagcacggcatccctatcccggtgaccccgaagaatccgtggagcatggacgaaaacctcatgcatatctcatacgaagccgggatactggagaatccaaagaaccaggcaccccccggcctttacaccaaaacccaggacccagcgaaggccccgaacacccccgacattttggagatcgagttcaaaaaaggtgtgcctgtcaaagtgacgaacgtcaaggatgggacgacgcatcaaacctccctcgaactcttcatgtatctcaacgaagtcgcgggaaagcacggagtgggcaggatcgacatcgtggaaaaccgcttcatcggtatgaagtccagagggatctatgagactcctgccggaacgatcctctaccatgcccaccttgacatcgaagcctttactatggaccgggaggtgcggaagatcaaacagggactgggtcttaagttcgccgaactggtgtacaccggattttggcactcgcctgagtgtgagttcgtgcggcactgcatcgccaaaagccaagaaagagtggagggaaaggtccaggtgtcggtgctgaagggacaagtctacattctcggacgcgaatccccgctgtcactctacaatgaggaactggtgagcatgaacgtgcagggcgactacgagccaaccgatgcaactggatttatcaacatcaattccctgcgccttaaggagtaccataggctgcagagcaaggttactgcaaag

SEQ ID NO: 6900 - DNA, 1236 bp, Artificial Sequence
  Description of Artificial Sequence: Synthetic coding sequence
atgtcctccaaaggctccgtggtgctcgcctactcgggagggttggatactagctgcatcctggtctggctgaaggagcagggttacgacgtgatcgcgtacctcgcaaacatcggccagaaagaggacttcgaggaagcacgcaaaaaggctttgaaactgggcgcgaaaaaggtgttcatcgaggatgtgtcgcgcgagttcgtggaagagttcatctggccagcaatccaatcgagcgcactgtatgaggatcgctacttgcttggcaccagcctggcccgcccgtgcattgcccgaaagcaagttgaaattgcccagcgggagggagcgaagtacgtctcccatggcgcaaccggtaagggtaatgatcaggtgcgcttcgaactgagctgttactcgctcgcgccgcaaatcaaagtgatcgccccatggagaatgcctgagttctacaatagattcaaggggcgcaatgatctgatggagtacgctaagcagcatggcatcccaatccctgtcacgcccaagaatccgtggtccatggacgagaaccttatgcacatttcatatgaagccggcatactcgaaaacccaaagaatcaggcgccgccaggactctacaccaaaactcaggatcccgctaaggctccgaacaccccggacatcctggaaatcgagttcaaaaagggagtccctgtgaaggtgactaatgtgaaagatggcaccactcaccaaacctccctcgaactgttcatgtacctgaacgaggtcgccgggaagcatggggtgggacggatcgacatcgtggagaaccgattcatcggcatgaaatccagaggaatctacgaaaccccggcaggaactattctctaccacgcccacctggacatagaagcgttcaccatggacagggaagtgcggaagattaagcaaggacttggactgaagttcgccgagctggtgtacaccggattctggcactcgccggagtgtgagtttgtgcggcactgcattgccaagtcacaggaaagggtggaagggaaggtccaggtgtccgtgctgaagggacaagtgtacatcctcggacgcgagtcccccctctcactctacaacgaggagctggtgtcaatgaacgtgcagggcgactacgaaccgaccgatgccactggattcatcaatatcaactcgctccggcttaaggaataccaccgccttcaatcaaaagtcaccgcaaag

SEQ ID NO: 6901 - DNA, 1236 bp, Artificial Sequence
  Description of Artificial Sequence: Synthetic coding sequence
atgtccagcaaaggcagcgtagtgttagcctattcaggcggcctggacacctcatgcattctcgtctggctgaaggaacaaggatacgacgtcatagcttatcttgcaaacattggtcagaaggaggatttcgaggaagcaaggaagaaagcccttaagctgggagccaaaaaggtttttattgaagatgttagtcgtgagtttgtggaagagttcatttggcccgctattcaatcaagtgctttgtacgaagacaggtatctgttgggcacctccctggcccgtccatgcattgcacgaaagcaggtcgagatagcccagcgcgaaggggcaaagtatgtgagtcatggagcgaccgggaaggggaatgatcaggtgaggttcgaactgtcctgctattctctcgccccgcaaatcaaggtcatcgctccatggcggatgcctgagttttataacaggttcaaagggaggaacgacctcatggagtatgcgaagcagcacgggattcctatccctgtgacacccaagaacccctggtccatggacgagaatctgatgcacatcagctacgaggccggaatactggagaacccaaaaaatcaagctccacccggactgtacaccaaaacccaggaccctgctaaagcacctaatactcctgatattttggaaatagaattcaagaagggcgtccccgtcaaagtcacaaatgtgaaggacggaacaacacatcagacgtctctggaactctttatgtatctgaatgaagtcgccggaaagcatggagtaggacgaatcgatatcgtagagaataggttcattgggatgaagagccgaggcatctacgaaacgcccgcgggcacgattctttatcatgcgcacctggacatcgaagcattcacaatggaccgggaggtgcgaaagatcaaacaggggctcggcttaaagttcgctgagctggtctacaccgggttctggcattccccggaatgcgagttcgtcagacattgcatcgcaaaaagtcaggagagagtggagggaaaggtccaggtatccgtacttaaagggcaagtttacatcttgggacgagagagtcctctgtctctgtacaacgaagaattggtatccatgaacgtgcagggcgactacgagccaacagatgctacgggtttcataaatattaactccttgcgcctaaaggaatatcatagattgcagtcaaaggtgacagccaag

SEQ ID NO: 6902 - DNA, 1236 bp, Artificial Sequence
  Description of Artificial Sequence: Synthetic coding sequence
atgagcagcaagggcagtgtagtattggcgtatagcggtggtctagacaccagttgtatcctcgtgtggctgaaagagcagggctatgatgtcattgcttatctggctaatatcggtcaaaaggaggacttcgaggaagcccgtaaaaaagccctaaagctgggcgccaagaaagtattcatcgaggacgtcagtagggaattcgtcgaagaattcatctggccagcgatacaaagttcggctctgtacgaagaccggtacctccttggcacctccctggcaaggccttgcattgcgaggaagcaggtcgagatagcccagcgggaaggtgccaaatatgtaagtcacggagccactggcaaaggtaacgaccaagtcaggtttgaactgtcttgctattccctggcaccacagataaaagtcatagctccctggaggatgcccgaattctataaccgtttcaagggtaggaatgaccttatggagtatgccaagcaacacggcattcctatacccgtaactccaaagaatccctggagcatggatgagaacctcatgcacatctcttacgaggctggaattctggaaaatccaaagaaccaagctccgcccggattatacactaagactcaggaccccgccaaagcccccaatactcccgacatcctagaaatagagttcaagaagggggtccctgtgaaggtaaccaacgtaaaagacggcactacacaccaaaccagtttagaactgttcatgtatttgaatgaagtggctgggaagcatggtgtgggaagaatcgatatagttgaaaatcgcttcataggcatgaagtcacgtggtatttacgagacccctgccggcaccattttgtatcacgcccacttagatatagaggcattcacgatggatagggaggtgagaaagatcaagcagggattaggattgaagttcgctgaacttgtttatacggggttctggcattcccccgagtgtgaattcgttcgacactgtatagctaagtcccaggaaagggtggaaggtaaagttcaagtgtccgttcttaaaggccaggtgtatatactgggtagggaatcacccctatccctgtacaacgaagaactggtgagcatgaacgtgcagggggactatgaacctacagacgccaccgggtttatcaatatcaattctctcaggcttaaggagtaccaccgcttacagtcaaaggtcacagcaaaa

SEQ ID NO: 6903 - DNA, 1236 bp, Artificial Sequence
  Description of Artificial Sequence: Synthetic coding sequence
atgtcctccaaggggtcagtggtgcttgcctacagtggagggctggacacttcttgcatcctcgtttggctgaaggagcagggttatgacgtcatagcctatctggccaacatcggacaaaaagaagactttgaggaggcccgcaagaaagctctgaagctcggagccaaaaaagtcttcattgaggacgtgtcccgggaattcgttgaggagtttatctggccggcaattcagagctccgcattgtacgaggatcggtacctactcggcacctctttagctcgtccttgtatcgctaggaaacaggtggagattgcgcagagggaaggcgccaagtacgtgtcgcatggggccactggcaagggaaatgaccaggtacgcttcgagttatcttgttatagcttggcgccccaaatcaaggtgattgcgccttggagaatgcccgaattctacaatcgcttcaagggacgaaacgatttgatggagtatgcaaagcagcacggcataccaattcctgtgacccctaaaaacccctggagtatggacgaaaacctcatgcatatatcatacgaagccggtatcttggaaaacccaaagaatcaggcgccaccaggattgtacaccaagacacaggatcctgccaaggctcctaacactccagatattctggagatcgagtttaaaaaaggggtacccgttaaggtgacgaatgtaaaggacggaactacccaccagacttccttggagcttttcatgtatcttaacgaagttgccggcaaacacggggttgggcgaattgacattgtggagaataggttcatcggcatgaagtccagaggaatatacgaaactccagctggcactatcctctatcacgctcatctggatatcgaggcattcaccatggaccgggaagtgaggaagatcaaacaaggtctaggactgaagtttgctgagctggtttacactggattctggcacagcccagagtgcgaattcgtgaggcactgcatagctaagtcccaggagcgagtcgagggaaaggtgcaggtcagcgtgcttaagggacaagtgtatatcttgggacgggagagccccctgtctttgtataatgaagagctggtttccatgaatgtgcagggcgattacgaaccaacagatgcaactggctttatcaacatcaattctctgcggttgaaggagtatcaccggctacagtccaaagtaaccgccaag

SEQ ID NO: 6904 - DNA, 1236 bp, Artificial Sequence
  Description of Artificial Sequence: Synthetic coding sequence
atgtcaagcaagggttccgtcgtgcttgcttactcgggcggacttgacacttcctgtatcctggtgtggctgaaggaacagggttacgatgtgattgcctacctcgcgaacattggacagaaggaagatttcgaagaagcccgcaagaaggcgctcaaactcggggccaagaaggtctttattgaagatgtgtcgcgagagtttgtggaagagtttatctggcctgcaatccaatccagcgcgctttacgaagatcgttaccttctcgggacttcgttggcaagaccctgcattgcaagaaagcaagtggaaatcgcacaacgcgagggggcaaagtacgtctcccatggtgcgaccggcaagggaaacgatcaagtgagatttgaactgtcatgctactccctggctccccagattaaagtcatagccccgtggcgtatgccagaattctacaaccggttcaagggtaggaatgacttgatggaatacgccaagcagcatggaatccctattcctgtgaccccaaagaacccgtggtcaatggacgagaatctgatgcacatatcgtatgaagcaggcatccttgaaaaccctaagaatcaggctcctcctggtctgtacacgaaaacccaagacccagcaaaggcacctaataccccagatatactggaaatcgaattcaaaaagggggtgcccgtcaaagttaccaatgtcaaagatggaaccacccatcaaacctcgcttgagttgtttatgtaccttaatgaggtggcaggaaagcatggagtgggaagaattgacattgtcgagaacaggttcattggcatgaagtccaggggaatatacgaaactccggctggtactattctgtaccacgcccacctggatattgaagcattcaccatggatagagaagtgaggaaaatcaagcaaggccttggtctgaagttcgccgagctggtctacactggattttggcactcccctgaatgtgaatttgtgcgtcattgcattgccaagagccaagaaagagtggaaggcaaggtccaggtgtcggtgcttaagggtcaagtctacattctggggagagaaagtcccctctcgctgtacaacgaagagctcgtctcgatgaatgtgcagggtgactacgagccaactgatgcaaccgggtttatcaatatcaactcattgagattgaaggagtaccaccgtctccagtcaaaagtgaccgcaaag

SEQ ID NO: 6905 - DNA, 1236 bp, Artificial Sequence
  Description of Artificial Sequence: Synthetic coding sequence
atgtcctcaaaaggcagcgttgtccttgcttactccgggggccttgacaccagttgtatcctggtctggctcaaggagcaggggtatgatgtcatcgcatacttggcaaatatcggtcaaaaggaggatttcgaagaggctcgaaaaaaggctctaaagctgggggctaagaaagtttttatagaagacgtcagccgtgaattcgtggaagagttcatatggccagctatccaatcctccgcgctgtacgaggatcgctacttgctaggaacatccctggcccgaccctgtattgctcgtaagcaagtggaaatcgctcagcgggaaggggctaagtacgtttctcatggcgcaactggaaagggaaacgatcaggttcgctttgaactctcgtgctacagtctggcaccccagataaaggttatcgctccatggcgcatgcctgagttctacaatcgcttcaaaggtcgcaatgacctgatggagtatgcgaagcagcatggaatcccgattcccgtgacgccaaagaacccttggtctatggatgagaatctcatgcacatctcatatgaggctggaattctagagaaccctaaaaaccaagcccccccaggtctctacaccaaaacccaggatccagcgaaagccccaaatacccccgatatactggagattgagtttaagaagggcgtcccggtcaaagtgacgaatgttaaagacggcactacgcaccaaacatctttagagttgttcatgtacctcaatgaggtggccggcaagcatggtgtgggtcgtatcgatatcgtggaaaatcgttttataggaatgaagtcacgggggatttatgagaccccagcagggactatcctctaccacgcgcacctcgacattgaggcgttcacgatggatcgtgaagttaggaagataaaacaaggtctgggccttaagtttgcggagcttgtgtacaccggattctggcactcgccagaatgcgagtttgttcgccattgcattgccaagtctcaagaacgggtcgaaggtaaggtccaggtttctgtcctaaagggacaagtatatatcctcgggcgtgaatctcctctatcgttatacaacgaagaactagtctcaatgaatgtgcaaggcgattacgagcctactgacgctacgggttttattaatatcaactccctccggcttaaggaataccatcgccttcagtccaaagtcactgcgaaa

SEQ ID NO: 6906 - DNA, 1236 bp, Artificial Sequence
  Description of Artificial Sequence: Synthetic coding sequence
atgtcctctaagggttcggtcgtcctggcgtactccggcgggctggataccagctgcattctcgtctggcttaaggagcagggctacgatgttattgcctatctcgccaacatcggacagaaggaagatttcgaggaggcccgcaagaaggccctcaagctgggcgcgaagaaggtgttcatcgaagacgtgagtcgcgagttcgttgaagaatttatctggcccgccatccagtcgtccgccctctacgaggatcgttacttgctgggtactagcctggcgaggccatgcattgcccgcaagcaggtcgagatcgcccagcgtgagggtgctaagtacgtctcgcacggtgctaccggaaagggcaacgatcaggtgcgtttcgagctaagctgctattcgctggccccccagatcaaggttatcgcgccctggcgtatgcctgaattttacaaccgattcaagggccgcaacgatctgatggagtatgccaagcagcacggaatcccgatccccgtcacgcccaagaacccttggagtatggatgagaacttgatgcatatctcctacgaagccggtatccttgagaatcctaagaaccaggcacctccgggcctgtacaccaagacccaagaccccgctaaggcccctaataccccggatattctggagatcgagttcaaaaagggagtccctgtgaaggtaactaacgttaaggacggcaccacccaccagactagccttgagctgttcatgtacttaaacgaggtcgccggtaagcacggcgtcggccgcatcgatattgtagagaatcgctttatcggtatgaagtctcgtggaatttacgaaactcctgcgggcacaattttgtaccatgcccacctggatatcgaagccttcacgatggatcgcgaggtccgtaagattaagcaaggcctggggctaaagttcgcggaactggtgtacaccggtttctggcactctcccgaatgcgagttcgtccgacactgcatcgcgaagtcgcaggagcgtgtcgaggggaaggttcaggtcagtgtgctcaagggtcaggtgtacatcctgggccgtgagtcgcctctctccctctacaacgaggagttggtcagtatgaacgtccagggtgactacgagcccacggatgctaccggcttcatcaacatcaactccctgcgtcttaaggaataccaccgcttgcagagcaaggttacggcaaag

SEQ ID NO: 6907 - DNA, 1236 bp, Artificial Sequence
  Description of Artificial Sequence: Synthetic coding sequence
atgtcaagtaagggcagcgtggtgttggcgtacagcggtggtctggacacctcttgtatcctcgtctggctgaaggaacaggggtacgatgtcatcgcctacttggctaatatcgggcagaaggaagattttgaggaggctaggaagaaggctctgaaattgggagcaaagaaggtgttcatcgaagatgtgtccagagaatttgtggaagaattcatttggccggctatccagtcctcggctctgtacgaggaccgctacctgctggggacgtccctggccagaccgtgcatcgcccggaaacaggtggagattgctcaaagagagggcgccaaatacgtgtcgcatggagccaccggaaagggaaacgatcaagtgaggttcgaactcagctgctactcactggcgccgcagatcaaggtgatcgcgccatggcggatgcctgagttctataaccgcttcaaggggagaaacgacctgatggaatacgccaaacagcatggaatcccaattccggtgactccgaaaaatccctggtcgatggacgaaaacctcatgcacattagctacgaagccgggatcctcgagaaccccaagaaccaagcacccccaggattgtacaccaagacccaggaccctgccaaggcgccgaatacgccggacatcttggaaatcgaattcaagaagggagtgcctgtcaaggtcactaatgtgaaagatggaaccactcaccaaacgagcctggagctgttcatgtacctcaacgaggtcgccggtaaacacggagtggggcggattgatatcgtggaaaaccgcttcataggcatgaagagccggggcatctacgagacgccagccggaacgatcctctatcacgcccatctggatatcgaggcttttaccatggaccgggaggtccgcaagatcaagcagggactcggactcaagttcgccgagcttgtgtacaccggattttggcattcacctgagtgtgaattcgtgcgtcactgcatcgccaagtcgcaagagagagtcgagggcaaggtgcaggtgtccgtgctcaaaggacaagtgtacatccttggccgagagagcccgctttcactgtacaacgaggaactggtgtccatgaacgtgcagggggattacgaaccaacggacgccactggattcatcaacatcaactcattgcgcttgaaggagtaccacagactgcagtccaaggttacggcgaag

SEQ ID NO: 6908 - DNA, 1236 bp, Artificial Sequence
  Description of Artificial Sequence: Synthetic coding sequence
atgtcaagcaaagggagcgtggttctcgcctatagtggcgggttggacacatcatgcatactcgtctggcttaaggagcaaggctatgatgtgatcgcctatctggccaatattggccagaaggaggattttgaggaagctcgaaagaaggcactcaagctgggcgctaaaaaggtcttcatcgaagacgttagccgcgagttcgtggaagagtttatttggcctgccatacaatcctctgctctctatgaggataggtatttacttggtaccagccttgccagaccatgcattgctcggaagcaggtcgagatagctcaaagggagggggccaaatatgtgtcacatggagccaccggcaaaggcaatgaccaggtacgcttcgaactgtcatgttacagtctcgctcctcagataaaagtgatagctccatggcgcatgccagagttttataatcgatttaagggacgcaatgatcttatggaatacgccaaacaacatggtatccccatccccgtcacgcctaagaatccctggtctatggatgaaaacttgatgcacatatcttatgaggccggtatcctggaaaatcccaaaaatcaggctccacccgggctgtacacgaaaacccaggatcccgctaaggcccccaacactccagacatactcgaaatcgagttcaagaaaggcgtgcccgtcaaggtgactaacgttaaggacggtaccactcaccaaactagtctggaactattcatgtatctaaacgaagttgccgggaaacacggcgtgggacggatagatatagtggagaaccgatttataggaatgaaatcacgaggtatctacgagactcctgccggcaccatcctttaccatgctcaccttgacatcgaggctttcacaatggatcgagaagttcggaagatcaagcagggacttggcctgaaattcgcagaacttgtgtataccggattctggcacagcccagagtgcgaattcgtccggcactgcatcgccaaaagtcaggaacgcgtggagggcaaagtccaggtgagcgtcctcaaaggccaggtctatattctgggcagagagtcccctctgtctctttacaacgaggaattggtttctatgaacgtccagggagactatgagccaacagatgccaccggctttatcaacatcaattcacttcgattgaaggaataccaccggctgcagagcaaagtgaccgccaag

SEQ ID NO: 6909 - DNA, 1236 bp, Artificial Sequence
  Description of Artificial Sequence: Synthetic coding sequence
atgtcgtccaagggtagcgtggtccttgcatactcgggtgggctggatacttcgtgtattcttgtgtggctgaaggaacagggctatgatgtgatcgcatatcttgcgaatattggtcaaaaggaagatttcgaagaggctcgtaagaaggcccttaaactgggagctaaaaaggtgtttattgaggacgtgtcgagggagtttgtggaagaattcatttggccagccattcaatcgtcagcactgtacgaagatagatacctgctcggaacctcgctcgctcggccttgtatcgcgagaaagcaggttgaaatagcacaaagagagggagccaagtatgtctcacacggtgcaactggtaaagggaatgatcaagttcgtttcgaactttcgtgctactctcttgcaccacaaatcaaggtgattgcaccctggcgaatgcctgaattctacaaccggttcaagggtagaaatgatctcatggaatacgcaaagcaacacggtatacctatccccgtgacccctaagaacccatggtccatggacgagaaccttatgcatatttcgtacgaagctggtatcctcgagaacccaaagaatcaagcaccacctggactctacactaagacgcaggatcccgcaaaggcaccaaatacgccggatattctcgagattgaattcaagaagggcgttcccgtgaaagtgaccaacgtgaaggacggcaccactcatcagaccagtttggaactgttcatgtaccttaatgaagtggcaggaaagcacggcgtgggccggatcgacattgtcgaaaatcggtttattggcatgaagtctcgaggaatatacgaaactcctgcaggaaccattctctaccatgcacacctggatatcgaggcattcacgatggatcgggaggtgcgtaagattaaacaggggctgggcctcaaatttgcggaactggtctacaccggattctggcattcccctgagtgtgagttcgtccgccattgcatcgcaaagagccaggaacgggtggagggaaaagtgcaagtgtctgttctgaaaggtcaggtttacatcctcgggagggaaagcccactttccctgtacaacgaagaactggtttcaatgaacgtgcaaggggactacgaacccactgacgccactggcttcattaacattaactcgcttagacttaaggaataccatcgcctgcagtcaaaagtgaccgccaaa

SEQ ID NO: 6910 - DNA, 1236 bp, Artificial Sequence
  Description of Artificial Sequence: Synthetic coding sequence
atgtcaagcaagggctctgttgtgctggcatatagcgggggtctggacacaagttgcatcctagtctggctgaaggaacagggctacgacgtgatcgcgtatctggccaatatcggtcaaaaagaggacttcgaagaggcacggaagaaagcactgaaacttggagcgaagaaggttttcatcgaggatgtctctagggagtttgtcgaggagttcatctggcctgcaatccagagttccgcgctgtacgaagacaggtacctccttggaactagcctggcccgtccttgcatcgctcgaaagcaggtggaaatcgcgcagcgcgaaggcgcgaaatatgtttctcacggggctaccggtaaaggtaacgaccaagttcgtttcgagttatcctgttactcactggccccccagatcaaggtaattgctccatggagaatgccagaattttacaacagattcaaaggacggaacgaccttatggagtatgccaaacaacacggcattcctatcccagtgactccgaaaaacccttggtcgatggatgagaacctcatgcacatttcctatgaggccggcattcttgaaaacccaaagaatcaagccccgcccggtctctacactaagactcaggatccggccaaggcacctaacacccctgacattctggaaatcgaattcaagaaaggggtacccgtcaaggtgaccaatgtgaaggacggaaccacacaccagacatccttggagctctttatgtatctcaacgaagtggccggaaagcatggcgttgggaggatcgacatcgtggagaataggtttattgggatgaaaagccgggggatctatgaaaccccagccgggacaatcttatatcacgctcatctggacattgaagcgtttaccatggatagggaggttcgcaaaatcaagcaggggctgggcctcaagtttgcagaactggtatatactggattctggcactcgcctgagtgcgagttcgtacgccactgcatagcaaagagtcaagaacgggtcgagggcaaagttcaagtaagtgtcctcaaggggcaggtctacatcttggggagggagagccctctgtccctgtataacgaagaattggtgagcatgaatgtgcagggggactatgaaccaaccgacgccaccggctttatcaacattaactccttgagacttaaagaataccacagacttcaatccaaggtgaccgccaag

SEQ ID NO: 6911 - DNA, 1236 bp, Artificial Sequence
  Description of Artificial Sequence: Synthetic coding sequence
atgtcatctaagggaagcgttgtgttggcttacagcgggggccttgacactagctgcatcctggtgtggttaaaagagcaggggtacgacgtaattgcataccttgctaacatcgggcagaaggaagattttgaagaagcaagaaaaaaggccctcaagctgggggccaaaaaggtgttcattgaggatgtttcccgcgagttcgttgaggaattcatttggcctgcaattcagagttctgcactatatgaagatcggtacctgctggggacttccctagcgcgcccgtgcatcgcacgcaagcaggtggagattgctcagagggaaggcgcaaagtacgtgtctcatggtgctactgggaaaggcaacgatcaagtgagattcgaactgtcctgttacagtctcgctccccaaattaaagtcattgcaccctggcggatgcctgagttctacaaccgatttaaagggagaaatgacttgatggagtacgccaagcagcacggtatccctatcccggtaactcccaaaaatccttggtcaatggacgagaacttgatgcatatctcctatgaggccggtatcctggagaaccctaagaatcaggcaccaccaggcctgtacacaaagactcaggatcctgcaaaggcgccaaatactcctgatattctggagatagaattcaaaaagggggtgcctgtgaaggtgacaaacgtgaaagatgggactacccaccagacctcactggaactcttcatgtatctgaacgaggtcgcaggaaaacacggcgtgggacgcatcgacattgtagagaatcgcttcattgggatgaaaagcaggggtatttatgaaacccccgcaggcaccatcctgtatcacgcacacctcgacatcgaagccttcaccatggacagggaagtccgaaaaataaagcagggactgggattaaaatttgcggagctggtttataccgggttctggcacagcccagagtgtgaatttgtcaggcactgtatagctaaatctcaggagcgggtcgaagggaaagttcaggtgtccgtgctaaaaggacaggtgtatatcctggggcgggaaagcccactgagcctatataatgaggagttggtatcgatgaatgtgcagggcgattacgaaccaaccgatgccacaggatttatcaatattaatagtctccgacttaaagagtaccatagattgcagtctaaggtcaccgccaaa

SEQ ID NO: 6912 - DNA, 1236 bp, Artificial Sequence
  Description of Artificial Sequence: Synthetic coding sequence
atgagctctaagggaagcgtggtcctcgcctatagcggcggactggacaccagctgtatattggtttggctcaaggagcagggctacgacgtgattgcctacttagccaacataggccagaaagaagacttcgaagaggcacgtaaaaaggctctaaaactaggggctaagaaggtcttcatcgaggacgtgtctcgagaatttgtggaggaattcatttggcctgctatacagtctagcgccctgtatgaggacaggtacctgctcggcacttcactggctaggccttgtatagcaagaaagcaagttgagattgctcagcgcgagggcgccaagtatgtctcccacggcgctaccggaaaaggaaatgaccaggtccggttcgagttgtcttgctattcactggcccctcagatcaaggttatcgctccctggaggatgcctgagttctacaaccgcttcaagggccgtaacgatctgatggaatatgctaagcagcacggcattcctattccagtgactccaaagaacccatggtccatggacgaaaacctgatgcatattagttatgaagctgggatcctggaaaatcccaaaaaccaagccccacctgggctttacactaagacacaagatcccgccaaggctcctaatacaccagacatactggagattgagtttaaaaagggggtgcccgttaaggttaccaacgtcaaagacgggactacacaccagacttccttagaactgtttatgtacctgaacgaagtcgccggcaagcacggcgtagggaggatagatatcgtggaaaatcgattcattggcatgaaatcccgggggatatatgaaacccccgccggaacaatcttgtatcacgcccatctggatatagaggcctttacaatggatcgggaggtccggaaaattaagcagggtttgggtctaaagttcgctgaactggtgtatactggattctggcacagccctgagtgcgaatttgtgaggcactgcatagccaagagccaagagcgagttgaagggaaggtacaagtgagcgtgctgaaaggtcaggtgtacatactcggcagggaaagccctctgagcctttacaatgaggaactggtttcaatgaatgtccaaggggactacgaacccacagatgcaaccggctttatcaacattaattccctgcggctcaaagaatatcaccggctgcagagcaaagtgacagcaaaa

SEQ ID NO: 6913 - DNA, 1236 bp, Artificial Sequence
  Description of Artificial Sequence: Synthetic coding sequence
atgagcagcaagggtagcgtcgtgttggcctactcaggcggacttgacacttcgtgcatcctggtgtggctcaaagagcaaggatacgacgtcatcgcctaccttgccaacatcggccagaaggaggacttcgaggaagcccgcaagaaggcccttaagctgggagccaagaaggtgttcatcgaggacgtgtcacgcgaattcgtcgaggaattcatctggccagcgattcaatcaagcgccctctacgaagatcgctacctgctcgggacctctctggcgcggccgtgcattgctagaaagcaagtcgaaatcgcacagcgcgaaggcgcgaagtacgtctcccatggggcgaccggaaagggaaacgatcaggtcaggtttgaactttcgtgctactcgctggctccgcagatcaaggtcatcgcgccgtggaggatgcctgagttctacaaccggttcaaaggacgcaatgacctcatggaatacgccaagcagcacggtatcccgattccagtcactccgaagaacccgtggagcatggatgaaaatctgatgcacatttcgtacgaagccggtatcctcgaaaacccaaagaaccaagccccaccgggcctgtacaccaagacccaggaccctgcaaaagcgcctaataccccggacatcctggagatcgagttcaagaagggtgtgcctgtgaaagtcacgaacgtcaaggacggcactacccatcagacctcgctggagcttttcatgtacctgaacgaagtggcagggaagcacggagtggggagaatcgacattgtggagaatcgcttcatcggaatgaagtcccgcggcatttatgaaactccggctggtacgatcctgtaccacgcgcacttggacatcgaggccttcaccatggacagagaggtgcggaagattaagcaaggcctgggtcttaagtttgctgagctggtgtacacgggcttttggcattcgcctgagtgcgaatttgtcaggcattgcattgcaaagtctcaagaaagagtcgagggaaaggtgcaagtgtccgtgctgaagggacaagtgtacatcctgggtagggaaagccccctgagcttgtacaacgaggagctggtgtcgatgaatgtgcagggagattacgagccgaccgatgcgactggatttatcaatatcaattcgctccggctgaaagaataccacagactgcaaagcaaggtcaccgccaag

SEQ ID NO: 6914 - DNA, 1236 bp, Artificial Sequence
  Description of Artificial Sequence: Synthetic coding sequence
atgtcctcaaaaggatcagtggtccttgcgtactctggtggacttgacacgagttgcatcctcgtctggcttaaagagcaaggatatgatgtcatcgcttatttagccaacatcggtcaaaaagaagactttgaagaggcccgcaaaaaagcgttaaaattaggcgcgaaaaaagtgtttatcgaagacgtgagccgtgaatttgtagaagaattcatttggccggctattcagtcttcagccttgtacgaggataggtacctgttaggaacgtcactagcaagaccgtgcattgcaagaaagcaggtggagatcgcccagcgggaaggcgcaaagtacgtcagccacggcgctacgggaaaaggcaatgatcaggtgcgctttgagttgtcctgctattcactggctcctcagattaaagttatcgcaccgtggagaatgccggaattttataatcgtttcaaaggtcgcaacgatttaatggaatatgctaaacaacatggaattcctattccggtcaccccaaagaatccgtggtccatggatgaaaatcttatgcatatttcatatgaagcgggaatacttgagaacccaaagaatcaggccccgcctggcctttacacaaaaacacaggacccggcgaaagcacccaacactccagatatattagagatcgaattcaaaaaaggtgtccctgtaaaagtaacgaatgttaaggatggaacaacacatcaaacttcattagaattatttatgtatttgaatgaagtcgcgggaaaacatggcgtgggaagaattgatatcgtagaaaatcgctttataggaatgaaatctcgggggatttatgaaaccccagctggaaccatcttataccatgcacatctcgatattgaagcttttacaatggatcgcgaagtacgtaagattaaacaaggattgggtttaaaatttgctgaactcgtttatacgggtttttggcattcacccgaatgtgagtttgttcgtcattgtattgcaaaatctcaagaacgagttgaagggaaagtccaggtttcagtccttaaaggacaggtttacattttgggacgtgaatcaccactgtcgctctataatgaagaattggtttcaatgaatgttcagggcgattatgaacccacggatgctacgggattcattaacatcaactctctccgtttaaaagaatatcacaggctccaatccaaagtcactgccaaa

SEQ ID NO: 6915 - DNA, 1236 bp, Artificial Sequence
  Description of Artificial Sequence: Synthetic coding sequence
atgtcctctaaagggtcagtagttttagcctactcaggaggcttggatacctcctgtattctcgtgtggcttaaggagcaaggctatgatgtcatagcctatcttgctaatatcggacaaaaggaagatttcgaagaagcccgtaagaaagcactgaaattgggggctaaaaaagtattcattgaggatgtgtcacgcgaatttgtggaagaattcatctggcctgccattcagagttccgcattgtacgaagaccgatatctgttgggaacatcgctggctcgtccatgtattgctcgaaaacaagtggaaatcgcacagcgagagggagctaagtacgtttcacatggagctacgggaaagggaaatgatcaggtaagatttgagttgtcttgttattcattagcgcctcaaattaaagtgattgcaccatggagaatgccagaattttataatcgattcaaaggacgaaatgacttgatggagtatgcgaaacaacatggaattcccattccagttaccccaaaaaatccatggtccatggacgaaaatctcatgcatatatcatacgaagcaggaattctcgagaatccaaagaatcaagccccgccaggtctctatactaaaacccaggatccagctaaagctccgaacacccctgacatattggaaattgaatttaaaaagggagtaccagttaaggttacaaatgttaaggacggaactacacatcaaacgtccttggaactttttatgtatttaaacgaagttgcaggaaaacatggagttggccggatcgatatcgttgaaaaccgttttattggtatgaagtctcgtggaatctatgaaaccccggcaggtactatcctgtaccacgctcatcttgacattgaagcgtttactatggatcgagaggttagaaaaatcaaacagggactcgggctcaagttcgcagaattggtgtatacgggtttttggcacagtcctgaatgtgagtttgtccgacactgcattgcaaaatctcaagagcgcgttgaaggaaaagtccaagtgtcagtgttgaagggccaagtttatatattgggacgcgagtcgccactatcattgtacaatgaagagttagtttccatgaacgtccaaggagattacgagccaacagacgcaacaggatttataaatattaattctctacgactcaaggaatatcatcgcctccaatcaaaggtcactgctaaa

SEQ ID NO: 6916 - DNA, 1236 bp, Artificial Sequence
  Description of Artificial Sequence: Synthetic coding sequence
atgtcatcgaaaggctccgtggtcctcgcatacagcggtggtctggataccagctgtattctcgtgtggctcaaagagcaaggatacgacgtgatagcttacctggcaaacataggtcagaaggaagattttgaggaggcgcgaaagaaagccctgaagttgggtgcaaagaaggtgtttattgaggacgtgtcccgtgagttcgttgaggagttcatctggcctgcaatacaatcctcagcactttacgaagatcggtacctcctcgggacttcgcttgccagaccgtgtatcgcacgaaaacaggtcgaaatcgcacagagagaaggagcaaagtacgttagccacggggcaaccggaaagggaaacgatcaggtgcgatttgaactttcgtgttactcccttgctccacagattaaagtcatcgcaccttggcggatgcctgaattctacaacagattcaagggccgtaacgatctgatggaatacgcaaagcagcacgggattccaattcccgtgactccgaagaatccctggtcgatggatgagaacctgatgcatatttcgtacgaggctggaatccttgaaaatcccaagaatcaagcacctcccgggctgtataccaaaactcaagaccctgccaaggcgcctaacacccccgatattcttgagattgaattcaagaagggcgtgcccgtgaaggtgaccaacgtgaaggatggaaccacccatcagacgtctctggaacttttcatgtacctgaatgaggtggcaggtaaacatggtgtgggaaggattgatatcgtggagaacaggtttatcggtatgaaatcgaggggtatctacgagactcctgcagggaccatcctttaccacgcacatttggatatcgaggctttcactatggatcgggaagtgagaaagatcaaacaaggacttggactgaagttcgccgagctggtctacactggtttctggcactcacccgagtgtgagtttgtcagacactgtattgccaagagccaagaacgtgtggagggaaaggtgcaagtgtccgtgttgaaagggcaggtctacattctcggacgcgaatcacctctgtcgctgtacaacgaagagctggtcagcatgaacgtgcagggagactacgaacctaccgatgctactgggtttatcaacattaactccctccgcttgaaggaatatcatcgacttcaaagcaaggtgactgcgaag

SEQ ID NO: 6917 - DNA, 1236 bp, Artificial Sequence
  Description of Artificial Sequence: Synthetic coding sequence
atgtcctccaaaggcagcgtggtgctggcatacagcggaggactggacacttcgtgtatcctggtctggcttaaggaacaaggttacgacgtgatcgcctacctggctaacatcggccagaaggaagatttcgaggaagcgcggaagaaagcactgaagctgggtgccaagaaggtgttcatcgaggatgtctcacgggagtttgtggaggagttcatctggcccgccattcagtcgagcgctctgtacgaagataggtaccttctgggaaccagtctcgcgaggccttgcatcgcgagaaagcaagtggagatcgcccagcgcgaaggggccaagtacgtctcccacggagctactggcaaggggaatgaccaggtgcgcttcgagctgagctgctacagcctggccccgcagatcaaggtgattgccccatggcgcatgccggagttttacaatcggttcaagggacgcaacgaccttatggagtacgcgaagcagcacggaatcccgatcccggtgactcctaaaaacccgtggtccatggatgagaatctgatgcatatctcctacgaggccgggatcctcgaaaaccccaaaaaccaagcacccccgggactctacactaaaacccaggacccagctaaggccccgaacactccggatatccttgaaatcgaattcaaaaagggggttccggtgaaggtgactaacgtgaaggacggaaccacccatcagacctccctggaattgtttatgtacctgaacgaagtcgctggaaaacacggagtcggacggatcgacattgtagagaacagattcatcgggatgaagtcgaggggaatctacgaaaccccagcaggtactattctgtaccatgcccaccttgatatcgaagcattcaccatggatcgggaagtgaggaagatcaaacaaggactgggcctcaagttcgccgagttggtgtatactggcttctggcactccccagaatgcgaattcgtgagacactgcatcgccaagtcgcaggagagggtggagggaaaagtgcaggtgtccgtgcttaagggccaggtgtacattctggggcgggagtcgcccctcagcctgtataacgaggaactggtttcgatgaacgtgcagggagattacgaaccaaccgacgcgactggcttcattaacatcaatagcctgcgccttaaggagtatcataggctccaaagcaaggtcacggccaaa

SEQ ID NO: 6918 - DNA, 1236 bp, Artificial Sequence
  Description of Artificial Sequence: Synthetic coding sequence
atgtcttctaaaggatcagtggtgctcgcctattccgggggcctggacacatcctgtatactggtgtggctgaaagagcaggggtacgatgtgatcgcttacctggctaatattggtcaaaaggaagactttgaagaggctcgcaaaaaggctttaaaactgggcgcaaaaaaggttttcatcgaggacgtctcacgggaatttgtggaggagttcatctggcctgccatccagagctccgcattgtacgaggaccggtacctgctgggcacgagccttgcccggccctgcattgcccgcaaacaagtggagattgcccagcgagaaggcgccaagtatgtgagtcacggtgctaccggaaaaggcaatgaccaagtgaggttcgagctgtcatgttactctctcgctcctcagattaaagtgattgctccctggcggatgcccgagttctataatcgatttaaagggaggaatgatttgatggagtatgccaagcagcacggcatacccatcccagtgaccccgaagaatccttggtcaatggatgagaacctgatgcacatttcttacgaagccggcattctggagaatcccaagaaccaagcacccccgggcctttatactaagacccaggaccctgccaaggctcccaacaccccagacatattggagatcgaatttaaaaaaggcgtgcccgtgaaagtgaccaacgtgaaagacggcactactcaccaaaccagtctggaattgttcatgtacctcaacgaagtggccgggaagcacggcgttggtaggatagatatagtggagaacaggttcatcggtatgaagagtcggggaatttacgagaccccagccggaactatactttaccacgctcatcttgacatagaggcctttactatggacagggaggtccgaaaaataaagcaagggttgggattaaagttcgccgagctggtgtacaccgggttctggcactcaccagagtgcgagttcgtacgtcattgcatcgccaagtctcaagagagagtggaagggaaagttcaggtcagtgttctgaaagggcaggtgtacatcttgggcagagaaagcccactcagcctctacaatgaggaattggtatctatgaatgtgcagggcgactacgaacccactgacgctacagggttcataaatattaacagtcttaggctcaaggaatatcataggctgcaaagtaaggtgaccgctaaa

SEQ ID NO: 6919 - DNA, 1236 bp, Artificial Sequence
  Description of Artificial Sequence: Synthetic coding sequence
atgtctagtaagggatctgtcgttttggcttatagtggaggtctggatacctcatgcatcctggtctggctcaaagaacagggatacgatgtgatcgcatacctggccaacatcggccaaaaggaagattttgaagaggccaggaagaaggcgctgaagttgggagcaaagaaggtattcatcgaggatgtgtcaagagagttcgtagaggaatttatctggccggctattcagagctccgctctctacgaagacagatacctgctcggaaccagcctcgcaaggccatgcatcgctcgcaaacaggttgagattgcccagcgcgagggtgctaaatacgtgagccacggcgccactggcaaaggtaacgaccaggtcaggtttgaattgtcatgctacagcctggctccccaaattaaagttatcgcgccgtggaggatgcctgaattctacaacaggttcaagggcaggaatgacttgatggaatacgccaaacaacatggaatcccaattccagtaacacccaaaaacccatggtcaatggacgagaacctcatgcacatatcctacgaggcaggtatccttgagaaccctaagaaccaggccccacccggcctgtacaccaaaactcaggatcctgctaaggcccccaacactccggacatcctcgagatagaattcaagaagggagtgccggtgaaggtgaccaacgtgaaggatggcaccacacaccagacttccttggagctgttcatgtatctcaacgaggtcgcaggtaagcacggtgtcggacgcatcgacatagtggagaacaggttcataggcatgaagagtagaggtatctacgaaactcctgccggaacaattctttaccatgcccaccttgatatcgaggccttcactatggatagggaagtaaggaagatcaaacagggtctgggcctgaagtttgccgagctcgtctacaccggcttttggcattctcctgaatgcgaattcgttcgccactgcatagccaagagtcaggaaagagtagagggaaaggtgcaagtgtccgtgctgaagggccaagtgtatatcctgggcagggagagcccactgagcctgtacaacgaagagctggtgtcaatgaacgtacagggtgattacgaaccgacagatgccacgggattcatcaacataaatagcctgcgcttgaaggaatatcacagactccagtcaaaggtgaccgctaag

SEQ ID NO: 6920 - DNA, 1236 bp, Artificial Sequence
  Description of Artificial Sequence: Synthetic coding sequence
atgtccagtaaaggaagtgttgtgttagcgtactcaggggggttggatacatcttgcatattagtttggctaaaggaacagggatatgatgtcatagcctacttggcaaacatagggcagaaagaagatttcgaagaagctcgaaaaaaggccctcaaactaggggccaaaaaagtttttattgaagatgtttcccgcgaatttgtagaagaattcatatggcccgccatccagagttcggctctctacgaagatcggtatctgctgggaacttctttagcccgcccatgtatcgcccggaagcaggtggagatcgcacagagagagggggccaaatatgtgtctcatggggctacaggaaaagggaatgaccaggtccggtttgaactttcctgttattctctcgctcctcaaatcaaggtgattgcaccatggagaatgcctgagttctacaaccggtttaaaggaaggaatgacctcatggaatacgctaaacagcatgggatacccattcccgtcactcccaagaatccatggtcgatggatgaaaatctcatgcacatatcttatgaagccgggatactagaaaatcccaaaaaccaggctcctcctggactttacactaaaactcaggatcccgccaaagcacccaatacacctgatattcttgaaattgaattcaaaaaaggagtacctgtaaaagtgacaaatgtgaaagatggaactacacatcagacttcattagaactgtttatgtaccttaatgaagttgcgggaaaacacggagtggggaggatcgatatagtagaaaaccggtttattggaatgaaatctagggggatctatgaaacacctgctgggactatcctgtatcacgcacacttggacattgaagcctttactatggatcgagaggtgcggaaaatcaaacaggggctggggctgaagttcgccgagctggtatatactggattctggcattcacccgagtgtgagttcgtcagacactgtatagccaaatcccaggaacgcgttgaaggaaaagtccaggtgagtgtcctcaaagggcaagtgtatattttagggagagaatcccccctatcactgtacaatgaggaactagtgtctatgaatgttcagggagattatgaacctactgatgctactggattcataaacattaactctctaaggctcaaagaataccataggttacagagtaaggtcactgccaag

SEQ ID NO: 6921 - DNA, 1236 bp, Artificial Sequence
  Description of Artificial Sequence: Synthetic coding sequence
atgagttccaaggggtctgtggtgctggcctactctgggggcttggatacaagctgcatcctggtttggctcaaggagcaaggctacgatgttatagcgtatctcgcaaacatcggtcagaaggaagatttcgaggaggctagaaaaaaagcgctgaaactgggcgctaaaaaagtgtttatcgaggatgtcagtcgagagttcgtagaagaattcatctggccagctatccagagcagcgcgctctacgaggatcgatatctgttgggtacttccttggcccgcccctgcatcgctagaaaacaggtggaaatagcacagagggagggagcaaagtacgtgtcccacggagccacaggaaagggcaacgaccaggtgcggtttgaactttcttgctactccttggcgccccagattaaggtcatcgcgccttggagaatgcctgagttctacaaccgattcaagggaagaaatgatcttatggagtacgcgaagcagcacgggatcccaattccagtaacccccaagaacccatggtcaatggacgagaaccttatgcacatctcatacgaagccggcatactggagaatcccaagaatcaggcgccacctggtctgtatacgaaaacccaggatccggctaaggctcctaatacccccgacatcttggaaattgagttcaaaaagggagtacccgtgaaagtgacgaatgttaaagatggaaccactcaccaaacttcactggagctgttcatgtacctcaacgaggtggctgggaaacatggggtgggaaggattgacatagtcgaaaaccgcttcatcggaatgaagagccgcgggatttatgagaccccggctggcaccatcctgtaccatgcacacctcgatattgaagcttttactatggacagggaggtcagaaaaatcaaacagggactcgggttgaagtttgccgaactcgtgtatacaggtttttggcacagccccgaatgcgagttcgtgaggcactgcatcgcgaagtctcaggagcgcgtcgaggggaaggtccaagtgtccgttttgaaggggcaggtttacatactggggcgcgagtcccccctctcactgtacaacgaagagctcgtctctatgaatgtgcagggcgactacgagcctacagacgccacaggcttcatcaatatcaactctctccgcctgaaagaatatcatcggctgcagagcaaggtgactgccaaa

SEQ ID NO: 6922 - DNA, 1236 bp, Artificial Sequence
  Description of Artificial Sequence: Synthetic coding sequence
atgtcgtccaagggctcagtcgtcctcgcttatagcggcggcctagacacaagttgcattcttgtttggctgaaggaacaggggtacgacgtcatcgcataccttgccaacatcggacagaaggaggacttcgaggaggcacggaagaaagccttaaaactcggcgcaaaaaaggtctttatcgaggacgtgagtagggaattcgtcgaggaatttatctggcctgccatccagagctccgcactatacgaggacagatatctgcttggaacttctttggctagaccctgtattgccagaaaacaagtggaaattgctcaacgggaaggtgcaaaatacgtctcccatggcgcgaccgggaaaggcaatgaccaggtgaggttcgaactgtcgtgctactctctggcaccccagataaaggtgatcgcaccctggcgaatgcccgagttttataaccgttttaagggccgtaatgacctcatggagtacgccaagcagcatggtatacccattccagtgacccccaaaaacccctggtcaatggatgaaaaccttatgcacattagctatgaagcagggatcctggagaacccgaagaaccaggcccctcctggcctgtacaccaaaacccaggatccagctaaggcacctaatactccagatatcctcgagattgagttcaagaagggggttccggtgaaggttactaatgtgaaagacggtaccacacaccagacttccttggagcttttcatgtacttgaatgaggtggccgggaaacacggtgtgggacgcatcgatattgtggagaacagatttataggtatgaagtctcgcggcatctacgagactcctgctggcactattctgtatcacgcacacttagatattgaggcttttacaatggacagggaggtgagaaaaataaagcaggggctggggctcaagttcgccgagctggtttatacgggattctggcacagtccagagtgtgaatttgtgcgccattgtatcgccaagagtcaagagcgtgttgagggtaaggtgcaggtctccgtgctgaaggggcaggtttatatccttggaagagagagtcccctttccttgtataacgaagagctggtctccatgaatgtgcagggggattacgagccaacagatgcaactggctttatcaatattaactcattacgactgaaagagtaccatcggctgcaatccaaagtcacggccaaa

SEQ ID NO: 6923 - DNA, 1236 bp, Artificial Sequence
  Description of Artificial Sequence: Synthetic coding sequence
atgtcaagcaagggttcggtggtgcttgcatattccggaggacttgatactagctgtattctcgtgtggctgaaggaacaagggtacgacgtcatagcatacctcgccaatattggtcagaaggaagattttgaagaagccaggaagaaggcactcaaacttggagcaaaaaaggtgtttatcgaagatgtgtcccgcgaatttgtcgaggagttcatctggccggcgattcaatcgtctgcactgtacgaagatcgatacttgctcggtacttccctggctcgcccctgtattgccagaaagcaagtggaaattgctcaaagagaaggagcaaagtacgtgagccacggggcaacggggaagggtaatgatcaggtccggtttgagcttagctgctattcactggcccctcagattaaggtgattgcaccctggcgtatgcctgagttttacaatcgattcaagggcaggaatgacttgatggaatacgcaaaacagcatggcatcccgattccggtgactcccaagaacccttggtcgatggatgaaaatctgatgcacatttcatacgaagcaggtattcttgagaaccctaagaaccaagcaccacctgggctctacactaagactcaagatccagcaaaggcacccaatacccccgatattctggagatcgaattcaaaaaaggcgtccctgttaaggtgactaacgtgaaagacggaaccacccaccagacctcgctggaacttttcatgtacctgaacgaggtggcaggaaagcatggagtgggacggatcgacattgtggaaaacaggttcatcggtatgaagagccgagggatttacgagactccagcaggcactatcctgtaccacgcacacctggatattgaggcatttactatggatcgcgaagtcaggaagattaaacaagggctgggactgaaattcgcggaactcgtctataccggattctggcattcaccagaatgtgagtttgtgagacattgtattgctaagtcgcaggaaagagtggaaggaaaggtgcaagtgtcggtgcttaagggacaagtgtacattcttggacgggagtccccactttcactgtataacgaggaactggtgagcatgaacgttcagggagactacgagcctaccgacgctactggattcataaacattaacagcctcaggctgaaagagtaccataggctgcaatcgaaggtgaccgccaag

SEQ ID NO: 6924 - DNA, 1236 bp, Artificial Sequence
  Description of Artificial Sequence: Synthetic coding sequence
atgtcgtccaagggaagcgtggtgcttgcatactcaggtggcctggacacttcttgtattctggtgtggttgaaagaacaaggctacgacgtgatcgcttacctcgcgaacattggtcagaaggaggacttcgaagaggccaggaagaaggcactgaagttgggggcaaagaaagtgttcatcgaggatgtctcccgggagttcgtggaggaattcatttggcctgccattcagagctccgccctgtatgaggatcgctacctgctgggcacttcgcttgcgcggccgtgcatcgcccgcaagcaggtcgaaattgcacaaagggaaggagcaaaatacgtctcacatggagccactggaaaaggaaatgatcaggtccggttcgagctgtcatgttacagcctggcgccacagatcaaggtgatcgccccgtggcgaatgccggagttctacaatagatttaagggacggaacgacctcatggaatacgccaagcaacacggaatcccgatcccggtgaccccgaaaaacccgtggtctatggacgaaaatctcatgcatatcagttacgaagccgggatcctggaaaatcccaagaatcaagcacctccgggactgtatactaagacccaggatccggcgaaggcgccaaacaccccggacatcctggaaattgaattcaaaaagggtgttccggtgaaggtgactaacgttaaggacggaactactcaccagacctccctcgagctgttcatgtacttgaacgaagtcgccggaaagcatggagtgggacggatcgacatcgtcgagaaccggttcatcggtatgaagagcaggggcatttacgagactccggcgggtaccatcctgtaccatgcacacctggatatcgaagcctttaccatggaccgcgaagtgcggaagatcaagcaggggctgggcctcaagttcgcagagctggtctacactggcttttggcacagccccgagtgcgaatttgtccgtcactgcattgctaaatctcaggaacgggtggagggtaaggtccaagtctcggtcctgaaagggcaggtgtacatcctgggtcgggaatcaccactctccctgtacaacgaagagctggtgagcatgaacgttcaaggagattacgagccaactgacgccactggattcatcaacataaactccctgcggttgaaggaataccaccgactccagtcgaaagtgaccgccaaa

SEQ ID NO: 6925 - DNA, 1236 bp, Artificial Sequence
  Description of Artificial Sequence: Synthetic coding sequence
atgtcgtccaaggggagcgtggtgttggcctactcaggtggtcttgatacctcgtgcattcttgtctggctgaaggaacagggatacgatgtgattgcatacctggcaaacataggtcagaaggaagattttgaagaagcacgcaaaaaagcactcaagctcggagcaaaaaaggtgtttatagaagatgtgtcgcgggaatttgttgaagagtttatctggccagcaatccaatcatcagccctttatgaggaccggtatctgcttggaacttcgcttgcgaggccttgcatcgctcggaaacaggtcgaaattgcccaaagagaaggtgctaagtacgtgagccacggagccaccggaaagggcaacgatcaagtccgatttgagctttcgtgttacagcctggcaccgcagataaaagtgattgccccttggcgaatgcctgagttttacaacagattcaaaggacggaatgatctcatggagtacgcaaagcaacatggaattcccattccagtgacccctaagaatccctggtcaatggatgagaacctgatgcatatatcatacgaagctgggattttggaaaatcctaagaatcaggcgccaccgggactgtacactaagactcaggatccagcaaaggcaccgaatacccccgatattcttgaaattgagtttaagaagggcgtcccagtgaaggtcactaacgtcaaggatggcactacccatcaaacctcccttgagctgttcatgtaccttaacgaggtggcagggaagcatggtgtgggtcgtatcgacatcgtggagaaccggttcatcggaatgaagtcgagaggcatctacgaaacccccgctggaaccattctgtaccacgcccacctggacatcgaagcatttaccatggaccgggaagttcggaagataaaacaaggcctgggacttaagtttgccgaactggtgtacactggattttggcactcgcctgaatgtgaattcgtgcgccattgtattgccaaatcgcaggaaagggtggagggaaaggtgcaggttagcgtgcttaagggccaagtgtacattcttggacgtgaatccccgttgagcctctacaatgaagaactcgtgagcatgaatgttcaaggagactacgagcccacggatgcaactgggttcataaacattaactcgctgcggctgaaggagtatcaccgcctgcagagcaaagtcaccgccaag

SEQ ID NO: 6926 - DNA, 1236 bp, Artificial Sequence
  Description of Artificial Sequence: Synthetic coding sequence
atgagcagcaagggctcagtggtgctcgcgtacagcggcggactcgacactagctgtattctggtctggcttaaggaacagggctacgacgtgatcgcatatttagccaatattggccagaaggaagacttcgaggaagcacgcaagaaggcactgaaactgggagccaaaaaggtcttcatcgaagatgtttcccgtgagtttgttgaagaatttatctggccagcaattcagtcttccgctctctatgaggaccgctatctcctgggaaccagcctcgccaggccctgcattgctagaaagcaagttgaaattgcccaaagggagggcgctaagtacgtctctcacggagccactgggaaggggaacgaccaggtccgattcgaactatcgtgttacagcttggccccacagatcaaagtgattgctccatggagaatgcctgagttctacaacagatttaagggccgtaacgatctgatggaatacgcaaagcagcatggcatccctatccccgtgacccccaagaacccatggtccatggacgaaaacttgatgcacatcagttatgaggcaggcatcctagagaacccaaaaaaccaggcacccccgggcctatacaccaagacccaggatccggccaaagcccccaatacccccgacattttggagatcgagttcaagaagggcgtgcctgttaaggttacgaatgtgaaggatggcacgacacaccaaacttcacttgagttgttcatgtacttgaatgaggtggccggcaaacacggggttggtcggattgatatcgtcgagaaccgtttcattggaatgaagtcccggggcatatatgaaactcctgcagggaccatactttaccacgcacacctcgacattgaggctttcaccatggacagagaagtgagaaaaattaaacagggactgggcctaaaattcgctgagctcgtgtatacagggttttggcattcccccgagtgtgagtttgtgcggcactgcattgctaagtcccaggagagggtggaaggaaaggtgcaggtctctgtactgaagggccaggtctatatcttggggcgagagtctcccctgtccctgtataatgaagaacttgttagcatgaacgtccagggcgactacgaaccgactgacgccacaggctttatcaacattaattccttgcgcctgaaagaataccatagattgcagtccaaggttacggctaag

SEQ ID NO: 6927 - DNA, 1236 bp, Artificial Sequence
  Description of Artificial Sequence: Synthetic coding sequence
atgagctctaaagggtcagttgtattagcatattccggcggactagatacatcttgcattctggtttggctgaaggagcagggctatgacgttatcgcttatctagcaaacattggccagaaggaggatttcgaagaagctaggaaaaaggcactaaagttgggtgcaaaaaaagtatttatcgaggatgtatctcgggaattcgtggaggaatttatctggcccgcaatacagagtagtgctctgtacgaggataggtacctgttggggacttcgctcgccaggccctgcattgcacgcaaacaagtcgaaatcgcccagagggaaggagcaaaatatgtgtcgcacggcgctaccggcaagggcaacgaccaagttcggtttgaactctcttgctattctcttgccccccagattaaagtgatcgcaccttggcgaatgcccgagttctataatcggttcaagggtaggaacgatcttatggagtacgccaaacaacatgggatcccgattcccgtcacccccaagaatccatggagcatggacgagaaccttatgcatattagttatgaagctggtatcttggagaaccctaaaaatcaagcccccccaggactttacacaaagacccaggatcccgcaaaggcacctaatacacctgatatcttggaaatagagttcaagaagggagtgcctgtgaaagttaccaacgtgaaggacgggaccacacatcagacatcccttgaactgtttatgtatttgaacgaggtcgcaggcaagcatggagtgggtcgcattgatatcgtggaaaatcggtttatcggaatgaagtctcgcggaatctatgagacacccgcaggtactattctctaccacgcgcatctcgacattgaggcttttactatggaccgggaagttcgcaaaataaagcaaggactaggcctaaagtttgcggagcttgtctataccggattctggcattctcccgaatgcgagttcgtgagacattgcatcgccaagagtcaggagcgcgtcgagggcaaggtgcaggtaagtgtgcttaaaggccaggtctacatcttgggcagagaaagtcctctgagtctgtataatgaagagttggtttccatgaatgtgcagggtgactacgaacctaccgatgctactggattcatcaatatcaattccctgagattaaaggagtaccaccgactccagtccaaagtgacagccaag

SEQ ID NO: 6928 - DNA, 1236 bp, Artificial Sequence
  Description of Artificial Sequence: Synthetic coding sequence
atgtcctcgaagggatcggttgtgctcgcatattctggggggctggacacctcatgcatactcgtatggcttaaggagcagggctacgatgtcattgcatatttagctaatatcggtcagaaagaggacttcgaggaggccaggaaaaaggccctgaagctgggggcaaagaaagtattcatcgaggacgtgagtagggagtttgtggaggaatttatatggcctgcaattcaatctagcgctctttatgaggatcggtacctgctgggcaccagcctggcacgcccttgcattgctcgcaagcaggtggagatcgcccaacgggagggggcaaagtacgtcagtcacggcgcaactggcaaaggcaacgatcaggtccggtttgaactctcctgttatagccttgccccccaaattaaagttatcgcaccatggcgcatgccagaattttacaaccggttcaagggaagaaacgacctgatggaatatgccaagcagcacggaataccaatccccgtgacacctaaaaatccatggagtatggacgaaaacctgatgcacatttcctacgaggctggtattctcgagaatccaaaaaaccaggctccccccgggctgtacaccaagactcaggacccggctaaggcaccgaacactcccgatatcctcgagatagaatttaaaaaaggggtacccgtgaaggtcaccaacgttaaggatggaacaacccatcagacctcattggagcttttcatgtacctgaatgaggtggctggaaaacacggtgtagggagaattgatattgttgagaataggttcatcggcatgaaaagtaggggtatttacgaaacgcccgcagggactattctgtatcacgcgcatctagacattgaagcttttactatggaccgggaagtccgtaagatcaagcagggcttgggtctgaagttcgccgaactcgtttacactggcttttggcacagcccggagtgtgaattcgttagacattgcatcgccaagtcccaggagagggttgagggcaaggtgcaggtttctgtcctgaaggggcaggtatatatcctggggcgcgaatcgcccctgagtttgtacaatgaagagctcgtgagtatgaatgtgcagggcgactatgagccaaccgacgctaccggcttcatcaatatcaatagtctccggctgaaagagtaccatagactgcagtctaaagtcactgccaaa

SEQ ID NO: 6929 - DNA, 1236 bp, Artificial Sequence
  Description of Artificial Sequence: Synthetic coding sequence
atgtccagtaagggttcggtggtgctggcctactcgggaggacttgatacttcttgtatacttgtgtggctcaaagagcaaggttacgacgtcatcgcatacctggcaaacatcgggcagaaggaagatttcgaagaagcaaggaagaaagcactgaagctcggtgcaaagaaagtgttcatagaggacgtctcgcgcgaatttgtggaggagttcatttggccagcaattcaaagctctgcgctctacgaggaccgatacctgctgggaacctcacttgctagaccgtgtatcgcacgcaagcaagtcgaaatcgcgcaaagagagggggcaaagtacgtgtcccatggagccactggtaagggtaacgaccaggtccgtttcgaactgtcgtgttatagcttggctccccagatcaaggtgattgcaccctggcgcatgcccgaattctacaataggtttaagggcaggaacgatttgatggaatacgcaaaacaacatggcattccaatcccagtgaccccaaagaacccatggtcaatggacgaaaaccttatgcatatctcatacgaagcaggaatactcgaaaaccctaagaaccaggcaccgcccggcctttacaccaagacccaagatccagcgaaggcccctaatactcccgacattcttgagatagagtttaagaaaggcgtgccagtgaaggtgactaacgtgaaggatggcactactcatcaaacgtccctggaactgttcatgtatctcaatgaagtcgcaggaaagcatggagtgggtcgtatcgacatcgtggagaataggtttatcggaatgaagtccaggggaatctacgaaacccctgcaggaaccatactctaccacgcacacctggatatagaggcatttactatggatcgggaagtgcgtaagataaagcaaggtttgggtctgaagtttgcggaactcgtgtacactggcttttggcactcgcctgaatgcgaatttgtgcggcattgcattgctaagagccaggaacgcgtcgaaggtaaggtgcaggtgtccgtcttgaagggacaagtgtacattctcggaagagaatcacctctttcactgtacaacgaagaactggtgtccatgaatgtgcagggagattacgaaccgactgatgccaccggatttatcaatatcaattcccttagacttaaggaataccaccggttgcagtcaaaggtcactgcaaag

SEQ ID NO: 6930 - DNA, 1236 bp, Artificial Sequence
  Description of Artificial Sequence: Synthetic coding sequence
atgtcgtccaaggggtcagtggtcctggcatattcgggtggtctggacacctcttgcattctggtgtggttgaaagagcaggggtacgatgtgattgcttacctcgccaatataggacaaaaggaagattttgaagaggcaagaaagaaggcgctcaagctgggagcaaagaaagtgtttatcgaggatgtgagccgtgagtttgtcgaagaattcatttggcctgctatccagtcgagcgcactttacgaagatcggtacctgctgggtacttcgctggcacggccatgtattgcacggaagcaagtggaaattgcgcaaagagaaggagcaaagtacgtctcgcatggtgcaaccggaaaaggtaacgatcaggtgcggtttgaactgtcctgctactcgcttgccccgcagattaaagtgatcgcaccatggcggatgccagaattctataacaggtttaaaggaagaaacgacctcatggaatacgcaaaacagcatggaataccaatacccgttacccctaagaacccgtggagcatggatgagaacttgatgcacatctcgtatgaggcgggaattcttgaaaatcctaaaaaccaggcaccacctggcctttacactaaaacccaagatcctgctaaggcacctaatactccagatattctggagatcgagttcaagaaaggtgtgccggtgaaagttaccaacgtgaaggatggaacgactcaccaaacctcgctggaactgttcatgtacctgaacgaggtcgcaggtaagcatggagtcggacgcattgatatagtcgaaaatcgctttattggaatgaagtcgagaggaatctacgaaaccccagccggtactattctgtaccatgcgcaccttgatatagaggcatttaccatggaccgggaagtcagaaagattaagcagggtcttggtcttaagttcgcagaactggtctacactggattctggcattctccagaatgtgaatttgtgagacactgtattgcgaagtcacaggagagagtggaaggaaaggtgcaggtgtcggtcctgaagggacaagtctacatcttgggccgagaatcccccctttcactctacaatgaagaactggtgtcaatgaacgtgcaaggtgattacgaacctactgatgctactggattcataaacataaactcccttcgtctgaaggagtaccaccgtctgcagtccaaggtgaccgccaag

SEQ ID NO: 6931 - DNA, 1236 bp, Artificial Sequence
  Description of Artificial Sequence: Synthetic coding sequence
atgagcagcaaaggttccgtggtgctcgcttactccgggggactcgatactagctgtatcttggtttggctcaaagagcaagggtacgacgtcatcgcatacttggccaatatcggccagaaggaggacttcgaagaggcacggaaaaaagcattgaagctgggtgcgaagaaagtgtttattgaggacgtgtcaagggagttcgtggaagagttcatctggccggccatccagtctagtgccctttacgaggacagatacctgctcgggacctcgctggctagaccgtgcattgcgcgcaaacaagtcgaaatcgcgcagagagaaggagcgaagtacgtctcgcatggagcaactggaaaggggaacgaccaggtgcggtttgaactgagctgctactcacttgccccacagattaaagtgatcgcaccatggcggatgcctgaattctacaatcgtttcaaaggacgcaacgacctcatggagtacgcaaagcagcacggtatcccgatcccggtcaccccgaagaatccttggagcatggatgaaaacctcatgcacatcagctacgaagccggaatcctcgagaacccgaaaaaccaggccccgcccggtctgtacactaagacccaagacccagctaaggcacctaatactccagacattttggaaatcgaattcaagaagggagttcctgtcaaggttacgaacgtcaaagatggcaccactcaccagacctcgttggagctgttcatgtatctgaacgaagtggcgggtaaacatggggtgggtagaatcgatatcgtggagaatcgcttcataggaatgaagtctcggggcatttacgaaaccccggccggaactatcttgtaccacgctcatctggacatcgaagccttcaccatggatcgcgaagtgagaaagatcaagcagggactgggacttaagttcgcggagcttgtgtacaccggcttctggcactcaccggaatgcgaatttgtgcggcactgcatcgcaaagtctcaggagagagtcgaaggcaaggtccaggtgtcggtgctgaagggccaagtgtacatcttgggtcgagagtcgcccctcagcctgtacaatgaggaactggtgtccatgaatgttcagggagactatgagcctaccgacgccaccggctttatcaacattaactccttgagactgaaggaataccatcgacttcagtccaaggtcaccgccaag

SEQ ID NO: 6932 - DNA, 1236 bp, Artificial Sequence
  Description of Artificial Sequence: Synthetic coding sequence
atgagcagcaaagggtcagtcgttctggcttacagcggtgggctcgacacttcttgcattttagtgtggctgaaggaacagggttatgatgtgatcgcctacttggcaaatatcgggcagaaagaagatttcgaggaggcgagaaaaaaggcactgaagctgggagccaagaaagtatttatagaagacgtctcacgtgagtttgtagaggaattcatctggccggccattcaatcttcagccttgtacgaggacaggtatctgctggggacctccctggcacgcccatgcattgcaagaaaacaggttgaaatcgcgcagcgagagggcgccaaatatgtgtctcacggggctacaggaaagggcaacgatcaggtacgctttgagctatcgtgctacagcctcgctcctcagattaaggtgatcgcaccctggaggatgcctgagttctataaccgcttcaagggtcgcaatgacctgatggaatacgctaagcagcatgggatccccatccccgtcactcccaagaacccctggagcatggacgagaacctgatgcacatctcatacgaggccggtattctagagaatcctaagaaccaggcacccccggggttatacaccaaaacgcaggaccctgctaaggcccccaacacacctgatattttggagattgagttcaagaagggcgtgccagttaaggtgacgaacgtgaaggacggaaccactcaccaaactagcctggaactgttcatgtacctaaatgaagttgcgggcaagcacggggtcgggaggatcgatatagtcgaaaataggtttatcggcatgaagagcaggggcatttatgagacccctgctgggacaatcctgtatcacgcgcacctggacattgaggcctttactatggatagagaggttcgtaagatcaaacagggcctggggctgaagtttgccgagttggtttacacgggcttctggcattcccctgaatgtgagtttgtgaggcattgcatcgctaagtcccaggagcgggtggaaggcaaggtgcaggttagtgtgcttaagggtcaggtgtacatcctgggaagagagagccccctctcgctgtacaacgaggagctggtttccatgaacgttcagggtgactatgaacccactgatgccacaggctttatcaacatcaacagccttcgcctaaaggagtatcaccgcctgcagagcaaggtgactgctaag

SEQ ID NO: 6933 - DNA, 1236 bp, Artificial Sequence
  Description of Artificial Sequence: Synthetic coding sequence
atgtcgtccaagggatcggtggtcctggcatactcgggagggctggacacctcgtgtattctcgtctggcttaaggagcaaggttacgacgtgattgcatacctcgcaaacatcgggcaaaaggaagatttcgaggaagctagaaaaaaggcgcttaagctgggagctaagaaggtgtttattgaggacgtgtcgagagaattcgtggaagagtttatctggccagcaattcagtcatccgcactttacgaagatcggtacctcctcggtacctcgctcgcacggccctgtattgcaagaaagcaagtggagatcgcacagcgcgaaggcgccaagtacgtctcgcatggtgcgacgggcaagggtaacgatcaagtgcgctttgagctgtcctgttactcccttgccccccagattaaagtgattgcaccatggaggatgcctgagttttacaaccgctttaagggacgaaatgaccttatggaatatgccaaacagcatggtatcccaattcccgtcactcccaaaaacccttggtcgatggatgaaaatctgatgcatatctcatacgaggccggaattcttgaaaaccctaagaaccaggcgcctccaggcctgtacaccaagacccaagacccggcgaaggcacctaacactcctgatatacttgagatcgagtttaagaaaggagtccccgtgaaagtgaccaacgtgaaagatgggaccactcaccagactagcctggagctctttatgtacctgaatgaagtggcaggtaagcatggcgtgggacggattgatatagtggagaatcggttcattggtatgaaatcgagaggcatttacgaaacccctgcagggaccatcctttatcatgcacatctggatatcgaagcgtttactatggatcgtgaagtgcgcaagatcaagcaggggctcggactgaagtttgcggaactcgtgtacactggattttggcattcgccggaatgcgagttcgtccgacattgtatcgcaaagagccaggaacgtgtggagggtaaggtccaggtgtccgtgctcaagggtcaggtctacatcttgggtcgcgaatcccccctttcgctttacaatgaggagcttgtctcgatgaacgtccagggagattacgaaccgaccgatgcaaccggattcattaacatcaattcactgaggcttaaggagtaccaccgactccagtcgaaggtgactgcaaag

SEQ ID NO: 6934 - DNA, 1236 bp, Artificial Sequence
  Description of Artificial Sequence: Synthetic coding sequence
atgtcttcgaaggggagtgtagttttggcgtactcaggaggacttgatacttcgtgtattttggtttggttgaaagaacaaggatatgacgttatagcatacttggcaaacattggtcagaaggaagacttcgaggaagcacggaagaaggctctcaagcttggagcaaagaaggtttttatagaggatgtgtctagggagttcgtcgaagagtttatatggccggccattcaatctagtgcattgtacgaagatcgttatcttcttggaacttcgcttgctagaccttgtatcgcaaggaaacaagttgaaattgcgcaaagggaaggtgctaagtacgtctcacacggcgctactggtaagggaaacgatcaggtgcgatttgaactaagctgttactcattggccccccagattaaggtcatagccccttggagaatgcccgagttttacaatagatttaaagggagaaacgatttaatggaatatgccaaacaacacgggatacctattccagtgactcctaaaaacccttggtcaatggatgaaaatctgatgcacatttcgtacgaggctggtattctagagaaccccaagaaccaagctccaccgggcctatatacaaaaactcaagaccccgcgaaggcccctaatactcctgatatccttgagattgaattcaaaaagggcgttccagttaaagtgactaacgtcaaggatgggacaacccaccaaacttcccttgaacttttcatgtatctcaatgaggttgctggtaagcatggtgtgggaaggatcgacattgttgagaacaggttcatcgggatgaaaagccgaggaatatatgagactcctgctggtaccatattatatcacgcacatttggatatcgaggcattcactatggatagagaggttcgtaagattaagcaaggcttaggactgaagtttgctgaactcgtttatacaggtttctggcactctcctgaatgcgagtttgtccgtcactgtattgccaaatcccaagaaagggtcgaaggaaaagtgcaggtttctgttttgaagggacaagtttatattctgggccgtgaaagtcctcttagcctatataatgaggaactcgtatccatgaacgttcaaggcgactacgaaccaaccgacgctactggattcattaacatcaattctttgcgacttaaagaatatcaccgcctgcagtcaaaggttactgctaaa

SEQ ID NO: 6935 - DNA, 1236 bp, Artificial Sequence
  Description of Artificial Sequence: Synthetic coding sequence
atgtcaagcaaaggatcggtggtgctcgcctactcgggaggactcgacactagctgcatccttgtatggttgaaggagcaaggatatgacgtgattgcctacctcgctaacatcggtcagaaggaagatttcgaggaggcccggaagaaagccctgaaacttggtgccaaaaaggtgttcatcgaagatgtgtcccgggaattcgttgaggagttcatctggcccgcgatccagtcctcggccctgtacgaggaccggtacctcttgggaacttccttggcccgaccgtgcatcgcgaggaagcaagtggaaatcgctcagagagaaggagccaagtacgtgtcgcacggcgcgaccggaaaaggcaacgaccaggtgaggtttgagctcagctgctactcgctggcaccgcagatcaaggtcatcgccccctggcgcatgcctgaattctacaaccgctttaagggcagaaatgacctgatggaatacgctaaacagcacggaatcccgattccggtcacgcctaagaatccttggtcaatggatgagaacctgatgcacatttcatacgaggctggaattctggaaaacccgaagaatcaagcaccgccaggactttacactaaaacgcaggacccggccaaggcaccaaacactcctgacatcctggaaatagaattcaagaagggcgtgcccgtgaaggtcaccaacgtgaaagacggtaccacccaccagacctctctggaattgttcatgtacctgaatgaagtcgcggggaagcatggagtcgggcgcatcgacatcgtcgagaacagattcatcggcatgaaatcccgtggcatctacgagactccagcgggaaccatcctctaccacgcacatctggatattgaagcattcactatggaccgcgaagtccgcaaaatcaagcaaggtctgggactcaagttcgccgaactggtttacaccgggttttggcattcaccggagtgcgaatttgtccgccattgtattgcgaagtcgcaggaaagagtggagggaaaggtgcaagtctcggtgctgaagggccaagtgtacatcctcgggcgggagtcaccactcagcctctataatgaagagctggtgtccatgaacgtgcagggagattacgagccaactgatgcgaccggcttcatcaacatcaattccctgcggctgaaggaataccaccggctgcagagcaaggtgaccgctaag

SEQ ID NO: 6936 - DNA, 1236 bp, Artificial Sequence
  Description of Artificial Sequence: Synthetic coding sequence
atgtcgtcgaagggctccgttgtgctcgcctactccggaggactggacacctcttgcatcctcgtgtggctgaaagagcaaggctacgatgtgatcgcttacctcgcaaacattggtcagaaagaggatttcgaagaagcacggaagaaggcccttaagctgggtgccaagaaggtgttcattgaagatgtctccagagaattcgtggaagagttcatctggccagcgatccagtcatccgctctctacgaagatcgctacctcctcggtacctcgctcgcgcgcccatgcattgctcggaagcaagtggaaatcgcacaacgcgagggagctaagtacgtgtcgcacggtgctaccgggaagggtaatgaccaggtgcgcttcgaactctcgtgctactccctggcgccacagatcaaagttatcgcgccttggcgcatgccggagttctataaccgcttcaagggacgcaacgacttgatggagtacgcaaagcagcacggaatcccgatccctgtgacccccaagaacccgtggagcatggatgagaatttgatgcatatctcgtacgaagcgggaatcttggagaacccgaaaaatcaagcgccgccgggactgtataccaagacccaggacccggccaaggccccgaataccccagacatcctcgagatcgagtttaagaagggagtcccagtgaaggtgaccaacgtcaaggatggaaccacccaccaaacctcgctcgagcttttcatgtacctgaacgaggtcgcaggaaagcacggcgtgggaagaattgacatcgtggaaaaccgcttcatcggaatgaagtcccgcggaatctacgaaactcccgcaggcactattctgtaccatgcacacctcgacatcgaagcgttcaccatggaccgggaagtccgcaagatcaagcaggggttgggactgaagttcgccgaactcgtctatactggattctggcactcaccggaatgcgagtttgtcagacattgtattgcaaaatcacaagagagggtggagggtaaggtccaagtgtccgtgctgaagggacaagtgtacatcctgggacgggaaagcccactgagcctgtacaacgaagagctggtgtcaatgaacgttcaaggagattacgagcctactgacgcaactggcttcatcaatatcaatagcctgcggttgaaggaataccaccgcctccaatcgaaagtgaccgctaag

SEQ ID NO: 6937 - DNA, 1236 bp, Artificial Sequence
  Description of Artificial Sequence: Synthetic coding sequence
atgtcttctaagggcagtgtggtcctcgcttattctggtggactcgacacaagttgcatcctggtgtggttgaaggaacagggttacgacgtgatcgcataccttgccaacattggacagaaggaagattttgaggaggcacgcaagaaggctcttaagctgggagcaaagaaggtattcattgaggacgtgtctcgtgagttcgtggaagagttcatctggcctgctattcagtctagcgctctgtacgaggatcgctacctgctgggaactagcctggctcgtccttgcattgctcgtaaacaagtggagattgcacagcgtgagggagcaaaatacgtgtcacacggcgctacaggcaaaggaaacgatcaagtgcgttttgagttgagctgctatagcctggctcctcaaatcaaggtgatagccccctggagaatgcccgaattctataacaggttcaagggtcgtaacgatttgatggagtatgcaaagcaacacggtataccaattcctgtcacacccaagaatccctggagtatggacgaaaatctcatgcacatatcatatgaagctggcattttggagaaccccaaaaaccaggctccccccggtctgtacactaaaactcaggatcccgccaaggcccctaatactcctgacatactcgaaatagaatttaagaagggagtgcctgttaaggtcactaacgtcaaagatggaacaacacaccagaccagcttggagctctttatgtatttgaatgaggtggcaggaaaacatggcgttggcaggatcgacattgtcgagaatcgcttcatcggaatgaagtccaggggcatctacgaaactcctgcaggaacaatcctgtaccatgctcatttggatatcgaggctttcaccatggaccgtgaggtacgcaagatcaaacagggcttgggtctgaaattcgctgagctggtgtacacaggcttttggcacagccctgaatgcgaatttgtacgccattgtattgcaaagagccaggagcgcgtggagggaaaggttcaagtgtctgtgctcaagggtcaggtatacatcctcggtagagagtcacctttgtctctttacaatgaggagctggtatccatgaacgttcaaggagattacgagccaaccgatgccactggatttataaacatcaacagcctgcgccttaaggagtatcacaggctccaatccaaagtgaccgccaaa

SEQ ID NO: 6938 - DNA, 1236 bp, Artificial Sequence
  Description of Artificial Sequence: Synthetic coding sequence
atgagctcgaagggatctgtggttctggcgtactctggaggactggatacttcgtgtatccttgtgtggttgaaggaacagggatacgacgtgattgcgtacctggctaacataggacagaaggaggacttcgaagaagcccgtaaaaaggctctgaagctcggagccaagaaagtgttcatcgaggacgtctcacgcgagttcgtggaggagtttatctggcccgctatccagtcatcagcgctgtacgaggatcgctacctgctgggcacttccctcgcaaggccatgcatcgcacggaagcaagtggaaatcgcgcagagagagggagctaaatacgtctcgcacggggcgactggaaaagggaacgatcaggtcagatttgaactttcgtgctactcacttgctccccagattaaggtcatcgccccttggagaatgccagagttttacaatcggttcaagggaaggaatgacctcatggagtacgccaaacaacatgggatcccaatcccggtgacgccaaaaaacccttggtcgatggacgaaaatcttatgcatatttcctatgaagccgggatactggaaaaccctaaaaaccaggcgcctcctggactgtacactaagactcaagatccggccaaggcaccgaacaccccggatatcttggaaatcgaattcaaaaaaggagtcccagtgaaggttaccaacgtgaaagacggcaccacccaccaaactagcctcgaactgttcatgtacctgaatgaggtcgccggaaagcacggcgtgggaagaatcgacatcgttgagaaccggttcatcggcatgaaatcccggggtatctacgagactccggccggaaccatcctttaccatgcacacctcgacattgaagccttcactatggacagagaagtccgaaagatcaagcagggtctggggcttaagtttgcggagctggtgtacacgggcttttggcacagccctgagtgtgaattcgtgcgccattgcatcgcgaagtcgcaggaacgggtggaaggaaaggtgcaggtgtcagtcctcaagggccaagtgtacattctcggcagggaaagcccgctgtcgctgtacaacgaagagttggtttccatgaatgtgcagggtgattatgaacctaccgacgcaactggtttcatcaacatcaattcactgcgtctgaaggagtaccaccgactgcaaagcaaggtgaccgcaaag

SEQ ID NO: 6939 - DNA, 1236 bp, Artificial Sequence
  Description of Artificial Sequence: Synthetic coding sequence
atgtcctccaaaggtagcgttgttctagcatattctggcggcctggacactagctgtatattggtttggctgaaagaacagggttacgacgtaatcgcgtatctggcgaatatcggtcagaaggaagacttcgaggaggcccgcaagaaagcactcaaactcggagctaaaaaggtctttatagaagacgtgtctagagagttcgtggaggagttcatctggccagcaattcaatctagcgccctttacgaggatcgataccttctcggtaccagtctggcccgcccttgtatagcacgtaaacaggtggagattgctcaacgagagggcgccaagtacgtgagccacggcgcgaccggcaagggtaacgaccaggtgcggttcgagctcagctgttattctctggcacctcagattaaggttatcgcgccttggagaatgccagagttttacaatcgctttaaaggccgcaacgacctgatggagtacgcgaagcagcacggaattcccatacctgtgactcccaaaaacccatggtcaatggacgaaaatttgatgcacatcagctacgaagctggaattctggagaaccctaaaaaccaggcgccaccaggtctgtatactaaaacccaggacccggcgaaagcaccgaacacaccagacattctggagatcgaatttaagaagggggtgcctgtcaaagtgacgaatgtgaaggatggcaccacacaccaaacctccctcgaactgttcatgtacctgaatgaagttgcaggaaagcacggtgtaggacggattgatatcgtagagaaccgatttatcggcatgaagtctcgtgggatctacgaaactccagcgggcacaatcctgtaccacgcccacctggacatcgaggcgtttaccatggaccgcgaagtgcgcaagattaagcagggcctgggtctgaagtttgcagagttggtctacacgggcttttggcacagcccagaatgcgagttcgtgcgccattgtattgcgaagagccaggagagagttgaaggtaaagttcaagtgtctgtgctgaagggccaggtgtacattctgggtagagagagccctctcagcctgtataatgaggaactcgtgagcatgaacgtgcagggcgactacgaacctaccgacgcaactggcttcattaatatcaattccttgcgcttaaaggagtatcacagactccagagcaaggtcaccgcaaag

SEQ ID NO: 6940 - DNA, 1236 bp, Artificial Sequence
  Description of Artificial Sequence: Synthetic coding sequence
atgtctagcaaagggtcagtcgtgctcgcctatagtggcggcctggatactagctgcattcttgtatggctgaaagagcaggggtacgacgtgatagcttatctggcaaacattggccaaaaggaggacttcgaggaggctcggaaaaaggcactgaaacttggtgcaaaaaaagttttcattgaggacgtttcacgagagttcgttgaggaatttatctggcctgccattcagagttcagcactctatgaagatcgctacctgctggggactagcctggcccgaccttgtatcgctcgaaagcaggtggagattgcgcaacgggaaggcgccaagtacgtctctcacggggctaccggcaagggcaatgatcaggtcagatttgaactaagttgttattccctcgcaccacagattaaggtgattgcaccttggcgtatgcctgagttctacaaccggtttaaaggccggaacgacttgatggagtacgccaaacagcatggcatacctatcccggtgacccccaagaacccatggtccatggacgagaaccttatgcacatcagctacgaggctggcattctggaaaatccaaagaaccaagctccccctggcctatataccaagactcaggatcctgccaaagcacctaatacacccgacatccttgagattgagtttaagaagggcgtgcccgtgaaagtgacgaacgtaaaagacggaactacacaccagacgtccctcgagcttttcatgtacctcaatgaggttgcaggaaaacacggtgtgggcaggatcgatatcgtggagaaccggtttatcggaatgaagtccagaggaatctatgaaacgcccgctggaacaattttgtaccacgcccacttagacattgaagcttttacgatggatagagaggttcgcaaaataaagcaggggctcggactcaaatttgcagagctcgtttacacaggcttttggcacagccccgagtgcgaattcgtacgccactgtattgcaaagtctcaggagcgtgtcgaggggaaggtccaggtgagcgtactgaagggtcaggtttacatactgggaagagagtccccactgagtttgtacaacgaggagctggtgtctatgaacgtacagggagactatgaacctaccgacgcaactggcttcatcaacattaattctttgcggttgaaagaataccaccggctccagtccaaagtgactgctaaa

SEQ ID NO: 6941 - DNA, 1236 bp, Artificial Sequence
  Description of Artificial Sequence: Synthetic coding sequence
atgtcaagcaaaggctctgtggtgcttgcatacagcggagggcttgataccagctgcattctggtgtggctgaaagaacagggatacgatgtcattgcctacctggccaatatcggacaaaaagaggactttgaggaagctagaaagaaggcacttaagctgggcgcaaagaaggtgttcattgaagatgtgagcagggaatttgtggaagaattcatttggccagcaatacaaagctcggccctgtacgaagatcgataccttcttggtacctccctcgcaagaccttgtatcgccagaaagcaagtcgagattgcacagagggaaggggcaaagtatgtgtcccatggagcaactggtaaggggaacgatcaggtgaggtttgagctgtcatgctactcgctggcccctcagattaaagtgatcgctccctggagaatgccagaattctacaacaggtttaagggtcgcaatgaccttatggaatacgccaagcaacatggaatacctattcccgtgacgccgaagaatccttggtctatggacgaaaatcttatgcacatttcatacgaagcaggtatcttggagaacccgaagaatcaggctccaccaggattgtacacgaaaacccaagatcccgccaaggcgccaaacaccccagatatcctcgaaatcgaattcaagaaaggcgtgcccgtcaaagtgaccaatgtgaaagacggtaccacccaccagacgagcctggaactgtttatgtaccttaacgaagtggcagggaagcatggagtcggaagaattgatattgtggaaaataggtttattgggatgaagagcagaggcatttatgagactcccgcgggaactatcctttaccatgcacatctggacattgaggcctttaccatggatcgggaagtgcgaaagattaaacagggcctcggtcttaagtttgcagagctcgtctatactggattttggcactcgccagagtgtgaatttgtgcgacactgcattgcaaagagccaagagcgtgtggaagggaaggttcaggtgtctgtgctgaagggacaagtctatatactgggcagagaatcccccctgtcgctttacaacgaagaactcgtgagtatgaatgtgcagggtgattacgaacctaccgatgccactggatttatcaacattaacagccttcgactcaaggaataccatcggcttcagtccaaagtcaccgccaaa

SEQ ID NO: 6942 - DNA, 1236 bp, Artificial Sequence
  Description of Artificial Sequence: Synthetic coding sequence
atgagctccaagggctcggtggtactggcatacagcggcggccttgatacgtcctgcatccttgtctggcttaaggaacaaggatacgatgtcatcgcatacctggccaacattggacagaaggaggacttcgaagaagctagaaagaaggcactgaagctgggcgccaagaaggtgtttatcgaggacgtctcccgtgagtttgtcgaggagtttatctggcctgcaatccaatcgtcagcgctttacgaagataggtaccttcttggtacgagtctcgcacgcccatgtattgcaaggaagcaagtggaaattgcacagcgcgagggtgccaagtacgtctcacacggggccactggtaagggcaatgaccaagtgcgttttgagctgtcgtgttacagccttgctccgcagataaaagtgattgcaccatggcgcatgcccgagttttacaaccgcttcaaaggaagaaacgatctgatggaatacgcgaagcaacatggaattcccatcccagtgaccccaaagaatccctggtcgatggatgaaaacctgatgcatatatcatacgaggcaggaattctggagaaccccaagaatcaagctcctcctggtctgtacactaagacccaggacccagccaaggctcctaacactcctgatatcctcgagattgaattcaagaaaggcgtgccagtgaaggtgaccaacgtgaaggatgggaccacccatcaaactagccttgaactgtttatgtacttgaatgaagtggcaggaaagcacggagtgggaagaatcgacattgtggagaacagattcatcggtatgaaatcacgcgggatttatgaaaccccggccggtaccattttgtaccatgcacatctcgacattgaagccttcaccatggacagagaggtgaggaaaatcaagcaaggactcggtcttaagtttgccgaactggtgtacaccggcttttggcattccccggaatgcgaatttgtcagacactgtatcgcgaagagccaggagcgagtggaagggaaggtgcaagtgtcagtcctgaagggtcaagtttacattctgggtcgggaatcacccctttcgctgtacaacgaagaacttgtctccatgaacgtgcaaggagactacgaacctactgatgcaactgggttcattaacatcaactcgcttcgcctcaaggaataccatcgcctccagtccaaggtgacggccaaa

SEQ ID NO: 6943 - DNA, 1236 bp, Artificial Sequence
  Description of Artificial Sequence: Synthetic coding sequence
atgtcaagcaagggctccgttgttctggcttattctggaggtctggatacttcctgtattctggtctggctgaaggagcagggctacgatgtcattgcatatttggctaatatcggtcaaaaggaagacttcgaggaggcccgtaagaaggccttgaagctcggagctaaaaaagtgttcatagaggacgtgagcagggagttcgtggaagagttcatctggcccgcgatccagagcagtgccctttatgaggatagatatctgctgggcacctcactagcgcgcccttgcattgcccgaaagcaggtggagattgctcagagagagggggcgaaatatgtcagccacggtgccacaggcaaggggaacgatcaggtccgctttgagctgagttgttactcccttgcgcctcagataaaagtcatcgcgccatggcgaatgcccgaattctataataggtttaagggcagaaatgacctgatggagtacgcaaagcaacatggcattcccatccctgtcaccccgaagaacccttggtcaatggacgagaacttgatgcatatctcttatgaagctgggatcctcgaaaatcctaaaaaccaagctcccccgggcctctacaccaagacccaggaccctgcaaaggcaccaaatacccccgacatcctggaaatcgagtttaaaaaaggtgtgcctgtgaaggtgacgaatgtaaaggatggcacaacacatcaaacctcattggaattgtttatgtatttgaatgaggtcgccggaaagcatggcgtaggacggattgacattgtagagaatcgattcatcggtatgaaatcccgagggatctatgaaaccccagcagggacaatcttatatcatgctcacttagacattgaagctttcactatggaccgggaagttagaaagattaagcaagggttgggcttgaagttcgctgagctggtttacaccgggttttggcatagcccagagtgcgaattcgtgagacattgcattgctaaatcacaggaacgtgttgaagggaaggtgcaggtttctgtactgaaggggcaagtgtatatcctcggccgcgaatcccccctctccctatataatgaggagctggtctccatgaacgttcaaggagactatgagccaaccgacgccacaggctttataaacatcaatagcctccgactgaaggaataccaccggttgcagtcaaaagttacagccaag

SEQ ID NO: 6944 - DNA, 1236 bp, Artificial Sequence
  Description of Artificial Sequence: Synthetic coding sequence
atgtcctccaagggttccgtcgtcttagcctacagcggaggtctggatacctcctgtattttggtgtggttgaaggagcagggctacgatgttattgcctacctggctaacatcggccagaaggaggatttcgaggaggcccgcaagaaggccttgaagctgggcgccaagaaggtgtttattgaggacgtgtcccgggaattcgtggaagagttcatctggccagccattcagagctccgcgctgtacgaggatcgttatctactgggtacgtccctcgcgcgcccctgcatagcccgcaagcaggtggaaatcgcccagagggagggggccaaatacgtatcgcacggagccactggcaaaggtaacgatcaggtgcggtttgagctgagttgctactccttagccccgcagattaaagttattgccccctggcgcatgccagaattttataataggttcaagggccgcaatgacctgatggagtatgccaagcagcatggcattccgattcccgtgaccccgaaaaacccgtggtcgatggatgagaatctaatgcacatctcctacgaggcaggcatcctagagaacccgaagaatcaggctcccccgggtctgtacactaagactcaagatccagcgaaagcccccaatactcccgatatactggagatagagttcaagaagggcgtgccagtgaaggttactaacgttaaagacggtaccacccatcaaacttccctggagttatttatgtacctgaatgaggtggctggaaagcatggcgtaggcaggatcgatatcgtggagaatcggttcatcggaatgaagtcccgaggaatctacgaaacccccgctggcactatactgtaccatgcccatctggacattgaggcttttaccatggatcgcgaagtcagaaagatcaaacagggcctgggtctcaagttcgccgaactggtttacacaggattctggcactcgccagagtgcgagtttgtccgacactgcatcgcgaaatcccaagaacgagtggaaggtaaggtgcaggtgtcagtcttgaagggtcaggtttatatccttggccgcgaaagccctttgtccctgtataatgaagaactggtaagtatgaacgttcagggcgactacgagccgacggatgctacgggattcatcaacataaattccctaaggctgaaggagtaccaccgactacagtcaaaagttaccgccaag

SEQ ID NO: 6945 - DNA, 1236 bp, Artificial Sequence
  Description of Artificial Sequence: Synthetic coding sequence
atgagcagcaaaggctccgtcgtgctggcctattctggtggtctggatacaagttgcatcctcgtgtggcttaaggagcagggctacgacgtgatcgcctatctggctaacattggccagaaagaggatttcgaggaggctaggaagaaggcactgaaactcggtgccaaaaaagtcttcatagaagatgtctccagggaattcgttgaagaatttatttggcctgcaatccagtcgtctgccctttatgaggacaggtatctactaggaacttcgcttgcaagaccatgcatcgccagaaagcaagtggagatcgcccagagagagggagccaaatacgtgtcccacggagccaccggtaaagggaatgaccaggttagatttgaactctcatgttatagtttggcccctcagattaaagttatcgcaccctggcgaatgccggagttttataacagatttaaagggaggaatgacctaatggagtatgccaaacagcacggcattcccatccccgttacacccaagaacccatggtcgatggatgaaaatttaatgcacatttcgtacgaggcagggatcctggaaaacccgaagaatcaggcccctcccgggctatacaccaagacacaggacccagccaaggctcccaacacaccagacattcttgagatcgaattcaaaaagggagtgcctgtgaaagtgacaaatgtcaaggacggaactacccaccagacatctttggagctcttcatgtatcttaacgaagtggcaggaaagcatggggtggggcgaatcgatattgtagagaacaggttcatagggatgaaatccagggggatttacgaaactcctgctggaaccatcctgtaccacgctcatttggacatcgaagcctttaccatggatcgagaggtgaggaagatcaagcagggcctgggtctgaagtttgctgagctcgtctacactggcttctggcactccccagaatgcgaatttgtcagacactgcatcgcaaagtctcaagagagagtcgagggaaaagtacaggtcagcgtgttgaagggtcaggtctacatcctgggccgagaatcaccactgtcactgtacaacgaggaactcgtgagcatgaacgtacaaggagactatgaacccacagacgctaccgggttcatcaacataaactcccttcggcttaaggagtatcatagactgcaatcaaaggtgacggcgaag

SEQ ID NO: 6946 - DNA, 1236 bp, Artificial Sequence
  Description of Artificial Sequence: Synthetic coding sequence
atgtcatccaaaggcagcgtggttctcgcatactcaggcggccttgatacttcgtgcatccttgtgtggctgaaagaacagggatacgatgtcatcgcatacctcgctaacatagggcaaaaagaggacttcgaagaggctagaaaaaaggccttgaagctgggtgcaaagaaggtgtttatagaagatgtcagccgcgaatttgtggaggagtttatctggccagcgattcagtcctcggcgctgtacgaagatagatacctgctggggacctcccttgcacggccatgcattgcacgaaagcaagtcgaaattgcacagcgagaaggtgcaaaatacgtgtcacatggtgcaactggcaagggtaatgaccaagtgcggtttgaactttcgtgttactcgctggcgccacagattaaggttatcgcaccgtggagaatgcctgaattctacaatcgctttaaaggtagaaacgatcttatggaatacgcaaagcaacatggaatccccattcctgttacgcctaaaaacccctggtcaatggacgaaaacctcatgcatatttcatatgaagcaggaattctcgaaaatcccaagaaccaggccccgcctgggctttacaccaagactcaagacccggctaaggcccctaatactccggatatcctggaaatcgaattcaagaagggtgtgccagtcaaggtcaccaatgtgaaggacggtactactcaccaaacctcgctggaactctttatgtacctgaatgaagtggccggcaagcatggagtgggcagaatagacattgtggaaaatcgctttatagggatgaagagcagaggaatttacgaaactccagcgggtaccattctgtaccacgctcatcttgatattgaagcatttactatggatagagaggtgagaaagattaaacaggggctgggactgaaattcgccgaactcgtgtatactggattctggcactcgcctgaatgtgaatttgttcgacattgtattgctaagtcgcaggaaagagtcgaagggaaagtgcaagtctcggttctgaagggtcaggtgtacattcttggaagggagtccccacttagcctgtacaacgaggaacttgtgtcgatgaatgtgcaaggagattacgaacctactgatgccactggtttcattaacattaacagtctccgtttgaaagaatatcataggcttcagtcgaaagtgaccgccaaa

SEQ ID NO: 6947 - DNA, 1236 bp, Artificial Sequence
  Description of Artificial Sequence: Synthetic coding sequence
atgtcctccaaaggatctgtggtgctcgcatacagtggcggactggataccagctgtatcctcgtgtggctgaaagagcaggggtacgatgtgatcgcctacttagcaaacatcgggcaaaaggaggactttgaggaagcccggaagaaggccctgaagttgggcgccaaaaaagtctttatcgaggatgtgagcagagaatttgttgaggagtttatttggccagccatccaaagcagcgcgctttatgaagacagatacttactcggaactagcctcgccaggccctgcatcgcccgcaagcaagttgaaatagctcaaagggaaggggccaagtatgtgtcccatggggctactggtaaaggcaatgaccaggtgagattcgaactgagctgttattctcttgctccccagatcaaagtcatagccccatggaggatgcctgaattttacaataggtttaaaggtaggaatgatctgatggagtatgctaagcaacatggaattcctatccccgtgactcctaaaaatccatggtctatggatgagaacctgatgcacatttcttacgaggccggaatcctcgagaaccctaaaaaccaggcacctccaggtctctataccaaaacgcaggacccggcgaaagcgcctaatacaccggacatcctcgagattgagtttaaaaagggggtcccagtgaaggtgactaatgtaaaggatggcacaacccaccagaccagcttggagctgttcatgtatctcaacgaggtggccggcaagcacggcgtcggcaggatcgacatcgttgaaaaccgcttcatcgggatgaaatctagagggatctacgaaacacccgccgggacaatcttgtaccatgcacatctcgatatcgaagcattcaccatggacagagaagtgagaaagatcaagcaaggccttggacttaaattcgctgagctggtgtacaccggcttctggcattctcccgagtgcgaatttgtgaggcattgcattgccaaaagccaggagcgcgttgaaggaaaagtccaagtctccgttctcaaaggacaagtttatattctcggtcgggagtcaccgcttagcttgtataacgaggaactggtgagcatgaacgtccaaggtgactacgagccaactgatgccaccgggtttattaatataaacagcttgcgtttgaaagagtatcacagactgcagtcgaaggtgactgcaaaa

SEQ ID NO: 6948 - DNA, 1236 bp, Artificial Sequence
  Description of Artificial Sequence: Synthetic coding sequence
atgtcctcaaagggctccgtcgtgcttgcctactccggtggacttgatacctcctgtatcctggtgtggctgaaggaacagggctacgacgtgattgcctacctcgcaaacattggacaaaaggaagattttgaagaagcaaggaagaaagcactcaagctgggggctaagaaggtgttcatagaggatgtgagccgggaattcgtggaagagtttatctggcctgcaatccaatcgtccgcactctatgaggatagatacctccttggtacctcgcttgcacgcccgtgtattgcaagaaaacaggtggaaatcgctcaacgtgaaggggccaagtacgtgtcgcatggagccaccggaaagggtaacgaccaggtccgattcgaactgagctgttacagccttgcaccccagatcaaggtgattgcaccctggaggatgccggaattctataaccggttcaaaggtaggaacgacctgatggaatacgcaaaacaacatggaattccaatcccggtgactccaaagaatccctggagcatggatgaaaatcttatgcacatttcatacgaggcgggaattcttgaaaacccgaagaaccaagcgccaccaggcctttacaccaagactcaagatcccgcaaaggcaccgaacacgccagatattctggagatcgagtttaagaagggcgtccccgtcaaggtgactaacgtcaaggatggtacgacccaccaaacctcgctggagttgttcatgtaccttaacgaggtagctggaaaacatggtgtgggaagaatagacattgtggaaaatcgctttatcggaatgaaaagccgcggcatctacgaaaccccggcagggactatactttatcatgcacatcttgacattgaagcgtttaccatggatagagaagtccggaaaatcaaacagggattgggtcttaagtttgctgaactggtgtacaccggtttctggcatagtccggaatgcgaatttgtgagacattgcatcgcaaaatcccaggagcgcgtcgaaggaaaagtgcaagtgtcagtgctgaagggacaggtgtacatactcgggagagaatcccccctctcactttacaacgaagaacttgtttccatgaacgttcaaggcgactacgagcctactgatgccactgggtttatcaacattaactccctgcgtcttaaggaataccatcgtctgcagtcaaaggtcaccgccaag

SEQ ID NO: 6949 - DNA, 1236 bp, Artificial Sequence
  Description of Artificial Sequence: Synthetic coding sequence
atgtcatccaaaggttcggtggtgcttgcctactcaggtggacttgatacttcctgtattttggtgtggcttaaagaacaaggttacgatgtgatcgcgtaccttgcgaacattggacaaaaagaagattttgaggaggcaaggaaaaaagctctgaaacttggggcaaagaaagtctttatcgaagatgtgagccgtgaattcgtggaagaattcatttggccagcaatccaaagttccgcactttacgaagatcggtacctgctggggacctcactggcacgcccctgtattgcacggaagcaggtggagatagcacaaagagagggtgcgaagtacgttagccatggagcaacgggaaagggcaacgatcaagtgagatttgagctctcatgttactcccttgccccccagatcaaagtgatagcgccctggagaatgcctgaattctacaatcgattcaagggcagaaacgatctgatggaatatgcgaaacaacacgggattcctatccccgttactcctaagaatccttggagcatggatgaaaacctgatgcacatttcatacgaggcagggattctggagaaccccaagaatcaggctccaccaggtctttacactaagacgcaagacccagcaaaggcaccaaacactccagatattcttgaaattgagttcaagaagggtgtgcctgtcaaggtgaccaacgtgaaggacgggactacccatcaaacctcacttgaattgtttatgtaccttaacgaggtggccggaaagcatggtgtgggccgcattgatattgtggagaacagattcatcggaatgaagtcccgaggaatctacgagactccggcaggaactattctttaccatgcgcatctggacatagaagccttcactatggatcgtgaagtgcgcaagattaagcaaggcctcgggctcaaatttgcggaactcgtctacaccgggttttggcattcgcctgagtgtgagtttgtgaggcattgtatcgctaaatcccaggaacgggtggagggtaaggtgcaggtcagcgtcctgaagggtcaggtgtacatcctgggtagggaatcgccactcagtttgtataatgaggaactcgtgtcgatgaacgtccagggcgattacgaacctaccgacgcaacggggttcatcaatatcaatagcctgcgcctcaaagaatatcatcgcctgcaaagcaaggtgacggctaag

SEQ ID NO: 6950 - DNA, 1236 bp, Artificial Sequence
  Description of Artificial Sequence: Synthetic coding sequence
atgtcctcaaaagggagcgtggttctggcatatagcgggggtctggatacttcctgtattcttgtctggctgaaggagcaggggtacgacgtgatcgcatacctcgcaaacattgggcaaaaggaagatttcgaagaagcaaggaagaaggcacttaagctgggtgcaaagaaagtctttatagaggacgtgtcgagggagttcgtggaagaattcatctggccagctattcaatcttctgcgctctatgaggatcgatacctcctcggtacctcccttgccaggccatgtatcgcaaggaaacaggtggaaatcgcacaaagagaaggcgctaagtacgtgtcgcatggcgcgaccgggaagggaaacgatcaggtgagattcgaattgtcctgctacagcctggcgcctcagattaaggtcatcgcaccctggcggatgccagaattctacaaccggtttaaaggaagaaacgatcttatggaatacgcaaagcaacacggaattcctattcccgtcacgccgaagaatccttggtctatggacgaaaatctcatgcatattagctacgaggcaggaatacttgagaatcctaagaatcaagcgcctcccggattgtacactaaaacccaagatcctgccaaggcacctaataccccagatattctggaaattgagtttaagaagggagtgccagtgaaggtcaccaatgtcaaagacggcaccactcatcaaacctcactggaattgtttatgtacttgaatgaggtggccgggaaacatggagtgggacgcattgacatcgtggaaaacaggttcatcgggatgaaatcgcgtgggatctacgaaacccccgccggaactatcctgtaccatgcccatcttgacattgaggcatttacgatggatagagaagtcagaaagattaaacagggattgggccttaagtttgctgaacttgtgtatactggcttctggcactcgccagaatgcgagtttgttcggcactgtattgcaaagtcacaagaaagggtggagggaaaggtccaagtttccgtgttgaagggacaggtgtacatactggggcgcgaatcccctctctccctgtacaacgaggaactggtcagcatgaacgtgcagggtgattacgagccaactgatgcaactgggtttatcaacatcaactcacttcgtcttaaggagtaccatcgccttcaatcgaaggtcactgcgaag

SEQ ID NO: 6951 - DNA, 1236 bp, Artificial Sequence
  Description of Artificial Sequence: Synthetic coding sequence
atgtcctccaaagggagcgttgtgttggcatactctggaggcctggacaccagctgcatcctggtttggttaaaggagcagggttacgatgtgatcgcatatttggctaatatcggacagaaggaggactttgaggaggcgaggaaaaaagcgctgaaattgggggcaaagaaagtttttattgaagacgttagcagagaattcgtggaagagtttatttggccggctattcaaagcagtgcattgtacgaagatagataccttttaggaacgtcactggccaggccatgtatcgcccgtaaacaggtggaaattgctcaacgcgagggggccaagtacgtgagccatggtgcgaccggtaagggcaatgatcaggtgcgatttgaactgtcgtgctatagtctggccccacagataaaagttatcgccccttggcggatgccagaattctacaaccggttcaaaggacggaatgatcttatggagtatgcgaagcagcacggcattcctatcccggtgaccccgaaaaatccctggtccatggatgaaaacctcatgcatattagctatgaggccggaattctcgaaaaccccaaaaaccaggcccccccaggtctctacactaagactcaggacccggcgaaagcccctaacacacctgacatcttggaaattgaattcaagaagggtgtgccagttaaggtcacaaacgttaaggatggcacaacccatcagacgtctctggagctctttatgtatctcaatgaagttgcaggaaagcacggcgtaggaagaattgacatcgtggaaaataggttcatcggcatgaagtctcgcggaatatatgagactccagccggcactattctctaccacgcccacctagacatcgaggctttcacaatggaccgcgaagtccgcaagatcaagcaaggcctgggtctgaagtttgcggaactggtctacaccgggttctggcatagccccgaatgtgagttcgtccgacattgcatcgccaagtcccaggaacgtgtcgagggtaaagtgcaggtctcagttctcaaggggcaggtctacatcctgggccgcgagtccccattatccctgtataatgaggagttggtttctatgaatgtgcagggtgattatgagcctacagatgccaccggtttcatcaacatcaatagcctacgcctcaaagaataccacaggctacagagtaaggtgactgccaaa

SEQ ID NO: 6952 - DNA, 1236 bp, Artificial Sequence
  Description of Artificial Sequence: Synthetic coding sequence
atgagctcaaagggatccgtggtgctcgcctactccgggggcctagacacatcgtgcatcctggtgtggctgaaggagcagggatatgatgtaatcgcttacctggcaaacatcgggcaaaaggaagacttcgaggaagcaagaaagaaagctctgaaactgggcgcaaaaaaggtattcatagaggacgtgtccagggaatttgtggaggaatttatctggcccgctatccagtccagcgcgttgtatgaagatcggtacctattaggcacaagcctcgctagaccctgtatcgcgagaaagcaggtcgagatcgcgcagcgtgagggagccaagtacgttagccacggcgctaccggcaagggtaacgatcaggtaaggttcgaactgtcatgctatagcctggctccccaaattaaggttattgcaccctggcgtatgccagagttttacaaccgcttcaaagggcggaatgatttgatggaatacgccaaacagcacggaatccccattcccgttactcctaagaatccgtggtcaatggatgagaacttgatgcatatatcctatgaggctggaatcttagaaaatcctaagaaccaggctccaccaggactctatacaaagactcaggaccctgccaaggctccaaacacaccagacattctcgagatcgaatttaaaaagggcgtacctgtaaaggtgaccaatgtaaaagacggtactactcatcagacctcactggagctcttcatgtatttgaacgaagtcgcgggcaagcatggcgtcggacgaattgatattgtggagaatagattcattgggatgaagtcacgtggcatctatgaaacacctgccggaactatactgtaccacgcacacctggatattgaggccttcaccatggatcgggaagtaagaaagatcaagcagggtttgggcctcaagttcgcagaactggtttacactggattttggcactcaccagagtgcgagtttgtacggcattgcattgccaagagccaggagcgtgtggagggtaaagtgcaggtgtccgtcctaaaggggcaggtttatattcttggcagggagtccccattgtcactgtacaatgaggagctcgtctccatgaatgttcagggagactacgagccgacggatgccacaggattcattaacattaacagcctgcggctgaaggaatatcaccgccttcagagtaaagtcacagccaaa

SEQ ID NO: 6953 - DNA, 1236 bp, Artificial Sequence
  Description of Artificial Sequence: Synthetic coding sequence
atgtcatccaaaggttcagtggtgctggcgtactccggaggactggacacctcgtgcatcctggtgtggctgaaggagcagggatacgatgtgatcgcatacttggcgaacatcggacagaaggaagatttcgaagaagcccggaagaaggcactgaagctgggcgccaaaaaagtctttatcgaggacgtgtcccgggaattcgtggaggaattcatttggcccgcgatccaatcaagcgcactgtatgaagatcgctacctcttgggaacctccctcgcgcgcccctgcatcgcacggaaacaggtggaaatcgcccagagggaaggggcgaagtacgtcagccatggcgcaaccggcaaaggaaatgatcaggtgcgcttcgagctgtcgtgctactcactggctccgcagatcaaagtgattgccccttggcggatgccggagttctacaatcgcttcaaggggcgcaatgatcttatggaatacgctaagcagcatggcatcccgatcccggtgaccccgaaaaacccatggtccatggacgagaatctcatgcatatttcctacgaggctggcattctggagaaccccaagaaccaagcgcctccgggcctgtacaccaagactcaagaccctgctaaggccccaaacaccccggacatcctggaaattgagttcaaaaagggcgttccggtgaaggttactaacgtgaaggacgggactacccatcagaccagccttgagcttttcatgtacctgaatgaggtcgcgggcaagcacggggtcggacggattgacatcgtggagaacaggtttatcggcatgaagagccggggtatctacgaaacccctgccgggactatcctgtaccacgcccacctggacatcgaggcctttactatggacagggaggtgagaaagattaagcagggactcggactgaaattcgcagagctcgtgtacacggggttctggcattcgcctgagtgtgaattcgtcaggcattgcatcgcaaagagccaagaaagggtggaaggaaaagtgcaggtttccgtgttgaagggacaagtgtacatcctcgggcgcgagtccccactctcactttacaatgaagagctcgtctcgatgaacgtccaaggagactacgaaccgaccgatgctactggattcatcaatatcaattcactgaggttgaaagaatatcaccgcctgcaatccaaggtgaccgctaaa

SEQ ID NO: 6954 - DNA, 1236 bp, Artificial Sequence
  Description of Artificial Sequence: Synthetic coding sequence
atgtccagcaaaggatcggtagtactggcctatagcggagggctggacacctcttgcatcctggtttggttgaaggaacagggttacgatgtgatagcctatctggcgaatataggccagaaggaagattttgaggaagcacgaaagaaagcccttaaactaggtgccaaaaaagtcttcatcgaagatgtatcccgcgagtttgtcgaggagttcatttggcctgcaatacagtcttccgctctgtacgaggaccggtatttgttgggtacctccctagcacgaccttgcatagcccggaagcaagtggagatagcacagcgggaaggcgccaagtatgtgagccatggagccacaggcaaaggtaatgatcaggttagatttgagctatcttgctattcgctggcccctcagatcaaagtaattgcaccctggcgcatgcctgagttctacaatcgcttcaagggacggaacgacctgatggagtacgctaagcagcacggcattcccatccccgtaactcctaagaatccttggagtatggatgagaacctgatgcatatcagctatgaggccgggatcttagagaacccgaagaatcaggccccgcccggcttatacacgaagacccaagatcctgccaaggcgcccaacacccctgacattctcgagatcgagtttaagaaaggagtgccagtaaaggtgaccaacgtcaaagacgggacaacccaccagacctctcttgagctttttatgtacctgaacgaagttgctggaaagcacggagtgggacggatcgatatcgtagagaatcgtttcataggtatgaaatctcggggaatttatgagacccccgccgggactattctgtaccatgcacacttggacattgaggcatttacaatggatagagaggtacgcaagatcaagcaagggttgggattgaaatttgccgagctggtgtacacgggtttttggcactcccctgaatgtgaattcgtgaggcattgtatcgcgaaatcccaggagcgcgtcgaagggaaagtccaagtgagcgtgctcaaaggacaagtctacatactgggacgagagtcacctctgtcgttgtataatgaggaattggtcagcatgaatgtacaaggcgactacgaacctaccgatgccaccgggttcatcaacattaattctctccgactgaaggagtatcatcgcctgcagtctaaggttaccgccaaa

SEQ ID NO: 6955 - DNA, 1236 bp, Artificial Sequence
  Description of Artificial Sequence: Synthetic coding sequence
atgtcaagcaaagggagcgtcgtgctggcttatagcggggggttagatacctcctgtatcctggtctggttgaaagagcagggctatgacgttattgcctacttggctaacattggccagaaggaggacttcgaggaagccagaaaaaaggcgctcaagcttggagctaagaaagtctttatcgaagatgtgtctcgcgagttcgtggaggaattcatttggccagcaatccagtctagcgcactgtacgaggacaggtacctcttgggtaccagccttgcacggccgtgcatagctcggaagcaggtggagatcgctcaaagggagggtgcaaaatacgtgtctcacggagccactggcaagggcaacgatcaggtacgcttcgagctgtcgtgttattctttagcccctcagattaaggttattgcaccatggaggatgcctgagttttacaacaggttcaagggcaggaacgatttaatggaatatgcaaaacagcacggcatcccaattcccgtgacccccaagaatccatggtccatggacgagaatttgatgcacatcagctacgaggcaggaattttggagaatcccaagaaccaagccccccctgggctatacacaaaaactcaggatcctgccaaggcacccaacacacctgacattctggagatagagttcaagaagggcgtgcctgttaaggtgaccaacgtgaaagatgggacaacacaccagactagtctggaactgttcatgtaccttaatgaggttgccggcaagcatggggttggaagaatcgacatcgtagagaaccggtttattggaatgaagtcacgcggcatctacgagactcccgcgggaacaatactgtaccacgcacacctggacatcgaagcctttaccatggaccgcgaggtcagaaaaataaaacagggcctgggcttgaaattcgctgagcttgtgtatacaggtttctggcacagtccagaatgcgagtttgttcgacactgtatcgcaaaatcccaggagcgcgtggaaggcaaagtgcaagtgagtgtacttaaagggcaggtttatatcctagggagggagtcgccactttccctgtacaacgaggagctggtatcgatgaacgttcagggggactacgagccaaccgatgctaccggatttatcaacattaacagtttaaggcttaaggagtaccataggctgcagtctaaggtgacagcaaag

SEQ ID NO: 6956 - DNA, 1236 bp, Artificial Sequence
  Description of Artificial Sequence: Synthetic coding sequence
atgtcatctaagggaagcgtggtacttgcctactccggcgggttggacactagttgtattctcgtatggctcaaggagcagggttacgacgtcatcgcttacttagctaatatcggccagaaagaggatttcgaagaagcccgtaagaaagcactgaagcttggtgccaaaaaggtcttcatcgaggatgtgagtcgagaattcgtcgaggagtttatatggcccgccatccagtccagcgcgctgtacgaagatagatacctcttgggcacaagtctagccaggccttgcattgccaggaagcaggtagaaatagcccagcgggagggggccaagtacgtatcacacggagcaaccggtaagggtaatgatcaggtgcggttcgaactgagttgttactctttagctccccagatcaaagtgatcgctccttggagaatgcctgagttttacaatcggtttaaaggacgcaacgatcttatggagtatgccaagcagcacggaatccctatccccgttacacctaaaaatccatggagtatggatgagaatctgatgcatatatcttacgaagctggcatattggagaaccctaagaatcaggcaccacctgggctctacacaaagactcaggatccagctaaggcccccaacacacctgacattctggagatcgaattcaagaaaggcgtgcctgtgaaagtcactaatgtgaaagacggtaccacccatcagacctcacttgagctattcatgtacctcaatgaggtggctgggaaacatggagttggaaggatcgatattgtggagaacagatttattggaatgaagtctcggggaatttacgaaacgcctgcagggactattctgtatcatgcccatcttgatattgaagccttcaccatggaccgggaggtaaggaagataaagcaggggttgggacttaagttcgccgaactcgtgtacactggattttggcattcacctgagtgcgagttcgtgcgacattgcatcgccaagtcccaggaacgagtggagggtaaagttcaggtgtcagtcctcaaaggacaggtgtacatccttgggagggagtcccccctgagcttatacaatgaggagctcgtgtctatgaacgtgcagggagattatgaacctactgacgcaaccggattcattaacatcaacagtctgcgattgaaggagtaccaccgtctgcagagtaaagttacagccaag

SEQ ID NO: 6957 - DNA, 1236 bp, Artificial Sequence
  Description of Artificial Sequence: Synthetic coding sequence
atgagcagcaaaggatcggtggtgctcgcgtactcgggcggcctggatacttcctgtattctggtgtggctcaaggaacaaggctacgatgtaatcgcctatctcgctaacatcggccaaaaggaggacttcgaggaagcccgaaagaaggccctcaagctgggtgcgaagaaagtgttcatcgaggacgtctcccgcgaattcgtggaagaattcatttggccagcgatccagagctctgcgctgtacgaagatcggtaccttctcggaacctccctcgctagaccatgcatcgctaggaaacaagtcgaaatcgctcagcgcgagggagctaagtacgtgtcgcacggagcaaccggaaagggaaacgatcaggtccggttcgagctgtcctgctactcgctcgccccacagatcaaagtgatcgcgccgtggaggatgccagaattctacaatcggtttaaggggagaaacgaccttatggaatacgccaaacagcatggaatcccgatcccggtgacccctaagaacccgtggtccatggacgagaacctgatgcacatctcctacgaggcgggaatcctcgaaaatccaaagaatcaggcccctccgggattgtacactaagacccaggacccggccaaggctcctaacaccccagatatcctggaaatcgaattcaagaagggtgtgccggtcaaagttaccaatgtgaaggacggaaccactcaccagacttcactcgaattgttcatgtacctgaacgaagtggcagggaagcatggagtgggcagaatcgacatcgtggagaataggtttatcggaatgaagtccaggggtatctacgaaaccccagccggaacgatcctctaccatgcgcacctcgacatcgaagcgttcaccatggaccgcgaggtcaggaagattaaacagggattgggactgaaatttgcggaacttgtgtacactggattttggcattcgcctgaatgtgagttcgtgcggcattgcattgccaagagccaagagcgggtggagggcaaggtccaggtgtcagtgctgaaagggcaagtgtacattctcgggcgtgaatccccactcagtctgtacaacgaagagctggtgtccatgaacgtgcaaggagactacgaaccaaccgatgctactggtttcatcaacatcaactccctgcggctgaaggaataccatcggctgcagtctaaagtcaccgcaaag

SEQ ID NO: 6958 - DNA, 1236 bp, Artificial Sequence
  Description of Artificial Sequence: Synthetic coding sequence
atgagctcgaagggcagcgtcgtcctggcttactcaggtggactggatacttcatgtatcttggtttggctcaaggagcagggctacgatgtgatcgcgtacctcgccaacatcggccagaaggaagatttcgaagaggcacgcaagaaagccctgaaactgggagctaaaaaggtgttcatcgaggacgtgtcgcgggaattcgtggaagagttcatttggccggcgatccaatcctcagcactgtacgaggaccgctacctccttggtacctccctcgccagaccctgcatagctcgcaagcaggtcgaaatagcccagcgggaaggcgcgaagtatgtgtcccatggcgctaccggaaaagggaacgaccaggtacgctttgagctgtcctgttactccctggcaccccaaatcaaggtgatcgccccttggcggatgcctgagttctataaccggttcaagggtcgaaacgatctgatggaatacgctaagcaacacggtattccgattcctgtcaccccgaagaacccttggtctatggatgagaatctgatgcacatctcctacgaggcggggattcttgagaaccccaagaaccaggccccaccaggtctttatactaaaacccaagacccggccaaggcccctaataccccggacatcttggaaatcgagtttaagaagggcgtgccggtgaaagtgactaacgtcaaggacggaactacccatcaaactagtctcgaacttttcatgtacctgaatgaggttgccggcaagcacggggtgggacggatcgacatcgtggaaaacaggtttattggtatgaaaagcaggggaatctacgaaacgccggcaggaactatcctctaccacgctcacctggacatcgaggccttcactatggatcgcgaggtgagaaagatcaagcaaggccttgggttgaagttcgccgaacttgtatacaccggattttggcattctccagaatgcgaattcgtgagacattgtatcgcgaagagccaggagcgagtggaaggaaaagtccaagtttcggtcctgaaaggtcaggtctacattcttggaagggagtcaccgctgagcctctacaacgaagagctggtgtcgatgaatgtgcagggagactacgagccaaccgacgcgactggattcatcaatatcaattcgttgcgcctcaaggaataccaccgccttcagtccaaggtcacggcgaaa

SEQ ID NO: 6959 - DNA, 1236 bp, Artificial Sequence; identical to SEQ ID NO: 6911
  Description of Artificial Sequence: Synthetic coding sequence

SEQ ID NO: 6960 - DNA, 1236 bp, Artificial Sequence
  Description of Artificial Sequence: Synthetic coding sequence
atgtcgagtaagggttcggtggtcctggcatactcggggggattggatacttcgtgtattctggtgtggctcaaggaacaggggtacgatgtgattgcctaccttgctaacattgggcagaaagaggactttgaagaagcgagaaagaaggctcttaagctcggagcaaagaaggtctttattgaggatgtgtcaagggaatttgtagaagagttcatctggcccgcaatccagtcgtccgcactgtacgaggatcgctacctcctcggtaccagccttgcgcggccttgtatcgcccggaaacaagttgaaattgcgcaacgagagggagcaaagtacgtcagccacggagcaaccggaaaaggaaacgaccaagtgcgatttgaactttcatgttacagtctggcccctcagattaaagtgatcgccccgtggcgcatgcctgaattctataacagatttaagggaagaaacgatttgatggaatacgcaaaacagcatggaattccaattcctgtcactccgaagaacccgtggtccatggacgaaaatctgatgcatatctcctacgaggccggaatcctggaaaatccaaaaaaccaagcacccccaggcctttacaccaagacccaagatccagctaaggcccccaatactccagatatcctggagatagagtttaagaagggagtcccagtaaaggtgaccaatgttaaagacggcacgactcatcagaccagcctcgagcttttcatgtatctgaatgaagtggcgggaaaacatggagtaggtcgcatcgatattgtcgaaaaccgttttatcggcatgaagagcaggggtatatacgagacgccagcaggtaccatcctgtaccacgcacaccttgatatcgaagcatttactatggatcgggaagtccgcaaaatcaagcagggtctgggcttgaaattcgcagagcttgtgtatactggcttctggcattcacctgagtgcgaattcgtgagacattgcattgcaaagtcccaagaacgcgtggaaggtaaagtgcaagtgtcagtgctcaaggggcaagtctacatacttggcagagagtcccctttgtcgctgtacaacgaagagctcgtctcaatgaatgtgcaaggagattacgaaccaacggacgcaactgggtttatcaacattaactccctcaggctcaaggaataccacaggctccaatcgaaagtcactgccaag

SEQ ID NO: 6961 - DNA, 1236 bp, Artificial Sequence
  Description of Artificial Sequence: Synthetic coding sequence
atgtcgtctaaaggaagcgttgtgctggcctattcagggggcctagacacttcatgcatcctggtttggctcaaagaacagggatatgatgtgattgcctatttggctaacatcggacagaaagaggacttcgaagaagcccgcaaaaaggcgctaaagctgggcgccaagaaagtgtttattgaggatgtctcaagggagtttgtcgaagagtttatatggccagctatacaatccagcgccctatacgaggatcggtacctgctgggcacaagccttgctcggccttgtattgcgaggaagcaagttgaaatcgcacagcgggaaggagcaaaatacgtaagccacggcgctaccggcaagggcaacgaccaagtgagattcgagctatcgtgttactccctcgccccacagatcaaggtgatcgcaccttggagaatgcccgaattctataacaggtttaagggcagaaatgatctcatggaatacgccaagcagcatggtattcccatcccagtgacaccaaaaaacccctggagtatggacgaaaatttaatgcacatctcttacgaggcaggcatcttagagaatcctaagaaccaagcccctccaggcttgtacaccaagacgcaagatccagccaaggcacccaatactccagacatactggagatcgagttcaagaaaggggttcccgtcaaagttactaatgttaaagacggcacaacccatcagacttctctggagctgttcatgtacttaaatgaagttgctggcaaacacggcgtgggcagaatcgatatcgtggagaataggttcatcggcatgaaatctcgaggaatctacgagactcctgccggaacgatcctttaccacgcccatcttgacatcgaggcctttacaatggaccgcgaagtccgtaagatcaagcaaggcttggggttgaaatttgcggaactggtctataccggtttttggcactcacccgagtgtgaattcgtccgacattgtatagccaagagccaggagagggtcgaggggaaggtccaggtgtctgtgctgaagggacaggtctatatcctgggacgcgagtcccccctctctctttacaacgaggagctggtgagcatgaacgtccagggtgactatgagcccacagatgccacagggtttattaacattaactctctgcggctaaaagaatatcacagactacagtccaaggttactgccaag

SEQ ID NO: 6962 - DNA, 1236 bp, Artificial Sequence
  Description of Artificial Sequence: Synthetic coding sequence
atgtcgtcgaagggatcggtggtgctggcatacagcggaggacttgatactagctgtattctggtgtggctgaaagagcaaggctacgacgtgatcgcgtacctcgcaaacatcgggcagaaggaagattttgaagaagcgagaaagaaggctctcaagctgggtgcgaaaaaagtgttcatcgaggatgtctcccgcgaatttgtcgaggaattcatctggccagccatccagtcgtcggccctgtatgaggaccgctacctcctcggtacctccctggctcgcccgtgcattgcccggaaacaagttgaaatagcccagcgagaaggagcgaagtatgtcagccatggtgccacgggaaaaggtaacgaccaggtccgcttcgagctgagctgctacagcttggctccacaaatcaaggttatcgcgccctggcggatgccagagttctacaaccggttcaagggtcgcaatgaccttatggagtacgcgaagcagcatggaatcccaatcccagtgaccccgaaaaacccatggtccatggatgaaaatctcatgcacatcagttacgaggccggaatcctggagaacccgaagaatcaagctcctccgggactgtacactaaaactcaggacccggccaaagcgccgaataccccagacattttggagatcgaatttaagaagggcgtgcctgtgaaggtcaccaacgtgaaagacgggaccacgcaccagacctcactggagctgttcatgtacttgaacgaggtggccgggaagcatggtgtgggacgtatcgatatcgttgaaaatagattcattggaatgaagtcgcggggaatctatgagactccggctggtacgattctgtaccacgcccatctggacatcgaagcctttactatggacagggaagttcggaagataaagcaaggattgggactgaaattcgcggagctggtttacactgggttctggcacagccctgagtgtgaattcgttcgacactgcattgcgaaatcacaggagagagtggaaggcaaggtgcaggtcagcgtactgaaaggccaagtgtacatcctggggagagaatcaccgctctctctgtacaacgaagaactcgtgtccatgaacgtccagggggattacgaaccgaccgatgccaccggcttcatcaacatcaactccctgcgtctcaaggaataccacagacttcagtccaaagtcaccgccaaa

SEQ ID NO: 6963 - DNA, 1236 bp, Artificial Sequence
  Description of Artificial Sequence: Synthetic coding sequence
atgagttccaaaggcagtgtcgtgctcgcttattcagggggacttgacacctcgtgcattctcgtgtggctgaaggaacaggggtatgacgtgattgcctatctggcaaacattggccagaaggaggacttcgaagaggccagaaaaaaagcgctaaaactgggggcgaagaaagtgtttatcgaggatgtgtccagagagtttgtagaagagtttatttggcctgccatacagagtagcgccctgtacgaggatcgctatttactgggaacgtctctggccagaccatgtatcgcacgcaagcaagtggagatcgctcagcgtgagggcgccaaatatgtgagtcacggggcaactggtaaggggaacgatcaggtccgctttgaactcagttgttattcacttgcacctcaaatcaaagtcatcgccccctggcggatgccagaattctataatcgcttcaaagggcggaacgacctgatggagtatgcaaagcaacacggaatccccattccagtaactcctaaaaatccctggtctatggacgagaaccttatgcacatatcctatgaggctggcattctcgaaaatccaaaaaaccaggccccccctggcctctatacgaaaacccaggatcctgccaaggcacctaatactccagacattttggagattgaattcaaaaagggtgtgcctgtcaaggtgactaacgtcaaagacgggacaactcaccagacttccctcgaactctttatgtacctgaatgaagtggctggaaagcacggggtcggtcgcatcgatatagtggagaatagattcatcggcatgaaatcgcgcggtatatatgagacgccagcaggtaccattctgtatcatgcacacttggatatcgaggcctttactatggatagagaggtccgcaagataaagcaagggctgggcctgaagtttgccgaacttgtttacactggcttttggcacagccccgaatgtgagtttgtgcgacattgcatcgcaaagtcccaggagagagtcgaaggcaaagtgcaggtctctgtgctgaagggccaggtatacatcttgggcagagaaagtcccctcagtctttacaatgaggaactcgtttcaatgaacgttcagggggattacgagccaactgatgccactggctttatcaatataaattctttgcgtctgaaagagtaccataggcttcaatcgaaagttactgcaaag

SEQ ID NO: 6964 - DNA, 660 bp, Artificial Sequence
  Description of Artificial Sequence: Synthetic coding sequence
atggagctgggcctaggcggcctcagcactctcagtcattgcccatggccacggcagcaaccagccctgtggcccaccttggcggcgcttgcactgctgagcagcgtggcggaagcaagcttgggatcagccccccgctcacctgcaccgcgcgaaggtccgcccccagtgttggcgtctcctgccgggcacctgcccggaggacgaacagctagatggtgtagcgggcgggccaggagacccccccctcaaccaagtcgacctgcaccccccccgcctgccccaccctccgccctgcctagaggtggcagggccgctcgggcaggcgggccggggtcacgcgctcgggccgccggggcccggggctgtaggctgcgctcacagctggtgccagtgagggcccttgggcttggacatcgctcagatgagctcgtcagattccgcttctgctccggtagctgtcggagagcccggtcgccacacgacctttccctagcctcactcctgggggctggcgccttaagaccacctcccgggtctagacctgtcagccagccttgctgtcgccccacgaggtatgaagcggtgagctttatggacgtcaattcaacatggaggaccgtggataggctctcagcgaccgcgtgtggatgcctcggg

SEQ ID NO: 6965 - DNA, 660 bp, Artificial Sequence
  Description of Artificial Sequence: Synthetic coding sequence
atggaactgggacttgggggactgtcgaccctttcccactgcccctggccccgccaacagcctgcactctggcctaccctggcagcactggcactgctgtcgtcagtggcagaagcatcgcttggatcggcccctcgttcccctgcacctagagaaggacctccgcctgtgcttgcctcgccagcaggacaccttcccggtggccgcactgccagatggtgctccggtcgcgcgcggcgccctcctccacaaccttcaagacctgcaccaccacccccagcaccaccatctgcgttgcctcgtggggggcgagcagcgcgagcaggtggacctggtagccgtgcccgagccgcaggtgcaaggggttgtagacttagatcgcaactggtgcccgtgcgcgcactgggactgggtcacagatcggacgagctggtgagattccggttttgcagcggcagctgcagacgagctagaagcccccacgatctctcacttgcatcgcttcttggagcaggggctctgaggcctccccctggctcccggcctgtctcccagccatgctgtcgacctactcgttacgaagctgtgagctttatggatgtgaactcaacttggcgcaccgtggatagactctccgcgacggcatgtggatgccttggc

SEQ ID NO: 6966 - DNA, 660 bp, Artificial Sequence
  Description of Artificial Sequence: Synthetic coding sequence
atggagctcggactgggaggactttcaacgctttcgcactgtccatggccaagacagcaaccagcgctttggcccacgcttgctgctcttgcccttctgtcctcagtcgccgaagccagcctgggctcggccccgagatccccggcgcctcgggaagggcctcctccggttttggcatcaccagcgggccacctgcccggagggaggactgctaggtggtgctcaggcagagcccgccgcccaccgccacaaccaagccgcccagcacctccacctccggccccgccttcggccctcccacgcggaggcagagcagccagagccggagggccagggtcgcgggccagggcggcgggcgctcgcggatgccgcctgaggtcccagctcgtgcctgtccgcgcactcgggctgggccaccggagcgatgaactggtgcgctttcgcttctgcagcggatcgtgtcgtcgcgctcgctcgccgcatgatctgtcgctcgcgtcacttttgggcgccggcgcactgcgcccaccgccgggatcgcggcccgtcagtcagccgtgctgccggcccactaggtacgaggccgtgagctttatggacgtgaactccacctggcggaccgttgacagactgtcggctaccgcttgtggatgcctcgga

SEQ ID NO: 6967 - DNA, 660 bp, Artificial Sequence
  Description of Artificial Sequence: Synthetic coding sequence
atggagttggggctgggggggctaagtactttaagccactgtccctggccccgacagcagccagcactgtggccaacactggcagctctggcactgctttcctctgtggccgaggccagcctgggcagcgctcctaggtcccccgccccccgcgaagggccacctcccgtgctcgcctcgccagctgggcatctgccaggcggccgtaccgccagatggtgcagcgggagagcccgcaggcctccgccccagccatctcggccagctcccccaccccccgcccctccaagtgccttgcctcgaggagggagagccgcccgggccggtggccctggcagtcgcgcccgggcggcaggggctagaggctgtcgcctgcggagccagcttgttccagtccgcgcattggggttgggacatagatccgacgaactcgtgaggttccggttctgttcagggagttgtaggcgcgcacgctctcctcacgatctatctttagcgtcccttctcggcgccggggccctcagaccacccccaggttctcgtcctgtctctcaaccatgctgtaggccaacccgctacgaagcagtgagttttatggatgtcaattcgacttggcggaccgtggacagactttctgcaactgcttgcgggtgtcttggc

SEQ ID NO: 6968 - DNA, 660 bp, Artificial Sequence
  Description of Artificial Sequence: Synthetic coding sequence
atggaactgggactcgggggactctcaaccctgtcccactgcccatggccaagacagcagcctgcactgtggccaaccctcgccgcgctcgcacttctctcctccgtggcggaagcctcgttggggtctgcccctagatcgccggcgccacgcgaaggaccgccgccggtgctggcatcaccggcaggacacctgccaggcgggcgcactgcacgctggtgctcaggccgggcgagacggccgccgcctcaaccatcccgaccggccccaccgcccccagccccgccgtccgcgctgcctcgagggggccgcgcagctagggcaggcggacctggaagcagggcgagagcagccggagcgcgcggctgcaggctgagatcgcagcttgtcccggtgagagcactgggattgggccacagatcggacgaactggtccgcttccgcttctgcagcggttcgtgcaggcgcgcgagatccccacatgacctgtccctggcctcactgctgggcgccggtgctctgcgccctccgcccgggtcgcgcccagtcagccagccgtgctgtcgaccaacccgctatgaggctgtgtcctttatggatgtgaactcgacctggagaaccgtggataggcttagcgccactgcttgtggatgcttggga

SEQ ID NO: 6969 - DNA, 660 bp, Artificial Sequence
  Description of Artificial Sequence: Synthetic coding sequence
atggaacttggactcggagggctttccactctatctcactgtccttggcctaggcagcagccagccctatggccaacattagcagccctcgcactcctcagttcggtagccgaagcctcattggggtctgcacccagaagtcctgccccacgagagggaccaccccccgtcctcgcttctcccgctggacacctccccggggggagaacagcacgatggtgtagtggaagggccagacggcctcctcctcagccctcccgtcctgctccccccccccccgcacctccctctgccctgccacgcggagggagagctgccagggctggagggcctgggagtagggccagagcggctggagcgcgagggtgcagactgcgcagtcagctcgttcctgtgcgagctttaggactgggacatcgaagtgatgaactcgtgcggttccggttttgttccggaagttgtcgaagggccagaagtccgcacgatctcagtctggcgtccctccttggagcgggggctcttaggccacctcccgggtctcggccagtctctcaaccttgctgtcgccccactcggtatgaagctgtgtcttttatggatgtgaactcaacttggaggacagttgatagacttagtgctactgcatgtgggtgcctggga

SEQ ID NO: 6970 - DNA, 660 bp, Artificial Sequence
  Description of Artificial Sequence: Synthetic coding sequence
atggagctaggcctggggggactgtccacattaagtcactgcccatggccgaggcagcagcctgctctgtggcccaccctggccgccctggccctcttgtcctccgtggccgaagcctccctcgggtccgcccctcgcagccctgcaccgcgcgagggcccacctcccgtgctcgcctcgccagcgggtcacctgcccggcggtagaaccgcgagatggtgctcgggtagggcccggagaccgcccccacaaccatcgagacctgctccacccccaccggctccccctagcgcactccccaggggcggacgcgctgcacgggccgggggacctggtagtcgggccagggccgccggcgctagaggatgccggctgaggtcacagctggtgcccgtccgcgccctgggactgggtcaccggagcgatgaattggtgcggttcagattctgttccggaagttgtaggcgtgctcgctccccacatgacctatctctggcttcacttctgggagccggcgccctcagaccaccgccagggtcccggcccgttagccagccgtgttgtcggcctacccgttatgaggcagtgtccttcatggatgtcaacagcacctggagaactgtggaccgcctgtcggcaacggcatgtggttgcctcggc

SEQ ID NO: 6971 - DNA, 660 bp, Artificial Sequence
  Description of Artificial Sequence: Synthetic coding sequence
atggaactggggcttggaggcctgtcaacactgagccattgtccatggccacgacagcaacccgccctgtggccaacattagcagcccttgcgctcctcagttccgtagccgaggccagcctagggtccgccccgcgaagcccggcccccagagaagggccccctcccgtgttggctagcccagcagggcacttaccaggcggaagaacagcccgctggtgttctggaagagcccggcgccctccaccacagcccagcaggcctgctccaccaccccccgcgcccccaagcgcactgccacggggtggacgggcagctcgtgctggagggccgggatctagggcgcgcgcagcaggcgcccggggatgtagactcagatctcagttggtaccagtgagagctctgggtctgggacatagaagcgatgagctggttagattccgattctgtagtgggagctgtagacgagcacgtagcccacacgatttgtccctggccagtctccttggagctggagcactgcgcccaccccccggatcccgtcccgtgagccagccttgttgcaggcccacccgttacgaagcagtatcttttatggatgtgaattctacatggagaacagtggaccgtcttagcgcgaccgcctgcggttgcctcggt

SEQ ID NO: 6972 - DNA, 660 bp, Artificial Sequence
  Description of Artificial Sequence: Synthetic coding sequence
atggagctcggtcttggcggcctgtcaaccctcagccactgtccctggcccagacagcagcccgcactgtggcctacgctagccgccctggcccttctaagctcagtggccgaggcatccttaggttccgcgccgagatcaccagcaccgagagagggccctccacctgtgctagcatcaccggccggtcatctgccgggtggcagaactgcccgatggtgttcagggagagctcgccggcccccccctcagccttcacgcccagcccccccaccacctgcgcctccaagtgctctcccgcggggaggacgggcggcacgggctggaggcccagggtcccgagccagggccgcaggtgcaaggggctgccggttacggtcacaacttgtgcccgtcagagcactcgggttgggacataggtccgacgagctcgtgcgctttagattttgctctgggtcatgcagacgcgcacgtagcccccatgatctgagcttagcctcactgctcggagcgggcgcactgcgcccgccaccgggctcccgtcctgtgtcgcaaccttgctgtcgacccacccggtatgaagctgtatctttcatggatgtcaactcaacctggaggactgtcgatcgcctgagcgccactgcttgcggatgtctcgga

SEQ ID NO: 6973 - DNA, 660 bp, Artificial Sequence
  Description of Artificial Sequence: Synthetic coding sequence
atggagctgggactgggcggactgagtacccttagtcactgtccctggcctaggcagcagcccgccctctggcccactcttgcggcactcgcgctgcttagttccgtggccgaggcctccctagggtcagctcccaggtcccccgccccccgcgaggggcctccccccgtgttagccagccccgccggacaccttccaggggggaggaccgcccggtggtgctccggaagagcacggcgcccgccgccccagccaagtcgaccagcccctcccccacctgcaccaccatctgctcttcctcgcggtgggcgcgcggcccgcgcgggaggacctggctcacgggccagggccgctggggcaagaggctgccggctcagatctcagctcgtgccggtaagagcccttggactcggccatcggtcagacgagctggtccgattcaggttctgctccggcagttgtcggcgcgccaggtccccccacgatttatcactggcatccctcttgggggccggagccctgagacccccccccggcagccggccagtgtcccagccctgttgtaggcccacccgctatgaggcggtatccttcatggacgtgaacagtacctggcgaaccgttgaccggttgtctgctaccgcttgtgggtgcctcgga

SEQ ID NO: 6974 - DNA, 660 bp, Artificial Sequence; identical to SEQ ID NO: 6972
  Description of Artificial Sequence: Synthetic coding sequence

SEQ ID NO: 6975 - DNA, 660 bp, Artificial Sequence
  Description of Artificial Sequence: Synthetic coding sequence
atggagctgggtcttggtggactgtcaactctttcgcactgtccatggccgcgccagcagccagctctgtggcctacccttgccgcactggctttgctctcgtccgtggctgaagcatcgctgggctcagctcctcgttcgcctgccccccgcgaggggcctcctccagtgcttgcatcacctgcaggacatctgccaggtggtcgaaccgccagatggtgtagcggtcgggccagacgtccacccccacagccctcaagaccggcacccccaccgccagccccgccctcagcactccctagaggagggcgcgcagcacgcgcaggaggtccaggaagccgcgctcgagcagcaggtgcccgaggatgtcgacttagatcccagctggtccctgtgagagcactgggactcgggcacagatccgatgagctcgtgcgatttagattctgtagcggatcctgccggagggcacgttcccctcacgatctgtcgctggcatccttgcttggggctggggcccttagacctccccccggaagccgcccggtgtcacaaccatgttgccggccaacgcgctacgaagccgtcagttttatggatgttaactcgacctggcggaccgtggacagactgtcagcaactgcatgcgggtgtttggga

SEQ ID NO: 6976 - DNA, 660 bp, Artificial Sequence
  Description of Artificial Sequence: Synthetic coding sequence
atggagcttgggcttggaggcctctcaaccctgagccactgcccttggccacgccaacaaccagcgctttggccgactctggcggccctggccctgctcagctcagtcgctgaggcctcgctcggatcagcaccgagaagccctgcgccgcgtgaggggccgccccctgtgctggccagcccggccggacacctgcctggcggcagaacggcccggtggtgcagcggaagggcgcgccggcctcccccacagccatccagaccggctcccccgccaccagcaccgccatcagctctgccaagaggaggacgggcagctcgcgccggaggaccaggatcacgtgcccgggctgcgggtgcccggggctgtcgtttgaggtcgcagttggtgccggtgagagccctcggcctggggcatcggtcggatgaactcgtacgcttccgcttctgttccggatcctgcaggcgcgcacggtccccgcacgatctgtccctggcgagtctcctgggcgctggggcacttcgcccgccgccgggatcgcggcccgtgtcccagccttgttgcaggccaacccgctacgaagcggtgtccttcatggacgtgaactccacttggagaactgtcgacagactctcggcgaccgcgtgcggttgccttgga

SEQ ID NO: 6977 - DNA, 660 bp, Artificial Sequence
  Description of Artificial Sequence: Synthetic coding sequence
atggagctgggcctcggcggtttgtccacactgtcacattgcccatggccaaggcagcagcccgcactgtggcccactctggccgctctggctctcctcagtagcgtggccgaggcgagtctcggttccgccccgagatctccggcacccagagagggcccgcctcctgtcctggccagcccggcaggtcacctcccaggcggccgcacagctaggtggtgctcaggaagggcccgcaggcctcccccccaaccttctcgccctgctcccccacctcctgcccctccgtccgcgctccctcgcggaggtagggcggctagagcaggtggaccaggatcaagggctcgcgcagccggagcaaggggctgcaggctcaggagtcaactcgtacccgtgcgcgcactcggtctcggtcatagatctgacgaacttgtgagatttagattctgcagtggctcctgcaggcgcgcaagatcaccccacgatctttctctcgcctccttgcttggcgctggcgccctgagaccacccccgggatctagaccagtctcccagccatgctgcagacccacgaggtacgaagctgtgtcatttatggacgttaactccacttggagaaccgtggacaggctttctgccacagcctgcggctgtttgggc

SEQ ID NO: 6978 - DNA, 660 bp, Artificial Sequence
  Description of Artificial Sequence: Synthetic coding sequence
atggaattaggtttaggaggattatcaacacttagtcattgtccatggccacgtcaacaaccagcactttggccaacattagcagctttagcactattaagttcggttgcagaagcttcattaggttctgctcctagaagtccagctcctagagaaggaccaccaccagttttagcttcaccagcaggacatttaccaggtggaagaacggctagatggtgttctggtagagctagaagacctccacctcaaccatcaaggcctgctcctccaccaccagctccaccaagtgctcttccaagaggaggaagagctgctagagctggaggtccaggatcaagagctagagccgccggtgcaagaggatgtagattaagatctcagcttgtgccagtaagggcacttggtttaggacatagatctgatgaacttgtaagattcagattttgctcaggatcatgtagaagagctagaagtccacatgatttatcattggctagtttgttaggagctggtgcattaagaccaccacctggatccagaccagtatcacaaccatgttgtagaccaacacgatatgaagcagtgtcttttatggatgttaattcaacatggagaacagttgatagattatcagcaacagcatgtggatgtttagga

SEQ ID NO: 6979 - DNA, 660 bp, Artificial Sequence
  Description of Artificial Sequence: Synthetic coding sequence
atggagttagggcttggcggcctatctacgctgagtcactgtccctggccccgacagcagcctgctctctggcccacattagccgcccttgcacttctaagttcagtcgccgaggcttctttgggctcagctcctaggagcccagcaccccgagaaggtcctccacccgtgctggcatccccggccggccacctcccggggggccgcactgcgcgttggtgttcaggacgggcccggcgcccaccaccccagccatctcggccagctcctccacccccggcccctcctagcgcgttgcctcggggtgggcgtgcggccagagcaggggggcccggctctagagccagagcagcaggcgctcgggggtgtcgccttcgctcacaactggtgccggttcgcgcactgggtctggggcaccgcagcgatgagctggtcaggtttcgattctgtagcggctcatgtcggagggcccgctcacctcacgatttatccctcgcctcccttctgggagctggtgccctgaggcccccaccagggtctcgccctgtatcacagccatgctgcagaccaaccaggtacgaggccgtctcctttatggacgtgaactcgacgtggcggactgtagaccggctgtcagcgaccgcgtgtgggtgtctgggt

SEQ ID NO: 6980 - DNA, 660 bp, Artificial Sequence
  Description of Artificial Sequence: Synthetic coding sequence
atggagctgggattgggtggactttcgaccctctcccactgcccgtggccacgccaacagccggccctctggccaaccttggccgccctggcactgctctcgagcgtcgcggaggcgtccctgggctccgcgccgcggtcgccggcaccgcgggaaggccctccacccgtcctggcctcccccgctggacatctcccaggaggtcggactgcccgctggtgctcgggccgcgcaaggaggcctccccctcagccgagcagacccgctccgccaccacctgcccctccatctgctctccctcggggaggcagagcggctcgcgcaggtggaccgggttcgcgcgccagagccgcaggagcacgtggatgtcggttgcggagccagcttgtgccggtgagagccctgggactcggacatcgtagcgacgaacttgtccggttccgcttctgctcgggatcctgtagacgggcacgcagcccgcacgacctgagcctcgcttctctgctgggcgccggtgccctgcgccctccgcccggctctcggccggtcagtcagccatgctgccggccgacccggtacgaagccgtttcattcatggacgtgaactccacctggagaactgtggaccgcctgtcggcgacggcatgtggatgcctcggc

SEQ ID NO: 6981 - DNA, 660 bp, Artificial Sequence
  Description of Artificial Sequence: Synthetic coding sequence
atggagttgggcctgggcggcctgagcacactgtcgcactgcccctggccccgacaacagcctgccctttggcccacccttgccgccctggcgctcctgagttcggtcgctgaagctagcctgggcagcgcccctcggtcccccgcacctagagaaggaccccccccggtccttgcgtcacccgccggccacttgcctgggggaaggaccgccagatggtgctcaggtcgggcaagaagaccccctccccagccttcgcgccccgctccccctccccctgcccctccttccgcactgcccagaggggggagggctgcacgggcaggaggccctgggtcgcgggcacgagcggctggagcgcgcggctgcaggctgagatcgcagttggtcccagtgagggccctgggtctcgggcatagatccgacgagctagtgagattcaggttctgctctggatcctgtcggcgcgcaagatctccgcacgacctgtccttggcgtctttactgggggccggggctctgcgcccaccgccgggctcccggccagtgtcgcaaccatgctgccgcccaaccagatacgaagccgtgagctttatggacgtcaactcaacatggcggacagttgataggctgtcagcaacagcctgcggctgcctgggc

SEQ ID NO: 6982 - DNA, 660 bp, Artificial Sequence
  Description of Artificial Sequence: Synthetic coding sequence
atggaacttgggcttggaggtctgtcaactctctcgcactgtccttggccaaggcagcaaccagctttgtggcccactctggctgcactcgctcttcttagtagcgttgctgaagcatccttgggtagtgctccccgctctccagccccacgagagggcccccctcctgttcttgcctcaccagctgggcatctaccgggtgggagaacagcacggtggtgcagtggtcgtgcaaggcgcccaccaccgcagccttctcgaccagcacctccacctccagctcctccttcagctcttccgcgtggcggcagggctgctcgggccggtggtccaggtagtcgtgcacgagcagctggcgcacgtgggtgccgtctgaggtctcagttggttcccgtgagagcattgggtttaggacatcggtcagatgagttggtgaggtttcgattctgttcaggaagctgcaggagagctcgtagcccccacgatctttcactggcgagcttgctgggtgcaggggcgctgcgtcctcctcctggatctaggcctgtgagtcaaccgtgctgcagacccactagatacgaggccgtatcattcatggacgtgaattctacttggcgcaccgttgaccgacttagcgcaacggcttgcggctgtttaggt

SEQ ID NO: 6983 - DNA, 660 bp, Artificial Sequence
  Description of Artificial Sequence: Synthetic coding sequence
atggaactgggcctcggtggactgtcgacattatctcactgtccgtggccccggcaacaacctgctctgtggccaacccttgcagccctggcattactttcaagcgtcgcagaagcaagtttaggttctgctccgcgttctccggctccgcgcgaaggtccacccccggttcttgcgagcccggcaggtcatctccctggtggtcggacagctagatggtgttcaggaagagcaagaaggcctcctccacagccgtcaagaccagcgccgccgccgccggcaccgccatcagccctgccaagaggcgggcgcgccgcaagagcggggggcccgggttctcgtgcaagagctgcgggcgcgcgcggctgcagactgcggtctcaactcgtcccagtgcgcgcgctgggtctgggacatcgctcagatgaattagtgcggtttcggttctgtagcggctcctgccgcagagctcgatccccgcacgacctttcccttgccagcttactcggagcaggggcgctcagaccgccgccgggctcccggccggtttcccagccttgctgccggcctaccaggtacgaggctgtgtcatttatggacgttaactctacgtggcgtaccgttgaccgcttaagcgcgactgcttgcggatgtttaggt

SEQ ID NO: 6984 - DNA, 660 bp, Artificial Sequence
  Description of Artificial Sequence: Synthetic coding sequence
atggagctcggcctgggaggactgtcgactctttcccactgcccgtggcctaggcaacagccagctctctggccgaccctggccgctctcgcactcctgtcgtcggtcgctgaggcgtccctcgggtcagcaccacgaagccccgctccccgcgaaggtccgccgccagtgttggcgtcgccggcaggacacctgccgggaggaaggaccgcgcggtggtgctcggggcgcgcgaggcgccctccgcctcagccatctcggcctgcacctccgccgccggctcccccgtcggccctccctagaggtggacgcgccgcaagagcaggaggcccaggttcacgggcgcgggccgcaggcgccaggggctgccggctgcgatcacaactggtgccagtccgagccctgggcctgggccataggtcagacgagctcgtgcgattcagattctgctccggcagctgtcgccgcgcgcgcagcccgcatgacctgtcgctggcctcgcttttgggcgcgggcgcgctgaggccgccgcctggtagcagacctgtctcgcaaccgtgttgccgaccaacgcgctacgaggccgtgtcatttatggacgtgaactccacctggcgcactgtggatagactgtcggccactgcctgcggatgcctgggc

SEQ ID NO: 6985 - DNA, 660 bp, Artificial Sequence
  Description of Artificial Sequence: Synthetic coding sequence
atggaattgggactcggaggactttccactctctcacattgtccttggcctaggcagcagccagcactctggccgacccttgcagccctggcactgcttagctctgtggcagaggcatccctgggatccgcaccacggtcgcctgcgccgcgcgaagggcctcctcctgtgctggcatcaccggctggacatcttcccggtgggagaaccgcacggtggtgttccggaagagctcgcaggccacctcctcaaccttcgaggcctgcgcctcccccgcctgcaccaccgtccgccctgcccagaggggggagggcggcaagagcaggaggacctggttcgagagcaagagccgcgggtgcccgcggatgtcgcttgcgcagccagctggtgccagtccgtgcgctgggtcttggacaccggtcggatgaacttgtgcgttttagattttgttctggtagctgtagaagagcccggtcgcctcatgatctttcactggcttccctgctgggtgcaggagcacttagacctccccccggttcaagaccagtgagccaaccttgctgtcggcctactagatacgaagcagtgagctttatggacgtgaattccacctggcgcactgtggatcgactctcggccacggcatgcggatgtcttgga

SEQ ID NO: 6986 - DNA, 660 bp, Artificial Sequence
  Description of Artificial Sequence: Synthetic coding sequence
atggaactgggactcggaggactttcgactctcagccactgcccatggccgagacaacagccggctctgtggcctactctggccgccctcgccctgctctcgtcggtggccgaggcctcccttggttcggcgccgcgctctcccgcaccgcgcgaaggccctcctccggtgctcgcctcacccgcagggcacctgccaggaggcagaactgcacggtggtgctccgggagagcgagacggcccccaccccaaccgtcgcgcccggcacctccgccaccggccccgccgtccgccctcccaagaggtggaagagctgcacgcgctgggggacccggaagccgcgcccgggccgcaggcgcccgcggatgccggctgcgtagccagctcgtgcctgtgcgggccctcggactggggcatcgctcggacgagcttgtgaggttccgcttctgcagcggaagctgccgccgggcacgctccccgcacgatctctcgctggcgagcctgctgggagctggagcgctgcggccgccaccgggatcccgtccggtgtcccagccctgctgcaggccgaccaggtacgaagccgtgagctttatggacgtgaactcaacttggagaaccgtggacagactctcggcaaccgcctgtggatgcctcgga

SEQ ID NO: 6987 - DNA, 660 bp, Artificial Sequence
  Description of Artificial Sequence: Synthetic coding sequence
atggagttgggattgggtggcctgtctactcttagccactgcccctggcctaggcagcagccagctctctggcccactctcgccgctttggccctcctgtccagtgtggcagaggcttcactgggatccgccccaaggtctcctgcccctagggaaggtcctcccccagtgcttgcttcccccgccggacacttgcctggtggtaggactgctcgttggtgctctggaagggcaaggcgtccacccccccagccttcccgcccagctccccccccccctgcccccccaagcgccctgccaaggggaggacgtgcagctcgcgccggaggccccggctctagggctcgcgccgcaggcgctcgtggatgtcgtctcagatcccaactggtgcccgtacgcgctcttggtctgggtcatcgctccgatgagttggtaaggttcagattttgcagtggaagttgtaggcgcgccaggtcaccacatgacttgtccctggcttccttgctcggagcaggcgcactgcgtcccccccccggttccaggcctgtttcacagccctgctgtcgccccactcgctacgaggccgtttccttcatggatgttaacagcacctggagaacagtggacaggttgtctgccacagcctgtggatgcttgggt

SEQ ID NO: 6988 - DNA, 660 bp, Artificial Sequence
  Description of Artificial Sequence: Synthetic coding sequence
atggaattaggactgggagggctttccaccctgagtcactgcccctggccccggcagcagccagctctgtggccaaccttagctgccctagctctgttatcgagcgttgccgaggcttcactgggctctgccccccgctctcccgcccccagagaaggcccacctccagtgttagcctcgcctgcaggccatttgcctggcggtcgcacagccagatggtgttctgggcgagcccgacgcccaccaccccagccttccaggcccgcgcctcccccccccgctccgcccagcgctctgccaagagggggcagggcagcaagagcgggagggccaggaagcagggcacgggccgcaggtgccagaggatgtcgcctgcgcagccagctggtaccggtgagggccctcggcttagggcatcgatcagacgaattggtgaggttccgtttctgtagtggctcttgccgacgagccagaagtccacacgacctgtccctcgcgagccttctcggagccggcgcattaaggccaccaccgggatccagacctgtcagccagccctgctgtcgccccacgcgctacgaggccgtgtccttcatggatgtcaatagcacttggagaaccgttgacaggctgtcagccactgcatgtggctgtctgggg

SEQ ID NO: 6989 - DNA, 660 bp, Artificial Sequence
  Description of Artificial Sequence: Synthetic coding sequence
atggaactgggtcttgggggcctgagcacactctcgcattgcccctggcctagacaacagcctgctttgtggcctacactcgcagccctcgccctcctgagtagcgttgccgaggccagcctcggatctgcgccaaggtcccctgcccccagggaaggacccccacccgtgttggcatctccagctggccaccttcccggtggccgcaccgcacggtggtgctctggtagagctagaagaccacccccccagcctagccgccctgcacccccacccccagccccccctagcgctcttccccgcggcggcagggcagcccgcgctggcggaccaggatctagagcgagagcggccggagcgagaggctgtagactgaggtctcagctcgttcctgtgagagcgcttggattaggacatcgctctgacgagctcgttagatttaggttctgctcaggtagctgcaggcgggccagaagcccacacgatctttcgctggctagcctgctgggtgctggagcactccgacccccccccggcagtaggcccgtcagccaaccgtgttgcaggcccacaagatatgaagcagtctcctttatggatgtcaacagtacatggcgaacagtcgacagactcagcgccacagcctgcggatgcttgggc

SEQ ID NO: 6990 - DNA, 660 bp, Artificial Sequence
  Description of Artificial Sequence: Synthetic coding sequence
atggaactgggtcttgggggattgtcaacgctgagccactgcccctggccccgccagcaacccgcactctggccgactctcgccgccctggcgttgttgagtagtgtggcggaggcttccctcggttctgcccctcgctcacccgctccaagagagggacctccccctgtgcttgcgagccctgcagggcacttgcccgggggccggaccgcgaggtggtgctctggccgcgcaagacgacctccacctcagccctcgcgacctgcaccaccccctcccgcccccccctccgcccttccccgagggggccgggccgcgcgggccggtggacctggcagcagagccagagctgctggggcccgaggttgtcgcctgcgcagccaactggtgcccgttcgtgcactggggctaggccatcgctcagacgaacttgtaagattcaggttctgctccggctcttgcagaagggctcgctcaccccacgacctaagccttgcctctctgcttggggctggagccctgaggccaccccctggttcccggcccgtgagtcagccatgctgccgaccaacaagatacgaggcagtaagttttatggatgtcaacagcacgtggaggaccgtggatagactgagtgcgacagcatgcggctgtctggga

SEQ ID NO: 6991 - DNA, 660 bp, Artificial Sequence
  Description of Artificial Sequence: Synthetic coding sequence
atggagctgggcctcggagggctttctactctgagtcattgcccctggcctcgccagcagcccgccctgtggccaacactggctgcacttgcgttgcttagcagtgtggccgaggcttccctcggttctgctccacgcagcccagccccaagagagggcccgcctcccgtgcttgcctcccctgctgggcacctccccggaggccgcactgccagatggtgttccggaagagcccgaagaccccctccccagccctcccggcccgcacccccaccacctgcacctccttctgccctgccgagaggaggtcgagccgcccgggctggtggtccaggctctagggcgcgggctgccggagcacgtggttgccggcttaggtcacagctggtacctgtgcgggccttggggctgggtcatcggtcggacgagttagtacgcttccggttttgctctggttcctgtcgacgggcgagatccccacacgatctgtcactggccagtctgctgggagcaggcgccctgcggccgccacctggtagccggcccgtttcccaaccctgctgtcgcccgactcggtacgaagctgtgagtttcatggatgtgaattctacctggcggacagtagatcgactttctgccactgcatgcgggtgtctgggg

SEQ ID NO: 6992 - DNA, 660 bp, Artificial Sequence
  Description of Artificial Sequence: Synthetic coding sequence
atggagttaggtctcggcgggttatcaaccctaagccactgcccttggccaaggcagcagcctgccctgtggcccaccttagccgctctggccctcctctcaagcgtagctgaggcgagtctagggtcagctccacggagccccgcaccccgagagggcccccctcctgtgctggcttctcctgccggtcacttgcccggaggcagaaccgctagatggtgtagtggaagggcacggcgtccacctccccaaccctcgcggcctgcccctcctccacctgccccccctagcgccttgccacgcgggggtcgggcggctcgcgccggcggaccaggttccagagctagggccgcaggagcgcggggctgcaggttacggtctcagctggttcctgtgagggccctgggacttgggcaccggtcggacgaattggtgcgtttcaggttttgctccggatcctgtaggcgcgccagaagccctcatgatctgagcttggcttcactcctgggagcgggggcactgcggccccctccaggcagtaggcccgtgtctcagccctgctgccgcccaactaggtatgaggccgtgagttttatggacgtcaattctacctggagaacagttgacagactttcggccacagcatgtggatgtcttggg

SEQ ID NO: 6993 - DNA, 660 bp, Artificial Sequence
  Description of Artificial Sequence: Synthetic coding sequence
atggagctgggtcttggtggtcttagcaccctttcgcactgtccctggccgaggcagcagcctgcactttggcctaccctcgcagcactggctctcctgagttcagtggccgaagcgagcctcggcagcgctcctagatccccggcccccagagagggacccccccccgtcctcgcatcacctgcaggacacttgcctgggggcaggaccgctagatggtgcagcggacgggcccggcgcccaccgccccagcccagccggcccgcgcctccgccgccagcacccccttctgcactgcctagaggagggcgggccgctagggcagggggcccaggttcacgagcacgggccgctggcgctaggggctgtaggttacgcagccagctggtgccagtgcgagcccttggcctgggtcacaggagcgacgagctggtacgcttcagattctgttctggatcctgcagaagggcaaggtcgccacatgacctgtcacttgcttctcttttgggcgctggagccctgaggcccccccctggaagtagaccggtctctcaaccctgttgtcgacctacccggtatgaagcagtctcattcatggacgttaactcaacctggagaactgttgatagactgagtgcgaccgcctgtgggtgtctgggc

SEQ ID NO: 6994 - DNA, 660 bp, Artificial Sequence
  Description of Artificial Sequence: Synthetic coding sequence
atggaactcggattagggggcctttctacactctcccactgcccatggccgcgacagcagccggcgctgtggcccaccctggcagcactggcactcctgtcatctgtggcagaagccagtctcggatcggctcctcgcagcccagccccacgtgaagggcccccaccagtactagctagccccgccggccacctaccaggaggccggacagctcggtggtgcagtggtcgggcccgacgccccccgccacagcccagcagacccgcgcctcctcccccggcgccacctagtgctctccctcgcggcgggcgtgccgccagggccggaggcccaggctcccgtgctcgtgccgctggggctcgggggtgtagactgcgcagccagctggttcctgtgagggcactgggcctgggtcatcgcagtgacgagttggtaagattccgtttttgcagcggtagttgtagacgcgccaggtcaccccatgatctctccctggcaagtctgctgggcgccggagcgctgcgacccccaccggggtcgcgcccagtaagtcaaccctgttgtcggcccactcggtatgaagctgtgagcttcatggatgtgaatagtacatggcgcaccgtggacagactgagcgcgaccgcctgcggctgcctggga

SEQ ID NO: 6995 - DNA, 660 bp, Artificial Sequence
  Description of Artificial Sequence: Synthetic coding sequence
atggagcttggactgggcggtctgtcaactttgtcccactgcccctggccgcgccaacagccagccttatggccaacactggctgctctggccctcttgtcatccgtggctgaagcctcacttggctctgcccccaggtcaccggccccccgtgagggcccccccccggtactggccagtcctgccggacacttaccaggcggccgcacggctcgatggtgcagcggccgcgcccgtagaccccccccgcaaccttctcgtccagcaccccccccaccagcacctcccagtgcgctgccgcgtgggggccgcgccgccagagcaggaggccccggatcgcgcgctcgagctgctggcgcaaggggttgccgattacgctcgcagctggtccctgtccgggccttgggtctaggtcatcgaagcgatgaactggtgcgatttcgtttctgcagcggcagctgccgccgtgcgcgctcgccccacgatttatcgttggcttcacttttgggagctggcgcactgcgaccacccccaggcagccgcccggtaagtcagccatgctgccgcccaacccgttatgaagccgtgagctttatggacgtaaacagcacttggcgcacggtggaccgcctaagtgccacggcttgtgggtgcctgggt

SEQ ID NO: 6996 - DNA, 660 bp, Artificial Sequence
  Description of Artificial Sequence: Synthetic coding sequence
atggagctgggcctcggaggactttcgactctcagccactgtccatggccacgccagcaaccggccctgtggccaacccttgctgcgttggcgctgctttcatctgtggcagaagcgtcgctcggaagcgcccctcgctcgccagctccgcgcgagggccccccgcctgtgctggcaagcccggctggacatctgccgggtggacggacggcaaggtggtgctcgggacgggcacgccgccctcccccgcaaccatcacggcctgcgccgccgcctcctgctccaccgtcggccctccccagaggaggacgggccgctcgggccggtggcccgggatccagagcccgggccgcgggagcccgcggttgccgcctccgctcacagctcgtccctgtaagagcgcttggcctggggcacagaagtgatgaactggtgcggtttcgcttctgctccgggagctgtcgccgtgcacggtcgccccatgacctctctctcgcctcccttctcggcgccggggcgctcagaccgcctccgggctcgcgccccgtgtcccagccgtgctgccggccgacccgctacgaggccgtgagcttcatggatgtcaactcaacctggcggactgtcgaccggctttcagcaaccgcgtgcgggtgcttgggg

SEQ ID NO: 6997 - DNA, 660 bp, Artificial Sequence
  Description of Artificial Sequence: Synthetic coding sequence
atggagctgggcctgggagggctcagtaccctcagtcactgtccatggcccagacagcagccggcactgtggccaaccttggcagccctagcccttctgtccagcgtcgcagaagcgtctctgggcagcgcccctcgaagtcctgccccgcgtgagggtccaccaccagtgctggccagcccagccggacaccttcctggaggtcgaaccgcaagatggtgctctggacgagcccgtcgaccccctccccagccctcccgacccgcgccacctcccccggctccaccttctgccttgccccgaggcggtagggcagcccgcgcaggtggaccaggctcccgagcccgtgcggctggggccagaggctgtaggctgcgatcccagctggtgcctgtgcgagctttggggctggggcatagaagcgacgagctggtacgcttccgattttgctcgggatcctgcagacgtgccagatctccccacgacctaagtctggcatcactgctgggagctggggcactgcggccaccacccggatctaggcctgtgtctcagccatgctgtcgaccaactagatatgaggccgtatcgtttatggatgtcaacagtacgtggaggacagtagaccgcctgtccgctactgcttgcgggtgtcttggg

SEQ ID NO: 6998 - DNA, 660 bp, Artificial Sequence
  Description of Artificial Sequence: Synthetic coding sequence
atggaactcggtcttgggggactctccacgctctcgcactgtccatggccacgacagcaacctgcactgtggccaaccttggcagctctggctcttctgtcgtccgttgcagaagcctccctgggatcagcccctagaagccccgcgcctagagaaggacctcctcctgtgctggcatccccagccggacatcttccaggcggtcggactgcaagatggtgttcaggtcgggcgagaaggcctccacctcaacctagcaggccagctccgccaccccctgcccctccatccgcactcccaagaggagggcgtgcagcacgcgcgggaggcccaggatcacgagcccgggcagcaggagcacgcggatgcagactgcgctcacaactggtgcccgtgcgcgcacttggacttggtcatcgctcagatgagctcgtgagatttagattctgttcaggtagctgtcgaagagcccgcagcccacatgatctttcgcttgcatcgcttctgggcgcaggtgcgcttagacccccacctggtagccggcctgtctcccagccttgctgtcgccctacccgctacgaagcagtttcattcatggacgtaaactccacttggaggaccgtcgacaggctttccgcaactgcatgtggctgtcttggt

SEQ ID NO: 6999 - DNA, 660 bp, Artificial Sequence
  Description of Artificial Sequence: Synthetic coding sequence
atggaactcggactggggggactctcaactctgtcgcactgcccgtggccgcgccagcagccggccctgtggccgaccctggcggccctggcccttctgtcctccgtggccgaggcgtcgctgggttccgcaccgcgctctcctgcaccacgagaaggaccgccgccggtgctcgcgtcgccggcagggcacctgcctggaggaagaactgctcggtggtgctcaggacgggcgcgcagaccgccaccccaaccctccagacccgcgcctccaccgccagctcccccttcagcgctcccacggggaggccgcgcggcaagagcaggaggacctggatctcgcgcccgcgcggcgggcgctcggggatgccggcttcggtcgcagctcgtcccggtgagggccctgggacttggacatagaagcgacgagctcgtgaggtttagattctgtagtggatcgtgccgcagagcccggagccctcacgacctctccctggcctccctgctgggagccggagccctccggccgccgcctgggtccaggcctgtctcacaaccgtgctgtcgcccaaccagatacgaagctgtctccttcatggacgtgaactcgacttggaggactgtggacagactgagcgccaccgcttgcggatgcctggga

SEQ ID NO: 7000 - DNA, 660 bp, Artificial Sequence
  Description of Artificial Sequence: Synthetic coding sequence
atggaactgggactaggaggcctgagcacactatcgcactgtccttggccacggcaacaaccggctctgtggcccactctggctgcactggccttactgtctagcgtggctgaggcatccctcggttcagcccctcgatcccccgccccccgggaggggcccccacccgtcctagctagccctgccggtcaccttccgggcggtagaaccgctcgttggtgctcaggtagggccaggaggccgcccccccaacccagtaggcccgcaccccctcctccggcacctccaagcgcccttccacgcggtggccgagctgctcgggctggaggccctggctctcgggcccgggcagcgggtgcaagaggttgtcgcttgcgcagccagctcgtcccggtgcgggccctgggcttggggcaccggagcgatgaactagtgcgttttcgcttctgctcaggaagctgtcggcgggctcggtctcctcatgacctctccttggcctcacttctcggggccggcgcactgagaccccctccgggatccaggccggtctcgcagccctgttgccgtcccacacgctacgaggccgtctccttcatggatgtgaattccacctggcgcaccgtggacaggctgtccgccacagcctgcggatgcttaggc

SEQ ID NO: 7001 - DNA, 660 bp, Artificial Sequence
  Description of Artificial Sequence: Synthetic coding sequence
atggagctcggcctggggggcctgtctaccctgtcacactgcccctggcctagacaacagcccgccctgtggcctacgctggcagcgctggcattgctgtctagtgtggcggaagccagcctggggagtgcgcctaggagccccgcgccacgcgaggggccccccccagttctcgcctcacccgctggacacctcccaggcggccggaccgcaagatggtgtagcggtagggctcggcggccccctccccagcctagtcgcccagcaccccccccgcccgcccccccgtctgctctgccccgcggcggaagagcggccagggctggtgggcctggcagccgcgctagggccgctggggcacgagggtgtcggctgaggagccagctggttccggtgcgcgctctgggcctggggcatcggtctgatgagcttgtccggttcaggttttgttccggaagttgcaggcgggctcggtccccccatgacctttctctggccagcctgttgggcgctggcgcccttcgccctcctcccggatccaggccagtgagtcagccttgttgccggccaaccagatatgaggcagtgtcatttatggacgtcaacagtacctggcgaacggttgacagactgtcagccacggcctgcggctgccttggc

SEQ ID NO: 7002 - DNA, 660 bp, Artificial Sequence
  Description of Artificial Sequence: Synthetic coding sequence
atggagctgggtcttgggggcctgagcactctgagccactgcccgtggccgaggcagcagcctgcactatggcccactctggcggcgctggcgctgctgagctctgtggcagaagccagtctgggcagcgctccgcgctctccggctcctagggaaggcccccctcctgtcctcgcaagccctgctgggcacctcccggggggtcgaacggcaagatggtgcagcggtcgtgcacgacgaccaccgccacaaccgtcacgcccggctcctcctccacccgctcctccaagcgccctgcctcggggtggtcgggctgcgcgggccggtggcccgggcagccgtgcacgtgccgcaggtgctcgcggatgccgcttgcgatctcaactggtgcctgttcgcgcgttgggtctgggccaccgctctgacgaactggtgaggtttagattctgtagcggcagttgccgccgcgctcgcagcccgcacgacctgtctctcgccagcttactgggtgcgggtgcgctgcgccctccgccggggagccgaccggtgagccaaccatgttgccgtcctacccgctacgaagctgttagcttcatggacgtgaattccacttggcgcacagtcgatcgccttagcgccaccgcttgcggttgtttgggt

SEQ ID NO: 7003 - DNA, 660 bp, Artificial Sequence
  Description of Artificial Sequence: Synthetic coding sequence
atggagcttggccttggggggttgtctacattgtctcactgcccctggccccgacaacaaccagccctttggccgactcttgcagctctggcattgctatcttcagtcgcagaggcgagcctcggaagtgcaccccgctcccctgcaccacgtgagggaccccctcctgttctggcaagcccagctggccacctgccagggggaagaactgcaagatggtgctctggaagggccagacggcctcctccacagccaagtagaccggcccctccacctcctgcaccacccagcgctttaccccggggtgggcgagcggcgcgtgcgggtgggcctgggagtcgagcgcgtgccgcgggcgcgcggggatgtcggctgcgatcccagctggttcccgtgcgggctctcggcctaggccacaggtccgacgaacttgtgcgtttccgcttctgtagtgggagttgtagaagggcccgcagcccgcatgacctgagcctcgccagcctgttaggcgccggagcgttgcgcccaccacctggaagccgaccagtgtctcaaccttgctgcaggcccacaagatatgaggccgtatcattcatggatgtgaactccacgtggcgcacagtcgacagactcagcgccactgcatgtgggtgcctggga

SEQ ID NO: 7004 - DNA, 660 bp, Artificial Sequence
  Description of Artificial Sequence: Synthetic coding sequence
atggagctgggccttggcggactcagcacactcagtcactgtccatggccgcgacagcagcccgctctctggcccacactggctgctctggcactgctgtcctctgttgcagaagcttcccttggctcagccccacgcagccccgccccacgcgagggaccccctcctgtcctcgccagtccagcaggccacctccccggtggacgcaccgccaggtggtgcagcggaagggctcgcaggccgccacctcaaccctccagacccgcccccccaccacccgcacctccctctgcactgcccagaggcggccgggcggccagggctggtggaccaggctcccgcgcacgggcggcgggtgccaggggctgtcggctgagaagtcagttggtgcctgtacgcgcactcggcctcggacataggtcagatgaactggtcagattcagattctgttctggatcttgtaggagagccaggtcaccgcacgatctctccctcgcatccctgctgggcgcaggcgccctgcgccctccacctgggtcccggccagtttcacagccatgctgtaggcccacgcgctacgaagctgtgtcctttatggatgtcaactctacatggcggaccgtggacagactcagcgccacagcatgcggatgtctcggg

SEQ ID NO: 7005 - DNA, 660 bp, Artificial Sequence
  Description of Artificial Sequence: Synthetic coding sequence
atggagctgggtcttggtggattgagcaccctcagccattgcccgtggcccagacaacagcctgcactgtggcctacgctggcagcactcgcccttttgtcatcggtggctgaggcatcgcttggtagcgcgccaagatcgcctgcaccgcgcgaaggccctccgccggtgctcgcctcgcctgccggacatcttcccggaggtagaactgcaagatggtgttctggtcgcgctagacgcccaccaccacagccaagcagacccgccccgccacctccggcacccccgtcggccctgcctcgaggaggccgtgctgcccgcgccggtggcccagggtcccgtgccagagcggcaggagcgagaggatgtagactgagatcgcaattggttccagtgcgggcactcgggctggggcaccggtccgatgaactggtccggtttcgattctgttcaggatcatgtagacgagcacgatctccccacgatctgagcctggcgtcccttcttggagcaggggcccttcgtccaccacctggttcccgcccggtgtcccaaccatgttgccgtcccaccaggtacgaagcagtgtcctttatggatgtcaactccacctggcggacggtcgaccggcttagcgccaccgcatgcggctgtcttgga

SEQ ID NO: 7006 - DNA, 660 bp, Artificial Sequence
  Description of Artificial Sequence: Synthetic coding sequence
atggaacttggactcgggggtctttcgaccttgtcgcattgcccttggccacgccagcagcccgcactttggcctaccctggctgcactggcgctgctctctagcgtcgcagaagcctccctgggaagcgccccccgatcccctgcccctagggaaggacctccaccagtgcttgcatcaccagcaggccatctccccggcggacgaaccgccagatggtgcagcggaagagcgagacgacctccaccacaaccatcgcgcccggcccctcccccgcctgctccacctagcgcactcccccgaggaggaagagccgcaagggcaggaggtcccggatcacgggcaagagccgcaggtgcacgggggtgtcgtcttagatcgcaactggtgccagtccgtgctctgggcctgggtcatagatccgacgaattggtgaggtttcgtttttgcagcggttcgtgtcggcgggcgcggtcgcctcacgatctctcgctggcatccctcctgggcgcaggcgcccttcgacctccacctggttcccgccccgtgtcgcaaccctgctgtagaccaacgaggtacgaagctgtatcgtttatggatgtcaattcaacttggcggaccgtcgataggctgtcggcgaccgcctgcgggtgtctggga

SEQ ID NO: 7007 - DNA, 660 bp, Artificial Sequence
  Description of Artificial Sequence: Synthetic coding sequence
atggaactaggtttaggtggtctatcgacgctatcgcattgtccgtggccgcgacaacaaccggcgctatggccgacgttagcggcgctagcgctactatcgtcggtagcggaagcgtcgttaggttcggcgccgcgatcgccggcgccgcgagaaggtccgccgccggttttagcgtcgccggcgggtcatttaccgggtggtcgtacggcgcgatggtgttcgggtcgagcgcgtcgaccgccgccgcaaccgtcgcgtccggcgccgccgccgccggcgccgccgtcggcgttaccgcgtggtggtcgagcggcgcgtgcgggtggtccgggttcgcgtgcgcgtgcggcgggtgcgcgaggttgtcgactacgttcgcaattagtaccggtacgtgcgctaggtttaggtcatcgatcggatgaactagtacgttttcgattttgttcgggttcgtgtcgtcgtgcgcgatcgccgcatgatctatcgttagcgtcgctactaggtgcgggtgcgctacgaccgccgccgggttcgcgaccggtatcgcaaccgtgttgtcgaccgacgcgatatgaagcggtttcgtttatggatgttaattcgacgtggcgtacggtagatcgtctatcggcgacggcgtgtggttgtttaggt

SEQ ID NO: 7008 - DNA, 660 bp, Artificial Sequence
  Description of Artificial Sequence: Synthetic coding sequence
atggagctgggtctgggaggcctgtcaactctgtcccattgtccatggccacggcagcagcccgctctatggcccactctagccgcgctggccctactatcatcagtcgccgaggcttctctcggctctgcaccccgctctcctgctccgcgtgaaggccctccccctgtgctagcaagtcccgccggacacctgcctggcggacggacagcccgttggtgctccggtagagcccgtcgtccaccgccccagccgtctaggcccgctcctcccccacctgcgcccccttcagcgttgccccgcggaggcagagccgcccgagccggagggccaggatccagagcccgggccgcaggagcaagaggatgccgcctcaggtcacagctcgtgcccgttcgggcccttgggttaggccacaggagcgatgaacttgtgcggttccgtttctgcagcggtagttgtagaagagcaaggtccccgcacgacctctccttagcgtccctgctaggcgcaggcgcactgcggccgcctccaggcagccgacccgtgagtcagccttgttgccgcccgactagatacgaggccgtgagctttatggatgttaacagcacctggcggacagtcgatagactgtccgctacggcttgcggctgtctgggt

SEQ ID NO: 7009 - DNA, 660 bp, Artificial Sequence
  Description of Artificial Sequence: Synthetic coding sequence
atggagctgggactcggtggcctgtccactctctcacattgcccatggccaagacaacagcccgcgctctggcctactctggccgcgctcgccctcctgtcgtcagtcgcggaagcgtccctgggcagcgcgccgagatccccggctccgcgcgaaggaccgccgcccgtgctggcctccccagcgggacatctccccggagggcggactgcacgatggtgctcgggaagagcgcggcgtccaccaccgcagccatcgaggccagcacctccgcctcccgccccgccgtcagcgttgccacggggaggtcgcgccgcgagagcgggagggcctggatcccgcgcccgcgcagcaggcgcccgcggatgcaggctgcggtcccaactcgttcctgtgcgggcactgggactcggacaccgctcggacgagctggtccgctttcgcttctgctccggaagctgccgccgcgctcggtccccgcatgacctgtcactggcttcgttgctgggcgccggagcactgcggccgccaccaggatcaaggccagtgtcccaaccttgctgtagacccacccgctacgaagccgtgtccttcatggacgtgaattcgacttggaggactgtcgatcgactgtccgccactgcttgcgggtgtttgggg

SEQ ID NO: 7010 - DNA, 660 bp, Artificial Sequence
  Description of Artificial Sequence: Synthetic coding sequence
atggaactgggactggggggactgtcgactcttagccattgcccatggccaagacaacagccggcgctgtggcctaccctggcggcactcgccttgctgtcgtcagtcgccgaagcctcgctgggatccgctccgcggtcccccgcgccgcgcgaagggccgccgcccgtgctggcaagccctgccggacatctgccaggaggcagaaccgcacggtggtgttctgggagagcccgacggcctccgccgcaaccttcgcgtccggcccctccgccgccggccccgccttcggccctgccgcgtggtggacgcgccgcaagggctggaggaccagggtcaagggcgcgcgctgcgggagcacgcggatgccgcctgcggtcccagctcgtgccggtgagagcccttggactcgggcaccgcagcgatgagctggtgaggttcaggttctgctccggctcttgccgccgcgctcgctcaccacacgacctctcgctcgcgtcgcttcttggcgcgggagctctgcgcccaccaccgggatcccgcccagtgtcgcagccatgctgtcggcccactcggtacgaagctgtgagcttcatggatgtgaactccacttggcgcactgtggaccggctttctgcgactgcctgcggttgcctggga

SEQ ID NO: 7011 - DNA, 660 bp, Artificial Sequence
  Description of Artificial Sequence: Synthetic coding sequence
atggaacttggtctcgggggcctgtctacactgagtcactgcccttggccaaggcagcagccagcgctatggccgaccctcgccgccctggccctgcttagctccgtcgctgaagccagtctcggatccgccccccgcagtccagctccacgagagggacccccccctgtgttggcctctcctgcaggccacctccccggcggtcgaacagctcggtggtgcagtggtcgtgcccgccgaccacccccgcagccatcacgaccagcccctccccctcccgcacccccaagtgctttgcccagagggggtcgagccgcgcgagccggcggccccgggtcccgcgcgcgggccgcaggagcgagggggtgtcggcttaggtcgcagctggtaccagtgagagcactgggactgggacataggagtgatgaactcgtgcgattccgcttttgtagcgggtcatgccggcgggctcgcagtccccatgatctcagtcttgcttcactccttggcgccggggccctcagaccaccacctggttcccgaccagtatctcagccttgttgccgccccacgaggtacgaggccgttagtttcatggatgtcaatagcacctggcgcaccgtcgaccggctgagcgccaccgcttgcggatgtcttgga

SEQ ID NO: 7012 - DNA, 660 bp, Artificial Sequence
  Description of Artificial Sequence: Synthetic coding sequence
atggagctcggccttggcggtctttcaaccctgtcacactgtccgtggccgcggcaacagcctgcgctgtggccaacgctcgctgcactggcgctgctctcatccgtagcggaagcatcattgggatcggcaccacgaagtcccgcaccaagagagggacctccgcccgtgcttgcaagccccgccggtcatttgcctggtgggcgaacggcgagatggtgctccggcagggcacgcagacctccacctcagccaagcagacctgcccctccgccgccggctcctcctagcgcacttccgagaggagggcgcgccgcacgggcaggggggcctggatcgcgagctagagcagccggtgcacggggatgtcgtctgcgttcccaacttgtgcctgtgagagccctgggacttggacatcggtccgatgaactcgtcaggttcagattttgttcgggtagctgccgccgcgctcgctcaccacacgacctgtcccttgcctcgctccttggagccggtgcactgaggcccccgcctggctccaggccagtttcccaaccttgttgccgtcccactaggtacgaagctgtgtcgtttatggatgtgaactccacctggcgcactgtcgaccggcttagtgcaaccgcgtgcgggtgtctcggc

SEQ ID NO: 7013 - DNA, 660 bp, Artificial Sequence
  Description of Artificial Sequence: Synthetic coding sequence
atggaactcgggctaggcggactcagcacattgtcgcactgtccttggccaaggcagcagcccgcgctgtggccaacactggcggccctagccctgctgtccagcgtggccgaggcatccctaggcagcgccccaagaagtccggctccccgggaagggcccccacccgtgctcgccagtccggccggccatttgcctggtggtcgaaccgccagatggtgcagcggccgggcccggagacctcccccacaacccagccggcccgcccctcccccacccgccccccccagtgcgttacccagagggggtcgggcggccagggctggagggcctggttcaagagcccgagccgctggtgctaggggctgtaggctgcgttcgcagttggtgcccgtccgggctctgggcctgggccaccggtccgacgagttggttcgatttcgcttctgtagtggctcttgtcgccgcgcacgttctccacacgacttgagcttagccagtctgttgggggcgggcgctcttcgtccaccgccagggtctcgccccgtatctcagccctgctgtcggcccaccaggtacgaagctgtctcgttcatggacgtaaacagtacctggagaacagtggacagattgtccgcaacagcctgcggatgcctggga

SEQ ID NO: 7014 - DNA, 660 bp, Artificial Sequence
  Description of Artificial Sequence: Synthetic coding sequence
atggaacttggacttggtgggctttcgaccctgtcccattgtccgtggccccgacaacagccagcactttggcctactctggcagcactggctcttctttcctcagtggcggaggcatcgcttggatccgccccccgttccccggcccctcgggaggggcctccacctgtgcttgcatcccctgccggacatctcccaggaggccgcaccgcacgttggtgtagcggaagggctagacgtcctccaccgcaacccagccggcctgcccctccgccacctgcccctccctcagccctgccacgaggtgggagggccgcacgcgcaggtggtccaggcagccgagcaagggccgccggtgcaagaggttgtcgccttagaagccaactggtccctgttcgggccctgggactcggacaccggtcggatgaactcgtgagattccggttttgtagcggttcgtgtagaagagcgcgctcacctcatgacctgtcgctggcttcgcttctgggagctggagccttgcgccctccaccaggatcgcgcccagtgtcgcaaccgtgttgccgccctacgaggtacgaagccgtgtcgttcatggacgtgaactcgacttggcggactgtcgataggctgtccgccacggcgtgtggatgtcttggt

SEQ ID NO: 7015 - DNA, 660 bp, Artificial Sequence
  Description of Artificial Sequence: Synthetic coding sequence
atggaactcgggctaggtggactgtccaccctttctcattgcccttggccccgccagcagcctgcactgtggcctaccctggctgctctcgcactcctctcttccgtggctgaagcgtccttagggagcgctcctaggtcaccggctccacgggaaggccccccacccgtcctcgctagcccagccggtcacctacccggaggaaggacagctcgatggtgctctggccgggcaaggagacctcctccgcagcccagcagacctgctccacctcctccagctccacccagcgccctccctcggggcgggcgggccgctagagcaggtggcccaggttcaagagcccgggctgctggcgcacgcggatgtagactgaggtcccaactagttcctgtacgtgcactggggcttggtcaccgctcagatgaactggttcggttcaggttttgctcggggtcatgtcgtagagcccgcagcccacacgacttgtctctagcctctcttcttggcgctggcgccctccggccccctcctggctcacgccccgtgtcacagccctgctgtaggccaactcgctatgaggccgtgtccttcatggatgtgaattccacatggcgcaccgtggaccgtctcagcgctaccgcatgcgggtgcttaggg

SEQ ID NO: 7016 - DNA, 660 bp, Artificial Sequence
  Description of Artificial Sequence: Synthetic coding sequence
atggaactgggattgggaggtctaagcactctgtcacactgcccttggcctaggcaacagccggctttgtggcctacgctggctgcgctggcccttctgtcttcagtcgcagaggcctcgctgggaagcgcgccaaggtcccctgcgcctcgcgagggcccccccccagtgcttgcctctccagctggacatctgccgggcgggaggacagctaggtggtgctcagggagagcgcggagaccccccccccaaccatctaggccagccccacccccgcccgcgccgcccagtgcactaccacgcggaggaagggctgctagggctggcgggcctgggagtagggccagagctgctggcgcgcggggctgtcggcttaggtcccagctcgttccagtgagagccttgggcctgggtcaccgaagcgatgaattggtgaggtttaggttttgctccggctcctgcaggagggccaggtccccccacgacctgtcactagcctccctgttaggcgccggggctctgcggcctccccctgggtcccggccggtcagccagccctgttgtcggccaacaagatatgaagccgtcagcttcatggacgttaacagcacctggcgcaccgtggatcggttgtccgctactgcgtgcgggtgtttggga

SEQ ID NO: 7017 - DNA, 660 bp, Artificial Sequence
  Description of Artificial Sequence: Synthetic coding sequence
atggaacttggcttgggaggactttctactctgtcgcactgtccctggccacgacagcagcctgcactgtggcccaccctggccgccctggcgctgctgagctcagtggcagaggcttccctgggttccgcccctagatcgcctgcgccgagagaaggtccccctcccgtgcttgcatcgccagccggccatctcccgggaggacggactgcaagatggtgttccggtagagctcgacggccgcctcctcaaccttcccgaccagcaccgcctcccccagcccctccttccgcacttcctagaggtggtagagcagcacgagctggaggtcccggatcgagagcaagagctgcaggtgcacgcggttgtcgcttgagaagccaactcgtcccagttagagccctcggccttggtcaccgttctgacgaactggtccgtttcagattctgttcggggtcctgtaggagagcgaggtccccacatgatctgagcctggcatctttgcttggagcaggagcactgcgacctcctcctggatcgcgccccgtgtcccaaccatgctgtcgcccaactagatacgaagcggtgtcatttatggatgtgaattccacctggagaactgtggataggctttcggcaaccgcgtgtgggtgtcttggt

SEQ ID NO: 7018 - DNA, 660 bp, Artificial Sequence
  Description of Artificial Sequence: Synthetic coding sequence
atggagctcgggctggggggattgagcaccctgtctcattgcccttggcccaggcaacaaccggccctgtggccgaccttggctgccttggctcttctgtcaagcgtcgccgaagcatcactcggtagcgccccacggtccccagccccccgcgaagggcctccgccggtcctcgcaagtccggcgggccatctgcccggcggaaggaccgcgcgttggtgcagtggccgggctaggcggccccctccgcagccatcacggccggctcctccgcctccagcacccccatcggcgctgccgagaggcggaagagctgctcgtgcgggtggcccgggatccagagcacgggccgccggagcgcgcgggtgccggctccgctcccagctggtgcccgtgagagcgctgggattggggcaccgctccgacgagctggtgcgctttcgcttctgttcgggatcgtgccgccgggcccgctccccgcacgatctgtcgctggcctcgctgttgggcgcgggcgctttgcggccaccgcctggtagcagaccggttagccagccatgttgcagaccgacgagatacgaagctgtgtccttcatggacgtgaactcaacttggcgcactgtagatcgactgagcgccactgcatgcggatgtctgggg

SEQ ID NO: 7019 - DNA, 660 bp, Artificial Sequence
  Description of Artificial Sequence: Synthetic coding sequence
atggagctgggcctgggagggcttagtaccctctcacactgtccctggcccagacagcagcccgctctctggccaacactggctgctctggccctactgtcatccgtagctgaggccagcttaggctctgccccaaggtctcccgctcctagagaaggaccgccacctgtcctggcttctcctgctggccacctgcccggggggcgcacagcacggtggtgtagcggtcgagcccggcgtcctccccctcaaccaagccgtccagccccgccaccacccgcccctccttcagccttacctcgcggtgggcgtgccgcacgtgccgggggcccagggtcaagggccagagcagccggcgcaaggggttgtcgcctacgctcccagttagtaccggtgagagcccttggcctgggccataggagcgacgagcttgtgagattccggttttgttctggctcttgtcggagggcgcgctccccccacgacctctctttggcatctctgctgggggctggcgcactaagaccgccccctggatccagaccagtgagtcagccgtgttgtcgcccaactcgatacgaggcagtctcattcatggatgtgaactcaacgtggagaacagtggatcggctgagcgcaacggcctgtggatgcctaggg

SEQ ID NO: 7020 - DNA, 660 bp, Artificial Sequence
  Description of Artificial Sequence: Synthetic coding sequence
atggaattaggcctgggtggtctgagtactctttcacattgtccttggcctcgccaacagccagctctctggcccacacttgctgcactggcactgctatcctcagtggccgaagcctcactgggatccgcgccacggagccctgcaccacgggaaggcccaccgcctgttctcgcatcccccgccggccacctgcctggaggccgaaccgcccgctggtgtagcggtagagcgcggcggccgccccctcagccgagcaggccggcaccacctccacctgcgcctccctccgccctacctagaggcgggagggcggcccgggcagggggtcccggcagccgggccagggcggctggtgcgaggggctgtcggttacggagccagctcgtgcctgtgagggcccttggcttagggcatcggagtgacgaactggtacgatttagattttgctcgggatcttgtagacgggcacggtccccacacgatctaagtcttgcctccctgctgggggccggtgcccttcggccccctccaggcagtcgccccgtgtcccagccctgttgcaggcccacccgatacgaggctgttagctttatggacgtgaattcaacttggcggacagttgataggctctcagcgacagcatgcggctgcctcggc

SEQ ID NO: 7021 - DNA, 660 bp, Artificial Sequence
  Description of Artificial Sequence: Synthetic coding sequence
atggagctcggcctcggaggactctccactctgagccattgtccctggccacggcagcagccagccctctggccgaccctggcggctttggctctgctttcatcggtggctgaggcttcgctcggaagcgcaccgagatcccctgccccgagagaagggccgccccctgtcctggccagcccggccggacacctgccgggaggcagaactgcgcgctggtgctccggtcgggcccggaggccgccgcctcaaccgtcccgccctgccccgccccctccagccccgccttccgcactgccgcgagggggtagagccgcacgggcaggtggaccgggaagccgcgcccgggccgccggggcgcgcggatgccgcttgcggtcacaactggtgccggttagagccttgggacttggacatcgcagcgacgaattggtgcggttccgtttttgctctggctcctgtcggcgcgctcgctcgccgcatgatctctccctggcttcgctgcttggtgcgggtgccttgaggccgccccccggttcgcgacccgtgagccagccttgctgccgcccgaccagatacgaggcagtctcgttcatggacgtgaacagcacttggagaaccgtggaccggctctccgccacggcctgcggctgcctggga

SEQ ID NO: 7022 - DNA, 660 bp, Artificial Sequence
  Description of Artificial Sequence: Synthetic coding sequence
atggagctggggttaggtggactttccaccctctcgcactgtccctggcccaggcagcagcctgctctctggcccacactggcagccttggcactgctctcctccgtggccgaggcttctttggggtcggctccacgctccccggctccacgagagggccccccccccgtcctggcaagtcctgccgggcatctcccaggggggagaacagcccggtggtgcagcgggagggccagacgtcccccgcctcaaccttcgaggccagccccgcctccaccagcccccccgtccgctttgcctcggggtggtagggcagctagggcaggcggcccaggaagtcgagccagggccgcgggcgccagagggtgcaggttaaggagccaactggtgccagtgcgggctttaggcctggggcatagatctgatgagcttgtgagatttcgattttgctcaggttcttgccggcgcgctaggtcccctcacgatctgtcactggcctccctcttgggggccggagcactgagacccccccctggctcacgacccgtcagccagccctgctgtaggccgacccgatacgaagccgtgtccttcatggatgtgaactccacttggcgaacagtggatagactgagcgctaccgcgtgcggatgcttggga

SEQ ID NO: 7023 - DNA, 660 bp, Artificial Sequence
  Description of Artificial Sequence: Synthetic coding sequence
atggaactgggactgggagggctgtcgacactgagtcactgcccctggccaagacagcagccggccttgtggcctacactggcagccctggcgctgttaagtagcgtggccgaagcatccctggggtctgccccccgttcacccgcaccacgggagggtccgcctccggtacttgcgtcaccagctgggcatctacccggcggcagaacggctcgctggtgttctggtcgtgccagacgccccccgccgcagccaagtcgccccgcgccacctccacctgccccaccgtctgccttgccacggggaggacgggccgcacgtgctggtggaccgggttcacgggcacgggctgccggtgctcgcggttgtcgtttgcgaagccagctcgttcccgtcagagccctcggtttgggccacagaagtgacgaactggttagattcaggttctgtagcggatcttgcaggcgggcccgtagtccacatgatctctctctggctagcctgttgggcgctggagcgctaagacctccgccaggtagccgtccagtatcacagccctgctgccggccgactagatatgaagccgtatcttttatggacgtgaactccacttggcggacagttgatcggctgtctgccacagcctgcggatgtcttgga

SEQ ID NO: 7024 - DNA, 660 bp, Artificial Sequence
  Description of Artificial Sequence: Synthetic coding sequence
atggagttggggctggggggtctgtcgacccttagccactgcccctggccgcgccaacaaccagcgctgtggccaaccttggccgccctggctctcctctcctcggtcgcagaagcctcattgggatcggccccgagatctccggccccgcgcgagggtcccccacctgtcctggcctcccctgctggtcatttgccgggtggcaggaccgcgagatggtgctccggacgcgcgagacgcccgcctccacagccatcacgccctgcgcctccaccaccggcaccgccgtcagcgttgccgagaggcgggagagcagcacgggccggcggacccggatcgagggcacgagctgcgggggcgaggggatgccggctgcgctcccagctggtacccgtccgggcactgggcctgggacatagatcggacgaactggttcgctttagattctgtagcggatcgtgtcggcgcgcacgttccccacacgatctttcgctcgcctctctgctgggagccggagctctgcgaccacctccaggttcacggccagtctcgcagccgtgctgccgcccgactcgatacgaggctgtgagctttatggatgtgaacagcacttggcggactgtcgaccggctctccgccaccgcctgcggatgtttgggg

SEQ ID NO: 7025 - DNA, 660 bp, Artificial Sequence
  Description of Artificial Sequence: Synthetic coding sequence
atggagttgggtctgggaggactttcgaccctgtcccactgcccctggcctcgacagcaaccagcgctttggcctacgctggcagcacttgccctgctgtcgtccgtcgcagaggccagcctgggatccgccccaagaagccccgcaccacgagaaggtcccccacctgtgctcgcgtcccccgccgggcatttgcctggaggacgtactgcccgctggtgttcaggcagggcacggcggcccccaccacagccatcacggcctgcaccccctcctccagctccaccaagcgcactccctcgcggagggagagccgccagagcgggaggaccgggaagccgcgcgcgagcagccggagcacgaggttgtagactgagaagccaactcgtgcctgttcgagcactgggtctgggtcatcggtcggatgaacttgtgcggtttcggttctgctccggctcatgtcggcgtgccagatccccacatgatttgtccttggctagccttctgggcgcaggggcgcttaggccacctcccggctcccgccctgtgtcccaaccttgttgtcgtcctacccgctacgaagccgtctcgttcatggacgtgaattcgacctggcgaaccgtcgatagactgagcgcaaccgcttgtggttgtctgggc

SEQ ID NO: 7026 - DNA, 660 bp, Artificial Sequence
  Description of Artificial Sequence: Synthetic coding sequence
atggagcttggactgggtggcctgtctactttgtcccactgtccctggcctcggcaacagccggccctgtggccaactcttgccgccctggcactgctgagtagcgttgctgaggcctctctagggtccgcccctcgctcacccgcaccgagagaagggccacccccagtgctcgcgtcaccagccggtcacttgcccggcggccgaaccgccaggtggtgcagcgggagggcgagacgaccccctccacaaccatcccgcccagccccccccccaccggccccacccagcgcgctcccgaggggggggcgagccgcaagggcgggaggacctgggtctcgtgcgagagccgcgggtgcccgtggctgcagactgcgatcccagctggtgccggtgcgggcactgggactcggacataggtctgatgagcttgtccgattccgtttctgcagcgggagctgcagaagggcccgaagccctcatgatctgagtctggctagtctccttggagccggagcactgcgtcctcccccaggaagtaggcccgtatctcagccttgctgccgtccgacccgatacgaggctgtgtcattcatggacgtgaactccacttggcgaacggtggatagattgtcagcaacagcttgtgggtgtctcggc

SEQ ID NO: 7027 - DNA, 660 bp, Artificial Sequence
  Description of Artificial Sequence: Synthetic coding sequence
atggaacttggtctgggtggactgtctaccctgtcgcactgtccctggccacgccaacaacccgcattgtggcccacccttgcagcactggcacttctgtcatcagtggccgaagcatccctgggttcggcacctagatctcctgccccacgggaggggccccctcctgtcctggcaagcccagcgggccatcttcctgggggccgcaccgctcggtggtgttccggtagagcgcgtagaccaccaccccaaccttccagaccagcacctcctccgcctgcaccaccttccgcccttcctcggggtggaagagcggctagggcaggtggtcccggtagcagggctcgagcggcgggcgcaagaggttgtaggttgagatcccagctggtgccggtccgggcgctgggactgggacatagatcggatgaactcgtgcggtttaggttttgtagcgggagctgtcgccgcgcaagatccccccatgatctttcccttgcaagcctgcttggagcaggggctctccgaccccctcctgggtccagacctgtgtcgcagccctgttgcagacccactagatacgaggcagtgagttttatggacgtgaatagcacttggcgcaccgtcgatcggctctccgcaactgcctgtggctgtctcggt

SEQ ID NO: 7028 - DNA, 660 bp, Artificial Sequence
  Description of Artificial Sequence: Synthetic coding sequence
atggaattaggactcggaggactgagtactttatctcattgcccctggcctcggcagcaacctgccctgtggccgacgttggctgctctagctcttttaagtagtgtggctgaggcatcattagggtccgccccccgatctcctgcccccagggaggggcccccaccagtccttgcaagtcctgctggacatctgcccgggggaaggactgcccgctggtgtagtggaagggcacgcaggccacctccacagcccagtcgcccagcacctccaccaccagctcccccctcagctctgccccgaggagggagggctgcccgggcaggaggacctggatctagggctagagccgccggggcccgggggtgccgactcagaagtcagcttgtgccagtccgagctctgggactgggacatcggtccgatgaattagtgaggttcagattctgttccggatcttgtcggcgagcgcggtcccctcacgatttatcacttgcatccctgttaggggcaggggcattaagacctccccccggatcaaggcccgtttcccagccatgttgtaggcccacacgctacgaagctgtgtccttcatggacgtgaactcaacatggagaacagtggaccggctgtctgccacggcctgcggatgcctcgga

SEQ ID NO: 7029 - DNA, 660 bp, Artificial Sequence
  Description of Artificial Sequence: Synthetic coding sequence
atggagctgggtctgggtggactttctacactgagccactgtccgtggccaaggcagcaaccagccctatggcccacgttggccgctctggcacttttgagctcagtggccgaggcttccctgggcagcgcgccccgaagccccgctccacgggaaggcccaccaccagttctggcctccccagccggtcatctgcctggaggacgtacagcaaggtggtgctctgggcgcgcacgaagacccccaccccagccatcacggcccgctcctcccccacctgccccccccagtgcccttccaagagggggacgcgccgcgagagccggcggtcccggtagccgagcccgtgccgccggtgcccggggatgtcgcctcaggtcgcaattggtgccagtaagggcccttgggctaggtcatcgctccgatgagctcgtcaggttccggttctgctcagggtcatgtagaagagcccgaagtcctcacgatctgtccctggccagtctcctaggcgcgggcgccctcagaccaccaccagggtcgagaccagtctcccagccatgctgcaggcccacacggtatgaagccgttagtttcatggatgtaaactccacatggcgaacagttgatcggctgtcagccaccgcctgcggttgtctcggt

SEQ ID NO: 7030 - DNA, 660 bp, Artificial Sequence
  Description of Artificial Sequence: Synthetic coding sequence
atggaattgggattgggtggtctgtccaccctgagccattgtccatggcccagacagcagccagccctctggcccaccttggctgcgcttgctttgctgtcttccgtagccgaggctagcctggggtctgcaccacgctccccagccccgcgcgagggacctccccccgttcttgcttcacctgcggggcatctgccaggtgggcgaaccgctaggtggtgtagcgggagagcccggcgaccaccgcctcagccaagccgacccgctcctcccccccctgccccaccttcagccctcccccgcggggggagagccgcaagggctggcggccctggtagccgcgccagggccgccggggctcgcgggtgccggctgaggtctcagcttgtaccggtgcgggccctgggccttggacaccgctccgacgagctggtgcgctttcgcttttgtagtggctcatgcaggcgcgcgaggagccctcatgacctcagcctggcctccctgttgggcgcgggtgcattgagaccacccccaggctccaggcctgtttcccagccttgttgtaggcccacacggtatgaagcagtcagcttcatggatgtgaacagtacctggcgcacggtggatcggctcagtgccaccgcatgcggatgtctgggc

SEQ ID NO: 7031 - DNA, 660 bp, Artificial Sequence
  Description of Artificial Sequence: Synthetic coding sequence
atggagctcggactgggagggttaagtactctctcccattgtccgtggcctaggcagcagcctgccctatggcctacccttgctgcattggcattattgtccagtgtcgcagaggcgtccttagggtcagcacctagatcaccagcacctcgagaaggacctccaccagtgctagcttcaccagctggacatcttccgggtggacgaacggcccgatggtgcagtggtagagcccgacgtccaccaccacagccaagtagaccagcaccaccaccaccagctccaccttctgcccttccgcggggaggaagagcagcgcgagcagggggaccaggctcacgtgcccgtgccgcaggtgctcggggatgccgactgcgttctcaattggttccggtacgagcgctaggattgggacatcggagcgatgaactggttcgcttcagattttgttctgggtcttgccgacgggcacgctcgccgcatgacctcagtcttgcttcattgttgggagccggagcattgcggcctcccccaggaagtcgtccagtgtcccaaccgtgttgccgaccgacgcgttatgaggccgttagcttcatggatgttaattcgacttggcggactgtggatcggctctccgctacggcatgtggttgcctggga

SEQ ID NO: 7032 - DNA, 660 bp, Artificial Sequence
  Description of Artificial Sequence: Synthetic coding sequence
atggagctgggactcggcggactctcgactctctcacactgcccttggcctcgccaacagcctgctctgtggccaactcttgcagccctggcgcttctctcctcagttgcagaagcctcgttgggatcggccccgagaagcccggctccgcgcgagggaccaccccccgtgctggccagtcctgccggccacctgccgggcggaaggaccgcgcgctggtgttccggaagggcacgccgccctccgccgcagccgtcacggccagctcccccaccaccagccccaccgagcgcgctgccgcgaggtgggagagccgcgcgcgcaggagggccgggctcgagagcgagggctgctggggccagaggatgccggctccggtcacaactggtgcctgtcagagcgctggggctgggacatcgttcggacgaactggtgcgcttccgcttctgcagcggctcctgtcgccgggccagatccccgcatgatctgtcgttggcctccctcctcggtgcaggtgccttgcggcctccaccgggatcgcggcccgtgagccagccgtgttgccggccgacgaggtacgaagcagtcagctttatggatgtcaactccacttggcgcaccgtggaccggctgtctgcgaccgcctgcggatgcctgggc

SEQ ID NO: 7033 - DNA, 660 bp, Artificial Sequence
  Description of Artificial Sequence: Synthetic coding sequence
atggagctgggcctgggcgggttgtcaacactgagccactgtccctggccacgacagcagcctgctctgtggcctacattggccgcactagcgcttttgtcttccgtggccgaggcctccctcggttctgctccacgctcgcccgcaccgcgtgagggtcctcctccagttctagcatcaccagccggccatctaccaggtggcagaacggcccgttggtgttctggtcgagcccgtcgacccccgcctcagccttctcgcccagctcctccacctccagctccaccatccgccctccctaggggaggcagagcggctcgggcaggaggtccaggcagcagggctcgcgcagcgggggcacgcggatgtaggttgcggtctcaacttgttccagtccgagcgcttggcttgggccaccgatcagatgaactcgtccgtttcagattctgctccggtagttgccggcgggctcgcagccctcatgatttatccctcgcttctctgttaggagccggagccctgcgaccaccacccggtagtaggccggtatcccagccatgctgcagaccaactcggtatgaagccgtctcctttatggacgtaaattcgacatggagaaccgttgatcggctcagtgcgactgcctgcgggtgtctcggg

SEQ ID NO: 7034 - DNA, 660 bp, Artificial Sequence
  Description of Artificial Sequence: Synthetic coding sequence
atggaactgggcctgggagggctctccactctgtcccactgtccatggcctcgccagcagcctgcactgtggccgactctggccgccctggcgctcctgagctcagtggccgaagcttccctggggtccgcaccccgctcacccgctccccgggaggggcctccaccagttctcgcatctcccgctgggcacttgccaggtgggcgtaccgctagatggtgtagtggaagggcgaggcggccaccgccacagccgtcacggcccgcccctcccccaccagcccccccctctgctctgccgcgcggtggccgagctgcccgcgctggagggcctggcagcagagcacgcgcagcaggcgctaggggatgtagactccgatcacagctcgtgccagtgagagccctggggctgggccacaggagcgacgaactcgtgcgcttcagattttgtagtggaagctgtcgaagagccagaagcccccacgatttgagcctagccagcctgttgggcgcaggcgccctgaggccccctcctggcagtcgaccggtgtctcagccttgctgcagacctaccaggtatgaggccgtctcatttatggacgtcaactcaacctggcgaaccgtcgaccggctgagtgccaccgcatgcgggtgcctgggc

SEQ ID NO: 7035 - DNA, 660 bp, Artificial Sequence
  Description of Artificial Sequence: Synthetic coding sequence
atggaactcggcttgggaggactctccaccctgtctcactgcccttggccgcggcagcagccagccctgtggccgacccttgcggcgttggctctgctgtcctccgtggccgaagcatctctgggatcggccccacgcagcccagctccacgggagggacctccgcctgtgctggcatcccccgcgggccacctgccgggaggacggactgccagatggtgtagcggaagagcccgcagaccaccaccgcagccgtcaagaccggcgcctcctccgccggccccgccgagcgcactcccacgagggggaagagccgcccgggctggaggtccgggttcaagggctcgcgcggccggcgcgagaggatgccgcctccgctcgcagctggtcccagtccgtgcactgggtctgggacataggagcgatgagcttgtgaggtttcggttctgctcgggatcatgcagaagggcacgcagcccacacgacctctcgttggcttcgttgctgggcgccggagccttgcgcccgccgccggggtcgcgccctgtgtctcagccatgttgccgcccgactcggtacgaggcagtgtcattcatggacgtgaattcaacttggcggacggtggaccgcctgtcggcaaccgcttgcgggtgtctgggc

SEQ ID NO: 7036 - DNA, 660 bp, Artificial Sequence
  Description of Artificial Sequence: Synthetic coding sequence
atggagcttggcctcgggggtcttagcactctctcgcactgcccttggccacggcagcaacccgcattgtggcctaccctggcagccctggccctgctttctagcgtcgcagaagcatcattgggttccgcaccccgctcgccagcgcctagggagggaccacctcctgttctggcttccccggctggacatttgcctggtggtaggaccgcacggtggtgttcaggacgcgccaggcgcccacccccacaaccgtcacgtccagcaccgccgccaccggctcccccctcagcgctccctcgtggcggtagagccgcacgggcggggggaccagggtcacgagcaagagccgccggagcaaggggctgcaggctgagatcacaactggttcctgtgcgggccctcgggctcggacatagatccgatgaactcgtgcgatttcgcttctgttcggggtcgtgtagacgggcaagatcgcctcacgacttgtccctggcatcccttctgggggcaggagctctccgccctccaccaggttccagaccggtgtcgcagccctgttgtagacccactagatacgaagctgtgagctttatggacgtgaactctacttggagaaccgtcgatagactgtcggcaaccgcatgtggatgtcttggt

SEQ ID NO: 7037 - DNA, 660 bp, Artificial Sequence
  Description of Artificial Sequence: Synthetic coding sequence
atggagctgggcctgggtggcctctcgaccctcagccattgtccttggccccgccagcaacctgcactttggcctactcttgcagccttggctcttctgtcatcagtggctgaggcgtccctcggatcggcaccgcggtcgccagccccccgcgaaggtccccctcctgtgcttgcaagcccagcgggacatcttccaggcggtagaactgcacgctggtgctccggaagggcacgacgtccacctccacaaccaagccggccagctccgccaccccccgctcccccttccgcccttcctcggggtggacgcgcggcaagagccggaggccccggtagccgggccagagcggcgggtgcccgtggatgtagactgcggtcgcaactggtgccagtccgtgccctgggactggggcatcgaagcgacgagctggtgcgctttcgcttttgttcagggtcgtgtcgcagagcaagaagcccacatgatctctccctggcatcgcttctgggagcaggagccctccggccgccaccaggatcccggcctgtgtcgcagccttgctgtagaccaacgcgttacgaggccgtgtccttcatggatgtcaattccacctggcggactgtggatagacttagcgcgactgcatgcgggtgccttggc

SEQ ID NO: 7038 - DNA, 660 bp, Artificial Sequence
  Description of Artificial Sequence: Synthetic coding sequence
atggagctcggcctcggagggctgtcaacgctgagtcattgcccgtggccgcggcaacagcccgctctgtggccaactctcgctgccctggccctgctttcctcggtcgccgaagcaagcctgggttcagctccgagaagccctgctccgcgcgaaggccctcctcctgtccttgcctcccctgccggacacctgccgggcgggaggacggcgcggtggtgctcgggacgggctcgcaggccgcccccgcagccttcccggccagccccaccaccgcccgcgccgcctagcgcgctgccccgcggtgggcgcgctgcacgggcaggagggccaggatcacgagctagagcggccggagcgagaggttgtcggctgagaagccaactcgtgccggtgcgggcactgggactgggacacaggtctgacgaactcgttaggtttcggttctgctcgggaagctgcaggagggcacgcagcccgcatgacctgtcccttgcgtccctgttgggggccggggccctccgccctcctccgggttccagaccggttagccagccttgctgccggccgacccggtacgaggccgtgagcttcatggatgtgaactccacgtggcgcaccgtggataggctctcagcgaccgcatgtggatgcttgggc

SEQ ID NO: 7039 - DNA, 660 bp, Artificial Sequence
  Description of Artificial Sequence: Synthetic coding sequence
atggagctgggtttgggcggcttaagtactttatcccactgtccatggcctagacaacagcctgctttatggccaactctggctgccctagcacttctatcatctgtggccgaggcttcactgggttctgctccaaggtcccccgctccaagagaaggtcccccccccgtgctcgcctcccccgcagggcatttaccgggcggcaggaccgcccgatggtgtagcggtcgcgcccgaaggccccctccacagccatctcgacccgctccccccccgcctgcaccaccaagcgcactgcctcgaggggggcgtgccgcaagagccggcggacccggcagtagggccagggccgctggggcccgcggttgccgtttacgctcacagctggtgcctgtccgcgccctaggactcggccatagatctgacgaattagtgcggttcagattctgttctgggtcctgccgcagagccagaagtccacacgacttgtctctggccagcctcctgggcgcaggggctttgagacctccccccggcagcaggccagtttcacagccatgctgcagacccacacggtacgaagctgtgagcttcatggatgtgaacagcacctggagaacagtggacaggctgtcagcaactgcctgtggatgcctgggg

SEQ ID NO: 7040 - DNA, 660 bp, Artificial Sequence
  Description of Artificial Sequence: Synthetic coding sequence
atggaactgggactgggagggctttccactctgtcacactgcccatggccgagacagcaacctgcgctctggccaacccttgcagcgctggcgctgctgtcctcggtggccgaagcatctctcggtagcgcacctcgctcaccagccccaagagaaggaccaccacccgtgctcgcaagccccgctggtcacctccccggaggaagaaccgctcggtggtgttcaggaagagcccggcgcccaccacctcagccttcgcggcctgccccacctccacctgcaccaccctcagcattgccaagaggtggcagagccgcgagggctggcgggcctgggtcgagagcacgtgcagcaggcgcccgcggttgcagactgcgctcccagttggtgcccgtgagagcgctcggacttggacatcgatcggacgagttggtacggtttcgattctgttcgggaagctgtcgacgggcacggtcgcctcatgacctgtcccttgcatccctccttggagcaggagcgctccgcccaccacccgggtcacgccccgtctcgcaaccttgttgcagaccaacccgttacgaggcggtttcgtttatggatgtgaactcgacgtggcggactgtggatagactttccgctaccgcctgtggatgcctcggt

SEQ ID NO: 7041 - DNA, 660 bp, Artificial Sequence
  Description of Artificial Sequence: Synthetic coding sequence
atggaactcggactcggaggattgagcaccctctcccactgcccatggccgaggcagcaaccagccctgtggccgaccctcgctgcattggccctgctgtcatccgtcgcagaggcttcacttggctcggcgcctcgctctcccgccccacgcgaaggaccaccgccggtgctggcctccccggctggacatctgcctggcggacgcaccgctagatggtgctccggaagagctaggcgcccgccaccgcagccgtcgcgcccggcccctccgcctcctgcaccgccgagcgctctgccacgcggaggcagagcggcccgcgccggaggaccaggctcgagggcccgggctgcaggagccagaggatgccgcctcaggtcgcagctcgtgccggtccgggccctgggtctgggtcaccggagcgatgaactggtgcgctttcggttctgcagcggatcatgccggcgcgcgagatcgccgcatgatctgtctctggcctcactgctgggagcaggagcattgcggccgcctccggggtcgcgccctgtgtcgcagccgtgctgccgcccaacgagatacgaggccgtgtcgttcatggatgtgaatagcacctggcgcaccgtggatcggctgagcgccactgcgtgtggctgccttgga

SEQ ID NO: 7042 - DNA, 660 bp, Artificial Sequence
  Description of Artificial Sequence: Synthetic coding sequence
atggagctcgggcttggaggactctcgaccctgtcccattgtccttggcctcgacaacagcccgcattgtggcctactctcgccgcgttggcactcctgagctcggttgcagaagcaagcctgggctccgcaccacgctccccagcaccaagagaaggtccccctcccgtgctggcaagccctgccggacatctcccagggggtagaactgcaagatggtgctcagggagagccaggcgcccaccgcctcagccgtcgcggccggcgcctccaccacctgccccaccatcggcactcccacggggcggccgcgcagcgcgagctggagggcctggatcgagggcacgagcagccggagcacgtggttgtaggttgcggtcgcaacttgtgccagtgagagcattggggttgggacatcgcagcgacgaactggtccgttttcgattttgcagtgggtcatgtaggcgggcaagatcacctcatgatctttcacttgcatcccttttgggcgcaggcgcactcagacctccaccaggtagcagaccagtctcgcagccgtgttgccgcccgacccgatacgaagcagtgtcgttcatggatgtgaactcgacctggcggaccgtggacaggctttcggcgaccgcctgtggatgccttggt

SEQ ID NO: 7043 - DNA, 660 bp, Artificial Sequence
  Description of Artificial Sequence: Synthetic coding sequence
atggaactgggattgggtgggctctccaccctgtcgcattgtccatggccccgtcagcagcccgcattgtggccgacccttgccgcactggccctgctgagctccgtggctgaagcgagcttgggaagcgccccacgatcacccgcccctagagagggtccgcctccagtgttggcatcgcctgcgggtcacctgccgggcggcagaactgccagatggtgttcagggagggcccgccgcccacccccgcagccttcaagaccagcgcctcctcctccagcgccaccttcagccctgcccaggggcggtcgagcagcgcgggctgggggtccaggaagccgcgcacgggcagcaggggcaagaggttgtagactccgttcccaactcgtgccagtgcgagcactcggcctgggacatagatcagatgaacttgtgcgcttccgtttctgctcaggaagctgtagacgcgctcgctcaccacatgatctttcgctggcctcgcttcttggagcaggagcactccgccccccacctggaagcagacctgtcagccaaccatgttgtcgtcccacccgttatgaagccgtgtcatttatggacgtcaacagcacttggcggaccgttgataggctttccgccaccgcctgtggttgcctcggg

SEQ ID NO: 7044 - DNA, 660 bp, Artificial Sequence
  Description of Artificial Sequence: Synthetic coding sequence
atggagctgggtcttggcggactctctacgcttagccactgcccgtggccgcggcagcagcccgctctctggccgacacttgcggctttggcgctgctttcctctgtggcagaagcctcccttgggagtgcaccgcgttctccagcccctcgcgagggccccccccccgtcctcgcaagccccgccggccacctccccggtggtcggactgcccgctggtgctcgggccgtgcccgccgccctccgccccagccgtcccgacccgcgccgccccctcccgctccaccgtctgccctcccacgcggaggtcgagcggcgcgggcgggtgggcctggatcgcgtgctcgcgccgccggtgccagaggttgccgcctccggtctcaactggtcccggtcagagccctcggactcggccacagatctgatgaactggtccgcttccgtttttgcagcggtagctgccgccgagcccggtccccgcacgacctatcgctcgcttctctcttaggcgccggcgcccttaggcctccgcctggttcgaggcccgtttctcagccatgctgcagaccgacccgctacgaagcagtctctttcatggacgtgaacagcacgtggcgcacggtcgaccggctcagcgccactgcctgcggctgcctggga

SEQ ID NO: 7045 - DNA, 660 bp, Artificial Sequence
  Description of Artificial Sequence: Synthetic coding sequence
atggaactgggtctgggcggattgagcacgctgtcccactgtccgtggccaaggcagcaacctgcgctgtggccgactctggccgcactggccctgctgagcagcgtggcggaggccagcctcggatcggcgccaagatcgccggcaccacgcgagggcccgccaccggtccttgcctcaccggcggggcacctgccgggcgggcggaccgcacgctggtgctccggccgcgcccggcggcctccaccgcaaccctcgcggccggccccgccaccgcctgcccctccgtccgctctcccgcgcggaggccgtgccgcaagagctggcggacctggatcccgcgccagggccgcaggtgcgcgagggtgtagactgagatcacagctcgtgccagtcagagcactgggcctgggtcacagatcggatgaactggtgagattcaggttctgctccggatcgtgtagaagagcaaggtccccgcatgatctgagcctggcctccttgctcggagccggtgcactccggccaccaccggggtcacgccccgtctcgcaaccttgttgtcgcccgacccgctacgaggcagtgtccttcatggacgtgaattcaacttggagaaccgtggaccggctcagcgcaaccgcctgcggatgccttggg

SEQ ID NO: 7046 - DNA, 660 bp, Artificial Sequence
  Description of Artificial Sequence: Synthetic coding sequence
atggaactgggcttgggaggcctgagtacgctcagccattgcccttggcctcggcaacagcccgccctgtggccaacgttggctgcactagctctgctatcttctgtggccgaggcatccttggggtctgctccgaggagccccgccccgcgtgaaggtcctccacctgtcttagcaagccccgcgggccacctcccaggaggcaggaccgccaggtggtgctccggacgggcgcgacgtccaccaccccaaccctcccggcccgctcctcctcccccagccccgccatccgccttgccccgcggcgggagagcagcaagagccggcggccccgggtcgagggcccgggccgccggtgccagaggatgtcggcttaggtctcagctcgtgcccgtccgggccctcggcctgggccatcggagcgatgagctggtgaggtttcgattctgttcaggttcttgccggcgcgccaggtctcctcatgacctgagtctggctagtctgctgggggccggggctctgaggcctccacctggctcgcgacctgtatcccaaccttgttgtagaccaacccgctacgaggctgtgagctttatggacgtcaacagcacctggaggactgtcgatcggctgtctgcaactgcatgtggctgcctgggg

SEQ ID NO: 7047 - DNA, 660 bp, Artificial Sequence
  Description of Artificial Sequence: Synthetic coding sequence
atggaactcggactgggcggcctctccacactttcacattgtccgtggccaaggcagcagcctgctctgtggccaacattggccgccctggcccttttgtctagcgtggccgaagcatctctgggttcagcaccacggagtcctgcgccgcgcgaaggccctcctccagtcctcgcgagccccgcaggccacttgcccggcgggagaactgccagatggtgttctggcagggcccgtcgcccccccccacaaccatcccgtcccgctccaccacccccagcccctccctctgccctcccccgcgggggtagagcagccagggctgggggccctggatccagggccagagctgctggcgcccgcggctgtcgcttgaggtcccagctggtgcccgtaagggcactaggccttgggcatcggtctgacgaactggtgagatttcgattctgttccgggtcctgccgccgcgctagatcgcctcacgatctcagtctcgcttcactcctaggagccggggcattgaggccgccgcccggatcccgaccagtgagtcagccatgctgcagacccacgcgatatgaagctgtaagcttcatggatgttaactctacgtggagaaccgttgacagactcagcgcaaccgcgtgtgggtgcctcggg

SEQ ID NO: 7048 - DNA, 660 bp, Artificial Sequence
  Description of Artificial Sequence: Synthetic coding sequence
atggagctcggcttgggtggtctgagcacactttcacattgtccttggccgcggcaacaacccgcattgtggcctacgctcgccgctttggccctgctatcctctgtggccgaagcatccttgggcagtgccccccggtcgcctgccccccgcgagggccctccccctgtcttggcgtctccagccggccacctgcctggaggaagaaccgctcgctggtgctccgggagagcccggcgcccaccccctcagccaagcaggcctgcacctccacctcctgccccaccaagtgctttgccaagggggggacgagctgctcgagcgggagggcccggatctagggcgagggcagccggagctcgcggctgcaggctgcggtcccaactcgtacctgttcgggctttgggtctggggcacaggtctgatgaacttgtgcgctttcgtttttgctccggatcttgtcgacgcgccagatcaccccatgacctgtccctcgcatccttgcttggagccggagcactgaggccccctcccggctctagaccagtgtcccaaccgtgttgccggcctaccaggtacgaagctgtctcttttatggacgtaaattctacctggcggaccgtggaccgcttgtcagccaccgcctgcgggtgtctgggc

SEQ ID NO: 7049 - DNA, 660 bp, Artificial Sequence
  Description of Artificial Sequence: Synthetic coding sequence
atggagctgggactcgggggactgtccactctgtcgcattgcccgtggcctcggcagcagcccgcactgtggccgaccctggccgccctcgccctgctgtcatcagtcgctgaggcgtcgcttgggtcagcgccgcgctcgccggcaccgcgcgaaggaccgccacctgtcctcgcgtcccctgcgggccacctgccgggagggaggaccgcccggtggtgctctggccgtgcccggcggccgccaccacagccttcgcggccagccccgccgccgccggcccctccatcggccctcccgcgcggcggtcgcgcggcgcgtgcggggggcccgggctcccgggcccgcgccgcaggagcaagaggatgccggttgcgctcgcaactggttccagtgcgcgcgttgggactggggcataggtcggacgagctggtgcggttccggttttgttctgggagctgccgccgcgcccgaagcccgcacgacctgtcgctggcctcgttgctgggagcgggcgcgctccgcccacccccgggtagcaggcccgtgtctcagccatgctgtagacctactcggtacgaagcagtctcctttatggacgtgaattcaacctggcggaccgtggatcggctctcagcgacggcttgtggatgcctgggt

SEQ ID NO: 7050 - DNA, 660 bp, Artificial Sequence
  Description of Artificial Sequence: Synthetic coding sequence
atggaattgggtctgggcgggttgtccactctttcgcattgtccttggccccggcagcaacctgccctgtggccaaccctcgcagcattggcactcctgtcgtccgtcgcggaagcctcgctcggaagcgctccccgttcgcctgcacctcgcgaaggcccacctcctgtgctcgcatctcccgcaggacacctgccgggagggagaactgcgagatggtgttcgggaagggcaagacgacctcctccacagccaagccgtcccgctccaccgcctccagccccgccatccgcactgccaagaggcggcagagcagcacgagccggtggtcccgggtcgcgtgcccgcgcggctggtgcgcgtgggtgtcggctgaggtcccaactcgtgccagtgagagcactgggtcttggccatcgctccgatgagctggtcaggttcagattttgtagcgggtcatgtagaagggccagatctccacatgatctgtcgctggcatcgcttttgggagcaggtgcgctccgtcccccgcctggcagcaggcctgtctcgcaaccttgttgcaggcctaccaggtacgaagccgtgtcctttatggatgtgaattcgacctggcggaccgtggatagactttccgcaactgcatgcggttgtctgggt

SEQ ID NO: 7051 - DNA, 1599 bp, Artificial Sequence
  Description of Artificial Sequence: Synthetic coding sequence
atgggaccaagaggagcagcatccctccctcgcggaccagggcctagacgacttttgctgcctgtcgtgctcccattgctcctgttgcttcttcttgcacctcctggttccggcgcaggcgcatcccggcccccacacctggtctttttgctcgcagacgacctgggatggaacgacgtgggatttcatggttcgcgcattcgcactcctcatctggacgctctcgcagcaggaggcgtgcttttggataactattacacccaacctctttgtacgccttctcgctcacaactgcttactgggagataccaaattcggactggactccaacaccagataatctggccgtgtcaaccctcgtgtgtgcccctggacgagaaacttcttccccaacttctgaaggaagctggatacactacgcatatggtcggtaagtggcatcttggaatgtataggaaggaatgccttcccacgcggaggggattcgatacttacttcggatacctgcttggatccgaagattactactcccatgagagatgtacccttatcgatgcattgaacgtgactagatgtgcacttgattttcgcgatggggaagaggtggcaaccggttataagaacatgtattcgacgaatatcttcaccaagcgagcaattgcactgatcaccaaccacccacccgaaaagcccctgttcctctaccttgcactgcaatcagtccacgaacctctccaggtgccagaagaatacctcaagccgtacgacttcatccaggataagaaccgacatcactacgcgggaatggtcagccttatggacgaagcggttggaaatgtgacggcggcactgaaaagctctggactgtggaacaacaccgtgtttatcttttcgaccgataacggcggtcagaccctcgcaggcggcaacaattggcctctgcgcgggcgtaagtggtcgctttgggagggaggagttcggggggtgggatttgtggcctcccctctcttgaaacaaaaaggggtgaagaacagagagcttattcacatttcagattggctgcccactctcgtgaagctggcacgtggacatactaatggaactaagcctcttgacggattcgatgtgtggaaaaccatctccgaaggttcgccttcccccagaattgagcttcttcacaatatcgatccgaactttgtggactcaagcccttgtcctagaaactcgatggcacctgcaaaagatgactcctcgctccctgagtactcggcattcaatactagcgtccatgcggcaattaggcacgggaactggaaacttttgactggctacccggggtgcggttactggttcccaccaccctcgcagtacaatgtgtcagaaataccttcatcggatccccccaccaagaccctgtggctttttgacattgaccgggacccagaggaaagacatgatctctctcgcgaatacccccacatcgtgaccaaacttttgagcagacttcaattctaccataagcactcggtccccgtgtacttccctgcacaggacccccgatgtgacccaaaggcgactggtgtctggggtccttggatg

SEQ ID NO: 7052 - DNA, 1599 bp, Artificial Sequence
  Description of Artificial Sequence: Synthetic coding sequence
atggggccaagaggggccgcctccttgcctcgcggacccggacccaggcgcttgttgctgccagtggtcctgcctctccttctcctcctgctcctggcacccccagggtctggggccggggcctctcgcccaccccatcttgttttcctcttagctgatgatctagggtggaacgatgtcggatttcatgggagtcgaattaggacacctcatttagacgctctagccgctggaggagtcctgctggataattattatactcagcctctttgtactccctcccgctctcagctccttacagggaggtatcagattcggacagggctccagcatcagataatatggccttgtcagccaagttgcgtgcctctcgatgaaaaactgctcccccagttattaaaagaggccggatatacaactcacatggtagggaagtggcatcttggaatgtatcgcaaagaatgtctccccacaaggaggggattcgatacatatttcgggtacctactcgggtctgaagattattacagtcatgaacgctgtacattaatcgatgcccttaacgtaacaaggtgtgctctggatttccgagatggggaagaagtggccacagggtataagaacatgtattctacaaatatattcactaaacgagcaatcgcactcataactaaccacccccccgagaaacccctcttcctatacctggccctgcagagtgtacatgagcccctccaggtgcctgaagaatacctcaaaccctacgattttatacaggataagaacagacaccactacgctggaatggtgtcgctcatggatgaagccgtggggaatgtgacggccgctctaaaatcttccgggctgtggaacaatacagtcttcatattttctactgataacgggggacagacactcgccggggggaacaattggcctcttaggggacgaaagtggtcattatgggaagggggagtgcgaggagtagggtttgtggcatctccccttctaaaacaaaagggagtcaaaaatcgcgaacttatacacatctccgattggctgccaacactcgtcaaactcgcacgcgggcatactaatgggactaagccactcgatggattcgacgtatggaaaacaatctcagaaggatcccctagtccacgaatcgaactcctccacaacatagatcctaattttgtggattcctcaccatgccctcggaatagtatggctcccgcaaaagatgattcctcgttacccgaatattctgctttcaatacatcagttcacgccgccatcagacatggaaactggaaattgctcacaggatatccagggtgtgggtattggttcccccctccatcacagtacaatgtttctgaaatcccatctagtgatcctcccacaaaaactctctggctctttgacatcgaccgcgatcccgaagaacggcatgatctgtcccgcgaatatccccacatagtgactaaactactgtccaggctgcagttctaccacaaacactccgtacccgtgtattttccagctcaggatccccggtgtgatcccaaagctacaggagtatggggaccctggatg

SEQ ID NO: 7053 - DNA, 1599 bp, Artificial Sequence
  Description of Artificial Sequence: Synthetic coding sequence
atggggccaaggggagccgcgtcgctgcctcgcgggccaggacctcgccggcttctgctgccggtggttctgcctctgctgctgctgcttctgctcgcacctccaggcagcggggcgggagcctcccgcccgccgcacctggtgttcctcttggcagacgacttggggtggaacgatgtgggatttcatggctccagaatccgcaccccacacctcgacgcgctggccgcggggggagtgctgctggacaactactacacgcagccgttgtgcactcctagccgaagccagctgctgacgggcagataccagatccgcactgggctgcaacaccaaatcatctggccatgccaacctagctgcgtcccgctggacgaaaagctcctgccccagctgctgaaagaggccggctacacgactcacatggtgggcaagtggcatctgggaatgtaccggaaggaatgccttcctacccgccgcggctttgatacctacttcggatacctgcttggaagcgaagattactatagccacgagcgctgcacgctcatcgatgccttgaacgtgacccggtgcgccctggatttcagagacggggaagaggtggctaccggatacaagaatatgtactcaactaacattttcacgaagagggcgatagcgctcattaccaatcatccgcctgaaaaacctctgttcctttacctcgcactgcagagcgtgcatgagccactgcaagtgccggaggaatacctgaagccgtacgactttatccaagacaagaatcgccatcattacgctggaatggtgtcccttatggacgaggcagtggggaacgtgaccgccgccctgaaatcctctggactttggaacaacactgtgttcatcttctccactgacaacggaggccagaccctggccggcggtaacaactggccattgcggggaagaaagtggtcgctctgggaaggaggagtccgaggtgtgggctttgtagcttccccgctgctcaagcaaaaaggggtgaaaaaccgtgagttgattcacatctccgattggctcccaactttggtcaagctcgcccgaggccataccaacgggaccaaacccctcgacgggttcgatgtgtggaaaactatctcagaagggtcgccttcgccgagaatcgaactcctgcacaacatcgatccaaatttcgtggactcgtcgccgtgtccgcggaactcgatggcgcccgccaaagatgactcctccctgcctgaatactccgcgttcaataccagcgtgcatgctgcaatccggcacgggaactggaagctcctgacgggctacccgggttgcgggtactggttcccccctccgagccaatacaacgtgtcagaaatcccgtcatcggaccccccaactaagaccctgtggctcttcgacattgaccgcgaccctgaggagagacacgacctctcgagagaatacccccacattgtcactaaactgctgtcgcgcctccaattctaccataagcactccgtgccggtgtacttcccagcccaagaccctcggtgcgatccaaaggccaccggagtgtggggaccatggatg

SEQ ID NO: 7054 - DNA, 1599 bp, Artificial Sequence
  Description of Artificial Sequence: Synthetic coding sequence
atggggccgcggggagctgcgtccctgccgcggggccctggaccgcggaggctccttctcccagtcgtcctgcctctgctgctgctcctgctgctcgctcccccaggtagcggcgccggagcttccagaccgccgcacttggtgttcctcttggctgatgaccttgggtggaatgacgttgggtttcatggatcccggatccgcaccccacacctggacgctctcgccgctgggggcgtgctcctggacaactactatactcaacccctgtgcactccgtcaaggtcccagctcttgaccggacgctaccagatcaggaccggcctccagcaccagatcatctggccttgccagccgtcgtgtgtgccgctcgacgaaaagttgctgccacaactgctgaaggaggcaggatacaccactcacatggtgggaaagtggcatctgggaatgtaccggaaagagtgcctgcctactcgcagggggttcgatacctattttggatacctcctgggctcagaggactactactcacacgagcgctgtaccctgatcgacgctctgaacgtcactcggtgcgccctggacttccgcgacggggaggaggtcgccactgggtacaaaaacatgtacagcactaacatctttaccaagcgggctattgcgttgatcaccaaccacccacctgaaaagcctctcttcctgtacttggcgctgcagtcagttcacgaaccgcttcaggtgccagaggaatacctcaaaccgtacgactttatccaggataagaacagacatcactacgcggggatggtgagcctgatggacgaggccgtgggaaacgtgactgcagccctgaagagctctggtttgtggaacaataccgtgttcattttctcgaccgataatggtggacagaccctggccggaggtaataactggccgctgcggggacgcaagtggagcctgtgggaggggggagtgcgcggagtcggattcgtcgcatcccctctgctgaagcagaaaggagtcaagaaccgggaactgattcacatcagcgattggctgccgacccttgtgaaactcgctaggggacacacgaatggaaccaagcccctggacggattcgatgtctggaaaaccatctcggaaggatcgccgtcgcctcggatcgaattgttgcacaacatcgacccaaacttcgttgactcttctccttgcccgaggaactcaatggccccggccaaggatgactcgtcgcttccagagtacagcgcctttaacactagcgtgcacgcggcgatccggcacggaaactggaagctgctgactgggtacccgggctgcggatactggttcccaccgccgtcccagtacaatgtgtcagaaatcccgtcctcggatccaccgactaagacgctctggctcttcgatatcgaccgcgacccggaggagcggcatgacctgagccgggaatacccacatattgtcactaagctgctgtcacgcctccagttctaccataagcatagcgttccagtctacttcccggcccaggacccacgctgtgacccaaaagctaccggggtgtggggcccttggatg

SEQ ID NO: 7055 - DNA, 1599 bp, Artificial Sequence
  Description of Artificial Sequence: Synthetic coding sequence
atgggacctagaggtgcggcctcactcccgcgaggcccggggccacgcaggctgctgctgcctgtcgtccttccattgctgctcttgttgctgctggcaccccccggaagcggcgccggagcttcgaggccgcctcacctggtgttcctgctggcagacgacttgggatggaatgatgtagggtttcatggaagccgtatccgaacgccccatctcgacgccctggccgccggcggggtgctgttggacaactactatactcagcctctgtgcacgccgagccggagccagcttttgacgggacgctatcaaatccgtaccggactccaacatcaaatcatatggccctgccagcctagctgcgtgccgctcgatgagaagctgcttcctcagctgctgaaagaggcgggatacactactcacatggtggggaagtggcatctgggtatgtacagaaaggaatgcttgccaaccagacgcggattcgacacctactttggatatctgctgggctccgaagattactactcgcacgagcgctgcaccctgatcgacgcactgaacgtgacgagatgtgctttggatttcagagatggcgaagaggtggctaccggatacaaaaacatgtacagtaccaacatcttcaccaaacgggcgatcgcactcatcaccaaccacccccctgagaagccactcttcctctacctggcactgcagtcagtgcacgagccactccaggtcccagaagaatacctgaagccgtacgatttcatccaggacaagaaccgccatcactacgcgggtatggtgtccctcatggacgaagcggttggaaatgtgacggccgcgctcaagagttccggtctgtggaacaacaccgtgttcattttctcaaccgacaatggagggcaaactttggccggaggaaataactggccgcttcgcggccggaagtggtcactttgggaagggggagtgaggggggtcggattcgtggcgtcaccactgctgaagcaaaaaggggtgaaaaatcgggaattgattcacattagcgactggctccctacgctggtgaaacttgcccggggacatactaacgggaccaagcctctggacggcttcgatgtttggaaaactatctcagaaggctccccgagcccgagaatcgaactgctccacaacattgatcctaacttcgtggattcgagcccctgcccgcggaattccatggcgccggctaaagacgattcgtctttgcctgaatactcggcctttaacacttcggtgcacgcggcaatcagacatggcaattggaagctcttgactggatacccaggctgcggctactggtttccgccgccatcccagtacaacgtcagcgaaatcccctcctcggacccgcccactaagaccctctggctgttcgatatcgatcgcgacccagaggagagacatgatctcagcagagagtaccctcacatcgtgactaagctgctgagccgcctgcagttctaccacaaacactccgtgccagtatactttcccgcccaagacccgagatgtgacccgaaggctaccggagtctggggaccgtggatg

SEQ ID NO: 7056 - DNA, 1599 bp, Artificial Sequence
  Description of Artificial Sequence: Synthetic coding sequence
atgggaccacgaggcgccgcttcattgccgagaggcccgggtcctaggcgacttctgctgcccgtggtgctgcctctcctgctgctcctgctactcgcccccccaggctccggcgctggcgcaagccgccctccacaccttgtgttcctcctggccgatgacctgggatggaatgacgtcggctttcacggctcccggattaggaccccccaccttgacgctctggcagcagggggggttctgctggacaactattacacacagccactctgcaccccatcaagaagtcagctgttaactggacgatatcagatccggaccgggctccagcaccagattatctggccttgtcagccatcatgcgttcccctggacgagaaactgttgccacagctgctaaaagaagcagggtatactacccacatggtgggcaagtggcacctcgggatgtaccggaaggagtgcctgcctactaggcgcggattcgacacttactttggttatctcctaggatctgaagattactactcgcacgaacgttgcacactgattgacgcgctgaacgtcactcggtgtgccctggactttcgcgacggagaggaggtggctactggttacaagaatatgtatagcaccaacatcttcacgaagcgggctatcgcgttgatcacaaaccatcctcctgaaaagccactttttctgtacttggccctccagtctgtgcacgagccgttgcaggtgcctgaagagtacctgaagccatacgattttatccaggataagaatagacaccattatgcagggatggtgtccctcatggatgaagcagtaggcaacgtgacggctgcattgaagtcatccgggttgtggaataacacggtgtttatcttcagcaccgacaatggaggtcaaaccctcgctggcggcaacaactggcctctccgaggaaggaaatggtcactgtgggaggggggagttcgcggggtagggttcgtggctagtccgctgcttaagcagaagggagtcaaaaatagggaactgatccatatctccgattggcttcctacactcgtgaagctggcgcgcggccacacgaacgggacgaaacccctagatggtttcgacgtatggaagaccatctccgagggttctccctccccacgcattgagctattgcacaacattgaccctaatttcgtggattcgtccccttgtccgcgaaactcgatggcgcctgccaaagacgattcaagcctgccagaatattctgcttttaacacttctgtgcacgccgctatccggcatggtaactggaagctgctgacaggctatcccgggtgtggttactggtttcctcctcctagtcagtataatgtgagtgaaatcccaagcagtgatcctccgacgaagaccctttggttatttgatattgaccgagatcctgaagaacgtcacgatctttcaagggagtacccgcacatagtgacaaaacttctgtctcgcctgcaattttaccacaagcactccgttcccgtctatttccccgctcaggaccccagatgtgaccccaaggcaacaggcgtgtggggtccatggatg

SEQ ID NO: 7057 - DNA, 1599 bp, Artificial Sequence
  Description of Artificial Sequence: Synthetic coding sequence
atgggtcctagaggagctgcctccttacctaggggacctggcccaaggagattgttacttccagttgttcttccgctattgttgttgctgcttctagccccccctgggtcaggcgcaggagctagtagaccacctcatttggttttcctcctcgctgacgatcttggatggaacgacgttggttttcatggttctcggatcagaactccacatttggacgcccttgctgctggaggagtattgctggacaactactatactcaacctctttgcactcctagtcgtagtcaactgttgacaggtagataccaaattcgaacgggtcttcagcatcagattatatggccttgtcagcctagttgcgtgcctttggatgagaaacttcttcctcagctgcttaaggaggccggttatactactcatatggtgggaaaatggcatctgggaatgtataggaaagaatgtcttccaacgagacgaggatttgacacttattttgggtatttgcttggctcggaagactactattctcacgaaagatgcaccttgatagacgccttgaacgttactagatgcgctcttgatttccgtgatggagaagaagttgcgacaggttataagaatatgtattcaacgaacatttttactaagcgtgccattgctcttattaccaaccatcctcctgaaaaaccactctttttgtatcttgctctccagtcggttcacgagccactacaggttccggaagagtatcttaaaccatatgactttattcaggataagaacagacatcactacgctggaatggtttctcttatggatgaggctgtcggtaatgttacagcagctcttaaatcaagtggtttatggaataacactgtcttcattttctccactgataacggtggtcagactcttgcaggtggaaataattggccactgaggggaaggaagtggtctctttgggagggaggcgttaggggtgtaggtttcgttgcttctccacttttaaagcagaagggagtcaagaacagagaactgattcatataagcgactggcttccaactctagttaaactggccaggggccacacaaacggaacaaagcctttggacggtttcgatgtgtggaagacaatttccgagggttccccaagccctcgtatcgagcttttgcataacatagatcccaactttgttgacagctcaccatgcccgcgaaactcaatggcccccgctaaggatgattcatcactgccagaatattcagcttttaatacgtcagttcacgccgcaattcgacacggaaattggaagctcttaacaggctatccaggttgcgggtactggttcccacctcctagtcagtataacgtctcggagattccctcgtccgatcctccaaccaagaccctgtggttatttgatatcgatcgtgatcctgaagaacgccatgatctctcaagggaatacccacacatcgtgactaagttgcttagccgtcttcaattttatcacaaacattccgtgccagtgtattttcccgctcaggaccctagatgcgacccaaaggctactggcgtttggggtccctggatg

SEQ ID NO: 7058 - DNA, 1599 bp, Artificial Sequence
  Description of Artificial Sequence: Synthetic coding sequence
atgggccctcgaggcgcggcgtcgcttcccaggggcccgggaccgcgccggttgctgctcccggtagttctgccgctgcttcttctccttctcctggccccgccagggtctggagccggggcgtctcgtcctccgcatctcgtttttctgttagccgatgatctaggatggaacgatgtaggcttccatggttctcgtattcgcacgccacatcttgacgccttggccgctggtggcgtcttgctagataattattatacgcagcccctatgtacgccgtcaagatctcaactacttacaggcagatatcaaataagaacaggcctgcagcatcaaattatctggccatgccaaccgtcttgtgtgccgctcgatgagaagttactaccacagttgctgaaagaagccggatacaccacacatatggtagggaagtggcatctcggtatgtacagaaaagaatgcttaccgacgagaagaggatttgacacttacttcgggtacttacttggttccgaagattattattcacacgaacgttgcacgctaattgatgctttaaacgttactcgatgtgcattagattttagggacggcgaagaagtagcgacaggttacaaaaatatgtattcgacaaatattttcacgaaacgtgctatcgcgctgattacgaaccaccccccagaaaagccgttatttctctatcttgcactgcaaagtgttcacgaaccgcttcaagtgccggaagaatatcttaaaccttacgatttcattcaagataaaaaccgtcatcattatgcggggatggtctctttgatggatgaggcggtcggaaatgtcacagcggcactgaaatctagcggtctctggaacaacacagttttcatatttagcacagacaatggaggacaaaccctggccggaggaaacaactggcctttgcgtgggaggaaatggagcctgtgggagggtggcgtacgcggggtcggattcgtagcgagtccattgttgaaacaaaaaggggttaaaaatcgagaacttattcatatcagcgactggcttccgactcttgtaaaacttgcccgtggacatactaacggcacgaaaccgttggatggttttgacgtttggaaaacaatttctgaaggctcgccgagtcctaggattgaactgttgcacaacattgatcctaactttgtcgattcgtctccatgtcctcgcaattccatggctcctgcaaaggatgattccagtctgccagagtactcagcgtttaatacgtctgtgcatgcggcaattcgacatggcaattggaagttgttaacaggctatccgggttgcggatattggtttccaccaccgtcacagtataatgtatcagaaataccgagcagcgatccgccgacaaagacactttggctgtttgacatcgatcgtgatccagaagaaaggcacgacttgtcgcgtgaatatccacacatcgtgacgaaattattaagcagacttcagttttatcacaagcatagcgttcctgtttattttccggcacaggatccgcgctgcgatcctaaagcaaccggtgtctggggtccgtggatg

SEQ ID NO: 7059 - DNA, 1599 bp, Artificial Sequence
  Description of Artificial Sequence: Synthetic coding sequence
atgggtccacgcggcgccgccagccttccgagaggaccgggcccacggagactgctgctgccggtcgtcctgccactgcttctcctgctgctcctggcacctccgggctcgggagctggcgcatcccggccaccgcatctcgtctttcttctggctgacgaccttgggtggaacgatgtggggttccatggctcgcggatccgcaccccacatctcgacgcgctggccgcaggaggcgtgcttctcgacaactattacactcagcccttgtgcactccaagccgctctcagttgctcactggacgctaccagatccgcaccggcctgcagcatcagatcatctggccgtgtcagccgtcatgcgtgcctcttgacgagaagctgctgcctcagcttctgaaagaggcaggatacaccacccacatggtgggaaaatggcatctgggaatgtaccgcaaggaatgcttgccgactagacgcggatttgatacctactttggatacctgctcggctcggaggactactacagccacgagcgctgtactctcattgatgcgctgaacgtgacccggtgcgctctggattttcgagatggagaagaggtcgcgaccggatacaaaaacatgtacagcaccaatatcttcaccaagcgcgctatagccctcattactaaccacccaccagagaaaccgctgtttctctacctggcccttcaatcagtccacgagccactccaggtgcccgaagaatacctgaagccgtacgacttcatccaggacaagaatcggcatcactacgcgggaatggtgtctctgatggacgaagccgtgggaaacgtgactgcggcactcaaatcctccggactgtggaacaacaccgttttcatcttcagcactgacaacgggggccaaactcttgccggaggaaacaattggcctctgcggggccggaaatggtccctgtgggagggaggggtgagaggagtggggtttgtggcgtccccactgctgaaacagaagggagtgaaaaacagggaactcatccatattagcgactggctgccaactctggtgaagctcgctagaggacacacgaacgggactaagcctctggacggtttcgacgtgtggaaaaccatctcggagggatccccgagtccgcgaatcgaactgttgcacaacatcgatcccaatttcgtggactcgagcccttgtccgagaaactcgatggctccggccaaggacgattcctcgctcccagaatacagcgcgttcaacacttcggtgcacgcggcgatccgacatggaaactggaagctgctgactgggtaccctggctgcggatactggtttcccccaccgtcccaatacaacgtgagcgagatccccagcagcgacccgccgaccaagaccctgtggctgttcgacatcgaccgcgaccccgaagagcggcacgacttgtcccgcgaatacccacacatcgtgactaagctgctctctcggctgcagttctatcacaagcattcggtgccggtgtactttcccgcacaggatcctcgctgcgaccctaaagctaccggagtgtggggcccatggatg

SEQ ID NO: 7060 - DNA, 1599 bp, Artificial Sequence
  Description of Artificial Sequence: Synthetic coding sequence
atgggcccgaggggtgccgcctcactcccacggggccctggacctaggagactcctgctgccagtggtgctgcctctgttgctcttgctcctcctggccccacctggaagcggcgcaggagcgagtagacctccgcatctggtgttcctgttagccgatgatctgggctggaacgatgttggattccatggcagtcgcattcggacaccacatcttgacgcattagccgccggcggggtgcttctggataattattatactcaaccactctgtacacctagtagatcacaactgcttacaggcagatatcaaattaggaccggacttcagcatcagataatttggccttgccagccaagctgcgttccactcgacgaaaagttgctgcctcagctgctgaaggaggctggttataccacacacatggttgggaagtggcacctcggcatgtacaggaaggagtgcctgccgacaaggcggggatttgatacctactttggctatctactggggtccgaagactactatagccatgagagatgcacgttgatcgacgcgctcaacgtgacacgctgcgctctggactttagagacggcgaagaggtcgcaactggctataagaacatgtactccaccaacatatttacaaagagggctatcgccttaattaccaaccacccaccagagaagcccctgttcttgtacctggcactgcagagcgtccacgaaccacttcaggttcccgaagagtacctgaagccttacgattttatacaagataagaatagacaccattatgcaggcatggtctccctcatggatgaggcagtaggcaatgtgacagccgcactgaagtctagcggtctttggaataacaccgtcttcatcttctcaaccgataatggcgggcagacacttgctggcgggaacaattggcccctcaggggtagaaaatggtctctgtgggagggcggggtgaggggagttggattcgtggccagtccccttctaaagcagaagggcgtgaaaaacagagaactgatccatatatccgattggttgcctactctggtcaaactcgccaggggacatacaaacgggactaagccattggatggattcgatgtttggaagacaatctctgaaggctctccttccccaaggattgaactcttgcataatatcgaccccaattttgtcgacagctctccgtgcccaaggaattccatggcaccagccaaagacgacagcagtctccctgagtactctgccttcaatacttcagtgcacgctgcaattcgacacggcaactggaaacttctgaccgggtaccccgggtgcggctattggtttccacccccatcccaatataacgttagcgaaatcccctcctccgacccaccaaccaaaaccctgtggttgtttgatatagatcgcgatcctgaagagaggcacgacttgtctcgcgaatatcctcacattgtcactaaactcctctctcgcctacagttctaccacaagcactccgtgcctgtgtattttccagcacaggaccccaggtgtgatccaaaagcaacaggagtctggggtccatggatg

SEQ ID NO: 7061 - DNA, 1599 bp, Artificial Sequence
  Description of Artificial Sequence: Synthetic coding sequence
atgggaccgagaggagcagcctcactgcctagaggaccgggaccgaggagactgctcctgccagtcgtgctgcctctgctgctgctcctcttgctggccccgcccggaagcggagcgggcgcctcgcggcctccacacctggtgttcctgctcgctgacgatctgggctggaacgacgttgggtttcacggaagccgcatccggaccccgcatctcgacgcactggcggcaggcggagtcctgctcgacaactactatactcaaccgctctgtaccccatctcgctcccaactcctgactgggcgttaccaaattagaaccggattgcaacaccagatcatctggccttgtcagccaagctgcgtgccgttggacgaaaagctcctgccacagctgcttaaggaggcgggatacactacgcatatggtgggtaagtggcacctcggaatgtaccggaaggaatgtctcccaactcggcgcgggtttgacacgtacttcggctacctgctggggtcagaagattactactctcacgagcgctgtaccctgattgacgcgcttaacgtgactcgctgcgcgcttgacttcagggatggagaagaagtcgccactggctacaagaatatgtactcgaccaacatcttcactaaacgcgccatcgccctgatcactaatcacccgccggagaaacccctgtttctctacctggcgctgcagtccgtccacgagccactccaggtgccggaagagtacctcaagccatacgactttattcaggacaagaatcggcaccattatgccggaatggtttcgctgatggacgaagctgtcggaaacgtgactgcggctcttaaatctagtggactgtggaacaataccgtctttatcttttcaaccgataatggagggcagaccttggcaggaggcaataactggcctctgagaggcaggaagtggtcgctgtgggaaggaggagtgcggggcgtcggattcgtcgcctcgcccctcttgaaacagaagggggtgaagaacagagagctgatccatatctccgattggctgccgacgctggtcaagctggcacggggacacactaacggcacgaaacccctggatggattcgacgtgtggaaaaccatcagcgagggtagcccatcccctcggatcgaacttctccataacatcgaccccaacttcgtggattcgagcccgtgtccgagaaattccatggcgccggcaaaggatgacagctcactcccggagtatagcgcgtttaacacctcggtgcacgccgcaatccgccacggaaactggaagctgctgactggatatccgggatgcgggtactggttcccgccgccttcacaatacaatgtctccgaaattccctcttcggacccaccgaccaagaccctgtggctcttcgatatcgaccgagatccagaggaacggcatgacctgtcgcgggagtacccgcacatcgtcaccaaactgctgtctcgcctccagttctaccataagcactcggtgccggtgtacttcccagcgcaggacccgcggtgcgatccaaaagcgaccggcgtgtggggcccgtggatg

SEQ ID NO: 7062 - DNA, 1599 bp, Artificial Sequence
  Description of Artificial Sequence: Synthetic coding sequence
atgggaccgcggggtgccgcctcgctgccgagaggacctggccctcgccgcctgctcctgcccgtggttcttccgctgctgctgctccttctgctggccccgccaggaagcggcgcgggggcttcccgcccgccacacctggtgttcctcctcgctgacgacttgggatggaacgatgtcggcttccacggatcaagaatccgcactccacatctcgatgccctggcggccgggggagtgttgctcgacaactactatacgcaaccgctttgcactccgtcccggtcccaactgctgaccggacgataccagatcagaaccggcctgcagcaccagatcatctggccctgccagccgtcgtgtgttccgctcgacgaaaagctcttgccgcaacttctgaaggaagccggctacactactcacatggtcggtaagtggcatcttggaatgtaccgcaaggaatgcctgccgactcggaggggcttcgacacctacttcggatacctcttgggttcagaggactattactcgcacgaaagatgtactttgatcgatgctctgaacgtcactcggtgcgccctggattttcgggacggcgaagaggtggcgacgggatacaagaacatgtactcgaccaatatcttcaccaagcgcgcaatcgctctgatcaccaatcacccgccagagaaaccactcttcctctacctcgcactgcagtccgtccacgagcctctgcaggtgccagaggagtacctcaagccttatgattttatccaggataagaacaggcaccattacgccggtatggtgagccttatggatgaagcagtgggcaatgtcaccgcagccctgaaatccagcggactgtggaataacaccgtgttcattttttctactgacaacggcggtcagactctcgcaggagggaacaattggccgctgcggggccggaagtggagcttgtgggaaggaggagtccgtggagtgggattcgtggcctccccgctccttaagcaaaagggggtgaagaatagggaactgatccatatttcggattggctgccgaccctggtgaagctggcgagagggcacacgaacgggaccaaaccgctggatggattcgatgtgtggaaaaccatttcggaaggatccccttcgcctcgcatcgagttgctccacaacattgacccgaatttcgtcgactcatcaccttgcccccggaatagcatggcccccgcgaaggacgattcgtccctgccagaatactctgcctttaacacttcggtgcatgctgcaatcagacacggaaactggaagctcctgaccggctacccgggttgcgggtactggtttcctccgccatcacaatacaacgtgagcgaaatcccctcctcagaccccccaactaaaaccctgtggctcttcgacatcgaccgcgatcctgaagagcgccatgacctgtcgagggagtacccacatatcgtcaccaaactgttgagccggctgcagttctaccataagcacagtgtgcccgtgtacttcccggcgcaagacccacgctgtgacccaaaagcgactggagtgtggggaccgtggatg

SEQ ID NO: 7063 - DNA, 1599 bp, Artificial Sequence
  Description of Artificial Sequence: Synthetic coding sequence
atgggaccaaggggagcagctagcctgcctcgggggccgggtcctcgccgacttctactgccagtggttctccccttactgctcctgctcttattagcccctcctggctcaggagccggcgccagcaggccccctcatctggtgtttctcctggccgatgacctgggatggaacgacgtggggttccatggatcccgaatccgaactccgcatctcgatgctctggctgcaggtggcgttctgctggacaattactatactcagccgctgtgtacaccctcccgttctcagctgctgaccggaagatatcaaattaggacggggctgcagcatcaaattatctggccttgccaaccctcttgtgtgcccctggacgaaaaacttttaccccagctgctcaaggaagctggatacacgacccatatggtgggtaagtggcacttagggatgtatcgaaaagaatgcctccccacgaggcgaggcttcgacacttatttcggctacctactgggatccgaagactattactctcatgaaagatgcacgctcatcgatgccctcaatgtgacaagatgcgcactcgacttcagagacggagaggaagttgcgaccgggtataagaacatgtactcaacgaatatcttcacgaagcgtgccatcgcacttattaccaaccaccctccagagaagcctctgtttttgtatctagccttgcagtccgtgcacgagcccctgcaggtgccagaagagtatctgaaaccttatgactttattcaggacaaaaacaggcaccactatgcaggtatggtttccctgatggacgaggcagtggggaacgtaaccgccgctcttaagtcaagtggactgtggaacaataccgtgttcatttttagtacagacaatggtggccagacattggcaggcggcaataactggcctctacgaggccgaaaatggtctctttgggaaggaggcgtgaggggggtcgggtttgtggcttcccctctcctaaaacaaaagggagtcaaaaacagagagctgatccacatctctgactggttaccgactctcgtgaagttggccaggggccataccaatggaacaaaaccccttgacggatttgatgtgtggaagactatcagtgaaggaagcccttctcccagaatcgagctgctacataacattgacccaaactttgtggactcctccccttgcccccgaaacagcatggcccccgcaaaggatgattccagcctccctgagtacagtgcatttaatacatcggtccatgcagcgatccgacatggcaactggaagctgcttactggctatcccggatgcgggtattggttccctccgccatctcagtataacgtgtcggagattccgtcctccgaccctccaacaaaaaccctttggctatttgatattgatagagatcctgaagaacgacacgatctgagccgagaatacccccacatcgtgaccaagttgctcagcaggctccagttctaccacaagcattcggtccccgtttatttccctgcccaggatcccaggtgtgaccccaaggcaactggcgtgtggggaccatggatg

SEQ ID NO: 7064 - DNA, 1599 bp, Artificial Sequence
  Description of Artificial Sequence: Synthetic coding sequence
atgggcccacgtggcgctgcttccctacccagaggccccggcccacgacgcttactgcttccagtggtgttacccctactactgctgctgctgctggccccacccggatctggagcaggcgccagcagacccccacacctggtgttcctcctggccgacgaccttggctggaacgacgttgggttccacggcagcagaattcgaactccccatctggatgccctcgccgccggaggtgtgctactggataattactacacccagccactgtgcactcccagccgatctcagctcctgaccggcagataccagatccgcactgggcttcagcaccagattatttggccttgccagcctagctgtgtacctttggacgaaaaactgcttccccagctgctcaaggaagccggctatactactcatatggtgggaaagtggcacctagggatgtacagaaaggaatgcttaccaactagacgcggctttgatacttacttcggctacctgctgggatcagaagattactactctcatgagcgatgtactctgatcgatgctctgaacgtgactaggtgtgccctggattttcgagatggcgaagaggttgctactgggtataagaacatgtatagtaccaatatttttacaaaaagagctatagcattgataaccaaccacccccctgagaagcccctgtttctgtatctggctctgcagagtgtgcatgagcctctgcaggtgcccgaggagtacttgaagccatacgactttattcaggataaaaaccgccatcactatgccggaatggtctctctgatggacgaggcagtgggtaatgtgaccgccgccctcaagtccagtggactgtggaataacaccgtttttattttctccaccgataatgggggccagactctcgccggaggcaacaattggcccctgcgcggccgaaagtggtccctgtgggagggcggcgtgcgcggtgtcggttttgtcgcttcccccctgctgaagcagaagggcgtgaaaaaccgcgagttgatccatattagtgactggctgcctacattagtgaagctggctaggggccatacaaacggcacaaagcccctggacggtttcgacgtttggaaaaccatatccgagggcagcccatctccccgcatagaactgctgcacaatatagaccccaacttcgtggattcttcaccctgccctagaaattctatggcacctgcaaaagacgacagttccctgcccgaatactcagccttcaacacatccgtacacgcagcaatccgccacggtaactggaagctgctgactggctacccaggatgcgggtattggttcccacctcccagtcagtataatgtgtccgaaataccatcctccgacccccccaccaaaacactgtggctgtttgacatcgatcgcgatcccgaagagcggcatgatctgtcccgggagtatccacacatagtcaccaaactactgtccagacttcagttctatcacaagcatagtgtgcctgtgtacttcccagctcaggatccccgatgcgatcccaaagccacaggcgtgtggggcccttggatg

SEQ ID NO: 7065 - DNA, 1599 bp, Artificial Sequence
  Description of Artificial Sequence: Synthetic coding sequence
atgggaccaagaggagctgccagcctgccgaggggaccgggaccacggcggctgctcctgccggtcgttctcccgctgctgctgcttctgctgctggcccctcctggatccggcgcgggggcatctcgcccaccacacctggtgttcctgctggcggacgatctcggatggaacgacgtggggtttcatggctcccgcatccgcaccccacatctcgacgccctcgctgcgggaggagtgctgctggataactattacacgcaaccactttgtaccccgtcacggtcgcaactgctcactggtagataccagattaggaccggactgcagcatcaaatcatatggccgtgccagccatcctgcgttccactggatgaaaagctcctgcctcagttgctcaaagaagccggatacactacccatatggttggcaagtggcacctcggaatgtaccggaaggaatgtctgccgaccaggagagggttcgacacgtacttcggatatctgttgggaagcgaagattactacagccacgaacgctgcaccctgatcgacgcccttaacgtgacccgctgtgcgttggatttccgggacggagaggaagtggcgactggatacaagaacatgtacagcaccaatatcttcaccaaaagagcaatcgccctcataaccaaccaccctccggaaaagccgttgttcctttacttggccctgcagtcggtgcacgaacctctccaagtcccggaggagtacctcaagccctacgatttcatccaggacaagaatcggcatcattacgccggcatggtcagccttatggacgaagctgtgggaaatgtgactgccgcacttaaatcgtcaggactctggaataacactgtctttatcttctcgacggacaacggagggcagaccctggccggagggaataactggccgctgagaggacggaagtggtcactgtgggaaggaggtgtgcggggagtcggatttgtcgcgtccccgctccttaagcagaagggagtgaagaaccgcgagctgatccacatctcggattggctccccaccctggtgaagctggctcgcggccacactaacggtaccaagcccctcgatggattcgacgtgtggaaaaccatcagcgagggatcgccgtcaccgagaattgaactgctgcacaacatcgacccaaacttcgtcgatagctcgccctgtccgcggaactcaatggccccggcaaaggacgattcgtccttgcctgagtactccgcgtttaacacctcggtgcatgcagcaatccggcacggcaattggaagctccttactggttacccgggctgcgggtactggttcccaccaccgtcgcaatacaatgtgagcgaaatcccgtcctctgacccgccaaccaagaccctgtggctcttcgacattgaccgggatccggaagagcgccacgacctcagcagggaatacccgcatatcgtgactaagttgctctcaagactccagttttaccataagcattccgtcccagtgtacttccccgctcaggaccctcggtgcgatccgaaagcgactggagtttggggcccttggatg

SEQ ID NO: 7066 - DNA, 1599 bp, Artificial Sequence
  Description of Artificial Sequence: Synthetic coding sequence
atgggacccaggggagccgcctcattgcctagggggccagggccccgccggcttttactccctgttgtccttcctctcctgttactccttttacttgccccccctgggtcgggagctggagcttccagacctccacatctcgtttttttacttgctgatgatctcggatggaatgatgtagggtttcacggatctagaatcagaactccccatctagatgccttggccgccgggggggtgcttctagataactactatacacagcccctctgcacaccaagtcggtcacagctgcttacaggacgctatcagattagaacagggctacagcaccagattatttggccatgtcagccttcttgcgtgcccctggatgaaaaactcctgccacagctccttaaagaagcaggatatactactcatatggtggggaaatggcacctcgggatgtatcgcaaagaatgcttaccaactcggcgcgggtttgatacttatttcgggtatcttctcgggtctgaggattattattctcatgagcgctgtacactcatcgatgctcttaatgtgacaagatgtgcactcgacttcagagatggggaagaagtagcaacaggatataagaatatgtattccactaatatctttactaaacgggctatcgctctgataactaaccaccctccagaaaaacccttgtttctatatctggcgctacagtctgtgcatgaacccctccaggtgcccgaagagtatcttaaaccttatgatttcatacaggataaaaatcgtcatcactatgcagggatggtgtccctcatggatgaggcagtcgggaacgtgacagccgctcttaaatcatctggactatggaacaacacagtgtttatattctcgacagataacggagggcagacactggctggaggaaacaattggcccttgagggggcgtaaatggtccctgtgggaagggggggtgaggggggtgggatttgtggcttcccctcttctaaagcagaagggagtaaaaaatcgtgaactgatacacatctctgattggctccctacattagtcaaactggcccgcggacacactaatgggacaaaaccactggatggattcgatgtgtggaagacaattagtgaaggaagtccttcacctcggatcgaactcctacacaacatcgatcccaatttcgtcgattctagtccttgtccacggaactccatggcaccagctaaagatgatagttcgctccccgagtatagtgcattcaacacatcggtacatgcggccatcaggcatgggaactggaagttactcacgggatatccagggtgcgggtactggtttccaccccccagtcaatataacgtatctgagatcccctcatctgatccccccacaaaaactctttggctctttgatatcgatagggatcccgaagagcggcacgacctctctagagaatatcctcacatcgtcactaaactactctcaaggttacagttttaccacaaacattcagtccccgtttatttcccagcccaggaccctcgctgcgatcccaaagccacaggagtatgggggccatggatg

SEQ ID NO: 7067 - DNA, 1599 bp, Artificial Sequence
  Description of Artificial Sequence: Synthetic coding sequence
atgggtccgaggggtgcggcttccttgcctcgtggccctggtcctcgacggctgttgttgcctgttgtgcttcctcttcttttgctgctcctgctcgcaccaccgggcagcggcgctggcgcatccagaccaccccatctcgtgttccttcttgcggacgatctggggtggaacgatgtgggctttcatggatcgaggataagaactccgcaccttgacgccctcgcagccggaggagtgctgcttgacaattactacacccaacctctttgtacccctagcagaagccagcttctgaccggacgataccaaatacgcactggtctgcaacatcaaatcatctggccctgtcagccatcgtgtgtgcctcttgatgaaaagctgcttccccaacttctgaaggaagcaggatacactacccacatggtggggaaatggcatcttggaatgtacaggaaggagtgccttcccactagacgcggctttgatacgtactttgggtacctgctgggaagcgaggactactactcgcatgaacgctgtaccctgattgatgcactgaacgtgaccaggtgtgctcttgacttccgcgacggagaagaagtggcaaccggatacaagaatatgtactcgacgaatatctttacgaagcgcgccattgcgctgatcaccaaccatcctccagaaaagcccctgttcctgtaccttgcgttgcagtccgtgcatgaaccacttcaggtgccggaagaatatctgaagccctacgacttcatccaggataagaacaggcaccattacgcaggaatggtgagcctgatggacgaggcagtgggaaacgtcactgcagccctgaaatcgtcgggcctctggaacaacactgtctttatcttttcgactgataacggaggtcagactttggctggcgggaacaattggcctcttagaggacgaaagtggtcgctctgggaaggaggagtgcgtggtgtggggttcgtcgcatcgccactccttaagcaaaagggggtcaagaaccgcgaactcattcatatttcggactggctgccaacccttgtgaagctggctagaggccataccaatggaaccaagcccctggacggattcgacgtctggaaaaccatttcggaaggttcgccaagcccccggatcgaactccttcacaacattgatccgaacttcgtcgatagctcaccttgtcctcgtaactctatggcacctgccaaagatgattcctccctgcctgaatactctgcatttaacacctccgtccatgcagcaattagacatggaaattggaaacttcttaccgggtatccaggatgtggatattggtttcctccgcctagccaatacaatgtgtcggaaataccaagctcagatccccctaccaagaccctttggctttttgatattgaccgggatccagaagagcgccatgacctctcgagggaataccctcatattgtcactaagctgctgagccgcctccagttttaccacaaacattcagtgccagtgtactttcccgcccaggatccccggtgcgatccaaaggccacgggagtgtggggcccgtggatg

SEQ ID NO: 7068 - DNA, 1599 bp, Artificial Sequence
  Description of Artificial Sequence: Synthetic coding sequence
atggggcccaggggagctgcctccctgccacgtggacccggaccgcgcagactcttgcttccggtagtgcttccattactcctgctgctgctcctggcacctcctgggtcaggagccggggcctcacgccccccccacctcgtctttcttctcgcggacgacctggggtggaatgatgtcggattccacggatcgcgaattaggacccctcatctggatgccctggctgctggcggcgtgttgctcgataactactatacccagcctctttgcaccccgtccaggtcacagctacttaccgggaggtaccagataagaacgggtctgcagcaccagattatttggccttgccagccctcttgtgttccactggatgagaagctgcttccgcagctcctgaaggaagccgggtacactacacacatggtggggaagtggcatctcgggatgtataggaaggaatgcctgcccacaaggcgggggttcgacacttatttcggctacctgttgggatcagaggactactactcgcacgagaggtgtaccttaatcgatgctctcaacgtcacgcggtgcgcgctagatttccgggatggtgaggaagtggctaccggttacaaaaacatgtacagtacgaatattttcaccaagcgcgcaatagctttgattactaatcatccgcccgaaaaacctttatttctgtatttagccctgcagtcagtgcatgagccccttcaggtgcctgaggaatatctgaaaccgtacgacttcatccaagacaagaatagacaccattacgctgggatggttagcctgatggacgaggccgtgggcaacgttactgcagcgctgaagagctcgggtctgtggaacaataccgtgttcatcttttccacagacaatggtggacaaacgctagctggaggaaataattggcccctgcgtggtcgcaaatggtctctctgggaaggaggagtgcgtggggtgggctttgtagccagccctttgttaaagcaaaagggagtcaaaaatagagagctcatccatataagtgattggctacctactctcgttaagctggcccgggggcataccaacggcacaaaacctctcgacgggtttgacgtgtggaaaactatttcagagggatccccttcacctagaattgagctccttcacaatatcgatcccaatttcgtggattccagtccatgcccccggaattctatggccccagccaaggacgattccagtcttccagagtactctgctttcaacacgagtgtccatgcagctattcgacatggaaattggaagctgcttaccggctaccctggatgtggatactggttcccacctccatcccagtataacgtctccgagattccaagttccgaccccccaaccaagacgctgtggctgtttgacattgatcgcgaccctgaggagcggcacgatctgtccagggaatacccacacatcgtgaccaagctgctctctagattgcagttctaccataagcactctgtgccagtttatttccctgcccaggaccccaggtgcgatccaaaagctaccggcgtgtggggaccgtggatg

SEQ ID NO: 7069 - DNA, 1599 bp, Artificial Sequence
  Description of Artificial Sequence: Synthetic coding sequence
atgggtcctcgtggtgctgcaagtcttccccggggccccgggcctcgccgcctgctcttacctgtggtactcccactgcttctccttctcctgctagcgccgcccggtagcggagcgggtgcgtctcgcccaccccatcttgttttcctcttagcggacgacctcggctggaatgatgttggcttccatgggtcgcgtatccgtaccccacacctcgatgctcttgcggcgggtggtgtgctccttgataactattacacccaacccctgtgtaccccgtctcgttctcagttgttgactggacggtaccagatccgtaccggtttgcagcatcagattatctggccgtgccagccctcgtgcgtaccactcgatgaaaagctcctgccacagctgctgaaggaggccggttataccacccacatggtcggtaagtggcacctcggtatgtatcgtaaggaatgtctcccgacccgccggggcttcgatacatacttcggttacctcctgggtagcgaggactactactcccacgagcgctgcacgttgatcgatgcgcttaatgtgacacgctgcgcgctggattttagagatggtgaggaggtggcgacgggctataagaacatgtactccactaacattttcacaaagcgtgccattgcgctgattaccaaccatcctcccgaaaaacccctgttcctctacctggctctccaatccgttcatgaacctctgcaggtccccgaggagtaccttaagccttacgacttcatccaggataagaaccgccaccattacgcgggcatggtctccctgatggatgaggccgtgggtaacgtaaccgccgctctgaaatccagcggactttggaacaacaccgttttcatctttagtacagataacggtggtcagactctggccggtggaaacaattggcccctccggggacgtaagtggtcgctgtgggagggaggagttcgaggtgttggcttcgtcgctagcccccttctcaagcagaagggcgtgaagaacagagagcttattcatatctccgactggcttcccaccttggtcaagctggcgcgtggtcacaccaacgggaccaagcccctcgatggatttgacgtttggaagactatcagcgagggcagcccgagccctcgcatcgagctcctgcataacatcgatccgaacttcgtcgattcgagcccgtgtcctcgtaactcaatggcccctgcgaaagatgactcctctctccccgagtacagcgcctttaacaccagcgttcacgccgcaatccgtcacggcaactggaagcttctgactggataccccggctgcggttactggtttcccccgccctcgcaatataacgtcagtgaaattccctcgagcgacccccctacaaagacgctctggctgttcgatatcgacagagatccagaggagcgacatgatctttcccgggagtacccacacatcgtcacgaagctgttgtctcgtctccagttctaccacaagcacagtgtacccgtctactttcccgcacaggacccacgctgcgatcccaaggcaaccggcgtctggggtccttggatg

SEQ ID NO: 7070 - DNA, 1599 bp, Artificial Sequence
  Description of Artificial Sequence: Synthetic coding sequence
atgggtcctagaggcgcagctagccttccaaggggccctggtccacggcgattgctccttcccgtcgttctgcctctgcttcttctgctccttctggccccaccgggaagcggagcaggtgcctccaggcccccgcacctggtgttcctcctcgcagatgacctggggtggaatgatgtgggatttcacggttcccggattaggactccgcatcttgatgcgctcgccgcgggaggagtgctgcttgacaattactacacccaacctctttgcaccccctcgcgttcccaacttcttactggccgttaccagattcgtacgggcttgcaacaccagatcatatggccttgtcagccctcctgcgtgcctcttgatgaaaaactgctcccacagctgctgaaggaggccggttacaccacccatatggtcggaaagtggcaccttggtatgtatagaaaggaatgtctgccaaccagacgaggttttgatacctactttggataccttctgggttccgaggattactactcacatgaacgctgcactctgatagatgccctcaatgtgacccgatgcgccctggatttcagagatggagaagaggtggcaactgggtacaagaacatgtactcaaccaacattttcacgaagcgggccattgccttgatcacgaatcatcctcctgaaaagcctcttttcctgtaccttgcccttcagagcgtgcatgagccgctgcaagtgcccgaagaatatctgaaaccttacgactttattcaagataagaacagacatcattatgcaggaatggtgtcacttatggatgaagcagtggggaatgtcaccgcagctctgaagtcgtccggcctgtggaacaacactgtgttcattttctccactgataatgggggacaaactctggccggtggtaacaattggcctctgagagggaggaagtggtccctgtgggaaggcggtgtgcgaggagtcggcttcgtcgcatctccactgcttaaacaaaaaggagtgaagaatcgagagttgatccatatctcggattggctccctacgcttgtgaaactggcaagaggacacactaatggaaccaagcctctggatggcttcgacgtatggaaaaccatttcggaggggtcaccatcaccacgtattgaactgcttcacaacattgatccaaacttcgttgattcatcgccctgcccccgtaattcgatggcaccagcgaaggacgacagctccttgcccgaatattcagcattcaatactagcgtccatgcggccattcggcatggcaattggaagctccttaccgggtaccctggttgtggatactggttcccaccaccctcccagtacaacgtcagcgaaattccttcctccgatccacccaccaagaccctttggctgtttgatattgatcgggatcctgaagaacgccatgatctttcaagagagtacccccatattgtgactaagctgctttcgagattgcagttctaccacaaacattcagtcccagtgtactttcctgcgcaagatccacggtgtgaccccaaggcaactggcgtgtggggcccgtggatg

SEQ ID NO: 7071 - DNA, 1599 bp, Artificial Sequence
  Description of Artificial Sequence: Synthetic coding sequence
atggggcctaggggggctgctagccttccacggggcccaggtccccggcgcctgcttctgcctgttgtgctccccttgcttctcttgctgttgctcgcgcctccgggctctggcgcgggagcgagccgccccccacacctggtttttctgctggcagacgatctcgggtggaacgacgtgggctttcatgggtctagaatacggactccacatctggatgcccttgctgcaggaggagtgcttctcgacaactattacactcagcccctgtgcacaccttctaggagtcagctcttgacagggaggtaccagattaggacaggtctccagcaccagatcatatggccttgccaaccctcttgcgtcccacttgatgagaagctgcttcctcagttgcttaaggaagccggttacactacccacatggtagggaagtggcacctgggcatgtatcggaaggaatgcctgcctacacggcgggggtttgacacctattttggatacctgctgggctccgaagattactactcccatgagagatgcacactgatcgatgccctgaacgtcacacgctgcgcactcgacttcagagatggagaggaggtggccacggggtacaagaacatgtacagtaccaacatctttacgaagagggcaatcgccctcattaccaatcacccccccgaaaagcctctttttctgtacctcgctctgcagtctgtgcacgagcctctccaggtccccgaggaatatctcaagccgtacgactttatccaggataagaacagacaccactatgcgggtatggtctcactcatggatgaggctgttggaaacgtgacggcagccctcaaatcctcaggtctgtggaataatacagttttcatattcagcacagacaatggaggacaaacgctggccggaggaaacaactggcctctgcgcgggagaaagtggagcctgtgggagggaggtgtgcgcggggtaggattcgttgccagccctctcctcaaacagaagggagtgaagaaccgagagctgatccacatctctgattggctcccgacccttgtaaaactggcgagaggccacacgaacggcactaagcctctcgatgggttcgacgtttggaagacgatcagcgagggaagccccagcccacggatcgagctcctgcacaatattgacccaaattttgtggactcttctccctgccctagaaacagcatggccccggctaaggatgattccagtcttcctgagtattctgcattcaacactagcgtgcacgcagcaattcggcacggtaactggaagctcctcaccggttatcctggctgtgggtattggttccctccccctagccagtataacgtctcagagattccttcctctgacccgcccactaaaaccctctggcttttcgacattgaccgggatcccgaggaacggcacgacctgagtagggagtatccgcacatagttactaagctgcttagcagactgcagttttaccacaaacactccgtgcccgtatatttcccagcgcaagatcccaggtgcgatcccaaagccactggtgtctggggcccctggatg

SEQ ID NO: 7072 - DNA, 1599 bp, Artificial Sequence
  Description of Artificial Sequence: Synthetic coding sequence
atgggacctcgtggagctgcgtcattgccccgaggaccgggaccccgccgccttctactacccgttgtactgccactcctcttgttgctgttacttgcaccaccaggaagcggagccggtgcaagccgtcccccgcatttagtctttttgttggctgacgatcttggctggaatgatgttggatttcatggtagcagaattagaaccccgcatttggatgcattagccgctggaggagttctacttgataattattatactcagcctttatgtactccatcccgttcacaacttctgactggacgttatcaaattcgtactggactgcaacaccagatcatttggccatgtcaacctagctgcgtgccgctcgatgagaaactcttgcctcaattgctgaaggaggcgggatacactacacatatggtgggtaaatggcacctaggaatgtatagaaaagaatgtttgccaacaagacggggatttgatacctattttggatatttgttaggatccgaagattactacagtcacgaaagatgtactttaatagatgctctgaatgtgacgcggtgtgctcttgattttagagatggagaggaagtggctacaggatataagaacatgtattctacgaatatctttactaaaagagctattgctctgatcacaaaccacccaccggaaaaaccattattcttgtatttggccctgcagtcagttcatgagccactgcaagttcctgaggagtacttaaagccttatgactttatccaagataagaacagacatcactacgctgggatggtttcacttatggatgaggcggttgggaatgttactgccgcacttaagtcatcaggactctggaataatacggtattcattttctcaacagataatggaggacaaactctggctggcggtaataattggccattacgtggtcgtaaatggtccctttgggaaggaggagtacgaggggttgggttcgtcgcaagtccgctgttaaagcagaagggagtgaaaaatagggaacttattcacatctccgattggttgccaactttagttaagttggctagaggtcatactaacggaactaaaccgcttgatggcttcgacgtctggaagactatttccgaaggatcaccctcgccgagaattgaactattgcacaacattgatcctaattttgtagactccagcccttgccctcgaaattcaatggccccagctaaggatgactcatcactcccagaatattcagccttcaatactagcgtgcacgcggcaatccgacatggaaactggaagctgcttactggttacccaggatgcggatattggtttccgccgccgtctcaatataatgtttcagaaatcccgtccagtgatccacctacaaagacactctggcttttcgacatcgatagagatccagaggagagacatgatttgtctcgagaatatccacatattgttacaaaacttctgtcgcgccttcaattttatcataaacattctgtgccagtctatttcccggctcaggatccacgatgtgatcctaaagcaacgggagtttggggaccatggatg

SEQ ID NO: 7073 - DNA, 1599 bp, Artificial Sequence
  Description of Artificial Sequence: Synthetic coding sequence
atgggtccgaggggggccgcctccttgccccgcggaccagggcctcgccgccttctgttgccggtagtcctgccactcttgctgctcttattgctcgctccacctgggtcaggagctggagcgtctcgccccccacatctcgttttcttgctggccgatgacttaggctggaatgatgtcggcttccacggaagcagaataaggacccctcacctcgatgcgctcgcagccggcggagtcctgctcgacaactactacactcagcccctttgtactccttctcgatcgcagctgctcacaggaaggtaccagattcgaactggactccagcaccagattatatggccatgccagcctagttgcgttcctctagacgaaaaactgctcccccaattgctgaaagaggccggatataccacccacatggtggggaaatggcatctagggatgtacagaaaagaatgcctgcctactaggcggggatttgatacctattttggctacttacttggctccgaagactactactcccacgagcgttgtacgctgatagatgctttgaatgtgacacgctgtgccctggattttcgggatggcgaagaagttgctaccgggtataaaaatatgtacagcactaacatttttacaaagagggcaattgccctcatcactaatcatcctccagaaaagccactgttcctctacctcgcattgcagtctgttcatgagccactccaggtgcccgaagagtaccttaaaccttatgacttcatccaggacaaaaacaggcaccattacgcagggatggtaagcctcatggatgaagccgtcggaaacgtaaccgcagctctgaagagctctggcctttggaacaatacagtcttcatcttctcaacggacaatggagggcaaacccttgcaggcgggaataactggccccttcgcggcaggaagtggtccctttgggaagggggagtacgaggggtgggctttgtggcttctccactgctcaaacaaaagggggtgaagaaccgcgaacttatacatatatcggattggcttccgactttggtgaaactggcacggggccacaccaacgggactaagcccttggatgggttcgacgtgtggaaaacgatatccgagggaagccccagcccacgcatcgaactgctgcacaacatagacccgaatttcgttgattctagcccttgccccaggaacagcatggctccagcaaaggacgacagctcactaccggaatattcagcctttaatacgtcagtccacgctgcaattcgtcatgggaattggaagctcctaacagggtatccaggatgtggatattggtttcctccaccctctcaatataatgtgagcgaaattccatcttccgatccgccaacaaagacattgtggctcttcgatatcgacagggaccctgaggagagacacgacctgagccgcgaatatccacacatcgtgaccaaacttctctcaagactccagttttaccataagcactcagttccagtgtactttccagctcaggacccccgatgcgacccaaaagccaccggggtttgggggccttggatg

SEQ ID NO: 7074 - DNA, 1599 bp, Artificial Sequence
  Description of Artificial Sequence: Synthetic coding sequence
atgggtccaaggggcgctgctagcctgcccagaggaccagggccaagaaggcttctactgccagttgtgctgcctctgctactactgctcctattggccccccccggatcaggcgccggggcaagtcggcctcctcacctcgtctttctacttgccgacgatttggggtggaatgacgtagggttccacgggtcccgcatcaggactccgcaccttgacgcccttgcagcaggcggtgtcctgcttgataattactacacacagcccttatgtaccccctcacgcagtcagctcctgacaggcaggtatcagataaggaccggcctacagcatcagatcatttggccgtgtcagccttcatgtgtgccccttgatgagaagctgcttcctcagttgctgaaagaagccgggtacacgacccacatggtggggaaatggcatctggggatgtataggaaagaatgtctccccactagaagaggatttgacacatactttggatacctcttgggctcagaggattattattcacacgagcgctgcaccctgatcgacgctttgaacgtgacgaggtgtgccctcgatttccgcgacggggaggaggtagcaacgggatacaagaacatgtacagtaccaatatctttacaaagcgggccatcgccttaataaccaaccatccacctgagaagcccttgtttctctatctggcactgcaaagcgtacacgagccattacaggtccctgaggagtatctgaaaccttacgatttcatccaagacaagaacagacatcattacgctggcatggtaagtctcatggacgaggctgtcgggaatgttactgctgccctcaagagcagtggcctttggaacaacactgtgttcatcttctccacagacaacggaggacagactctcgccgggggtaataattggccactcaggggacgtaaatggagcctgtgggaaggcggagtccgcggggtcggattcgtggcatcacccctcctgaagcagaagggcgtaaaaaatcgggagttgattcatatatcagattggctgcccacactggttaaactggccagggggcacaccaacggcacaaagcccctcgatggctttgacgtctggaaaactatctctgagggcagccctagcccaaggattgaattactccataatatcgatccaaacttcgtggactcaagcccatgccccagaaacagcatggctcccgcgaaagacgacagctccctgcctgagtactccgcatttaatacttcagtccacgctgctatcaggcacggtaactggaaactcctcaccggatacccaggatgtggatactggtttcctccaccatcccagtataatgtctctgagatcccttcttcagatcctccgacaaaaacactgtggctcttcgatattgatcgggacccagaggagcggcacgatttgtctcgcgagtacccccacattgtgaccaagctgttgtctcgccttcagttctaccacaagcacagcgtgcccgtttatttccccgctcaggacccgcgctgtgatccaaaggccacgggggtgtggggtccctggatg

SEQ ID NO: 7075 - DNA, 1599 bp, Artificial Sequence
  Description of Artificial Sequence: Synthetic coding sequence
atgggtccgaggggtgcggccagcttgccccgaggtccgggcccacgacgccttctactacccgtggttctgcccttactactgttgttactactcgccccaccgggctccggagcgggggcatccagacctccgcaccttgtttttcttctggctgatgacctcggatggaatgatgtcggattccatggaagtcggatacgaaccccgcatctcgacgcccttgctgcgggtggtgttctcctcgataattactatacccagccgctctgcaccccttctagatcccagcttcttacaggcaggtaccaaattcggaccggcctgcagcatcagattatttggccatgccagccctcctgtgttccgttagatgaaaagctcctcccgcaacttcttaaggaggcgggatacactacgcatatggtgggtaagtggcatcttgggatgtaccggaaggaatgtcttccaacgcgtcggggcttcgatacttatttcgggtacttattgggatctgaggactattattctcacgaacgttgcacgctgatcgatgctttgaacgtcactcgttgtgccctggattttcgtgatggtgaggaagtcgcgacaggctataaaaacatgtactctactaatatatttaccaagcgtgcaatcgctctgataacgaaccacccacctgagaagcctctgttcttgtacttggctctgcaatcagtacatgaaccactgcaggtgcccgaggagtatctcaaaccttacgattttatacaagacaaaaatcgacaccattacgcggggatggtatctcttatggatgaggcggtgggaaatgtgacggcggctctcaagagttccgggttgtggaataataccgttttcatttttagtactgacaacggaggtcaaacgctggcaggtggcaacaactggcctcttcgcgggcgaaagtggtcactttgggagggcggtgttcgcggagttggttttgtcgcaagcccactactgaaacaaaagggcgttaaaaaccgtgaacttatacatatatccgattggcttccgactctcgttaagctagccagaggccatactaatggaaccaaacctcttgatggtttcgatgtctggaagacaatcagtgaggggagtccgtctcccaggattgaattgctccataacatcgatccgaactttgtggatagctctccatgtccgaggaactcaatggcgccagcgaaagacgacagttctttgccggaatactcggcatttaacacctctgtgcacgccgccattcgtcatgggaattggaagctactgacaggttaccccggctgtggctactggttcccaccgcccagccagtataatgttagtgagatcccctcaagcgatccaccgacaaagacactgtggctcttcgacatagatagggacccggaggagcgccacgatttgagccgagagtacccgcacatcgttactaagctgctgagtagactccaattttatcacaagcacagcgtgccagtctatttcccggcgcaagatccccgctgtgatcctaaggctacgggtgtgtgggggccgtggatg

SEQ ID NO: 7076 - DNA, 1599 bp, Artificial Sequence
  Description of Artificial Sequence: Synthetic coding sequence
atgggccctcggggtgctgcctcactgccgcggggacccgggccccgacgtctgctcttaccagtggtgttgccattgctattgcttcttctgctggccccacccggctctggagccggcgcgagccgccccccacacctagtgtttctgttggctgatgatcttggctggaacgatgtgggctttcacggaagccggatccgcacgccacacctcgacgccttggcagctgggggcgtgctcctcgacaactactacactcaacctctttgcaccccatcgaggtcacagctactcacgggtcgctatcagatcaggacagggcttcagcaccagataatttggccctgtcaaccctcatgcgtgccgctcgatgaaaagttactgccacagctacttaaagaggccggttatactacccacatggtggggaagtggcacctcgggatgtataggaaagaatgtctgccaaccaggcgaggatttgatacatatttcgggtatttgttgggctccgaggactactatagtcatgaacggtgcacattaatcgacgccctgaatgttactcgttgcgctttggattttagagacggggaagaagtcgctactggctacaagaacatgtacagcacaaatatcttcacaaaacgcgccattgccttgataacgaatcaccctcctgagaagcctcttttcttgtatctcgcattgcagtctgtgcatgagccattgcaggttcctgaggaatatctgaagccgtacgactttatccaggataagaatcggcatcattacgccggtatggtgagccttatggatgaggccgttgggaatgtaacagcagccctaaagagttcaggactgtggaataacaccgtgtttattttcagcaccgataatgggggacagacattggctggcggaaataactggcccctgcgcggccgcaaatggtcattatgggaaggtggcgtgaggggagtcggctttgtcgcatctccactcttgaaacagaagggtgtaaagaaccgtgagcttattcatatcagcgactggctcccaaccttggtgaagctggcaaggggccacaccaacgggaccaaaccactggatggtttcgacgtgtggaagacgatttccgagggtagcccatctcctagaatcgaattgctgcataatatagatccaaactttgtcgatagctcaccttgccccaggaattcaatggcaccagccaaggatgactctagcctacccgaatattcagccttcaatacttctgttcacgctgctattcggcatgggaattggaagttgctgaccggctatcctggatgtggatattggtttccaccaccgagtcagtacaacgtcagcgagatcccgtcatcagatcctccaacgaaaacactttggctcttcgacatcgacagagatcctgaggagcggcacgatctatctcgtgaatacccccacatcgttaccaaattgctgtctagactgcaattttaccataagcactcagttcccgtgtactttcccgcacaggatccccgctgtgaccctaaagctaccggagtatgggggccttggatg

SEQ ID NO: 7077 - DNA, 1599 bp, Artificial Sequence
  Description of Artificial Sequence: Synthetic coding sequence
atgggtccaagaggtgccgcatcgctccccagaggacctggtccacgcagactgctgcttccggtggtgctgcccctgcttttgctgcttctgttggcaccacccggttccggcgcaggtgcatcgcgcccaccccatctcgtgtttcttctcgcggatgacctgggatggaatgatgtcggatttcacggttcaaggatccgcactcctcatttggatgccctggccgcaggtggagtgttgctggacaactactacacccaacccctgtgtactccatcgaggtcacaactgcttactggcaggtaccaaatacggacgggcttgcagcatcagattatctggccatgccaaccatcatgtgtccctcttgatgaaaagctcctgccccaactgctgaaggaagccgggtatactacccacatggtgggtaagtggcacctgggaatgtaccggaaggaatgtctgccaacgcgacgaggttttgacacttacttcggctacctgctcggctcggaagattactactcacatgagcgctgtacccttatcgacgcactcaacgtcacgcggtgtgcacttgatttcagagacggcgaggaagtggcgaccggatacaagaacatgtacagcaccaacattttcactaagcgggctattgcactcatcaccaaccacccccctgagaagcccctgttcttgtacctggcgctgcaatccgtgcacgaacctctgcaagtgcccgaagaatacctgaagccgtacgatttcattcaagataagaacagacatcattacgccggaatggtgtcgcttatggatgaggcagtcgggaacgttaccgcagcactgaaatcgagcggactttggaacaacaccgtgttcatcttttccactgataatggcggacaaaccctggcaggcggtaacaattggcccttgaggggaagaaagtggtcgctgtgggagggcggtgtgaggggcgtgggttttgtggcatcacctctgttgaagcagaaaggggtgaagaatcgggaacttatacatattagcgattggcttcccacccttgtcaaactggccagaggtcacactaatgggaccaagccgttggatggctttgacgtgtggaaaactatttccgaaggttccccttcacctcgtattgaacttcttcacaacattgatccaaactttgtcgattcatccccttgtccaagaaactccatggcccctgcaaaagatgattcctcactccccgaatactcggcatttaacacttccgtgcatgcagcaattaggcatggtaactggaaacttttgactgggtaccccggatgtggatactggtttcctcctccatcgcagtacaacgtgtcggagatcccatcctccgatccccccaccaaaactctttggctgtttgacatcgatcgcgaccctgaagaacgccatgacctgagccgggaatatcctcatattgtgacgaaacttctgtcgcggctccagttttaccataagcattccgtgcccgtctattttcctgcacaagacccaagatgtgaccctaaagctactggagtctggggtccatggatg

SEQ ID NO: 7078 - DNA, 1599 bp, Artificial Sequence
  Description of Artificial Sequence: Synthetic coding sequence
atggggccccgcggcgctgcatcccttcccagaggaccaggcccacggagactactgctgcccgtggtgttgcctttgctccttctgttgctcctcgctccgccaggaagtggggcaggagcctcccgaccgccgcaccttgtgttcttgctggctgacgatctggggtggaacgacgtggggttccacggatcacgaatccgtacaccccacctagacgccctcgcggccggaggggtgttactggacaattattacacccagccactgtgcacgccctcaaggtcccagctgttgaccggcagataccagatccggacgggcttacaacaccaaatcatatggccctgccagccttcttgcgttccgctggacgagaagttattgcctcagctgttgaaagaggccgggtatactacacatatggtggggaagtggcatctgggaatgtaccgcaaagagtgccttcccactcgaagggggttcgacacctactttggatacctcctgggtagtgaagattactattctcacgaacgatgcacgttgattgacgctctgaacgtgacacggtgtgctctggacttcagggacggggaggaggtcgctaccggttacaagaacatgtatagtactaatatcttcacaaaacgagctattgctctgataaccaaccatccacccgagaaaccccttttcctttatctggccctgcagtccgtgcacgaaccattgcaagttcccgaggaatatctcaagccatatgacttcatacaggacaagaacagacaccactacgccggaatggtgtcgctcatggatgaagctgtgggcaacgtgactgctgctctgaagagctctggcttgtggaataatacagtatttatattctccaccgataatggtggccagactctcgccgggggaaataactggccattgagggggcggaagtggagcctgtgggagggaggggttcggggcgtgggtttcgtagccagtccccttctgaagcagaagggtgtcaaaaaccgtgaactaattcatatcagcgactggttgcccaccctcgtcaaactagctcgtggccacactaacgggaccaagcctctggatggattcgacgtgtggaagacgatctcagagggatctcccagtcccaggatcgagctcctccataacatagacccaaactttgtggatagtagcccgtgtccacggaattctatggctcccgctaaggatgatagttcactgccagaatacagtgcctttaataccagcgtgcacgccgctattcgacacggaaattggaagctgcttaccgggtaccctgggtgcggctactggttccctcccccttctcaatataacgtatcagaaatccccagctctgaccctcccacaaagacactgtggctattcgatatagaccgcgatcccgaagaacgccacgacctatcacgagagtacccacacatcgtgaccaagctactgagccgccttcagttttaccataagcacagcgtgccagtatatttccctgcccaggacccgcggtgtgaccccaaagccaccggtgtgtggggcccctggatg

SEQ ID NO: 7079 - DNA, 1599 bp, Artificial Sequence
  Description of Artificial Sequence: Synthetic coding sequence
atgggcccccggggcgcagcttcactgcctaggggtccagggccccgacgcttactactgccagttgtacttcctctcctgttgctcctgctgctcgccccgcctggctctggcgctggagccagtagacctccgcatctggtgttcctcctggcggatgacttgggctggaatgacgtaggattccatgggtctcggattcgcactccccatctcgacgcgctcgctgctggtggcgtgctgctggacaattactacacacagccgctatgcaccccttcaaggtctcaattgctcaccggacgctatcaaatccggaccggactccagcatcagatcatatggccatgtcagccgagctgcgttcctttggatgagaagctcttaccccagctgctcaaggaagccggatacacgacacacatggtcgggaaatggcaccttggcatgtaccggaaagaatgccttcctactaggaggggattcgatacatatttcggatatctgttaggatccgaagattattatagtcatgaacgctgcactctgatcgatgctctgaatgtgacccggtgcgctcttgatttccgagacggtgaggaggtagccaccggttataagaacatgtactccactaacatatttactaaacgcgccatcgcactcataacaaaccacccccccgaaaagcctctttttctgtacctggcattgcagtctgtgcacgaacccctgcaggtacctgaggaatatctgaaaccttatgacttcattcaggacaagaatagacaccactacgctggaatggtgagtttgatggatgaggccgtgggtaatgtgacagcagccttgaagtcgagtggtctctggaacaacaccgtgtttatattctccaccgacaatgggggtcagactttggcaggggggaacaactggccactgagagggcgaaaatggagcttgtgggaagggggcgtccgaggcgttggatttgtggcgtccccactcctaaagcagaaaggggtgaagaatcgcgagctgatccacatctccgactggttgcccactctggtgaagctagcgagaggtcacactaatggcacgaagccactggatggctttgacgtatggaagacaatcagcgagggctctcccagccctcggattgagctgctgcacaacatcgaccccaatttcgtagattcaagtccatgtccccgcaattctatggcccctgcaaaggatgattcctcactgcccgaatactccgcgttcaataccagtgtccacgccgccattcgacacggcaactggaagctcctgactggctacccaggatgcggctactggtttccaccccctagccagtacaacgtgtcagagattccttcgtcagatccccctacaaaaacactctggctattcgatatcgacagagatccagaagaaagacacgatctctctagagagtatccccacatcgttacaaaactgctatcaaggttgcagttctaccataagcattcggtccctgtgtatttcccagctcaggaccctaggtgtgacccaaaggccacaggagtgtggggcccgtggatg

SEQ ID NO: 7080 - DNA, 1599 bp, Artificial Sequence
  Description of Artificial Sequence: Synthetic coding sequence
atgggtccccggggagctgcatctttgccgcgaggcccaggacccagacggttgctcctcccagtcgtcctgccactcttgctgctcctgttgcttgcaccccccggatctggagctggggcctctcgcccacctcatctggtctttttgctggccgatgatctcggctggaacgatgtgggcttccacggctcccgtatcaggaccccccatctggatgcgctcgccgccggtggagtcttgctggataattactatactcaaccgctttgcacgccatctaggagtcaattactaactggacggtaccaaatccgtactggcctgcaacatcagatcatttggccctgtcagccttcgtgcgtgccactggacgagaagctgctcccacagctcctgaaggaagccggatatacgacacatatggtcgggaagtggcatcttgggatgtacaggaaagaatgtctccctaccagacgggggttcgacacctacttcggatatctattgggtagtgaggactactacagtcatgaaaggtgcactctgatcgacgccctgaatgtgacacggtgcgcactcgacttcagagacggagaagaggtcgctacaggctacaaaaatatgtactccaccaatatttttaccaagcgggccatcgcactgattactaaccacccgcccgagaaacctctctttctgtacctggccctgcaaagtgtgcatgaaccactacaagtgccggaagagtatctaaaaccctatgactttatacaggataagaaccgacaccactatgcaggcatggtctcgttaatggacgaagcagtgggcaacgttactgcggctctgaaaagctccggtctatggaataatactgtcttcattttctctactgataatggagggcagacacttgcaggcggaaacaattggcccctgagggggagaaagtggtccttgtgggagggcggcgttaggggagtggggttcgtcgcatccccactcctcaaacaaaaaggagttaaaaaccgggagctgatccatatttcggactggctccctaccctggtgaagttagctcgcggacacaccaacggcacgaagccgctggatggattcgatgtctggaagactatcagcgagggctccccttcaccccgcatcgagctcctccacaacatcgatccaaacttcgttgatagctccccatgtccaaggaactcaatggctccagcaaaagacgatagctcccttcccgagtactccgcctttaacacatccgttcacgctgcaattagacatggaaactggaagcttctgaccggctaccctggctgtggctactggtttccgccaccgagccagtacaatgtgtccgagatcccatcttctgatccccctaccaagacgctctggctgttcgatatcgatagggatccggaagagaggcacgacttatctagggagtatccccacattgtcacaaaactgctgtcccgtcttcagttttaccacaaacatagtgtccccgtatattttcccgctcaagaccctcgttgtgatccaaaagctaccggggtgtggggcccatggatg

SEQ ID NO: 7081 - DNA, 1599 bp, Artificial Sequence
  Description of Artificial Sequence: Synthetic coding sequence
atgggaccccgcggagccgcgagcctgccgcgcggacccggaccaagacgtctgctgctcccggtcgtgctccccctcctgctgttgctcctgctggcaccgccgggtagcggagccggagcctcccgcccgccccatttggtgttcctgctggctgatgatctgggatggaacgacgtgggtttccatggatcgaggatcagaaccccgcacctggacgccctcgcagccgggggagtgctgttggataactattacacccaaccgctctgcaccccttcccgctcccagctccttaccggacgctatcagatccggaccggtctgcagcaccagatcatttggccgtgccagccgagctgcgtgccgctcgacgagaagctgctgcctcaattgctgaaggaagccggctatacgacccacatggtgggcaagtggcacctcggcatgtacaggaaggaatgtctccccacccgtcgagggttcgatacctacttcggatacctcctcggttcggaggactactattcacacgaacggtgtaccctgattgatgcacttaatgtcacccggtgcgcgctggatttccgcgatggggaagaggtggccacggggtacaaaaacatgtactccaccaacatctttaccaagcgcgctatcgctctgattactaaccacccacctgagaagcccttgttcctgtacctcgcactccaaagcgtgcacgagccgctgcaggtgccagaagagtaccttaagccgtacgactttatccaggacaagaatcgccatcactacgcgggcatggtatctctcatggacgaagctgtgggcaacgtgactgccgctttgaagtcaagcgggctctggaacaatacggtgttcatattctcgactgacaacggcggacagactttggctggagggaacaattggccgctccgcggacggaagtggtcgctgtgggaaggcggagtgcgaggcgtcgggttcgttgcctcgcctcttctgaaacagaaaggcgtgaagaatagagaattgatccacatctccgactggttgcctacgctcgtgaagctggctcggggtcacactaacgggactaagcctctggatggatttgacgtctggaaaactatcagcgagggatctccgtcgcctcgaatagaactgctgcacaatatcgacccgaacttcgtcgatagcagtccgtgccctcgcaactcgatggcgcccgctaaagacgactcgtccctgccagaatacagcgctttcaatactagcgtccatgcggcgatcagacatggaaattggaagctcctgactggataccctggatgcggttactggttcccgccgccatcacagtacaacgtctcagagatcccatcgagcgacccaccgaccaagacgctctggctgtttgacatcgatcgcgatcctgaagagaggcacgacctcagccgggaatatccacacatcgtcactaaactgctgtcacggctccagttctaccacaagcactcagtcccagtctactttcccgctcaagatccaagatgtgatccaaaagctactggtgtttggggaccgtggatg

SEQ ID NO: 7082 - DNA, 1599 bp, Artificial Sequence
  Description of Artificial Sequence: Synthetic coding sequence
atgggcccgagaggtgccgcatccctgcctcgtggacctggccctaggcgactccttttgcccgttgtgcttcccctgttgctactgctccttctagcgcctcctggaagcggtgcgggagcaagtcgtcccccccatttagtgttcctccttgccgatgatttaggctggaacgatgtgggatttcacggttctaggatacgcaccccccacctggatgccctggcagccggcggcgtccttctggacaactactatacccagccactgtgtacaccaagcagaagccagctcctgaccggcagatatcagattcgcacgggactgcagcatcagattatctggccctgtcaaccctcatgcgtgccactggatgagaaacttcttccacagctgttgaaggaagcaggctataccacacatatggttggcaagtggcacctgggtatgtaccgcaaggagtgtctcccgacaaggagaggcttcgatacttactttgggtacttactcgggtcagaggattattacagccacgagcgctgcaccttgattgacgccctcaatgtcacacgatgcgcgcttgatttccgagatggcgaagaggtcgctactgggtacaagaatatgtattcaacgaatatatttactaaacgtgccatcgcgctaatcaccaaccatcctcccgagaaacctctattcctatacctagccctccagtcagtgcatgaacctcttcaggttcccgaagagtatttgaagccctacgacttcatccaggacaaaaataggcatcactacgctggcatggtgagcctgatggatgaggcagtaggtaacgtgaccgccgcgctgaaatctagcgggctgtggaacaataccgtatttatattctctaccgacaatgggggacagacattggctggcggcaacaactggccacttagagggcggaaatggtccttgtgggaaggaggagtgaggggagtgggcttcgtcgcctcaccactcctgaagcagaaaggggttaagaacagggaactgattcacatctctgattggctcccgacccttgtgaagctggcacggggtcacactaacggcaccaaacctctggatgggttcgacgtttggaaaacgataagtgaagggtccccaagccccagaattgagttgctccacaacattgaccctaacttcgtggactcgtctccgtgcccccggaattccatggcgccagccaaagatgacagcagcctgccggagtatagcgcctttaacacatcggtgcacgcagccatcaggcacggcaattggaagctcctgacaggttatcccggctgcggatactggtttccgccgcccagccagtataatgtaagcgagattccttcctccgatccgcctactaaaactctgtggttgtttgacattgatcgcgacccagaggaaaggcatgacttatcccgagaataccctcacatagtgacgaagctcctgtcacgcctgcaattctaccacaaacactctgtgcctgtgtactttcccgctcaagaccctcgttgcgatccaaaggcgactggggtatggggaccatggatg

SEQ ID NO: 7083 - DNA, 1599 bp, Artificial Sequence
  Description of Artificial Sequence: Synthetic coding sequence
atgggaccacgcggggcggcgagcctgcccaggggccctgggcccagacgtcttctcttgcccgtagtcctgccactactgttattattgctcctagcaccgcccggctccggcgccggcgctagccgaccacctcatctagttttcctgcttgccgatgacctgggatggaatgacgtcggcttccatggatctcgtatccgtacacctcaccttgatgcattggcagcaggcggggttctgctcgataattactatactcaacctctgtgcacgccttctcggagccagctgttgacaggccgataccaaatccgcactgggctgcagcaccagattatttggccatgccagccaagctgcgtccccctggacgaaaaactgctgcctcagttgcttaaagaggccggatatacgacccatatggtggggaaatggcacctgggtatgtatcggaaggaatgccttcccactaggcgcggattcgatacatactttggttacctgttgggttcggaggactactactctcacgaacgatgtacattgatcgatgctctgaacgtgacccggtgtgctctcgactttcgcgacggtgaggaggtagcaacaggatataagaatatgtacagcacaaatatctttacaaaacgagcaatagctcttatcactaaccaccctccggagaagccactgttcttataccttgccttgcagagcgtgcatgagcctctgcaagtgcccgaggagtacctgaaaccgtacgactttatacaagacaagaacagacaccactatgccgggatggtgagcttaatggacgaggcggtgggcaatgtgactgcagctctcaagtcctcaggcctatggaacaataccgtgttcatattcagtactgacaacgggggccagaccctcgcgggtgggaacaattggcccttacggggaagaaagtggagcttgtgggaggggggagtacgcggtgtgggctttgttgcttctccgctactcaaacaaaagggcgttaagaaccgggagctcatccatatctcggactggttaccgactttggtgaaactagccagaggccacactaatggtaccaaaccactggatggatttgatgtgtggaagacaatctcagaggggtcacctagcccccgaatcgagctgttgcacaacattgaccctaattttgttgattcaagtccctgtcctcggaacagcatggcccccgctaaggacgatagctcacttccagagtatagcgctttcaatacatccgtacatgcagccattcgccacgggaactggaagctgctgaccggatatcctggttgtggatattggttcccaccaccttcccagtataacgtatctgagattccttctagtgatcctccaacaaaaacactatggctgtttgacatcgacagagaccccgaagagcgccacgacttgtctcgagagtacccacacattgtaaccaaactgctgagccgactacaattttatcataaacatagcgtgcccgtgtatttccccgcacaggacccgcgatgtgaccctaaagcaactggcgtgtggggaccttggatg

SEQ ID NO: 7084 - DNA, 1599 bp, Artificial Sequence
  Description of Artificial Sequence: Synthetic coding sequence
atgggccctaggggtgccgcgtcactcccccgcggccccggcccccgccggctcctcctgcccgtggtgctgccgctcttgctactgttgctgctggccccccccgggagcggggccggagccagtaggccccctcatctcgtgtttctgttggcagacgatctcggatggaacgatgtcggcttccacggttcccggatccgaacacctcacctggacgcattagccgccgggggggtgctgctcgataactattacacccagccactgtgtacaccgtcaaggtcgcagttactgaccgggagataccagattcggacaggcctgcagcaccagatcatctggccgtgtcagccctcatgcgtccctttagatgaaaagttgctaccgcagctgttaaaggaggccggttacactacacacatggtgggaaaatggcatttggggatgtatagaaaggaatgcttgccaacacggcggggctttgatacttatttcgggtatcttctcggtagtgaagattactactcacatgagagatgtactctcatagacgccctgaatgttactcgatgcgccttggactttagggatggagaggaggtggccaccggctataaaaatatgtattctaccaacatcttcaccaagagggccatcgctctcattacaaaccaccccccggagaagcccctgttcctgtaccttgccctccaatctgttcatgagccactgcaggttcctgaagaatatctgaagccatatgactttatccaggacaagaatcgccatcactacgcaggcatggtctccctaatggacgaggctgtgggtaatgtgacggctgccctgaagtccagcggcctctggaacaacactgtattcatcttctcgaccgataacggcggacaaactttggccggtggcaacaattggcctctgcgcgggcggaaatggtcattgtgggagggcggtgtacgaggggtgggtttcgtggcatcgcccctgctgaaacagaagggagtgaaaaacagagaactgattcacatctctgattggcttcccaccttggtgaagttagcaaggggccacaccaacggcactaaacccttggatgggtttgatgtttggaagacaatcagcgagggcagcccttctcctcggatcgaactgctgcacaatatagacccaaactttgttgacagtagcccatgcccgaggaacagcatggcccccgccaaggacgacagcagcctgccagagtatagcgccttcaatacgtccgtccatgccgcgatcagacatggtaattggaaactcttgaccggatatcccggctgcggatattggttcccccctccatcacaatataacgtaagcgaaattccaagcagcgacccgccaacgaagaccctttggttgttcgatatcgaccgggacccggaagagagacacgacctgtcgagggaatacccacacatcgtcacaaagttactctcgcgattgcagttttatcataaacattccgtcccagtctactttcccgcccaggacccaagatgcgaccccaaggctacgggggtgtggggcccttggatg

SEQ ID NO: 7085 - DNA, 1599 bp, Artificial Sequence
  Description of Artificial Sequence: Synthetic coding sequence
atgggcccccggggggcggccagcctgccgcggggaccgggccctcgccgcctgctgctgccggtggtgctcccgcttctcctgttgcttttgcttgccccaccgggaagtggcgctggagcctcgcgccctccgcatctggtgttccttctggccgacgacctcggctggaatgatgtggggtttcacggaagccgtatccggactccgcatcttgacgcgctcgccgccggcggtgtcctcctggacaactactacacccagccactgtgcaccccttccagatcccagctgctcactggacggtaccaaatcagaaccggactgcagcaccagattatctggccatgtcaaccgtcctgcgtcccactggatgagaaactcctcccgcagctgttgaaagaggccggttacacgacccatatggtgggtaagtggcacctgggtatgtaccggaaggaatgcctgccgactagacgcggatttgacacctacttcggatatctcctcggctcagaggactactactcccacgagcgctgtaccctgatcgatgcactgaatgtgactcggtgtgcgctggattttagagacggagaagaagtggccaccggatacaagaacatgtactcgacgaatatctttacgaagcgggcaatcgcgctcattactaatcacccgccggaaaagccactgttcctgtacctggccctccagagcgtgcacgaaccgctccaggtgcccgaggagtacctgaaaccgtacgacttcatacaggacaagaatcggcaccattacgcgggcatggtgtcactcatggatgaggcggtcggcaacgtgactgcggcgctgaagagctcgggactgtggaacaacactgttttcatcttctcgaccgacaacgggggacagactctggcaggcgggaacaattggccgctgagaggccggaagtggtccctgtgggaaggaggagtgcggggagtcggattcgtggcttccccacttctgaagcaaaagggggtcaagaatcgcgagttgatccacatttccgattggctgcctaccctggtgaagctggcacggggccacaccaacggaactaaaccgcttgacggatttgacgtgtggaaaacgatctcagagggctcccctagcccgaggatcgagctgctgcacaatatcgatcccaacttcgtggattcatctccgtgcccgcggaacagcatggcaccggcgaaggacgattcctcacttccagagtactccgcgtttaacaccagcgtgcatgcggcaatcaggcacggaaattggaagttgctcactggatacccaggctgtggctactggtttccaccaccatcgcaatacaatgtgtcagaaatcccaagctcagacccgccaaccaagaccctctggctgtttgacattgatcgagatccggaagagcggcacgacttgagccgggaatacccgcacatcgtcactaaacttctgtctcgcctccagttctaccacaagcactcggtgcctgtttacttcccagcccaggatccacgatgtgatcccaaagccacgggggtgtggggaccatggatg

SEQ ID NO: 7086 - DNA, 1599 bp, Artificial Sequence
  Description of Artificial Sequence: Synthetic coding sequence
atgggaccgcgaggagccgcctcgctcccacgcggaccgggaccccgcagactcctgctgcccgtggtgctccctctcctgttgctgttgcttctggctccaccgggaagcggtgccggagcctcacggcctccgcaccttgtctttctgctggctgacgacctgggatggaacgatgtgggcttccacggatcgcgcatccggacccctcatctcgacgcgctggctgcaggaggtgtgctgctcgacaactactacactcagcctctgtgcactccatcgcgatcccaattgctcactggaagataccaaatcagaaccggcctccagcatcaaatcatttggccttgccagccgtcgtgcgtcccactcgatgagaagctgcttccacagctgctgaaggaagcaggatacaccacccacatggtgggaaagtggcatctcggtatgtacaggaaggaatgcctgcctactcgtcgcgggtttgatacttacttcggctacctgctgggctcggaggactattactcgcatgagaggtgcacgctgatcgatgccctgaacgtgactagatgcgcgctggatttcagggacggagaagaggtcgccaccggatacaagaatatgtattcaaccaacatcttcactaagagggcaatcgcgctgattaccaaccacccaccagagaagcctttgtttctctaccttgcactgcaatcagtgcatgaaccgctgcaggtgccggaagaatacctgaaaccgtacgatttcatccaggacaagaatcgccatcattacgcgggaatggtgagcctgatggacgaggcagtgggaaatgtgactgcggcactcaagtccagtggactgtggaataacactgttttcatcttctcaaccgacaacggggggcagaccctggcgggaggcaacaactggccgttgagaggacggaagtggtcgctctgggaaggaggagtccgcggtgtgggatttgtggcgtcgccactgcttaagcaaaagggcgtgaagaaccgcgagctgatccatatttccgactggctgcccaccttggtgaagctcgcgagggggcataccaatggaactaagccgctcgacggattcgatgtctggaaaaccatttccgaaggctccccgtcgccacggatcgaactgctccataacatcgacccgaatttcgtggactcgtccccctgccctcggaacagcatggcaccggccaaagatgactccagcctcccagagtactccgccttcaacacgtccgtgcatgccgcgatcagacatggcaattggaaactgttgactggctacccaggctgcggttactggttcccgcctccgtcccagtacaatgtgagcgaaatcccttccagcgatccgcctactaagactctttggttgttcgacatcgaccgagatccagaggaacggcatgacctctcacgcgagtacccccacattgtcaccaagttgctgagccgcctgcagttctatcacaaacacagcgtgcctgtgtatttcccagctcaggatccaagatgcgatcctaaggccacgggcgtttgggggccttggatg

SEQ ID NO: 7087 - DNA, 1599 bp, Artificial Sequence
  Description of Artificial Sequence: Synthetic coding sequence
atgggacctcgaggtgcagcaagcttacctagggggcctggtcccagaagactgttgctaccggtggtactcccattgctgctcctgcttcttttggcccctccagggtcgggcgccggagcaagcagacctcctcacctcgtgtttctgttggcagacgacctcggctggaatgacgtgggtttccatggctctcgtatccgaactccacacttggatgccctggcagcagggggggtcctgctggataactattatactcagccactgtgtaccccatcccgatcccagctgcttacagggagatatcagatccgcactgggctgcaacatcagataatttggccatgccagccctcttgtgtgcccctcgatgaaaagctcctcccccagctgctgaaggaggcaggctacacaactcacatggtgggtaaatggcatctcgggatgtacaggaaggagtgcttgcccactcgtagagggttcgacacttactttgggtatctgcttggcagcgaagattattactctcatgagaggtgtaccctaatcgatgccttgaatgtcaccagatgtgcccttgacttcagagatggggaagaggtcgctactggatataagaacatgtactccacgaacattttcactaaacgggccatagcgctgattacaaaccaccctcctgaaaagcccctctttctatatctagccctgcagtccgtgcatgaaccactgcaagttccagaggagtacctgaagccctacgattttatacaggacaaaaacaggcatcactacgcgggcatggtttctctgatggacgaggcagtagggaacgttactgctgcccttaaaagctcgggcctctggaataacactgtgttcatttttagtacagacaacggaggccagactcttgcaggtggaaataattggcccctaaggggcaggaagtggagcctctgggagggtggtgttcgcggtgtgggattcgtcgcttcaccactactcaaacaaaagggagtgaaaaacagagagctgatccacatatcggattggcttcctacacttgtaaagctcgcccggggacacaccaacggtacaaaaccgctagacggcttcgatgtctggaaaacaatcagtgaagggtctcccagccctagaatagaactcctccataatattgaccctaacttcgtcgactcaagcccctgtcccagaaatagcatggctcctgcaaaggatgactctagtctgccggaatatagtgctttcaatacatccgtccacgcggcgatcagacacggcaactggaaattgctgacaggctatccaggctgcggctattggtttcctcccccttcacaatacaatgtgagtgagattccttcctcggaccctcctaccaaaacactatggctgttcgacatcgaccgagatccagaagaaaggcacgacctgtctcgggaatacccacacattgtaaccaagctactgtcccgtctgcagttttaccacaagcattcagtgccggtgtactttcctgcgcaggatcccaggtgcgatcctaaggccaccggcgtatggggtccatggatg

SEQ ID NO: 7088 - DNA, 1599 bp, Artificial Sequence
  Description of Artificial Sequence: Synthetic coding sequence
atgggcccacggggcgcagcctctcttcctcggggaccggggccaagaagactgctccttcctgtagtgcttccattgttgcttttgctcttgctggccccaccagggtcaggcgcaggagctagccgccccccacatctggtgttccttctcgcggacgacctgggctggaatgacgtgggattccacggctcacgcatccgcactcctcacctggatgccctggccgcaggcggggtgctgctggataactattatacacaaccactgtgcacaccttcccgcagccaacttctcaccggccggtaccagattcgaacggggttgcagcaccaaatcatttggccatgtcagccttcctgtgtgcccctggacgaaaaactgctcccccaactcctcaaggaggctggatacacaacacatatggtgggaaaatggcatctgggaatgtatcgaaaggaatgtctgcctacccggagaggcttcgatacctactttggttaccttctgggcagcgaagactattatagccatgagcggtgcaccctgatcgacgccctgaacgtcactcgatgtgcactggactttcgcgacggagaggaggtcgctacaggatacaagaacatgtacagcacgaacatcttcacaaaacgcgcgatagcgcttataaccaatcaccccccagagaaaccgctgtttctctacctcgccctgcaaagtgtgcatgagccattgcaggtcccagaggagtatctgaagccatacgactttatccaggacaagaatagacaccattacgcgggcatggtgagcctgatggatgaagccgtcggaaacgttacggccgctcttaagtctagtggtttgtggaataatacagtgtttatcttttctactgacaacggtggccagaccttggctggcggtaacaattggcccctgcgcgggcggaagtggtccctgtgggaaggaggggtccggggtgtcggttttgtggctagcccacttctgaagcagaaaggagttaaaaacagggagcttatccacatctcagattggttgccaaccttggtcaaactggctcgggggcacactaatggcactaagccactggacggctttgatgtatggaagaccataagcgaaggttctcctagcccccgaatcgagcttctgcataatattgatcctaattttgtggacagttcaccctgcccgcgaaactcaatggctcccgccaaagacgactcaagtcttcccgagtattcagcgttcaatacaagcgtacacgccgctatccggcacggcaactggaagcttctcactggctatccgggctgtgggtactggtttccaccaccaagtcagtataacgtttctgagataccatccagcgatccccctacgaaaaccctgtggctgttcgacatcgaccgcgatcctgaggagagacacgacctgagtcgagagtacccccatatcgttacaaagcttctgtctcgccttcagttttatcacaaacacagtgtgcccgtgtattttcctgctcaagaccctcggtgtgatcccaaagcaaccggagtatggggaccctggatg

SEQ ID NO: 7089 - DNA, 1599 bp, Artificial Sequence
  Description of Artificial Sequence: Synthetic coding sequence
atgggacctcgcggcgcagcatcgctccctcggggacctggcccacgtcggctccttttgcctgtcgtgcttcctctgcttcttctgctgctgcttgcaccgcccggaagcggcgcgggtgcctcaagaccacctcaccttgtgtttctccttgcagatgatctcggatggaatgacgtcggatttcatggatcccgcattagaaccccacatcttgatgccctggcggccggcggtgtgcttctggacaactactacactcaaccactctgcaccccctcccgctcccagctccttacgggtcggtaccaaattcggactggtctgcaacaccaaatcatatggccatgtcagccttcctgtgtccctcttgatgagaagttgcttccccagcttctcaaagaagcaggttacactacccatatggtgggtaagtggcatctgggaatgtaccgtaaggaatgccttccgactaggcgcggatttgacacctattttggttaccttctcggatcggaagattactactcgcatgaacgctgcaccctcattgatgcacttaatgtcaccaggtgtgccctcgacttcagagatggggaggaggtggcaactgggtacaagaacatgtactcgaccaacattttcaccaagagggccattgcactgattactaatcatcctccggaaaagcccttgttcctgtacctcgcactccaaagtgtgcatgaacctctccaagtgcctgaggaatacctcaagccatacgatttcatacaagacaagaacaggcatcactacgcaggaatggtatcccttatggacgaagctgtcgggaatgttacggcggcacttaagtccagcggcctgtggaataacaccgtctttatcttttcgaccgacaatggtggtcagaccctggcaggcggaaataactggcctcttcgcgggagaaaatggtcgctctgggaggggggagtgcggggcgtgggattcgtagcttcaccactcttgaaacaaaagggggttaagaaccgtgaacttatccacatctcggattggcttccgaccctcgtcaagctcgcacggggtcatactaacggcaccaaacctctcgatggttttgatgtctggaaaactatcagcgaaggatcaccttcaccaagaattgaacttctgcataacattgatcccaactttgtggatagctcgccctgtcctcgtaactcgatggcacccgccaaagacgattcgagtctgcccgaatattcagcatttaacactagcgtccatgccgctattaggcacgggaattggaaactgttgactggataccctggatgtggatactggttccctccaccatctcaatacaatgtgtcagaaattccatcctctgaccctccaaccaagactctgtggctcttcgatattgaccgggaccctgaagagcggcacgacctgtcccgcgaatatcctcacatcgtgactaaacttcttagccgactccagttctaccataagcactctgttcccgtgtactttcccgcgcaggatccgagatgcgatcccaaggcaactggtgtgtggggaccgtggatg

SEQ ID NO: 7090 - DNA, 1599 bp, Artificial Sequence
  Description of Artificial Sequence: Synthetic coding sequence
atgggtccgcgaggagcggcctcacttcctcggggacccggcccacggcgattgctgttgccggtggtgcttccgctcctcctgttgttgctcctcgccccgccaggatcaggagctggggctagtagaccgccgcacctcgtgttcttgctggctgatgatttgggatggaacgacgtcggcttccatggctcgcggatccgcactccgcatctggacgcgctcgccgcgggaggagtcttgctggataactactacacccagccgctgtgcacgccgagcagatcacagctccttaccggtcgttaccaaatcagaactggactccagcaccagatcatttggccatgtcaaccgagctgcgtgccactggacgaaaagctccttccacagctcctgaaggaagctgggtacaccacccacatggtgggtaagtggcatctgggcatgtaccgcaaggaatgccttccgaccaggagaggcttcgacacttacttcggctacctgctcggaagcgaggattactactcccatgaacggtgcactctgatcgacgcgctgaacgtgacccggtgcgcattggatttccgggatggcgaggaagtggcaaccggatacaagaacatgtactcgaccaacattttcacgaagcgcgcaatcgccctgatcaccaaccacccgcctgaaaagcctttgttcctctacttggctctccagagcgtgcacgagccgctccaggtgccggaagagtacctcaagccgtacgatttcatccaagataagaatcgccatcactacgcggggatggtgtcactgatggacgaagccgtgggaaatgtgacggcagccctgaaatccagcggactgtggaacaacaccgtgttcatcttctcgaccgacaatgggggccagaccctcgctggaggcaacaattggcccctgcgcggacggaaatggtcgctctgggaaggaggagtgagaggagtgggcttcgtggcctcaccactgctcaagcagaaaggagtgaagaaccgggaactgatccacatctcggactggctgcctaccctggtcaagctggctagaggacacaccaacggaactaagcccctggatgggttcgacgtctggaaaactatctccgaaggctcgccatcgcctcgtattgagctgctgcataacatcgacccgaatttcgtcgattccagcccttgcccaagaaactcaatggcaccggccaaagatgattcgagcctgccggaatactcggccttcaatacgtcagttcacgccgcgatcagacatggcaattggaagctgcttaccggctatcctggttgcggatactggttcccgcctccgtcccaatacaatgtctcggagatcccttccagcgacccgccaacgaaaaccctgtggctgttcgacattgatcgggacccagaagaacgccacgacctctcacgagaatacccacatatcgtgaccaagctcctgagccgcctgcagttctaccacaagcactcagtcccagtgtactttcccgcgcaagacccccgctgcgacccaaaggctaccggggtgtggggtccatggatg

SEQ ID NO: 7091 - DNA, 1599 bp, Artificial Sequence
  Description of Artificial Sequence: Synthetic coding sequence
atgggacctcgcggcgctgcgtcgctccccagaggacctggacctcgaaggcttttgctgcccgttgttctgcctctcctgctgctgttgctgctggcgccaccgggatctggggctggggcctccagaccaccccatctcgtgtttctgctggcagatgacctggggtggaatgatgtgggattccacggctcgcggatcaggacccctcaccttgacgcgctcgctgctggtggcgtactgctggataattactacacacagcctttgtgtaccccctccaggtcccagctgttgacaggaaggtaccaaattcgcacagggttgcagcatcagatcatttggccctgccagccctcttgcgtgcccctggatgaaaagctcctcccgcagctacttaaagaggcaggttacactacacacatggtaggcaaatggcatctgggaatgtatagaaaggagtgtttacccaccagaagggggttcgacacctatttcggctatttactgggctcggaggactactactctcacgagagatgcacactgattgatgcattaaacgtcactcgctgcgccctcgattttcgggacggggaagaggttgctaccggatataaaaacatgtatagtaccaacatcttcacgaaacgcgccattgcacttatcacaaatcatcctcccgagaaacctttattcctttacctggctctgcagagtgtgcatgaacccttgcaggtccctgaggaatacttgaagccctacgacttcattcaagataaaaatagacatcactatgccggaatggtttctttaatggacgaggctgtcgggaacgtgacagctgctctgaagagctctgggctctggaataacaccgtttttatcttcagtacagacaacggaggtcaaacactggctggtgggaataactggcccctgcgaggcagaaaatggtcactgtgggaaggtggcgtgaggggagtggggttcgtagcctcgcctctactgaaacagaagggcgtgaaaaatcgcgagcttatccatattagcgactggctcccgacattagtaaaactggcgagaggacataccaacggcaccaagcctctggacgggttcgacgtgtggaagacaatctccgaagggtccccaagtcctagaatcgaactgttgcataacatagaccccaatttcgtggactcttcaccatgcccacgaaattccatggctcccgctaaagatgactccagtctacctgaatactctgcatttaatacatcagtgcatgctgcgatccggcacgggaattggaagctgctgactggctatcccggatgcggctactggttcccgcctccatcgcaatacaatgtgagcgagatacccagttccgatccgccaacgaagactctttggcttttcgatattgacagagatcctgaagagagacatgacctgagcagagagtatccgcatatcgtgacaaagttgttgagtcgactacagttctatcacaaacactccgtcccagtctatttccctgcacaggacccaaggtgcgacccaaaggcgactggggtttgggggccttggatg

SEQ ID NO: 7092 - DNA, 1599 bp, Artificial Sequence
  Description of Artificial Sequence: Synthetic coding sequence
atgggaccgcgcggagcggcgagcctgccgagaggacctggccctcgcaggctgctgcttcctgtggtgctgccgttgctgctgctcctcctgctggcccctccaggatccggagccggtgcctcgcggcccccacacctggttttcctgctcgccgacgacctggggtggaatgatgtcggattccacggttctcggatccggaccccccatctggacgccctcgcggccggcggagtgctgctggacaattactacactcaaccgctctgcactccgtcccgcagccagctgctgaccggtcgctaccaaatccgaaccggcctccagcatcagatcatatggccttgccagccatcgtgcgtcccactggacgagaagttgttgccacagttgctcaaagaggcgggatacaccacccacatggtcggaaagtggcatctggggatgtacaggaaggagtgtctgccgacccggaggggtttcgacacttacttcgggtatctcctgggatccgaagattactactcacatgaacgctgcaccctgatcgacgccctgaatgtgactagatgcgcactcgatttcagagacggagaagaagtggctactggatacaagaacatgtactccaccaacattttcaccaaaagagctatcgcgctcattacgaatcaccctccagagaaacccctcttcctgtacctcgcgctgcaaagcgtccacgagccgctgcaggtgcctgaagagtacctgaaaccttacgatttcatccaggataagaacagacaccattacgcgggaatggtttcgttgatggacgaagctgttggcaatgtgaccgccgccctgaagagttcgggcctgtggaataacaccgtgttcatcttctcaaccgataatggcggacaaacgctggccggaggaaacaattggccactccggggccggaagtggagtctttgggagggaggggttcggggggtgggttttgtggcatcccccctgctgaagcagaagggtgttaagaacagagaattgattcatatctctgactggctgccgactcttgtgaagctcgctcggggacacaccaatggtactaaaccgctggacggcttcgatgtgtggaaaactatttcagaaggttcgccgtcaccgcggatcgagctgctccataacatcgacccaaacttcgtggactcatcaccgtgtcctagaaactccatggcccctgccaaggatgattcctcactgccagagtactcggcattcaacacctccgtgcacgctgccatccgtcacggtaactggaaactcctcactgggtaccccggatgcggctactggttcccgccaccgtcacaatacaacgtgtctgagatcccgagctcggatccacccactaagaccctttggctgttcgacatcgatcgggaccctgaagaaaggcacgatctgtcgcgggagtaccctcacatcgtgactaagctgctgtcccggctgcaattctaccacaagcattcagtgccagtgtactttccggctcaggacccgcgctgtgacccgaaggcgactggagtgtggggaccgtggatg

SEQ ID NO: 7093 - DNA, 1599 bp, Artificial Sequence
  Description of Artificial Sequence: Synthetic coding sequence
atgggacctcggggggccgccagcctgccccggggcccgggaccccgtaggctgcttctgcccgtcgtcctgccactgctactgttattattgcttgctcctcctggctcgggagccggtgctagccgtccaccccatctggtgttcctcctcgccgacgatctcggttggaatgatgtcggtttccatggctctaggattaggacaccccatctggacgcacttgccgctggaggcgtgctgctggataattactacacccagcccttgtgtacccccagcagaagccagctactgaccggaaggtaccaaattcggaccggcctgcagcatcagattatctggccctgtcagcctagctgcgtaccactggatgaaaaactcctgcctcagctgctaaaggaagcaggctacactactcatatggttggcaagtggcacttggggatgtacaggaaagagtgtttgcctacccgccgtggttttgatacatactttgggtacctgctgggatcggaagactactactcccatgagcgatgcactttaatagacgccctcaacgtgaccaggtgtgcactcgacttccgcgatggtgaagaggtggcgactggatacaagaatatgtactccaccaacatatttaccaagcgtgctatcgccctgatcacgaatcacccacccgagaaacctttgtttctttatctggcactgcagagcgtccatgaacctctccaggtccctgaggaataccttaaaccctatgactttatacaggataaaaatagacaccattatgctggtatggtgtctctgatggatgaggctgtgggcaatgtgacagccgccctcaagtctagcggcctctggaataacactgtgttcatcttttcaacagataatgggggccagactctcgctgggggaaataattggccacttcgcggcaggaaatggagtctttgggaagggggggtgaggggcgtgggattcgtggctagtccgctcctcaaacagaaaggtgtcaagaaccgggaactaattcatatatctgactggctgcccacactggttaaactcgcccggggccatacaaatggcaccaagcctctggatggatttgatgtttggaagaccatctctgaggggtcgccatctccccgtattgaactgctgcacaatattgatcctaattttgtagactcatccccatgtccacggaattctatggcccctgccaaagacgattcttccttgccagaatatagcgcattcaatacaagcgtgcacgccgctatcaggcacgggaactggaagctgctaacagggtacccaggctgtggctattggttccctcctccctcgcagtacaacgttagtgagatcccctcttcagaccccccaacaaagaccctttggctgttcgacatcgaccgggaccctgaagaacgacacgacctcagtcgtgagtatccccacattgtgacgaaactgttgagtaggctacagttttaccataagcactcagtgcctgtatactttcccgcgcaggatcctaggtgcgacccaaaggccacaggggtgtggggcccttggatg

SEQ ID NO: 7094 - DNA, 1599 bp, Artificial Sequence
  Description of Artificial Sequence: Synthetic coding sequence
atgggtcctcgcggcgcggcatccctgccacgcgggccagggcctagacgtctgctgctgccggtggtcttgccacttctgcttcttctgcttctggcaccaccggggtcaggcgctggcgcatctcggcctccacatctggtgttccttcttgcagatgatctgggatggaacgacgtgggctttcatggatcacggattcgaaccccacatctggacgcacttgccgccgggggtgtgctccttgataactattacactcaacccctttgtactcctagccggtcgcagctcctcaccggaaggtaccaaattagaaccggccttcaacatcagatcatttggccatgtcaaccttcgtgtgtgccccttgatgagaaacttttgccacaactcctgaaagaagccggatacaccactcacatggtcggtaagtggcatctgggtatgtaccgaaaagaatgcctgcctacccgccgaggctttgatacgtactttggttaccttcttggtagcgaggactactactcacatgagcgctgtaccttgattgatgccctgaatgttacgagatgtgcacttgattttcgagatggcgaggaagttgccactgggtacaagaatatgtactccactaacatctttactaagcgcgcaatcgcacttattacgaaccatccccctgagaagcctcttttcctgtacttggccctgcaatccgtgcatgagccactgcaggttccagaggaatacctgaagccttatgactttatccaagataagaatcgacaccattatgcagggatggtcagcctgatggatgaggccgtgggaaacgtcaccgcagcccttaaatcttccggcctttggaacaataccgttttcatcttttccactgataacggtggccagaccttggcaggaggaaacaattggccacttaggggacgcaaatggagcctgtgggaaggaggagtgcgaggtgtgggttttgtggcttcgcctcttctcaaacagaagggggttaagaatcgcgaactgattcatatttccgattggctgccaactctggtcaaactggcaagaggacatactaacgggactaagccactcgatggtttcgatgtgtggaaaacgatttccgaaggaagcccttcgcctagaattgaacttcttcacaacattgacccaaactttgtggattcaagcccctgccctcggaactcgatggcaccagctaaggacgattcgtccctgccggagtactcagcttttaacacttccgtccacgcggcaatccgccatggtaattggaaacttctcactggttaccctggttgtgggtactggtttccccctccatcccagtacaacgtgagcgaaatcccgagctccgatcctccgactaagacgctttggctgtttgacattgaccgtgatcccgaggagaggcatgacctgagccgtgaataccctcatatcgtgactaagctcctctcgagactccagttttaccataagcattcggtgcctgtgtatttccccgcacaagacccgaggtgtgacccaaaggcaactggagtgtggggaccttggatg

SEQ ID NO: 7095 - DNA, 1599 bp, Artificial Sequence
  Description of Artificial Sequence: Synthetic coding sequence
atgggtccgcggggtgcagcatctctcccacgggggccaggcccgcggcggttgctgcttcccgtcgtgctaccattgttactgttgctgctgctggctccacccggctcgggggcgggggcatccagacctccccaccttgtttttctgctggccgacgacctcgggtggaatgatgtggggttccacggaagcaggatacgcactccccacctggatgcacttgccgcagggggcgtgttgctggacaactattacacacaacctctgtgtacaccttctaggtctcaacttcttactggccgctaccagattaggacaggcctgcagcaccagatcatttggccgtgtcaaccctcctgcgtgcccctcgacgagaagttgctgcctcagctgctaaaggaggccgggtatacgactcacatggtaggcaagtggcacctaggcatgtacaggaaggagtgtttgcctacccgcagggggttcgacacttacttcggatacctattagggtctgaggactactatagtcatgaaaggtgcacgctcatagacgctctgaatgtgacgagatgtgcccttgatttccgcgacggtgaggaggtggctaccggctacaagaacatgtattctactaacatctttacgaagagggccattgccctgattacgaaccatccccctgagaagccactgttcctgtatctcgccctgcagtcggtccatgaaccactccaagtcccggaggaatacctaaaaccatacgatttcattcaagacaaaaataggcaccactatgccgggatggtgtcattgatggacgaagctgtcggtaatgttaccgccgctctgaagtctagcggcctgtggaataataccgtattcatcttttctacggacaacggcgggcagactttagctggaggcaacaattggccattgcgtggtcgcaagtggtccttatgggaaggaggtgttaggggggtggggttcgtggcctcacccctcctcaaacagaaaggcgtgaagaatcgtgagctaattcacatctcagactggcttccgactctggtgaagctcgctcgtgggcacactaatggcactaagcccctggatggcttcgacgtttggaagaccatcagcgaaggatcccctagtccccgcatcgagctactccataatattgaccccaactttgtggacagtagcccttgtccgcggaactccatggcccccgctaaagacgacagcagtctgccagagtactcagcgttcaacacttcggtgcacgcagccatccgccacggcaattggaagttactcaccggctatcctggctgcggttattggttccctccgccaagccagtacaacgtgagcgagattccaagtagtgatcctccgacgaagacgttgtggctgttcgatattgatagggaccccgaggagagacacgatctgagtagggagtatccacatatcgttaccaagctgctgtcaaggctgcagttttatcacaaacactctgtccctgtgtacttcccagcacaagatccgcggtgcgatccgaaagccaccggcgtctggggcccgtggatg

SEQ ID NO: 7096 - DNA, 1599 bp, Artificial Sequence
  Description of Artificial Sequence: Synthetic coding sequence
atgggcccgcgcggagcagcgagcctcccacgggggcctggacctcgcagacttctgctgccggttgtgcttccgctcctcctcctgctcctcctggcgccgcctggtagcggagccggagcctcgcgcccgccacacctcgtctttctgctggcggacgacctcggctggaatgacgtgggatttcatgggtccagaatccgcaccccacacctcgatgccctggctgcgggaggagtgctgctggacaactactatacccagccgctctgcactccttcgcgcagccagcttttgactggacggtaccagatcagaaccgggcttcagcaccaaatcatttggccttgccagccgagctgcgttccactcgatgaaaaactcttgcctcaactcctgaaggaggctggctacaccactcatatggtggggaaatggcatctcggaatgtaccgcaaagaatgcctcccgacccgccgaggtttcgacacttacttcggataccttttgggatccgaggactactactcccacgaacgctgcactctgattgatgctctcaatgtgacgcgctgtgcgctcgactttcgcgatggtgaggaggtggcaacgggatataagaacatgtactccaccaatatcttcaccaagcgggccatcgccctgatcacgaaccacccaccagaaaagccgctgttcctgtacctcgcactgcagtcggtgcacgagcccctgcaggtgcctgaggaatatctgaagccgtacgatttcattcaggataagaaccggcaccattatgcgggcatggtgtctctgatggacgaagccgtggggaacgtgactgccgcactgaaatcatcaggattgtggaacaataccgtgtttatcttcagcaccgacaacggaggccagactctcgctgggggaaataactggccgctgcggggcagaaagtggtccctgtgggagggcggagtgcgcggggtgggattcgtggcttcccctctgctcaagcagaagggcgtgaaaaacagggagctgatccatatctccgactggttgcccaccttggtgaaacttgcccggggacataccaacggaaccaagccgctggatggctttgacgtgtggaaaactatctccgaagggtcaccgtcaccgcggatcgaactgctgcacaatatcgacccaaacttcgtggactcatcgccatgcccacgcaattcaatggctcccgccaaggacgattcttcgctgccagagtactccgccttcaacacgtccgtgcacgccgcaatcagacatggaaattggaagctgcttaccgggtaccctgggtgcggatactggttcccaccgccgtcccagtacaacgtcagcgagatcccgagctccgatccaccgaccaagaccctgtggctgttcgacatcgacagggaccctgaggaaaggcatgacctgtcccgggaatacccccacattgtgactaagctgttgtcacggcttcagttctaccataagcattccgtcccggtctacttccccgcccaggacccccgttgcgatcctaaggccactggagtgtggggaccatggatg

SEQ ID NO: 7097 - DNA, 1599 bp, Artificial Sequence
  Description of Artificial Sequence: Synthetic coding sequence
atggggcctcggggtgcagcatccctgcctcggggacccgggccaagacgcctcctgctccctgtggtgttgccgctcctcctccttcttctgcttgcaccaccaggttcaggtgcaggggcctcccgacctccccacttggtgttcctgctggcagacgatctgggctggaacgatgtgggatttcatggcagccgcattagaaccccccatctcgacgcactggcagcaggaggtgtgcttctggataactactacacccaacccctgtgtacccctagccggtcgcagcttctgactggacggtaccaaattcgcactggactgcagcaccagataatctggccatgtcaaccatcgtgtgtccctcttgacgaaaagttgctgcctcagctgctgaaagaagccggttacacgactcacatggtgggaaagtggcaccttggaatgtacagaaaggagtgccttcctactcgcagaggttttgacacctacttcggttaccttctcggatcggaggactactacagccatgaaaggtgcacccttatagatgcgctgaatgtgaccaggtgcgcactcgattttcgggatggggaagaagtggcaactggctacaagaacatgtactccacgaacatcttcaccaagcgagcgattgcccttattaccaatcatcccccggaaaaacccctttttctgtacctggctcttcagtccgtccacgagcctctccaggtgcctgaagaatacctgaagccctacgatttcattcaggacaaaaacagacatcattacgcaggaatggtgagcttgatggatgaagccgtcgggaacgtgaccgcagccctgaagagctcaggtctgtggaataacaccgtgttcatattctccaccgataacggcggacaaactctcgcaggtggaaataactggccacttcggggcagaaagtggtcgttgtgggagggcggcgtgcggggagtcggtttcgtggcctcgcctctccttaagcagaagggagttaagaaccgcgaactgattcatatctccgactggctgccaaccctggtcaagttggcccggggtcataccaatggtaccaagccactggacggtttcgatgtttggaaaacgatcagcgagggcagcccatcccctagaattgagctgctgcataacatcgacccaaactttgtcgactccagcccctgtccacggaattccatggctccagcaaaggatgactctagcctgcctgaatattcggcttttaacacttcagtgcacgctgccattcggcacggaaactggaagctgttgaccggatacccgggttgtggatattggtttccacctccctcgcaatacaacgtgtccgaaataccatcgtccgatccaccgaccaaaactctgtggctgtttgatatagaccgcgaccctgaggagaggcacgacctgtcccgagagtacccacacatcgtcaccaaacttctgtcacggcttcagttttaccacaaacattccgtcccggtctacttccccgcacaagatccacgctgtgaccccaaagccaccggagtctggggcccatggatg

SEQ ID NO: 7098 - DNA, 1599 bp, Artificial Sequence
  Description of Artificial Sequence: Synthetic coding sequence
atgggaccacggggagccgccagcctgccacggggaccgggaccacgccgccttctgttgccagtggtcctccctcttctgcttctgctgcttcttgcacctcctggttcaggggcaggtgcgagcagaccacctcatctcgtctttctgctggcggacgacctgggttggaacgacgtcggatttcatggaagcaggataagaactcctcaccttgatgcgctcgcagcaggaggagtgcttttggataactactatactcagcccttgtgcactccgtcgaggtcccagcttctgaccggaagataccaaattcgcactggattgcagcatcagatcatatggccctgtcaaccttcgtgcgtgcccctcgatgagaagctcctcccgcagctgcttaaggaggcaggctacaccacccacatggtcggaaaatggcacttgggcatgtaccggaaggagtgtctgcccacccgccgaggttttgacacgtacttcggatacctgctgggtagcgaagattactactcccatgagcgttgcactcttatcgatgccctgaatgtgactcgatgtgcattggattttagggacggtgaggaagtcgctaccggttacaagaacatgtactcgacgaacattttcaccaagcgggcaattgctctgatcaccaatcatcctcctgaaaagccacttttcctttacctggccctgcagtccgtccatgaaccactgcaggtgcccgaagaatatctcaagccgtacgactttatccaggacaagaatcggcaccactacgccggaatggtgtccttgatggatgaagcagtgggcaatgtgactgcagcgttgaagagcagcggcctgtggaacaacactgtattcatattctcgacggataacggtggacaaactttggccggagggaacaactggcctttgagggggagaaagtggtcgctttgggaggggggcgtcaggggtgtgggttttgtggcctccccactgctgaagcagaaaggtgtcaagaatagagaactgattcatatctcagattggctcccaacgctcgtgaaacttgcacggggtcataccaacggcactaagcctctcgatggatttgacgtctggaaaaccataagcgaaggaagcccttctccacgtatcgaattgcttcataacatcgacccaaactttgttgattcctcgccctgtcctcgaaactccatggcgcccgcaaaggacgactcatcgcttcccgagtacagcgcgttcaatacttcggttcacgcagcaatcaggcatggaaattggaagctgcttaccggatacccaggatgtggctactggtttccgcctcccagccagtataatgtgtccgagataccaagtagcgatcctccaaccaagaccctttggctttttgatattgatagagatccggaggaaagacacgacctctcacgggaatacccccatattgtgaccaaactgctttcacgcttgcagttctaccataaacattcagtccccgtgtactttcctgcccaggatccccggtgtgacccgaaggcaactggtgtgtggggtccttggatg

SEQ ID NO: 7099 - DNA, 1599 bp, Artificial Sequence
  Description of Artificial Sequence: Synthetic coding sequence
atgggtccgcggggcgccgcctcgctgcctcgaggtccaggcccacgcaggcttcttctccctgtggttctgcctcttctgctgcttctgctgctcgcccctccaggctcgggtgccggagcatctcggcctccccatctggttttccttctggcagatgatcttggttggaacgacgtgggttttcacggctcgagaatccgcaccccgcatctcgacgctttggccgccggaggtgtgctgctggataactactacacgcagccactctgtactccaagccgtagccagcttctgactggcagataccaaattcgcactggacttcagcatcagatcatttggccgtgccagcctagctgtgtgcctctggatgagaagctcctgcctcagcttctgaaggaagcgggctacacgacccacatggtcggaaagtggcatctgggtatgtaccggaaggaatgcctgccaacgagaaggggatttgatacttacttcggctacctcctgggttcagaggattactactcacatgaaaggtgtaccctgattgacgcactcaacgtgactcggtgtgcactggatttcagagatggggaagaagtggcaactggttacaagaacatgtactcaaccaacattttcactaagcgcgccatcgcacttattaccaaccatcctccagaaaagccactttttctttacctggccctccaaagcgtccacgagccacttcaagtaccagaagagtatcttaagccgtacgactttatccaagataagaaccgtcatcactacgctggtatggtgtcattgatggacgaagccgtgggaaatgtgaccgcggcacttaagtcgagcggactgtggaacaacaccgtgtttatcttttcgaccgacaacggaggtcaaactctggcaggagggaacaactggcccttgcggggaagaaagtggagcctgtgggagggaggtgtgcggggtgtgggattcgtggcaagcccgcttctgaaacagaagggggtgaaaaacagagaacttatccatatttccgactggcttccaacgcttgtgaagctcgcaaggggacacaccaatggaaccaagcccctggacgggttcgatgtgtggaaaactatttccgaagggagcccttccccacgaattgaactgctgcacaacattgaccccaactttgtcgattcatccccatgtccacgaaactcgatggcgccagcaaaggatgattcgagcctgcctgaatactccgcattcaacacgagcgtgcatgcagcaattcggcatgggaactggaaactgctcactggatacccaggctgtggctactggtttccaccaccatcgcaatacaatgtgtcggagatcccttcgagcgatccacctactaagactctgtggctgtttgatatcgatcgagatcccgaagaacgacatgatctgtcccgcgaatacccccatatcgtgactaaacttctgtcccggcttcagttttatcataagcattccgtgcctgtgtacttcccagctcaagatcctagatgtgatcctaaagccaccggagtctggggtccatggatg

SEQ ID NO: 7100 - DNA, 1599 bp, Artificial Sequence
  Description of Artificial Sequence: Synthetic coding sequence
atgggcccgcggggagcggcctcgctcccgcgcggacctggaccgcgccggctgctgctgccagtggtgctccccctgctgctgctgcttctgctggctccgccgggaagcggagcgggagccagccgaccgcctcacctggtctttctcctggcagacgatttgggatggaacgacgtgggtttccatggttcccggatccggactcctcatctcgacgcgctggccgcgggcggagtgctgctggacaactattacactcagccgctttgcaccccttccagaagccaacttctcactggaaggtaccagatccggacggggctccagcatcaaatcatctggccatgccagccatcctgcgttcctctggatgagaagctgctgccgcaattgttgaaagaagcaggatacaccacccatatggtgggaaaatggcacctcggaatgtacagaaaggaatgcttgcctactcgcagagggtttgatacctactttggatacctgctgggatccgaggactattactcccatgaacgctgcacgctcattgacgcacttaatgtgactcgatgtgcacttgacttcagggacggagaagaggttgcgactggttacaagaacatgtactcaaccaacatcttcaccaaaagagcaatagcccttattactaaccacccccctgagaaaccactcttcctctacctcgccttgcagtcagtccacgagccactgcaagtgcccgaagagtacctgaagccttacgacttcattcaggataagaacagacaccactacgcgggtatggtgtcactgatggacgaagcagtgggaaacgtcactgccgcccttaagagctcggggctgtggaataacactgtgttcatcttttccaccgacaacggaggacagaccctggctggaggcaacaactggccgcttcggggacggaagtggtcactgtgggaaggaggagtgcggggagtgggctttgtcgcctcaccacttctgaagcagaagggagtgaagaacagagagctgatacatatctccgattggctgccaaccttggtcaaactggccagaggccacaccaacggaactaaacctctggacggcttcgacgtctggaaaaccatttcagaaggctcaccttcaccccgcatcgagctcctgcacaatatcgacccgaatttcgtggactcgtcgccgtgcccgcgcaactccatggcaccggcaaaggacgactcgtccctgcccgaatactccgccttcaatacctccgtgcacgccgcaattcggcatgggaactggaagctgctcactggctaccctgggtgcggatactggtttccaccaccaagccagtataatgtgtcagagatcccgtcatccgatccaccgacgaaaactctttggcttttcgatattgaccgggaccctgaggaaagacacgacctctcgcgggagtacccgcacattgtgactaagctcctctcgcgcctccaattctaccacaaacactcggtcccagtgtacttcccggcccaggatcccaggtgcgatcccaaggcgactggggtctggggcccctggatg

SEQ ID NO: 7101 - DNA, 1599 bp, Artificial Sequence
  Description of Artificial Sequence: Synthetic coding sequence
atgggacctcgaggagcagcatcgctccccagagggcctggtccacggcggcttctgctaccagttgttctcccactgctgctgctccttctgttggccccaccgggcagcggcgccggcgccagcaggccaccccacttggtgttcttgctggctgacgatctcggctggaacgacgtgggcttccacgggtcaaggatacgtacaccgcacctcgacgcactagctgccggcggagtgctgctggacaactactacacccagcccctctgtacaccaagcagatcccagctcctgactggacgataccagattcggactgggcttcagcaccagataatttggccttgtcaacctagctgtgtgccactggacgagaaactactgcctcagctcctgaaagaagcaggatacactacacacatggtcgggaagtggcacctgggtatgtacagaaaggaatgtctccccacaagacgtgggtttgatacgtatttcggctatctgttagggtccgaggactattacagccacgagcgatgtactctcattgacgcgctgaacgtcactagatgtgccttagattttcgagatggcgaggaagttgcaaccggttataagaacatgtatagcaccaatatctttacaaagcgggccatagctctcataacaaatcaccctccagagaagccgcttttcctgtaccttgcgttgcagagcgtccacgagccccttcaggtgcctgaggaatatctgaagccatacgactttatacaggacaaaaacagacaccattacgcaggcatggtgtctctcatggatgaggcagtgggaaacgtcacagctgcactgaagagttcgggactatggaataataccgtcttcatatttagtacagataatgggggccagactctcgccggcggcaataattggcctcttagaggacgcaaatggagtctttgggaagggggcgtgcgcggggtgggcttcgtagcctcccccctccttaagcagaagggggtgaaaaaccgcgaactcatccacatcagtgattggttaccaaccttggtgaaacttgcaagaggacataccaacggtaccaaacccctcgatggtttcgatgtctggaagacgatcagcgaggggagcccctcacctcgaatagaactgctccacaatatagatccaaatttcgtcgacagttcaccttgccccagaaacagtatggctcccgccaaagacgactcctccttgcccgagtatagtgcgttcaacacgtcagtccacgcagcgatacgacacgggaattggaagctgttaacaggatacccgggctgcgggtactggtttcctccaccaagccagtacaatgtttcggagattcccagctctgatccaccaacaaagacgctttggctttttgatattgacagagaccccgaagaaagacatgatctatcaagggagtaccctcacatcgtaaccaaactgctctctcggctgcaattctaccacaagcactccgtgcccgtctactttcctgcccaggaccctaggtgtgatccaaaagccaccggagtctggggcccatggatg

SEQ ID NO: 7102 - DNA, 1599 bp, Artificial Sequence
  Description of Artificial Sequence: Synthetic coding sequence
atgggtccaagaggagcagcatctttaccaagaggaccaggacctcgaagattgttacttcctgttgtcttaccattacttttacttttattacttgctcctccaggttctggtgcaggagcttcaagacctcctcatcttgtttttttattagcagacgatttaggatggaatgatgttggattccatggttcacgtattagaacaccacatcttgatgcattagctgcaggtggtgttttattagataactactatacacaaccattatgtactccatcaaggtctcaattattgacaggaagataccaaattcgaacaggtttacaacatcaaattatttggccttgtcaaccatcatgtgtacctttagatgaaaaacttttaccacaattattaaaggaagcaggttatactactcatatggtaggaaaatggcatttaggaatgtatcgtaaagaatgtttaccaactagaagaggatttgatacttattttggatatttgcttggaagtgaagactattactcacatgaaagatgtaccttaattgatgccttaaacgtaacaagatgtgcattggatttccgtgatggagaagaagttgctacaggatataaaaacatgtattcaactaatatttttactaaacgtgcaatagcacttataactaatcatccacctgaaaaaccactttttttatatttagctttacaatctgttcatgaaccacttcaagttccagaagaatatttaaaaccatatgactttatccaagataaaaatagacatcactatgcaggtatggtttcattaatggatgaagcagttggaaatgttacagctgctcttaaatcatctggactttggaataatactgttttcatcttttcaacagataatggaggtcaaactcttgcaggagggaataactggccacttagaggacgtaaatggtctttatgggagggaggtgttcgtggagtaggattcgttgcatctccattattaaaacaaaaaggagttaaaaacagagagttaatacatataagtgattggttaccaacacttgttaaactagctcgaggacatacaaacggtacaaaaccattagatggttttgatgtttggaaaacaatatctgaaggaagtccatctccaagaattgagttacttcataatattgatccaaattttgttgattcatcaccttgtcctagaaactctatggcaccagctaaagatgatagtagtctacctgaatattctgcatttaacaccagtgttcacgcagcaattcgacatggaaattggaagttactaacaggttatccaggatgtggatattggtttccaccaccatcacaatataatgtttcagagattccatcatccgatcctccaacaaagaccctatggttatttgatatcgatcgagatccagaagaaagacatgatctcagtagagagtatccacacattgttacaaaattgttgtctagacttcaattttatcataaacattcagttcctgtatatttcccagctcaagatccaagatgtgatccaaaagctactggggtttggggaccatggatg

SEQ ID NO: 7103 - DNA, 1599 bp, Artificial Sequence
  Description of Artificial Sequence: Synthetic coding sequence
atgggacctcgcggtgcggcctccttgcctcgcggaccaggaccacgccgccttctgctgccggtggtcttgccactgctcctgcttttgctgctggcgccaccgggatcaggagctggagcgagccgccctccccatctcgtctttctgctggccgatgacttgggctggaacgacgtaggattccacgggtcgcggatccgcactccacatctggatgccctggcagccggtggagttctgctggacaactattacacccagccgctctgcactccgagcagatcgcaactgctcaccgggcggtaccagatccgcacgggcctgcagcatcaaatcatttggccgtgccagccctcgtgcgtgccgctggatgagaaattgctgcctcagctgctgaaggaagctggttataccacccacatggtcggaaagtggcacctcggaatgtacagaaaggaatgtctgcctactcgccggggtttcgatacttactttggttacctgctcggctcggaagattactactcccacgaacggtgcaccctgattgatgcgctcaacgtgactcgctgcgccctggacttccgggacggtgaggaggtggccacgggctacaagaatatgtactcgaccaacatcttcaccaaacgcgccatcgcgctcatcaccaatcacccgccagaaaagccgctcttcctgtaccttgccctccagtcagtccatgagccgttgcaagtgccagaggaatacttgaaaccatacgactttatccaggacaaaaatcgccaccactacgccgggatggtgtccctgatggacgaagccgtggggaacgtgactgcagccctcaagtctagcggactctggaataacaccgtctttatcttctctacggataatggagggcagaccctggctggtggcaataactggccgcttcgcggtcgtaagtggtcactctgggaagggggagtgcgcggggttggttttgtcgcatcccccctgcttaagcaaaagggcgtgaaaaaccgggagctcatccatatctcagattggctgccgaccctggtgaaactggcaaggggccatacgaacggcaccaaaccactggatggtttcgacgtttggaaaaccatctcagaaggaagcccaagtccgcgcatcgaactcctccataacatcgatccgaattttgtcgactcgtctccgtgtcctcggaactcgatggcacctgccaaagacgactctagcctgccagaatactcagccttcaacactagcgtgcacgcggcgatcaggcacggcaactggaagttgctcactggctacccgggctgtgggtactggttccctcccccatcgcagtacaacgtgtccgagatcccatcctcggatccacccactaagacgctctggctgtttgacatagacagagatcctgaagaacgccatgatctctcccgggaatacccccatatcgtcaccaagctcctgtcgaggctgcagttttaccataagcactcagtcccggtgtacttcccagctcaagaccctcgctgtgaccctaaggcaaccggagtctgggggccgtggatg

SEQ ID NO: 7104 - DNA, 1599 bp, Artificial Sequence
  Description of Artificial Sequence: Synthetic coding sequence
atgggtcctaggggtgcagcatcactgccccggggacctggaccaaggagactcctgcttcctgtggtgcttccgctgctccttttgcttcttctggcaccgcctgggtcgggtgcaggtgcgagtcgacctccacacctggtgttcttgcttgccgatgatcttgggtggaacgatgttgggttccatggttcccgcattcgcaccccacacctcgatgcactggcagcagggggagtgcttttggacaattactatactcaacctctttgtaccccaagcaggtcgcaactgcttaccggacgctaccagatccggaccggactgcagcaccagatcatctggccgtgccaaccctcgtgtgttccccttgacgagaaattgcttcctcagttgctgaaagaggccggatacactactcatatggtcggcaagtggcatttgggaatgtacagaaaggagtgtctcccaaccagacgtggattcgacacttacttcgggtacctccttggatccgaggattactactcgcatgaaagatgcactctgattgatgcactgaacgtgacgaggtgcgccttggactttcgggacggggaagaagtggctactggatacaaaaacatgtactcgaccaacattttcacgaagcgggctatcgcactgataactaaccaccctccagaaaagccactctttctttaccttgcactgcagtcggtacatgaaccccttcaagtacccgaggagtatctgaaaccctacgacttcattcaagacaaaaatcgccatcattacgccggaatggtgtcgcttatggacgaagcagtcggcaacgttaccgcggcactcaagagctcaggtctttggaacaacaccgtgtttatctttagcactgataatggtggacaaacccttgccggtggaaacaactggccactgaggggacgcaagtggtcactgtgggagggaggcgtccgcggagtgggatttgtcgcgtcgcctttgctgaagcagaagggagtgaagaacagggaactgattcatattagcgattggctgccgactctggtcaagctggcaagaggacacaccaatggtaccaagcccctggatggttttgatgtgtggaaaactattagcgaaggcagcccttccccccgaattgaacttttgcataacattgatccaaactttgtcgatagctccccctgtccgcggaacagcatggccccagcgaaagatgactcttcgttgcccgaatactccgcgtttaacacctcggtccacgcagcgataaggcacggtaattggaagctgcttacggggtacccagggtgtggatactggttcccacctccctcgcaatacaacgtctcagagataccttccagcgatcctccgaccaaaaccctgtggctgttcgatatcgatagagatccagaggaaagacatgacctgagccgtgaataccctcatattgtcaccaagctgctgtcacgcctgcagttctaccataaacattcggtgcctgtgtactttccagcccaagatccgagatgtgacccaaaggcaacgggcgtgtggggtccttggatg

SEQ ID NO: 7105 - DNA, 1599 bp, Artificial Sequence
  Description of Artificial Sequence: Synthetic coding sequence
atgggcccacgcggtgcggcttctcttcctcgggggccaggaccacgacgcctcctgcttccagtggtgctcccgctgctgctcctgctgttactggcccctcccggtagcggcgccggtgctagtagaccgcctcacttggtgttcctgttagcggacgatctggggtggaacgatgtaggattccacggctctcgcatccgcactccccatctcgatgccttggccgccgggggcgtacttctggataattattacactcaaccgttgtgcacgccctctcggagtcagctgttgacaggccgctatcagattagaacaggattgcagcatcagattatctggccttgtcagccctcgtgtgtgccactcgacgagaagctactgccccagctgctcaaggaagctggatataccactcacatggtcgggaagtggcacctgggcatgtaccggaaggagtgcctgccaactagacggggatttgacacctattttggctatctcctcggtagtgaggattactactcacacgagcgctgtacccttattgatgccttgaatgtgacccggtgcgcacttgatttccgtgacggagaggaagtcgcaactgggtataagaatatgtatagtaccaatatctttaccaagcgggccattgccctgattaccaatcatccccccgagaagcctctctttttatatcttgcccttcagagtgttcatgagcctctgcaggtgcctgaagaatacttgaaaccctatgattttatccaggacaagaataggcaccattatgcgggaatggtgtctttgatggatgaagcggttggtaatgtgactgctgcccttaagagctccgggctctggaacaatactgtattcatattttccactgacaacggcgggcaaactttagccggtggaaataattggcctcttcggggaaggaaatggagcttgtgggagggcggggtcaggggcgtgggttttgtcgcctccccgcttctgaaacagaaaggagtcaaaaaccgagagctaatccacatttccgactggctgcccacgctggtgaaattagcccgcgggcataccaacggcactaagcctcttgacgggtttgacgtgtggaagactattagcgaaggctctccgtcaccacgcatcgagctcctacataatatcgacccaaatttcgtggacagctcaccttgcccccgcaattcgatggcgccggctaaggacgacagctcacttcctgaatactcagcctttaataccagcgtgcacgcagctatccgccatggcaactggaagctcctcactggctaccctggctgcggttattggttcccaccccccagtcagtataacgtttccgagattccgagtagcgacccccctaccaagactttgtggctttttgacattgatagggaccctgaagaacgtcacgatctgtccagagagtatccgcatattgtcaccaagctcctttctaggctgcaattctaccataaacatagcgtgccagtgtattttcctgcgcaagaccctcgttgcgacccaaaggctactggcgtttggggtccatggatg

SEQ ID NO: 7106 - DNA, 1599 bp, Artificial Sequence
  Description of Artificial Sequence: Synthetic coding sequence
atgggaccaagaggggcagcaagcctgcctcgcggaccaggtccacggcggttgctgcttccagtcgtgttgcctctgctgctgcttttgctccttgccccacctggatccggtgcaggcgccagcagaccgccacatctggttttccttctggcagatgatcttggttggaacgatgtgggatttcacgggagccgaattcggaccccgcacctcgatgcacttgcggccggtggcgttctgctggacaattactacactcaaccactttgtaccccgtcaagatcacaactgttgaccggtcgataccaaattagaactgggcttcagcatcaaatcatttggccgtgccaaccttcatgtgtgccactcgacgaaaaactcctgccacagctccttaaagaagcaggttacacgactcatatggtgggaaagtggcacctcgggatgtaccggaaagaatgtctgccaacgagacgtggattcgacacctacttcggttacctgctgggatcagaagattactactcgcatgaacgttgcactttgattgacgcacttaacgtcacgcgctgtgcactggattttcgggatggggaggaggtggcaactggatacaagaatatgtactccaccaacattttcacgaagagggccatagctctgatcactaatcaccctcccgaaaagcctctgttcctttacctcgcgctccaatccgtgcacgagccactgcaagtgcctgaagagtaccttaaaccttacgactttattcaggacaagaaccgccatcactacgcgggcatggtttcccttatggatgaagccgtgggaaatgtcaccgcagcactgaagtcctccggcctgtggaacaatactgtgtttatcttttccacggacaacggtggacagaccctggcagggggtaataactggcccctgcgagggcgcaaatggagcttgtgggaaggaggtgtgcggggtgttggatttgtggcatcacctcttctcaagcaaaaaggcgtgaaaaacagagagctgattcacatttcggactggctgcccacgctggtcaagttggcacgggggcatactaacggaactaagcctcttgatggctttgacgtgtggaaaaccatctccgaaggttcgccatctcctaggatcgaactcctgcataacattgatcctaactttgtcgactcatccccctgccctagaaattcaatggcaccagccaaagatgattcctcccttcctgaatactccgccttcaatacctcagtccatgcggccatccgccatggaaactggaaactgctcactggctaccccggctgtggatactggtttccccctccatcccagtacaatgtgtcagagatacctagctcagatcctccaaccaagactctttggttgtttgatattgatagggatccggaggagcggcacgatctgtcccgtgagtacccacatatagtgaccaagctccttagtagacttcaattctatcataagcattcagtgccagtgtacttcccagcacaagatccaagatgcgacccaaaggcaactggagtgtggggtccatggatg

SEQ ID NO: 7107 - DNA, 1599 bp, Artificial Sequence
  Description of Artificial Sequence: Synthetic coding sequence
atgggtcctcggggagccgctagcctcccgcgggggcccgggccccgtagactgcttttacctgtggttctgcccctgctgcttttgttgttgttagcacctccagggtctggggccggggcatcaaggccgccacacctcgtgttcctactggccgatgacttaggctggaacgacgtggggtttcatggaagtaggattcgcaccccgcacctggacgcactggcagccgggggagttctgctggacaattactatacccagccactgtgcactccaagcagaagtcaactgctaacagggcgataccagatcaggactggtctccaacatcagatcatctggccttgccagccgagctgtgtccccctggatgaaaagctgctgccgcagctgcttaaagaagccggttacacgacccatatggttggaaagtggcatctgggtatgtataggaaagagtgtttgcctacacggagaggcttcgatacttattttgggtaccttctgggatctgaggattattattcacacgagcgatgtacactaattgacgctctgaacgttacacggtgcgcactggattttagggatggcgaggaggtggcgaccggctacaagaatatgtacagcacaaacatcttcactaaacgggccattgctcttattacgaaccacccaccagagaaacccctgttcctctacctggccctgcaatccgtccatgagcccttacaggtacctgaggagtaccttaagccctacgacttcatccaggacaagaacaggcaccattacgctggtatggtgagtcttatggatgaggccgtgggcaacgtcacagccgcacttaaatcttctggcctgtggaataatacagttttcattttttcgaccgacaacggcggacagacactcgccggaggaaataattggccccttcggggtaggaaatggagtctgtgggagggaggcgtcagaggggttgggttcgtggctagccctctactcaagcagaaaggagtcaaaaacagagagctgatccatattagcgattggctgccgacactggttaaattagcgagaggacacaccaatggaactaaaccgttagacggctttgatgtttggaagactatttctgagggttcccccagtccgcggatcgagctgctgcacaatattgaccccaacttcgttgactcatcaccttgcccgcgaaattccatggcccccgctaaagatgactccagtcttccagaatattccgcattcaatacgtccgtccacgctgccatcaggcatggcaactggaagctcttgaccggctaccctggctgtggctactggttccctccaccctcgcagtataacgtttccgaaattcccagctcagatcctcccactaaaaccttgtggctattcgatatcgacagggacccggaggaacgtcacgacctgtcacgggaatacccacacatagtgactaaactgctgagtcgactgcaattctaccacaaacactctgtccctgtgtactttccagcgcaagatcccaggtgcgacccaaaggctacaggagtgtgggggccctggatg

SEQ ID NO: 7108 - DNA, 1599 bp, Artificial Sequence
  Description of Artificial Sequence: Synthetic coding sequence
atggggcctaggggcgcagcctcactgccacgaggccccggacctcggcgcctgctgctgccggtcgttctgccattgctgctgcttcttctccttgctccaccaggctctggggctggcgcttctcgcccaccacatcttgtgtttcttctggctgacgacctgggctggaacgacgtgggattccacggcagtagaataagaacacctcacctggacgcactggcagcgggtggagttctgctcgacaactactatacacagcccctgtgtactcccagccggagtcagctgctcactgggaggtaccaaatccgcaccggattgcaacaccaaataatttggccttgtcaaccttcttgcgtgcctctggacgaaaagctgcttccacagctcctgaaggaggccggctacacaacacatatggtgggtaagtggcacctgggaatgtaccggaaggaatgcctcccaacccggaggggttttgatacatacttcggatatcttctgggttcagaagattactattcacatgagaggtgcaccctcatcgatgcactgaacgttacccggtgcgcccttgactttcgggacggagaagaggtggccaccggctacaaaaacatgtactctacgaacatcttcaccaaacgcgctattgctcttataaccaatcacccccctgagaagcctctgttcttgtacctggctctccagtcagttcacgaacctttgcaggtgccagaagagtatctgaagccctatgattttatccaagacaagaacaggcaccattatgcgggcatggtctccctgatggacgaggctgtcgggaatgtcacagccgcattgaagagttccgggttgtggaacaatacagtttttatcttcagtaccgacaatggcggccagactttggctggggggaataactggcctctgcggggccggaagtggagcctctgggaagggggtgtcagaggagtgggtttcgtggcctcccccctgctgaaacagaagggtgtgaagaatcgcgagctgatccatatttccgactggctcccgacactggtgaagctcgcccgagggcatacgaacggtacaaagccccttgatggatttgacgtgtggaagacaatcagtgaagggagtccatctcctcgcatagagcttctgcacaacattgaccccaatttcgtcgactcttccccctgcccccggaactcaatggctcctgccaaggacgatagctccctgcctgaatactcagcgttcaacaccagcgtgcacgctgcgattcgccatggtaactggaagttgctgaccggttacccaggatgtgggtattggtttcccccacctagccaatacaatgtgagcgaaatcccatcatctgatccaccaacaaagactctctggttgttcgacattgacagggatccagaggagcgacacgacctttcacgggagtacccacacatcgtaacaaagttgctgtcccgactgcagttttatcacaagcactcagttcctgtgtacttccccgctcaggatcctcgatgtgatcccaaagccaccggagtgtgggggccctggatg

SEQ ID NO: 7109 - DNA, 1599 bp, Artificial Sequence
  Description of Artificial Sequence: Synthetic coding sequence
atgggccctaggggagcagcatccctcccccgagggcctggcccaagacgactgcttcttcctgtggtgctccctctgctgttgctgctgttgcttgcaccgcctggttcaggtgccggagcgtcgcgacctccccatctggtgtttcttctggcagacgatcttggttggaatgatgtgggctttcacggatcgcgcatccgtactccacatcttgatgctctggcagccggtggcgtgctcctggacaattactacacccaacccctgtgcactccatcccgctcacagctcctgactggtagataccagatccggactggactccaacatcagattatctggccttgccagcctagctgtgttcctcttgatgagaagctcctgccacaactgcttaaagaagcaggatacaccacccacatggtgggaaagtggcatctgggaatgtacagaaaggaatgtctgccaacccgcagagggtttgacacgtacttcggttaccttcttggttcagaggattactattcccacgaacgatgtaccctgatcgatgcgcttaacgtgactagatgtgctctggattttagagacggggaggaagtggccaccggatataagaatatgtacagcaccaacattttcactaagagagctatagccctgattactaatcacccaccagagaagcctctttttctttacctggcactgcaaagcgtgcacgagccactccaggttccagaagaatacctgaagccctacgacttcatacaagataagaatcggcaccactacgcaggcatggtgtcgctgatggatgaagcagtgggaaatgtcacggcagcacttaagtcgtcggggctttggaacaacactgtgtttatctttagcaccgataacggcggccaaactctggcaggtggtaacaattggcctctgcgcggcaggaaatggtccctttgggaaggaggggtgagaggcgtcggttttgttgcaagccctcttctcaaacaaaagggcgtgaaaaacagagaattgatacatatctcagattggcttcctacgctcgtgaagctcgcccgtggtcacaccaacggaactaaaccgcttgatggctttgatgtttggaaaacgatttcagaagggtcaccttctcctaggattgagcttctccataacatcgatccaaacttcgtggattcatcaccctgcccccggaactcaatggcgccagcaaaggacgattcctcattgcctgaatattccgcttttaacaccagcgttcatgcagccatccggcatgggaactggaaactgttgaccggctacccaggatgtggatactggttcccgcccccttcgcagtacaatgtgtcggagattccgtcctccgacccacccactaagaccctgtggctttttgatatagaccgggacccagaagagagacatgacctgtcgagagagtacccgcatattgtgaccaaacttctgtccaggctgcaattctaccataaacatagcgtgcccgtttacttccccgcacaagacccgcgctgtgatcctaaggcaaccggagtgtggggtccttggatg

SEQ ID NO: 7110 - DNA, 1599 bp, Artificial Sequence
  Description of Artificial Sequence: Synthetic coding sequence
atggggcccagaggtgctgccagcctcccacgtggccctgggccacggcgcctcctcctccccgttgtcctccctcttctattgctgctactgttagctccacctggcagcggtgccggcgcctctcggcccccgcatctggtttttctgctcgctgatgatctgggatggaatgacgtcggctttcacggcagtcggattaggacaccacatctggacgctctggcagccgggggggtgctgctggacaattattacacacagcccttgtgcacgccatcacgctcccaactgctgaccggaaggtaccagattcgcaccggtctccagcaccaaatcatctggccatgccagccatcctgtgtgccgttggatgaaaagctgctgccacagctgcttaaagaggctggttatacgacgcacatggtcggaaaatggcatctaggcatgtatcgcaaagagtgcttaccaacccgccgcgggttcgacacatactttggctacctgctgggttcagaggactactattcccacgaacgatgtactctgatcgacgccctgaacgtcacccgctgtgccctggatttccgggatggcgaagaggtcgctactggatataagaacatgtattcaactaacatcttcacaaagagagctatcgcactgatcactaatcatccccccgagaaacctctgtttctgtatcttgccctgcagtccgtccatgaaccccttcaggtgcctgaggaatacctgaaaccatacgatttcatacaggacaagaatagacatcactacgcagggatggtgtcattaatggacgaagccgtgggcaacgtcactgcggcccttaagtcctccgggttgtggaataacacagtgttcatctttagtactgacaatggagggcagacactggctggcggaaataactggccgctgcgtggtcgaaagtggtctttatgggagggcggcgtgcgaggcgtaggctttgtggcgtctccccttttaaagcagaaaggcgttaagaacagggagcttattcatatctcagattggctccccacccttgtgaagctggctcgaggccatactaatgggacgaaacctttagacgggttcgacgtttggaagacaatctccgaaggtagtcccagccctagaatcgagctcctgcataacattgacccaaactttgtcgacagctcaccatgtccaaggaactctatggctccagctaaggatgactctagtctgccagaatattcagccttcaatacaagcgtgcatgccgcgatcaggcatggaaattggaagctcctgaccggttatccagggtgtgggtattggttcccccctccatctcaatataacgtttcagaaattccatcttcagatcccccaaccaagacgctctggctgttcgatattgaccgagatccagaggagagacacgatttgagccgggagtaccctcacattgtcaccaaactgctcagtcgattgcagttttatcataaacatagcgtacctgtgtacttccccgcccaggatcctcggtgtgatcccaaggctaccggagtttggggaccctggatg

SEQ ID NO: 7111 - DNA, 1599 bp, Artificial Sequence
  Description of Artificial Sequence: Synthetic coding sequence
atgggccccagaggcgcagcaagcctgccccgtggtcccggccctagacgactgctcctgccggtcgtcctgcctttgcttctcctcctgcttctggcgcctcctggatccggagcaggtgcgtcaagacccccacacttggtgttccttctggctgacgatctggggtggaacgatgtgggatttcatggaagccggattagaaccccccatctcgatgcgctggcagctggaggtgtgctgctggacaattactacacccaacctctgtgtactccatctcgatcacagttgttgaccggcagataccagatacgcacgggacttcaacaccagataatctggccatgtcagccaagctgtgtgccccttgacgagaaacttttgccgcagctgcttaaggaggcggggtataccactcatatggttggaaagtggcacctggggatgtaccggaaggagtgtctccctactagaagaggatttgatacttactttgggtacctcctcgggtcagaggattactattcacatgagcggtgcaccttgattgacgcgcttaatgtgacgaggtgtgcactggacttcagagatggagaggaggtggctaccggctacaagaatatgtattcaactaacatctttaccaaaagagccattgcacttattaccaaccatccacctgaaaaaccactcttcctctatcttgcacttcaaagcgtccatgaacctcttcaagtccctgaagagtaccttaagccgtatgacttcatccaagacaagaaccggcatcattacgcagggatggtgtcgttgatggacgaagcagtcggaaatgtgaccgccgcgcttaagtcaagcggactttggaacaacaccgttttcatattctcgacggataatggtggtcaaactcttgcaggcggaaacaactggccactgagaggtagaaagtggtccctgtgggaaggaggcgtgaggggcgtggggttcgtcgcctcgccccttcttaaacagaagggagtcaagaatcgcgaacttattcacatctccgactggctccctaccctggtgaagctggcaagaggacacacgaacgggaccaagcctctggatggatttgatgtgtggaaaaccatctcggaaggtagtccaagtccccgcatcgagctccttcataacattgatcccaattttgtggatagctcaccatgtccccggaactccatggcacctgcaaaagacgattcaagcctcccagaatacagcgcatttaacacctcggtgcatgcagcgatccgacacggaaactggaaactgctgaccggataccccggatgcgggtactggtttccaccaccttcccagtacaacgtgtccgaaattccttcgtcggacccaccaactaaaaccctctggctctttgacatcgaccgtgatccagaagaaagacatgatctgtcacgcgaataccctcatattgtgaccaagctgctgtcgaggcttcaattctaccacaagcatagtgtgccagtgtactttcccgcacaagacccccgatgcgatcctaaggcgaccggtgtctggggaccttggatg

SEQ ID NO: 7112 - DNA, 1599 bp, Artificial Sequence
  Description of Artificial Sequence: Synthetic coding sequence
atgggtccccgtggggcagcgtctctgccccgcggcccgggaccaaggcgcttactcctgcctgtcgtgcttccattactgctgctgctgctgttagcgccaccgggcagcggggcaggcgccagccgaccacctcacttggtgtttctgctggcggacgatctgggctggaatgatgtcggttttcatggctcacgcatccgcacgcctcatctggacgcgctggcggctggtggagtgctgttggataactactatactcaacctctgtgtaccccaagccgtagccagctgttgacgggtcgataccaaattcgaacaggactgcagcaccagattatttggccatgccaacccagctgtgttccactggacgagaagttgttaccgcagctgctgaaagaggcaggctataccactcatatggttggaaagtggcatctagggatgtaccgcaaggaatgcctaccgactcgccggggcttcgacacgtatttcggctatctgttaggaagtgaggactattattcccacgaacgctgcaccctgattgatgctctgaacgtgacgcgctgtgcattggatttccgcgacggtgaagaggttgctaccgggtataagaacatgtatagcactaacatcttcacgaaacgtgccattgcacttattacgaaccatccgcctgagaagcctctgttcctgtatctcgcgctgcagagcgtccatgagccactgcaagtaccagaagagtacctaaaaccgtacgatttcatccaggacaaaaaccgccatcactacgcggggatggtgagcttaatggatgaggcggttggtaacgtgaccgcggcgttgaagtcatccggtctctggaacaataccgtattcatctttagcactgacaacggcggccaaacactggcgggcggcaacaactggccgctacgcggacgcaagtggagcctgtgggagggcggagtgaggggtgttggtttcgtcgcaagccccctgctgaagcagaagggagtgaaaaacagagagctgattcacatctccgactggctgccgacgttggtgaaactggcgcgcggccatacaaacgggacgaaaccgctggatgggtttgacgtatggaaaaccattagcgaagggagcccaagcccgcgcatcgaactgctgcacaatatcgatccaaattttgtcgactcaagcccgtgccctcgcaactcgatggcccccgcaaaagacgattcttcactgccggagtactccgcatttaacacttccgtgcacgcggcaattcgccacggcaattggaagctgctgacgggttatccagggtgtggctactggttcccgccaccgagccagtataatgttagcgaaattcctagctcggatcctccaacgaaaaccctgtggctgttcgatattgaccgcgatccggaggaacgccacgatctgagcagggaatatccacacatagtgactaaattgctctcccggctgcaattctaccacaaacacagcgtgccggtttatttccctgcccaagatcctagatgtgacccgaaggcgaccggagtttggggtccgtggatg

SEQ ID NO: 7113 - DNA, 1599 bp, Artificial Sequence
  Description of Artificial Sequence: Synthetic coding sequence
atgggtcctagaggggctgcgagcctgcctcgagggccaggaccccgacggctgctgctcccagttgtgctgcccctgttactcctcctcctattagcccctccgggatctggagccggcgcaagtaggcctcctcacttagtcttccttctggcggatgatctgggatggaacgacgtggggtttcacggctctcggatccggacgccacaccttgatgcgctcgcagccggtggcgttctcctagacaactattatacgcagccactgtgcactccatcaaggtcccaactgctgacaggcaggtaccaaattcgtacagggctgcagcatcagattatctggccatgccagccaagctgcgtcccactggacgaaaagctgctgccacagcttctgaaggaggcaggttacactacgcacatggtgggtaagtggcatctcgggatgtaccggaaagaatgtttgcccacccggcgtggttttgatacctacttcggatatctgctcggctccgaagattactactcacacgagcggtgcacactcatcgacgcgctgaacgttacaaggtgcgcgctggattttcgggacggagaggaggtcgccactgggtataagaacatgtatagtacaaacatcttcacaaaacgtgcgattgctctcatcactaaccacccacccgagaaacccctcttcttgtatctggccttacagtccgtgcacgaacctctgcaggtgcccgaggagtacttgaagccctacgattttatccaggataaaaatcgccatcactatgcaggtatggttagcctaatggacgaggcagtgggcaatgtgactgccgccctgaaatcatctggcttgtggaataatactgtgttcattttttccacagacaacggcggccagaccttggcgggagggaataattggcccctccgggggagaaagtggtcattatgggaagggggcgtgaggggcgtgggattcgtagcgtcgcccttacttaagcaaaaaggagtgaaaaatagagaacttatacacatttctgactggctgccaactctcgtcaagctggcgcggggccacacaaacgggaccaaaccattggacggttttgacgtgtggaagaccatttccgaggggtctcctagccctcgcatagaacttcttcacaacattgaccctaatttcgtggattcatccccctgcccgcgaaacagcatggcacccgccaaggacgacagttctttgcccgaatactccgcttttaatactagcgtccacgctgcaatcaggcatggaaattggaaattactgaccggttacccaggctgcggctactggtttccaccaccgtcccagtataacgttagcgaaatcccgtcctccgatccaccgacaaaaacactctggctgttcgacatcgatcgggacccagaagagcggcatgacctctctagagagtaccctcacattgtgactaagttgctgagccgactgcaattctatcacaaacatagtgtgccagtttactttccagcacaggacccccggtgtgaccctaaagccaccggagtgtggggcccgtggatg

SEQ ID NO: 7114 - DNA, 1599 bp, Artificial Sequence
  Description of Artificial Sequence: Synthetic coding sequence
atgggcccaaggggcgctgctagtttgccacgagggcctgggccaagaaggctgctgctccctgtggtgttgccactcttgctccttctcctactcgccccgcctggctctggagccggtgcttcccgccctcctcatttagtcttcctactcgcagacgacctgggctggaacgatgtcggatttcatggatcaaggatccgcaccccacacctagacgcgctcgcagctgggggagtccttctcgataactattacacgcaacctctgtgcaccccctctagaagccagttgctaacgggacggtaccagatccggaccggccttcagcaccagattatttggccatgccagcctagctgtgtgcccctggatgagaagctcctgccacagctcctgaaggaagcaggatacaccacacacatggtcgggaaatggcacctgggcatgtaccggaaggagtgcctgcctaccaggcgtggctttgacacgtatttcggttacctgttggggtcggaagactactatagccatgaacgatgcacactgatagatgccctgaacgtgacacggtgtgccttggactttcgtgacggtgaggaggttgcaacggggtacaagaatatgtactccaccaacatctttacgaaaagagccattgctctcatcaccaaccatccaccggaaaaaccactcttcctgtacctggcactacagtccgtccatgaacctttgcaggtccctgaggagtatcttaagccatatgacttcatccaggataagaaccggcatcattacgcgggcatggtgtcccttatggacgaggctgtggggaacgtgacagctgctttgaagtcatctggtctgtggaataataccgtgttcatctttagtacggacaatggcggacagaccctggcagggggtaacaactggcctctgagaggtcgaaagtggtccttatgggaaggaggagttaggggagtaggatttgttgcttctcccctcctcaagcagaagggtgtgaagaatcgcgaactcatccacataagcgattggctgcctaccctggttaagttggctcgcggtcatactaacggaaccaaacctctggacgggttcgacgtttggaagacaatttcagagggctccccgagtccacggatcgagctgctgcataacatcgatcctaacttcgtggatagctctccttgccctaggaattccatggcgccggctaaggatgattcttctttacctgagtactctgcgtttaacaccagcgttcatgccgcgatccgccatggcaattggaaattgctgaccgggtacccaggctgtggatactggttccctcctcccagccagtataacgtgtccgagataccatccagcgatcccccgacaaaaacattgtggctgtttgatatagatagggatcccgaggagcgacatgatctgtccagagagtacccccatatcgtaaccaaactactgtcgagactgcagttctaccacaagcacagcgttcccgtatacttccctgcccaagacccacgatgcgatccaaaagcaaccggagtgtggggaccttggatg

SEQ ID NO: 7115 - DNA, 1599 bp, Artificial Sequence
  Description of Artificial Sequence: Synthetic coding sequence
atgggcccaaggggagcagcatcactccctagaggtcccggaccacggcggctcctccttcctgtggtcttgccactgttgctgctcctgctgcttgcacctcctgggtcgggggccggtgcgtcaagaccccctcatttggtgttccttctggcggatgacttgggttggaacgacgtgggctttcatggctcgcgaattaggaccccacatttggacgcactcgcagcgggtggtgtcctcctggataactattacactcaaccactttgtaccccgagccgctcccaacttcttactggacggtaccaaatccgcaccggactccagcaccagatcatttggccatgccagccttcgtgtgtgccactggatgagaagctgctcccgcagctgctgaaggaggcaggatacaccacccacatggtgggaaagtggcatcttggtatgtacagaaaggaatgccttcctactaggagaggatttgatacctacttcggttaccttctcggttcggaagattactactcccatgagagatgcactctgattgacgcactgaacgtgacgcgatgtgcgcttgactttcgagacggcgaagaggttgccactggatacaagaacatgtacagtacgaatatctttaccaagcgtgcaatcgcactcattactaaccacccgcccgagaagccactttttctctacctggccctgcaaagcgtgcatgaaccactgcaagtgcctgaggaatacctgaaaccatacgatttcatccaagacaagaaccggcatcactacgcaggaatggtgagtctgatggacgaagccgttgggaatgtcaccgcagcacttaagtccagcggactttggaacaatactgtgtttatcttctccaccgacaacgggggtcagaccctcgcaggagggaacaattggcctctgcggggaagaaagtggtcgctctgggaaggaggggttcgcggagtgggtttcgtggcaagcccgcttcttaaacaaaagggtgtgaaaaatcgcgaactcatccatattagcgattggcttcccactcttgtcaaactggcacggggacataccaacggtacgaagccactcgatggtttcgatgtttggaaaacgatctcggaaggctccccctcgccgcggatcgagcttctccataacatcgacccgaattttgtggatagcagcccgtgtcctagaaactcaatggcgccagcgaaggatgattcatcccttcccgaatattccgccttcaatacgtccgtccacgcagcaattaggcatggaaactggaagctgcttaccggttatccgggatgcggatactggttccccccgccgtctcaatacaacgtgagcgagatcccatcatcagatcctcctactaagaccctgtggctttttgacatagatcgggaccctgaagaacggcatgacctgtcccgcgaatacccccatatcgtcaccaagctgctgtccaggctgcagttttaccacaaacatagcgtgcctgtctactttccagcgcaggatcccaggtgtgatcctaaagccaccggggtgtgggggccatggatg

SEQ ID NO: 7116 - DNA, 1599 bp, Artificial Sequence
  Description of Artificial Sequence: Synthetic coding sequence
atgggtcctaggggagcagcaagtcttcctagaggtccaggcccgcgccgcttgttgctgccggtagtgctgccattgctgctgctcttgttgttggcaccccctggttccggtgctggcgcttcccgcccgccccacttggtgttcctgcttgccgacgacctcggctggaacgacgtaggttttcacggttcccgcatacgcaccccgcatctggacgctcttgcggccggcggcgtccttctggacaactactacactcagccactctgtaccccgagtagaagtcagctgctgaccggccgctatcaaattcgcactggcctgcagcaccaaatcatctggccatgtcaaccgtcttgtgtcccactggacgagaagctgcttcctcagctgttgaaggaagcgggatacaccacccatatggtaggtaagtggcatctgggaatgtatagaaaagagtgtctcccaacgagaaggggttttgacacttattttggctaccttctcggcagtgaggattactacagccacgagaggtgcacgctcattgatgcgctcaacgtgactaggtgtgcgctggatttccgcgacggcgaagaagtggccactggttacaagaatatgtattctacaaacatatttacaaaaagggcaattgccctgattacgaaccaccctcctgaaaagcccttgttcctctatctggctcttcagagcgtccacgaaccactgcaggtccctgaggagtatttgaagccctatgacttcatccaagacaaaaacagacaccactatgccggcatggtgtcccttatggacgaagcagtgggtaacgtcacggcggccctgaagagctctggtctgtggaacaacacagtcttcattttcagcactgacaacggaggccagaccttggcaggtggaaataactggcctctgagaggtcgcaaatggagtttgtgggagggtggcgtacgcggagtgggtttcgtcgcctcccccctgctgaagcagaagggtgtcaagaatagagagttgattcacataagtgattggttgcccaccctggtgaaactggcccgcggccacactaacggaaccaagcctctggatggcttcgacgtttggaaaacgatatcagagggtagccccagtccgcgcattgagctgctgcacaatattgacccgaactttgtagacagctccccctgtcccagaaattctatggcgcctgcaaaagatgattcctctctgcctgagtactccgcgttcaatacttcagtgcacgccgccattaggcatggaaactggaagttgctgaccggctacccaggatgcggatactggttccctccaccctcccagtataatgtatctgagatcccctccagcgacccgccaaccaaaactttgtggctctttgatattgacagagaccctgaagagcgccacgatctgagtagagagtacccacacatagtgactaaactgctgtcaagactccagttctaccataagcactccgtacccgtttactttcccgcgcaagacccacgctgcgaccctaaagctaccggtgtgtggggaccgtggatg

SEQ ID NO: 7117 - DNA, 1599 bp, Artificial Sequence
  Description of Artificial Sequence: Synthetic coding sequence
atggggcctcggggagcagcaagtctgcctagggggcctggaccccggcgtctactgctccccgttgttctaccactgcttctgcttctgctcttagctccacctggaagtggtgctggcgcctctcgtccccctcacctagtcttcttattggccgacgaccttgggtggaatgacgtagggtttcatggaagtaggataagaaccccccacctggatgcattagccgcagggggcgtccttctcgacaactattacacccagcccctgtgtaccccatcacggagccagcttctgactggaaggtaccagattcgaaccggtctgcagcatcagatcatctggccctgccaaccatcttgcgtgccactggacgaaaaactcctgccgcagctcctgaaagaggcgggttacacaacacacatggttggaaagtggcatcttggcatgtatagaaaggagtgtctcccaacacgccggggatttgacacttacttcggttatctgctgggaagtgaggactactattcccacgaacggtgtacgctcatagacgccttgaacgtgacaagatgcgccttggacttccgagacggagaggaggtggccacaggttacaagaatatgtatagcacaaatatatttactaagcgggcaattgccctgataactaaccacccccccgaaaagccgctgtttctttatttggcgcttcagtccgtgcacgaaccgcttcaggtccccgaggaatacctaaagccttatgacttcattcaggataagaaccgacaccattatgctgggatggtgagtctgatggatgaagccgtcgggaatgttacggccgctttgaaatcctccggcctctggaataacacggtgttcattttctccaccgacaacggcgggcagacactcgctggaggcaataactggcctctaaggggccgtaagtggagtctttgggaggggggtgttaggggcgttggcttcgtggctagcccactcctaaaacagaagggggtaaagaatagagaattaattcacatctctgattggctccccactctggttaaacttgccaggggccacaccaacggcacaaagcctctggacggatttgatgtctggaagaccatcagtgagggcagtccttccccgcgcatcgaattgctgcataacattgatcccaactttgtagactcatccccctgcccccgcaatagtatggctccggcaaaagatgattcttcgctgccggaatattccgcttttaatacctctgttcatgctgccatccgccacgggaattggaaacttctgactggttatccaggatgtggctattggtttccccccccctcacagtacaacgtaagtgaaatcccttccagcgatccgcccactaagactttgtggctgttcgacattgaccgagatccagaagagcgccacgacctgagtagagaatacccacacatcgtcacaaaacttctgagccggctgcagttctaccacaaacactccgtgcccgtctacttccctgcacaagaccccaggtgcgaccccaaggccacaggcgtttggggaccatggatg

SEQ ID NO: 7118 - DNA, 1599 bp, Artificial Sequence
  Description of Artificial Sequence: Synthetic coding sequence
atgggcccccgaggcgcagcaagcctgccccgcgggcctggaccccgccgactgctgctgcccgtagtcctgccactgctcctactcctattgctcgctccaccaggcagcggtgcgggggcttctagaccacctcacttagtctttctgctcgccgacgacctgggctggaatgatgtagggttccacggctctcgcatccggactccacaccttgatgcgcttgcagccggaggggtgctgctggataactactacacccagcccctgtgtacacccagcagatcccagttactcactggacggtatcaaatccgcactggtctgcagcaccaaatcatatggccttgccagccctcttgcgtacctctggacgagaagttgctaccccaactgttgaaagaagcagggtacacaactcacatggtaggcaagtggcatctaggaatgtatcggaaagagtgcctcccaacccgtcggggattcgacacatacttcggataccttctgggaagtgaagactactattcgcatgagcggtgcacactcatcgacgcattgaatgtgacaaggtgcgcgttagacttcagggatggtgaggaggtagcaacaggttacaagaatatgtattctaccaacatcttcaccaagcgagctatcgctctgattaccaaccaccctcccgagaagccattatttctttatctggcgctccagagcgtccatgagcccttgcaggttccggaggaatatctcaagccctatgacttcatccaggacaagaatagacaccattacgcaggtatggtatctctgatggacgaggccgtgggcaacgttacagccgcattgaaatcaagcgggctgtggaacaacaccgtcttcatattctctacggataacggcgggcagacactggcgggggggaataactggccactcagggggcggaagtggtccctttgggagggcggagttcggggtgtgggctttgtggctagccccctcctgaagcagaaaggcgttaagaaccgagagctcatccacatctctgattggctacccacattggtgaagctggctagaggccacaccaatgggactaagcccttggatggatttgatgtgtggaaaaccatctctgaagggtctccaagtccacggattgaactgctgcataatattgatcctaatttcgtcgactcttccccttgcccacgcaattcgatggcgccggctaaagacgacagttctctaccggagtacagtgcattcaacacttcagtccacgctgcaattcgtcatgggaattggaaactgctcactggatacccggggtgtgggtattggtttcctcccccctcccaatacaatgtgtcggaaatcccctcctccgatccgcccacgaagacactctggctgttcgacattgaccgggatcccgaggagaggcatgatctgagtcgcgaatatccccatatcgtaaccaagctcctgagccgcctgcagttctatcataaacatagcgtacctgtctattttcctgcacaggatcctagatgcgaccctaaggctaccggcgtgtgggggccatggatg

SEQ ID NO: 7119 - DNA, 1599 bp, Artificial Sequence
  Description of Artificial Sequence: Synthetic coding sequence
atgggacccagaggagccgctagcctgcccagaggccccggaccccgcaggctgctgttgcctgtcgttctccccctgctgcttcttctgctcctggctccacccggtagcggtgctggagccagtcgtcctcctcacctggtgtttctgttggctgatgacttgggctggaacgacgttggcttccacggcagcaggattagaaccccccacctggatgcattggccgctggcggtgtcctgctggacaactattacacccagccactgtgtactcccagtcgcagccaacttctcaccggcagataccagattcgtaccggcctgcagcaccagatcatctggccatgccagccctcctgcgtccccctggacgaaaaactgttgccccagcttctgaaggaggctggctacacaactcatatggtgggaaagtggcatctgggaatgtaccgcaaagagtgcctgcctacccgccgcggtttcgatacatatttcggttacctcttgggttccgaggactactattcacatgaacgttgtacactgatcgatgctctcaatgttacccgttgcgctcttgactttcgcgacggcgaggaggtagctactggctataagaacatgtactctacaaatattttcaccaagagagccatcgctctcatcacaaaccacccccccgagaagccactgtttttgtaccttgccctccaatccgtgcacgagccccttcaggtgcccgaggagtatctcaaaccatacgatttcatccaggacaagaacagacaccattacgctggtatggtctctctgatggacgaggctgtgggtaacgtcactgccgccctgaagtccagtggattgtggaataatacagtattcatcttctctaccgataacggcggacagactcttgcaggtggtaacaactggcctctgcgcggtcgcaagtggtctctttgggaaggaggcgtcaggggagtgggatttgtagctagtcccttgctgaagcagaagggtgttaagaaccgcgaactcatccacatctctgattggcttcccacactggtcaagctcgctagaggacacaccaatggcaccaaaccactcgatggcttcgatgtctggaagaccatttctgagggatcaccttccccccgcatcgaattgctccacaacattgatcccaactttgttgattcttccccttgccctagaaactccatggctcctgctaaggacgatagttctctgcctgagtacagtgcctttaacaccagcgtccatgcagccatcaggcatggaaactggaaactcctgacaggctaccctggctgcggttactggtttccccccccatctcagtacaatgtctctgagatcccctccagcgatccacccaccaagaccctgtggctcttcgatattgacagggatcctgaggaaagacacgacctctccagagagtaccctcacatcgtgacaaagttgctctctcgtctccagttctaccacaagcattccgtaccagtttacttcccagctcaggatcctcgctgcgatccaaaagccactggagtctggggtccatggatg

SEQ ID NO: 7120 - DNA, 1599 bp, Artificial Sequence
  Description of Artificial Sequence: Synthetic coding sequence
atgggccccagaggagctgcttcactccccagaggcccggggcctaggagactattactccctgttgtcctccctctcctcctcttgcttttgctggcccccccaggaagcggggctggagcctctcggccacctcacctagttttcctgcttgccgatgatctggggtggaacgacgtgggattccacgggtcacggatccgaacccctcatctggatgctttggctgccggcggcgtcttactcgataattactacactcagcctctgtgcacgccatccagaagccagctcctaactggccggtaccagattcgcactggcctgcaacaccagatcatttggccctgtcaaccctcctgtgttcctctggacgaaaaactgctcccgcagctgttaaaagaggctgggtacacaacccacatggtggggaagtggcatcttgggatgtaccgcaaagagtgcttgcccacacggagaggattcgacacctatttcgggtatctcttagggagcgaagactattacagccatgagcggtgcactctgatcgacgctcttaatgtgacccgatgtgccctcgatttccgagatggagaggaggtggctacagggtacaaaaatatgtacagtaccaatatctttactaagagggcgatcgccctgattaccaaccatccgcctgaaaaaccactatttctgtaccttgccctccaatccgttcatgaacccctgcaagtacccgaagagtacttgaagccttacgactttatacaagacaaaaacagacaccattacgccggcatggtttcgcttatggatgaagctgtgggcaatgttaccgccgctctaaagagtagtggactgtggaacaatactgtcttcattttcagtaccgacaacggaggacagacattggcgggcggtaataactggcccttgaggggtagaaagtggagtctgtgggaggggggagttagaggtgtcggattcgtagcaagtccactattgaaacagaagggggtgaagaatcgcgaactgattcatataagcgattggctccctacattggtaaagctggctcgcggccacacaaatggaactaaaccccttgatggcttcgacgtctggaagactattagtgaaggttcacccagcccgcgaattgagctgctccataacatcgacccaaatttcgtggattcttccccttgcccaaggaactcaatggcgcccgccaaggatgattccagcctgccggaatatagcgcatttaacacgtccgtccacgccgcgattcgccacggcaactggaaactgctgactgggtatcccggttgcgggtactggtttcctcctccttcccagtacaatgtttccgagataccctccagcgaccctcccaccaaaacactttggttgtttgacatcgatcgggatcccgaggagcgccatgacctgtcaagggagtatccccacattgtcactaagctgctcagcagacttcaattttaccataaacatagcgtaccagtttacttccctgcccaggaccccaggtgtgatcctaaggcaacgggcgtgtggggcccttggatg

SEQ ID NO: 7121 - DNA, 1599 bp, Artificial Sequence
  Description of Artificial Sequence: Synthetic coding sequence
atgggtccgcgtggtgcggcgtcgttaccgcgtggtccgggtccgcgtcgattattactaccggttgttttaccgctattactactattattattagcgccgccgggttcgggtgcgggtgcgtcgcgtccgccgcatttagtatttctattagcggatgatttaggttggaatgatgtaggttttcatggttcgcgtatacgaacgccgcatttagatgcgctagcggcgggtggtgtattattagataattattatacgcaaccgttatgtacgccgtcgcgttcgcaactattaacgggtcgatatcaaatacgaacgggtttacaacatcaaataatatggccgtgtcaaccgtcgtgtgttccgttagatgaaaaattattaccgcaattattaaaagaagcgggttatacgacgcatatggtaggtaaatggcatctaggtatgtatcgaaaagaatgtctaccgacgcgtcgaggttttgatacgtattttggttatttactaggttcggaagattattattcgcatgaacgatgtacgctaatagatgcgttaaatgtaacgcgttgtgcgttagattttcgtgatggtgaagaagtagcgacgggttataaaaatatgtattcgacgaatatatttacgaaacgtgcgatagcgctaataacgaatcatccgccggaaaaaccgctatttttatatctagcgttacaatcggttcatgaaccgctacaagtaccggaagaatatttaaaaccgtatgattttatacaagataaaaatcgtcatcattatgcgggtatggtatcgttaatggatgaagcggtaggtaatgtaacggcggcgttaaaatcgtcgggtctatggaataatacggtatttatattttcgacggataatggtggtcaaacgctagcgggtggtaataattggccgctacgtggtcgtaaatggtcgttatgggaaggtggtgttcgtggtgtaggttttgtagcgtcgccgctactaaaacaaaaaggtgtaaaaaatcgtgaattaatacatatatcggattggctaccgacgctagttaaattagcgcgaggtcatacgaatggtacgaaaccgttagatggttttgatgtttggaaaacgatatcggaaggttcgccgtcgccgcgtatagaattattacataatatagatccgaattttgttgattcgtcgccgtgtccgcgaaattcgatggcgccggcgaaagatgattcgtcgttaccggaatattcggcgtttaatacgtcggtacatgcggcgatacgacatggtaattggaaattattaacgggttatccgggttgtggttattggtttccgccgccgtcgcaatataatgtatcggaaataccgtcgtcggatccgccgacgaaaacgctatggttatttgatatagatcgtgatccggaagaacgacatgatttatcgcgtgaatatccgcatatagttacgaaattattatcgcgactacaattttatcataaacattcggtaccggtatattttccggcgcaagatccgcgatgtgatccgaaagcgacgggtgtatggggtccgtggatg

SEQ ID NO: 7122 - DNA, 1599 bp, Artificial Sequence
  Description of Artificial Sequence: Synthetic coding sequence
atgggcccgcgcggcgccgcctccctgccccgtggtcccgggccccgccgactgctgctgccggtggtcctgcccctgctgctgctcttactgcttgcccctcctggctccggcgccggcgcctctaggcctccccatctcgtgttcctgctggcggatgacctggggtggaacgacgtgggttttcacggctcgcggatacgaacgccccacctcgacgcgcttgccgcgggcggagtcctcctggataactactacacacagccactatgtactcccagccggagccaactgctgacaggacgataccagattagaacgggtctacaacaccagattatctggccctgtcagccatcttgcgtccccttggatgagaagctgctccctcagcttctcaaggaagccggatacaccacgcacatggtcggaaagtggcatctcggcatgtaccggaaggagtgcctcccgacgaggcgaggttttgatacgtacttcggatacctgctaggatccgaggattactactcgcacgagcggtgcacgctaatcgatgctctgaatgtgacccgctgcgcactggatttccgggatggtgaggaagtggcgaccggatacaagaatatgtactcaaccaacattttcaccaagcgggcaatagcactaatcactaatcatcctcctgaaaagccgctgtttctgtatttggcactgcagagcgtgcatgagcctttacaggtgccggaagagtacctcaagccgtatgatttcatccaggataagaaccggcaccattatgcaggaatggtctccctgatggacgaggccgtcggtaacgtcaccgccgcgttgaaatcgtcgggtttgtggaacaacacagtgtttattttctcaacggataacggcggccaaaccctggctggaggtaataactggcctctgagggggcgtaagtggagcctttgggagggaggcgtccgaggggtgggctttgtagcaagtcccctattgaagcagaagggagttaagaaccgcgagctgatccacatctcggattggctgccgaccttggttaagttggcaaggggccacaccaatggtacaaagcccctcgatggtttcgacgtatggaagacgatttcggagggcagcccaagccctaggattgagctgttgcacaacatcgatcctaactttgtcgattcgagtccctgcccccggaattcgatggctcccgctaaggacgattccagtcttcccgaatactcggcattcaacaccagtgtccacgccgctatccgccacggaaactggaaactgctgactggctatcccggctgcggttattggttcccgcctccctctcagtacaatgtctctgagattcccagctccgatccgcccactaaaaccttgtggttgtttgatattgatcgagatcccgaggagaggcatgatctcagccgcgagtacccgcatattgtgactaagctactgtcccgcctgcagttctaccacaagcattcggtgccagtctacttccctgcccaggacccgaggtgcgacccgaaggccacaggagtgtggggcccttggatg

SEQ ID NO: 7123 - DNA, 1599 bp, Artificial Sequence
  Description of Artificial Sequence: Synthetic coding sequence
atgggcccgcggggagcggcgtctctcccgcgaggcccgggcccgcggcgcttgctgctgcctgtcgtgctcccgctcctccttctgctgcttctggcgccgccgggtagcggagcaggagcgtccagaccaccgcacttggtgttcctgctcgctgatgatctgggctggaacgatgtcgggtttcacggctcacggatccgcactccgcacctggacgctctggccgccggtggggtcctgctggataactactacactcaaccgctttgcaccccatcccgctcacaactcctcaccggaagataccaaatccggacgggactgcaacaccagatcatttggccgtgccagccttcatgcgtcccgctggacgaaaaacttctgccgcaactccttaaagaagccggatacaccactcacatggtgggcaagtggcacctcggcatgtaccgcaaggagtgcctccctacgcggcgcgggttcgacacctatttcggatacctgcttgggtcagaagattactactcccacgaacgttgcaccctgatcgatgccctcaatgtgacgcgttgcgccctggacttcagagacggggaagaggtggctactggatacaagaatatgtacagcactaatatctttaccaaaagagcgattgcgctgatcaccaatcatccgccggaaaagccactgtttctgtaccttgcactgcagtccgtgcacgaaccacttcaggtgccggaagagtatctcaagccgtacgatttcatccaagacaagaaccgccatcattatgctggaatggtgtccctgatggatgaggcggtgggaaacgttactgcagccctgaagtcgagcggactgtggaacaataccgtctttatcttcagcactgataacggtggacagacgttggccggcggcaacaattggccattgcgggggaggaagtggtccctctgggagggaggggtccgaggcgtgggcttcgtggcctcccccctgctgaagcagaagggtgtgaagaacagagaactgatccacatctcggactggttgcccaccctcgtcaagctggcgcgaggacataccaatggaaccaagccactggacggattcgacgtgtggaaaaccatctcagagggatcgccaagcccgaggattgagctcctccataacatcgaccctaactttgtggattcgtcaccttgcccgcgcaactcaatggcacccgctaaggatgactcaagcctcccagagtacagcgccttcaatacctcggtccacgccgcgatccgccacggtaactggaaactgctgacggggtacccaggttgtgggtattggtttcccccaccatctcagtacaacgtgtcggaaatcccttcctcagatcctcccaccaagaccctgtggctcttcgacatcgaccgtgaccccgaggaacgccatgacttgtcgcgcgaatacccacacattgtgaccaagctgctgtcgcgcctgcagttctatcacaaacattcggtgccagtttacttcccagcacaggacccacgctgcgacccgaaagctaccggagtgtggggtccttggatg

SEQ ID NO: 7124 - DNA, 1599 bp, Artificial Sequence
  Description of Artificial Sequence: Synthetic coding sequence
atgggacccagaggagccgctagcctgccgcgcggccctggaccaaggcgtctgctgctcccagtggtgcttccgctgctgctcctgctgctgcttgcgccgccgggatccggtgcaggagcctcacgcccaccgcatcttgtttttctcctcgcagacgacctgggatggaacgatgtgggcttccacgggtcgcggatccggacccctcacctcgacgccctggccgccggaggagtgctcctggataactactacacccagccgctgtgtactccgtcaagatcccagctgctgactggccggtaccaaattaggaccggattgcagcatcaaatcatctggccgtgtcagccgtcgtgcgtgccgctggatgagaagctcttgccgcaacttctgaaagaggcaggatacactacccacatggtggggaagtggcatctcggcatgtaccgcaaagaatgcttgcccactagaaggggatttgacacctacttcggctatctgctcggttccgaggattactactcacacgagcggtgcacgttgattgatgctttgaatgtgactagatgcgcgctcgacttccgcgacggcgaagaggtggctactggatacaagaacatgtactcgaccaacattttcactaaacgcgcgatagcgctgatcacgaatcatccaccagaaaaaccacttttcctttacctggccctccaatccgtgcatgagccgctgcaggtgccagaagaatacctgaaaccctatgacttcatccaggataagaatcggcaccattacgccggaatggtgtccttgatggacgaggccgtcggtaatgtcactgcagcgctgaagtcatcggggctgtggaacaatactgtgttcatcttttcgactgacaatggaggacagaccctggccggaggtaacaactggccactccgcggaagaaagtggagcctctgggagggtggcgtgcggggtgtggggttcgtggcaagtccgttgctgaaacagaaaggagtcaagaatcgcgaactgatccatatctccgactggctgccgaccctggtgaagttggcccggggacacactaacggaaccaagcctctggacggatttgacgtgtggaaaacgatctcggagggatcgcctagcccgagaatcgaactgcttcataacatcgaccctaactttgtagactcgtccccctgcccgcgcaatagtatggcaccagccaaggatgactcatccctcccagaatactcagcgttcaacacttcggttcacgcagcgattcggcatggaaactggaagctcctcactggatacccgggttgcggctactggttccctccgccgtcccagtataacgtgtcggaaattccgagttcggacccaccgactaagactctgtggctgttcgacatcgaccgggacccagaagagcgccacgacttgagccgcgagtacccgcacatcgtgaccaagctgctgtctcggctccagttctatcacaagcactcagtgcctgtttacttcccggctcaggatccccgctgcgatccgaaggcgactggcgtctggggtccctggatg

SEQ ID NO: 7125 - DNA, 1599 bp, Artificial Sequence
  Description of Artificial Sequence: Synthetic coding sequence
atggggccccggggagcggcgagcctgccaagaggcccaggacctcggcggctgctgcttccagtcgtgttgcctcttcttttgcttctccttcttgccccaccaggatcaggtgcaggtgcatcccgacctccgcacctcgtgtttcttctggcggatgatctcgggtggaatgacgtcggcttccacggctcgcgaatccggaccccccatctggatgcacttgcagcaggaggtgtcctgcttgataactactacacccaacctctgtgtactcctagtagatcccagcttctgactggcaggtaccaaatcagaaccggactgcaacaccaaatcatttggccctgtcagccgtcatgtgtgcctcttgacgagaaattgctgcctcaacttcttaaagaagccggctacactacgcatatggtggggaagtggcatctgggaatgtaccggaaggaatgcctgccgacccgtagaggttttgacacctactttggataccttttggggtcggaggactattactcgcatgaacgatgcaccctcatcgatgcacttaatgtgactagatgcgcacttgattttcgtgatggagaagaagtcgcaactggttacaagaacatgtacagcactaacattttcactaagcgagcaattgcccttattactaaccaccctcctgagaagccgcttttcctgtatcttgcgctgcagtccgtccatgagcctctccaagtgcctgaggagtaccttaaaccttacgactttatacaggacaagaaccgacatcattacgcaggtatggtgagccttatggatgaagcagtggggaatgtgactgcagcgctcaagtcaagcggcctttggaacaacacggtgttcatattctcgacggataatgggggccaaaccctggcaggggggaataactggccgctgagaggtagaaagtggtcgctttgggagggcggagtacggggtgtgggttttgtggcgtcacctttgctgaaacagaagggagtgaaaaaccgcgaacttatccatatttcagattggcttcccacgcttgttaagttggcacgcggccacaccaacgggacgaagccactggacggctttgatgtgtggaaaaccatctcggagggatccccttcgcccagaatagagcttctgcacaatattgaccctaactttgtcgattcatcgccctgtccgagaaacagcatggccccagcgaaggacgatagctcacttcctgaatactctgccttcaataccagcgtgcatgcagcaattaggcacggcaattggaagctgcttacgggttacccaggatgtggctactggttcccacctccttcgcaatacaacgtgtcagagattccaagcagcgatccgcctactaagaccctgtggctttttgatatcgaccgggacccagaagaacgccatgatctgtccagagaatacccacatattgtgactaagctcctttcgcggcttcagttttaccataagcattcagttccagtctacttccctgcacaggatccccgttgtgatccaaaggctaccggtgtgtggggaccctggatg

SEQ ID NO: 7126 - DNA, 1599 bp, Artificial Sequence
  Description of Artificial Sequence: Synthetic coding sequence
atgggaccaaggggggcagcgtccctgccacgggggccggggccccgcagattactgctgcctgtggtgctacccctgctgctacttctgctgctggccccaccgggcagcggcgccggcgcaagtagacctccccacctagtgtttctgctagcagatgatctggggtggaacgacgtgggcttccacggctccagaatacgaaccccccacctggacgccctggctgcgggcggtgtgctcctagataactactacactcagcctctgtgcacaccttcccgaagccagctgctaacaggaagatatcagatacggaccgggctgcagcatcagatcatctggccttgccagccttcatgtgtacccttggacgagaaactcctgccgcagttgctgaaggaagcagggtacactacccacatggtaggaaagtggcacttggggatgtacaggaaggagtgcctgcctacaagacgggggtttgacacatatttcggctatttgttgggctctgaggactactattctcacgagcgctgcaccctcatcgacgccctgaacgtgaccagatgcgcccttgacttccgcgatggcgaagaagtggccacagggtataagaatatgtactccaccaatattttcacaaagcgggctatcgctctcattactaatcatccacctgaaaagccgctgtttctgtacctcgctctccagagcgtccatgagccactccaagtgcctgaagagtacctgaaaccatacgactttatacaggacaagaaccggcaccattacgcagggatggtttccctcatggacgaagccgtgggaaatgtgactgctgccttgaagtctagcggtctttggaacaacactgtcttcatcttctccacagataacggaggccaaaccctagctggaggtaacaactggcccctaagagggcgcaagtggtcattatgggaaggtggcgtgagaggagtcggttttgttgcaagccccctattaaaacagaaaggggtcaaaaatcgagaactgatccatatatcagattggcttcctaccctcgtcaaacttgcaagaggacatactaatggtacaaagccactggatggattcgacgtgtggaagacaatatctgagggctcaccctcaccaagaatcgagctgctccacaatattgatccaaacttcgtggatagttccccgtgcccacgtaattccatggcacctgccaaggacgatagtagtctcccagaatactccgcttttaacacctcggttcatgccgccatccggcatggaaattggaaacttctcaccggctaccccggatgtggctattggttcccaccccctagccagtacaacgtcagcgagattccttccagcgatcccccaacgaaaacactctggctcttcgacatcgatagagaccctgaggagaggcatgacctgagccgcgagtatcctcatatcgtaaccaagctgctcagtagactgcagttttaccacaaacactcagtgccagtatacttcccagctcaggatccccggtgcgaccccaaggccacgggtgtttggggtccatggatg

SEQ ID NO: 7127 - DNA, 1599 bp, Artificial Sequence
  Description of Artificial Sequence: Synthetic coding sequence
atgggtccaaggggggccgcctcactgccgaggggcccaggccccagacgcctgctgctccctgtagtgctcccacttctgctgctgttactgctggcaccacccggctctggagccggtgcctcacgccctcctcacttggtgtttttgttggccgatgacttaggatggaacgacgtcgggtttcacggctcacggattaggaccccacacttggatgcactggctgcaggcggcgtgctgttagacaactattacacccagccgctttgcactcctagtcgctcacagctactgactgggcggtatcagattcggaccggtttacagcaccagattatctggccatgccagcctagctgtgttcctctggacgagaaactcctgccccaactgctcaaggaagctgggtacaccacacatatggttggaaagtggcatctcggtatgtaccgtaaagagtgtttgcccacacggcgagggttcgatacttacttcggatacctattgggctctgaggactattactcacacgagcgttgcaccctcatcgatgctttgaacgttactagatgtgccctcgacttccgggatggtgaggaggtcgccacaggctacaagaacatgtattcaaccaacatcttcaccaaaagagctatcgctttgattacaaaccacccccccgaaaagcccctgttcctttatttggctctgcagtctgtgcatgagccgctgcaggtgcctgaggaatatctgaagccttacgacttcatccaggacaagaataggcatcactacgcgggtatggtgtccctgatggacgaggcagtgggaaatgtgaccgcggcgctgaagtcaagtggcctttggaataatacggtgttcatcttcagcacagataacggtggccaaaccctggccgggggcaacaattggcccctcaggggacgcaagtggtccttatgggaggggggcgtgaggggggtgggctttgtggcctcccccctgcttaaacagaagggcgtcaagaaccgggagcttatacacatcagtgactggctcccaacattggtgaagttggcacgtggtcacacgaatggaactaaacccttggatggcttcgacgtgtggaaaacgatctccgagggaagtcccagtcccaggatcgagctgctccataatatcgaccccaactttgtagatagttccccgtgcccccgcaatagtatggcccccgctaaggatgattcatcactaccagagtactccgctttcaacaccagcgtccacgcggccatcaggcacggaaattggaaattgctgactggctatcccgggtgtggctactggtttccacctccatcacagtataatgtcagcgaaataccaagctccgatcctcccacaaagacactctggttgttcgatatcgacagggatccagaggaacggcatgacttaagtcgagagtatcctcacattgtcaccaaattgctttcccgccttcagttctatcataagcacagcgtgcccgtgtatttcccggctcaggatcctaggtgcgatccaaaagccacaggcgtatggggcccatggatg

SEQ ID NO: 7128 - DNA, 1599 bp, Artificial Sequence
  Description of Artificial Sequence: Synthetic coding sequence
atgggtccccgcggggccgcaagcctccctcggggtcctggccctagacgtctgctgcttcctgtcgtgctgccactgctgctcctgctgctccttgcacccccaggaagcggtgcaggggcatccaggccgccccatttggtctttttgctggcagatgatctgggttggaacgatgtcggattccacgggtcccgcattcggaccccccatcttgatgcacttgcggccggaggcgtgcttctggacaattactacacccagccactgtgtactccctcgagaagccagcttctcacgggtcgataccagatccgaaccggtttgcagcatcagatcatctggccatgtcagccttcatgcgtgcctctggacgaaaagctgcttccccaacttcttaaagaggccggctacactactcatatggtcggtaagtggcatcttggcatgtaccgtaaagagtgccttccaactcgccggggctttgatacttacttcgggtaccttctcggttcagaggactactactcccatgagcgttgcactctgattgatgcacttaatgtcacccgttgtgccctggatttccgggatggtgaagaggtggccaccggatacaaaaacatgtattcgaccaacatcttcactaagcgcgcaattgccctgattactaatcacccaccagaaaagccactgtttctctacttggccctccaatcagtccatgaaccactgcaggttccggaagaatatcttaagccttacgactttatacaggataagaatagacatcactatgcaggaatggtgagcctgatggatgaagcagtcgggaatgtcaccgccgcattgaagagctcggggctctggaataacactgttttcattttcagtacggataacggaggacaaacgctggcaggcggaaacaactggcccctgcgcggccgtaagtggagcctgtgggagggaggcgtgcggggagtgggattcgtggcgtccccactgctgaagcagaagggagtgaagaaccgcgagctgattcacatttcggattggctgcccactctcgtcaagctcgcaaggggtcacaccaacggtaccaagccgctggatggatttgatgtgtggaaaaccataagcgagggaagcccttcgccccggatagaactgcttcataacattgatccaaactttgtggactcttccccctgtcctcgcaactccatggcccctgccaaggacgatagctccttgcctgaatactcagcctttaacacctccgtccatgccgcgatccggcatggtaactggaagctgcttaccggatacccaggttgtgggtactggttcccgccaccatcgcagtacaatgtgtcagaaattcctagctcagatcctccgaccaaaacgctgtggctctttgatattgacagggatccggaagagcgacatgacctgtccagggaataccctcatattgtcacgaaactcctctcacgcctccaattctatcacaaacactcggttccggtctacttccctgcacaagatcctagatgtgatccaaaagccactggagtctggggaccttggatg

SEQ ID NO: 7129 - DNA, 1599 bp, Artificial Sequence
  Description of Artificial Sequence: Synthetic coding sequence
atgggacctagaggagcagcctcactgccccgcggaccggggccacgcagattgctgctcccagtcgtcctgccattgctccttttgttgctgctggctcctccgggatccggtgccggagctagccgaccgcctcatttggtgttcctgctggccgacgatctcggatggaatgacgtggggttccacggaagcagaatcagaacgccgcacctggacgccctggccgccggaggggtgctgctggacaactactacacccaacctctgtgcaccccctctcgatcccaactcctgaccggccggtaccaaatccggactggactccagcaccaaatcatctggccgtgtcaaccgtcttgtgtgccactggacgaaaagctgttgccccagctgctgaaggaagctgggtacactactcacatggttggaaagtggcacctgggaatgtacagaaaggagtgcctgccgacccggagggggtttgatacctactttggatatcttctggggagcgaggactattactcgcatgaacggtgcaccctgatcgatgcgctgaacgtgacccgatgcgcacttgacttcagagatggagaggaagtggcgactggatacaagaatatgtactcaaccaacatctttactaagcgggctatcgccttgatcaccaaccatccgcccgaaaagccgctcttcctgtacctggccctccaaagcgtgcacgaaccgctgcaggtgccggaggagtacctgaagccgtacgacttcatccaggacaagaaccgccatcactacgccgggatggttagcctgatggacgaagccgtcggcaacgtgaccgccgccctgaagtcgtccggactctggaataacaccgtctttatcttttcaactgacaatgggggacaaacccttgctggcggcaataactggcctctcaggggccggaagtggtcgctctgggagggtggagtacgcggggtgggattcgtggcgtccccgttgctcaaacagaagggcgttaagaaccgcgaactcatccacatctcggattggctgccgaccctggtgaagctggcacgcggccacactaatggaaccaagcccttggacggattcgacgtgtggaaaactatttcggagggatcgccatctccacgcattgagttgctccataacatagacccgaacttcgtggacagctcgccatgtccgcgcaattcgatggcgccagccaaagatgactcctcactccccgagtactccgcgttcaatacttcagtgcacgccgcgatccgccatggcaactggaaactgttgaccggctacccaggatgcggttactggttcccgccgccctcccagtataatgtgtcggaaatcccatcgtccgatccaccgaccaagacgttgtggctcttcgatatcgaccgcgaccctgaggaaagacacgacttgtcccgcgaatacccgcacattgtgacgaagctcctctcccgcctgcaattctatcacaagcactccgtgccggtgtacttcccagcccaggatccgagatgcgatcctaaggcgacgggagtgtgggggccatggatg

SEQ ID NO: 7130 - DNA, 1599 bp, Artificial Sequence
  Description of Artificial Sequence: Synthetic coding sequence
atgggcccacggggggctgcctctctgccccgaggacctgggcccagacggctcctgttgccagtggtgttgcctctactgctcctcttactgttggcccctcccggatctggggctggggcctcccgaccccctcatctcgtgtttttgctggctgatgacttgggttggaacgacgtaggctttcatggaagccgaattcgaacacctcacttggacgcattggcagctggaggcgttttgctggataattattacacacagcctctttgcactccctccaggtcacagctcctcaccggacgatatcagatcaggaccggcctgcaacatcagatcatatggccttgccagccatcctgtgtcccgcttgatgagaagctgctgccgcagcttctgaaggaagctggatatactacacacatggtagggaaatggcatctcggaatgtatcgcaaagagtgtcttccgactagacggggtttcgacacttactttggatatcttctgggatcggaggattattacagtcatgagcggtgtacccttattgacgcactgaatgttactagatgcgccctggactttcgggacggcgaagaggttgccaccggctacaaaaacatgtactctacaaatatcttcacaaagcgcgccattgcgttaatcacgaaccacccacccgagaagcccctcttcttatatctggccctgcagtccgttcatgaacctcttcaggtgcccgaggaatacctgaaaccctatgactttattcaggataagaaccggcaccattatgccgggatggtgtccctgatggacgaagcagtggggaacgtgacagccgccctgaagtcctcaggcctgtggaacaacacagtatttatcttttctactgataacggcggacagacactggctggaggcaacaattggccactcagggggcgcaaatggtccctgtgggagggcggcgtgagaggtgtaggctttgttgccagccccctccttaagcagaaaggggtcaaaaatcgggaactcattcacatcagcgactggctgccaacacttgttaaactggccagaggccatacgaacggcacaaaaccgcttgatggattcgatgtctggaagacaatctccgagggctcaccgtcaccacggatcgaactcctccataatattgaccccaatttcgtggattccagcccttgcccgcgcaacagcatggctccagccaaagacgactccagcctgcccgaatattcagcttttaatacctccgttcacgccgccataagacatggtaactggaagctcctgaccggctaccctggctgtgggtattggtttccccccccttctcaatacaatgtgtctgagatcccttcctcagacccacctacaaagacactgtggttgttcgacattgatcgagacccagaggagcgtcacgacctgtctcgggagtatccgcatattgttacaaagttgctctctcgtctccaattttaccacaagcactcagtgcccgtctattttccggcccaagaccctaggtgtgatcccaaggccaccggcgtgtggggcccctggatg

SEQ ID NO: 7131 - DNA, 1599 bp, Artificial Sequence
  Description of Artificial Sequence: Synthetic coding sequence
atgggcccaaggggagccgctagccttccaagaggtcctggacctagacgcctgctcctgcctgtcgtgttgccattgctgcttctgctcctcctggcccctccgggctccggagccggggccagccggccaccacacctcgtattcctgttggcggatgacctgggatggaatgatgtgggctttcacggaagcagaatcagaacccctcatctggacgccctcgcggcagggggcgttttgcttgataactattacacccaaccactgtgcactccgagccggtcccagctcctgacagggcgctaccagatcaggaccggcctgcaacatcagatcatctggccttgtcaaccatcctgcgtgcctctcgatgaaaaactgctcccacagcttttgaaggaggccggatataccacgcacatggtgggaaagtggcacctgggcatgtatcgaaaagagtgtttgcccactagaagaggttttgatacctattttggctatcttttgggcagcgaagactattattctcatgaacggtgcactttgattgatgccctcaatgtcactagatgcgctctcgactttcgcgacggtgaggaggtggcaacgggttacaaaaacatgtactcaacaaacatctttactaagagggcgatagctctcattactaaccacccacccgagaaacctctgtttttgtacctcgctttgcagtctgtgcacgaaccattgcaggttccagaggagtacctcaaaccttacgacttcatccaggataagaacaggcaccattatgcaggcatggtgtctctgatggatgaggctgtaggcaatgttactgcagcactgaagagttctggcctctggaacaatacagtgttcatattttccactgataatggcggccaaaccttagcgggaggcaacaactggccactgagaggccgaaaatggtccctttgggaggggggtgtgagaggagtgggattcgttgcgagccctttgctgaagcaaaaaggtgtcaagaacagagagcttattcatatcagcgactggttgccaacactggtgaagttggctagaggacacacaaacggaaccaaaccgctggatggcttcgacgtttggaaaaccatcagcgagggcagtcccagccctcgcattgagcttctgcataatatcgatcccaactttgtggatagttcgccctgtccccgtaacagcatggctccggccaaggatgactccagcctgcccgagtacagtgcttttaacacctccgtgcatgcagccataaggcatggaaactggaagctcttgacaggttatcctggctgcgggtattggttcccccctccgtctcagtacaacgtatcagaaataccgtctagtgaccctcccacaaagactctgtggttatttgatatcgatcgcgatcccgaggaacgacacgatttgtcgagagaatatccacacatcgtgaccaaattgctgtcacgtctgcaattttatcataaacattccgttccagtttactttcccgcccaagacccacgttgcgaccctaaggctacaggagtatggggaccctggatg

SEQ ID NO: 7132 - DNA, 1599 bp, Artificial Sequence
  Description of Artificial Sequence: Synthetic coding sequence
atgggaccaagaggagccgcttctctccccagaggccctgggccaaggaggctccttctgcctgtggtcctgccattgctccttttgttgctccttgccccccccggcagtggggcgggagccagcagaccccctcatcttgtattcctgctcgccgacgatctggggtggaatgatgtgggcttccatggaagtagaataagaaccccccacctggacgctctagccgctggcggtgtgttgcttgataattactacacacaaccactatgtaccccctccaggtcccagctgcttactgggcgatatcagatacgtactggcctgcagcatcagatcatttggccttgccagccttcttgcgtaccactggacgagaaactgttgccacaacttttaaaggaagctgggtacaccacccacatggtcgggaagtggcatctgggtatgtatcgaaaagaatgtttgcctactcgaagagggtttgatacgtatttcgggtacttactcggatccgaggactactactcacatgagcggtgtacgcttatcgacgcactcaacgtgactaggtgcgctttagattttcgtgacggtgaggaggtcgcaaccggttacaaaaacatgtatagcacgaatatcttcacgaagcgggcgatcgctttgatcacaaaccacccccctgagaagccgctttttctgtacctggctttgcagagcgtgcacgagcccctccaggtgccagaagagtatcttaagccttacgattttatccaggacaagaataggcaccactatgcaggaatggtgtccttgatggatgaggccgtggggaacgttaccgctgccctcaaaagctccggattatggaacaatacagtcttcattttttctacagataacggaggccaaacactcgccggtggcaataattggcctctgagagggcggaaatggtcattatgggagggaggtgtccgtggcgttggatttgtcgcctctccgctgctcaagcagaagggtgtgaagaatcgggagctaatccatatttcagactggttacccacgctggttaagctggctcgtggccataccaacgggaccaagccactagacggctttgatgtttggaagacaatctcagaaggctctcccagccctagaatcgagctcctgcataacatcgatcccaactttgtggactcatcaccctgtccccgcaatagcatggcgccagctaaagacgacagttctctgccagaatacagtgcctttaacacatctgtgcatgctgccatcagacatggcaattggaaactgctcactggctatccaggctgcggctattggtttccgccaccctcccagtataacgtgtctgagattccctcatcagatcctcccactaagacattgtggctgttcgacatcgaccgagacccagaggagcgacatgacctcagtagggaatatcctcacatcgtgacgaaactcttgagcaggttgcagttctatcataaacatagcgtgcctgtgtacttccctgcccaggacccccgatgcgatcctaaggctacaggagtgtgggggccttggatg

SEQ ID NO: 7133 - DNA, 1599 bp, Artificial Sequence
  Description of Artificial Sequence: Synthetic coding sequence
atgggcccgcgcggcgcggcctcgctgccacggggacccggacctcgccgactcttgctcccagtggtgctgcctctccttttgctgctcctcttggcgccgccaggctcaggagccggcgcctcccgcccgccgcacctggtgttcctccttgccgacgatctgggctggaacgacgtcggctttcacggatcgcggatccgcactcctcacctcgacgctttggcggctggaggagtgctgctggacaactactatacccagcctctgtgtacgccctcacggtcccagcttttgaccggtcgctatcagatccggaccggattgcagcatcagattatttggccgtgccaaccaagctgcgtcccgctggacgagaagctgctgccgcagcttctgaaagaagccggatacaccacccacatggttgggaagtggcatttgggtatgtacagaaaggaatgcctgccgactagacggggatttgatacctacttcgggtatctcctggggtccgaggactactactcccatgagcgctgcacccttatcgatgctctgaacgtcaccagatgcgccctcgatttccgcgatggagaggaggtggccaccgggtacaagaacatgtactccactaatatcttcactaagcgcgctatcgcgctgattaccaaccatccaccggagaagccgctcttcttgtaccttgcactgcaatcagtgcacgagccgctccaagtgccagaagaatacctgaagccatacgacttcatccaggataagaataggcatcattacgcaggaatggtgagcctcatggacgaggccgtgggtaatgtgacggcagcactcaagagcagcgggctttggaacaacacggtgttcatcttcagcactgacaacggtgggcagaccctcgcaggaggaaacaattggcctctgcgcggacggaaatggtcactgtgggaaggaggagtgcggggtgtgggattcgtcgcttcgccgctcctgaagcagaagggagtgaagaaccgggagctgatccatatctcggactggctgccgaccctcgtgaaacttgcgagaggccataccaacggcactaaacctctggacggattcgatgtctggaagaccatctcggaagggtccccatcaccccgcatcgagcttttgcataacatcgacccgaacttcgtggactcatccccgtgtcctcggaactccatggcccctgctaaggacgatagctccctgccagagtacagtgccttcaacacctcggtgcacgctgctatccggcatggcaattggaagctcctgaccggttatcctggctgcggatactggttcccaccgccatcacagtacaacgtgtcagaaatcccgtcgtccgatcctcctactaaaacgctttggctcttcgacatcgaccgcgacccggaagaacggcacgatctgtcgcgggaatacccgcatatcgtgaccaagctgctgtctcgcctccagttttaccataagcactccgtgccggtctacttcccggcgcaagacccgcggtgcgatccaaaagcaactggagtgtggggaccctggatg

SEQ ID NO: 7134 - DNA, 1599 bp, Artificial Sequence; identical to SEQ ID NO: 7110
  Description of Artificial Sequence: Synthetic coding sequence

SEQ ID NO: 7135 - DNA, 1599 bp, Artificial Sequence
  Description of Artificial Sequence: Synthetic coding sequence
atggggcctaggggggcggccagcctcccgcgcgggcctggaccacgcaggctgttgctcccagtagtgttgccactgcttttgttgttgttgctggcacccccagggtcaggggctggggcgagtcgcccgccccacctcgtgtttctcctcgcggacgatctagggtggaacgatgtggggtttcacgggagtaggatcaggaccccgcacttggacgctctggcagcaggtggagtccttctggacaattattacacacaacctctctgcaccccatcacgctcccaactgctgaccggtcgctaccagatccgcacgggcttgcagcaccagatcatttggccttgtcagccatcttgcgtgccactcgacgaaaagcttctcccccagttgctgaaggaagccgggtacactacgcatatggtgggaaaatggcacctgggtatgtacaggaaagaatgtttgcctacccgaagaggcttcgacacttactttggctacttattaggaagtgaagactactatagccacgaaagatgcactttgattgacgccctgaatgttacacggtgcgcactggatttccgcgacggagaggaggtcgcaacaggctataagaatatgtactctaccaacatctttacaaaacgcgcaattgcactcatcacaaaccaccctccggagaagcctctgttcctttatctggcacttcagtccgtccatgagccactccaggtgccagaagaatatctgaagccgtacgacttcatccaggataagaatcgacaccactacgctggtatggtctcgctcatggacgaagccgtcggaaacgtgacagccgctttgaaaagttcagggctgtggaataacacggtttttatcttttctaccgataatggaggccagacactcgctggtggcaacaattggcccctcagaggacgcaaatggagcctgtgggaaggcggtgttaggggcgttggtttcgtggcctcccccctgcttaagcaaaaaggggtgaagaatcgtgagctgattcatataagtgattggcttcccacactagttaaactggccagggggcataccaacgggactaagccacttgatggctttgatgtgtggaaaaccattagcgagggctccccgtccccgaggatagagctccttcacaatatagatcctaacttcgtggactcctccccatgccctcgcaatagtatggctcccgccaaggacgattcctctctgcccgagtattccgccttcaatacctcagttcacgccgcgatccgccatgggaattggaagttgctcaccggctaccccggctgtgggtactggttcccaccaccatcacagtataatgtgtccgagatcccttccagtgatccacctactaagaccctgtggctgttcgatatcgaccgggatccagaggagcggcacgatctttctagagaatatcctcacatcgtgaccaagctcttgtctcgtctccagttctaccacaagcacagtgttcctgtgtacttcccggcccaagatcctaggtgtgatccaaaggcgacaggcgtgtggggcccgtggatg

SEQ ID NO: 7136 - DNA, 1599 bp, Artificial Sequence
  Description of Artificial Sequence: Synthetic coding sequence
atgggccctcgtggggctgcctctcttcctcgaggaccgggccccaggcgcttgctgctgcctgtggttctgcctctgctgcttctcctccttttagcaccacccggctccggagctggtgcctccaggccaccacatctggtttttttattggcagacgatctaggctggaacgacgtcggctttcacggcagtaggatacgaaccccacatctcgacgccttagctgctggtggagtgctgctggacaactactatactcagcccctctgcacacccagccgatctcaattgctcacaggccgttatcagataaggaccggcctgcagcaccagattatatggccctgccagccctcctgtgtcccacttgatgagaagttactgccccagctcctgaaggaggctggatatactactcacatggtgggcaagtggcatctaggcatgtatcggaaggagtgcctgccaacgcgccgagggttcgatacatacttcggttaccttcttgggtccgaggactattattctcacgagcgatgcactctgattgatgccttgaatgtcacacgatgcgcgcttgacttccgggacggcgaggaggttgccaccgggtacaagaatatgtattccaccaacatctttacgaaaagagcaatcgcccttatcaccaaccatccgcctgagaaacccctattcctttacctggccttacagtcagtgcatgaaccacttcaagtacccgaagagtatctgaagccttacgactttatacaggacaaaaaccgacatcactatgcaggtatggtcagtctgatggatgaggcagtggggaatgtgacagccgctcttaagtccagcgggctctggaataatacggtgttcatattctctaccgacaacggaggccagaccctcgccgggggcaacaactggccccttcgcggcagaaagtggtctctgtgggaggggggggtgcggggtgtcggattcgtcgcgtcccctctccttaaacaaaaaggcgttaagaatcgggaactcattcacatctccgactggctcccgactctggtgaaactggcccggggccatacaaatgggaccaagccgctcgacgggttcgacgtatggaaaaccatctctgaggggagtcctagtccacggattgaattactgcataacattgatcccaactttgtagatagcagtccttgcccaagaaactccatggcccccgccaaagatgatagttcgctacctgagtacagtgcattcaacacttccgttcatgccgccatccgacatgggaattggaaacttttgacagggtacccaggttgcggctattggtttcctccaccatctcagtataacgtttctgagattcccagctcagacccaccaaccaaaacactatggctgttcgacattgacagggatccagaggagcggcatgatctgtctcgcgagtatccccatatcgtgacgaagctgctcagcagattacaattttatcacaagcactcagtcccagtttacttcccagcccaagatccccggtgcgatcccaaagcaaccggcgtctgggggccatggatg

SEQ ID NO: 7137 - DNA, 1599 bp, Artificial Sequence
  Description of Artificial Sequence: Synthetic coding sequence
atgggccctcgaggagcagcgtcacttcctaggggtcctggtccccgacgtctgttgctgcctgtggtgctgccactgctgttgcttttgctgcttgcgcccccgggatcaggggcaggagcatcccggcccccacaccttgtgttccttctcgccgatgaccttggctggaacgatgtgggatttcacggttcgagaattaggactccccacctcgatgcacttgccgcaggaggagtgcttctggacaactattacactcaaccactgtgtacgccaagcagatcccaactccttaccggcagataccagattagaactgggcttcaacatcagattatctggccctgccagccttcgtgcgtgccgctggatgagaagctgctgcctcaactgttgaaggaagcagggtacacgactcatatggtgggaaagtggcatctgggaatgtatagaaaagaatgtctgcctactagacggggcttcgatacgtacttcggataccttctgggaagcgaggattactactcccatgaacggtgtactctgattgatgcactgaatgtgaccagatgcgctcttgattttcgggatggagaagaggtggccactggatacaagaacatgtactcgactaacattttcaccaagagagcaatagccctgattactaaccatccccctgaaaagccgctgtttctgtaccttgccctgcaatccgtgcacgagccgctgcaggtgccagaggagtatctgaaaccttacgacttcatccaggacaaaaaccgtcatcactacgcaggcatggtttcgctgatggatgaagccgtcggaaatgtgactgcagcactgaaaagctcgggcctctggaataacactgtgttcatattctcaaccgataatgggggccaaaccctggcaggaggtaacaattggccacttcgggggaggaagtggtcgctgtgggaagggggtgttagaggagtgggtttcgtggcatcgccattgctgaagcaaaagggcgtgaagaaccgcgagctgatccatatcagcgactggcttccaacgctggtgaagttggccagggggcataccaacggcacgaagcctttggacgggtttgatgtgtggaaaaccatctcggaaggttccccttctcctcggatcgagctgcttcataacatagaccctaactttgtggattcatcaccctgtccaagaaacagcatggcccctgcaaaagatgatagcagcctgccggagtacagcgcgttcaacacctctgtccatgcggccattcgccacggaaactggaagctgcttaccggatacccaggttgtggatactggtttcctccaccttcacaatacaacgtgtcagaaattccatcatcggatccgcctactaagactctctggctttttgatatcgatcgcgacccagaagagcgccatgatctgtcaagagaatacccccatattgtgacgaagctcctctcccggctgcagttctaccacaagcattccgtgcctgtgtactttcctgcacaggatccaagatgtgaccccaaggcaaccggagtgtggggaccatggatg

SEQ ID NO: 7138 - DNA, 939 bp, Artificial Sequence
  Description of Artificial Sequence: Synthetic coding sequence
atgacttcgtgccatatcgctgaggaacatatccaaaaagtggccatcttcggcggaacgcatggaaacgaacttaccggcgtgtttctcgtgaagcactggctggaaaatggagcagaaatccagcgcactggattggaggttaagccattcatcaccaacccacgggccgtgaagaagtgtacccggtacatcgattgcgatctcaataggatctttgacctggagaacctcggaaagaagatgtcagaagatctcccatatgaagtccgccgcgcgcaagaaatcaaccacctgttcgggccgaaggattccgaggattcctacgacatcatcttcgacctgcataataccactagcaacatgggatgtaccctgattctcgaggactcgcggaataacttcctgatccaaatgttccactacattaagacttcgctggccccgttgccgtgctacgtgtacttgattgagcacccctcactcaagtacgcgaccacgagatccatcgccaaatacccggtcggaatcgaagtcggaccgcagcctcagggagtccttcgagcggacatcctggaccagatgaggaagatgatcaagcacgcactggacttcatccatcatttcaatgaaggcaaggaatttccgccttgcgccattgaagtgtacaagatcatagagaaagtggattatccgcgcgatgagaacggggagattgcggcaatcatccacccaaatcttcaggaccaggactggaagccgctgcaccccggcgaccccatgtttctgactctggatggtaaaaccatccctctcgggggtgactgcactgtgtacccagtgttcgtcaacgaggctgcttactacgaaaagaaggaagcattcgccaaaaccaccaaactcactctgaacgccaaaagcatcagatgttgcctgcac

SEQ ID NO: 7139 - DNA, 939 bp, Artificial Sequence
  Description of Artificial Sequence: Synthetic coding sequence
atgacttcgtgtcatattgcggaagagcatattcagaaggtggctatctttggaggaactcacggcaacgagctgactggagtgtttctggtgaagcattggttggaaaacggtgcagaaattcaaagaactgggctggaagtgaagccattcattactaatcctagagcagtgaagaagtgtacccgttacattgattgtgatctcaaccgcatttttgacctcgaaaaccttggaaagaagatgtccgaggatctgccgtacgaagtcagacgggcccaggagattaatcatctgtttggccctaaagactcggaagattcgtacgatatcatttttgatcttcataacaccacctcgaacatggggtgtacccttattctggaggactcgagaaacaacttccttattcagatgttccattacattaagacctcactggcgcctttgccatgctacgtctatctcatcgaacatccaagcctgaaatatgcaaccactagatcgatagcaaaataccctgtgggtatagaagtgggacctcaaccacaaggagtgttgcgggccgatatcctggatcaaatgagaaagatgattaagcacgcactggatttcatacaccactttaatgagggaaaagaatttcccccttgtgcgatcgaagtgtacaaaatcatcgaaaaagtcgattaccctagggatgagaacggggaaattgccgcaataatccatccaaatctgcaagatcaggattggaaacccctgcacccaggcgatcccatgtttcttacccttgatggtaagacgattcctctgggaggagattgtaccgtgtaccccgtgttcgtgaatgaggcggcctactacgaaaagaaggaggcatttgcaaaaaccactaagctgaccctgaacgcaaagtccatccgttgctgtctccat

SEQ ID NO: 7140 - DNA, 939 bp, Artificial Sequence
  Description of Artificial Sequence: Synthetic coding sequence
atgactagctgccacatcgccgaagaacacattcagaaggtggccatcttcggaggtacgcacggcaacgaactcactggcgtgttccttgtgaagcactggttggaaaacggtgcggagatccagcggaccggcctcgaggtcaaaccgtttatcaccaacccacgcgccgtgaaaaagtgtactcgctacatcgactgcgacctgaatagaatctttgacctggaaaatcttggaaagaaaatgtcggaggacttgccgtacgaggtccgccgggcccaggaaatcaaccacttgttcggcccgaaggactccgaagattcgtacgacatcatattcgacctgcataataccacttcgaacatgggatgcactcttatccttgaggactcccgcaataactttctcatccaaatgttccactacatcaagaccagcctggccccgctgccatgctacgtgtatctgatcgagcatccgtccctcaagtacgccactacccggtcaatcgcaaagtacccggtgggaatcgaggtgggcccgcagccacagggagtgctgcgcgcagacatcctggaccagatgagaaaaatgattaaacatgcactcgactttatccaccatttcaacgaaggaaaggagttccccccatgcgccattgaggtgtataagatcatcgagaaggtggattaccctagagacgaaaatggcgaaatcgcagctatcatccacccgaatctgcaggatcaggattggaaacctctccaccctggtgatcctatgttcctgacgctcgacggaaagacgatcccccttggaggtgactgtaccgtgtacccggtgttcgtgaatgaagctgcctattatgagaagaaggaggccttcgcaaagaccacgaagctcactctgaatgcaaaatcaattcggtgctgcctgcat

SEQ ID NO: 7141 - DNA, 939 bp, Artificial Sequence
  Description of Artificial Sequence: Synthetic coding sequence
atgacctcctgtcacatagccgaggagcacatacagaaggttgctatcttcggtgggacgcatggtaatgagttaaccggagtgttcctggtgaaacactggctagagaatggagctgagatccaacgaacaggcctggaagttaagccttttatcaccaaccctagggccgtcaagaagtgtaccaggtatatcgactgtgatctgaacaggatttttgatctcgagaatctaggcaagaagatgtccgaagacctaccgtatgaagtcagaagagcccaagaaattaaccatctcttcgggcccaaagacagcgaagattcttacgatatcatttttgacctgcataacacaacttcaaacatgggatgcacactcatcctcgaggattctcggaataacttcttaatccagatgtttcactacataaagacctctttggcaccactcccctgctacgtttaccttattgaacacccctctctgaagtacgccaccacccgaagtatcgctaaataccccgtaggcatcgaggtgggcccacaacctcagggcgtactgagggctgacatcctggaccaaatgaggaagatgattaagcacgccctcgatttcattcatcacttcaatgaggggaaggagttccccccgtgcgcaatagaggtatacaagatcatcgagaaagtggattacccaagggacgagaatggcgaaattgccgctatcatccacccaaacctgcaagaccaagattggaagcccctacaccccggggaccccatgttcctcaccctagatgggaaaacaatcccgttgggcggtgactgtacagtttatcccgtatttgtgaatgaggccgcatattacgaaaagaaagaagcattcgctaagacaacgaagctgactctcaatgccaagtccattaggtgttgtctgcac

SEQ ID NO: 7142 - DNA, 939 bp, Artificial Sequence
  Description of Artificial Sequence: Synthetic coding sequence
atgacttcgtgccatattgctgaagagcatatccagaaagttgctatcttcggaggcactcatggtaacgaactgaccggtgtgttcctcgtcaagcactggctggaaaacggagccgagatacagcgcactggactggaagtgaagcctttcataactaacccaagggcggtgaaaaagtgtacccggtacatcgactgcgacctgaaccggattttcgatcttgagaatctgggcaagaagatgtctgaagatttgccatacgaggtcaggcgtgcccaggagatcaaccacttgttcggccctaaagacagcgaagattcctacgacattatctttgacctccacaataccacctcgaacatgggatgcaccctgattttggaagattcccgcaacaacttcctgatccaaatgttccactatatcaagacctccctcgccccgcttccgtgttacgtgtacctgatcgaacatccgtcactcaaatacgcgactacgaggtcgatcgctaagtacccagtgggtatcgaggtgggaccacaaccacagggagtgctgcgcgcggatatccttgatcagatgcgaaaaatgatcaagcacgcgctcgactttatccatcacttcaatgagggaaaagaattccctccgtgtgccatcgaggtgtacaagatcattgagaaggtcgactacccgcgggacgagaacggggaaattgcagcaatcatccatcctaatctgcaagatcaggactggaagcccctgcacccgggggatccgatgttcctgactctcgacggaaaaaccataccactcgggggcgattgcactgtgtacccggtctttgtcaacgaggccgcatattacgaaaagaaggaagcctttgctaagaccactaagttgacgctgaatgccaagtccattcgctgctgcctgcac

SEQ ID NO: 7143 - DNA, 939 bp, Artificial Sequence
  Description of Artificial Sequence: Synthetic coding sequence
atgacctcatgccacatagccgaggaacatattcagaaggtggcaattttcggtgggactcacggcaatgaactcacgggagtattcttagtgaaacactggctggagaatggcgccgaaatccaacggacgggattggaggttaagccattcataactaacccacgtgcggtgaagaagtgtacacgctatatcgactgtgaccttaaccggatattcgacctggaaaatctcggcaagaagatgagtgaggatctgccttacgaagtgcggcgggctcaggaaattaatcatctgtttggccccaaagacagcgaagattcctacgatattatattcgatctccacaacaccacaagtaacatgggatgtacactgattctagaggacagcagaaataatttcctgattcagatgttccattacatcaaaacatccttagctccgcttccctgctatgtctacttgatcgagcacccctccctcaaatatgcaacaacccgctcaattgccaagtacccagtaggaattgaggtgggtccccaaccccagggggtcctgcgggcagacattctggaccagatgcggaaaatgattaaacatgcactggatttcatccaccacttcaatgagggaaaagagtttcccccttgcgcgatcgaggtttacaagatcattgagaaagtggattacccccgggatgagaatggtgaaattgcggcgatcatccaccccaatctccaggatcaggattggaaacctctccaccccggtgacccaatgttcttaactctggacggaaagactatccccctaggaggcgattgcaccgtctatcccgtgtttgtcaacgaagcggcgtattatgagaagaaagaagcatttgccaagaccaccaaactgaccttgaatgcgaagagcatccgatgttgtttgcac

SEQ ID NO: 7144 - DNA, 939 bp, Artificial Sequence
  Description of Artificial Sequence: Synthetic coding sequence
atgaccagctgtcatattgcggaggaacatattcaaaaggtcgcaattttcggaggaacgcacggaaacgaacttactggtgtgttcctggtcaagcactggttggagaatggagcggagatacagaggacgggtctggaggtgaagccgttcattactaaccctcgagcagttaagaagtgcacgcgctacatcgattgcgatttgaatcggattttcgacctggagaatctgggtaaaaagatgtcagaagatctcccgtacgaagtgcgcagggcacaggagataaaccatctgtttggtcctaaggactcagaggacagctacgatatcatctttgatctgcataataccacctccaacatgggctgtactctcatcttggaggacagcagaaacaatttcctgattcaaatgtttcattacatcaagacctcgctggcgccgcttccatgttacgtgtaccttattgaacacccttcgctcaaatacgcaaccacccgctccatagcgaaataccctgtgggaatagaagtcggaccccaaccccagggagtgcttcgggcagatattctggatcagatgaggaagatgattaaacacgcgctcgactttattcaccatttcaatgaaggcaaagagtttccgccctgcgccattgaagtctacaagatcattgagaaggtggactacccacgcgatgaaaacggagagattgcagcaatcatccatcctaatctgcaagaccaagactggaagcctttgcatcccggtgatcctatgtttcttactttggacggaaagaccatccctctcggaggcgattgtacggtgtatcccgtttttgtgaacgaagcagcatactacgaaaagaaggaagcgtttgccaagactaccaagttgactcttaacgcaaaatcgataagatgttgtctgcat

SEQ ID NO: 7145 - DNA, 939 bp, Artificial Sequence
  Description of Artificial Sequence: Synthetic coding sequence
atgacctcctgccacatcgccgaagaacacattcagaaagtggcaatctttggcggtactcatgggaacgagcttaccggagtttttcttgtgaaacactggctcgaaaatggagcagaaatacaaagaacgggtctggaggtgaagccgttcataacgaatcctagagctgtcaagaagtgcactcggtacatagactgtgatctcaacaggatttttgatctggaaaaccttggaaagaagatgtccgaggacctgccgtacgaggtgcggcgggcccaggagattaatcatctttttggacccaaggacagcgaagattcctacgacatcatctttgatcttcataatactacctcaaacatggggtgcacccttattctggaagattcgcggaacaactttttgattcaaatgttccattacatcaaaactagccttgccccactgccctgttacgtctacttgattgaacatccatcgctgaagtacgccacgacccgctctattgctaaataccctgtcggaattgaggtgggaccccagccacaaggggtgttgagggctgatatacttgaccaaatgcgaaagatgatcaagcacgcactggatttcatacatcacttcaacgaaggaaaggagtttcctccctgtgcgatcgaggtgtataagattattgaaaaggtcgattacccaagagatgaaaacggtgaaattgccgctatcatccacccaaatctgcaagaccaggattggaaaccactgcatcctggcgatccgatgttcttgactcttgatggtaagactattccacttgggggcgactgtaccgtctaccctgtgtttgtcaatgaggctgcgtactatgagaaaaaagaagcgtttgcaaagaccaccaaattgactctgaacgccaagagcatccgctgctgtctgcat

SEQ ID NO: 7146 - DNA, 939 bp, Artificial Sequence
  Description of Artificial Sequence: Synthetic coding sequence
atgaccagctgtcacattgctgaggagcacatccagaaggtggcgatctttggggggacccacgggaatgaacttaccggtgtattcctggttaaacactggctcgagaacggagccgagattcagcggacaggactggaagtcaaacccttcatcacaaacccaagagcagttaagaaatgtactagatatattgattgcgacctcaataggatatttgacctcgaaaacctgggaaagaaaatgtctgaggacctgccctacgaggtgaggcgggcccaggagatcaaccacctcttcggcccaaaggactctgaggattcctacgatatcatctttgacctgcataacacgactagcaacatgggctgcacccttatcctggaggacagcaggaataactttctgatccagatgttccactacataaagacgagcttggccccactcccttgctacgtctatctgatcgagcacccctcattgaagtatgccactacacgcagcatagctaagtatcctgtggggattgaggtgggtccacagccccaaggagtgcttagagctgacatcctggaccagatgcggaagatgatcaagcacgccctcgacttcattcatcactttaacgaaggtaaagagtttcctccctgcgctattgaggtatacaagatcattgaaaaagtggattatccccgggatgagaatggcgagattgctgccatcatccaccccaatctccaggaccaggactggaagcctctgcatccgggagaccccatgtttttgaccctggatggcaaaacgataccgttgggaggggattgtacagtttaccccgtcttcgtgaatgaagctgcttactatgagaaaaaagaggccttcgctaaaactacgaagcttaccctcaatgccaagagcatccggtgttgccttcac

SEQ ID NO: 7147 - DNA, 939 bp, Artificial Sequence
  Description of Artificial Sequence: Synthetic coding sequence
atgaccagttgccacatcgccgaagagcatattcagaaggtggccattttcggaggcactcacggcaacgagttgacaggcgtgttcctggtgaagcattggttggaaaacggggcagaaatccagcgaactgggcttgaagtaaaacccttcatcacaaatcccagagccgtgaagaagtgtacccgctacattgactgcgacctcaaccggatttttgatttagaaaacctcggtaagaagatgtccgaggacctcccatacgaggtgcggcgagcccaggaaatcaaccatttgtttgggcccaaagacagcgaggatagctacgatatcatcttcgatttacataataccacaagcaacatgggctgcactctcattctggaagacagtaggaataatttcctgatccagatgtttcattacattaaaacgtccctcgcacccctcccgtgttatgtctatttaatcgagcatccgagcctgaaatacgcaaccacacgttccatagccaagtaccccgtgggaatagaggttgggccacagcctcagggcgttctgagggcggacatactcgaccaaatgagaaaaatgataaaacatgcattggatttcatccaccactttaacgagggcaaagaatttccaccttgcgctatcgaggtctacaaaataatcgagaaggtcgactatcccagggatgagaatggcgagattgctgctatcatccatcccaatcttcaggaccaggattggaagcctctccatcctggcgaccctatgttcctaacactggacggtaaaacgatcccccttgggggggattgtaccgtgtacccggtctttgtgaacgaagcggcctattatgagaaaaaggaggcctttgcaaaaaccaccaaacttactttgaatgccaagtccattcgttgctgtttgcat

SEQ ID NO: 7148 - DNA, 939 bp, Artificial Sequence
  Description of Artificial Sequence: Synthetic coding sequence
atgacaagctgccacatcgccgaagagcacatacagaaggtggctatattcgggggcactcacggcaacgagctgaccggggtgtttctcgtaaaacactggctggagaacggggccgagattcaaaggacagggctagaagttaagccctttatcaccaatccgagggccgtgaagaagtgcacccgctacattgattgcgatctgaaccggatatttgatctggaaaatctgggaaagaaaatgtcagaagacctaccttatgaagttcgaagagcccaggagattaaccatctcttcggccctaaggattctgaggactcgtatgacatcatcttcgatctgcataacaccacttcaaatatgggctgcaccctgattcttgaagactcccgcaacaatttcctgattcagatgtttcattatattaaaacgtctctggccccattgccctgttacgtctatttgattgagcatccatctctcaagtacgcgactacccgctccatcgcgaagtacccagtgggcatagaggtggggccccagccacagggcgtcctgcgggcagatatactcgaccagatgcgaaagatgatcaagcacgcacttgacttcatccaccactttaatgagggcaaagaattccccccatgcgctatcgaggtatacaagataatcgagaaggtggattatcctcgggacgagaatggcgaaatcgcagctatcatccatcccaatttacaggaccaggattggaagcccctgcaccctggagatcccatgttcctgactctggacgggaaaacgattcccctcgggggtgattgtaccgtatatcctgtgttcgtcaacgaagctgcctactacgagaaaaaggaggcgttcgccaaaaccacaaagctgaccctgaatgccaagagtatccgatgctgcctccac

SEQ ID NO: 7149 - DNA, 939 bp, Artificial Sequence
  Description of Artificial Sequence: Synthetic coding sequence
atgaccagttgtcacatcgctgaagagcacatccaaaaggttgctattttcggcggaacccacgggaacgagctcaccggagtcttcctggttaaacactggctcgaaaacggagctgagatccaaaggacgggtctcgaagtgaaaccttttatcaccaatcctcgcgccgttaagaagtgtactcggtacatcgattgtgatctaaaccgcattttcgacctggagaaccttgggaagaagatgtccgaagacctgccgtacgaagtgcggcgggcccaggagatcaaccatctgttcggacccaaagatagtgaggactcatatgatatcatcttcgatctgcacaataccacctccaatatgggctgcaccttgatactcgaggattcacgcaacaatttcctgatccagatgtttcactacattaagacttccctggcgccactgccttgctatgtctatcttattgaacacccaagcctcaaatatgcgactacgcgcagcatcgcgaaatatccggttggaatcgaagtggggcctcagccacaaggcgttcttagagcagatatcctggaccaaatgaggaaaatgattaaacatgctctggatttcatacaccacttcaatgaggggaaggaatttcccccttgtgcaattgaagtttacaagatcattgagaaggttgattatcctcgcgatgaaaatggagaaattgcagctatcattcatcccaatctgcaggaccaagactggaaaccactacaccctggggatccaatgttccttacccttgatgggaaaaccattccacttgggggagattgtaccgtttaccccgtgtttgtgaatgaggctgcctactatgagaaaaaggaggccttcgccaaaaccaccaagctcactctgaacgcaaagagcatacggtgctgtctccat

SEQ ID NO: 7150 - DNA, 939 bp, Artificial Sequence
  Description of Artificial Sequence: Synthetic coding sequence
atgacctcctgccatattgcggaggaacatattcaaaaggtcgcgatttttggagggacccacggaaacgaactcactggcgtctttcttgtcaaacactggttggagaacggagcagaaattcaacggactggtcttgaggtgaaaccgttcatcactaacccccgtgcggtgaagaagtgtacccggtatatcgattgcgacctgaatcggatttttgatctggagaatctcggaaaaaagatgagcgaggaccttccgtacgaagtgagacgcgcacaagaaatcaaccacttgtttggacctaaagattcggaagatagctacgacatcattttcgaccttcacaacacgacttccaatatgggctgcaccctcatacttgaagattcaagaaacaactttctgattcagatgttccactacattaagacttctctggcaccactgccttgttacgtgtacctgattgaacatccttcgcttaagtacgcaactactaggtcaattgcgaagtaccccgtgggcatcgaagtcggccctcagccacaaggcgtgctccgtgccgatatccttgaccagatgcggaaaatgatcaagcatgcacttgacttcatccatcactttaacgaagggaaggagttccctccatgtgctatagaggtgtacaagataatcgaaaaggtggattaccctcgagacgaaaacggagaaatcgcagcgattatccaccccaacctccaagaccaggattggaagccactccatccaggggatcctatgttcctcaccctggacggaaagaccattccactgggaggagattgtaccgtctacccggtgtttgtgaatgaggcggcctattacgagaagaaggaagcatttgcaaagactactaaattgactctcaatgcaaagtcgatccgatgttgtttgcat

SEQ ID NO: 7151 - DNA, 939 bp, Artificial Sequence
  Description of Artificial Sequence: Synthetic coding sequence
atgactagttgtcacattgctgaagagcacatccagaaggtggctatattcgggggaacgcacgggaacgagctgacgggcgtgttccttgttaaacattggctggagaatggtgccgagatccaacggaccggtctggaggtgaagccctttataacgaatccgcgcgcagtaaagaagtgcacccgatacatagactgcgacctgaatcgcattttcgatctggagaatctcggaaaaaagatgtccgaggatctcccttatgaggtgcggcgagctcaggagatcaatcacttatttggccccaaggactctgaggattcatatgatataatctttgaccttcacaatacaaccagcaacatgggctgtacgttgatactagaagacagcagaaacaattttctgatccagatgtttcactatatcaagaccagcttagcccctcttccatgctacgtgtatcttatagaacacccatccctcaaatacgctaccaccagatccatcgctaagtacccggtgggcatagaggtggggccccaacctcagggtgtgctgcgggccgatatcctggatcagatgagaaaaatgatcaagcatgccctagatttcattcaccattttaatgaaggaaaagaattcccgccgtgcgccatcgaggtctacaagattatcgaaaaggtagattaccctcgcgatgaaaatggcgagattgcagctatcattcaccccaatttgcaggaccaggattggaaaccccttcatcctggcgaccctatgtttctcacactggacggtaagacaatccctctaggaggagattgcaccgtctatcccgtttttgtgaatgaagccgcgtactacgagaaaaaagaagctttcgccaaaaccacgaagttaacactgaacgccaaatctatcagatgctgccttcat

SEQ ID NO: 7152 - DNA, 939 bp, Artificial Sequence
  Description of Artificial Sequence: Synthetic coding sequence
atgacctcttgtcacatagctgaggagcacattcagaaggtcgctatttttggcggcacccacggcaatgagctgactggcgtatttctggtcaagcattggcttgaaaacggcgctgagatccagcgcacaggtctggaagttaagccgtttatcacaaacccgagggctgttaaaaaatgtactaggtacatcgattgcgacctcaacagaattttcgacctcgaaaacttgggcaagaaaatgtccgaggatctgccgtatgaagtaaggagagcccaagagatcaaccacctcttcggacccaaggatagcgaggacagttatgacattatattcgatctgcacaacacgacctccaacatgggctgtactctgatcttggaggactctaggaacaattttttgattcagatgtttcactatatcaaaactagcttggcgcccctgccttgctatgtataccttattgagcatccctccctgaagtatgctactacgagatctatcgcaaaataccccgtgggcatcgaagttggcccgcagcctcagggcgttctgcgcgctgacattcttgatcaaatgagaaaaatgataaagcacgctctggattttatccaccacttcaacgaaggtaaggaattccccccttgcgccattgaggtttataaaattattgaaaaggttgactaccccagggatgagaacggcgaaatcgccgctatcattcatccaaacctgcaggatcaagactggaaaccactgcatcccggcgatccaatgtttctgaccctggatggcaagacgatcccacttggtggcgactgcactgtgtatccagttttcgtcaacgaagcggcttactacgagaagaaggaggcctttgcaaaaactaccaagctgactctcaacgctaagagcatcagatgctgtttgcac

SEQ ID NO: 7153 - DNA, 939 bp, Artificial Sequence
  Description of Artificial Sequence: Synthetic coding sequence
atgacatcgtgccacatcgctgaagagcacatccaaaaagtcgcgatctttgggggaacacacggcaacgaattaaccggggtctttcttgtcaaacactggctcgaaaatggagctgagattcagcggacgggtttagaggttaaaccgttcatcacaaacccgagagccgttaagaagtgtacaagatatatcgattgcgatttaaatagaatttttgatctggaaaatttgggcaaaaagatgtcagaagacctcccgtacgaagtccggcgcgcacaggaaataaatcatctgtttgggccaaaagattctgaggattcttacgatatcatatttgacctgcataacacaacgagtaatatgggatgcactttaattttagaagacagtcgaaataattttctgatccaaatgttccattacatcaaaacatctctcgccccgttaccctgttatgtgtatttaatcgaacatccgagcctgaagtacgcaacaacaagaagcattgccaaatacccagtaggaatcgaagtaggaccgcaaccgcaaggcgtcttaagggccgacattcttgatcagatgagaaaaatgattaaacatgccttagattttattcatcactttaatgaggggaaagaatttccgccgtgcgctattgaagtctataagattattgagaaggtcgactatcccagagacgaaaatggcgaaatagcagctattattcaccctaacctgcaagatcaggattggaaaccgctgcatccaggtgacccgatgtttctgacacttgatggcaagacaatacctcttggaggagattgtacggtgtatcctgtgtttgttaatgaagcagcctattatgaaaaaaaagaagctttcgcaaaaacaacaaagcttactcttaacgcaaaatcaattagatgctgtcttcat

SEQ ID NO: 7154 - DNA, 939 bp, Artificial Sequence
  Description of Artificial Sequence: Synthetic coding sequence
atgacttcgtgccacatcgccgaggagcacattcagaaagtcgccatctttgggggcactcacggcaatgaattgactggagtgtttctggtgaagcattggctcgaaaacggcgctgaaattcagcgcaccggactggaagtgaaaccgttcatcacgaatcctcgcgcggtgaagaagtgcacgcggtacatcgactgtgacctgaacagaattttcgacctcgaaaatcttggcaagaaaatgagcgaggacctgccttacgaggtgcggagagcgcaggaaatcaaccacttgttcggtccgaaggactctgaagattcttatgacatcatctttgatctgcataacaccacctcgaacatgggatgcactctgatcctcgaagatagcagaaacaactttctgatccagatgttccactacatcaaaacttcactcgcaccgctcccgtgttacgtgtatctcatcgaacatccttccctgaagtacgcgacgactagaagcattgccaagtacccggtcggaatcgaggtcggcccgcagccccaaggagtgctgagagcagacattctcgatcagatgcgcaagatgatcaaacacgccctggatttcatccaccatttcaacgaaggaaaggagttcccaccgtgtgctatcgaagtctacaagattatcgagaaagtggattacccccgggatgaaaatggggaaatcgctgccatcatccatccgaatctccaagaccaggattggaagccgctgcacccaggcgacccaatgttcctgaccctggacggcaagacgatcccactcgggggagattgcactgtctacccggtgttcgtcaatgaggccgcgtactacgaaaagaaagaagccttcgccaagaccactaagctgaccctgaatgcgaagtccatccggtgctgcctgcac

SEQ ID NO: 7155 - DNA, 939 bp, Artificial Sequence
  Description of Artificial Sequence: Synthetic coding sequence
atgaccagctgtcatatagccgaagaacatattcagaaggtcgcgatttttggaggcacccacggtaacgaacttactggtgtgttcttggtgaaacactggcttgagaacggtgcagaaatccaacggactggccttgaagtcaagccgtttatcaccaacccacgggccgtgaaaaagtgtacccggtacattgattgtgatctgaacaggattttcgatctcgaaaacctggggaagaaaatgagcgaggatctgccatacgaggtgagaagagcacaggagatcaaccatctctttggtccaaaggacagcgaggactcgtacgatatcatctttgatcttcataatactacttccaacatgggctgtaccctcatccttgaggatagcagaaataactttctgattcagatgtttcactacatcaagacctcccttgcacccctcccgtgttacgtgtaccttatcgagcacccatcactgaagtacgcgaccactcggtcaattgccaaatatcctgtgggaatcgaggtgggcccccagccccaaggtgtgcttcgcgcagacattcttgatcaaatgcggaagatgattaagcatgcgcttgactttatacatcacttcaatgaaggcaaagagtttcccccctgtgcgattgaagtgtacaagatcattgaaaaggtggactacccacgggacgagaatggagaaattgccgcaatcattcatccaaacctccaggatcaagattggaagccactccatcctggtgatccaatgttccttacgctggacggaaagaccatccctcttggaggagattgtaccgtctaccctgtctttgttaatgaagcagcatactacgaaaagaaggaagcatttgcaaagacgactaagctgactttgaatgccaagtccatccggtgctgtctgcat

SEQ ID NO: 7156 - DNA, 939 bp, Artificial Sequence
  Description of Artificial Sequence: Synthetic coding sequence
atgacttcttgtcatattgcagaagaacatatacaaaaagttgcaatttttggaggaacacatggaaatgaactaacaggagtttttcttgttaagcattggcttgaaaatggagcagaaatacaaagaacaggtttagaggtaaagccattcattacaaatccaagagctgttaaaaaatgtacacgatatattgattgtgatcttaatagaatttttgatttagaaaatctagggaagaaaatgtctgaagatttaccatatgaagtaagaagagcacaagaaattaatcatcttttcggtcctaaggatagtgaagattcttatgatataatttttgatttacataatacaactagtaatatgggatgtacattaattttagaagattcacgaaataattttttgattcaaatgtttcattatattaaaacatcacttgctccacttccttgttatgtttatcttattgagcatccatctcttaaatatgcaactactagatcaatagcaaaatatccagttggaatagaagttggaccacaaccacaaggagtattaagagctgatattcttgatcaaatgagaaaaatgataaaacatgcacttgattttattcatcattttaatgaaggaaaggaattcccaccatgtgctattgaagtttataagattattgaaaaagttgattacccaagagacgaaaatggagaaattgctgctattattcatcctaacttacaagaccaagattggaaaccattacatccaggagatccaatgtttttaactttagatggaaagacaattcctcttggtggtgattgtactgtttatccagtattcgttaacgaagcagcatactatgaaaaaaaggaagcattcgcaaaaactacaaagttaactcttaatgcaaaatcaattagatgttgtttacat

SEQ ID NO: 7157 - DNA, 939 bp, Artificial Sequence
  Description of Artificial Sequence: Synthetic coding sequence
atgacttcctgtcacattgcagaggaacatattcagaaagtcgctatttttggggggacccatggtaacgaactgactggcgtgttcttggtgaaacattggctcgaaaatggcgcggagattcagcgcacagggcttgaggttaagccattcataactaaccctcgcgcagtcaagaaatgtacaagatacatcgactgcgacttgaatcgtatctttgacctggagaatctcggaaagaagatgtctgaggatctcccttatgaggtccgccgagcccaggagatcaatcatctcttcggtccgaaggacagcgaagactcttacgacattatctttgacctgcacaacaccacatccaatatggggtgcacactgattttggaggacagtaggaataactttctgatacaaatgtttcactatatcaagacaagtctcgctccattgccctgttatgtctacctcattgagcacccctccctaaagtacgccaccacccgttcaatcgctaaataccctgttggaattgaagtgggcccacaacctcaaggagtgctgcgggcagatatactggatcagatgaggaaaatgatcaagcacgcgctggattttatccaccactttaacgagggcaaagaattccctccatgtgccattgaggtttataagattatagagaaagtggactacccccgagacgagaacggggaaattgcagcgatcattcaccctaacctgcaagatcaagactggaagcccttgcaccccggcgaccccatgtttttgaccctcgatgggaagactataccgctaggaggcgattgtaccgtctaccccgtctttgtgaacgaggccgcctactatgagaagaaagaagcattcgcgaaaaccacaaagctcaccctgaacgcgaagagtatacggtgttgtctgcac

SEQ ID NO: 7158 - DNA, 939 bp, Artificial Sequence
  Description of Artificial Sequence: Synthetic coding sequence
atgacttcctgccatatcgccgaggagcatatccagaaggtggctatattcgggggaactcacgggaacgaactgaccggagtgttccttgtaaaacactggctcgagaacggcgcagagatccagcgcaccggactggaagtcaagccctttatcaccaacccgcgcgctgtgaagaaatgtaccagatatatcgattgtgaccttaacaggatttttgacctggaaaatctgggaaagaagatgtctgaagatttgccgtacgaagtaagacgcgcgcaggaaatcaaccatttgtttggacccaaggactccgaagattcctacgacatcattttcgacctgcacaataccacgagcaacatgggatgcacgctgattctggaagattcgcgcaacaacttcctgattcagatgttccattacatcaagacttcacttgcgcctctcccttgctacgtctatttgatagaacacccgagcttgaaatacgccacgaccaggtcaatcgcaaaataccctgtgggaattgaggtgggaccccagcctcaaggcgtgctcagggcagacatcctggatcaaatgcggaagatgataaagcacgccctggacttcatccaccacttcaacgaaggaaaggagtttccgccgtgtgctattgaagtgtacaaaatcatcgagaaggtcgactaccctcgagacgagaacggtgaaattgctgcaatcatccatccaaatctccaagaccaagactggaagccactgcatccgggcgatccgatgtttcttactctcgatggtaagaccatcccgctcgggggagattgcaccgtttacccggtgttcgtgaatgaggctgcctactacgaaaagaaggaagccttcgccaagactaccaagctgacccttaatgccaagagcatcagatgctgcctgcat

SEQ ID NO: 7159 - DNA, 939 bp, Artificial Sequence
  Description of Artificial Sequence: Synthetic coding sequence
atgactagctgccacatagcggaagagcatatccagaaagttgccattttcggtgggacccacgggaacgagttgaccggagtgttccttgtcaagcactggctcgagaacggggcggagatccagcgcaccggactcgaagtgaagccattcatcactaacccgcgggccgtgaagaaatgcacgcgctacatcgactgcgacttgaatcgcatctttgacttggagaacctgggcaagaaaatgtcggaagatctcccatacgaggtccggcgcgcacaagagatcaatcacctgtttgggcctaaggactcggaagattcatacgatatcatcttcgacctgcataacaccactagcaatatgggctgtactctgattctcgaagattcacgaaataactttctgattcagatgttccactacatcaaaactagcctcgcgccgctcccttgctacgtgtacctcattgagcacccgtcgcttaagtacgcaaccacccgctccatcgcgaagtacccggtgggcatagaagtgggaccgcagccccagggcgtgctgagagcagatatcctggatcaaatgcggaagatgataaagcacgctctggactttatccatcatttcaatgagggaaaagaattccctccgtgtgccattgaagtgtacaagatcatagaaaaggtcgattatccgagagacgagaacggcgaaatcgcagctatcatccatccaaatctgcaagaccaggactggaagcccctgcacccaggcgacccgatgttcctgactctcgacggaaagaccatcccgctcggaggagattgtacggtctacccagtgttcgtgaacgaggccgcctactatgaaaagaaagaggcattcgctaaaactactaaactgaccctgaacgctaagtccatcagatgctgccttcat

SEQ ID NO: 7160 - DNA, 939 bp, Artificial Sequence
  Description of Artificial Sequence: Synthetic coding sequence
atgacgtcgtgccacatcgcggaagagcacattcagaaggtggcgatcttcggcgggactcacgggaacgagctcaccggagtattcctggtgaagcactggctcgaaaacggagccgagatccaaagaaccgggcttgaagtgaagccctttatcaccaacccccgcgccgtcaagaaatgtactcgatacatcgattgcgatctgaacaggatctttgatctcgaaaatctgggcaagaaaatgtctgaagatctgccttatgaggtccgcagggcgcaggaaatcaatcatctgttcggccctaaagacagcgaggactcctatgatatcatcttcgatctccataacactacctcgaatatgggatgcaccctcattctcgaggattcgcggaataacttcctcatccaaatgttccactacataaagacttcactggcaccactcccgtgttacgtgtacctgatcgaacacccgtcgctcaagtacgccaccacgcgcagtatcgccaagtacccggtgggtatcgaagtggggccgcagcctcagggagtcctccgggcagatatcttggaccagatgcgaaagatgatcaagcatgccctggacttcattcatcacttcaatgagggaaaagagttccctccgtgcgctatcgaagtgtacaagattatcgagaaggtggactacccacgcgacgagaacggggaaatcgccgcaatcattcatccgaacctccaggatcaagactggaagcctctccacccgggagatccgatgttcctgactttggacggaaagaccattcctctgggcggagattgcactgtctaccctgtttttgtgaacgaggcggcctactacgaaaagaaggaagcgtttgccaagaccaccaaattgaccctgaacgctaagagcatccggtgctgcctgcat

SEQ ID NO: 7161 - DNA, 939 bp, Artificial Sequence
  Description of Artificial Sequence: Synthetic coding sequence
atgacctcctgtcatatcgccgaagagcatatccaaaaggtcgcgatttttggcgggactcacggcaacgaactgactggagtgtttctcgtcaagcactggctggaaaacggagctgagatccagaggaccggactggaggtcaagccatttatcaccaaccctcgcgccgtaaagaagtgcaccagatatatcgactgcgatttgaaccggatattcgaccttgagaatctcggaaagaagatgagcgaagatctgccgtacgaggtgcggcgcgcccaggagatcaaccacctgttcggcccaaaggactccgaagattcctacgacatcatcttcgacctgcataacaccactagtaatatgggatgcactctcatcctggaagattcacgcaacaatttcttgatccagatgttccactacattaagacctccctcgccccactgccgtgctacgtgtaccttatcgaacacccctcgttgaagtacgcaaccacccgctcgatagccaaatacccagtgggaatcgaagtgggaccgcagccgcaaggcgtgctgcgcgcagacatcctggatcagatgcgcaaaatgatcaaacatgcgctggacttcatccatcacttcaacgaaggtaaggagttccctccttgcgccatcgaagtgtacaaaatcatcgagaaggtggactacccgcgcgacgagaatggcgaaattgctgccatcatccatccaaatctccaggaccaagactggaaacctctgcacccaggtgacccaatgtttctcactttggacgggaaaaccatcccactgggcggagattgcaccgtctatcccgtgtttgtgaacgaagcagcgtactacgagaagaaggaagcctttgcaaaaactacgaaactgactctgaacgcgaagtctattcgctgttgcctgcac

SEQ ID NO: 7162 - DNA, 939 bp, Artificial Sequence
  Description of Artificial Sequence: Synthetic coding sequence
atgacttcgtgccatatcgccgaggaacatatacaaaaggtcgcaatcttcggaggcactcatggaaacgaacttactggtgtattccttgttaagcattggcttgaaaatggggcagaaatccagaggactgggctcgaagtcaagcctttcattaccaatccacgggcggtgaagaaatgtactcggtacatcgactgcgatctgaatcgcatctttgatcttgaaaatctgggaaagaaaatgagcgaagatctgccttacgaagtgagacgagcacaagaaatcaaccatctcttcggacccaaggactccgaggattcatacgatatcattttcgatctccataataccacttccaacatggggtgtacccttatcctcgaagattcaagaaacaatttccttatacaaatgttccactacattaagacgtccttggcccctctgccatgttacgtgtaccttattgaacacccttccctcaaatacgcaaccacccgctcgattgcaaagtacccagtggggattgaggtcgggcctcaaccacagggagtgcttcgtgctgacatactcgaccaaatgagaaaaatgatcaagcatgccctggatttcattcaccactttaatgaaggcaaggaatttccaccgtgcgccattgaagtgtacaagattatcgaaaaggtggactatcctcgggacgagaacggagaaattgcggcaatcattcatcccaaccttcaggaccaagattggaagcctcttcatccaggtgatccaatgttcctcactctggatggaaagaccataccgctgggaggcgattgcactgtgtacccagtttttgtgaacgaggcggcctattacgaaaagaaggaggcatttgcaaagactactaaattgacgcttaacgcgaagtccattaggtgttgcctgcat

SEQ ID NO: 7163 - DNA, 939 bp, Artificial Sequence
  Description of Artificial Sequence: Synthetic coding sequence
atgacctcatgccacatagccgaagaacatattcaaaaggtggcgatttttggaggtacccacggaaacgaactgaccggagttttcctcgtgaagcattggctggagaacggtgcggaaatccaaaggaccggccttgaggtgaagccctttatcacgaaccctagggcagtgaagaagtgtacccgttacatcgactgcgaccttaaccgaatcttcgacctcgagaaccttggtaaaaagatgagtgaggacctcccatatgaggtcaggagagcacaggaaatcaaccatctgtttggtccgaaggatagcgaggatagctacgatatcatattcgatcttcataataccaccagcaacatgggttgtactcttattctggaggatagccgtaacaactttttgattcaaatgttccattacatcaaaacttcacttgcaccactgccttgttacgtgtacctgatcgaacatccatcccttaagtacgcaaccacccggtccatcgcaaaatacccagtgggtattgaagtgggtccacagcctcaaggggtgcttcgggcagatatcctggatcagatgaggaaaatgataaaacatgcactggacttcattcaccacttcaacgaggggaaggaatttcctccttgtgctattgaagtctacaagataatagaaaaagtcgactaccctagagacgaaaacggtgagattgccgcgattatacatccaaacctgcaagaccaagactggaagccacttcaccctggagatcccatgtttctcacccttgacggaaagaccatacctctcggaggagattgtactgtgtaccccgtctttgtgaacgaagcagcttactacgagaagaaagaggcatttgcaaagactactaagctgacgttgaacgcaaagtcgatccgctgttgcctgcat

SEQ ID NO: 7164 - DNA, 939 bp, Artificial Sequence
  Description of Artificial Sequence: Synthetic coding sequence
atgacatcctgccatatcgccgaggagcatatccagaaagttgccatctttggaggtacacacggaaacgaattgactggcgtttttctggtcaaacactggctcgaaaatggagctgagattcaaaggacaggtctggaagtgaaaccgttcatcaccaatccgcgtgccgtaaagaagtgtactcggtatattgactgtgatctcaaccgtatattcgatttagaaaacttggggaagaagatgtctgaggatcttccatatgaagttcgtcgtgcacaagagattaatcatctatttgggccaaaagattcagaagacagttatgacattatatttgatctacataacactactagcaatatgggctgtacattaattcttgaagattcgcgaaacaatttcctgatccagatgttccattacatcaagacctcgcttgccccactcccttgctatgtgtatcttatcgagcatccatcacttaaatatgcaacaacaagatctattgcaaaatatccagtcggaattgaggtgggaccccagccacaaggcgtattacgggcagacattttagaccaaatgagaaaaatgattaaacatgccttggattttattcaccattttaacgaaggtaaagaattcccaccatgcgcgatcgaagtttacaaaataatagagaaagttgactacccacgcgatgaaaatggagaaattgcagctatcattcatccaaatttgcaggatcaagattggaaaccgttgcatccaggtgatcctatgttcttgacgcttgatggaaagaccatcccgttaggaggagattgtacggtttacccggtttttgttaatgaagcagcttattacgagaagaaggaagcgttcgcaaaaacgacaaaacttactcttaatgctaaatccatccgctgctgtcttcat

SEQ ID NO: 7165 - DNA, 939 bp, Artificial Sequence
  Description of Artificial Sequence: Synthetic coding sequence
atgacttcttgtcacatcgccgaagagcatattcagaaggtggccattttcggagggacccacgggaacgaactgacaggcgtcttcctcgtgaagcactggttagaaaatggtgcagaaatccaacgtaccggcctggaagtgaagcccttcatcacaaaccctcgtgctgtcaaaaaatgtactcggtatatcgactgcgacctcaaccggatatttgatctggaaaacctgggaaagaagatgagcgaagatctgccctatgaggtgcgcagggctcaggaaatcaatcacctgttcggaccaaaggatagtgaagatagttacgacataatattcgacctacacaatacaacatcgaacatgggttgtactttaatcctggaggattctaggaataacttcttgatccagatgttccactacataaaaacctctctggcaccgctgccatgctacgtttacttgatagaacatccttcgttgaagtatgccaccacacgatctattgccaaatatccagtgggcatcgaggtcggcccacagccccagggcgtcctgcgcgcagacatacttgaccagatgcggaagatgattaagcatgcactcgactttatccaccacttcaacgaggggaaggaattcccgccctgcgctattgaggtctacaaaattattgagaaagtggactacccgcgggatgaaaatggcgagattgcagcgatcatacacccaaacctccaggatcaggactggaagcccctgcaccccggcgaccccatgttcctgacgctggacggcaaaactatccctctggggggtgactgcacagtgtatcccgtttttgttaacgaggcagcttattacgagaagaaggaggctttcgcgaagaccacgaagcttacactgaatgctaaaagtattcgatgctgtctgcat

SEQ ID NO: 7166 - DNA, 939 bp, Artificial Sequence
  Description of Artificial Sequence: Synthetic coding sequence
atgacctcatgtcatatcgccgaggaacacatccagaaagtggcaatcttcggagggacgcacggaaacgagctgactggtgtgtttctggtcaagcactggttggaaaacggagctgaaatccagcgaactggactggaggtgaagcctttcatcaccaacccgcgcgcggtgaaaaagtgcacccgctatattgattgtgatttgaatcgcatttttgacctggaaaacctgggcaaaaagatgtccgaggatctgccttacgaagtccgccgggcgcaggaaatcaaccatctgttcggcccaaaggacagcgaggactcgtacgacattatcttcgatctccacaataccacctccaatatgggatgcactctgattctggaagattcacggaacaatttcctgatccaaatgttccattacatcaagacctcgttggctccgctgccttgttacgtctacctgatcgaacacccatcgttgaagtacgcgaccactcggagtatcgcaaagtaccccgtgggcattgaagtgggaccacaaccacagggggtgctgagagctgatatcctggaccagatgcgcaagatgatcaagcatgcactggactttatccatcatttcaatgagggtaaggagttccctccgtgtgctattgaagtttacaagatcatcgaaaaagtcgactacccgcgcgacgagaacggggagatcgccgcgatcattcacccgaaccttcaggaccaagattggaagccattgcatcctggagatccgatgtttttgaccttggacggaaagactatcccgctgggcggcgactgcaccgtgtacccagtgtttgtcaacgaagccgcatactacgaaaagaaagaagccttcgcaaagactactaagctcaccctgaacgctaagtcgatcaggtgttgcctgcat

SEQ ID NO: 7167 - DNA, 939 bp, Artificial Sequence
  Description of Artificial Sequence: Synthetic coding sequence
atgacctcctgtcatattgcagaagagcatattcaaaaggtggcaattttcggagggactcatggcaacgagcttaccggagtgttccttgtcaagcattggcttgaaaacggtgcagaaattcagagaactggcctggaagtgaagccattcatcactaacccccgtgcagtgaagaaatgcacgcgctacatagactgtgatctgaaccggatatttgaccttgaaaatctgggtaaaaagatgtccgaggacctgccttacgaagtgaggagggcccaagagataaaccacctttttggccccaaggactcggaggattcgtacgacatcatttttgatctgcacaacactactagcaacatgggatgcactctcatcctcgaagattcgcggaacaactttcttattcaaatgtttcactacataaagaccagcctggcacccctcccgtgctacgtgtacctgattgaacatccttcgctgaagtacgcgactactcggtccattgcgaaataccctgtgggaatcgaagtgggtcctcagccacagggagtcctcagggcagacattcttgatcaaatgaggaaaatgatcaaacatgcgctggactttattcatcactttaacgaaggaaaagagttccccccatgcgcgattgaagtctacaaaatcattgagaaagtggactacccacgggatgagaatggagaaatcgcagcaattatccacccaaaccttcaggaccaagactggaagcctctccacccaggcgaccccatgttccttactctggatgggaaaactatcccacttggtggtgattgtactgtctatccagtctttgttaacgaagccgcctactacgaaaagaaggaggcattcgcaaagactaccaagctcaccctgaatgctaagtcgattagatgttgtttgcat

SEQ ID NO: 7168 - DNA, 939 bp, Artificial Sequence
  Description of Artificial Sequence: Synthetic coding sequence
atgaccagctgtcatatcgctgaagaacatatacaaaaagtagctatcttcggtggcacccacgggaacgagctgactggagtctttctggtgaagcattggctcgaaaacggagcagaaatccagagaactggtctggaagtgaaaccgttcattaccaaccctcgggccgtgaagaagtgtactcgctacattgactgtgatctgaatcgcattttcgacctggaaaatctgggaaagaaaatgagcgaagatctcccttacgaggtgcggagggcccaagagattaatcatctgtttggtcctaaggattcggaggactcgtacgacatcatatttgacctccataacacgacttcaaatatgggttgtaccttgattctggaggattcccggaacaactttctgattcaaatgttccactacattaagacgtccttggcgccacttccctgttacgtctacttgatcgaacacccttctctgaagtacgcgactacccgatcgatcgcaaaatacccagtgggaatcgaagtgggtccccagcctcaaggtgtgcttagagcagatattctcgaccagatgcgaaagatgatcaagcatgcgttggacttcattcatcatttcaacgaaggaaaggaatttcctccttgtgccatagaagtctacaaaatcattgaaaaggtcgattatcctcgagacgaaaacggcgagatcgcggctatcatccatcccaatcttcaggaccaagattggaagcccctgcacccaggagatccaatgtttctgacccttgatggaaagaccatcccattgggaggggattgcaccgtctatccagtgtttgtcaacgaagccgcgtactacgagaagaaggaagcatttgcgaaaaccactaagctgacgctgaacgcaaagtccattcgctgttgccttcat

SEQ ID NO: 7169 - DNA, 939 bp, Artificial Sequence
  Description of Artificial Sequence: Synthetic coding sequence
atgacctcctgtcatatcgccgaggagcatatacaaaaggttgccatttttggaggaacgcacggtaacgagctgacaggagtattcctggtgaagcattggcttgaaaatggggcagaaatacagaggactggactggaggtcaaaccgtttatcaccaacccgcgggccgttaagaaatgtaccagatatattgactgtgacctgaatcggatcttcgaccttgaaaatctggggaagaaaatgagcgaggacctgccatacgaagtgagacgcgcccaggaaattaaccacctgtttgggcccaaggattctgaggactcctatgacatcattttcgatttgcacaacaccacctccaatatggggtgcacccttatcctcgaggacagtcgaaacaatttcctcatccaaatgttccactatatcaagaccagcctggcgcccctgccttgttatgtctacctcatagagcacccaagtctcaagtacgccacaacgcgctccatcgccaagtaccctgtcggaatcgaagtgggtccccagccccaaggtgtccttcgcgctgacattctggaccagatgcgaaaaatgatcaaacacgccctggattttatccaccattttaatgagggtaaagaattcccaccctgcgccattgaagtctacaaaattatcgagaaggtcgattatccgagagatgagaatggagagattgccgctattatccatcccaatcttcaggatcaggactggaaaccgctgcaccccggcgaccctatgttcctcaccctcgatgggaagacgataccccttggcggagattgcacagtgtaccctgttttcgtgaacgaagctgcatattacgagaagaaagaggcattcgctaagacaaccaaactgactctcaacgcaaagtcaattagatgctgccttcat

SEQ ID NO: 7170 - DNA, 939 bp, Artificial Sequence
  Description of Artificial Sequence: Synthetic coding sequence
atgacatcatgtcacattgcggaagaacatatccagaaagtggccatcttcggcgggacacacggaaacgaactgaccggcgtgttcctcgtgaagcactggctggagaacggagctgagattcagagaacaggtctggaggtcaagccctttataacgaaccccagagcagtaaagaagtgtactcgatatatagattgtgacttgaatagaatttttgatctggagaacttagggaaaaaaatgagcgaagatctcccctacgaagtgagacgagcccaagaaatcaatcatctgtttggaccgaaagattccgaggatagttacgatatcatcttcgacttacacaatactacttctaatatgggctgcacactgatcctggaggattctagaaataacttcttgattcaaatgtttcactacattaagacatccctcgcccctctcccttgttacgtctacctgattgagcatccgtcattgaagtacgctactacgagaagtatcgctaaatatcccgtggggattgaagtggggccccagccgcaaggcgtcctgcgggcagatatactggatcagatgagaaagatgattaagcacgctcttgatttcatccaccacttcaacgaaggcaaagaattccccccttgtgccattgaagtgtacaagataatcgagaaggtggactatcctcgagacgaaaacggggaaatcgcagctataatccaccctaatctacaggatcaggactggaaacctctccatcctggagacccaatgttcctgacactggacgggaagactatacctcttggcggcgattgcacagtctaccccgttttcgtgaatgaagcagcgtattacgaaaaaaaagaagccttcgcaaaaacgactaagctgaccctgaacgctaagtctatcagatgctgtctgcat

SEQ ID NO: 7171 - DNA, 939 bp, Artificial Sequence
  Description of Artificial Sequence: Synthetic coding sequence
atgacttcctgccacatcgctgaagaacacattcaaaaagtggccatctttggagggacacatgggaatgaactgaccggagttttcctcgttaagcattggttggagaacggcgcggagatccagaggaccgggctcgaggtcaagccgtttatcacaaatcccagggccgtgaagaagtgtacgcgctacattgactgcgacttgaatcggatctttgacttggaaaatttgggcaaaaagatgtcagaggacttgccctatgaagttcgaagagcccaggaaattaatcatctctttgggccgaaagactccgaggattcatacgacataatattcgatctgcacaacaccacaagtaacatgggctgtaccctaatcctggaggattctagaaataacttccttatacagatgtttcattatatcaagacaagcctggcaccacttccttgctacgtgtatttaatcgaacatccttccctcaagtatgcgaccacacgttctatagctaagtacccggtcgggatcgaagtgggtccacagccacagggagtgctgagagcagatatcttggaccagatgcgaaagatgatcaaacatgcccttgacttcattcatcacttcaacgaggggaaggagttccccccatgcgctattgaagtgtacaagattattgagaaagtggattacccgagagatgagaatggcgagattgcagctattatccatcctaatctgcaagaccaggattggaagccactccaccctggcgaccctatgtttctgactcttgatgggaaaaccatacctctcggcggggattgcacagtctatcccgtctttgtgaacgaagccgcatactatgaaaagaaggaggcctttgcaaaaactaccaagctcaccttgaacgccaagtcgattaggtgttgtttgcac

SEQ ID NO: 7172 - DNA, 939 bp, Artificial Sequence
  Description of Artificial Sequence: Synthetic coding sequence
atgacaagttgtcacattgccgaagagcatattcagaaagtggcgatttttgggggcacgcatgggaacgaactgacgggagtttttttggtcaagcattggttggaaaacggtgcagaaattcagaggactggattggaagtgaaaccattcattaccaacccacgagcggtgaagaaatgtactcggtacatcgattgcgatctgaataggatttttgacctggagaatctcggcaagaagatgagcgaagacctgccatatgaagtgcgacgagcacaggaaataaatcatttgtttggtcccaaggattccgaggactcttacgacattatattcgacctgcacaataccacctcaaacatgggctgcaccctgatactcgaggattctcgaaataacttcttgatccagatgtttcactatatcaagacctctttggctccactaccatgttatgtgtacctgattgagcacccatccctgaaatatgccactacacgttctattgccaagtatcccgtgggcatagaagtgggaccacagccacaaggggtgttacgagctgacatactggatcaaatgcggaaaatgattaagcatgccctggacttcattcaccattttaatgagggcaaggagtttcctccttgtgctattgaagtatacaagattatcgaaaaggtcgattatcccagagatgagaacggcgaaattgctgcaataatccaccctaacctgcaggatcaggattggaagcccctgcacccgggggatcctatgttccttaccctcgatgggaaaacgatcccccttggaggagactgcaccgtttatcctgtatttgtgaacgaggctgcatattatgaaaagaaggaagcctttgcaaagactacaaaactcaccttgaacgccaagtccatccgctgctgtctccac

SEQ ID NO: 7173 - DNA, 939 bp, Artificial Sequence
  Description of Artificial Sequence: Synthetic coding sequence
atgacttcctgtcacattgccgaggagcacatacaaaaggtcgctatcttcggaggaacccatggtaacgagctgacgggggtgtttctcgtgaaacactggctcgaaaacggagcggagattcaacggaccggcctggaagtgaagccattcattactaacccccgggccgtcaagaagtgtactaggtacatcgactgcgacctcaatcgcattttcgacctcgagaacctgggaaagaaaatgagcgaagatctgccgtacgaggtgcgcagggcacaggaaatcaaccatctgtttggaccaaaggactccgaggactcgtacgacatcatcttcgaccttcataataccacctctaatatgggctgtactctgatcctcgaagattcacgcaacaacttccttatccagatgttccactatatcaagacgtcactcgcacccctgccttgctacgtgtacctgatcgagcaccctagcctcaagtacgcgactactcggtccatcgctaaatacccggtgggaatcgaagtgggacctcagccacagggagtgttgcgggcggacatcctggatcagatgcgcaagatgatcaagcacgcgctggactttatccaccactttaacgaaggaaaagagttccccccttgtgccatcgaggtgtacaaaatcattgaaaaggtagattaccccagagacgagaatggcgagatcgcagcaatcatccatccaaatctgcaagaccaggactggaaacccctgcacccgggtgatcccatgttcctgactctggacggcaagactattccgttgggaggcgactgcaccgtgtacccggtgttcgtgaacgaggctgcttactacgagaagaaggaggccttcgccaagactactaaactgactctcaacgccaaatcaatcagatgttgcctgcat

SEQ ID NO: 7174 - DNA, 939 bp, Artificial Sequence
  Description of Artificial Sequence: Synthetic coding sequence
atgacctcctgccacattgctgaggagcatatccagaaggtggccatctttggcgggacacacggtaacgagctgaccggcgtgtttctcgtcaagcattggcttgagaacggcgcagaaatccagagaacaggtctggaagtcaaaccttttatcacaaatccccgagctgttaaaaaatgcaccagatatatcgactgcgatctcaatcggatttttgacctggagaatctcggcaagaaaatgagcgaggaccttccatacgaagtccgccgagcccaagagattaaccatctctttgggccaaaagacagcgaagactcctacgatatcatttttgatctccataacaccacctcaaacatgggctgtactcttatccttgaggattccaggaataactttctgatccaaatgttccattacatcaagacctcactcgcaccacttccttgttacgtttacctcatagaacacccttctctcaagtacgcaacaacaagatctatcgcaaagtaccctgttgggatcgaggtgggacctcagcctcaaggcgtcctgagggctgatatcctcgatcaaatgagaaagatgattaagcacgctctggactttatacatcatttcaacgaagggaaagagtttccgccctgcgctattgaagtgtacaagatcatcgaaaaagtggattacccgcgggatgaaaacggggaaatcgctgccatcatacacccaaacttgcaagaccaagactggaaaccgctgcatccaggtgacccaatgttcctcactttggacggaaaaacgatccccctgggcggcgattgcaccgtttatccagtgtttgttaacgaggccgcctactacgaaaaaaaggaggcattcgctaaaaccacaaagctgacactcaacgctaagtcaatccggtgttgcctgcac

SEQ ID NO: 7175 - DNA, 939 bp, Artificial Sequence
  Description of Artificial Sequence: Synthetic coding sequence
atgacgagctgtcacatcgcggaggaacacattcaaaaggtcgcaattttcggcggcacccacggaaacgaactgactggtgtgttccttgtcaagcattggctcgagaatggagcggagatccagagaactggtcttgaagttaaaccgtttatcactaaccctcgggcagtgaagaaatgcaccaggtatattgattgtgacctgaatcgcatcttcgaccttgagaatcttggaaagaagatgtctgaagatctcccctacgaagtgagacgcgcccaggagattaaccacctctttggacccaaggactcggaggactcgtacgacattatctttgatctgcataacactacctcaaatatggggtgtactcttatcctggaagattcccggaataactttcttatccagatgtttcattacataaagacctccctggccccacttccttgttacgtgtatttgattgaacatcctagccttaagtacgctaccaccagatcaatcgccaagtaccccgttggaattgaggttggtcctcaaccgcaaggagttttgagggcggacattcttgatcaaatgcggaagatgatcaagcatgcactcgatttcattcaccatttcaatgaaggaaaagaattccccccttgtgctatcgaagtgtacaaaatcatcgaaaaagtggactacccgcgggatgagaacggtgaaatcgctgcgattatacatccaaaccttcaagaccaagattggaagccccttcacccaggtgatcccatgttcctgactctggacggaaagacgattcctctgggaggggactgtactgtgtaccctgtgttcgtcaatgaagcagcatattacgagaaaaaggaggcttttgcaaagacgaccaagctgactcttaacgccaagtccattagatgttgccttcac

SEQ ID NO: 7176 - DNA, 939 bp, Artificial Sequence
  Description of Artificial Sequence: Synthetic coding sequence
atgaccagctgccatatcgcagaagaacatatccagaaagtcgcaatctttggaggaacccatggcaacgaacttaccggcgtgtttctggtgaagcactggctggaaaacggagcagagattcagcgtacgggactggaggtcaagcctttcataacgaaccctcgcgccgtgaagaagtgtactcgctatatcgattgtgatcttaaccgcatttttgatctggaaaatctgggaaagaaaatgtcagaagatcttccctacgaagtgagaagagcgcaagagatcaaccatcttttcggcccaaaggattccgaggattcatacgatatcatattcgacctgcacaataccacttctaatatgggatgtaccctcatcctggaggacagccgaaacaactttctgatccagatgtttcactacatcaagacctcacttgcaccgctcccctgttacgtctacctgatcgaacatccatcacttaagtatgccaccacgaggtccatcgcaaagtacccggtgggaattgaagtcgggcctcaacctcagggagtgcttagggcagatattctggatcaaatgagaaagatgattaaacacgccctcgactttatacatcatttcaatgaaggcaaagaatttcccccttgcgccatcgaggtgtacaaaatcatcgaaaaagtggactacccaagagacgaaaatggagagattgcagcgattatccatccaaacctgcaggatcaagattggaaacctcttcacccaggagatccaatgttcctcacgctggatggtaagactattccacttggaggtgattgtactgtgtatccagtctttgtcaatgaggcggcatactacgaaaagaaggaggcatttgccaagaccactaagttgactcttaacgcaaagtccatacgctgctgtctccac

SEQ ID NO: 7177 - DNA, 939 bp, Artificial Sequence
  Description of Artificial Sequence: Synthetic coding sequence
atgacctcctgtcacatcgctgaggaacacatccagaaggtggcgatatttggcggtactcacggcaatgaactgaccggagtgtttctggtaaaacactggctcgagaatggcgccgagatccagagaaccggacttgaagtgaagccgttcatcactaacccgcgcgccgtcaagaagtgcactcgctacatagactgcgatctgaatcgcatctttgacttggaaaacctgggaaagaaaatgtcagaggatctcccctatgaggtgcgacgggcacaagagatcaaccatctgttcggtccgaaagactcggaagattcgtacgatatcatcttcgacctgcacaacaccaccagcaacatgggctgcacccttattctcgaggattccagaaataactttctgatccaaatgttccattacatcaagacttctctggctccgctgccctgctacgtctacctgatagaacatccaagtctcaagtacgctactacccgcagcattgcgaaatacccagtgggaattgaagtgggaccacaaccacagggagtgcttagggcagatatcctcgaccagatgcggaaaatgattaagcacgcgcttgacttcatccatcatttcaatgaagggaaggagttccctccgtgcgccatcgaggtgtataagatcatcgaaaaagtcgattacccgcgggatgagaacggtgaaatcgccgccattattcacccgaatctccaggatcaggactggaaaccactccacccgggggatccgatgttcctcactctggacggaaagactatcccattgggcggagactgcacggtgtaccctgtatttgttaacgaagcagcatactacgaaaagaaggaagcgttcgctaaaacgaccaagctgacgctgaacgcaaagtcaatccggtgttgtttgcac

SEQ ID NO: 7178 - DNA, 939 bp, Artificial Sequence
  Description of Artificial Sequence: Synthetic coding sequence
atgacgagctgccacatagcagaggagcacatccagaaagtcgccatctttggcggtacccatggtaacgagctgaccggtgttttcctggtcaagcactggctcgagaacggcgctgagattcaaagaaccggtctggaggtcaagccttttatcactaatccaagagcagtgaaaaagtgcacaagatacatagactgcgatctgaatcgcatctttgacctggagaacctagggaagaaaatgtccgaagatttgccatatgaggttcgccgcgcccaggagatcaatcatttgttcggtccgaaagattccgaagacagctacgacatcattttcgatctgcataacacgacgagcaacatggggtgtactctgatcctagaggactccaggaacaatttcctgatccagatgttccattacatcaagaccagcctggcgccactgccttgttatgtgtatctgattgagcacccgagtctgaaatatgccacgactcggagtatcgccaagtacccggttggtattgaggttggcccgcaaccgcagggtgtgctgcgtgcggatatcctggaccagatgcgaaaaatgatcaagcatgctcttgatttcattcatcattttaatgaaggtaaagagtttccaccttgtgccatcgaagtctacaagatcatagagaaagtggactatcctcgtgacgaaaatggtgaaattgcggcaattatccatcctaacttacaggatcaggattggaaacctctccatccgggtgatccaatgttcctgaccctggatgggaagacaattccgctgggcggggactgtaccgtctatccggttttcgtgaatgaggcggcctattacgaaaaaaaagaggccttcgcgaagacgactaagctcaccctgaatgcaaagagcattcgctgttgcctacat

SEQ ID NO: 7179 - DNA, 939 bp, Artificial Sequence
  Description of Artificial Sequence: Synthetic coding sequence
atgactagctgtcacatcgcagaagaacatatccagaaagtcgcaattttcggcggaacccacggcaacgagctcaccggcgtttttctcgtgaaacattggctggaaaatggggctgagatccaaaggactggactggaagtgaaaccatttatcacaaatccccgagcagtcaaaaaatgcaccagatatattgactgtgacctaaatcgaattttcgatctggagaatcttggcaaaaaaatgtctgaagatctgccctacgaagtccgtagggctcaggagatcaaccatttgttcggtccaaaggactcggaggactcatatgacattatcttcgatctacataatactacctccaatatggggtgtacgttgatcttagaagactccaggaacaactttttgatccagatgttccattacattaaaacttcacttgccccgctgccgtgctacgtgtatctcattgaacacccttctctgaagtatgcaacaacccgcagcatcgccaaatatcccgtgggaatcgaggtgggcccccagcctcagggggttctgagggctgatatcctagaccagatgcggaagatgattaagcatgcactcgatttcatacatcacttcaatgaagggaaggaattcccaccgtgcgcaattgaagtgtacaagattatcgagaaagtggattatccaagggacgaaaatggcgaaatcgcagctatcatccatcccaacctgcaggaccaggattggaagccactccaccccggggacccaatgtttctcacgcttgatggtaaaactatcccattgggcggcgattgtaccgtgtatccagtgtttgtgaatgaagctgcctattatgagaagaaagaggccttcgcgaagaccacgaagctgactctgaatgccaaaagcattcgctgctgcctgcac

SEQ ID NO: 7180 - DNA, 939 bp, Artificial Sequence
  Description of Artificial Sequence: Synthetic coding sequence
atgacttcttgccacatagccgaggaacatatccaaaaagtcgcaatattcggaggaacccacggtaacgaactgactggtgtgtttctagtgaaacattggctcgaaaatggagcagaaatccagagaactggactagaagtgaagcccttcattactaatccgcgggctgtcaagaagtgcactcgttatatcgactgtgaccttaaccgtatcttcgacctggaaaatctgggcaagaaaatgtccgaggatctgccatatgaggtaagacgagcgcaagagatcaatcatctgtttggacctaaggactccgaggattcatatgacataatatttgatttgcacaatacaactagcaatatgggctgtaccttgatcctggaagattctcgaaataactttctcatacagatgtttcattacatcaaaacctctctggctcccctgccctgttacgtctatcttattgagcacccctccctgaagtacgcaaccacccgcagtatcgctaagtacccagtcggaatcgaagtggggccccagccccaaggggttctccgcgccgacatcctggaccaaatgcgcaagatgataaaacatgcccttgattttatccatcacttcaacgagggcaaggaattcccaccatgtgctattgaggtgtacaagattattgagaaggttgattatccgagagacgagaatggagagattgctgcaatcatccatccgaatctgcaggaccaggactggaagccactgcatcccggagacccaatgtttctcactctggatgggaagaccattccgctggggggggattgtacagtttatccggtcttcgtgaacgaagctgcttactacgagaaaaaggaagctttcgccaagactacaaaactgacgctgaatgcaaaatctatcaggtgctgcctccac

SEQ ID NO: 7181 - DNA, 939 bp, Artificial Sequence
  Description of Artificial Sequence: Synthetic coding sequence
atgacatcctgccacattgctgaagaacatatacagaaagtagccatctttggcggcacccatgggaatgaattaacaggcgtctttttggtgaagcattggctggagaacggagccgaaatccagcggacggggctggaagtaaagcctttcattacgaatcccagagccgtcaagaagtgcacacgttatatcgattgtgacctgaaccgcatcttcgacctggagaacctggggaagaagatgtctgaagatcttccctacgaggtgcggagagcgcaggaaatcaaccatctgtttggcccaaaggattcagaggacagttacgatattatattcgacctgcataatactaccagcaatatgggttgcaccctcatcctcgaggattcccgcaataacttcctgatccagatgttccactatatcaaaacgtcacttgcacccttgccatgctatgtctatctgattgagcaccccagcctgaaatatgctacaacgcgctccatcgccaagtaccccgttggaattgaggtgggaccccagccccagggggtcctgcgtgcagacattcttgatcagatgaggaaaatgattaagcacgctcttgattttatccatcatttcaatgagggcaaagaattcccaccatgcgcgatcgaagtatacaagattatcgaaaaggtcgactaccctagggatgagaatggtgagatcgctgccattattcatccgaacttacaagatcaagactggaaacctcttcatccaggtgaccctatgtttctgacactggacggtaaaaccatccccctgggaggtgactgcactgtttaccccgtgtttgttaacgaggccgcatattatgagaaaaaagaggccttcgccaaaaccaccaaattgaccttgaatgccaaaagcatcagatgttgtcttcac

SEQ ID NO: 7182 - DNA, 939 bp, Artificial Sequence
  Description of Artificial Sequence: Synthetic coding sequence
atgacatcctgtcacattgcggaggagcatatccagaaggtcgcgatttttggcggcacacacggtaacgagctgacaggtgttttcctggtcaaacattggctggagaacggagcagagattcaacggacgggcttggaagtgaaaccctttattactaacccgagggctgtgaaaaagtgtactcgttatatagactgcgatttgaaccgcatatttgacctcgagaacttgggcaagaaaatgtccgaagatctgccgtatgaagtccgaagagcccaggagatcaaccatctgttcgggccaaaagatagcgaagacagctacgacatcattttcgacctccataatacgacgagtaacatgggatgcaccctcatccttgaggattcgcgtaataatttccttatacagatgttccactacatcaagacctctttggctcctcttccttgctatgtctacctcatcgagcacccctccctgaaatacgccaccacccgttcaattgccaagtatcctgtgggtatagaggtgggaccccagccacagggggttctaagagctgacatccttgatcaaatgagaaagatgataaagcacgctctggacttcattcatcattttaacgagggtaaagaattccccccgtgtgcaattgaagtgtacaaaattatcgaaaaagttgattacccccgggacgagaatggtgagatcgcagccattatccaccccaatttgcaggatcaggattggaagccgttacaccccggagaccctatgtttctgacgcttgacggtaaaaccattcccctcggcggcgattgcaccgtgtaccccgtgtttgttaacgaggcggcttactatgaaaagaaggaggcttttgccaagactactaaacttacgctaaatgcgaagtctataagatgctgcctgcat

SEQ ID NO: 7183 - DNA, 939 bp, Artificial Sequence
  Description of Artificial Sequence: Synthetic coding sequence
atgaccagctgccacattgccgaggaacacatccaaaaggtcgcaattttcgggggaacgcatgggaacgaacttaccggagtgttccttgtgaaacactggctggagaacggagcagaaatccagagaactggactggaggtgaagccgttcattaccaatccccgcgcggtcaagaaatgcactcggtacatcgattgcgacctgaaccggatcttcgacctcgaaaatctggggaagaagatgtcggaggacctgccgtacgaagtcagaagagcccaagaaatcaaccacctgttcggaccaaaggactcagaagatagctacgatatcatcttcgacttgcacaacaccacctctaacatgggatgtactctgatcctggaagattcccggaacaacttcttgatccaaatgtttcactacatcaagaccagcctggctcccctcccgtgttacgtgtacctcatcgaacacccaagcctgaagtacgccactactcgctcgattgcaaagtacccggtcggaatcgaagtcggtccgcaacctcaaggggtcctgagagcggacatcttggaccagatgagaaagatgatcaaacacgcgctggacttcatccaccactttaacgagggtaaagagttccccccgtgcgctatcgaggtgtacaagatcatcgaaaaggtggactacccacgggacgaaaacggcgagattgctgccatcatccacccaaacctccaagatcaggactggaagcctctccacccgggcgatccgatgtttctgacgctggacggaaagaccatcccgcttggaggcgactgcaccgtttaccccgtgttcgtgaatgaagcagcttattacgagaagaaagaagcattcgcaaagaccaccaagctgactttgaacgcgaagtcgatcagatgctgcctccac

SEQ ID NO: 7184 - DNA, 939 bp, Artificial Sequence
  Description of Artificial Sequence: Synthetic coding sequence
atgacctcttgtcacatcgccgaagagcacatacagaaagtcgccatttttggaggtactcacgggaacgagctgacaggcgtattcttggttaagcactggctagagaatggagcagagattcagcgcacggggctagaggtgaaaccattcataaccaacccgcgagcagtgaagaagtgtactcggtacattgattgcgacctgaatcgcattttcgacctggagaatctgggtaagaagatgagtgaagatctcccatacgaagtacggagggcccaagagatcaaccatctcttcggccccaaggactctgaagatagttacgacattatattcgacctgcacaacaccaccagcaatatgggatgcacattgatcctagaggatagtagaaacaactttctcattcagatgtttcattacatcaagacttctctcgcaccccttccatgttacgtgtaccttatcgagcacccgagtctcaagtacgctaccacacgctctatcgccaagtacccagtggggatcgaggtcggcccccagccccaaggtgttctcagagcagacattctggaccagatgagaaaaatgatcaaacacgccttggatttcatacatcactttaacgagggcaaggagttccccccatgcgctatcgaagtgtacaagatcatcgaaaaggtggactaccccagggatgaaaacggtgagatagccgcaataatacatcccaacttgcaggatcaagactggaagccactgcacccaggcgacccaatgtttttgacattggatgggaaaaccatcccactgggcggggattgcacagtgtaccccgtgttcgtgaatgaggcggcatactatgagaagaaagaggcgttcgccaagaccaccaagttgacgctgaacgcgaagagtattcgctgttgcctgcac

SEQ ID NO: 7185 - DNA, 939 bp, Artificial Sequence
  Description of Artificial Sequence: Synthetic coding sequence
atgacttcatgtcatatagccgaagagcatatccagaaggtggccatttttggcggcacgcatggaaatgaactcactggagtgttccttgtcaaacactggcttgaaaacggggccgagattcaaaggaccggacttgaagtgaaaccatttatcaccaatcctcgagccgtgaagaaatgtactaggtacatagattgcgatctgaacagaatcttcgatctggaaaacctcggaaaaaagatgagcgaggacctgccttacgaggtccgccgagcacaagagattaatcatttgtttgggccaaaagatagcgaggactcctatgacatcatattcgaccttcacaacacgacttcgaacatgggttgcacccttatccttgaagattcacggaacaactttctgattcagatgttccattacatcaagacgtccctggcaccacttccgtgttacgtgtaccttattgaacatccatctctcaagtatgcaactactcgctcaattgcaaagtatccagtcggaattgaagtgggtccacaaccgcagggagtgctcagagcagatatcctcgatcagatgcgtaagatgataaagcatgccctggactttatccatcacttcaatgagggcaaagagtttcccccatgtgccatcgaggtatacaagattattgagaaagttgactacccgagagatgagaatggtgagattgcagctatcattcacccgaacctccaggaccaagactggaagccactgcaccctggcgacccgatgttccttacccttgacggtaagaccattcccctgggtggagactgtactgtgtacccagtctttgtgaacgaagctgcctactacgagaagaaggaagcatttgccaagaccaccaagttgaccctgaatgcaaaatcgatccgctgctgtctccac

SEQ ID NO: 7186 - DNA, 939 bp, Artificial Sequence
  Description of Artificial Sequence: Synthetic coding sequence
atgacgagctgtcatatcgctgaggaacacatccagaaggtggctatattcggaggcacccacggaaatgaactgacaggcgtgtttctcgttaagcactggcttgagaatggcgccgagatccagcggacaggtctggaggttaagccttttattactaatccgagggccgtgaagaagtgcactcggtacattgactgcgacctcaataggattttcgatctggagaacctcggaaaaaagatgtcggaggatctgccttatgaggtcagaagagctcaggagattaatcacctgtttggacctaaagattccgaagattcttatgacattatcttcgacctgcacaataccacatcaaatatgggctgcacattaattttggaggattcacgaaataactttcttatacagatgtttcattacataaagacctctctggcgcccctgccctgttatgtgtacctgatcgagcatcccagtctgaaatacgcaactaccagatctatcgctaaataccccgtgggtattgaggtcggcccacagcctcagggtgtgctcagggcagatatacttgatcagatgcgcaaaatgataaagcatgccctcgactttatccatcatttcaacgagggaaaagagttccccccttgtgctatagaagtatacaagattatagaaaaggtggactaccctagagatgaaaacggcgaaattgccgcgattatccaccccaacttacaggatcaggattggaaacccctccatccaggggaccccatgttcctcacccttgacgggaaaaccatccctctggggggcgactgcaccgtgtaccccgtttttgtcaatgaagcagcatattatgagaagaaagaggcgtttgcaaaaacaacaaagctgaccttaaatgcgaaatcaataagatgctgcctgcat

SEQ ID NO: 7187 - DNA, 939 bp, Artificial Sequence
  Description of Artificial Sequence: Synthetic coding sequence
atgacgtcgtgtcatatagcggaagaacatatacaaaaagttgcgatatttggtggtacgcatggtaatgaattaacgggtgtttttctagtaaaacattggctagaaaatggtgcggaaatacaacgtacgggtctagaagttaaaccgtttataacgaatccgcgtgcggttaaaaaatgtacgcgttatatagattgtgatttaaatcgtatatttgatctagaaaatttaggtaaaaaaatgtcggaagatctaccgtatgaagttcgacgagcgcaagaaataaatcatctatttggtccgaaagattcggaagattcgtatgatataatatttgatctacataatacgacgtcgaatatgggttgtacgttaatactagaagattcgcgaaataattttttaatacaaatgtttcattatataaaaacgtcgctagcgccgttaccgtgttatgtttatttaatagaacatccgtcgctaaaatatgcgacgacgcgttcgatagcgaaatatccggttggtatagaagtaggtccgcaaccgcaaggtgttttacgtgcggatatactagatcaaatgcgaaaaatgataaaacatgcgttagattttatacatcattttaatgaaggtaaagaatttccgccgtgtgcgatagaagtatataaaataatagaaaaagttgattatccgcgagatgaaaatggtgaaatagcggcgataatacatccgaatttacaagatcaagattggaaaccgttacatccgggtgatccgatgtttttaacgctagatggtaaaacgataccgctaggtggtgattgtacggtatatccggtttttgtaaatgaagcggcgtattatgaaaaaaaagaagcgtttgcgaaaacgacgaaattaacgctaaatgcgaaatcgatacgatgttgtctacat

SEQ ID NO: 7188 - DNA, 939 bp, Artificial Sequence
  Description of Artificial Sequence: Synthetic coding sequence
atgacatcgtgccacattgctgaggagcatatacagaaggtggcgatcttcggggggacacatggcaatgaactgactggcgtttttctggttaagcactggctggagaacggtgccgagattcagcggactggactcgaagtaaaacctttcattaccaacccccgagcagtcaagaagtgtacgcgatacatcgactgcgatttgaataggatatttgatctggagaacttgggcaagaagatgtctgaagatctgccctatgaggtacgccgggcacaggagatcaatcatctgtttgggccaaaggatagtgaagatagttacgatatcatctttgacctgcacaatacgacaagcaacatggggtgtaccctcatcctagaagattcacgaaacaatttcctgatccagatgttccattacatcaagacttccttggcgccactcccttgctacgtctatttgattgagcacccgagcttgaaatacgccacgacccgaagcattgctaagtaccctgtcgggatcgaggtaggtcctcagccgcagggcgtactgagagcagacattttggaccagatgcggaagatgataaaacacgccctggactttatccatcactttaacgaagggaaagagtttcctccgtgtgccatcgaagtctataaaataatcgagaaggtagattaccctcgggacgaaaatggagagatcgccgctatcattcacccgaacctgcaagaccaggactggaaacctttgcatcctggcgatccaatgtttctgacgctggacggcaaaacaattcctctgggaggggattgtaccgtatatccagtctttgtgaacgaagctgcctactatgaaaagaaggaagcattcgctaagaccacgaagctgacacttaacgcgaagtccatccggtgttgcctccac

SEQ ID NO: 7189 - DNA, 939 bp, Artificial Sequence
  Description of Artificial Sequence: Synthetic coding sequence
atgacttcatgccatatcgcagaggaacacatccagaaagtggctatcttcggtgggactcatggaaacgagctcacgggagtctttctggtgaagcattggctcgaaaacggagccgaaatccagcgcaccgggctcgaagtcaagccgtttatcaccaaccccagagcggtcaaaaagtgtacgagatacatcgactgcgacctgaaccgcatcttcgatctggaaaaccttggaaagaagatgagcgaagatctcccatacgaggtccggcgtgcgcaagaaatcaaccacttgttcggccctaaagattcggaggactcgtacgatatcatattcgacctgcacaatactacctcgaacatgggatgcaccctgatcctggaggacagccgcaataactttctcatccagatgttccattacatcaagactagcttggcgccactgccttgttacgtgtacttgatcgaacacccatcgttgaagtacgcaaccactcggagcattgctaaatacccagtgggaatcgaggtgggaccacaacctcagggagtgttgcgcgctgacatcctggatcaaatgcgcaaaatgatcaaacatgccctggatttcatccaccacttcaacgaggggaaagagtttcccccctgtgcgatcgaagtgtacaagataatcgaaaaggtggattacccacgggacgaaaacggcgaaatcgcagcaattatccatccgaatctccaagaccaggactggaaaccgctgcaccctggcgacccaatgttccttaccctcgatggaaaaacgatcccgctgggaggcgactgtaccgtctacccggtctttgtgaacgaagcggcctactacgagaaaaaggaagcattcgctaagactactaagctcaccctgaatgcgaagtccatccgctgctgcctccat

SEQ ID NO: 7190 - DNA, 939 bp, Artificial Sequence
  Description of Artificial Sequence: Synthetic coding sequence
atgactagctgccacatcgcagaggagcatatccagaaagtagctattttcggcgggacccacggcaatgagctgaccggcgtgtttctcgtcaaacactggctggagaatggagccgaaatccagaggactggcctggaggtcaaacccttcattaccaatccccgcgcagtcaagaaatgcacacgatatatcgattgcgatcttaacaggattttcgatcttgaaaatctgggaaagaagatgagcgaagaccttccctatgaggttagacgtgcacaagagattaatcacctatttgggccaaaagactctgaggatagctacgacattattttcgatctccataacaccacctctaacatggggtgcacattaatcttagaggattctaggaacaatttcctgattcaaatgttccattatattaagacctctttggcgcctctgccctgctacgtatacctgatcgagcacccttctctgaagtacgccaccaccagaagcatcgctaaatacccagtggggattgaggtaggacctcagccacagggggtattacgggctgatatcttagaccagatgcgaaagatgatcaaacatgcccttgattttattcatcattttaatgaagggaaggagttccctccttgtgctatcgaggtgtacaagatcattgagaaggtggattaccctagagatgaaaacggtgaaattgctgcgatcattcatcccaaccttcaagaccaggattggaagccactgcaccctggggatcctatgtttttgaccttagatggtaagacaattcccttgggcggagattgtacagtgtatcctgtgttcgtgaacgaagcagcttattatgagaagaaagaggcattcgctaagacgacgaagctgaccctcaatgcaaaaagcattaggtgctgtctgcat

SEQ ID NO: 7191 - DNA, 939 bp, Artificial Sequence
  Description of Artificial Sequence: Synthetic coding sequence
atgacctcctgtcacatagcagaagaacatatacagaaggtggcgatttttggcggaacgcacggtaatgaactcaccggagtctttctggtgaagcactggcttgagaacggagccgagattcaaagaaccggactcgaagtgaagccctttatcactaacccacgagccgtcaaaaagtgtacccggtacatcgactgcgacctgaataggattttcgatctggaaaatctcggaaaaaagatgtctgaggacctgccatatgaggtccgcagagcccaagaaatcaatcatctctttggccctaaagattccgaggatagttacgatatcatttttgaccttcataacaccacctccaacatgggatgtacgcttatactggaggattccaggaataactttctcattcaaatgtttcattacatcaagacctcccttgcccctcttccttgctacgtgtacttgattgaacatcctagcctgaaatacgcaaccacccggtcgatcgcgaagtacccagtgggcattgaggtcgggccacaacctcagggagtcctgcgggcagacatcctcgatcaaatgagaaagatgattaagcatgcactggactttattcatcactttaatgaaggaaaagaatttccgccttgtgccatcgaagtgtacaagatcattgagaaggtcgactacccgcgagacgaaaatggcgaaatagccgccatcattcatcctaatcttcaggaccaggattggaagccactccatccaggggatcccatgtttctcactctggatggtaaaactattcccctggggggtgattgcaccgtgtaccctgtgttcgtcaacgaagcggcatactacgagaagaaggaagcattcgcgaaaaccacgaagctgaccctgaacgcaaagagcatcaggtgttgtctgcac

SEQ ID NO: 7192 - DNA, 939 bp, Artificial Sequence
  Description of Artificial Sequence: Synthetic coding sequence
atgacctcgtgtcacatagcggaagaacatatacaaaaagttgcgatttttggagggacccacgggaacgagcttactggtgtgttcctggtgaagcactggcttgagaatggtgcagaaatccagcgcaccgggcttgaagtcaaaccattcattaccaatcctagagctgtgaagaagtgcactaggtacattgattgcgacctgaaccggatctttgaccttgagaacctgggaaagaagatgtcggaggaccttccatacgaggttagacgagcccaggagattaaccatctgtttggaccaaaggactctgaagattcttatgatatcattttcgacctccacaacaccacctccaacatgggatgtactttgatactggaggatagccgcaataacttccttattcaaatgtttcattacattaagacgtcacttgcacctctcccctgctacgtgtacctcatcgagcacccttcgctcaagtacgccaccactcggagcattgctaagtacccagtcggtatcgaggtggggcctcagcctcaaggagtgctgcgcgctgatatacttgatcaaatgcggaagatgattaagcacgcgctcgactttattcatcatttcaacgaaggtaaagaatttcctccctgtgcaatcgaagtctacaaaatcatcgagaaagtggattacccaagggacgagaacggagaaattgccgcgatcatccatcctaatctgcaggatcaagattggaagccgctgcaccctggtgaccctatgtttcttaccctcgatggaaagactatcccattgggcggtgattgtactgtctatccagtctttgtgaacgaagccgcatactatgagaagaaggaagccttcgcaaaaacgaccaagctgacccttaatgcgaagagtatcaggtgttgtctgcac

SEQ ID NO: 7193 - DNA, 939 bp, Artificial Sequence; identical to SEQ ID NO: 7151
  Description of Artificial Sequence: Synthetic coding sequence

SEQ ID NO: 7194 - DNA, 939 bp, Artificial Sequence
  Description of Artificial Sequence: Synthetic coding sequence
atgacatcctgccacatcgccgaggaacatatacagaaagttgccattttcgggggaacacatgggaatgaattaactggggtgttcctagtgaagcattggttggagaacggtgcggaaatccagagaactggacttgaagtgaagcccttcattacgaacccccgcgctgtcaagaagtgtacccgctatattgactgtgatctgaaccggattttcgacctggaaaatctgggcaagaaaatgagcgaagatcttccctacgaagtccgccgtgcgcaggaaattaaccatctgttcggtcccaaggactccgaggatagctatgacattatctttgaccttcataacactacctcgaacatgggatgtaccttgatactggaggactcccgcaacaattttctcatacagatgttccattatattaagacatcccttgcgcccctcccctgctatgtctatctgatcgagcacccgtcactgaagtacgcaacaacaagatccatcgccaagtatccagtgggcattgaggtgggaccccagccacagggcgtcctacgtgccgatatcttagaccaaatgcggaaaatgatcaagcacgccctggacttcatacatcattttaacgagggaaaagagttccccccctgtgcaatcgaggtatacaagattattgaaaaggttgattacccacgcgacgaaaacggcgagatagccgcaatcatacatccaaatctccaggaccaggactggaagccccttcaccctggcgatccgatgttcctcacactggatgggaagaccatcccacttggaggtgattgcacagtataccctgtgttcgtcaacgaagccgcctactatgagaagaaggaggcgttcgccaagacaactaagcttactcttaacgccaagtctataagatgttgcctgcac

SEQ ID NO: 7195 - DNA, 939 bp, Artificial Sequence
  Description of Artificial Sequence: Synthetic coding sequence
atgacttcctgtcatatcgcagaagagcatatacagaaagtagctatctttggaggaactcatggaaatgagttgacaggggtgtttctagtaaaacactggctggaaaacggggccgaaatccagcgaacaggactcgaagtcaagcctttcataactaaccctcgcgctgtcaagaaatgtactaggtatatagattgcgaccttaacagaatatttgatcttgaaaacttggggaaaaaaatgtctgaagacctcccatacgaagtgcggcgcgcccaggaaatcaaccatctgttcggacccaaggacagtgaagatagttacgatatcatcttcgatctgcataatactacttccaacatgggatgcactcttatcctcgaagattctcgcaacaactttctaatacagatgtttcattatataaaaacttctctggccccactcccatgttatgtgtatctcatcgaacatcctagtctcaagtacgcaacaactagatctatcgccaaatatcccgttgggatcgaagttgggccacagccccaaggggtgttacgggccgatatactagatcagatgagaaagatgattaaacacgcactcgattttatccaccattttaacgaagggaaagaattccccccctgcgccatcgaagtttataagatcatcgagaaagttgattacccccgggatgagaacggagaaatagcggcaatcattcacccaaacctgcaggatcaggattggaaaccactgcatcccggggatcccatgtttctcacacttgatgggaaaactattcccttaggaggggattgtacagtataccctgtgtttgtgaacgaagcagcttactatgaaaagaaagaagcttttgccaagacgactaagctaactctgaacgccaaatcaatacgctgttgtttacac

SEQ ID NO: 7196 - DNA, 939 bp, Artificial Sequence
  Description of Artificial Sequence: Synthetic coding sequence
atgacatcttgccatatcgccgaagaacacatccagaaagttgccatcttcggtggaacccacggcaacgagttgactggcgtcttcctagtgaagcattggctggaaaacggggcagaaatacagaggaccgggctggaagtaaagccttttataacgaacccacgtgccgttaagaaatgcactagatatattgactgtgacctcaaccgtatatttgatttggagaatcttggcaagaagatgtctgaagatctaccttacgaagtacggagagcccaggagatcaatcacctgtttggccctaaagattcagaggactcatatgacatcatcttcgacttgcacaatacgacgagtaatatgggatgcaccctgatactggaggattctcgcaataacttcctgatccaaatgttccattacatcaaaacttctctcgcccccttgccgtgttatgtctacctaattgaacacccttctctgaagtatgcgaccaccagatccatcgcgaagtatcctgtgggaatcgaggttggtccgcagccccagggggtgttgcgtgcggacattctcgaccaaatgcgaaagatgatcaagcatgctttggatttcatacatcattttaatgaaggcaaggaattcccaccctgcgcaattgaagtctataaaataattgaaaaggttgattatccacgggacgagaatggtgaaatcgccgctataatccatccgaatctccaggaccaggattggaagccccttcatcccggtgatcccatgtttcttacactggatggaaagaccatccccctagggggtgattgcacggtttaccctgttttcgtgaatgaggcagcttattatgagaaaaaagaggcttttgcaaaaaccacaaaattgactctcaacgctaagtcgatacgctgttgccttcac

SEQ ID NO: 7197 - DNA, 939 bp, Artificial Sequence
  Description of Artificial Sequence: Synthetic coding sequence
atgacctcctgccacatcgcagaggagcatatccagaaggtggcaatctttggcggaactcacgggaatgaactgaccggggtattcttggtgaaacattggttagagaacggagcagagattcaaaggacaggtctggaggtcaaacctttcattaccaaccccagggctgtgaagaagtgcacgaggtatattgactgcgatctcaacaggatcttcgatctggaaaaccttggcaagaaaatgtccgaggacctgccatacgaagtgaggcgcgctcaggagatcaatcatctttttggtccaaaggactccgaggactcgtatgacatcattttcgatctgcacaacacgacatctaacatgggctgcaccctgatcctcgaggatagccgaaataactttctgatccaaatgtttcattatatcaaaacttctcttgctcctcttccctgctatgtttatctaatcgagcaccccagtctgaaatatgccaccacacgctctatagccaagtaccctgtcggaatagaggtaggcccccagcctcagggcgtcctcagggctgatatcctggaccaaatgaggaagatgatcaagcacgcattagattttattcatcatttcaacgagggcaaagaattccccccgtgcgcaatcgaggtgtataagatcatagagaaagtggactatcctcgggatgagaatggcgaaattgccgcaataatacatccaaacttgcaagatcaggattggaagcctctgcatcctggggatcccatgtttttgacccttgacggcaagacgatcccattgggaggcgactgcaccgtttacccagtttttgttaatgaagctgcatactatgaaaagaaggaggcattcgctaagaccaccaagttgactttgaacgccaaatccattcgctgctgtctgcac

SEQ ID NO: 7198 - DNA, 939 bp, Artificial Sequence
  Description of Artificial Sequence: Synthetic coding sequence
atgaccagctgccatatcgccgaagagcatattcagaaagtggctatttttggcggaacacacggaaatgagctaaccggggtcttcctggtgaaacactggctcgagaacggcgccgaaattcaacggacaggcctagaagttaaacccttcattacaaatcctcgagccgtcaaaaaatgtacccgttatatcgattgtgatctgaatcggatcttcgacctggaaaacttgggcaagaagatgtcagaggatctcccttacgaggttagaagggcacaggagattaatcacctgttcgggcctaaggacagtgaggactcttacgacattatttttgatctgcacaacactacctccaacatggggtgtacactgatcctggaggactccagaaacaacttcctgattcaaatgttccactatataaaaactagtttggcccccctaccatgctacgtctatttaatcgagcatccaagtctgaagtatgctactactcggtctattgctaagtaccctgtggggatcgaggtgggaccccagccccagggggtcttacgcgccgacattctggatcagatgcgcaaaatgatcaagcacgccttggattttatacatcactttaatgagggaaaagagtttcccccctgcgccatcgaagtttacaaaattatcgaaaaggtggattatcccagggatgagaatggcgagatagcagccattattcatcccaacttgcaggatcaggattggaaaccactgcatccaggcgaccctatgtttctgacactggacggcaaaaccatcccactgggcggcgactgtacagtgtaccctgtgttcgtgaacgaggcagcatactatgagaagaaggaggcctttgcaaaaacaaccaagttgacactgaacgccaaatcaatccgttgttgtctgcac

SEQ ID NO: 7199 - DNA, 939 bp, Artificial Sequence
  Description of Artificial Sequence: Synthetic coding sequence
atgacttcgtgccacatcgcagaagagcacatccagaaggtcgccatcttcggagggactcacggtaacgaactgactggcgtctttttggtgaagcattggttggaaaacggcgcagaaattcagcggaccggactcgaggtgaaacccttcatcaccaacccgcgggcagtcaaaaagtgtactcgctacatcgattgtgatctgaatcggatcttcgacctcgagaacctggggaaaaagatgtcggaggatctgccatatgaggtgagacgggctcaggagataaatcacctcttcggcccgaaagatagcgaggattcctacgacattatcttcgacttgcataacactacctccaatatgggctgtacccttatcctggaggattcgcgcaacaactttctcattcagatgtttcattacatcaagacctcgctggcaccactgccatgctacgtgtacctcatcgagcacccgagcctcaaatacgctaccactcgctccatcgcgaagtacccagtgggaatcgaagtcgggccacagccccagggagtgctccgggcggacatcctggaccaaatgcgcaagatgatcaaacatgcgctggacttcatccatcactttaacgagggaaaagaattcccgccctgtgccatcgaggtgtacaagatcatcgagaaggtggactacccacgggacgagaacggcgagatcgcagctatcattcacccgaacctgcaggaccaagattggaagccgctgcacccaggggaccctatgttcctgactctcgacggaaagaccatccctctgggaggagactgcactgtctacccggtgttcgtgaacgaagccgcgtactacgaaaagaaggaagcgttcgctaagaccactaaactgaccctgaacgccaagagcatcaggtgttgccttcat

SEQ ID NO: 7200 - DNA, 939 bp, Artificial Sequence
  Description of Artificial Sequence: Synthetic coding sequence
atgacttcttgccacatcgctgaggaacacattcagaaagtggccatctttggcggtactcacggtaatgagcttactggcgtgttcttggttaaacattggctagagaacggtgccgagattcagcgcacggggctggaggttaagccctttataaccaaccccagagcagttaagaagtgcactcggtacatagactgtgacttgaacaggatcttcgacttagagaatctcggtaagaagatgagcgaggatcttccctatgaggttcggagggctcaggagatcaatcacttgttcggtcctaaggatagtgaggatagttatgacataattttcgacttgcacaacactacctctaatatggggtgtactctgattctagaggacagtcgcaataacttcctgattcagatgttccactacatcaaaactagccttgcgccgctaccctgctacgtctatctcatcgaacacccaagcctaaagtacgctacgacacggtctatcgccaagtatcctgttggcatcgaggtgggacctcagccgcagggcgttctgagagccgatatcctggaccagatgagaaaaatgataaaacacgctttggactttatacaccattttaacgaaggtaaggagttcccaccctgtgccatcgaggtatacaagataatcgagaaggtcgactaccccagagatgaaaacggtgagatcgcagcgattatacaccctaatctacaggaccaggactggaagccgctgcatccaggggatcctatgttccttacattagatggcaagacaattcccctcgggggggattgcaccgtttatccggttttcgtcaacgaagcagcatactatgagaagaaggaggcctttgcgaagacaacaaaactgaccctgaacgcaaagtcaattagatgttgtttgcat

SEQ ID NO: 7201 - DNA, 939 bp, Artificial Sequence
  Description of Artificial Sequence: Synthetic coding sequence
atgacttcctgtcatattgcagaagaacatatccaaaaagtcgccatctttggcggaacccatgggaatgaactcactggagtctttctggtcaagcattggcttgagaacggagcagaaattcagcgtactggactcgaagtgaaaccttttatcactaatcctagagctgtgaaaaagtgtactcgctacattgactgtgatctcaatagaatctttgacctggaaaacctggggaagaaaatgtccgaggaccttccttacgaagtgagaagggcacaggagattaatcacctgttcggaccaaaggattcagaagatagctacgacattatctttgatctgcacaataccacgagcaatatgggctgtaccctgatcttggaagattccaggaacaactttcttatccagatgttccattacatcaaaacttccctcgcgcctctgccctgttatgtgtacctgattgaacatccatcccttaagtatgctaccaccagatcgatagcgaagtaccctgtgggaatcgaagtcggaccccagcctcaaggtgtgctgcgcgcggatattcttgatcagatgcgcaagatgattaagcatgcacttgactttatccaccactttaacgagggaaaggagttcccaccatgtgcaattgaagtgtacaagataattgagaaagtggactaccccagagacgaaaatggagagatcgcagccatcattcatcctaacctgcaagaccaggactggaagccccttcatcctggtgatccaatgtttctgacgcttgatggcaagactatcccactgggcggagattgcactgtgtacccagtgtttgtgaatgaagctgcctactacgaaaagaaggaagcgttcgcaaagaccactaaacttaccctgaacgcgaagtcgatcaggtgctgcctgcat

SEQ ID NO: 7202 - DNA, 939 bp, Artificial Sequence
  Description of Artificial Sequence: Synthetic coding sequence
atgacctcatgtcacatcgccgaggagcacattcagaaggtggctatctttggcggaacgcacgggaatgagctaaccggagtgtttctggttaagcattggctggagaacggggccgagattcagaggactggactggaagtcaaaccattcatcaccaacccacgcgccgtgaaaaagtgtacgcgctacattgactgtgaccttaatagaatttttgacctcgagaatctgggtaagaagatgtccgaagacctgccatacgaagtacgccgggcacaggaaattaaccacctgtttgggcccaaggattctgaggactcctatgatattatttttgacctccataataccacttcaaatatgggctgcaccctgattctagaggactcccgcaacaacttcttgattcagatgtttcattatatcaagacatcgctggccccactgccatgttatgtgtatctcattgagcacccctctctcaagtacgctaccacaaggtcgattgccaagtaccccgtggggatcgaagtcgggccccagccccagggagtgttaagggctgacatcctcgatcagatgaggaaaatgatcaaacacgcactggatttcatccatcacttcaatgagggcaaagaatttcccccttgtgctatagaagtctataagattattgagaaagttgactacccccgtgatgaaaacggcgaaatcgccgcaatcatacaccccaacctacaggatcaggattggaaacctcttcaccctggggatcccatgttcctgaccttagacgggaaaactatcccactcggcggagattgcacagtgtatcctgtgttcgttaatgaggcggcctactacgagaaaaaagaagcctttgccaaaaccacgaaactaaccttgaatgctaagtccatacgatgctgtctccat

SEQ ID NO: 7203 - DNA, 939 bp, Artificial Sequence
  Description of Artificial Sequence: Synthetic coding sequence
atgacgtcctgccacatcgccgaagagcacattcagaaggtcgctattttcggtgggactcatggaaatgaactcaccggcgtgttcctcgtgaaacattggctagagaatggggccgagatacagaggactggcctcgaagtgaagccctttattaccaacccgagagctgttaagaagtgtaccagatacatcgactgtgacctgaaccgcatatttgatctcgagaacctgggcaaaaaaatgagcgaggacttaccctacgaggtaagacgggctcaggaaatcaaccatttatttggccctaaagattcggaggattcatacgacatcatttttgacctgcataacaccacaagcaacatgggctgtactctgatccttgaggattcacgcaataattttctcatccagatgttccactatatcaaaaccagtcttgccccattgccctgttacgtttatctgatcgagcaccccagtctgaagtacgcaactacccgcagtatcgccaaatatccagtgggaatcgaggtcggacctcagcctcagggcgttctcagagctgatatactggaccagatgcgtaaaatgatcaagcatgcactggacttcatacaccacttcaacgaaggaaaggaattccccccctgtgcaatcgaggtgtacaaaatcattgagaaagtggattatccccgagacgaaaacggtgagattgctgcaataattcatcctaatctgcaggatcaggactggaagcctctgcacccaggagaccctatgttcttgacattagatggcaagaccattcctctagggggagattgtaccgtgtacccagtgttcgttaacgaagcagcctattatgaaaagaaagaggcctttgctaagactacgaagctgacgttgaatgcaaaatccatccgatgctgcctccac

SEQ ID NO: 7204 - DNA, 939 bp, Artificial Sequence
  Description of Artificial Sequence: Synthetic coding sequence
atgaccagttgtcatattgccgaagaacatatccaaaaagttgccatctttggagggactcacggtaacgaattgactggagtttttcttgtgaagcattggttggagaatggggcagagatccagcgtaccggcttggaagtgaagcctttcattaccaacccaagggcagtgaagaaatgcacgcgctatattgactgtgatctgaacagaatctttgatctggaaaaccttggcaaaaagatgtccgaagatcttccttacgaagtccggcgtgcccaagagataaatcatctgtttggacccaaggatagcgaggattcctatgatatcattttcgaccttcataacactacctccaacatggggtgtacgctgatcttggaagattcgcgaaacaactttctgatccagatgtttcactacattaagacttccctcgcaccattgccgtgctacgtgtacctgatcgagcatccttcgctgaaatacgctaccactaggagcattgcaaagtacccggtggggatagaggtgggccctcaaccacaaggagtcctccgcgcagacatccttgatcagatgagaaaaatgattaagcatgcgctcgactttatacatcactttaatgagggaaaagagttcccaccgtgtgccatcgaagtgtacaagattattgaaaaggtggactacccaagggatgaaaacggagaaattgcagcaatcatacacccaaatcttcaagatcaggattggaaaccgctccaccccggtgatcccatgttcctgactctggacggtaagactatcccccttggtggcgattgtactgtctaccccgtgttcgtaaacgaagctgcgtactacgagaaaaaggaggcgtttgcaaagactaccaagctgaccttgaatgcaaagtcgattagatgctgtctccat

SEQ ID NO: 7205 - DNA, 939 bp, Artificial Sequence
  Description of Artificial Sequence: Synthetic coding sequence
atgacctcatgtcacattgcagaggaacatattcagaaagtcgcaatctttggaggcacccatggtaacgagctcaccggagtctttcttgtgaagcactggcttgagaatggcgccgaaatacagcgtactggattggaggttaagccctttattaccaaccctcgcgccgtgaaaaaatgcacccgctacattgattgtgacttgaataggattttcgacctggagaacctgggtaagaagatgtctgaagatctcccttacgaagtgagaagggctcaagaaatcaatcatctgttcggccctaaggattctgaagactcttacgacataatatttgacttgcataatacaactagcaacatgggctgcactctgattctggaggactcaaggaacaacttcttgatccaaatgttccattacataaagacctctctggcccctctgccctgctacgtgtacctgatagagcatccctcactgaaatatgcaacaactagaagcattgctaaataccctgttggcattgaggtcggcccccaacctcagggcgtgcttagagcagatatcttggatcaaatgaggaaaatgattaagcatgctctggactttattcaccacttcaacgaaggtaaggagttccccccttgcgccatcgaggtctacaagataattgaaaaagtggactatcccagagatgaaaatggcgagatcgccgctatcattcatcccaaccttcaagaccaggactggaagcccctccacccaggtgaccccatgttcctgacattggatggcaaaaccatcccattgggaggtgattgcacagtgtaccctgtgttcgtgaacgaagccgcctattatgagaagaaggaagctttcgccaaaactacaaagctgaccctgaatgccaaaagcattcgctgttgcctccac

SEQ ID NO: 7206 - DNA, 939 bp, Artificial Sequence
  Description of Artificial Sequence: Synthetic coding sequence
atgacctcttgccatatcgccgaggagcatattcagaaagtggcgatttttggaggtactcacggcaatgagctgacaggggtgtttctggtcaagcattggcttgagaacggcgcggaaatccagcgcaccggactcgaggtgaagcccttcataaccaacccccgtgccgtcaaaaagtgtactagatacatcgattgcgatctgaatagaatttttgatttggagaacctcggaaagaagatgagcgaagacctcccttatgaggtgcgacgcgcacaagagataaatcatctgttcgggcccaaggattctgaggacagctacgatatcatttttgacctgcataacacaacttcaaacatggggtgtaccctgatcctcgaagactcacgcaacaacttcctcatccagatgtttcactacatcaagaccagcctcgcccccctgccgtgctacgtgtatctgattgaacacccttccctcaaatacgctacaactaggtcaattgctaagtaccccgtcggaatcgaggtgggaccacagccacagggcgtcttgcgggctgacatcttagatcaaatgcgcaagatgattaagcacgccctagattttatacaccatttcaatgaaggaaaggagtttcctccctgtgcaatagaggtgtataagattatagagaaggtggattaccctcgcgacgaaaatggagagatcgcagccattatccatcccaacctgcaggaccaggattggaagcccctacaccccggcgaccccatgttcctcacactagacggcaagacaattcccctgggcggtgactgtaccgtatatccggttttcgtgaatgaagcagcatactatgaaaaaaaagaggcattcgccaaaactacgaagttaactttaaacgcaaagtctataaggtgctgtcttcat

SEQ ID NO: 7207 - DNA, 939 bp, Artificial Sequence
  Description of Artificial Sequence: Synthetic coding sequence
atgactagctgccacatcgcggaagagcatatacaaaaggtggccatatttggtggaacgcacggcaatgagctgaccggggtgttccttgtgaagcactggctcgaaaatggggcagagattcagcgcaccggactcgaagtaaagccctttattacaaatcccagagcagttaaaaagtgcactaggtatatcgactgtgacctgaaccgcatttttgaccttgaaaacctggggaagaaaatgtctgaagatcttccctacgaggtccgccgagcacaagagatcaaccacctgtttggccccaaagactcagaagacagctacgatatcatatttgacctgcataacaccacgtccaacatgggatgcacactgattctcgaagactctaggaataattttttgatccagatgtttcactatatcaagacgagcctggcccccctcccctgttacgtctacctcatcgaacacccaagcctgaaatatgccacaaccaggtccattgcgaaataccccgtgggcattgaagtcggaccccagccccagggcgtgttgagggccgacattttggaccagatgcggaagatgataaaacatgctctcgattttatccaccacttcaatgaggggaaagagttccccccatgtgccatcgaggtttataaaatcatcgagaaggtggactaccctcgagatgagaatggcgaaatcgctgcaattatccatccaaacctgcaggatcaagactggaagccccttcatccaggcgatccaatgtttctgaccctggacggcaagacgatccccctcggcggagattgcactgtgtaccctgttttcgtaaacgaagcagcttactatgagaagaaagaggctttcgcgaagacaactaagcttaccctcaatgcgaagagtatcaggtgttgtctgcac

SEQ ID NO: 7208 - DNA, 939 bp, Artificial Sequence
  Description of Artificial Sequence: Synthetic coding sequence
atgacatcctgccatatcgcggaagaacatatccagaaggtggctatcttcggcgggacccatggaaacgaactcactggggttttcttggttaaacactggctcgaaaatggggctgaaatccagcggacaggcctagaggtgaaaccttttatcacaaacccgcgtgccgtgaaaaagtgcaccagatatattgactgcgacctaaataggatttttgacctagagaatcttggaaagaagatgagcgaggatttgccctacgaagtgcggagggcacaggagattaatcacctgtttggtcctaaggattctgaagatagctatgacataatattcgatctgcataacacaacaagtaatatggggtgtacgctcattctggaagattcaagaaataatttcctgatccagatgtttcattatatcaagacctctcttgctccgctgccctgttacgtctatctaattgaacacccatctttgaagtatgccaccactagatccatcgctaaataccctgtaggtattgaggttggcccccagcctcagggagttctgagagctgacatactggatcaaatgaggaagatgatcaagcacgccctcgacttcatacatcacttcaacgaagggaaagaatttcctccatgtgctattgaggtgtacaagattatagagaaagtagactatcctcgggacgaaaacggagagatagccgctatcattcatcctaatttgcaggatcaggattggaagcctctccacccaggggacccgatgttccttaccctggatggcaaaacaatccctttagggggagactgcactgtctatcccgtgtttgtgaatgaggcagcgtactacgagaaaaaagaagctttcgcaaaaacaacaaaacttaccctgaatgctaagtcaatccgatgttgcctgcac

SEQ ID NO: 7209 - DNA, 939 bp, Artificial Sequence
  Description of Artificial Sequence: Synthetic coding sequence
atgacttcttgtcacatcgcagaggagcatatccaaaaggttgccatattcggaggcacccatggtaatgaacttacaggtgtattcttggtcaaacattggctagagaatggggcagagattcaacggactgggctggaggtaaaaccattcatcacgaacccaagagctgtcaaaaagtgtacaagatatatcgattgtgatttgaatcggatttttgatttggagaaccttgggaaaaaaatgagcgaggatttaccatatgaagttagacgtgctcaagaaatcaatcatctcttcggtcccaaagactctgaggattcttacgatataatttttgatttacataataccacatctaacatgggttgcacacttattttggaggatagcaggaacaacttcttgatacaaatgttccattatattaaaactagtctcgcaccacttccatgctacgtttatttgatcgaacatccatctctcaaatatgctaccactagatcaatagcaaagtaccctgtgggtattgaagttggtccacaaccgcagggagttcttagagctgatatccttgatcagatgaggaaaatgatcaagcatgctttggactttatccatcactttaatgaaggaaaggagtttcctccatgcgcaattgaggtgtataagattatagagaaagtggattatcctagggatgaaaacggagagatcgctgccattattcatcctaatcttcaagatcaagattggaagccactgcatcctggcgatccaatgttccttactctggatggcaagaccatcccactgggcggtgattgtaccgtctatccggtttttgttaacgaggccgcttactatgaaaagaaagaggcttttgctaagacaaccaaattaacgcttaatgctaaatcaataagatgttgtttgcat

SEQ ID NO: 7210 - DNA, 939 bp, Artificial Sequence
  Description of Artificial Sequence: Synthetic coding sequence
atgacctcctgtcatattgccgaagagcatattcagaaggtggcaatctttggtgggactcatggaaacgaacttactggggtctttctggtgaagcattggctcgagaacggcgcagaaattcaaagaactggactggaagtgaagccgttcattacgaacccacgtgcagtgaagaagtgtaccagatacatcgactgtgacctgaacagaatctttgaccttgagaatcttggaaagaagatgtccgaagatctcccctatgaagtgcggcgggctcaagaaatcaaccaccttttcggaccaaaagactcggaagatagctacgacatcatcttcgacttgcacaatactactagcaacatgggatgcactcttatccttgaggattcccggaacaactttcttattcaaatgttccactacatcaagacctcgcttgcaccactcccatgctacgtgtacttgattgaacatcctagcttgaaatacgcaacgactagatccattgccaagtaccctgtgggtattgaggtgggcccgcagcctcaaggtgtccttcgggcagacatcctcgaccaaatgcgtaagatgataaagcatgccctcgatttcattcaccatttcaatgaaggaaaagagtttccaccatgtgccatagaggtctacaagatcattgagaaggtggattacccaagggacgagaacggagagattgcggcaattatccatcctaacctgcaggatcaggattggaagcctcttcatcccggagatcctatgtttctgactcttgatggtaagaccatccctctgggaggagactgtactgtctacccagtgttcgtgaatgaagcggcctattacgagaagaaggaagccttcgccaagaccaccaagctcacccttaacgccaaatcaatccgttgctgtctccat

SEQ ID NO: 7211 - DNA, 939 bp, Artificial Sequence
  Description of Artificial Sequence: Synthetic coding sequence
atgacttcctgtcatatcgcagaagagcacatccagaaggtcgcaattttcggcggaacccacggaaacgagctgaccggggtgttcctggtgaagcactggctggagaacggcgctgagatccaacgaaccggactcgaagtgaaaccattcatcaccaaccctcgggcggtgaagaagtgcacgcggtacatcgattgcgacctcaaccggattttcgaccttgaaaacttggggaagaaaatgagcgaagatctgccatatgaggtgaggcgcgcgcaggagatcaatcacctgttcggtccgaaagacagtgaggactcgtacgacataatcttcgacctgcacaataccacttcaaatatgggatgcacgttgatcttggaagattcaagaaataactttctgattcaaatgttccactacataaagacgtccctggcgcccctcccttgctacgtgtacctgattgaacacccgagcctgaagtacgcgactacccggtcaatcgcaaaatacccggtcggaatcgaggtcggcccgcaaccacagggggtgctgagagccgatatcttggatcaaatgcgcaagatgatcaagcatgctctggatttcatccaccatttcaacgaaggtaaggagttccctccgtgcgctatcgaagtctataagattatagaaaaggtggactaccctagagatgaaaacggagaaatcgcagctatcatccacccaaatctccaggaccaggattggaagcctctccatccgggtgaccccatgttcctgacgttggatggaaagactatcccgcttggaggcgactgtactgtgtacccagtgtttgtcaatgaagcggcctactacgagaagaaagaggcctttgccaagactactaaactcaccctgaatgccaagtctattcgctgctgccttcat

SEQ ID NO: 7212 - DNA, 939 bp, Artificial Sequence
  Description of Artificial Sequence: Synthetic coding sequence
atgacctcttgtcatattgctgaggaacatatccaaaaggtggcgatcttcggaggaacacacggtaacgaattgactggtgtctttttggtgaagcactggcttgaaaacggagctgaaatccagcgtacagggcttgaagttaaaccatttatcacaaacccaagggctgtcaaaaagtgcactcggtacatagattgtgatcttaaccgcatcttcgacctggaaaatttggggaagaaaatgagtgaggatctgccatacgaggtcaggagagcacaggagatcaaccacttgtttggacccaaagatagtgaggactcatacgacatcatatttgacctgcacaataccacctccaacatgggatgcactctaatccttgaggattctcggaacaatttcctcatccagatgttccattacatcaaaactagcttggcacctttaccttgctacgtgtacctgatagaacacccttctctgaaatatgccaccaccaggagcatagcaaaatatcctgtgggcattgaggtcggcccccagccccagggagtcttgcgcgccgacatccttgaccagatgcgcaagatgataaaacatgctctcgatttcattcatcattttaacgagggcaaggaattcccaccctgcgccattgaagtgtacaaaattatagaaaaggtggattaccccagggacgagaatggtgagatcgccgccatcatccacccaaatctgcaggatcaagattggaaacccctgcatccaggtgaccctatgttcctcacactcgacggcaagaccatcccccttgggggagactgtaccgtctaccctgtattcgtgaacgaggcggcctactacgagaagaaggaagcgttcgcaaaaactacaaaactgaccttgaacgcaaagtcgatccgatgttgccttcac

SEQ ID NO: 7213 - DNA, 939 bp, Artificial Sequence
  Description of Artificial Sequence: Synthetic coding sequence
atgacctcctgtcacattgctgaagaacacattcagaaggtggcgatctttggcggcacccatggaaatgagttaacaggagtgtttcttgtgaagcactggcttgaaaacggcgccgaaatccagcggacgggcctagaggttaaacccttcattacaaaccctcgagctgtaaaaaagtgcaccagatatatcgattgcgacctgaataggatttttgacttagagaacttaggcaaaaagatgtccgaggacttgccttacgaggtgcggcgcgcccaggaaattaatcatctttttggcccaaaagacagcgaggattcttatgacatcatcttcgatctgcacaacaccacgtccaatatgggctgcacactgattctcgaagattcaagaaataattttctcatccagatgttccactacataaagacaagtctagcccctctgccatgttacgtatacttgatcgaacaccctagcctgaagtacgcaaccactagatccattgcgaaatatcccgtgggaattgaagtcggcccacaaccccagggggtgctgagggctgatatcctcgatcagatgaggaagatgatcaagcatgcgttggacttcatccatcactttaacgaagggaaggagtttcctccatgcgccatcgaggtatacaaaatcattgagaaagtcgactaccctagggatgagaacggagagattgccgctattatacatcccaatctccaggatcaggattggaaaccattgcaccccggtgatccaatgtttctgacgctggatggtaagaccattcccctgggcggggactgcacagtctatccagtgtttgtaaacgaagctgcctattacgaaaagaaagaggccttcgccaaaacaactaagctgacgctcaatgctaaaagcatacggtgttgtttacac

SEQ ID NO: 7214 - DNA, 939 bp, Artificial Sequence
  Description of Artificial Sequence: Synthetic coding sequence
atgacttcttgccatattgccgaggaacacatccagaaagttgcaatcttcggagggacacatgggaatgagttgactggagtcttcctagtgaaacattggctcgaaaatggggcagagatccagcggactgggctcgaagtcaaacctttcataacaaatcctagagccgtaaaaaaatgcacacgatatatcgattgtgatctgaataggatattcgacctcgaaaacttgggaaagaaaatgtcagaggatttaccatatgaagtccggagagctcaggaaatcaatcatctctttgggcctaaggatagtgaagattcatatgatataatctttgatcttcataacactacttcgaatatgggatgtactctcatccttgaggattctaggaacaactttttaatccagatgtttcattatataaaaacgtccctagctcctttgccctgttatgtctacctcatagagcatccatctcttaaatacgctacaactcgcagtattgccaagtatcccgtcgggatagaagtcgggccacagccccagggggtgctgcgggctgatattcttgatcagatgaggaagatgataaagcacgctctcgattttatacatcattttaatgaaggaaaagaattccctccgtgcgccatagaagtgtacaaaataattgaaaaagtcgactacccccgggacgaaaatggagagatagctgctatcattcaccctaatctacaggatcaagattggaaacccctgcacccaggggatccgatgttccttactctagatgggaaaacgatccccctagggggggattgcactgtgtaccccgtcttcgtaaacgaggcggcctattatgaaaaaaaagaagcattcgcaaaaacaactaagcttacactcaatgctaaatccattagatgttgcctgcat

SEQ ID NO: 7215 - DNA, 939 bp, Artificial Sequence
  Description of Artificial Sequence: Synthetic coding sequence
atgacttcctgccatatcgccgaagagcatatccaaaaggtcgccatctttggaggcacccacggaaacgaactcaccggagtctttctggttaaacactggctggaaaacggcgccgaaatccagcgcactgggctcgaggtcaagccgttcatcactaacccccgcgcggtgaagaagtgcactagatacatagattgtgatctcaatcgaattttcgatctggaaaatcttggaaagaaaatgtcagaggacctgccttacgaagtaagacgcgcccaagaaatcaatcacctcttcggaccaaaagattccgaggactcatacgacatcatctttgatctgcataacactacctcgaatatgggatgcaccctcattctggaagattcacggaacaacttcctgatccagatgttccactacatcaaaactagcttggcaccgcttccgtgttacgtgtacttgattgaacacccgtctctcaagtatgcaactaccagatcgattgccaaatacccggtcggcattgaggtggggcctcagcctcaaggagtgctgcgagctgacattctggaccaaatgcgcaagatgatcaagcatgctctggactttatccaccatttcaacgagggaaaggagttcccgccatgcgcaatcgaggtgtataagatcatcgaaaaagtggattacccccgggatgaaaatggggagatagcggctatcatccatccgaacctccaggaccaagattggaagcctctgcaccccggggacccgatgttcttgaccctggatggaaagaccatcccgttgggtggagactgtaccgtgtaccccgtgtttgtcaacgaagcagcatactatgagaagaaggaagcgttcgccaagaccaccaaactcacgctgaatgcgaagtcaattaggtgttgcctccat

SEQ ID NO: 7216 - DNA, 939 bp, Artificial Sequence
  Description of Artificial Sequence: Synthetic coding sequence
atgaccagctgccacatcgcagaagaacatatccagaaggtcgccatattcggggggacacacggcaacgagctgaccggcgtgttcctggttaaacactggcttgaaaacggagcagagattcagcgcacaggtttggaggtcaaaccattcatcacaaatcccagagccgtcaagaagtgcacacggtacattgattgcgatctgaaccgcattttcgatttagaaaatttgggcaagaagatgagtgaggacctgccctatgaagtgcgtcgtgcccaggaaattaaccacctctttggcccgaaagattctgaagatagctacgatattatcttcgatctccacaataccacctccaatatgggttgtacactgattctagaggactcaagaaacaatttcctgatccagatgttccactacattaaaacaagcctagctcctctcccatgttacgtctacttgatagagcacccctcactgaaatatgccactactcgttcgattgcaaagtatccagtggggatcgaagtggggcctcagcctcagggtgtccttcgagcagatatccttgatcagatgagaaaaatgattaagcacgcccttgatttcatacaccatttcaatgaaggcaaggaattccccccctgtgcaattgaggtgtacaagatcatagaaaaagtggattacccaagagacgagaatggggagatagctgccatcatccaccctaatctacaggaccaggactggaaacctctccatcccggcgaccccatgttcctcactctggatggaaagactatccctctgggcggggactgcacagtgtatccagtcttcgtgaacgaggccgcttactacgaaaagaaagaagcgtttgccaaaacgaccaaactgacgctcaacgccaagtccatccggtgctgcctccac

SEQ ID NO: 7217 - DNA, 939 bp, Artificial Sequence
  Description of Artificial Sequence: Synthetic coding sequence
atgacatcatgccacattgccgaggaacacatccagaaggtggccatcttcgggggcactcacggcaatgagttgaccggtgttttcctcgtgaagcattggctggagaatggtgccgagatccagcgaactggccttgaggtgaagccattcatcactaacccccgggctgtcaagaagtgcacgcgctacatcgattgcgatcttaaccgcatcttcgatctcgagaacctgggcaagaagatgagcgaggatttgccgtatgaggtccgccgggcccaggagatcaaccacttattcggacccaaggactcggaggactcgtacgacatcattttcgacttacataacacaacttccaacatgggttgcacacttatccttgaagactcccgtaacaactttctcatccagatgttccactacattaagacctcgctggcgcctctcccgtgctacgtgtatctcattgagcacccctcactgaagtacgcgacaacccgcagcattgccaagtatccagtcggaatcgaggtgggccctcaacctcagggcgtattgcgggcggatatcctggaccaaatgagaaagatgatcaagcacgccctcgattttatccaccacttcaacgagggcaaagagtttcctccctgtgctatagaggtctataagatcatcgagaaagtggactacccccgtgatgagaacggcgagattgccgccatcattcatccgaacctccaggaccaggactggaaacccctccatccaggtgacccgatgttcctgaccctcgacggtaagaccattcccctgggcggggattgtaccgtttaccctgtcttcgttaacgaggccgcttactacgagaagaaggaggcctttgctaagactaccaagctgaccttgaacgctaagtcgattcgttgttgtcttcac

SEQ ID NO: 7218 - DNA, 939 bp, Artificial Sequence
  Description of Artificial Sequence: Synthetic coding sequence
atgacgagctgccatatagctgaagagcatatccagaaagtcgccatatttggaggcacccacggaaacgagttaactggcgtttttctcgtgaagcactggcttgaaaatggagctgagatccagcgaacgggcctggaagtgaaaccattcatcaccaacccaagggctgtcaagaagtgcaccaggtatatagattgcgacctgaaccgtattttcgacttagagaacctcggcaaaaaaatgagcgaggatttaccgtacgaggtgcggagagcccaggaaataaaccatttgttcggccccaaggactccgaagacagttacgatattatttttgacctgcacaacactacttccaatatgggatgcaccctgattctggaggatagtcgtaataacttcctgatccaaatgttccattacataaaaacttcccttgctcccctgccatgctacgtctatctcattgaacatccctcactcaagtacgctacgactcgcagtatcgcaaaataccccgttgggatagaggtgggacctcagccacaaggagttctcagggccgatattttggatcagatgcggaagatgatcaaacacgcgctggatttcatccatcactttaacgaaggcaaggaattcccaccctgcgctattgaggtatataaaatcatagagaaagttgattatccgcgggatgagaatggggagattgccgcgatcatccaccccaatctccaggaccaggactggaagcccttacaccctggagatcccatgtttcttaccttggatggaaagacaatccctttagggggggactgcacagtataccctgttttcgtgaacgaggctgcctattacgagaaaaaggaagccttcgctaagaccacaaaattaacactgaacgccaaaagtatcagatgttgcctccac

SEQ ID NO: 7219 - DNA, 939 bp, Artificial Sequence
  Description of Artificial Sequence: Synthetic coding sequence
atgacctcatgccacattgcagaagagcacatccaaaaggtcgccatcttcgggggcactcacgggaacgagctgaccggagtgttcttggtgaagcactggctggagaatggagccgaaatacagcggactgggctggaggtgaaaccgttcatcaccaacccgcgcgctgtcaagaagtgcacccggtacattgattgtgacctgaaccgaattttcgatctggagaatctcggcaagaagatgtctgaggacctcccttacgaagtgcggcgggcacaggaaatcaaccatctgttcggaccgaaggactccgaggactcgtatgatatcatcttcgacctgcacaataccactagcaacatgggatgcaccctcatcctggaggactcccggaacaactttctgattcagatgttccactatatcaagacctcactcgctccactgccgtgttacgtgtacctgatcgaacatccgtcgctcaaatatgccactactcgctcgatcgcgaaatacccagttggaatcgaagtcggaccgcagccgcagggtgtgctgcgagccgacatccttgatcaaatgcgcaagatgataaagcatgcactggatttcatccatcactttaacgagggaaaggagtttccaccatgcgcgattgaagtctacaaaatcattgagaaggtagactaccctagagatgaaaacggtgagatcgctgccattatccatccaaatcttcaagatcaggattggaagccgctccaccccggtgaccccatgtttctgacccttgacggcaagactattcctctcggcggcgactgcaccgtgtacccggttttcgtcaatgaggccgcatactacgaaaagaaagaagcatttgcaaaaaccaccaaactcactctcaacgctaagtccatccgctgctgtctccat

SEQ ID NO: 7220 - DNA, 939 bp, Artificial Sequence
  Description of Artificial Sequence: Synthetic coding sequence
atgacaagctgccatatcgccgaggagcatatccagaaggttgcgatctttggcggaacccacggcaacgaattgacgggcgtatttctggtcaagcactggctggaaaacggagcggagattcagcggaccggactggaagtgaaaccatttatcacgaatccacgcgcggtgaaaaagtgtacgaggtacattgattgcgatctgaaccggatattcgacctggagaatctaggaaagaaaatgtcggaggatttgccctatgaagtccggcgggcccaggagatcaatcatctgtttggcccgaaagatagcgaagactcatacgatatcatattcgatctgcacaacaccacgtcgaatatgggctgcaccctgattctcgaggatagccgcaacaactttctaattcagatgttccactacattaaaacatccttggcgcccctgccctgctatgtgtatttgatcgagcacccatctcttaaatacgccactacgcgttcgatcgccaagtacccagtcggaattgaggtgggcccgcagccccaaggtgttctgcgagcggatatccttgatcaaatgaggaaaatgatcaagcacgcgttggacttcatacaccactttaatgagggaaaggaattccccccgtgcgctatagaggtctacaagatcatagagaaagtcgattatccacgtgatgaaaacggcgaaatcgctgctattattcaccccaatcttcaggatcaagactggaagcccctgcatccgggagaccccatgttcctcaccctcgatgggaagaccataccgttgggcggcgactgtaccgtgtacccagtgtttgttaacgaagccgcctactacgagaagaaggaggcctttgccaaaacgacaaagcttaccctgaacgccaaatcgatccgatgttgtctgcac

SEQ ID NO: 7221 - DNA, 939 bp, Artificial Sequence
  Description of Artificial Sequence: Synthetic coding sequence
atgacttcgtgccatatcgccgaggaacatatccagaaggtggcaattttcggcggcacccacgggaacgagctgaccggagtgttcctggtgaaacactggctcgaaaacggggccgaaatccaacgaacgggtctggaagtgaagccctttatcactaatcctagggcggttaagaagtgcactagatacatcgactgtgacctcaataggatttttgaccttgaaaatctcggcaagaagatgagcgaggacctgccgtatgaagtgcggcgcgcacaggagatcaaccaccttttcggaccgaaggattctgaggactcctacgacatcatattcgatctgcacaataccacttcaaacatgggttgtaccctcatattggaggattcccggaataacttcctgattcagatgttccattacatcaaaacctccctcgcaccacttccttgctacgtgtacttgatcgaacatccgagcttgaagtacgccactacgcgctcgatcgctaaatacccagtgggcatcgaagtgggaccccagccacaaggtgttctgcgcgcggatatcctggatcagatgcgcaagatgatcaagcatgcgctggactttatccaccatttcaacgagggaaaggagttcccgccatgcgccattgaagtgtacaagattatcgaaaaagtcgactacccgcgggatgagaacggagaaatagcggctatcatccatccaaatctccaagaccaggattggaaacctttgcacccgggcgacccaatgtttctgaccctcgacggtaaaactatcccgctcgggggagattgcaccgtgtacccagtgttcgtgaacgaggccgcctactacgagaaaaaagaagcgtttgccaagacgactaagctgaccctcaacgcaaagtcgatcagatgctgtctccac

SEQ ID NO: 7222 - DNA, 939 bp, Artificial Sequence
  Description of Artificial Sequence: Synthetic coding sequence
atgacttcctgtcatatcgcagaagaacatattcaaaaggtagccatctttggaggcacacacggtaatgagctgaccggcgtgtttctggtaaagcactggttggagaacggggccgagatacagcgcactgggctggaggttaagccatttatcaccaaccctagagctgtcaagaaatgcacaagatacatagattgtgatctgaaccggatcttcgacctggagaacctgggaaaaaagatgagtgaggatctcccctatgaggtgaggcgtgcccaggagataaatcatctatttgggccaaaagattctgaggactcgtacgatattatctttgaccttcataacacaacgtcaaatatgggctgcacactgattctggaggattcacgcaataactttctgatacagatgtttcattacatcaaaacttcactagccccactcccgtgctatgtgtacctgatcgaacatccgtctttgaaatatgccactacccgcagcatcgctaaatatccagtgggaattgaagtcgggcctcagccacaaggagtcttgcgggccgatattctggaccaaatgaggaagatgattaaacacgccctggatttcatacatcatttcaatgaggggaaggagtttcccccttgcgccatcgaggtgtacaagatcatagagaaggtggattaccctcgggacgagaatggcgagatcgctgccataatccaccctaatttgcaagaccaggattggaagccacttcaccccggagatccgatgtttctgaccctcgacggtaagacgatacctctgggcggagattgcacagtttatccagtttttgtaaatgaggccgcatactacgagaagaaagaggcatttgccaagacaaccaaactgaccctgaacgcaaagtcgataaggtgctgtcttcat

SEQ ID NO: 7223 - DNA, 939 bp, Artificial Sequence
  Description of Artificial Sequence: Synthetic coding sequence
atgacttcgtgtcatattgctgaagaacatatccaaaaggtcgcgatttttggaggcactcacggaaacgaattaactggtgtttttctagtaaaacactggctggaaaacggagccgagatccagcgtaccggtctggaagtcaaaccttttattacaaatcctcgcgccgtcaagaaatgtacaaggtacattgactgcgatctgaaccgtatttttgatctggaaaacctgggaaagaagatgtctgaggacctcccttacgaagtccgtcgggcccaggagatcaaccatctgtttgggcctaaggattctgaagacagctacgatattatctttgacctgcataataccactagcaatatgggttgcactcttatcctcgaagactctcgcaacaattttctaatccagatgtttcattacattaagacatctcttgcccccttgccttgttatgtatacttgattgagcatcctagtttaaagtatgccaccacccggtctatagccaagtatccggtgggaattgaagttggtcctcaaccccaaggcgttttacgggcggatatactcgaccaaatgcggaagatgatcaaacacgctctcgacttcatccaccactttaatgagggaaaggaatttcctccctgtgctattgaagtgtataagataatcgagaaggtggactatcctagggatgagaacggggagatcgcagcaataatccaccccaatctccaggatcaggattggaaacccctccaccccggagatcctatgttcctgacactcgatgggaagactatacctctggggggggattgcaccgtgtaccctgtgtttgttaacgaggccgcatattatgagaagaaagaagccttcgccaaaaccaccaaactgactctcaacgcgaaaagcatccggtgttgcttgcac

SEQ ID NO: 7224 - DNA, 939 bp, Artificial Sequence
  Description of Artificial Sequence: Synthetic coding sequence
atgactagctgtcacatcgcggaagagcacattcagaaagtcgcaatcttcgggggcactcatggtaacgaactgaccggcgtgttcctggtcaaacactggctggagaacggagccgagatccaaagaaccggactggaggtgaagccgttcataactaacccacgggccgtcaagaagtgcaccaggtacatcgactgtgatctgaacagaattttcgacctggagaacttgggaaaaaagatgtccgaggacctcccgtacgaggtgaggcgagcccaagaaattaaccacctcttcggccctaaagattccgaagactcctacgacatcatcttcgatctgcacaacactacttctaatatgggatgcaccttgatccttgaggactcgagaaacaattttctgatccaaatgttccattacattaagacgtcactcgctccactcccctgttacgtctacctgatcgaacacccctccctgaagtacgccactacgcggtctatcgccaagtatccggtcggaatcgaggtgggaccccagccacaaggtgtgttgcgcgcggatatcctggaccagatgcgcaagatgatcaaacacgctctcgatttcatccaccatttcaatgagggcaaagaattccctccgtgcgcaatcgaagtctacaaaatcatcgagaaggtggattacccgcgtgacgaaaacggagaaattgcagcgatcatccacccaaatctgcaggaccaggattggaagccgcttcaccctggggacccaatgttcctgaccttggacggaaaaactatcccgttgggcggagactgcactgtgtacccagtgttcgtgaacgaagcggcgtactacgagaaaaaggaggcgttcgcaaaaactaccaagctgactctgaatgcgaagtcgatccggtgctgtctccac

SEQ ID NO: 7225 - DNA, 3753 bp, Artificial Sequence
  Description of Artificial Sequence: Synthetic coding sequence
atgtccacggaacgggattctgaaaccaccttcgatgaagattcccagcccaatgatgaagtcgtgccctacagcgatgatgaaaccgaggatgaactggatgaccagggttccgcggtggaaccagaacaaaatcgtgttaaccgcgaggcagaagaaaaccgggagccgtttagaaaggagtgtacttggcaagtcaaagcgaacgatcgcaaatatcatgaacaacctcatttcatgaacactaagtttctgtgcatcaaggaatcgaagtatgctaataacgccattaagacttataagtacaacgcctttacctttatcccgatgaacttgtttgaacagtttaaacgcgcggcaaatctttactttcttgcacttctcattctgcaagcggtgccacaaatttcaaccctcgcgtggtacactactctcgtgcccctgcttgtagtgcttggagtcactgcaatcaaagacctggtggacgatgttgcaagacataagatggacaaggagattaacaataggacttgtgaagtcattaaagatggaagatttaaggtggccaagtggaaggaaatccaagtaggcgatgtgataaggttgaagaagaatgactttgtgcccgcggacattctgctccttagctcgagcgaaccgaattctctttgctacgtggaaactgctgagctggatggtgaaaccaaccttaagtttaagatgtcgttggaaatcaccgatcaatacctgcagagagaggatacccttgcaacctttgatggctttatagagtgtgaagaacctaataaccgtctggataagttcactggaacccttttttggcgaaacacttctttcccccttgatgccgacaaaattctgctccgcggttgtgtcatacggaatactgatttctgccatggcctggtgatctttgcaggagcagataccaagattatgaaaaactcgggaaaaacccgctttaaacgtacgaagattgattatctgatgaattacatggtgtacactattttcgtggtcctgatactcctgtcggcaggtctggcaatcggccacgcctactgggaggcccaagtcggaaattcctcgtggtatctgtacgatggagaagatgacaccccctcgtatagaggcttccttatcttttgggggtacatcatcgtgttgaatactatggtgcctatcagcctgtacgtgagcgtggaagtgattcgcctgggccagtcgcacttcattaactgggaccttcaaatgtactatgccgaaaaggacactccagccaaggcccgaacgaccaccctgaacgagcagttgggtcagatccactacattttcagcgacaagactggaactctgactcaaaacatcatgacgttcaagaagtgttgtattaacggtcagatctatggagatcatcgtgatgcctcccaacataaccataacaagattgaacaagtggatttttcctggaacacttacgcagacggcaagttggcattttacgaccactaccttattgaacagatccagagtggaaaagagccagaagtcaggcaattcttcttcctgcttgccgtctgtcacaccgtcatggtggacaggaccgatggacagctgaattaccaagccgcttccccggacgagggcgcgttggtcaacgccgcaagaaatttcggttttgcttttcttgccagaactcagaacactatcaccatttcggaattgggaactgaacggacctacaacgtgctcgccatactcgactttaacagcgatagaaagcggatgtcaattatcgtgagaacccctgaaggtaacattaagttgtactgtaagggggcggacaccgtgatttacgaaagacttcaccgcatgaacccaaccaagcaagagacgcaggatgcattggacatctttgcaaatgagactctgcgaaccctctgcttgtgctacaaagagatagaggagaaggaatttacggagtggaacaagaaattcatggcagcctcagtcgcgagcactaaccgggatgaagcgcttgataaggtgtacgaggaaatcgaaaaggacctcatcctccttggggccactgctatcgaagataagctgcaagatggagtgccagagactatatcgaaacttgcaaaagcagacattaagatttgggtgctcacgggcgacaaaaaggaaactgcagagaacattgggtttgcctgtgaactgcttaccgaagatacgaccatttgctacggagaagatatcaactcacttcttcacgcacggatggagaaccagagaaatagaggaggggtgtacgctaagttcgcgcctccagtgcaagagagcttttttccaccgggaggtaaccgagcgctgattatcactggttcctggctcaatgagattctgttggaaaagaaaaccaaaagaaataagattcttaagctgaaattcccaagaactgaagaggagaggagaatgcggactcagtccaaacgtaggcttgaagcaaaaaaggaacagcgccagaagaacttcgtggatctcgcatgcgaatgttcggcagtgatctgttgtagggtcacccctaagcagaaagcaatggtggtagatctcgtcaagcgctacaaaaaggctattaccttggcaattggggatggcgcaaatgatgtcaatatgattaagaccgcacatatcggtgtcgggatttcgggtcaagaaggaatgcaagcagtgatgtcatccgactactcgtttgcacaatttcgatacctgcaacggcttctcttggtgcatggacgttggtcgtacatcaggatgtgtaagtttctgcgatactttttctacaaaaactttgcatttacccttgtccatttctggtattcatttttcaacggatactcagcccagaccgcgtacgaggactggtttatcaccctgtacaacgtgctgtacacctcccttcctgttcttctcatgggactgctcgatcaagacgtgtccgataagttgtccttgagattccctgggctttacattgtgggccagcgagatctgctgttcaactacaagcggttttttgtttcgttgttgcatggtgtactgacctccatgatcctgtttttcatccctctgggtgcataccttcagaccgtgggacaagacggtgaagcaccgagcgactaccagtccttcgcagtcaccattgcatcagcgttggtcattactgtcaatttccagataggtctggatacttcgtactggacctttgtgaacgccttctcgatttttggaagcatcgcactctactttggcataatgtttgactttcattcggcaggaatacacgtgctttttccctctgcttttcaattcaccggaactgcctcaaacgcactccgacaaccttacatctggctgacgatcattctggccgtggccgtgtgccttctccctgtcgtggcaattagatttctgagtatgaccatctggccaagcgagtcggataagattcaaaagcatagaaaacggctcaaggcggaagaacagtggcaacggagacagcaagtgttccggcggggtgtgtcaacccgcaggtcagcatacgcattctcccaccagcgagggtacgctgatttgattagcagcggcaggagcatccgcaaaaagcggtccccgctcgacgccattgttgcagacgggactgcagagtaccgccgcaccggagattcg

SEQ ID NO: 7226 - DNA, 3753 bp, Artificial Sequence
  Description of Artificial Sequence: Synthetic coding sequence
atgtctactgaacgagactctgaaactacgttcgatgaggattcccagcctaacgatgaagttgtaccctactctgatgatgaaactgaagatgaacttgatgaccagggatcagctgtcgagcccgagcaaaatagggtgaacagagaggccgaagaaaaccgcgaacccttccggaaggagtgcacctggcaagtaaaggccaatgaccgtaaatatcacgagcagccccacttcatgaatactaagttcctgtgcatcaaagagagtaaatacgccaataacgccatcaaaacatacaaatacaacgcattcaccttcattccaatgaatctgtttgagcaatttaagcgagcagccaatctgtatttcttagccctgcttatactgcaggcagttccccagattagcacactagcttggtataccactctggtccctctgctggtggtgttgggggtaaccgcaattaaggacctggtagacgatgtagccagacataagatggataaggaaatcaataatcggacgtgtgaagtcattaaagatggtcgctttaaggtggctaagtggaaggaaatccaggtaggcgacgttattcgcctcaagaagaacgatttcgtgccagccgacatcctgcttctgagttcgagcgagcccaactctctctgttatgtagaaacggcagagttagacggcgaaactaatctgaaattcaaaatgtctctggagatcaccgatcagtacctccagcgggaagatactctggccactttcgacgggttcattgaatgcgaagaacctaacaatcggctcgacaagttcactgggaccctattctggagaaataccagctttccccttgatgctgataagatactgctgcgcgggtgcgtgatcagaaacaccgacttctgccacggtttggtgattttcgcgggggctgacaccaagatcatgaagaattcagggaagaccagatttaaacgcacgaaaatcgattatttgatgaactacatggtgtatactatctttgtggtactgattctgctctcagctgggctggccattggtcacgcttattgggaagctcaagtaggcaattctagctggtatctgtatgacggcgaagacgacacaccatcatataggggtttcctgatcttttggggctatattattgtcctgaataccatggtgcctatttcgctgtatgtgtctgttgaagttatcaggctggggcagagccacttcattaactgggacctgcagatgtactacgctgagaaagacacaccagcgaaggctcgaactactaccctaaatgagcagcttggtcagatccattatattttttctgataaaacgggaactttaacacaaaatattatgaccttcaagaagtgctgcattaacggtcagatttacggagaccatagagacgcttcccaacacaaccataataaaatcgagcaggtggacttcagctggaacacctatgccgatggcaagctggctttttatgaccattacctgattgagcagatccagagtgggaaggaacctgaggttcggcagtttttctttcttctggccgtatgtcacacagttatggttgatcgaacagacggccagctcaattatcaagccgcttccccagatgaaggcgcattggtcaacgctgcgaggaacttcggctttgcattcctcgctcgcacgcagaacacaatcaccataagcgagctcggtacggagcgaacctataacgtgctcgccatactcgattttaacagtgatagaaagcgcatgtccataatcgtgcgcacccctgagggtaacattaaactatactgcaagggtgctgatacagtgatttacgaacgattacacaggatgaaccccaccaaacaggaaactcaggatgccttagatatcttcgcaaatgaaacgctgaggacgctgtgtctttgttataaggagatcgaagaaaaggaattcactgaatggaataagaaattcatggctgcatctgtcgcttcaaccaatagggatgaggctttagacaaggtgtatgaagaaatcgagaaggacctcatcctgcttggcgcaacagcgatcgaagataaactgcaggatggcgtgcctgaaaccatctcaaagctggcgaaggccgacatcaaaatttgggtgctcacaggagacaaaaaagaaaccgcagagaacattggcttcgcgtgcgaactgctgactgaggataccacaatctgctatggcgaggacatcaacagcctattgcatgcgcggatggagaatcaacggaatcgtgggggagtgtacgccaagttcgctcccccagtgcaggagtcgttctttcccccaggcggcaacagggccctgattatcacggggtcctggctcaacgagatcttgttagagaagaaaactaagaggaacaaaatcctcaagttgaaatttcccaggactgaagaagaaaggagaatgcgcacgcagagtaaacgccggctggaagcgaagaaggaacagcggcagaaaaatttcgtagatctggcatgcgaatgctctgcggtgatatgttgccgagtgacccctaagcagaaagcaatggtcgttgaccttgttaagcgatacaagaaggccattactctggccattggagatggggctaacgacgtgaacatgatcaaaactgctcacattggggtgggaataagtgggcaagagggcatgcaggcagtgatgtccagtgattacagcttcgcccagttcaggtatctgcagagactcttgctggttcatgggcggtggtcttacatcaggatgtgtaagttccttaggtacttcttttacaagaacttcgcattcaccctggtgcatttctggtactcattcttcaacggctactctgcgcagaccgcctatgaagactggttcatcacactgtacaacgtgttgtacacttcgttaccagtcctgctcatggggttgctcgaccaggacgtgagtgacaaacttagcctaaggtttcccggtctgtatatcgtgggacagagggacctgctgttcaattacaagaggttttttgtttctcttctacatggggtgctgacctctatgatcttattttttattcccctgggtgcatatctgcagactgtcggtcaggatggggaagcccccagtgactaccagagtttcgccgtgacaatcgcgtcagctttagtaatcaccgtgaactttcagatcgggcttgataccagctattggacctttgtgaacgctttttcaatttttggaagcatagctctttattttggcattatgtttgacttccacagtgctgggatccatgtattgtttccctctgcctttcaatttacaggtacagccagcaatgctttgcgccaaccttacatctggctgaccatcattctcgctgtggccgtgtgtctgctgccagttgtcgctattcggtttctttcgatgaccatttggcctagcgaatctgataaaatacagaaacaccggaagcgcctgaaggctgaggaacagtggcagcgccgtcagcaagtgttcagacggggcgtgtctacgcggagatctgcctacgcatttagtcaccagcgaggctacgccgatcttattagttctgggaggagcattagaaagaagagatccccgctggatgccatcgtcgcagacggcacagccgaataccggagaaccggagacagt

SEQ ID NO: 7227 - DNA, 3753 bp, Artificial Sequence
  Description of Artificial Sequence: Synthetic coding sequence
atgagcactgagcgcgatagcgaaaccacgtttgatgaagatagccagcctaatgatgaagtggtcccgtactcggacgacgaaaccgaagatgaactggacgaccaaggatcagcagtggagcccgaacaaaaccgggtgaaccgggaagcggaggaaaatcgcgagcctttcagaaaggagtgtacctggcaggtgaaagcgaacgatagaaaataccatgaacagcctcatttcatgaataccaaatttctgtgtatcaaagaatcgaagtacgcgaataatgcaattaagacgtacaagtacaacgcgttcaccttcattccgatgaacctcttcgagcagtttaagcgggccgcgaacctgtacttcctcgccctcctgatcctgcaagcggtgccccaaatctcgaccctcgcgtggtacactaccctcgtcccgctgctggtggtcctgggagtgacggccataaaagatctcgtggacgatgtcgctcggcacaagatggacaaagagatcaataacagaacctgcgaggtcatcaaagatggaagatttaaggtggccaagtggaaggagattcaagtcggagacgtgatccgcctgaaaaagaacgactttgtgccggcggatatcctgctgctctccagctcagaaccaaactcgctgtgctacgtggaaacggccgagctggacggagaaactaacctgaagttcaaaatgtcgcttgaaatcactgatcagtacctccaacgggaggacactctcgccactttcgacggattcatcgagtgcgaggaaccaaacaatagactggacaagttcacggggacccttttctggcgcaacacttcttttccactggatgcagacaaaattctcctgcgagggtgtgtgattaggaacactgatttctgccacggactggtcatctttgcaggagcagacactaaaatcatgaagaactcggggaaaactcgctttaagcggaccaagatcgactacctgatgaactacatggtctacaccatcttcgtggtcctgatcttgctgtccgcgggactggctatcgggcacgcctactgggaggcacaagtggggaacagctcgtggtacctgtatgacggagaggacgatacgccgagctaccggggcttcctgatcttctggggatacatcatcgtcctcaacaccatggttccaatctccctttatgtgagcgtcgaagtgattcggctgggacagagccacttcatcaactgggacctgcagatgtactacgcggaaaaagacactccagccaaggcgcggaccaccaccctgaatgaacagcttgggcaaattcattacattttctccgataagaccggcaccctgactcagaacatcatgaccttcaaaaagtgctgcatcaacggacagatctacggggaccaccgggacgcctcccaacataatcacaataagattgagcaagtggacttttcttggaacacctacgcggacggaaagctggcattttacgaccattacctgatcgagcagatccagtcaggaaaagaaccagaggtgcggcagtttttctttctgttggccgtgtgccacactgtcatggtggatagaaccgacggccagctgaactatcaggctgcttcgcctgatgagggagccctcgtgaatgcggcacgcaacttcggtttcgcgttcctcgccagaacccagaataccatcacgatctccgagctcggcacggagcgcacctacaacgtgttggccattctggatttcaattcggatcggaaacgtatgtccatcatcgtgcggaccccggaaggtaacatcaagctctactgtaagggagcagacaccgttatctacgaacggctgcaccggatgaaccctaccaagcaagaaactcaggatgctctcgatatcttcgcaaatgagactctgcgcaccctctgtctgtgttataaggaaattgaagaaaaggaattcaccgaatggaataagaaattcatggcagcctccgtggcgtctaccaacagagacgaagcgttggacaaagtgtacgaagaaatcgagaaggatctgatcctcctgggagccactgccatcgaagataagctgcaggatggagtcccggaaactatctcgaagctcgccaaagcagacatcaaaatctgggtgttgactggagataagaaggaaacggcggaaaacattggattcgcctgtgaactgctgactgaggacacgactatctgctacggtgaggacattaacagcctgctgcacgcacggatggagaaccagcgtaatagaggaggcgtgtacgcaaagtttgctccccctgtgcaggaatcattcttcccgcccggcggcaaccgggccctcatcattactggctcatggctgaacgagatcctgctggagaagaaaactaagcgcaataagatcttgaagctgaagttcccccgcaccgaagaggaacggcgtatgcgaacgcagtcgaaaagaaggctggaagccaagaaggaacagcgccagaagaacttcgttgatctcgcctgcgaatgttccgccgtcatctgttgcagggtgactccgaagcagaaggcgatggttgtggacctggtcaagaggtacaagaaggcaatcaccctcgccataggcgacggagcgaatgacgtgaatatgatcaagaccgcacatatcggcgtgggcattagcgggcaggagggcatgcaagccgtcatgagctcagattactcattcgctcaatttcggtacctccagcggctgctgcttgtccacggacggtggagctacatccgcatgtgtaagttccttaggtacttcttttacaagaattttgccttcacgttggtgcacttttggtactcctttttcaacggatacagcgcccagacggcgtacgaggactggttcatcactttgtataacgtgttgtacaccagcttgcccgttctcctgatggggctcctcgaccaggacgtgtccgacaaattgtcccttcgattccccggcctgtatatcgtgggtcagagagatcttctgttcaactacaaacggttcttcgtatcgctcctccacggagtcctgacctcaatgatcctgttcttcatcccactgggagcctaccttcaaactgtgggccaagacggtgaggcaccgtcggactaccagtcgtttgccgtgacgatcgcaagcgcgctggtcatcaccgtgaacttccagatcggcctggacacgtcttattggactttcgtcaacgccttttcaatcttcggtagcatcgccttgtactttggaatcatgtttgatttccattcggccgggattcatgtgctcttcccctcggcattccaatttaccggtaccgcttccaatgccctccggcaaccgtacatctggctcactattatcctcgcggtggcggtgtgcttgctcccggtcgtggctatccggtttctctcgatgacgatttggccgtccgagtcggacaaaatacagaagcaccggaagagactgaaggctgaagaacagtggcagcggcggcagcaggtctttcgccggggcgtctccactagacggtccgcctacgctttttcacaccaaaggggatacgcagacctcatcagctcaggaaggtcgatccggaagaagcgttcaccgctcgatgctatagtggctgacggtactgccgagtaccggcggactggagactca

SEQ ID NO: 7228 - DNA, 3753 bp, Artificial Sequence
  Description of Artificial Sequence: Synthetic coding sequence
atgagtacagagcgagattcagagaccacctttgatgaagactcacagccaaatgacgaggtcgtgccttactccgacgacgaaacagaggatgaacttgatgaccaggggagcgccgtggagcctgagcagaatcgggttaatagagaggcagaggagaaccgagagccgtttcggaaagaatgcacttggcaggtgaaagctaatgaccgcaaatatcacgaacagcctcattttatgaacaccaaattcttatgtatcaaagaatcaaaatatgccaataacgcgattaaaacctataaatacaatgctttcaccttcataccaatgaacctgttcgagcagttcaagcgcgctgctaacttatacttccttgccctactgatattgcaggctgtacctcagatctctactctagcatggtacactacccttgtccctctccttgtggtgctcggcgtcactgcaattaaagacttggtggacgatgtggctagacataagatggacaaggagattaataaccgcacctgcgaggtgattaaagatggtcggtttaaagtggccaagtggaaggagatccaggtcggggatgtgatcaggttaaagaagaacgactttgtacccgcggatattttgctgctgtcgtccagtgagcccaattccctgtgttacgttgagacggctgagttggatggggagaccaacctgaagttcaagatgagtctggaaataacagaccagtacctgcagcgggaagacaccttggcaacttttgacggttttattgagtgtgaggagccaaacaatcgtctggataaattcacaggaaccctcttctggcgtaacacatcctttccgctggacgccgataagatcctgctacgcggatgtgtgataagaaatacagacttttgccatggattagtcatcttcgctggggctgacactaagattatgaagaactcaggtaagacgaggttcaagaggacgaaaattgattacctgatgaattatatggtgtacacaattttcgtggtcctgatccttctgagcgcaggattagccatcggacatgcttattgggaagcccaggtgggcaactcatcttggtatttgtacgacggcgaagatgacacaccttcctaccggggattccttattttttgggggtacatcatcgtgctgaacactatggtgccaatcagcctttacgtaagcgtcgaagttatcaggctgggacagagccatttcatcaattgggacctgcagatgtattacgcggaaaaagacaccccggccaaagctcgcacaaccaccctgaacgaacaactgggccaaatccattacatcttctcagataaaaccggtaccctcactcagaatattatgaccttcaaaaagtgttgcataaatggccagatctacggcgaccatcgcgatgcaagtcaacataatcataacaagattgaacaggtcgactttagctggaatacctacgctgatgggaagctggctttctacgaccactacttgattgagcagatccagtccggcaaggagccagaggttcggcagtttttcttccttctggccgtgtgtcataccgtgatggttgacagaaccgacggccaactgaactatcaggccgctagtcccgacgaaggggccctggttaatgctgcccggaattttggcttcgcattcctcgctaggacccagaatacaatcaccatttccgagctcggtaccgaacgaacatataacgtgctggcaattctggacttcaattccgatcgtaaacggatgtctatcattgtaaggacaccagaagggaatatcaaattgtattgtaaaggtgctgacactgtgatttacgaaaggttgcatcggatgaatccaacaaagcaggaaactcaggatgccctggatatctttgcaaatgaaaccctgcgaaccctctgcttgtgctacaaggagatcgaggagaaagagtttactgagtggaacaaaaagttcatggccgcatctgtggccagcacaaaccgggacgaagctcttgataaggtctacgaggagatagagaaagacctgattctgttaggcgccactgccatcgaggacaaactgcaagatggcgtacccgagactatctcaaaactggccaaggctgatataaagatttgggtcctaacaggagataagaaggagactgcggagaacattgggttcgcatgtgagcttctgaccgaggacaccacaatctgctatggcgaagacatcaattcattactgcatgcaaggatggagaatcagcggaacaggggaggagtgtatgccaaattcgctcctcctgtacaggaatctttctttccacctggcggaaacagagccttgattatcactggtagctggctaaacgagatcttgctggagaaaaaaaccaagcggaacaagattttgaagctaaagttcccccgcacagaggaggaacggcgcatgcgcacccagtcgaagagaaggctcgaggctaagaaggaacaacgtcaaaaaaatttcgtcgatttggcttgtgagtgttccgccgtcatctgctgcagggtaacccccaaacagaaggccatggtagttgatttggttaaaagatacaaaaaggctattacactggcaataggggacggggcgaacgacgtgaatatgatcaagacagcccatataggggtgggaattagtgggcaggagggaatgcaggccgttatgtccagcgattacagtttcgcccagtttagatacctgcaaaggctgctattggtccatgggcggtggagctacatccggatgtgtaaattcctacgatactttttctataagaatttcgcgttcacccttgtgcatttttggtacagtttcttcaacggatactctgctcaaacggcgtatgaagattggttcatcactctgtacaatgtgctctatactagcctgccagtcttattgatgggcctcttggatcaggacgtgagcgataaactgtcacttaggtttccgggtctgtatattgtcgggcagcgggacctcctgttcaattataaaagatttttcgtttcactcctccacggtgttctcacctctatgatcctatttttcataccactcggtgcgtacctgcagaccgtgggccaggatggtgaagccccctctgattaccagtctttcgctgtaacaatcgctagcgcactggttatcaccgtcaactttcagatcggactggacacatcatactggaccttcgtcaacgctttctctatattcgggtccatcgctttatatttcggaatcatgttcgactttcactccgctgggattcatgtcctgttcccatcagcctttcagtttacaggtacagcgtccaacgcgctgcggcagccatacatctggttgaccattattctggcagtggctgtttgcctgctaccagtcgttgcaattcggtttttgtccatgactatatggccaagtgagagcgacaagattcagaagcatagaaagagactcaaggcggaggagcagtggcagaggaggcagcaagtctttcgccgcggtgtcagtacacgccgcagtgcgtacgccttctctcatcagcgcggctacgccgatttgatttctagtggacgtagtatccgaaaaaagagatcacccctggacgcgatagtggctgacgggaccgccgaatacagaagaaccggtgactct

SEQ ID NO: 7229 - DNA, 3753 bp, Artificial Sequence
  Description of Artificial Sequence: Synthetic coding sequence
atgtcaaccgagagagatagcgagacaaccttcgacgaggacagccaacccaatgatgaagtggtgccatatagcgatgacgaaaccgaggacgagctcgacgaccagggctctgccgtggaacccgagcagaatcgggtgaaccgcgaagccgaggagaacagagaacccttccgaaaagagtgtacttggcaggtgaaagctaatgacaggaagtatcacgagcagcctcacttcatgaataccaaattcctgtgcataaaagagtctaaatacgcgaacaatgctattaagacatacaagtacaatgccttcacattcatccctatgaatctgtttgagcagttcaaacgggccgccaacctgtacttcctggccctcctcatcctgcaggcagtgccccagatttccacactcgcttggtataccaccctcgtccccctgcttgtcgtcctgggcgtgaccgccattaaggatttggtggatgacgtggctaggcacaagatggataaggagataaataatcgaacatgcgaagtcattaaggacggccgatttaaagtggcaaaatggaaggaaatccaggtcggcgatgttattcggttgaagaaaaacgattttgttccagccgatatcctgctgctgtcttcctccgaacccaatagcctctgctatgtcgagacggctgagctcgacggggaaactaaccttaaattcaagatgagcttggagatcaccgaccagtatctgcaaagagaggataccctcgcaacctttgacggcttcatcgagtgcgaggagcccaataatcgcctggataagttcaccggcacactcttctggcgaaatactagcttccccctggacgccgataagatactgcttcggggctgtgttatccgaaacacggacttttgccatggtcttgtgatcttcgcgggcgccgataccaagattatgaagaacagcgggaagactcgctttaaaagaacaaagatcgattacctcatgaattatatggtttatactatcttcgtggtactgatcctgctgtccgcagggttggccatcggtcacgcttactgggaggcacaagtggggaattcctcatggtatctgtatgacggggaggacgacacaccaagctaccgcggattcctcatattttggggctacataatcgttctgaataccatggtgcccatttctttgtacgtcagcgtcgaagttattcgccttggtcagtcacatttcattaactgggatcttcaaatgtactacgccgagaaggacacaccggccaaagcgaggactaccacgctcaatgaacagttgggccagattcactacatattctcagacaaaaccggaaccctgacccagaatatcatgacattcaagaagtgttgcatcaatggccagatttacggggaccaccgggacgcttcacaacataaccataataagattgaacaggtagatttttcctggaatacatacgccgatgggaagcttgccttctacgaccactacctgattgagcagatacagtcaggtaaagagccagaggtgcggcagttcttcttcctgctcgccgtttgtcacacggtgatggtggaccggactgacggtcagttgaattaccaagccgcctcccctgatgaaggggcccttgttaacgctgccaggaatttcggattcgctttcctcgctcgaacacaaaataccataactatcagtgaactggggacggaaaggacctacaatgtgttggcgattttggatttcaacagtgatcgcaagaggatgtctatcatagtgaggacaccagagggcaacatcaagctgtattgcaaaggtgcagatacagtcatctatgaacgcctccatcgcatgaaccccacaaaacaggaaacccaggacgcgctcgacatattcgccaatgagactcttcgcactctctgcctttgctataaagagatcgaggaaaaggagtttacagagtggaacaagaaatttatggccgcatccgtggcaagcaccaatcgggacgaggcgctggacaaggtgtatgaggaaatcgagaaagacctgatccttctgggggccaccgccattgaggataagttgcaggacggggtcccagaaactataagtaaactcgcaaaagcagacattaagatttgggtattgactggggacaagaaagaaaccgcagagaatattggctttgcatgcgaacttctgacggaggatacgacaatttgctatggagaggatatcaacagtctgctccacgcccggatggaaaatcagcgcaatcggggtggggtctacgcaaagttcgccccccccgtacaagaaagcttcttcccacccggtgggaaccgggctctgattatcacaggttcctggctgaacgagatcctcttggagaagaaaacaaaacgcaacaaaatcctgaaactcaagttcccacgcacagaagaggagagaagaatgagaacacagagcaagcgcagactcgaggccaaaaaggaacagcggcagaagaatttcgtcgacctggcctgcgagtgctcagccgtgatatgttgccgggtgacgcctaagcagaaggctatggtagtggacctggtgaagagatacaaaaaagctattactcttgccatcggcgatggcgcaaacgacgtcaatatgattaaaacggctcatattggtgttgggatcagcggtcaggagggcatgcaagctgtgatgagtagcgattattcattcgctcagttcagatatctgcaacgactgctgttggtgcatggccggtggagctacatccgcatgtgcaagttcctgagatacttcttttacaaaaactttgcatttacccttgtgcacttctggtacagcttttttaatgggtattccgctcagaccgcgtatgaggactggtttatcaccctttataacgttctttatacttccctccctgttctgctgatgggtcttctggaccaggacgtatccgacaagctgagtctccgattccccggcctgtacatcgttggacagcgggatctgctgtttaattataagagattcttcgtgagcctgttgcacggcgtgcttactagcatgattctgttcttcattccgctcggcgcctatcttcagaccgtggggcaagatggagaagcgcctagtgattatcagtcctttgctgtgacaatcgcatcagctctggtgatcacagtgaactttcagattgggctggacactagctattggactttcgtcaatgcattctccattttcggttctatcgcgttgtactttggcattatgtttgacttccattccgcaggcatccacgtgctgtttccatcagccttccaatttaccggaacggcatccaatgcgcttcgccagccgtatatttggctcacgataattcttgccgtggcggtttgcctgctgcccgtcgtggctatccgcttcttgtctatgactatctggccaagtgaaagtgataagatacagaagcatcggaagagactgaaagcggaggaacagtggcagcgaagacagcaagtgtttcgcagaggtgtgtctacgcgacggtctgcatatgcgttctctcatcaaagagggtacgccgaccttatctcttcaggtagatcaattcggaagaaaaggtctccactggatgcgatcgtggccgatggtactgcagagtacagacgaactggagacagt

SEQ ID NO: 7230 - DNA, 3753 bp, Artificial Sequence
  Description of Artificial Sequence: Synthetic coding sequence
atgtctactgagcgggatagcgagactaccttcgacgaagacagccagccaaacgatgaggtggtgccctattccgatgacgaaactgaggacgaacttgatgatcagggctcagcagtagagccagagcagaaccgggtaaatcgggaggctgaggaaaatcgagaaccttttagaaaagagtgtacctggcaggtgaaagctaacgatagaaaatatcacgaacagcctcatttcatgaacaccaaatttctctgcatcaaagagtctaaatacgccaataatgcaatcaagacatataagtacaatgcatttacattcattccgatgaacctattcgagcaattcaaacgggccgcgaacctgtattttcttgccttgctgattttacaggcagttccgcagatttctactctggcgtggtataccacgctcgtgccgctgctggtggttctgggggtcacggccatcaaagatcttgtggacgatgtcgcgcgccacaagatggataaggagatcaacaatagaacctgtgaagtgatcaaagacggccgattcaaggtggccaagtggaaggagatccaggtcggcgacgtgatcaggttgaagaaaaacgattttgtccccgccgatatcttgctgttgtcatctagcgaaccgaactcgctctgttacgtggagacagccgagttagatggggagactaacctgaaatttaagatgtccctcgaaatcactgatcagtaccttcagagagaggataccctcgccacctttgatggcttcatcgaatgcgaggagcccaataaccggctggacaaattcactggcacactgttctggcgcaacacaagctttccgctcgatgcagataagattctgttgcggggttgcgtgattcgtaacacggatttttgccacggtctagtgatattcgcgggtgcagacacaaagatcatgaagaactcagggaaaactcgcttcaaacgtaccaagatcgattacctcatgaactacatggtctacacaatcttcgtcgtgctgattttgctgagcgctggtctggcgatcggccatgcatattgggaggcgcaggtcgggaattcctcatggtatctttatgacggagaagacgacacccctagctatcgcggctttctgatattctggggctatataatagtccttaatacaatggtgcccatctctttgtacgtgtcagtggaagttatccgcctgggacagagccacttcatcaattgggacttgcagatgtattacgccgaaaaagacacacccgccaaggccaggaccacaacactcaacgaacagctaggacaaatccactatatatttagcgataagaccggtactctcacacagaatatcatgactttcaagaagtgttgcataaacggacagatctacggggaccatcgcgatgccagccagcacaaccataacaagatcgaacaagttgacttttcctggaacacatatgctgatggaaagctcgctttctacgaccattacctaattgaacagattcagagcggaaaggagccagaggttcgccagtttttcttcctgctggctgtatgccacacagtgatggttgacagaaccgacggccaactgaactaccaggcagctagtccggatgagggggcccttgtaaatgccgcccgcaatttcggctttgccttcttggcccgcacacaaaacactattacgatcagtgaattgggaactgagcgtacctacaatgtattagcgatactggactttaattctgaccggaagaggatgtcaatcatagtgagaacaccagaggggaatataaaactgtactgtaagggggccgacaccgttatttatgaaagacttcatcggatgaaccccactaagcaggagacccaggatgctctggacatcttcgccaacgagacgctgcggaccttgtgcctgtgttacaaggagatagaagaaaaggaatttactgagtggaataagaaatttatggccgccagcgtcgccagtactaaccgggacgaagccttagataaggtgtacgaggagatagagaaagacctaattctccttggggcgaccgctattgaagacaagctccaggatggcgtaccagaaaccatcagcaagctggcaaaggcggatatcaaaatctgggttctgaccggcgataaaaaagaaacagccgaaaacatcggtttcgcctgcgagctgttaacagaggacacaaccatctgctatggcgaagacattaacagcctgctccacgcccgaatggagaatcagcgtaatcgcgggggggtgtatgctaagttcgcccctcccgtccaggagagcttttttccacccggtggcaatcgcgccttgatcatcacgggtagttggttgaacgaaattttactggagaagaagacaaagcgaaacaagatccttaaattaaagttcccacgaacagaagaggaacggcggatgcgaacccagagtaaaagaaggttggaggcgaaaaaagaacagcgtcaaaagaattttgtggacttagcatgtgaatgttctgcagtgatctgttgcagagtgactcctaagcagaaggcaatggttgttgatttggtcaagcggtacaagaaagccatcactctggcaattggagacggagcaaatgacgtcaacatgatcaagacagcccatatcggagtgggcattagcgggcaggaaggcatgcaggccgtaatgtccagcgattatagcttcgctcaatttcgctaccttcagagactgcttctcgtgcacggaagatggtcatatatcagaatgtgcaaattcctgcgctatttcttttacaagaacttcgccttcaccttggtgcatttctggtacagcttcttcaatgggtattccgcgcagacagcttacgaagattggttcattaccctctataacgtgctgtacacctccctaccagtgctacttatgggactcctcgatcaggacgtaagtgataaactcagtttaagattccccggcctgtacatagtggggcaacgcgacctgttatttaattataagcgcttctttgtttcactcttgcacggggtgttaacctcgatgattctcttcttcatccccctgggggcttacctgcaaaccgtaggacaggatggcgaggccccctctgactaccagtcatttgccgtaaccatcgcctctgccctggtgattacggtgaactttcagatagggctggatacctcatactggacgtttgtcaatgcctttagtatttttggctctattgccctgtatttcggcatcatgttcgacttccattctgctggtattcatgtgctctttccatccgcctttcagttcaccggcactgcatcaaacgccctgcggcagccatacatatggctcaccatcatcctcgccgtagccgtttgtctgctccctgtggtggcaatacgctttctgtcgatgactatctggccctctgaatcagacaagatccagaagcatcgcaagcgcctgaaggcagaagagcagtggcagcgacggcagcaagtgttccggaggggagtcagtacacgcaggtcagcctacgcattctcccatcagcgtggatacgccgatttgataagcagcggacggagtatcaggaagaaacggtcaccactagacgctattgtggcagatgggacagcggagtacaggcggaccggtgactcc

SEQ ID NO: 7231 - DNA, 3753 bp, Artificial Sequence
  Description of Artificial Sequence: Synthetic coding sequence
atgagtacggaaagagactcagagactacttttgacgaagacagccaacctaacgatgaggtggtaccctactctgacgacgaaactgaggacgagctggacgaccaaggcagcgccgtcgaacccgagcagaaccgggttaatcgggaggcagaagagaaccgggaaccgtttaggaaggagtgcacgtggcaggtgaaagccaatgaccgcaaataccacgaacagccacattttatgaataccaagttcttgtgtatcaaagagtcaaagtatgctaacaatgcaatcaagacctacaagtacaacgccttcacctttatcccaatgaatttattcgagcagttcaagcgcgccgctaacctttacttcctagccctgttgatcttgcaagcagtgcctcagatctccacactggcatggtataccactctggtccccctcctggtggtactcggcgtgaccgctattaaagacctcgtggacgacgtggcgcgccacaagatggataaagagatcaacaaccgaacctgtgaggtgatcaaggacggacgattcaaggtcgctaagtggaaagagatccaagtgggcgatgtgatccgcctcaagaaaaatgatttcgtgccggccgacatcctgttgctgtcgagttctgagcccaattctctgtgctacgtcgaaacagccgaacttgatggtgaaaccaacttgaaatttaagatgagtttggagatcactgatcagtatttgcagcgcgaagatacactcgccacctttgacgggttcatcgagtgcgaagagccaaataatcgcttggacaagttcaccgggaccctgttttggcggaacacaagttttcctctagatgccgataaaatacttctgcgtggctgcgtcatccgcaacacggatttttgccacgggctggtgatattcgcaggtgcggacaccaaaatcatgaaaaattctgggaagacccgtttcaagagaaccaagatagattaccttatgaattacatggtctataccatcttcgttgtacttattctgttgtcggcgggccttgcaatcggacatgcttattgggaggctcaagtgggcaactcatcctggtacctctacgacggcgaggatgatactccatcttaccggggttttttaatattctggggatacatcattgttcttaacactatggtcccaattagcctgtacgtgagcgtggaggtcatcagactaggccagtctcactttattaactgggaccttcagatgtactatgcagagaaagatacaccagccaaagccagaactactactcttaacgagcaactaggtcagatccactatattttctccgataagactggtaccctgacacagaatatcatgactttcaagaagtgttgtatcaacggacaaatatacggggaccaccgtgatgccagtcagcacaaccataataagatcgaacaggtggatttcagctggaatacttatgcagatggtaaattggctttttatgatcattatctaatcgagcaaatccaatcaggaaaggaaccagaagtccgccagttttttttcctgcttgctgtgtgtcacactgtgatggtagatagaactgacgggcaactcaattaccaggcagctagcccagacgaaggagccttagtgaacgcggcacgcaactttgggttcgccttcctggctcgaacacagaatacgatcaccatctccgaattaggcacagaacggacttacaacgtcctggccattttggacttcaattctgatcgaaagcggatgtctattattgtgagaacccctgaagggaatataaagctttattgtaagggtgcagatacagtgatttacgaacggctacatcgcatgaatcctacaaagcaggaaacccaggacgctctcgacatcttcgctaacgagacattgagaacactgtgcctttgctataaggagatcgaggagaaagagtttactgagtggaacaagaaattcatggccgcgagcgtggcttccactaaccgcgacgaagccctcgataaggtatacgaggaaatcgagaaagacctgattctcttgggggctaccgcgattgaagacaaactgcaggacggcgtcccagagaccatctccaaactggcaaaggctgatatcaagatctgggttctaacgggggataaaaaggagaccgctgaaaacattgggtttgcatgtgagctacttaccgaggacacaaccatttgctatggcgaagatattaacagtctgctgcacgcacgcatggagaatcaacggaacagaggtggggtgtatgccaagtttgcgccccccgtacaggagtccttttttcctcccggcggcaacagggctctgattattaccgggagctggctcaatgagatattgcttgaaaagaaaacgaagcgtaacaaaattctgaagctgaaattcccacggacagaggaagaaaggagaatgaggacgcagagcaaacggcgactggaggccaaaaaggaacaacgccaaaagaattttgtagacttggcttgtgagtgctccgccgtaatctgctgtcgcgtcacgcctaagcagaaagcaatggtggtcgacttggttaagagatataaaaaggcgattacactagccatcggggatggagccaatgacgtcaacatgattaagacagcccatatcggcgtgggcatcagcgggcaggaaggcatgcaggcagtgatgtcatccgattacagcttcgctcagttcagatatcttcaacggctgctgctggttcatgggaggtggagttacatccggatgtgcaaattcttaaggtatttcttctataagaatttcgccttcacactagtgcatttttggtattccttcttcaatggatattctgcccagactgcctacgaagattggtttattactctgtataatgtcctatatacctcacttcccgtgctcctgatgggcctcctcgaccaggatgtaagtgataagctctctctccggttcccaggcctgtacattgtgggccagcgagatctgcttttcaactataaacgcttctttgtttcactccttcacggagttctgacgtccatgatcctcttctttataccgttgggagcatatctgcagacggtgggacaggacggtgaagctccgagtgactaccaatcattcgccgtgaccatcgccagtgctctggttattaccgtaaatttccagatcgggctcgatacatcttattggacatttgtgaatgctttttccatattcgggagcatagccctttactttggcataatgtttgattttcatagcgctgggattcacgtactgttcccgagcgccttccaatttacgggaaccgcaagcaacgcgctaagacagccctatatctggctcaccatcatcctcgcagtcgcagtctgtcttctgcccgtggtggccatccggtttctgagtatgaccatttggccatctgagtcggataagattcaaaagcaccgtaagagactgaaagcggaggaacagtggcaacgacggcagcaggtgttcagacgcggcgttagtacccggcggagcgcatacgcattctctcatcaaagaggctacgccgacttgatctcttctggccgtagcattaggaagaaacgcagccctcttgatgctatcgtggctgacgggactgcagagtataggcggacaggcgatagc

SEQ ID NO: 7232 - DNA, 3753 bp, Artificial Sequence
  Description of Artificial Sequence: Synthetic coding sequence
atgtctacagaacgggattcagaaactacatttgacgaggattctcagcccaatgatgaagtcgtcccatattcagatgatgaaacagaagatgagctcgatgatcagggatccgccgtcgagccagaacagaatcgggtgaatcgggaagcagaagagaacagggaacccttcaggaaggaatgtacttggcaggtgaaggctaacgaccggaaatatcatgaacagccccattttatgaatactaaatttttgtgcattaaagagtccaagtacgcaaataacgctattaagacttataagtataatgcattcacattcatccccatgaacctatttgaacagttcaaacgggccgccaacctctatttcctagccctacttatacttcaggctgtgccgcagatatcaactctcgcctggtatacaactctcgtgcccctcctggtggtactcggagtgacggctattaaagatttggtggatgacgtggctagacacaagatggataaagaaattaacaaccggacttgtgaagtcataaaagatggacgcttcaaagttgcaaagtggaaagaaatacaggttggggacgtaatcaggctcaaaaaaaatgatttcgtacctgcagatatcttacttctttcaagttccgaaccaaactccctctgctatgtggaaactgcagaactcgatggggaaacaaatctaaaattcaaaatgagtttagagataactgatcagtatcttcagagggaagatactcttgcaacattcgatgggttcatagaatgtgaagaaccaaataacaggctggataaatttactggaactctcttctggaggaacacatctttcccactggatgcagataaaatcctgctccggggatgcgtaatacgaaatactgatttctgtcatggattagtgatattcgctggagctgatacaaaaattatgaaaaactctgggaaaactcggttcaaacggactaaaatagactatttaatgaactacatggtttatactatcttcgtagtgctcatactgctgtccgccgggcttgcaatcggacatgcttattgggaagcccaggtgggaaattcatcatggtatctgtatgatggagaagatgatactccatcataccgaggatttctgatcttctgggggtatataatagtgctcaacacgatggtgcctatatctctttatgtatctgttgaagtaatccgccttggacaatcccactttataaattgggacctgcaaatgtactacgcagaaaaagatacacctgccaaagcaaggactactactctcaacgagcagctcgggcagatacactatatctttagtgataaaacaggaacactcactcagaatattatgacattcaagaaatgttgtatcaatggacagatctatggggatcaccgagatgcttcccagcataatcacaataaaatcgaacaagtggacttctcatggaatacatatgcagatgggaaactagctttttatgatcactatctcatcgaacagatacagtccgggaaagaacccgaagttcggcagttctttttcctgctcgcagtttgccacacagtgatggtggaccgcacagatgggcagctaaattaccaggccgcttcacctgatgaaggagctctagtcaacgctgcgaggaatttcggatttgcctttttggccaggactcagaatactatcacaatctccgaactcggaactgaaaggacgtacaacgttctagccatccttgattttaattctgataggaaaagaatgagtatcatcgttaggactcctgaaggaaacataaaactctattgtaaaggggctgatacagtgatatatgagcggctacacaggatgaatccaacaaaacaggaaactcaggacgcattagatatctttgcaaacgaaacacttcggactctttgtctttgctacaaagagatagaggaaaaagagttcacagaatggaataaaaaatttatggccgcttccgtcgcttcaactaaccgcgatgaagccctcgataaagtgtatgaagaaattgaaaaagacctaatcttgctcggggccactgccatcgaagataaactgcaggatggagtgcccgagacaatctctaaacttgccaaagccgatattaagatctgggtcctaacaggggataaaaaggaaacagcagagaatatcggattcgcttgtgagcttctcactgaagatacgacaatatgctatggagaagatatcaacagtttgctacacgcgcgaatggaaaatcagcggaatcgaggaggggtctatgcaaagttcgcacctcctgtgcaggaatccttctttccccccggagggaatcgagctttaataatcactggatcctggctgaatgaaatcctactagaaaagaaaactaaaagaaacaaaatcctcaaattgaagtttcctcggacagaagaagaaagaaggatgaggactcagtcaaaacggcgtctggaagccaagaaagagcagcgccagaaaaattttgtggatctggcctgcgagtgttccgctgtgatatgctgtagggttacaccaaaacagaaagcaatggttgtggatctggtaaaaagatataaaaaagcaattactctggcaatcggagatggagcaaatgatgttaacatgatcaaaactgcccacatcggagtaggaatttccgggcaggaagggatgcaggccgtaatgtcttctgattattccttcgctcagtttagatacctgcagaggctgttgcttgtgcacgggcgttggtcctatatccggatgtgtaagttcctcagatactttttttataaaaattttgccttcactttggttcatttctggtattcatttttcaacggatattcagcccagacagcttatgaagactggtttatcacattgtataatgtgctgtatacaagtttgcccgtattactcatggggctgctagatcaggatgtcagtgataaacttagtctcaggtttccagggctatatatagtgggacagagggatcttctgtttaattataaacgcttctttgtgtccctgctccatggagtccttacaagtatgattctcttctttatcccactgggagcctacctacagacggtggggcaggatggggaagctccttcagactatcagtcattcgccgtcacaatagcctccgcactcgtaataacagttaatttccagatcggactggatacgagttattggacgttcgtgaacgccttctccatatttgggagtatcgccttgtactttgggatcatgtttgattttcattccgctgggatacatgtgctgtttccctctgcctttcagtttactgggactgcaagtaacgctctcagacagccctatatctggctaacgattattctggcagtggctgtctgtctgctcccagtcgtggccataaggtttctatcaatgactatctggccatccgaatctgataagatccagaaacacagaaagaggctgaaagccgaagaacagtggcagcggagacagcaggtatttaggcgtggggtttcaactcggaggtctgcttatgccttctctcaccagcgagggtatgccgatctaatctcctccggacgctcaatccggaaaaaaagatctcccttagatgccatcgttgccgatgggacagctgaatacagacggacaggggattcg

SEQ ID NO: 7233 - DNA, 3753 bp, Artificial Sequence
  Description of Artificial Sequence: Synthetic coding sequence
atgtccaccgaacgggattcagaaaccacttttgacgaggatagccagcctaatgatgaggtggtgccttactccgacgatgaaaccgaggacgaactcgatgaccaaggatcagccgtggagcctgaacagaatcgcgtgaaccgggaggccgaagaaaacagagagccttttcgcaaagagtgtacttggcaagtcaaggcaaacgatagaaagtaccatgagcagcctcacttcatgaacactaagtttctttgtattaaggagtcgaaatacgcaaacaacgccatcaaaacctacaagtacaacgcttttaccttcataccaatgaacctctttgaacagttcaagagggcagcgaacctgtactttttggcactgcttatcctgcaagcagtcccccagatcagcaccctcgcatggtacaccactctcgtccctctgctcgtcgtgctgggagtcactgccattaaggatctggtcgatgatgttgcaagacataagatggataaggagatcaataacagaacctgtgaagtcattaaagatggaaggtttaaggtggccaaatggaaggaaattcaagtgggcgatgttatccggcttaagaagaacgacttcgtgcctgcagacatacttctgctttcgtcaagcgagccaaactcactttgttacgtcgaaactgccgaacttgacggagaaaccaacctgaagtttaagatgtcccttgaaatcactgatcaatacctgcagcgggaggatacgctggcaaccttcgatgggtttatcgaatgcgaagaaccgaacaatagactggacaagttcacgggtacgcttttttggcgcaacaccagcttccctttggatgcagataagattctgctgcggggttgtgtgatccgtaacaccgatttttgtcacggtcttgtgatttttgcaggagcggataccaagattatgaagaattcaggtaaaacccgctttaagcggactaaaatcgattacctgatgaactacatggtgtatacgatttttgtggtgctgatccttctgagcgccggcctggcgatcgggcacgcctactgggaagcacaggtgggtaacagctcctggtacctttacgatggagaggatgatacgccgtcctacagaggttttctgattttctggggatatatcatcgtgctcaatactatggttcccatttccctttacgtgtcagttgaagtgatccgcttgggacaatcacactttatcaactgggatctgcagatgtattatgcagaaaaggataccccagcaaaggcacgtactactacccttaacgagcaactgggccagattcattacatcttttccgacaaaactggaaccctgacccagaacattatgacctttaagaagtgttgcatcaacggacagatttacggcgaccatagagacgcatcgcagcataaccacaataagatagaacaggtggacttttcgtggaacacctacgccgacggcaaactcgcattctacgaccactaccttatcgagcaaattcagtcgggtaaggaacctgaagtgaggcagtttttcttccttctcgcagtctgtcatactgtcatggtcgatagaacggacggtcaactgaactaccaagccgcgtcaccggatgaaggggccttggtcaacgcagcacggaattttggatttgcatttttggcaagaacccagaacactatcactatctcagaactcgggaccgaacgcacctacaacgtgctggccatcctcgatttcaatagcgaccgaaaaagaatgtccataatcgtgcgtacgcctgaggggaacataaaactttactgcaagggagccgacaccgtcatttacgagaggcttcacaggatgaacccgacgaaacaagaaacccaagatgcacttgatatcttcgccaacgaaacgcttcgaactctttgcctgtgctacaaggaaatcgaagagaaggaatttaccgaatggaataagaaattcatggcagcatcagtggcttctacgaacagggacgaagcactggacaaggtgtacgaggaaatcgaaaaggatctgatcttgcttggagctacggcaatagaggacaagctgcaggacggagtccctgaaactatttccaagttggcaaaggcggacattaagatttgggtgctcactggagataagaaagagactgcagagaacattggcttcgcgtgcgaacttctgaccgaggacaccaccatttgctacggagaggacatcaactcattgctgcacgcaagaatggaaaaccaacgcaaccggggcggagtgtacgccaaatttgcgccaccagtgcaggaatccttttttcctccgggtgggaacagagcactgatcattaccgggtcctggctgaatgaaattctgctggagaaaaagactaagcgcaacaagattctgaagctcaagtttcctcggactgaagaggaacggcgaatgcgcactcaatcaaagagacgtctcgaagcgaagaaagagcagcgtcagaagaactttgtcgacctggcatgtgaatgcagcgctgtcatttgttgtagagtgacccctaaacaaaaggccatggtcgtggatctggtgaaacggtacaagaaagcaatcactctggccattggcgatggagccaatgacgtgaacatgataaagaccgcacatattggagtgggcatctcaggtcaggaaggaatgcaggctgtcatgtctagcgattactcattcgcgcaattccggtacctccagagacttctcttggtgcatggacggtggtcgtacattcggatgtgcaaatttctgagatactttttctacaagaactttgcatttactctcgtccacttctggtactccttctttaacggctacagcgcgcaaacggcatatgaggactggtttatcactctgtacaacgtgctttacactagccttccggtgctcctgatgggactgcttgaccaggacgtgtcggataagctgtcgctgcgctttccaggactctacattgtcggacaacgggaccttctgttcaattacaaacgcttttttgtttcgctgctgcacggagttctgacttcaatgattttgtttttcattcccctgggagcatatcttcaaacggtgggccaagatggtgaagcccccagcgattaccagtcctttgcagtgaccattgcaagcgccctggtcatcactgtgaactttcagatcggtcttgatacctcgtactggactttcgttaatgcattctccatttttggttcaatcgcattgtatttcggcattatgtttgattttcactcagcagggattcatgtgcttttcccttcggccttccaatttactggtaccgcgtccaatgcactgaggcaaccttacatctggttgaccatcattctcgcagtcgctgtgtgtctgcttccagtggtggcaatccgttttctctcgatgaccatttggccgagcgaatcggataagattcaaaagcaccgtaagaggcttaaggcagaagaacagtggcagcgcagacagcaggtctttcgtaggggcgtctcaactagacgctccgcatacgcgttttcgcatcagcgagggtacgctgatcttatctcgtcgggacgctccatacgaaagaaaaggagccctctcgatgccatcgtggcggatgggactgccgaataccggcggactggtgattcc

SEQ ID NO: 7234 - DNA, 3753 bp, Artificial Sequence
  Description of Artificial Sequence: Synthetic coding sequence
atgtcaaccgagcgcgatagtgagactacctttgacgaggactcccaaccaaatgatgaagtggtgccatactctgatgatgagactgaggacgaattggatgatcagggttcagcagtcgagccagaacaaaaccgcgtgaaccgcgaggcagaagaaaaccgggaaccttttcggaaggagtgtacctggcaggtgaaagccaacgacagaaagtaccacgagcaaccacatttcatgaacactaagtttctttgtatcaaggaatccaagtacgcaaacaatgccattaagacttacaagtacaatgcctttacttttatccccatgaacctttttgaacaattcaagagagcggccaacctctacttccttgcactcctgatactgcaagccgtgccgcagattagcacgcttgcatggtacactactctggtccctctcctcgtggtgctgggtgtgaccgccatcaaagatctggtcgatgacgtcgccagacacaaaatggataaggaaatcaacaacaggacctgcgaggtcattaaggatgggcgtttcaaggtcgcaaagtggaaagaaattcaggtgggtgacgtgatccgtttgaaaaagaacgatttcgttcccgcagacatccttctcctttcgtcatccgagcctaactcgctgtgttacgtggagactgcagaacttgacggtgaaactaacctgaagttcaagatgtcgcttgaaattaccgatcaataccttcaaagggaagatactctggcaacctttgacggattcatcgaatgtgaagaaccaaacaaccggctggataagtttactggcacgcttttttggagaaatacttcgtttcctctggacgcagacaagattctgctgcgaggctgtgttattcgtaacaccgacttttgtcacgggcttgtcatttttgccggagcagataccaagatcatgaagaattcgggtaagactcggttcaagcgcaccaaaatagattacctcatgaactatatggtttacacgatttttgtcgtactgatacttctctcagctggtttggccattggacatgcgtactgggaagcacaggttggaaactcctcctggtatctgtacgatggagaagatgacactcccagctaccgtggtttcctcattttctggggatacataattgtacttaatactatggtgccaatttcgttgtacgttagcgtagaagttatcagacttggacaatcccactttatcaattgggatcttcagatgtactacgcagagaaagatacccctgcaaaggcaaggaccaccacccttaacgagcagctcggacaaattcattacatcttctcagataagacgggaactctgacccaaaacattatgacctttaagaagtgctgtattaacggccagatttacggcgaccatagagatgcctcccaacataatcataacaagatcgaacaggtcgatttttcatggaacacttacgcagacggcaagctggcattttacgatcattacctcattgaacaaatccagtcgggtaaagagcctgaagtgcgccagttcttttttcttctggcagtgtgtcacaccgtcatggtcgaccgcaccgatggtcagcttaactaccaagccgcaagccctgatgaaggcgcactggtgaatgccgcacggaattttgggttcgccttcctggcacggactcagaacactattactatttccgaactgggtaccgaacggacctacaacgttctggcaattctggactttaactcagatcgcaagaggatgagcattattgtaagaaccccggaaggcaacattaaactttactgtaagggggcagataccgtgatttatgagcgtctgcatcgcatgaaccctactaagcaggaaactcaagatgctctggacatttttgcaaacgaaaccctcaggacgctgtgcctgtgctataaggagatcgaagaaaaggagtttaccgaatggaataagaagtttatggctgctagcgtggcgtccactaatcgcgatgaagcactcgataaagtttacgaggaaatcgaaaaagacttgattcttctcggagccaccgctattgaagataaacttcaagacggggtgccagaaactatttctaaacttgcaaaagcagatatcaagatatgggtccttaccggtgacaaaaaagagacggctgagaatatcggatttgcttgcgagctgctgacggaagataccactatctgctacggagaggacataaacagtctcctgcatgccagaatggaaaaccaacgcaatagaggaggagtctatgctaagttcgcacctccggtgcaggagagcttttttccgcctggtggaaaccgagcactgattatcaccggatcatggctgaatgagattttgcttgagaagaaaaccaagagaaacaagatcctcaagctgaagttccccaggactgaggaagagcgccgaatgaggactcaatcgaaaaggagacttgaagcaaaaaaggaacagcggcagaaaaactttgtggatcttgcctgtgagtgttccgcagtgatatgttgtagagtgacccctaaacaaaaggcgatggtggtggatctcgtgaagcgctacaaaaaggccattacccttgcgatcggcgacggagccaacgatgtcaatatgataaagaccgcacacatcggagtgggaatttcgggtcaagaaggcatgcaggccgtgatgtcgtcagattactcgttcgcccagtttcgctatcttcaacggctgttgcttgtacacgggagatggagctacattaggatgtgcaagttcctccgttacttcttctacaagaattttgcgttcactctggtgcatttttggtattcattctttaacgggtacagcgcacaaacggcatacgaagattggttcataaccttgtacaatgtcctttacacttcgcttccagtgcttctgatgggactcctcgatcaggatgtgtcagataagctctcccttagattccctggtttgtacatcgtaggtcagcgtgacctgctctttaactataagcgattctttgtgtcgcttcttcatggagtgctgacgtcgatgatcctcttctttatcccactcggtgcatacctgcaaactgtcgggcaagatggagaggcaccttccgactaccaatcctttgcagtgaccatcgcgtccgcactggtgataaccgtgaattttcagattggactcgacacctcctactggacctttgtgaatgcgttttccatctttggtagcatcgcactgtactttggaattatgttcgactttcattcagcgggcattcatgtgttgtttcccagcgcattccaattcaccggtaccgcatcgaatgccctcaggcagccatacatttggctcactattatcctggcggtcgccgtgtgcctcttgcccgttgtcgctattaggttcctgtctatgactatatggccaagcgaaagcgataagatacaaaagcatcgtaaaaggctcaaagcagaagagcaatggcagagacgtcagcaagtctttagacggggcgtctcgaccagacgatccgcgtacgcgtttagccaccaacggggctacgccgatcttatttcgtctgggcgatcaatccggaagaaacgctccccccttgacgcaattgtggctgatggcactgcagagtacagacggaccggggattcg

SEQ ID NO: 7235 - DNA, 3753 bp, Artificial Sequence
  Description of Artificial Sequence: Synthetic coding sequence
atgtctaccgaacgagactcagagactacgtttgacgaggattcccagccgaacgacgaggtggtcccctactccgacgatgaaactgaggatgagctcgacgaccagggttctgccgtggagccagaacagaatagagttaaccgcgaagcagaggagaatcgcgagccgttccggaaagagtgcacttggcaggtgaaggccaacgatagaaagtaccatgagcagcctcactttatgaataccaaatttctctgtatcaaggaaagcaagtacgcgaataatgccatcaaaacctacaagtacaacgcctttacctttatcccaatgaacctgtttgaacagttcaaaagagcagcgaacctgtactttctcgccctgctgatcctgcaggccgtcccacaaatttccactctcgcgtggtacacgactctggtgcctctgctcgtggtcctgggcgtgactgcgattaaagacctggtggatgacgtggcgcggcataagatggacaaggagatcaataaccgcacctgcgaggttatcaaagacggacgcttcaaagtggctaagtggaaggaaattcaggtgggcgatgtgatcaggctgaagaagaacgacttcgtgccggccgacatcctgctgctgtcctcatcggagcctaactcgctgtgctacgtggagactgcggaactggacggagagactaacctcaaattcaagatgtcacttgagatcactgaccaatacctgcagagggaggacacgctcgcaacttttgacggattcatcgaatgcgaggaaccaaataaccgcctcgataagtttaccggaactctgttctggaggaatacttcgttcccccttgacgcggacaaaatactgctccgggggtgcgtgatcagaaacactgacttttgtcacggactcgtgatcttcgcgggagcggacactaagatcatgaagaactcaggaaagacccggtttaagcggaccaaaatcgattacctgatgaattacatggtctacaccatattcgtggtgctcatcctgctgtcagctgggctggccattggacacgcgtactgggaggcgcaggttgggaacagctcttggtacctgtacgatggcgaggatgacaccccgtcataccgcggattcctcatcttttggggttacatcatcgtcttgaatactatggttccgatttcactgtacgtgtccgtggaggttatccgcctcgggcagtcacacttcatcaactgggacctgcaaatgtactacgccgaaaaggacaccccagcaaaagccagaaccaccactctgaatgaacagctggggcaaatccattacatcttctcagacaaaaccggaaccctgactcagaacatcatgactttcaagaaatgttgcattaacggccagatctacggagatcaccgagatgcgtcgcaacacaaccacaacaaaatcgagcaagtggacttctcgtggaatacttacgcggacggaaagctggccttttacgaccattacctgattgaacagatacaatccggaaaagaacccgaagtccgtcaattctttttcctgttggcagtgtgccatactgtcatggtcgatcggacggatgggcaactgaactaccaggcggcttcgcctgatgaaggagctctggttaacgcagcaagaaatttcggcttcgcatttctcgcccggacccagaacaccatcactatctcggaactgggcaccgagaggacttacaatgtgctggcgatccttgatttcaattccgatcgcaagcggatgtccattatcgttcgcactcccgaaggaaacatcaagctgtattgcaagggagcagacaccgtgatctacgagcggctgcaccggatgaacccaaccaaacaggaaacgcaggatgctctcgacatctttgcgaacgaaaccctccggaccctgtgcctgtgctacaaggagatcgaagagaaggagttcactgagtggaataagaagttcatggccgcgtcggtggcgtctacgaaccgggacgaagcactggacaaggtgtatgaggaaatcgaaaaggacctcatcctgctcggagctactgccatcgaagataagctccaggatggagtcccggaaaccatctccaaactggctaaagctgacatcaagatttgggttctgaccggagacaagaaggaaaccgctgagaacatcggattcgcctgtgaactgttgaccgaggataccactatctgttacggggaggacatcaacagcctgctccatgcgcgtatggaaaaccaaagaaacagaggaggcgtgtacgccaaatttgcaccaccggtccaagagtcattcttcccgcccggcggaaaccgggcgctgatcatcactgggtcctggttgaacgaaatcctgctcgagaagaaaaccaagcgcaataagatcctgaaactgaagttcccgcggaccgaggaggaaagacgcatgcgcacccagtcaaagagaagattggaagcgaagaaagaacagcggcaaaagaatttcgtcgaccttgcatgcgagtgcagcgccgtcatctgttgtcgcgtcaccccgaagcagaaggccatggtggtcgatctcgtgaagcgctacaagaaggcgatcactctcgctattggcgacggcgctaacgatgtgaatatgatcaaaaccgcccacatcggagtgggcattagcggccaggagggcatgcaggcagtgatgagcagcgattattcgtttgctcagttccgctacctgcagcgcctgcttctggtgcacggacggtggtcatacattaggatgtgcaaatttctgagatacttcttctacaagaatttcgccttcactctggtccacttttggtactcattcttcaatggttactccgcacagaccgcgtacgaggactggttcatcaccctgtacaacgtgctgtacacctcgctgccggtgctcctgatgggacttctcgatcaggacgtgtcagataaactttcacttcgattcccaggactctacatcgtgggacaacgcgatctcctgttcaattacaagcgcttcttcgtgtcgctgctgcatggagtgttgaccagcatgatcctgtttttcattccacttggagcatatctgcagaccgtggggcaggacggagaggcccctagcgactaccaatccttcgcggtgaccatcgcctcggccctcgtcatcaccgtcaattttcaaattggactggacaccagctattggacctttgtcaatgctttctcgatcttcggaagcatcgctttgtacttcggcatcatgtttgatttccacagcgctggcatccacgtcctcttccctagcgcctttcaattcactgggaccgcctcaaacgccctgagacagccgtacatttggctcactatcatcctcgccgtcgcggtgtgcttgctccctgtggtggcaatacgtttcctctcaatgaccatctggccttcggagtcggacaaaatccagaagcacaggaaacgcctcaaggcagaagagcagtggcaaagacggcagcaggtgtttcggcggggcgtgtcaacccgcagaagcgcctacgcattttcccaccagcgcggatacgccgacctcatcagctctggcagaagcatccggaagaagcgcagccctcttgatgcgatcgttgccgacggtactgcggagtacagaaggactggtgattca

SEQ ID NO: 7236 - DNA, 3753 bp, Artificial Sequence
  Description of Artificial Sequence: Synthetic coding sequence
atgtcaacagaaagagattctgaaacaacgttcgatgaggattcccagccaaatgatgaagtggtgccttattccgacgacgagactgaagatgaactggacgatcagggatcagccgtcgagcccgaacagaaccgcgtcaacagggaggccgaagagaacagggaaccgtttcgtaaagaatgtacttggcaagtgaaagctaatgatcggaaatatcacgaacagccccactttatgaatactaaatttctatgtatcaaagagtctaaatatgccaacaacgctattaaaacatataagtacaatgctttcacttttatccccatgaatctctttgaacagttcaaaagggccgccaacctctatttcttagcccttctgattctgcaggcggtgccccagatctctactctggcctggtatacaactctggtccccctgttagtggtcctgggggtgactgccatcaaagatctcgtagatgatgtagcccgacacaaaatggataaagagattaataacaggacatgcgaagtcatcaaagatggaaggtttaaagtcgctaaatggaaggaaatacaggtcggagatgtgataagactcaaaaaaaacgatttcgttcccgctgatatactcctcctctcgagttcagaacccaattctctgtgttacgtggaaactgcagaacttgatggagaaacaaaccttaaatttaaaatgtcactcgaaatcactgatcagtatctgcaacgggaagatacactggctacgtttgatgggtttatagaatgtgaagaacccaacaacagactggataaattcacaggaacacttttctggcgcaacacatctttccctcttgatgccgacaaaatacttctacggggatgcgtcatccgcaatactgacttctgtcatgggctcgtcatctttgcaggagcagatactaaaattatgaagaactccggaaagactaggtttaagcggactaaaattgattacctaatgaattatatggtatacactatcttcgtggtactaatacttctgtccgcggggcttgcaattggacacgcctattgggaagcccaggtgggaaattcctcatggtatctatatgatggagaagatgatacacctagttatagaggatttctcatattctggggatatattatcgtactgaatacaatggtacccatcagtctttatgtgtcagtggaggtgatcagattggggcagtcacacttcattaattgggatctgcagatgtactatgccgaaaaagatacacctgccaaagccaggactactacacttaacgaacagcttggacagatccactatatcttctccgataaaactgggacactcacacagaacataatgacttttaagaaatgctgtataaacgggcagatctacggagatcatcgggatgcatctcagcataaccataacaaaatagaacaggttgatttttcatggaatacatatgcggatgggaaattagcattctatgaccattatttaatcgaacagatccagtcgggaaaagaaccagaagttagacagtttttttttcttttggccgtgtgccacacagtcatggttgatcggactgatggacaactaaactatcaagccgcctccccagatgaaggagctctcgttaatgctgctcgaaacttcggattcgctttcttagcacggacgcagaatacaatcactatctctgaacttggaactgagcgaacatataatgtgcttgccatcttagacttcaattcagacagaaaacggatgtcaataatagtaagaacacctgaggggaatataaaactttattgtaaaggagcagatacagtcatctatgaaagattacaccggatgaatcccactaaacaggaaactcaggatgcgctcgacattttcgctaacgaaactctccgaactttatgcctctgctataaagaaatcgaagaaaaagaatttacagaatggaacaagaaatttatggccgccagtgtcgcgtctacaaaccgggatgaggcactggataaagtgtatgaagagatcgagaaagatctgattcttctaggagccacagcaatagaagataaactacaggacggagtgcccgaaactatatccaaactcgctaaagctgatataaaaatatgggtattgacaggagataaaaaggaaacagcagaaaacataggattcgcttgcgaattacttactgaagacactacaatatgttatggggaagatattaatagtctcctccacgcccgaatggaaaaccagcgaaaccgcggaggggtatacgcaaaattcgctccaccagttcaggaaagttttttccctcctggggggaaccgggccctaataataacagggtcttggctaaacgaaattctcctagaaaaaaagactaaacgcaataaaatcttaaagttaaaattccctaggacagaagaagaaagacggatgcggactcagtccaaacgccggttagaagcaaaaaaagaacaaagacagaaaaacttcgtggacctcgcgtgtgaatgttctgcagtcatctgttgtcgggtgacaccaaaacagaaagccatggttgtggatctcgtaaaacggtataagaaggctataacactggccatcggagatggggctaacgatgtgaatatgattaaaactgcccatataggagtggggatctctgggcaagaagggatgcaggcggtgatgtcgtcggactacagttttgcccagtttaggtaccttcagcggctactactagtgcatggaagatggtcatacatccgaatgtgcaaattcctccgatatttcttttacaaaaatttcgcatttactcttgtacatttctggtactcatttttcaatgggtattcagcgcagactgcctatgaagattggtttattactctttacaacgtcctctacacttctctacccgtacttctcatgggactgcttgatcaggatgtgtccgataaactttctttacggtttccagggctctatatcgtggggcagcgcgatcttctgttcaactataaaagattttttgtgtccctcctccacggagtgctgacatctatgattctattcttcattccattaggagcctatttgcaaactgtaggacaggacggggaggcaccctcagattaccagagttttgctgtaacaattgcttctgcactcgtgattactgtgaactttcaaattgggcttgatacaagttattggacattcgtgaatgctttcagtatctttgggtcaattgccctgtattttggaatcatgtttgatttccactctgccgggatccacgtgctgttcccctccgctttccagtttacaggaacagcatcaaacgctcttcgccagccctatatctggctcactataatcctcgccgtcgcagtgtgccttctcccagtggtggccatccgattcctgtccatgactatttggccaagtgaatctgataaaatccagaaacacagaaagaggttgaaagcagaagaacaatggcaaagacggcagcaggtttttcggaggggggtgtccactcggcgctcagcctacgctttctcccatcagaggggatacgccgatttgatcagttcagggcgctccataaggaaaaagcggtccccacttgatgccatagttgctgatggaacagcagaatacaggaggactggggatagt

SEQ ID NO: 7237 - DNA, 3753 bp, Artificial Sequence
  Description of Artificial Sequence: Synthetic coding sequence
atgagtactgaacgggattcggagactactttcgatgaagattcgcaaccgaatgacgaggtggtgccctactcggacgatgaaacggaagatgaactggacgaccaggggtcagcggtggagccagaacaaaaccgcgtcaacagagaagctgaagaaaatcgggagccgttcagaaaggaatgcacttggcaggtgaaagctaacgatcggaagtaccacgagcaacctcatttcatgaacaccaagtttctctgtataaaggaaagcaagtacgcaaacaacgcgatcaagacctacaaatacaatgcgttcaccttcattccgatgaacctgtttgagcagttcaagcgggcggccaacttgtacttccttgcactcctgatcctccaggccgtgccacagatctccactctggcatggtacactactctcgtgcccctcctcgtggtgctgggcgtgactgccattaaggacctcgtggacgatgtggcccggcacaaaatggataaggaaatcaataaccggacctgcgaggtcatcaaggatggacgcttcaaggtggccaaatggaaagagatccaagtgggcgacgtgatccggctcaagaaaaacgatttcgtgccggcagacattctgctcctgtcctcatcagagcccaacagcctgtgctacgtcgagactgccgaactggacggagaaaccaacctcaagtttaagatgagcctggaaatcactgatcaatacctgcagcgcgaggacaccctcgctactttcgacggtttcatcgagtgcgaagagccgaataaccgcctcgacaagttcactggaacgctcttctggagaaataccagctttcctctggatgccgacaagatactcctgcggggatgcgtcattcgaaataccgacttctgccatggactcgtgatctttgccggagcagacaccaagatcatgaagaatagcggaaagactcgtttcaagaggacgaagatcgactacctgatgaactacatggtatacacgatctttgtcgtcctgatactcctctccgcgggtttggctatcggccacgcatactgggaggcccaagtgggaaactcgtcgtggtacctgtacgatggcgaggatgacaccccgtcctaccgcggctttctcatcttctggggatacatcattgtgctgaacactatggtgcctatttcgctgtacgtgtctgtggaggtgattaggcttggtcagtcccacttcatcaattgggacctccaaatgtactacgcggaaaaagatacccctgccaaggcacggacgactactttgaacgagcaactcgggcagatccactatatctttagcgataagacgggtacccttactcaaaacatcatgacgttcaagaagtgttgcatcaatggacaaatctacggagatcaccgggacgcctctcaacataaccacaacaaaattgagcaggtggacttttcatggaatacctacgccgatgggaagctcgccttctacgaccactaccttatcgagcagatccagtcgggaaaagaacccgaggtgcgccaattcttcttcctgctggctgtctgccacaccgtgatggtggaccgcacggacggacaattgaactaccaggctgcgtcgccggacgaaggggcactggtcaatgcagctagaaacttcggcttcgcattcctcgctagaactcagaatactattactatctccgagcttggaactgagaggacttacaacgtcctcgccatcctcgacttcaattccgataggaagcgcatgtcaatcattgtgcggacccccgaagggaatatcaaactctactgcaagggagccgacacggtgatttacgaaagactccatcgcatgaacccaaccaagcaggaaacccaggatgctctggacatttttgccaatgaaactctgcgcactctctgcctctgctacaaagaaatcgaagagaaagaattcactgagtggaataagaagttcatggcggcctcggtcgccagcactaaccgtgacgaagcactcgacaaagtgtacgaagaaatcgaaaaggacctcatactgctgggtgccactgcaatcgaggataagctccaggatggcgtgcccgaaactatctcaaagctcgccaaggccgacattaagatctgggtgctcaccggagataagaaggagactgcagaaaacatcggattcgcttgtgagctgctcactgaagataccaccatttgctacggtgaggacatcaactccctgctgcacgctagaatggaaaaccagaggaacaggggcggcgtgtacgcgaagtttgccccgccggttcaagagagcttcttcccgccgggcggcaaccgggccctgatcatcactgggagctggctcaatgagatcctgctggagaagaaaaccaagcgcaacaagatccttaagctgaagttcccgcggaccgaagaagaacggagaatgaggacccaatcgaagcgccgcctggaagccaagaaggaacagcggcagaagaattttgtggatttggcctgcgaatgctcagctgtgatttgctgccgcgttacgcccaagcaaaaggctatggtggtcgacctcgtcaaacggtacaagaaagctattaccctggcgatcggagatggcgcgaatgacgtcaacatgatcaagaccgcccacatcggcgtggggatctcagggcaggaaggaatgcaggcggtgatgtcctccgattattcgttcgcccagttccgctatctgcagcgtctgcttctggttcacggaagatggtcgtacattcgcatgtgtaagtttctgagatactttttctacaaaaactttgcttttactctcgtgcatttctggtactccttctttaatggatactcagcccaaaccgcctacgaggattggttcatcactctgtacaacgtgctgtacacctcactgcctgtcctgctcatgggactgctggatcaagacgtctcggacaagctgtcgctgagattccctggactgtacatcgtgggacagcgggacctcctgttcaactacaagagattcttcgtgtcgctcctccacggagtcttgacttcgatgatcctctttttcatcccgcttggggcttacctccaaacggtggggcaagatggcgaagcaccaagcgactaccagtcattcgcagtgactatcgcttccgcccttgttatcactgtgaactttcagatcggactggatacctcctattggactttcgtgaatgctttttccatcttcggttccatcgccctgtacttcggcatcatgttcgacttccacagcgcgggaatccatgtgctcttcccatccgcttttcagttcactgggaccgcatcgaatgcattgcggcagccctacatctggctcaccatcatcctggcggtggccgtgtgcctcctgccagtagtggcgatcaggttcctgtcgatgaccatctggccatcagaatccgacaagatccagaaacaccggaagaggcttaaagctgaggaacaatggcagcgccggcagcaggtctttcgccgcggtgtctcaacgcgccgcagcgcctacgcgttttcacatcagcggggatatgctgatctcatctcgtcgggcagatctatccgcaagaagcgctcccctcttgatgccatcgtggcggacgggaccgctgagtaccgcagaactggagactcc

SEQ ID NO: 7238 - DNA, 3753 bp, Artificial Sequence
  Description of Artificial Sequence: Synthetic coding sequence
atgagcaccgaacgcgactcagaaaccactttcgacgaggacagccaaccaaacgacgaagtggtcccttacagcgacgacgagactgaggacgagctcgacgaccaggggtccgctgtggaacccgaacaaaaccgcgtcaaccgggaagccgaagaaaatagggagccgttccggaaggagtgcacttggcaggtcaaggcaaatgatcggaagtaccatgaacagccccactttatgaacaccaagttcctttgcatcaaggagtcgaagtacgcgaataacgccatcaagacgtacaagtacaacgcatttacgtttatcccgatgaatctgtttgaacaattcaaacgcgccgccaatctgtacttcctcgcccttctcatccttcaagccgtcccgcagatttctactctggcctggtacaccaccctggtgccgctgttggtggtcctgggtgtgactgccatcaaggacctcgtggacgatgtcgcaagacacaaaatggataaggagatcaataaccgaacgtgcgaagtgatcaaggatggacggttcaaggtggcgaaatggaaggagatccaggttggcgacgtgatccgcctcaagaaaaacgactttgtgccggctgacatccttctgctgtcatcatcggaaccgaactcgctctgttacgtggaaaccgccgaactggacggggagactaatctgaagttcaaaatgtctctggaaatcacggaccagtacctccaacgcgaggatacgctggctactttcgatggcttcatcgaatgcgaagagcccaataaccggctggataagtttaccggaacgctcttttggcggaacacctcattcccgctggacgctgataagatcctccttaggggttgcgtgattcggaatactgatttctgtcatggcctcgtcatctttgccggcgccgacaccaaaatcatgaagaattctggaaaaacccggtttaagaggaccaagattgactaccttatgaattacatggtctacactatcttcgtcgtccttatactgctgtcggcgggacttgccatcggtcacgcctactgggaagctcaggttggaaacagctcgtggtacctttacgacggagaagatgacaccccgagctacaggggattcctgatcttctgggggtacatcattgtgttgaatactatggtgccaatctcactctatgtgtcagtggaggtcatccggctggggcagtcacacttcatcaattgggatctccaaatgtactacgccgagaaagatacgccagccaaggcccgtactactactctgaacgagcagctgggacagatccactacatcttctcggataagaccggaacgctgactcagaacatcatgactttcaagaaatgctgcattaatggacagatttacggagatcatcgggacgcttcgcagcataatcacaacaagatcgaacaggtcgacttctcgtggaatacgtatgcggacggaaagctggctttctacgatcactatttgattgagcagatccaaagcggaaaggaaccggaggtgagacaattcttcttcttgctggccgtgtgccacactgtgatggtcgacagaaccgatggtcagctgaactaccaagccgcttcaccagacgaaggcgccctggtgaacgcagccagaaactttggcttcgcctttctggcacgtactcagaacacgatcaccatatcagaactcggcactgaaaggacgtacaacgtgttggctatcctggacttcaattcggatcggaaaagaatgagcattatcgttagaaccccagaaggcaacataaaactgtactgcaagggggcggatactgtcatctacgaaagacttcatcggatgaaccccactaagcaggaaactcaagatgcactggacatcttcgcgaacgaaactctccgcaccctgtgtctctgttacaaggagatcgaggagaaagaatttactgaatggaacaagaagtttatggctgcctcggtggcctccactaatcgggatgaagcgctggacaaggtgtatgaagaaatcgaaaaggatctgatcctcttgggagccactgcgatcgaggacaagctgcaggatggtgtcccagaaactatctccaaactggcaaaggcggacatcaaaatctgggtgctcactggcgacaagaaggagactgcagaaaacattggattcgcatgcgagcttctgaccgaggacaccaccatatgctacggagaagatatcaactccctgctccacgcgcgcatggaaaatcagagaaaccgcggcggggtgtatgcgaaattcgcgcccccggtccaagagtcgtttttcccgccgggaggcaacagagctcttatcatcactggatcctggctgaacgaaatcctgctcgagaaaaagaccaagcgcaacaagattctcaagctgaagttcccgcggaccgaggaagagcggcgcatgcggacccagtctaagcggcgccttgaagcgaaaaaagagcaacggcaaaagaacttcgtggacctggcttgcgagtgctcggcagtgatctgctgcagggtcacccctaaacagaaggcaatggtggtggacctcgtcaaacgttacaaaaaggcgatcaccctggcaatcggtgacggcgccaatgatgtcaatatgatcaagactgcacatattggagtgggcatctcgggacaggaaggtatgcaagccgtgatgagctccgactacagctttgcgcaattcaggtatctccaacgcctcttgctggtgcatggtagatggagctacatcagaatgtgtaagtttctcagatacttcttctacaagaattttgctttcaccctggttcacttctggtacagctttttcaacggatacagcgcgcagaccgcatacgaggattggttcatcaccctgtacaacgtgctgtacacgtccctgccagtgctgctcatgggtctgcttgatcaagatgtgtcggataagctgtccctcagattccccggcctgtacatagtgggccagcgcgacctgctcttcaactacaaaaggttcttcgtgtccctgcttcatggcgtgctcacctccatgatcctgttctttatcccgctcggagcatacctccagaccgtggggcaggacggcgaggcgccgtcggattaccagtccttcgcagtgaccatcgcttcagcgcttgtgattaccgtcaacttccagatcggactcgacactagctactggaccttcgtcaatgcgttcagcatcttcggctcgatcgccctctactttgggatcatgttcgatttccactccgcggggattcacgtgcttttcccatccgcattccaatttaccggaaccgcctcgaacgcgttgcggcaaccttacatttggctcaccatcatccttgcggtggccgtttgtttgctgccggtggtcgccatcaggtttttgtcaatgactatctggccttcggagagcgacaagatccagaaacaccgcaagagactgaaggccgaggaacagtggcagaggcgtcaacaggtgttccggcggggagtctccactcggagatcggcctatgctttctcccatcaacgcggctatgccgacctgatctcgagcggacgcagcatccgcaagaagaggtccccactggatgccatcgtggcagacgggaccgcggagtaccggagaaccggtgactca

SEQ ID NO: 7239 - DNA, 3753 bp, Artificial Sequence
  Description of Artificial Sequence: Synthetic coding sequence
atgtcaactgagagggatagcgagaccacttttgatgaggacagtcagccaaacgatgaagtggtgccttatagcgacgatgaaaccgaggacgagctggatgatcagggctcagccgttgaacccgaacagaacagggtgaacagggaggccgaggagaacagggagccatttcgaaaagagtgtacctggcaggtgaaggccaacgacaggaaatatcacgaacagcctcattttatgaacacaaaattcttatgcataaaggagtctaagtacgccaataatgccattaaaacttataagtacaacgcctttacctttatcccaatgaacctctttgaacagtttaagcgcgctgcaaatttatattttctagctctgctgatccttcaagccgttccacagatttccacactcgcatggtataccacactggtccctctgttagtggttctgggcgtcaccgcaattaaagacctagtggacgatgtcgcccggcataagatggataaggagattaataaccgaacctgcgaggtgataaaggatggacgcttcaaggttgccaaatggaaagagatccaagtcggagatgtgatcaggctgaaaaagaacgactttgtacccgctgacattctgttactgtcttctagtgaacccaactccttatgctacgtggaaactgcagagctggacggggaaactaatctgaagttcaaaatgagcctggagattacagatcagtacctgcagcgggaagatactttagccactttcgatggcttcattgagtgtgaagagcctaataacaggctcgacaagtttaccgggaccctgttctggagaaacacctctttccctctcgatgctgataagattctgctacggggttgtgtgatccgtaacacagacttttgccacggactggtgattttcgccggggctgacaccaagattatgaaaaattccggcaaaaccaggttcaaaaggaccaaaatagattatctgatgaactacatggtgtatactatctttgtggtgctcatactcctgtctgccggcctcgctataggacacgcttactgggaagcccaggtgggtaattcctcttggtacctttacgatggtgaggatgacactccaagctacagagggttcctgatattttgggggtacataattgttctgaataccatggtgcccatcagcctgtatgtgtccgtcgaagttatacgcctgggccagagtcactttataaattgggaccttcagatgtattacgccgaaaaagacacaccagctaaggcccgcactaccactctgaacgaacagctgggccagattcactatatcttctctgataagaccggcaccctgacacagaacattatgactttcaaaaagtgttgcataaatgggcagatctacggcgatcacagggacgcaagccaacacaatcacaacaaaatagaacaggtggacttctcatggaacacatacgcagatgggaagctcgctttctacgaccactacctgatagagcagatccagtccggcaaagaaccagaggttcgacagtttttctttctgcttgctgtgtgtcacacagtgatggtcgaccggacagatggccagctgaactaccaagccgcctcccccgatgagggggccctggtgaacgcagcccgcaactttggctttgctttcctggcccggacacagaacaccatcactatctctgagttagggactgagaggacttataatgttctggccatccttgactttaacagtgacaggaagagaatgtcaataattgtgcgaaccccagagggtaacattaagctttattgcaagggcgctgacactgtgatttacgagaggctacacagaatgaacccaaccaaacaggagacacaagatgcactggatatcttcgcaaatgagactctccgcaccctttgtctgtgttacaaggagatcgaagagaaggagtttaccgagtggaacaagaagttcatggctgccagcgtcgcctccaccaacagagatgaggctctggacaaggtctatgaggagattgagaaagacttaattctgctgggagctaccgccatagaggacaaactgcaggacggcgtcccagagacaatctctaagctagcaaaggctgacatcaaaatatgggtgctgacaggggataagaaagagaccgcagaaaacatcggattcgcatgcgaactgctgaccgaagataccacaatttgctatggggaggatataaacagtctgctgcatgctcgtatggagaatcagaggaacaggggaggcgtgtacgccaaattcgcccctccagtacaagaatctttttttccacccggcgggaacagggcactgattattaccgggtcctggctgaacgagattttactggaaaaaaagactaaacggaataagatcctgaagctcaagtttcctagaaccgaggaggagcgcaggatgagaacccagtctaaacggaggctagaggctaaaaaagagcagaggcagaagaactttgtggacctagcctgcgagtgcagtgccgtgatttgctgcagggtgaccccaaaacagaaagccatggtcgtggacttggtaaagcgatacaagaaggccatcacactggcaattggcgacggagcaaatgacgtcaatatgattaagactgcccacatcggcgtgggcattagcggtcaggaagggatgcaagcagtgatgtccagtgattattcatttgctcagttccgatacctgcagcgattactgctagttcacggacgttggtcctatataaggatgtgtaagtttttgagatacttcttttataagaatttcgccttcacactggtgcacttttggtacagcttcttcaatggttactctgcacagaccgcatacgaggactggttcatcacactgtataacgtcctatacacctccttaccagttctgctgatgggcctgctggaccaggatgtttctgataagctgagtcttcgtttccctggtctgtacatcgtgggccagagggacttactatttaattacaagcggtttttcgtcagcctgcttcatggagtgctaaccagcatgatccttttcttcattccactgggagcttatttgcaaaccgtgggccaggacggcgaggccccaagtgactaccagtccttcgccgttactatagctagtgcactggtcatcaccgtgaattttcagattggactggatacttcttactggactttcgttaacgccttttccatcttcggaagcatagccctgtactttggcataatgtttgattttcattctgccgggatccacgtgttgttcccaagtgcctttcagttcactgggactgcctccaacgccctacgccaaccctatatctggctcaccataatcctggctgttgccgtgtgcctgctccccgtcgtcgctattcggtttctgtccatgaccatttggccatccgaatccgacaaaatacagaagcaccgcaagagacttaaagcagaagaacaatggcaaagacggcagcaggtgttccgccgtggcgtgtctactcggcgatctgcctacgccttttcccaccaacgcggttatgccgacttaataagcagcggcaggtctattcggaaaaagcgcagcccattagacgctatcgtcgctgatggaaccgcagagtatagaaggacaggtgactcc

SEQ ID NO: 7240 - DNA, 3753 bp, Artificial Sequence
  Description of Artificial Sequence: Synthetic coding sequence
atgagcacagagcgcgatagcgagacaacttttgatgaggactcacaaccgaatgacgaggttgttccgtattccgatgacgagaccgaggacgaattagatgatcaggggtcagccgtcgagccggaacaaaaccgagtgaaccgagaagctgaggaaaatagggaaccttttaggaaggaatgcacctggcaggtgaaggctaatgatagaaagtaccacgagcaaccacatttcatgaacacaaaattcctgtgcattaaggagtctaagtacgcaaataatgccattaagacatataagtacaatgcctttacattcatacccatgaatcttttcgagcagttcaaacgtgcggccaatctctattttctagcgctgctgatcctgcaggccgtcccacagatctccaccctggcttggtacactacactcgtcccgctgctggtggtccttggtgttactgcgattaaagacttggtcgatgacgttgcgagacacaagatggataaagaaataaacaacagaacctgtgaagtgatcaaagacggacgtttcaaggtggcaaagtggaaagagattcaggtaggtgacgttattcgcttaaagaaaaatgactttgttcctgcagatatcctgcttctctcgtcatctgagcccaatagtttatgctatgtcgagactgcggaactggacggagaaactaacctgaaattcaagatgagcctcgagattactgaccagtacctccagagagaggacactctggcgacgttcgatgggtttattgaatgtgaagagccaaacaatcggttagacaagtttactggtaccctcttctggcggaacacttcattcccccttgacgccgataaaattttgttacgggggtgtgtaattaggaacactgatttttgtcacggcctggtgatctttgccggtgccgatacaaagataatgaagaactcaggcaagacccggtttaagcgtactaaaatcgattacttgatgaattatatggtttacactatattcgtggtgctgatcctgctgtccgcgggcctagccattggacatgcctactgggaggcgcaggtaggaaactcttcctggtacctgtacgatggcgaggacgatacgccctcgtacagaggcttcctgatcttctggggatatatcattgttctcaataccatggtgccaatcagcctgtatgtcagcgtggaggtgatccgcctagggcaaagccattttatcaattgggacctgcagatgtactatgccgaaaaggacacacccgcaaaagcgaggaccacaaccctgaatgaacagctgggccagattcattatatcttttccgacaagacagggacgctgactcagaacataatgacatttaagaaatgctgcattaacggccagatatacggagatcacagagatgcaagtcagcacaaccacaacaaaatcgagcaggtggatttttcctggaacacatatgccgatggcaagctggccttttatgatcactatctaatagaacagatccagtctgggaaggagccagaggtccgacagttctttttcctgcttgcagtctgccacactgtgatggttgaccgaaccgatggtcaactgaattatcaagccgcctcccccgacgagggcgctctggtaaacgctgcccgcaactttggattcgcttttttggctagaacgcagaacacaattacaattagcgagctcgggacggagaggacttacaacgtgctggcaatacttgatttcaactcagacagaaagcggatgagcatcattgtgcgcacgcccgagggcaacatcaaattgtactgcaagggagccgacactgtgatctacgaacggcttcaccgtatgaatccaaccaaacaggagacccaggatgccctcgacatctttgcaaatgagaccctgcgtactctgtgcctttgctataaagagatcgaggagaaagaatttacggagtggaacaagaaattcatggcggcaagcgtagcttcgacgaatcgcgatgaggcattagacaaagtttacgaagaaattgagaaagacttgattttgctgggcgccaccgcaatagaagataagctgcaagacggtgtgcccgagactatatctaaactggccaaagccgacatcaaaatctgggtgctcaccggggacaaaaaggaaactgcagaaaacatcggcttcgcctgtgagctgctcacagaagatacaactatttgctacggagaggatataaacagcctgcttcacgcaaggatggagaaccagaggaaccggggaggtgtctacgcaaagttcgcgccccctgtccaggagtccttctttccaccagggggaaaccgagcgctcattataacgggcagctggttgaacgagatcctgctcgaaaaaaaaaccaaacgcaacaagattctaaagcttaagttcccacggaccgaggaagagaggcggatgagaacccagtcgaagagaaggctcgaagcgaaaaaagaacagagacagaaaaatttcgtggacctggcatgtgagtgctctgcggttatatgttgtagggttacgccaaagcaaaaggccatggtggtggacctcgtgaagcgctataagaaggctattacacttgctattggggatggagccaatgacgtgaacatgataaagacagcccatattggggtggggatttctggccaggagggcatgcaggcagtgatgtcctctgattacagtttcgctcagttccggtatctgcagcgcctcctactggttcacggcaggtggtcatatatccgaatgtgcaaattcttgcgctatttcttttacaaaaatttcgcctttacactcgtgcatttttggtattcattttttaacggatactccgcccagactgcctacgaggattggttcataaccctttataacgtgttgtacacctccctgccagtcctattgatgggccttttagatcaggacgtctcagataaactttcactgcgcttccccgggttatacattgtgggccagcgagacttgctgtttaattacaaacggttcttcgttagcctgttgcacggggtactgacttccatgattttgttttttatcccgctcggcgcatacctgcagaccgtgggacaggacggcgaagcccccagcgattaccagtcctttgccgtgaccattgcttccgcactagtaatcaccgttaatttccagataggcctggatacgtcttactggacttttgtgaacgctttttcgatcttcggctctattgccctttattttgggatcatgttcgatttccattccgcaggtatccacgttctgtttccatcagcatttcagtttaccggcacagcatctaacgccctgcgacagccctacatctggcttaccattattctcgcagtggctgtctgcctgctcccagtcgtggctatcaggtttctctccatgacaatctggcctagtgagtctgataagatacagaaacataggaagcggttgaaggccgaggaacagtggcaacgtaggcaacaagtgttcagaagaggagtttcaacgagacgttctgcctatgctttttcacaccaaagaggctacgccgatctgatttcctccggcaggtccatcaggaaaaagcgcagccccctggatgctattgtcgccgatggaacagccgaatatagacggaccggtgattct

SEQ ID NO: 7241 - DNA, 3753 bp, Artificial Sequence
  Description of Artificial Sequence: Synthetic coding sequence
atgtccactgaaagggacagcgagaccacctttgatgaggatagccagcccaacgatgaggttgtgccctatagtgatgatgaaactgaggacgaactggatgatcaaggtagtgcagttgagccagaacagaatcgggttaaccgggaggcagaggagaaccgagaacccttccgcaaggaatgtacttggcaggtgaaggcaaacgaccgaaaataccacgagcaaccccacttcatgaacaccaagtttctctgtataaaagagagtaagtatgccaataacgcaatcaaaacttataagtacaacgccttcacgtttatccccatgaatctctttgaacaatttaagcgggccgctaatctgtactttctggcgctgttgatcttgcaggccgtcccgcaaatttccacactcgcatggtataccacactcgtgccccttctcgtcgtgctcggcgtcaccgccattaaggacctggtagacgatgtcgcccggcacaaaatggacaaagaaattaataatcgaacttgcgaggttattaaggacggtaggttcaaggttgcaaagtggaaggagattcaagtgggagatgtgattagacttaaaaaaaacgacttcgtccctgcggacatactgctcctttcttcttccgaaccgaactcactctgttacgtggaaactgcagagctggacggcgagacaaatctgaaattcaagatgtccctcgagatcacggaccaatatctgcagcgcgaggatacccttgcgactttcgatggtttcatcgagtgtgaagagccgaataaccggcttgacaagttcacaggaaccttgttttggaggaatacctcctttccactggatgctgacaagatcctactgcggggatgcgtaatcaggaacaccgacttctgccacgggctggtcatttttgccggagccgacacgaaaatcatgaagaattccgggaaaacccgtttcaaaaggaccaagatagattacctgatgaactatatggtgtatactatatttgtggttctaatcttgctgagcgcaggtctagccatcggacacgcctattgggaggctcaggttggaaatagcagttggtacttatacgacggagaggacgacactccttcatatagaggctttcttattttttgggggtacattattgtgcttaacacgatggtacccatatctctgtacgtcagcgtggaggtgataaggctcgggcagtcccattttatcaattgggatctccagatgtattatgcagagaaagataccccggctaaagctcgcactacgaccctgaatgagcagctcggacaaatacactacattttctccgataaaaccgggacccttacgcagaatataatgacctttaaaaaatgttgcatcaacggacagatatacggtgatcacagggacgcctcacagcacaatcacaacaagattgagcaagtggacttttcctggaatacatatgcagacggcaagttagcgttctatgaccactacttaattgagcagattcagtctggcaaggaacctgaggtgagacaattcttctttctcttggcggtgtgccatacggttatggttgataggactgacggccaactgaattaccaggctgcctctccggatgaaggcgccctggtcaacgcagcccggaactttggatttgcttttctggcccggacccagaacacgattaccataagtgaactgggaacggagcggacctacaacgtgttggctatattagattttaacagtgataggaagaggatgtctatcattgtccggaccccagagggaaatataaaattgtactgcaagggggctgacacggttatatacgaacgtcttcataggatgaacccaacaaaacaggagacccaggacgcgttggatattttcgcaaatgaaactctgcggaccctgtgtctgtgctacaaggaaatcgaagagaaagagtttacagaatggaacaaaaaattcatggctgcttctgtcgcatccactaacagggatgaagcacttgacaaggtctacgaagaaatagagaaggaccttattctcctgggggccactgcaattgaggacaaactgcaggacggagtgcctgagacaatctctaagttggccaaagcggacatcaagatttgggtcctgactggtgacaaaaaagagacggcagaaaacatagggtttgcttgtgaactcctcactgaagacaccaccatatgctacggcgaggatattaattccttattgcatgctcgcatggagaaccagagaaatagaggcggggtgtatgcaaagttcgccccacccgttcaggaatcgtttttccctccaggaggaaatagagctctgataatcaccggctcttggctgaatgaaatactgctagaaaagaaaacgaagagaaataagatcctgaagttgaagttccctcgcactgaggaagaaaggcggatgcgaacacaatccaaacgacgcctggaggctaagaaggagcaaagacagaagaatttcgtggacctggcatgtgagtgttcagctgtgatctgttgtagagtaacacctaagcagaaggcgatggtggtcgacctggtgaaacggtacaaaaaggcgataacactggcaataggcgatggggccaacgatgtgaacatgatcaagaccgctcatattggtgtcggaataagcggccaggagggaatgcaagctgtgatgagtagcgattacagctttgcgcaattccgttatctccagcggctgctcttagtgcacggaagatggagttacatccggatgtgtaagtttcttcgctacttcttctacaagaattttgcctttaccctggtacatttttggtatagtttctttaatggttattcagcccagacggcctacgaggactggtttatcactctgtataacgtgctgtatacctcactgcccgtgctcctcatgggactgctagatcaggacgtgagcgataaattatcattacggttccccgggctttatatcgtggggcagcgggaccttttattcaattataaaaggttctttgtgtcgctcctgcacggcgttctgacaagtatgatcctgttttttattcccttaggtgcgtaccttcagacagttggacaggatggcgaagccccttcggactatcagtcgtttgccgtcacaattgcctccgcgctcgtgattaccgtgaactttcagattggcctcgacacctcttattggactttcgtcaacgcctttagtatatttggatccattgctctctacttcggaattatgtttgactttcactccgctggaatccacgtgctgttcccttccgcattccagtttaccggtaccgcatctaacgcgcttagacaaccatacatatggctgacgatcattttggctgtggccgtgtgcttgctccctgttgtcgccataaggtttctgtctatgacaatctggccgagtgaatccgataagatccagaaacaccggaaaaggcttaaggctgaagagcaatggcagcggaggcagcaggtgttccgcaggggtgtgtcgacacgccgatctgcctatgccttttcccaccagcgaggatatgccgatctgatatctagcggacggtccataagaaagaagcggagcccactcgacgcaattgtcgcagacggcaccgccgaatacaggaggacaggcgactca

SEQ ID NO: 7242 - DNA, 3753 bp, Artificial Sequence
  Description of Artificial Sequence: Synthetic coding sequence
atgtctactgaaagagattcagaaaccacatttgatgaagattcacaaccaaatgatgaagtcgttccttattctgatgatgaaactgaagatgaacttgatgaccaaggaagtgctgtagaaccagaacaaaatagagttaatagagaagcagaagaaaatagagaaccatttagaaaggaatgtacatggcaagttaaagctaatgatagaaaatatcatgaacaaccacattttatgaatacaaaatttctttgtattaaggagtctaaatatgcaaacaatgcaattaagacatataaatataatgcttttactttcattccaatgaatttatttgaacaatttaaacgagctgcaaacctatattttcttgcattgttaattttacaagcagtaccacaaatcagtactttagcatggtatacaacattagttccattattagttgttcttggagttactgctattaaagatttagtagatgatgttgcaagacacaagatggataaggaaattaataataggacttgtgaagttataaaagatggaagatttaaggttgcaaaatggaaagaaattcaagttggagatgtaatacgtcttaaaaaaaacgattttgttcctgctgacattttattgctttccagtagtgaacctaattcattgtgttatgtagaaacagctgaattagatggagaaacaaatcttaaatttaaaatgagtttagaaattacagatcaatatcttcaaagagaagatactcttgctacttttgatggatttattgaatgtgaagaaccaaacaatagacttgataaatttacaggaacattattttggaggaatactagttttccacttgatgctgacaagatattgcttagaggatgtgttatcagaaatactgatttttgtcatggtcttgttatttttgctggagctgatactaaaatcatgaagaactcaggaaagactagatttaaaagaacaaaaatagattatttaatgaactatatggtatatacaatttttgtagttttaattcttctatcagcaggattagcaattggacacgcttattgggaagctcaagttggaaatagttcttggtatctttatgatggagaagatgatactccatcatatagaggatttttaattttttggggatatattattgttcttaatactatggttcctattagtttatatgttagtgttgaagttattagacttggacaatcacatttcataaattgggatctacaaatgtattatgctgagaaggatacaccagctaaggcaagaacaacaacgcttaatgagcaattagggcagattcattatatatttagtgataaaactggtacattaactcaaaatattatgacatttaaaaaatgttgtattaatggacaaatatatggtgaccatagagatgctagtcaacataatcataataaaattgaacaagttgatttttcttggaacacatatgcagatggaaaattagctttttatgatcattatcttattgaacaaattcaatctggaaaggaaccagaagtaagacaatttttttttttacttgctgtttgtcatacagtaatggttgatcgtactgacggacaacttaattaccaagcagcatctccagatgaaggtgcattggttaacgctgcaagaaactttggattcgcatttttagcaagaacccaaaatacaattactatttcagaattaggaacagaaagaacatataatgttttagcaattttagattttaattcagatagaaaacgtatgtcaataattgttagaacaccagaaggaaatattaagttgtattgtaaaggagcagatactgttatttatgaaagactacataggatgaatccaacgaagcaagaaacacaagacgcattagatatttttgcaaatgaaactttaagaacactttgtctttgctataaagagatagaagaaaaagaatttactgaatggaacaaaaagtttatggcagcatcagttgcttcaactaatagggatgaggctttagataaagtttatgaagaaattgagaaagacttaattttattaggagctacagcaattgaagataaacttcaagatggagtgccagaaacaataagtaaacttgcaaaagcagatattaaaatttgggttttaacaggagataaaaaagaaactgcagaaaacataggatttgcttgtgaattattgacagaggatactactatttgttatggagaagacattaattctcttttgcatgctagaatggaaaaccaaagaaatagaggaggagtgtatgctaaatttgctcctcctgttcaagaatcgttctttcctccaggaggtaatagggcacttattataacaggatcatggttgaatgagattttattagaaaaaaaaacaaaaagaaataaaattctcaagcttaaattcccaagaaccgaagaggaaagaagaatgagaacacaaagtaaaagacgattagaggcaaaaaaggagcaacgacaaaagaattttgttgatcttgcatgtgaatgttcagcagttatttgctgtagagttactccaaaacaaaaagcaatggttgtagatctagttaaaagatataaaaaggctataacattagcaattggtgatggtgctaatgatgttaatatgattaaaactgcacatattggtgttggtatttcaggacaagagggaatgcaagcagttatgtcatcagattattcatttgcacaatttagatatttacaaagactattattagttcatggaagatggtcatatataagaatgtgtaaatttctacgttacttcttctataagaatttcgcttttacacttgttcatttctggtatagtttttttaatggatatagcgcacaaactgcatatgaagattggttcattacattatacaatgttctttatacttcattgcctgtattactaatgggtctacttgatcaagatgtttcagataaattatcattaagatttccaggattatatattgttggacaacgtgatttattattcaactataaaagattcttcgtatcattacttcatggtgtattgacttcaatgattcttttttttattccattaggagcttatcttcaaaccgtcggacaagatggagaagctccatctgattatcaatcatttgctgttacaattgcttcagctttagttattacagttaattttcaaataggtcttgatacttcttattggacttttgttaatgctttcagtatttttggaagtatagcactttattttggaattatgttcgatttccattcagcaggtattcatgtattatttccatcagcctttcaatttactggaactgctagtaatgctcttagacaaccatatatttggcttacaattattttggctgttgctgtttgtcttttacctgttgtagcaattagatttttatctatgacaatatggccatcagaatctgataaaattcaaaaacacagaaaaagattaaaggctgaggaacaatggcagagaagacaacaagtatttagacgtggagtttcaactagaagatctgcatacgctttttcacaccaaagaggatatgctgatttaatttcttcaggtagatcaattagaaagaaaaggtcaccacttgacgccattgttgctgacggaactgctgaatatagaaggactggggattct

SEQ ID NO: 7243 - DNA, 3753 bp, Artificial Sequence
  Description of Artificial Sequence: Synthetic coding sequence
atgtccaccgagcgagatagcgaaaccacgtttgacgaggatagccaaccaaatgacgaagtggtgccatacagcgacgacgaaaccgaagatgaactggatgatcaaggttcagcagtggagccagaacaaaatcgtgtcaaccgcgaagctgaagagaacagagaacccttccgcaaggaatgtacctggcaagtcaaggcgaatgatcgaaagtaccatgagcaaccacatttcatgaacaccaagttcctctgcattaaggagtccaagtatgcaaacaacgccataaagacttacaagtacaacgcatttactttcatacctatgaaccttttcgaacagtttaaacgtgccgctaacctgtactttctcgcactgctgatcttgcaagccgttcctcaaattagcaccctggcgtggtacaccactctggttccgcttcttgtggtgctgggagtcaccgcgattaaagatcttgtcgacgatgtggcgcggcataagatggataaggaaatcaataacagaacgtgcgaggtgattaaggatggccggtttaaagtggcgaaatggaaggaaattcaagtgggcgacgtgattaggctgaagaaaaatgatttcgtcccggctgatattctccttctttcatcctccgaacctaattcactctgttacgtggaaactgcagaacttgacggcgagactaatcttaagtttaagatgtcccttgaaattaccgaccaataccttcagagagaggacacgcttgccactttcgacggttttatcgagtgcgaagagcccaataatcgactcgataagttcaccggtactctcttttggagaaacacctcgtttcccctggacgctgataagattctgctgaggggatgtgtcatacgcaacaccgatttttgtcatggactggtgattttcgccggcgccgacaccaagattatgaagaactctggaaagactcgctttaaacggactaagatcgattaccttatgaactacatggtgtatactatctttgtggtgctcatccttttgtcagcgggactggcaattggtcacgcatactgggaggcacaggtgggaaactcctcctggtacctttacgacggcgaagatgatactccgtcataccgcgggttcttgatcttttgggggtacatcattgtgcttaacacgatggtgccaatttccctgtacgtgtccgtggaagtgattcggctgggtcaatctcacttcatcaattgggatcttcagatgtactatgctgaaaaggacaccccagcgaaagcccgaactactactctgaacgaacagctgggccagatacattacatcttctcagacaagactggcactctcactcagaacattatgaccttcaaaaagtgttgtatcaacggccagatctatggagatcaccgggacgcatcgcagcacaaccataacaaaattgagcaggtggatttttcttggaacacctacgcagatggaaagctggcattttacgatcattacctcattgagcaaattcagtccggaaaggaacctgaagtcaggcagtttttcttcctcctggcagtgtgccacactgtgatggtggaccgcactgacgggcaactgaactaccaagcagcttcaccagacgaaggcgcactggtgaatgcagcacggaactttgggtttgctttcctggccagaacccagaacaccatcaccattagcgagctgggaactgagcggacttacaacgtcctcgccattctcgacttcaattccgatcgcaagcgaatgtccataatagtgcgaaccccagagggaaacatcaagttgtactgtaagggggccgacaccgtgatttacgaaaggctgcatcggatgaaccctactaaacaagaaactcaagatgcgctcgatatctttgcgaatgagactctgcggaccctctgtctctgctacaaagaaatagaagagaaagagtttaccgaatggaacaagaaattcatggcggcatcggtcgcatcgaccaaccgggatgaggctctggataaagtgtacgaagaaatcgagaaagatctgatccttctgggcgcaaccgcaattgaagataaactccaagacggtgtccctgaaaccattagcaaactcgcaaaggccgacatcaagatctgggtgctgaccggggacaaaaaggagacggcagagaacatagggtttgcgtgtgaactcctgaccgaagataccaccatttgttacggggaagatatcaactcgttgcttcacgcaaggatggaaaatcagaggaatagaggaggcgtctacgcgaagttcgcaccccccgtgcaggaatcctttttcccacctggtggtaatagagccctgattatcactggatcgtggcttaacgaaattctgctggagaaaaagacgaagcgcaacaagatccttaagctgaaatttcccagaacggaagaagagagacgaatgagaactcagagcaagcgtcggcttgaggccaagaaggaacaaaggcagaagaatttcgtggatctcgcatgtgagtgttcggcagtgatctgttgtcgggtgacccctaaacagaaggctatggtggtcgaccttgtcaaaagatataagaaagccatcaccctggcgatcggtgacggtgcaaacgacgtgaatatgataaagacggctcatatcggggtcggtatttccggacaagagggtatgcaagctgtgatgtcctcggactactcttttgctcaattccggtaccttcagcggcttcttctggtgcatggaaggtggtcgtatatccggatgtgcaagtttcttcgctacttcttctataagaatttcgcgttcactctcgtccatttttggtactcgttcttcaacggctactcggcacaaacggcgtacgaagattggttcatcaccctctacaatgtcttgtacacttcactcccggtcctgcttatgggactgctcgatcaagatgtgtcggataagctctcactccgatttcccgggctgtacattgtgggccaaagagatctgcttttcaactacaagaggtttttcgtgagcctgctgcacggcgtccttacctccatgatcctcttctttatcccacttggggcatatttgcagacggtggggcaagatggagaagcccctagcgattaccagtcgtttgcagtcaccatcgcctcggcgttggttattactgtgaacttccaaattggcctcgataccagctactggactttcgtgaacgcattttcaattttcggttccattgcactttacttcggtattatgttcgattttcacagcgcaggaatccacgtcctgttccctagcgcattccagtttactggaactgcaagcaacgcactgcggcaaccttacatatggcttacgattattctcgccgtggcagtgtgtctcctccctgtggtggcaattcgttttctgtcgatgaccatctggccttccgaatccgataagatccagaagcaccgtaagcgccttaaagccgaagaacaatggcaacgccggcaacaagtctttagaaggggagtgtcaactcgtagaagcgcatacgcctttagccatcagcgcggttatgcagacctcatttcctcgggacggtccatccgaaagaaaagatcaccacttgacgctattgtggcggacggaactgcagagtaccggaggacgggtgattcc

SEQ ID NO: 7244 - DNA, 3753 bp, Artificial Sequence
  Description of Artificial Sequence: Synthetic coding sequence
atgagtacggagagggacagtgaaaccactttcgacgaggactctcaacccaacgacgaggtcgtgccatactccgacgacgagaccgaggacgaactggacgatcagggaagtgctgtcgagccagaacaaaatcgcgttaacagggaggccgaggagaatagggaaccgttcaggaaggaatgcacttggcaagtgaaggcgaacgatcgcaagtaccacgagcagccacacttcatgaacactaaatttttgtgcattaaagagtccaaatacgccaacaacgccattaaaacctataagtataatgcttttacgtttatcccaatgaatctctttgagcagttcaaaagggccgcgaacctgtacttcctggcattgcttattcttcaggccgtgccacagatctcaacacttgcttggtacaccaccttggtgccgctgttggtggtgctcggcgtcactgctattaaggatttggttgacgacgtcgcacgccataaaatggacaaagaaattaataataggacgtgcgaggtcatcaaggacggaaggttcaaagtagccaagtggaaagagattcaggtgggcgatgtaatccgcctgaagaagaacgattttgttcccgccgacatactgctgctcagctcctctgagcccaatagcttgtgttacgttgagactgcagagcttgacggcgagactaacttgaaattcaaaatgtcccttgagatcacagaccaatatttgcagagagaggacacgctggcaacgtttgacggctttatcgagtgcgaggaaccaaacaacagactggataagttcaccggaacactgttctggcgcaatacctctttccccctggacgcagacaaaattcttcttcgcggttgtgtcattagaaacaccgacttctgccatggtctggttattttcgctggcgcagacactaaaatcatgaagaacagcggaaagacaagattcaaaaggacaaaaattgattatttgatgaactacatggtttataccatttttgtggtcctcattctgctgtccgcgggcctggccatcggacacgcctactgggaggcccaagtgggcaattcatcttggtacctgtatgacggagaggatgacaccccgtcataccgcggatttcttatcttctggggctatatcattgtgttgaacacaatggtgcctatttctttgtatgtgtctgttgaagttattaggcttggccagtctcacttcataaattgggacctccagatgtattatgccgagaaggatactccagcaaaggcgaggaccacaaccctcaacgaacagctgggccaaattcactatatattcagcgacaagacaggcaccttgactcagaatattatgactttcaagaagtgctgcatcaacggacaaatttatggtgaccatagagatgcctcccagcataaccataacaaaatagagcaagtggatttttcttggaatacttacgcagatggcaagctcgcgttctatgatcactacctgattgagcaaatccagagcggaaaagaacccgaggttagacagttctttttcctgctcgccgtttgccacaccgttatggtggacagaacagacggccagctgaattatcaggcagcatcacccgacgagggcgccttggtcaatgctgcccgcaatttcggtttcgcctttctggcgagaacacagaatacaatcaccattagtgagctgggtaccgaaagaacttacaacgtccttgccatcctcgattttaactcagataggaagcgcatgtcaatcatcgtgagaaccccggaaggcaacatcaagctttactgcaagggcgctgataccgtcatctatgagagattgcacagaatgaatccaacaaagcaggagacacaagatgctctcgacatcttcgcaaacgagaccctgaggaccctctgtctctgctacaaggaaatcgaggagaaggagttcaccgaatggaataaaaaattcatggccgccagcgtggcttctaccaacagggatgaggctttggacaaagtgtacgaggagatcgaaaaggaccttatacttctgggcgcgactgctattgaggacaaattgcaggacggtgtccccgaaacaattagtaaattggcgaaggctgacatcaagatttgggtgttgaccggcgacaagaaggaaacagctgagaacataggctttgcttgcgagctgctcaccgaggacactacaatatgctatggcgaggacattaatagcctcctccacgcgagaatggaaaatcagagaaataggggaggagtttacgccaaattcgccccccctgtgcaagagtcctttttcccacctggcggaaaccgcgccctgatcattacaggttcctggctgaatgaaatcctcctggagaagaaaaccaagcgcaacaagattttgaaactgaagtttcctagaaccgaagaggagagacgcatgcgcactcagtcaaagaggcgcctcgaagcaaaaaaagaacaacgccagaaaaacttcgttgatttggcttgtgaatgttccgctgttatatgctgccgcgtcactcctaagcagaaggccatggtggtagacctggtgaaacgctacaagaaagcaataacattggctatcggcgatggcgctaacgatgtgaatatgattaagacagctcatattggagtgggcattagcggacaagaaggcatgcaagctgtcatgtctagcgactacagcttcgcgcaattcagatatctgcaaaggctccttctggttcacggacgctggagctacattcgcatgtgtaaattcctgaggtacttcttttataagaattttgctttcaccctggtgcacttttggtacagcttctttaatggctatagcgctcaaactgcatacgaagattggtttatcaccctgtacaatgtgctgtatacttctctccccgtgttgcttatgggtcttctggaccaggatgtcagcgataagctctccctccgctttccgggactgtacattgtgggccaacgcgacctgctctttaactataagagattcttcgtctcactgcttcacggagtgcttacttcaatgattctgttcttcatccccttgggagcctacttgcagacggtaggccaggacggtgaggctcctagtgattatcaaagcttcgccgtcaccattgcgtctgctttggtgatcacagtgaacttccaaatcggactcgatacgtcttattggactttcgtcaacgcattcagcattttcggtagcatcgctctttacttcggtataatgttcgactttcactccgctggaatccacgttctctttccatccgcctttcaattcacaggaactgcatctaatgcactgaggcagccctacatatggctgactattattctggcggtggccgtgtgtcttcttccggtcgtcgccattagattcctgagcatgactatctggccatccgagtcagataagatccagaagcataggaaacgcctcaaggccgaggagcagtggcaacgcagacagcaggtcttccgcaggggtgtgtcaaccagacgcagtgcctatgcgttttcccatcagagaggatacgcggacctgattagctccggcagatctatccgcaagaagaggtccccgctggacgctattgtggccgacggaaccgcagagtacagacgcaccggagatagc

SEQ ID NO: 7245 - DNA, 3753 bp, Artificial Sequence
  Description of Artificial Sequence: Synthetic coding sequence
atgtccaccgagcgcgatagcgaaaccacttttgacgaggactcgcaaccaaacgatgaagtggtgccgtactctgacgacgagactgaagatgaacttgacgatcagggatcggcagtggagcctgaacaaaacagagtgaacagggaggcggaagagaacagggaacctttccggaaggagtgtacctggcaagtgaaagccaacgatagaaaataccatgaacaaccccacttcatgaacactaagtttctgtgtatcaaagagtccaaatacgcaaacaatgcaatcaagacttacaagtacaacgcgtttacctttattcctatgaatctcttcgaacagtttaagagagcagcgaatctttacttccttgcactgctgatcctgcaggcagtgcctcagatctcaactcttgcatggtacactaccctggtccccctgcttgtggtgctcggtgtcactgccattaaggaccttgtagacgacgtggcaaggcataagatggacaaggagattaacaatcgaacttgcgaagtgattaaggacggtagattcaaggtggccaagtggaaggaaattcaggtgggcgacgtgatcaggctcaagaaaaatgattttgtgccagcggacatcctgcttctctcgtcaagcgaaccaaatagcctctgttacgtcgaaaccgctgaattggatggcgaaaccaacctgaagtttaagatgtccctggaaataactgaccagtatctgcaaagagaggacacgcttgcaactttcgatggttttatcgaatgtgaagaacctaataacaggcttgacaaattcactggaacgttgttttggagaaatactagctttcccctggacgcagataagatacttctgagaggttgtgtgattcgaaacaccgacttttgtcacgggctggtcatctttgcaggcgcagacaccaagatcatgaagaactccggtaagaccagatttaagcgcaccaagattgattacctcatgaattacatggtctataccatcttcgtggtgcttattctgctgtcagccggtctggcaattggtcatgcctactgggaggcgcaggtgggaaattccagctggtatctctacgatggtgaggacgatactccctcctaccggggtttcctcattttctggggttacattatagtgctgaacaccatggtgccaatttccctgtacgtctccgtcgaagtgataagattgggtcaatcgcatttcattaactgggacctgcaaatgtactacgccgaaaaggatacccccgcgaaagcacgaaccactacccttaatgaacagctgggacagattcattacattttctcggataagaccggtacccttacgcagaacattatgactttcaaaaagtgttgtatcaacgggcagatttacggtgaccaccgtgacgcatcccaacacaatcataacaaaattgaacaagtggacttctcgtggaatacctacgctgatggcaagttggcattttacgatcactacctcatcgaacagattcagagcggaaaagaaccagaagtccggcagtttttcttcctgctggctgtgtgccataccgtcatggtggaccgcactgatggtcagctcaactaccaagccgcatccccagacgagggtgcactggttaacgccgccaggaattttggattcgcatttctcgcaagaacccaaaacactattaccattagcgaactgggtaccgaacggacgtacaacgtcctggcaattttggatttcaactccgacagaaagcggatgtcaataatcgttcggacgcctgagggaaacatcaagctgtactgcaagggtgcggataccgtcatatacgaaaggctccacagaatgaaccctactaagcaggagacgcaggatgcactggatatctttgcaaatgaaacgcttagaaccctctgtctctgttacaaggaaatcgaagagaaagaatttactgagtggaacaagaagtttatggcagcctcagtggccagcactaaccgagacgaagccttggataaggtctacgaagagattgaaaaggacctgatcctccttggggccactgcaatagaagataagctgcaagacggagtgcccgaaaccatttccaaacttgcaaaggcagacatcaagatttgggtccttaccggcgacaaaaaagagactgcagagaacataggattcgcatgtgagctgttgacggaggatactaccatctgctacggagaggatatcaactcgctgctccacgctaggatggaaaatcagcggaatcgcgggggagtgtatgccaagtttgcaccaccagtgcaagagtcctttttccccccaggtgggaaccgtgctctgatcataaccggttcttggcttaatgagattctgctggaaaagaaaaccaagagaaataagattttgaaattgaaattccctagaacggaagaggaacgtcgaatgcggacccaatcgaagcgcagactggaagctaaaaaggagcagcgtcagaagaattttgtggatctcgcatgtgaatgctcagctgtgatctgttgccgagtcaccccgaagcaaaaggcgatggtggtggatctggtcaaaagatacaagaaagccattactctcgcaattggtgatggagctaacgacgtgaacatgattaagactgcacatatcggcgtgggaattagcggacaagaaggtatgcaagcggtcatgagcagcgattactcttttgcacagttcagatacctccagagacttttgctcgtccatggtcgttggagctatatcaggatgtgcaaatttctgcgatactttttctacaagaattttgcattcactcttgtgcatttttggtactcgtttttcaatggctactccgcccaaactgcatacgaagattggttcattaccctttacaatgtgctgtatacgtccttgcctgtgctgcttatgggactgctcgatcaagacgtgagcgataagctctcactgagatttcctggactgtacattgtgggccagcgggacctgttgtttaactacaagcgatttttcgtttcgcttctgcacggggtgcttacttccatgattctctttttcatccctctgggcgcatacctccagacggtgggtcaagatggggaggccccatctgattatcagtcgttcgcagtgactatcgcgtctgccttggtcattaccgtgaactttcaaataggcctggacacttcgtattggaccttcgtgaacgcgtttagcatcttcggatccattgcgctttactttgggattatgtttgattttcattcagcaggtattcatgtgctgttcccgtcggcctttcaattcactggtaccgcatccaatgccttgcggcaaccttacatttggcttacgatcatcctggcagtggccgtgtgtctcctgcctgtcgtggcaatacggttcctttcgatgaccatttggccttcagaatcggataagatacaaaagcacagaaagcggcttaaagcagaggaacagtggcaacggcgccaacaggtgttccgtcgaggtgtgtcaactcggaggagcgcatacgcatttagccaccaacgcgggtacgcggatctgatttcatccggcagatccatcaggaagaagcgttcgcctctggatgcaattgttgcagatgggaccgcggaatacaggagaactggagattca

SEQ ID NO: 7246 - DNA, 3753 bp, Artificial Sequence
  Description of Artificial Sequence: Synthetic coding sequence
atgtccaccgagcgggattcagaaaccacattcgatgaagactcccagccgaatgacgaggtggttccttacagcgatgacgagaccgaggacgagctggatgatcagggctccgccgttgaacccgagcagaatcgggttaacagagaagcagaggagaaccgtgaaccctttagaaaggagtgcacctggcaggtgaaggcaaacgatcgcaagtatcacgagcagccacatttcatgaatacaaagttcttatgcatcaaggagtccaagtacgccaataacgcgattaaaacatataagtacaatgcgttcaccttcatccccatgaaccttttcgagcagtttaaacgagcagccaatctttattttctggcgctgctaatcctccaggctgttccccagatttccactctggcatggtatacaaccctagtacctctgctggtggtgctgggagtgaccgctattaaagacctggtggatgatgtggcccggcacaaaatggacaaagagattaacaatcgcacttgcgaggtgattaaggatgggaggtttaaggtggctaagtggaaagagattcaggtcggagatgtgattaggcttaaaaagaacgatttcgtccctgccgatattctactgctctcctcttctgaacccaattcactttgttatgtggaaaccgcggaattggacggtgagacaaacctcaaatttaaaatgagcctcgagataaccgatcaatacctgcagagggaggacaccctggccacattcgacgggtttatagagtgcgaggaaccaaacaatcgcctcgataaatttactggcactttgttctggcggaacaccagctttcccctggacgccgacaaaatactgctgcgcggatgcgttatccggaacaccgatttctgccatggactcgtcatctttgcaggggcggatactaaaataatgaaaaattctggcaagacgaggttcaagaggactaagatcgactatttgatgaactacatggtctacacgattttcgtcgtgctgattctgctaagtgccggtctcgccatcggccacgcctactgggaggctcaagtaggtaattcaagctggtacttgtatgatggggaggacgacactcccagttatcgcgggtttctcatcttttgggggtacatcattgtgttgaatactatggtgcctatttcactctatgtcagcgtcgaagtaattcgattggggcagtcccactttatcaactgggatctgcagatgtactatgcggagaaggacaccccagctaaggctcgaaccacgaccttgaacgaacagctggggcaaatacactatattttttctgacaagaccggtacgttgactcaaaatattatgaccttcaagaagtgctgtatcaatgggcagatctacggtgatcacagagacgcctcacagcacaaccataataagattgaacaggtcgatttctcatggaacacctacgctgacgggaagctggccttctacgatcactatttgatcgagcaaatccagtccggtaaggagcccgaggtgaggcagttcttcttcttgttggccgtgtgccacacagtaatggtggaccggactgacggccaactgaattatcaggccgcaagtcccgatgaaggggcattagtaaacgctgcccgcaatttcggcttcgctttcctggcgcggacacagaacactatcacaatttcagaactggggacggagcgaacctataatgttctcgctatcctcgacttcaacagtgaccgaaagcggatgtccatcatcgtgcgaaccccggaaggtaacatcaagctgtattgcaaaggagccgacacagtcatatacgaacgcctgcacagaatgaatccaactaagcaggagactcaggacgcactcgatatatttgccaacgaaacactaaggacgttgtgcctgtgctataaagagatcgaggaaaaggagtttaccgagtggaacaagaagttcatggctgcctccgtagcgtcaacgaaccgagacgaagccctggataaagtgtacgaagagatcgagaaggacttaatcctattgggggccactgctattgaagataaactgcaggacggcgtgccagaaacgattagcaagctggcaaaggccgatattaagatctgggtgctgacgggtgacaagaaagaaaccgccgaaaatataggctttgcctgtgaactactgacagaggacaccaccatttgctatggagaagatatcaactcactgctgcacgcccgaatggagaatcaacgcaaccgcggtggcgtctacgctaaatttgctcctcccgtccaggaatcttttttccctcctggaggtaacagggccctaattattacggggtcctggctcaacgagatactgctcgagaagaagacaaaaagaaacaaaatcctgaagttgaagttccccagaaccgaagaggagagacgcatgaggactcagtccaaacgccgtcttgaagctaaaaaggagcaaaggcagaagaactttgtggatttagcatgcgaatgtagtgcggtaatatgctgcagagtgacccccaaacagaaggccatggtggttgatcttgtcaagagatataagaaggcaatcacattggctatcggagacggtgccaacgacgttaatatgatcaagacggcacatattggagtcggtatttctggacaagagggtatgcaggccgtcatgtcgtcagactactcttttgcgcagtttcgatatctccagaggctgctgttggtgcacggtaggtggtcctacatcagaatgtgcaagtttctgcggtacttcttctacaagaacttcgcttttacccttgtccacttttggtacagtttcttcaatggctacagcgcacaaacagcgtatgaggactggttcataacactgtacaacgtcctctatacatccttgcccgtgttactgatgggtctgcttgaccaagacgtttcagacaaactgagtctgcgcttccccggcttgtatatcgtgggtcagcgggacctcctctttaattataagagattctttgtcagcctgctgcacggagtgctgaccagcatgatcctctttttcattcccttgggggcctatctgcagaccgttgggcaggacggagaggcgccaagcgattaccagtcttttgccgtgaccatcgcttcagcccttgtgatcacggtgaacttccagataggactggacacctcctactggacattcgtcaatgcgttttctatcttcgggtccattgcactgtacttcggaatcatgtttgattttcattcagccggtattcacgtgttgttcccgagcgcctttcagttcacgggcacggcaagcaatgcactgcgtcagccttacatctggctcacaatcattttagctgttgcagtgtgtctcctgcccgtcgtggccatccggtttctgtcgatgactatctggccctccgaaagcgacaagatacagaaacaccgaaagaggctgaaggccgaagaacagtggcagaggcggcagcaggtcttccgtagaggggtgagcacaagacgatccgcatatgccttttctcatcagcggggatacgctgacttaatcagttccggcagaagcatcaggaaaaaacggtccccactcgacgccatcgtggcagacggtaccgctgaataccgtaggacgggagactct

SEQ ID NO: 7247 - DNA, 3753 bp, Artificial Sequence
  Description of Artificial Sequence: Synthetic coding sequence
atgtccactgagagggatagtgagactactttcgacgaagattcccagccaaatgatgaagttgttccctattcagacgacgaaaccgaagatgagcttgacgatcaaggctccgctgtggaacctgagcagaatagggtaaatcgtgaggcagaggaaaacagagagcctttccgtaaggaatgcacatggcaagtcaaggctaatgatagaaagtatcatgagcagccacattttatgaacacaaaattcctttgcatcaaggaatctaagtacgcgaataacgctatcaagacgtataagtacaacgcatttacctttattccaatgaacttattcgagcaattcaagagagcagctaatttgtatttccttgcacttttgattttgcaagcagtccctcaaatttcaacacttgcttggtatacgactcttgtacccttactagttgttctaggtgtcactgctatcaaagatcttgttgatgacgtcgcgagacataaaatggataaagaaataaacaaccgaacttgtgaagttataaaggatggtagattcaaggtcgctaaatggaaggaaatccaagtgggcgatgttatcaggcttaagaagaacgactttgttccggctgacatattgctgctgtccagtagtgaaccaaactcattgtgctatgtggaaacagccgagcttgatggagagactaaccttaaatttaagatgagccttgagataactgatcagtacctacaacgagaagacacattggctactttcgacggtttcattgaatgtgaagagcctaataacaggttagataagtttactgggacattattttggcgtaacaccagttttcctttagatgccgataagatcttgttgaggggttgcgttattcgaaatacagacttttgccacgggttagtcatctttgctggcgcggacactaagatcatgaaaaactcaggcaagactagattcaaacgcaccaagatcgactacctgatgaactatatggtatataccatttttgttgtgttgatactactttctgctggactagccataggtcacgcttactgggaagcccaagtaggaaattctagttggtatctttacgacggtgaagatgacaccccaagctatcgtggctttctgatattttggggatatataatcgttttgaacaccatggttcccattagtctttatgtgtctgtcgaagtgattagacttggtcaatcacattttatcaactgggatttgcagatgtactatgctgagaaggatacaccagctaaggcacgtactactactctcaatgaacaattaggacagatccactatattttttccgataagaccggcactctgacccagaatatcatgacctttaaaaagtgttgcattaatggtcagatttacggagatcaccgagatgctagccaacacaatcacaataaaatcgaacaggtggatttttcctggaatacgtacgctgatggtaaattggctttttatgatcactacttgatagaacagatacaaagtggaaaggagcccgaggtgcgccagtttttcttcttacttgctgtttgtcacaccgttatggttgacagaaccgacggacaacttaactatcaagcagctagtccggatgagggagctcttgttaacgctgctaggaactttggttttgcctttttagctagaacacaaaatactatcactataagcgaacttggcacagagcgcacctacaatgtgttggctattcttgattttaatagtgatcgaaagaggatgagtatcatagtgcgaactcctgagggaaatatcaaactgtattgcaagggtgcagatactgtcatatacgagcgacttcatcgtatgaatccaacaaagcaggaaacccaggatgcattggatatttttgctaatgagacactccgaacactctgcttgtgttacaaggaaatcgaggaaaaagagttcacagagtggaataagaagttcatggcagctagtgttgcttcaaccaaccgagatgaagcactggataaggtttacgaggaaatagagaaagacctaatattactaggcgctactgctatcgaggataagttgcaagatggcgttccggaaactatttcaaagctggcaaaggcagatattaaaatttgggtgcttaccggtgataagaaggaaacagccgagaatatcggatttgcctgtgagttattgaccgaagatactacgatatgctatggagaggatatcaattctttgcttcatgcgagaatggaaaatcaacgcaatcgtggaggagtgtatgcaaagttcgcgccaccggttcaagagtctttctttccgccaggtgggaaccgggctttaattataacaggatcatggcttaacgagatcttgcttgaaaagaagacgaagagaaacaagattctcaagttgaagtttcctagaactgaggaggaacggcgaatgcgaacccaatcgaaacgtcgattagaagctaagaaagagcaaaggcaaaaaaatttcgttgatctggcttgtgaatgctctgctgttatctgctgtagagttacccctaaacagaaggcaatggttgttgatctagttaaacggtacaagaaggcaattacacttgccataggtgatggtgctaatgatgtgaatatgatcaagactgctcatataggtgttggaatttctggacaagagggaatgcaagccgtgatgtccagtgattacagcttcgcacaattcagatatcttcaacggctattgctcgttcatggtcgatggtcatacattaggatgtgcaaattccttaggtactttttctacaagaatttcgccttcaccctcgtacatttttggtattcatttttcaacggttacagtgcacaaactgcgtatgaggattggttcattacattgtacaatgtgctttatacttcgcttcctgttctcttgatgggactcctggaccaagacgtctcagataaattgagtttgcgttttcctggtctttatattgttggtcaaagagatctcctcttcaactacaaaagattcttcgtcagcctccttcatggagtgctgaccagtatgatcttgttttttatacctctaggtgcttatcttcagactgtgggtcaagatggtgaggccccatcagattaccagtcatttgctgttaccatagcaagcgctttggttatcactgtgaattttcagatcgggttggatacgagctactggacattcgttaatgctttttcaatttttgggagcattgcactttacttcgggatcatgttcgatttccatagcgctggaatccatgtactttttccatcagcatttcagtttacgggtaccgctagtaacgcccttcgacagccttatatttggctcaccatcattctagcagtggcagtctgtctccttcctgtggttgctattagattcctttcaatgactatatggccaagtgaatcagacaagatccaaaagcataggaaacgtttgaaggctgaagaacaatggcaaagacggcaacaggtttttcgaaggggtgtgtcaactcgtcggagtgcctatgctttctctcatcaaaggggctacgccgatcttataagttcaggcaggtcaataagaaaaaaaaggtcgcctctagatgccattgtcgccgacggtacggctgaatatagaaggacaggcgattct

SEQ ID NO: 7248 - DNA, 3753 bp, Artificial Sequence
  Description of Artificial Sequence: Synthetic coding sequence
atgtccacagagcgtgattctgagaccaccttcgatgaggattcacagcctaatgatgaggtggtgccgtattccgatgatgaaacagaggatgaacttgatgaccaggggtcagccgtggagcctgagcagaaccgggttaacagggaagcggaagaaaatcgcgagcccttccgcaaggagtgcacctggcaggtaaaggcgaacgatcggaaatatcacgaacagccacattttatgaataccaaatttctgtgtattaaggaatccaagtacgccaataacgccattaagacttacaagtacaacgctttcacctttattcccatgaacctcttcgagcaattcaaacgagctgccaacctttatttccttgctctgctgattcttcaggcagttccccaaatcagcactctggcatggtatacaaccctggtccccctcctggtcgtcctaggggtcacagccatcaaagacctggtggacgatgtcgcgcgacacaagatggataaggagattaataacagaacatgtgaggtaataaaggatgggcgattcaaggtagcaaaatggaaggagattcaagtcggagatgttatacggctaaagaagaatgacttcgtcccagccgacattctgctcctgtcaagtagcgagcctaatagcttgtgttatgtggagaccgccgagttggacggagaaaccaacctgaagtttaagatgtctctggaaatcactgatcagtacctgcagcgggaagataccttggccacctttgatggcttcatcgaatgtgaagagcccaataacagactggataaatttactggtaccttgttctggcgtaacacaagcttccccctggacgccgataagattctcttgcgaggatgcgtgatacggaacactgatttttgtcacggactggtcattttcgcgggcgctgacacgaagataatgaagaattcagggaagactaggttcaaacggacgaaaatagattatcttatgaactatatggtctatactatctttgtggtcctgatcttgctgagtgctgggcttgcaatcggccacgcatactgggaggcacaagtgggcaatagctcctggtatctgtacgacggtgaagacgatacccccagttacaggggatttctgatcttctggggctacattatcgtcctcaacacaatggtgcccatctccctctatgtcagtgtggaagtgataagattgggacaatcgcacttcattaattgggatctccaaatgtactatgctgagaaggatacaccggccaaggctaggaccacaaccctgaatgaacagttgggccaaattcactacatcttctccgataagacagggacactgacccaaaacatcatgacatttaagaaatgctgcatcaatggtcagatctatggtgatcatcgggacgcctcccagcacaatcataataagattgagcaggtggactttagctggaacacttacgcagatggcaaactcgcattctacgatcactacctgatcgaacaaatccagtcaggaaaagagcccgaagtgcgtcagttctttttcctgctggcagtttgccatacggtaatggtcgacaggacagatggccagcttaattatcaagctgcctccccagatgagggggccctagtcaatgcagctcggaatttcggattcgcatttctagcccggacccagaatactatcaccattagtgaactgggcacagagcggacttataacgttctcgctattctggacttcaacagcgatcggaagaggatgtctatcatcgtgagaacaccagaaggcaatataaagctctactgcaagggcgccgataccgttatctatgagcgacttcataggatgaatcccactaagcaggagacgcaggacgcccttgacatattcgctaatgagactcttcggacactctgtctgtgttataaagagatcgaggagaaagaattcaccgaatggaacaaaaagttcatggccgccagcgtggctagtactaaccgggatgaggcactcgataaggtatacgaagagattgaaaaagacttgattctgttgggcgcaactgccatagaggacaaattacaggacggcgttcccgaaacaataagtaaactggctaaggcggatataaagatctgggtgttgaccggtgataagaaggaaaccgccgagaacattggttttgcttgcgagctgctcacagaagacactacaatatgctatggagaagacattaactctctcctccacgctcggatggagaatcagcggaacaggggcggcgtctacgccaagtttgcccctcctgtccaagagtccttctttccccccggggggaaccgggctctcattatcactggcagttggctgaatgagatcctgttagaaaaaaagacaaaacggaacaagattctgaaactgaagttcccaaggaccgaggaggagagacggatgaggacgcagtccaagcggcggctggaggcgaagaaggaacagcggcagaagaactttgttgacctggcatgcgaatgttcagccgtgatatgctgccgcgttacaccaaagcaaaaggcaatggtcgttgacttagttaagaggtacaagaaggccatcacacttgctattggcgatggcgccaatgacgtcaatatgataaaaacggcacacataggggtaggtattagcgggcaggaaggtatgcaggccgttatgtcctctgattattctttcgcacagtttcgctatctgcaacgcctgttactcgttcatggccgctggagttacattcggatgtgcaagtttctgagatatttcttctataaaaattttgcatttacattggtgcacttctggtactcctttttcaatggctattctgcccagaccgcttacgaggactggttcattaccctttataacgtgctctatacttccctaccggtgctgctgatgggcttgctggaccaggacgtgtcggacaagctatctctgaggttcccgggcctgtacattgtggggcaaagagatctgctgttcaattataaacggtttttcgttagtctattgcatggcgtcttgaccagcatgattctcttcttcatccccctcggtgcctatctgcagacagtgggccaagacggagaagcaccaagtgattaccagtcctttgccgtcacaattgcctcagctctcgtgatcacagtgaattttcagattggactggacactagctactggacgttcgtgaacgcattttccatcttcggcagcatcgcgttgtatttcggaattatgttcgatttccacagcgccggaatacacgtgctgtttccgagtgcatttcaatttaccggaacagcttctaacgccctgagacagccttacatttggctgacgatcattctcgcagtcgcggtgtgtctactgcccgtcgtagccatcaggttcctttctatgactatctggccctcagagtccgacaaaattcagaaacaccgcaaaaggttaaaagctgaggagcaatggcaacggcggcagcaggtgtttcgccgaggcgtgagcacacgccggagcgcctacgccttcagccatcaaagaggttatgcggatctcatttcctctgggagatcgatccggaagaaacgtagtccactggatgccatcgtggctgacggcacagcggagtaccgccgtactggcgattcc

SEQ ID NO: 7249 - DNA, 3753 bp, Artificial Sequence
  Description of Artificial Sequence: Synthetic coding sequence
atgtccaccgaaagggattcagagaccaccttcgacgaagattcccagcccaacgacgaggtggtgccctattcagacgacgagacggaagatgagcttgacgaccagggaagtgccgtggagcccgagcaaaacagagttaatcgggaggccgaagaaaaccgtgagccgttcaggaaggaatgcacttggcaggttaaggctaacgaccggaagtatcacgaacagccccatttcatgaatacaaaatttctttgtatcaaagagagcaagtatgctaataacgctatcaagacatacaaatataacgcttttaccttcataccgatgaacctctttgagcagttcaaaagggccgctaacctttatttcctggcgttgcttatattgcaagcagttccccagatctccacactggcttggtatactacactggtaccactgctggtagtattaggcgtgactgctattaaagatcttgttgatgatgtcgcgagacacaaaatggacaaagagatcaataaccgtacgtgcgaagttattaaagacggccgcttcaaagtggcaaagtggaaagagatccaagtcggagatgtcatcagactgaaaaagaacgacttcgtacccgcagatatattgcttctgagctcctctgaacctaactcattatgttatgttgagaccgccgagctggacggagaaacgaatttgaagtttaaaatgtcactagagatcacagatcaatacctgcagcgcgaggatacactggccacatttgacggattcattgagtgtgaggaaccaaataataggcttgacaaatttaccggtaccttgttttggaggaatacgagctttcctctcgatgctgacaagatactgttgcggggctgcgttattagaaacacagatttctgccatggtctcgtcatctttgctggcgccgatacaaagattatgaaaaacagtggcaaaacccgatttaagaggaccaaaatagattacctgatgaattacatggtgtatactatttttgtggtcttgatcctactgtctgctgggcttgctattggtcacgcctactgggaggcccaagtaggtaattcatcatggtatttgtatgatggggaggatgacactccctcataccgcggcttcttgatcttttgggggtatataattgtacttaacacaatggtgcctatctcactctacgttagcgttgaggtaattaggctcggtcagtcacattttatcaattgggatctgcaaatgtactatgccgaaaaagatacgcccgctaaagccagaacaaccactctgaacgaacagctgggccagatccactatatcttctccgataagaccgggacgctaacgcaaaacatcatgacattcaagaagtgctgtataaatggtcaaatctatggcgatcaccgggatgcgagtcagcataaccataataagattgaacaggtagacttctcttggaatacgtatgctgacgggaaattggcattttatgatcattatctcatcgaacagattcagtcgggaaaggagcccgaagtccggcaattctttttcctgctggccgtgtgccacaccgtcatggtggacagaacggatgggcagctaaactaccaggcagcgagccccgacgaaggcgctctggtgaacgccgccagaaacttcggttttgcgtttctcgcacgcactcagaataccattaccatctcagaactcggaaccgagcggacatacaatgtcttagcaattttggacttcaatagcgaccgtaaaagaatgtccataatcgttcgcactcccgagggaaacatcaagctgtattgcaaaggcgctgatacagtgatttatgaaagactccatcgtatgaaccccacaaagcaagagacgcaggacgcgctggatatctttgctaatgagacgcttcggaccctgtgtctatgttataaggaaatcgaagagaaagagtttaccgagtggaataaaaagtttatggccgcctctgtggcctctacgaaccgggatgaggctcttgacaaagtctatgaagaaatcgagaaagatctgattctcctaggggcaacggctatagaggataagttgcaggatggggtacccgagacgatcagcaaattagccaaagccgatattaagatctgggttctgacaggagacaagaaagagactgcagagaatattggtttcgcctgtgagctgctgaccgaagatacgacgatttgctacggagaggatattaattccctgctgcatgctaggatggaaaaccaaaggaacagaggcggggtgtatgctaaattcgctccaccagttcaagagagcttctttccaccgggtggtaacagagcactcattatcaccgggtcgtggctcaatgaaatcctgctagaaaaaaaaaccaagaggaacaagatactcaagctgaagtttccccggacggaagaggaaagacgcatgcggacgcagtctaaacgtcgattggaggccaagaaagaacaaagacaaaaaaattttgtggacctggcctgcgagtgttcagctgttatttgttgtagagtaaccccaaagcaaaaggcaatggtggtcgacctggtgaagcgctacaagaaagccatcactttggcgataggggacggcgctaacgatgtaaacatgatcaagactgctcatattggtgtgggcattagtggacaggaggggatgcaggccgtgatgagctccgactactctttcgcacagtttagatatcttcagcgactcctgttggttcatgggagatggagctacatccgcatgtgcaaatttctgcgctatttcttttacaaaaatttcgcgttcaccctcgtccatttctggtactcatttttcaacggttattctgcgcagacggcatacgaggactggtttatcaccctgtataatgtcctgtacacgtcattaccggtgctgctcatgggcctgttggaccaggatgttagtgacaagctcagtctgcggtttcccgggctgtatatagttgggcagagggatctgttgtttaactacaagcgcttcttcgtgtccctactgcatggggtattgacatccatgatcctatttttcatcccgctgggagcatacctgcaaacggtgggtcaggatggtgaggcaccttccgattaccagtcttttgctgtcacaatcgcgtcagcccttgtgataacggtgaactttcagatcgggctggataccagttactggacatttgtcaacgcattctccatcttcggatcaatagccttatatttcggcatcatgttcgacttccattcagctggtatccatgtgctgtttccatctgcattccagtttaccggcactgctagtaatgccctgcgtcagccatacatttggttgactatcatactggccgtcgctgtgtgcctcctcccagtggttgctattcggtttttgtcgatgaccatttggccctctgaaagcgataagatccagaagcatcgtaaacgtttgaaggcagaggaacagtggcagcggcgacaacaggtcttcagacggggcgtctccacaaggaggtctgcttacgcgttcagccaccaacgcgggtacgccgacttgatatcgtcgggcagatccatccggaagaaaaggagtcctctggacgccattgtggcagacggcaccgcagaataccgtcggaccggggactct

SEQ ID NO: 7250 - DNA, 3753 bp, Artificial Sequence
  Description of Artificial Sequence: Synthetic coding sequence
atgtcgaccgaaagagatagcgagactacctttgatgaggattcgcagccgaacgacgaagtggtgccctactccgacgacgagactgaagacgaactggatgatcagggaagtgcggtcgagccggagcagaaccgagtcaaccgagaggccgaggagaatagggagcccttccggaaggaatgcacctggcaagttaaagccaatgacagaaagtaccacgagcagccccatttcatgaacaccaaattcctgtgcattaaagagtccaaatacgctaataatgctattaagacttataagtacaatgcatttacattcatcccgatgaatctatttgagcaatttaagcgcgcagcgaacctctatttccttgccctgctaatccttcaggcagtgccgcaaatctcgacactcgcctggtacactaccttggtgccattgctggtggtgttgggcgtgacggcaattaaagacctggttgatgatgttgcccgacataagatggataaagaaataaacaatcgtacatgcgaagtgatcaaggacggcaggttcaaggtggcaaagtggaaggagattcaagtcggtgacgtgatccgcctgaagaaaaatgatttcgtgcccgccgacatcctgctgttgagctcgtccgagccaaattcactgtgctatgttgagacagccgagctggatggcgagaccaatctaaagttcaaaatgtcgctggaaataacggatcagtatctgcagcgtgaggacaccttggccactttcgatggcttcatcgagtgcgaggaaccgaataacagactggataagtttaccggaaccttgttttggcgcaacacttcatttccgctcgacgctgataagattctgctcaggggctgcgtgatacgcaacacagatttctgtcacggcctagtgatattcgccggagccgatacgaagataatgaagaatagtggcaagacgcgtttcaaacgtacgaagatcgactacttgatgaattacatggtatacaccatcttcgtggttttgattcttctatcagctggtttggcaattggccacgcctattgggaagcccaagtcggaaacagctcctggtacctgtacgatggcgaagatgacacaccgagctaccgcggtttcctcatcttttggggatatatcattgtgttgaacacaatggtgcctatcagcctgtacgtgtccgtggaggttatccgtctgggccaatcccacttcattaattgggacttgcaaatgtactacgcagagaaagacaccccggcgaaggctagaacaaccacattgaacgagcagctgggacagatccattacattttcagtgacaaaaccggtacactgacacaaaacataatgacgttcaagaaatgctgcatcaatggtcagatatatggtgaccatagggacgcgagccaacacaaccataataagatcgagcaggtggacttcagttggaacacttacgccgacggcaagcttgctttttacgatcattatctgatcgaacagatccaatctggaaaggagccggaagtccgtcagttcttttttctactggcagtatgccacacggtcatggtggatcgcacggatgggcaacttaactatcaggccgcaagccccgatgaaggggcactagtgaatgcagctaggaactttggattcgcgttcctcgcgcgcacgcagaacacgatcaccatcagcgagctgggcactgagcgcacatacaatgtgctggccatattggatttcaactcagatcggaagcgtatgtccataatcgtccgtacccccgagggaaatatcaagctgtactgcaagggtgcggacacggttatctatgaacgtttacatagaatgaatccaactaaacaagagacccaggatgccttggatatattcgctaacgaaaccttgcgtacgttatgcttgtgctacaaggagatcgaggaaaaggagttcacagaatggaataaaaagttcatggcagccagcgtcgcctcaaccaatagagatgaggccctggataaggtctatgaagaaatcgagaaggacctcatcctgctgggtgccacagccattgaagacaaactgcaggacggagttcccgagactatatctaagctggccaaagccgacatcaagatctgggttttgactggagacaaaaaggagacggccgaaaatatcggttttgcctgcgagttgctcaccgaggatacaacgatatgttatggagaagacatcaattccctcctgcacgcccggatggaaaatcagaggaataggggcggtgtttatgccaaattcgcccccccagtgcaggagtcgttctttccaccgggaggaaaccgagccttgatcataacggggtcctggctgaatgagatcttgcttgagaaaaagacgaagcgaaataagattctcaagctcaagtttccccggactgaggaggagcgtcgtatgcggacgcaaagcaagaggaggctcgaggcgaagaaggagcagcgccagaaaaacttcgtcgacctggcgtgcgagtgctcggctgtaatatgttgccgagtgacaccaaagcagaaggctatggtcgttgacctggtgaagcgctacaagaaggccataacactcgctataggcgatggcgcgaatgacgtgaatatgatcaagaccgcccatatcggtgtgggaatttcgggccaggagggcatgcaggcggtgatgagttccgattactcctttgcacagtttaggtatctgcagagactgctgctggttcatggacgttggtcctacatccgaatgtgcaaatttctgcgctatttcttctacaagaactttgctttcacgcttgttcatttctggtacagcttcttcaacggctatagtgcacagaccgcctacgaagattggttcataacactctacaatgtcctgtatacgagcctgcctgtcttgctaatgggcctacttgatcaagacgtttccgacaagctgtcgctgcgctttccgggtctatacatagtgggccagagagatctgctgtttaattacaaacgtttctttgtgtcgcttcttcacggcgtcctgacgagcatgatcctctttttcattcccctgggcgcatacctgcaaaccgtgggtcaagatggcgaggcccctagcgactaccagtcatttgccgtgacgattgccagcgcccttgtaattactgtgaacttccaaattggtttggacacgtcgtactggacctttgtgaacgctttttcaatctttggctcgatcgccctttacttcggaatcatgttcgatttccactcggcaggcatacacgtcctgtttccctcggctttccagttcaccgggacagcctcgaacgcgctgcgtcaaccctatatctggctgacaatcatcctcgcagtcgcggtctgcttgctgccggtcgtcgccatccgattcctctcgatgacgatctggccgagcgagtccgacaaaatccagaagcacaggaagcgcctcaaggccgaggagcaatggcagcgccgccaacaagtttttaggaggggcgtgtccaccaggcgcagtgcctatgccttctcacaccagcgcggctacgctgatctgatcagcagcggccgctccatccgcaaaaagagaagtcccctggacgccattgtagcagacggtaccgccgaatatcgtcgcacgggagatagt

SEQ ID NO: 7251 - DNA, 3753 bp, Artificial Sequence
  Description of Artificial Sequence: Synthetic coding sequence
atgtcgaccgagagagatagcgaaaccacctttgatgaggactcgcagcctaacgatgaagtggtcccgtactcagacgatgaaaccgaggatgagctcgatgaccagggatcagcggtcgagccggaacaaaacagggtgaatagagaagcagaagaaaaccgagagcccttcagaaaggagtgcacctggcaggtgaaagccaatgatcgtaagtatcatgagcagccacactttatgaacaccaagtttctgtgcattaaagaaagcaaatacgcaaataacgcaattaagacctacaaatacaatgcatttacgttcattcctatgaacctcttcgagcaattcaagagggcagcaaacctttactttctggcactcctgatactgcaagcagtgcctcaaatttcaactctggcgtggtacaccacgcttgtgccactgctggtcgtgctcggtgtcactgcaatcaaggatctcgtggatgatgtggcaaggcacaaaatggataaagagattaacaacagaacttgtgaagtgattaaggatggtaggttcaaggtcgcaaagtggaaagaaatccaggtgggcgacgtgatcagactcaagaagaatgattttgtgcctgcagatatccttctgctctcctcctcggagccaaattccttgtgttacgtcgaaactgcagagcttgatggtgagactaacctgaaattcaagatgtcccttgaaatcactgatcaataccttcaacgcgaagataccctggcgacctttgatgggtttattgagtgcgaggaacctaataaccgacttgacaagttcactggtacccttttttggaggaacacctccttccctctggacgcggacaagatcttgctgagggggtgcgtcatacgaaacactgacttctgtcacggtctggtcattttcgctggagcagataccaaaatcatgaagaactcgggaaaaactaggttcaaaagaaccaagatcgattaccttatgaactatatggtgtacactattttcgtcgtcttgatactgctttcagccggcctggcgatcggtcatgcgtactgggaggcacaggtgggaaattcctcgtggtacttgtacgacggcgaggatgatactcctagctaccgcggctttctgatcttctggggttacattattgtccttaacaccatggtgcctatctccctttacgtcagcgtcgaagtgataaggcttggacagagccacttcatcaactgggatctgcaaatgtattatgcagagaaagacaccccagccaaggccagaactactaccttgaatgaacaactgggtcaaatacattacatcttttccgacaagaccggtaccctgacccagaatatcatgacctttaagaagtgttgcattaatggacagatctacggagatcatcgagatgccagccagcacaatcacaataagatcgagcaggtggatttctcttggaacacgtatgcagacggtaagctcgcattttacgatcattaccttatagaacaaattcagagcggcaaagaacccgaggtgcggcagttctttttccttctggcagtgtgtcatactgttatggtcgatcgcactgacggtcagctcaactaccaagcagcctcgccagacgaaggagcattggtcaacgcggcacggaattttgggtttgcatttcttgctcgaactcagaatactattaccatctcggaacttggcaccgaaaggacttacaatgtgcttgcaatccttgactttaactccgatcgaaagagaatgtccataattgtccgtactccggaaggtaacataaagctgtactgtaagggagcggataccgtcatttatgagcgtctgcacagaatgaacccgaccaaacaggaaacgcaggatgctcttgacatttttgccaacgaaacgctgcggactctttgcctttgctacaaggaaattgaagagaaggagttcactgaatggaacaagaagttcatggcagcttcagtggcatcaaccaaccgagacgaagcattggataaggtgtacgaggaaattgagaaggacttgattttgttgggagcaactgcaatcgaagataagctccaagatggggtgcctgaaaccatttcgaaactggcaaaggcagacataaagatttgggtactcactggagacaaaaaggaaaccgccgaaaacatcggatttgcatgtgaacttctgactgaggataccactatttgttacggtgaagatatcaattcgttgttgcacgctaggatggaaaaccagcgaaaccgaggaggggtgtacgctaagttcgctccgccggtgcaggaatccttttttcctccaggtggaaaccgagcattgattatcaccggatcatggcttaatgagattctcctggaaaagaaaactaaaagaaataagatacttaagctgaagttccctcggaccgaggaagaaaggaggatgaggacgcaaagcaaacgccggcttgaggcgaaaaaggaacagcgacagaaaaactttgtggatctcgcatgtgaatgctcggctgtgatctgttgtagagttaccccaaagcaaaaggccatggtggtggatcttgtcaagagatacaagaaagcgatcaccttggcaatcggcgacggtgcaaacgacgtgaacatgatcaagaccgctcatatcggagtgggcatatctggccaagagggaatgcaagcggtcatgtcctcggattactcattcgcacagtttagatacctccaacggctgttgctcgtgcacggaaggtggagctacatacggatgtgtaagtttctgagatacttcttttacaagaacttcgcctttaccctggtgcatttttggtactccttcttcaacggctacagcgcacaaactgcttacgaggactggtttatcaccctctacaacgtgctttacacttcacttcccgtccttcttatggggctcctggatcaagatgtgagcgataagctgtcgctgaggttccccggactctatatagtgggccagcgcgatcttctctttaactacaaaaggtttttcgtgtcgctcttgcatggggtgctcacctccatgattctgttctttataccactcggcgcctacctccagaccgtgggacaggatggtgaggcaccatccgattaccagtcgtttgcggttactatagcatccgcgctggtgatcaccgtcaactttcaaattggtttggatacttcatattggactttcgtgaacgcattttcaatattcgggtcgattgcactttactttggtatcatgtttgactttcattcggcgggtattcatgtgctgttcccctcagcctttcaatttactgggaccgcctcgaacgcgctgcggcaaccttacatttggctgactatcatcctggcagtcgcagtgtgtctgcttccagtggtcgctatacgttttctttctatgaccatttggcctagcgaatccgacaaaatccaaaagcacagaaaaaggctgaaggcagaagagcaatggcagagacgccaacaggtctttcggagaggagtgtcgactcgtcgcagcgcatacgcattctcccatcagcgcggatacgccgatctgatcagctccggaagaagcatcagaaagaaacgctccccacttgatgcaattgtcgccgacggaaccgcggaataccgcagaactggagacagc

SEQ ID NO: 7252 - DNA, 3753 bp, Artificial Sequence
  Description of Artificial Sequence: Synthetic coding sequence
atgtcgacggagcgcgattcagaaacgactttcgacgaggactcgcagccgaacgatgaggtggtcccatactccgacgacgagacggaggacgaactggacgaccaagggagcgcagtggaacctgaacagaacagagtgaatcgcgaggctgaagaaaacagagaaccgttccgcaaggaatgtacttggcaggtgaaggccaacgaccgcaagtaccatgagcagccccatttcatgaatactaaattcctctgcatcaaggaatccaagtacgctaataacgccatcaaaacttacaaatacaatgcctttactttcatccctatgaatttgttcgagcaattcaagcgggcggccaacttgtacttcctcgcactgctgatcctgcaggcggtgccgcaaatctcgacccttgcctggtacactacgctcgtgccgctcctggtggtgctgggagtgactgccatcaaggatctcgtggatgacgtggcccggcacaaaatggataaagaaatcaacaaccgcacctgcgaagtcatcaaggacggacggttcaaagtggccaagtggaaggagatccaggtgggtgatgttatccgcctcaagaagaatgatttcgttcccgcggacatcttgctgctgtcctcctcggagccgaactcgctgtgctacgtggaaaccgcagaactggacggagagactaacctcaagttcaagatgtcgctcgagattaccgaccaataccttcaaagagaggacaccctcgccaccttcgatggattcatcgaatgtgaggagcctaacaacagactggataagttcaccggaacgctgttctggagaaacacctcgttcccgctggatgccgacaaaatcctcctgcgcgggtgcgtgatccggaacactgacttttgccacggactggtgatcttcgcaggagccgacactaagatcatgaagaattcagggaaaactaggttcaagcggacgaaaatagattaccttatgaactacatggtgtataccatctttgtggtgctgattctcctctcggcgggactggccatcggacacgcatactgggaagctcaagtcggaaatagctcatggtatctctacgacggagaagatgacacgccgtcatacaggggattcctgatcttctggggttacatcattgtcctgaacaccatggtcccgatcagcctgtatgtctcggtggaagtgatcagactggggcagtcgcactttatcaactgggacctccaaatgtactacgcagagaaggatactccggccaaggcccggactaccacgctgaatgagcaactcggacagatacattacatcttctcagacaagacgggaactctgacccagaacattatgactttcaaaaagtgctgcatcaatggacagatctatggggaccatagggatgcatcgcaacacaaccacaataagatcgaacaggtggacttttcctggaatacctacgcggatggcaaacttgccttctatgaccactacctgatcgaacagatccagtcggggaaggagccggaggtgcggcaattcttcttcttgctcgcagtgtgtcataccgtgatggtcgacagaactgacggccagctcaactaccaagcggctagcccggatgagggagcgctggtcaacgcggcaagaaatttcggcttcgcatttctcgccaggactcagaacactatcaccatcagcgagctcggaactgagcgcacctacaacgtcctggcgattctggacttcaattcggacaggaaacgcatgagtatcatcgtgcggacccccgagggaaacatcaagctgtactgcaagggagccgatactgtgatctacgagcgccttcataggatgaacccgaccaaacaagaaacccaggacgcactcgacattttcgcgaacgaaaccctgcgcaccctgtgtctgtgctacaaggaaattgaggaaaaagaattcaccgaatggaacaagaaattcatggcggccagcgtggcttcaactaatcgggacgaggctcttgataaggtgtacgaggagatcgagaaggacctcatcctcctgggcgcaaccgcgatcgaggataaacttcaggacggagtgccggaaactatctcgaagctcgccaaggccgacattaagatctgggtgttgactggcgacaagaaggaaaccgccgagaatatcggatttgcttgcgagctgctcaccgaggacaccactatctgttacggcgaagatatcaattccctcctgcacgcaagaatggaaaaccagcgtaacagaggcggggtgtatgccaagttcgcgccaccggttcaagagtcttttttccctccggggggcaaccgggccctcatcattactggatcctggcttaacgaaatcctgctggaaaagaaaacgaagcgcaataagatcctcaagttgaagttcccgagaactgaagaagaacggcggatgcggacccagtccaagaggagactggaagccaaaaaggaacaacgacagaaaaactttgtggacctggcgtgtgaatgctccgccgtgatctgttgccgggtcaccccgaagcaaaaagccatggtggttgacctcgtcaaaagatataagaaggcgatcacgcttgcgatcggtgatggtgctaacgacgttaacatgatcaaaaccgcgcatatcggggtggggatcagcggccaggaaggtatgcaggccgtgatgagctctgactactcatttgcacaatttaggtacttgcagcggctgctcctcgtgcacggaaggtggtcatacatcagaatgtgcaagttcctcagatacttcttttacaaaaacttcgccttcacgctggtccatttctggtactcgttcttcaacggatactccgcacagaccgcgtacgaagattggttcatcactctctacaatgtcctgtacacctcactgccggtgctcctgatgggactgctggaccaggatgtcagcgacaagctgtccctgcggtttcctggcctgtacatcgtgggtcaacgcgacctgttgttcaactacaagagattcttcgtgtcactgcttcacggcgtcctgacctccatgatcctgttcttcatcccgctgggagcctacctgcaaactgtgggtcaggacggtgaggccccgtcggactaccagtcgtttgcagttactattgcaagcgcattggttatcaccgtgaacttccagatcggattggatacctcgtactggacttttgtgaacgctttcagcatctttggatccatcgccctctacttcgggataatgttcgatttccacagcgcgggaatccatgtcctgttcccatcggccttccagtttactggtactgcatctaacgctctgaggcaaccatacatctggctgaccatcatcctggctgtggcagtgtgcctcttgccggtagtggctatccgctttctgtcgatgactatctggccttcagaatcagacaagatccagaagcacagaaagcggctgaaggcagaggaacagtggcagaggaggcagcaggtgttccgcagaggtgtctcaaccaggcggtccgcctacgctttttcacaccaaagaggatacgctgacctgatcagctccggacgatccatccggaaaaagaggtcgcctctggacgcgattgtcgcggacggaacggccgaatatcgaagaaccggagatagc

SEQ ID NO: 7253 - DNA, 3753 bp, Artificial Sequence
  Description of Artificial Sequence: Synthetic coding sequence
atgtccaccgaacgagacagcgaaaccacttttgacgaggactctcaacccaatgacgaagtggtgccttactctgacgacgaaaccgaagatgagctggatgaccaaggcagtgcagtggaacctgaacagaatcgtgtcaatcgcgaggcagaagaaaaccgggagccatttcgaaaagagtgtacgtggcaagtcaaggcaaatgacagaaaataccacgaacagccccacttcatgaacacaaaattcctctgtattaaggaaagcaaatacgccaataacgcaatcaagacatataagtataatgctttcacctttatacctatgaacttgttcgagcagttcaaacgggctgcaaatctgtacttcttggcgttactgatccttcaggctgtcccccagatctctactcttgcatggtatactaccctcgtgccgctgctggtggtcttgggggtgacggccataaaggacttggtggatgacgtcgcgcgccataaaatggacaaagagataaacaataggacctgtgaagtcataaaggacggtcgtttcaaggtggcgaagtggaaggagattcaagtcggagatgtgatacgcttgaagaagaacgattttgtccccgcggatatactcctgctgagtagttctgagcccaattcactttgctatgtcgagaccgcggagctggacggcgagacgaatctgaagtttaagatgtctctggagataaccgatcaatacttacagcgggaggatacgttggccacgtttgacgggttcatcgagtgtgaggaacccaacaacagacttgacaagttcaccgggactcttttctggaggaatacatctttccccctggatgccgataagatactgctgagaggctgtgtcatccgaaatactgacttctgtcacggcctggttatatttgccggcgccgacacaaaaattatgaagaactctggtaagacccgctttaaaagaacaaaaatcgactacctgatgaactatatggtgtacaccattttcgttgtgctcattctcttgagcgctggactggctatcggacacgcctactgggaggcacaagtcggcaattcctcctggtacctctatgatggagaggacgacaccccaagctacagaggctttctgattttttggggctatatcatcgtgctgaataccatggtgcccatttccctatatgtgtctgtggaagtcattaggctgggccagtcacactttataaactgggacctgcagatgtattatgctgagaaagatacccccgccaaggcccgcaccacaaccttaaacgagcagctgggtcagattcattatatcttctccgataagaccggtacactgacacagaacataatgacctttaagaagtgctgtataaacggccagatttatggggaccaccgagacgctagccagcacaatcacaataagattgagcaggttgacttttcctggaacacttacgccgatggcaaattagcattctatgaccactacctgattgaacagatccagtctggtaaggagcccgaagtgcgtcaattcttttttctgcttgccgtgtgtcacacagtgatggtcgaccgaaccgacggacagcttaactaccaggctgcatctccagatgaaggtgctctggttaacgccgccagaaacttcggtttcgccttcctcgctcggactcaaaatacaataacaatttcggagttggggacagagcggacgtataacgtgctagcaatcctcgattttaatagtgacagaaagcgcatgagcataatcgtacggacacctgagggaaacatcaagctgtattgcaaaggagctgatactgtgatctacgagcgtctgcaccgtatgaaccccaccaagcaggaaacacaagacgctttggacatctttgctaacgagactctgcgtacactctgtctgtgttataaagagatagaggagaaggagtttaccgaatggaacaaaaagttcatggcggcaagcgttgcatctactaacagggacgaggccctggacaaagtgtacgaagagatagaaaaagatctgattttgctgggggccactgctattgaagataaactgcaggacggggtgcccgaaaccatcagtaaacttgctaaagctgatattaagatctgggtgctgaccggcgataagaaggagacggcagagaacatcggattcgcctgtgagttgctgaccgaggatacgaccatttgttatggcgaagatataaactccctcttgcatgcccgtatggagaaccagcgaaaccgtggcggagtgtacgccaaatttgctccgcccgttcaagagtccttcttcccccctggaggcaatcgtgcactgataatcactggatcctggctcaacgagatcctgttggaaaagaagacaaaacggaataaaatattgaagctcaagtttcccagaaccgaggaggagcgccggatgcgtacccaaagcaaacgcagacttgaggcaaaaaaggaacagcgccagaaaaattttgtggatctcgcttgtgaatgctcggcagttatttgttgccgtgtgacccctaagcaaaaggctatggttgtagacttggtgaaaagatataaaaaggccattactctcgcgattggggacggggctaacgatgtcaatatgatcaaaacagcacatatcggggtggggatttcaggtcaggagggtatgcaggccgtcatgtcctccgattacagctttgctcagttccggtacttgcagcggctcttactcgtgcacggcagatggtcctacatacggatgtgtaagttcctgcgctatttcttctacaagaactttgcattcaccctggtacacttttggtactcattctttaatgggtactctgcccagactgcttatgaagattggtttataacactgtataatgttctctacacttccctcccagtacttcttatggggctcctggaccaggatgtaagcgataagctctcactgcgcttccccgggctctatatagtcggccagcgagatctcctgttcaattacaagagattcttcgttagtctgcttcatggcgtcctgacctcaatgattctgttcttcatcccccttggggcctatctccagacggtcgggcaggacggggaggctccaagtgactatcaatcgtttgccgtgactatcgccagcgctcttgtcatcaccgtaaacttccagatagggcttgatacatcttattggacgttcgtgaacgccttctctattttcggtagcatcgcgctgtatttcggcatcatgtttgactttcactctgccggcattcacgtactcttcccctctgcctttcagttcaccggtacagcttcgaatgccctacggcagccttacatctggctgaccatcatcctggccgtagcagtttgtctcttacccgttgtggctatcagatttctttctatgacaatttggccatctgagagcgacaagatccagaagcatcgtaagcggctcaaggcagaggagcagtggcagcgccggcaacaggtgttccgtagaggggtgtccaccaggaggtccgcctacgccttttctcatcagcgtggctatgccgacctgatctcttccggacgcagtatacgcaagaagcgtagcccgttggatgccattgttgccgatggcaccgctgaatataggagaactggcgacagc

SEQ ID NO: 7254 - DNA, 3753 bp, Artificial Sequence
  Description of Artificial Sequence: Synthetic coding sequence
atgtcgactgagcgggatagcgaaactacgtttgacgaggatagccaaccaaacgacgaagtggtcccgtactctgacgatgaaactgaagatgagctcgatgatcaggggagcgccgtggaacctgaacagaatagagttaaccgagaagccgaagagaacagagaaccgtttagaaaagagtgcacctggcaagtgaaggcgaacgatagaaaataccatgagcaaccgcactttatgaataccaagtttctttgtattaaggagtcgaagtacgctaacaatgcaatcaagacctacaaatacaacgcatttacctttatccctatgaacctgtttgaacaattcaagcgggcagcaaacctttacttcctggcattgctgattttgcaagcagtccctcagattagcactctggcatggtacacgacgcttgtcccccttttggtggttctcggtgtcactgcgattaaagatctcgtggacgacgtggcaagacataagatggataaggaaatcaataaccgtacgtgtgaagtcatcaaggacggtcggtttaaggtcgcaaaatggaaagagatacaggtgggagatgtgatcagactcaaaaagaatgacttcgtgcctgcggatatcttgctcctgtcaagctcagagcccaattcgctctgttacgtggaaaccgcagagcttgatggagagactaacttgaaattcaaaatgtctctggagatcaccgatcaatacctgcaacgtgaggatacccttgcaacctttgacggctttatagaatgtgaggaacctaacaatcggctcgataagttcaccggaacgctcttttggcgtaacacttcatttccactcgatgcagataagattctgctccgggggtgtgtgatcaggaacactgacttctgtcacggcctcgtcatcttcgcaggcgccgacaccaagataatgaagaacagcgggaaaactcggtttaagcgtaccaaaatcgattaccttatgaattacatggtctatacgatctttgtggtgctgattctcctgtccgctggccttgcaattggacacgcatactgggaagcacaagtcggaaactcctcctggtacctttatgatggagaggacgatactccgtcctaccgcggcttccttatcttttggggctacattatcgtactgaacactatggtccccatttcgctttacgtgtcggtggaagtgatccggcttggacagtcccatttcattaactgggatctgcaaatgtactacgccgagaaggacaccccggcaaaggctaggactactactcttaacgaacaattgggacaaatccattacatctttagcgataagaccggaactcttacccagaacattatgacctttaagaagtgttgcattaacggtcaaatctacggtgaccatcgtgatgcctcccagcacaatcacaacaagattgaacaagtggatttcagctggaacacctacgctgatggaaagctggcattctacgaccactaccttattgaacagatacaatcgggaaaggagcccgaagtgagacagtttttctttcttcttgcagtctgccataccgtcatggtggataggacggacgggcagttgaattaccaggcagcgagcccagacgaaggtgcattggtgaatgcagcaaggaattttggtttcgcatttctcgcaagaacccaaaacaccattacgatctcggagctgggtactgagaggacctacaacgtgctggcaattctggactttaactctgatagaaagcggatgtccattattgtgagaactcccgagggcaacattaaactgtactgtaagggagcggatactgtgatctacgaacgccttcaccggatgaatccgaccaagcaggaaactcaagatgcactcgacatctttgcaaatgaaaccctgcgtactctgtgcctgtgttacaaggaaatcgaagaaaaggagtttacggagtggaacaagaaattcatggccgcaagcgtggcctcgactaatagagacgaagcactggataaggtgtacgaggagattgaaaaggatcttatccttcttggtgctaccgcaatcgaagataagctccaagatggagtgcctgaaaccatttcgaagctcgcaaaagcagatatcaagatctgggtgcttaccggagataagaaggagactgcagagaatattggatttgcgtgcgaacttttgactgaggacaccacgatttgctacggtgaagatatcaactcgctcctgcatgcaagaatggaaaaccaacggaatcgcggcggagtgtacgccaaattcgccccaccagttcaagaatcctttttcccgcctgggggaaacagggcgctcataatcacgggctcctggctgaatgagattttgctggagaagaaaactaaaaggaacaaaatccttaaactgaagtttccccggactgaggaagaacgccgcatgcggactcagtcaaagcggcgtcttgaagcaaagaaggaacagcggcaaaagaacttcgtcgatctggcatgcgaatgttcggccgttatttgttgcagggtgacgcccaagcagaaagccatggtcgttgacctggtgaagcgttacaagaaggcgattacccttgcgataggagatggtgccaacgatgtgaacatgatcaagactgcacatattggtgtgggtatttccggacaggaaggaatgcaagctgttatgtcatcagactactccttcgcacaatttcgttacctgcaacgcctgcttctggtccacgggagatggtcctacatccgaatgtgtaagtttttgagatacttcttttacaagaactttgcgtttactctggtgcatttctggtacagcttctttaacggctactcggctcagaccgcatacgaagattggttcatcaccctttacaacgtgctttacacctccctgcctgtcctgctgatgggtctgctggatcaagatgtgagcgacaaactttcgcttagatttcctggtctgtacattgtgggtcaacgcgatctcctcttcaactacaagagatttttcgtgtcgctgcttcatggtgttcttacttccatgatccttttcttcatacctcttggagcctacctgcagaccgtgggacaggatggtgaggcgccttcggactaccagagtttcgcagtcacgattgcctccgccctggtcattactgtgaattttcagattggcctcgatacgtcgtattggacttttgtcaacgcattcagcatctttggcagcatcgctctgtactttggaatcatgttcgactttcattccgcaggaatccatgtcctttttccatctgcatttcagttcactggaaccgccagcaatgcactcaggcaaccttacatttggcttaccataatccttgcagtggccgtctgtctcctgccggtcgtggcgattaggtttctttccatgactatctggccttcagagagcgacaaaattcagaaacatcgcaagcgcctgaaggcagaagagcagtggcaacggagacagcaagtgttcagacgcggtgtgtcgaccaggcggtcggcgtacgccttctcccatcagcgcgggtacgcggatcttatatcttcaggacggtctatccggaaaaaacgatccccactcgatgcgattgtcgcggatggcaccgcagagtacaggcggacgggtgactcc

SEQ ID NO: 7255 - DNA, 3753 bp, Artificial Sequence
  Description of Artificial Sequence: Synthetic coding sequence
atgtcgactgaacgggacagcgagactacctttgatgaagattcccagccgaatgacgaagtcgtcccttatagcgatgatgaaaccgaggatgagctggatgatcaaggatcagcagtcgagcctgaacagaatagggtgaacagagaagcagaggaaaatcgagagccgtttaggaaggaatgtacctggcaagtgaaagccaatgatcgaaagtaccacgagcaaccccatttcatgaatactaagtttctttgtatcaaggagtcgaagtacgctaacaacgcaatcaagacttataagtacaatgcattcacctttatccctatgaatctcttcgaacagtttaaacgagcagcaaatctttacttccttgcgctgcttatccttcaagctgtgcctcaaatctccaccctcgcgtggtacactaccctggtgcctctcctggtggtccttggagtgactgccataaaggacttggtcgatgatgtggctcgccataagatggataaggagattaacaataggacttgcgaagtgatcaaagatgggcgattcaaagtggcaaaatggaaggaaattcaagtgggagacgtgattcggctcaaaaagaatgattttgtgccagcagatattctgctgctttcgagctccgaaccaaactcgctgtgctacgtcgaaaccgcagaacttgatggcgaaactaatctcaagtttaagatgtctctggagataacggaccaatacctccaaagagaggacactttggctacttttgatggattcatcgaatgtgaggaaccaaataacaggctggataagttcacgggtaccctgttttggagaaatacgtcctttcccctggatgcggataagattcttcttcgaggttgtgtgatccggaataccgatttctgtcacggactggtgatttttgctggcgcagatactaagattatgaaaaactccgggaaaactcggttcaagagaaccaaaattgattaccttatgaactacatggtgtacacgatctttgtggtccttatcttgctgtccgccggactggcgattggacatgcatactgggaagcccaggtgggtaacagcagctggtacctgtacgatggcgaagatgacacccctagctaccggggctttctgattttctgggggtacattatcgtgctcaatacgatggtgccaatctcactgtacgtgtccgtggaggtgattaggctgggacaatcccatttcatcaactgggatcttcaaatgtactatgcagagaaggacaccccggcaaaagcccggaccaccactctgaacgaacagcttggccagattcactacattttcagcgacaagactggaacgctgactcaaaacattatgaccttcaagaagtgttgtataaacggacaaatctacggtgatcacagagatgcaagccagcacaatcacaataagatcgaacaagttgacttctcctggaacacctatgccgatggcaagctcgccttttacgatcattatctgattgaacagattcagagcgggaaggaacctgaagtgaggcagttctttttcttgctggccgtgtgccacactgtgatggtggatagaaccgacgggcagctgaactaccaggcagcaagccctgatgaaggggccctcgtgaatgctgcacgaaactttggattcgcattcctggcgagaactcagaacaccataacgatttcggagctggggactgagcggacctacaacgtgctggcaattcttgactttaactcggaccgtaagcgaatgtcgattatcgtccgcaccccagaaggcaacataaaactttactgcaagggagccgacacggtgatatacgagcgccttcaccggatgaatcctactaagcaagaaacccaggacgcgctggatatcttcgcaaacgaaaccctccggaccctgtgtctgtgctacaaagagattgaagagaaagaatttacggaatggaacaagaaattcatggcagcatcggtcgcaagcaccaaccgcgacgaagctcttgataaagtctatgaagaaattgaaaaggatctcattctcctcggtgccactgcaattgaagataagttgcaggacggtgtgcccgagactatatccaagctggccaaggcagatatcaagatttgggtgctgactggggacaagaaagagactgccgaaaacataggattcgcgtgtgagttgcttactgaagataccactatttgttacggcgaggatatcaacagcctccttcatgctcggatggagaaccaacggaatcggggtggagtgtacgccaagtttgcacctccagttcaggaatccttttttcctccggggggaaacagagcgctcatcattactggatcgtggctgaacgaaatactcctcgaaaagaaaactaagcgcaataagatcctcaagctgaagtttcctaggaccgaagaggaacgtaggatgagaactcagagcaagcgtagacttgaggcgaagaaggaacaacgtcagaaaaactttgtcgaccttgcatgcgaatgctcggcagtgatctgctgtcgagtgactccaaaacaaaaagcgatggtggtggatctcgtgaagcgatacaagaaggcaattaccctggccattggggatggagccaacgacgttaacatgattaagaccgcacatatcggtgtgggcatctcaggtcaggaagggatgcaagctgtgatgtcatcggactactcgtttgctcagttccgctacctgcaacgacttctccttgtgcatggaagatggtcgtacataagaatgtgtaaattccttagatactttttctacaaaaactttgcatttaccctggtgcatttctggtacagctttttcaacggttactcagcacaaaccgcctatgaggactggtttatcactttgtataatgttctgtacacctcgctcccagttcttttgatggggctcctggaccaagacgtgtccgacaagctctctctgagattccccggtttgtacatcgtcggccagagagatctgctgtttaactacaaacggtttttcgtgtcactgcttcatggagtcctcaccagcatgattctgttctttatacctcttggggcatacttgcagactgtggggcaagatggagaagccccaagcgactaccaatcatttgccgtcaccatcgcatccgcgctggtcataaccgtgaattttcaaattggtctggacacttcgtactggacttttgtcaacgcattttccattttcggatctatcgcgttgtacttcggcattatgtttgattttcatagcgctggtatccacgtcctgtttccctccgcctttcagtttaccggaactgcgagcaacgcactgagacagccatacatctggctcaccatcatccttgcagtcgcagtgtgtctgctcccagtcgtcgcaattagattcctgagcatgactatatggccctcggagtcggataagatccaaaagcataggaagagactgaaggcagaagaacaatggcagcggagacagcaagtctttcgaagaggagtctctaccagacggtcggcatacgcatttagccatcaacgcggttacgcagacttgatctcgagcggccgatcgattcgaaagaaacgtagcccgctcgatgctatcgtcgcagacgggaccgccgagtacagacgtactggtgactcc

SEQ ID NO: 7256 - DNA, 3753 bp, Artificial Sequence
  Description of Artificial Sequence: Synthetic coding sequence
atgtccaccgaacgggattctgagacaacttttgatgaggatagtcagccgaacgatgaggtggtgccctattccgacgatgagaccgaggacgaactggacgatcaaggttcagccgtcgaaccggagcagaatcgtgtcaatcgcgaagctgaagaaaaccgcgaaccatttaggaaggagtgtacctggcaggtgaaggccaacgatagaaaataccacgagcagccacactttatgaatacaaaattcctgtgtatcaaggagagcaaatatgcaaacaacgccattaaaacctacaaatataacgctttcaccttcatacctatgaatctgttcgagcagtttaaaagggccgcaaacctgtactttctggccctcctgatcttacaggctgttccccaaattagcacacttgcttggtacacgacactggttccccttctcgtcgttctgggtgtcaccgctataaaggacctagtggacgacgtagcccggcataaaatggacaaggaaataaacaatcggacatgcgaagtgataaaagacggcagatttaaggtggcaaagtggaaggaaatacaggtgggcgacgtcattcgattaaaaaaaaatgattttgtgcctgcggacattcttctcctgagctcttccgaacctaattctctatgctacgtcgaaacagcggaactggacggagaaaccaacctaaaattcaagatgtctctggagattactgaccagtatctacaaagagaagacacgctcgccacatttgacggctttatcgagtgcgaggaacccaacaatcggctggacaaattcacgggcaccctgttctggcgcaacacaagctttcccctagatgcagataagattttgctgcgggggtgcgtgattcgaaatacagatttctgccacggacttgtgatattcgctggcgctgataccaaaattatgaaaaacagcggcaaaactcgctttaaacgcactaagatcgactacctgatgaattacatggtgtacaccatctttgtggtgctgattctcctgagcgccggccttgccattggacatgcctattgggaggctcaggtgggaaacagttcatggtacctgtacgacggagaagacgacaccccttcatataggggatttctcatcttttggggctatattatcgttctaaacactatggtcccaatttctttgtatgtttcagttgaggtgatccgactggggcagagccactttatcaactgggacctgcagatgtactacgcagagaaagacactcctgccaaggctagaactactaccctcaacgaacagctgggacaaattcactatattttttcagacaagaccggcacactgactcagaacatcatgacttttaaaaaatgctgcatcaatggccaaatctacggcgaccatcgtgacgcctcacagcataaccataacaaaatcgagcaggtagacttctcctggaacacttacgccgacgggaagctggccttttacgaccactatctcattgaacagatccagtccggaaaggaacccgaggttaggcagtttttctttctgctcgcggtgtgccacaccgtcatggtggatagaactgacggtcagttgaactaccaggctgcctcccctgacgagggcgcactggtgaatgcagctagaaattttggattcgcctttctggcgcgtactcagaataccatcactatctccgaactgggcaccgaacgaacctacaacgtgcttgcgattttggactttaactctgatcgaaagcggatgtccatcatcgtgcgcaccccggagggaaatattaagctatattgcaaaggcgctgatacagtgatctatgaacgcctgcatcgcatgaaccccacgaaacaggagactcaagacgccctcgacatatttgcgaacgaaacacttcgtacactctgcctctgctacaaggaaatagaggagaaagaattcacggagtggaacaagaagtttatggcagcctccgtggcctcaacaaacagagatgaggctctggacaaggtgtacgaggaaatcgagaaggatctgatccttctgggcgcgacagccattgaggataaactgcaggacggagtccctgaaaccatctcaaaacttgccaaggctgatattaaaatctgggtgcttaccggtgacaagaaagaaacggccgagaacattggctttgcttgtgaattgctaactgaggacaccacgatttgctatggagaagacataaacagcctgcttcacgccagaatggagaatcagaggaacagaggaggagtatatgctaaattcgccccgcctgtgcaggaaagtttttttcccccaggtgggaaccgggccctgatcatcactggctcttggctgaacgagattttactggaaaagaagacaaaaaggaacaagatcctgaaacttaagtttccccgcactgaggaagagagacgaatgcgaactcagtccaaaaggcgactggaggccaagaaagaacagcgccaaaagaacttcgtagatctggcatgcgaatgctccgccgtaatttgttgccgcgtcacgcctaagcagaaggctatggttgttgacttggtgaagcggtacaaaaaggcaataacgcttgccatcggtgatggtgccaacgacgttaatatgatcaagacagcccacattggagtcggtatctctggtcaggagggtatgcaggcagttatgagttcagattattctttcgcgcagttccgttatcttcagagactgctgcttgtgcacggcagatggtcctacatcagaatgtgtaaattcctgcgatactttttttacaaaaacttcgcgttcaccctggtgcatttttggtatagctttttcaacggctatagcgcacagaccgcatacgaagactggtttatcactctgtataacgtgctctatacatccctgccagtgctgctcatggggctgctggatcaggatgtttcagacaagctttcactgcggttcccgggactgtatatcgttggacagcgcgatttgctgtttaattacaagcgcttctttgtgagccttttacatggcgtcctcaccagcatgatcctattttttattccgctgggcgcttatctgcagaccgtggggcaggatggtgaagctccctctgactaccagagctttgcagtcactatcgccagtgccctggtaattaccgtgaacttccagatcggtctggacacgtcttattggacttttgtgaacgcatttagcatctttgggtctattgctctttatttcggcatcatgttcgatttccacagtgcaggcatccatgtccttttccccagcgcattccagttcacaggaaccgcgtccaacgcactcaggcagccttacatctggctgacaattatcctggccgttgccgtttgtcttttaccagtagttgcaatcaggttcctgtcaatgaccatatggcccagcgagagcgataaaatacaaaagcatcgcaaaaggttgaaagcagaggagcagtggcagcgacggcaacaggtgttcagacggggcgtctccacacggagatctgcctacgcatttagtcaccaaagggggtacgccgacctcatatctagtggaaggtccatcaggaaaaaaagatccccattagatgctatcgttgctgacgggacggccgagtacaggaggactggagatagc

SEQ ID NO: 7257 - DNA, 3753 bp, Artificial Sequence
  Description of Artificial Sequence: Synthetic coding sequence
atgtcgacggaacgggattcggaaacgaccttcgacgaagattctcaaccgaacgacgaggtggtcccgtactcggacgacgaaaccgaggacgaacttgacgatcagggctctgccgtcgaaccggagcagaatcgcgtcaatcgcgaggcggaagaaaaccgggagccgtttcggaaggaatgcacctggcaagtgaaggcaaacgaccggaagtaccacgaacagcctcatttcatgaatactaagttcctctgcatcaaggagtcaaagtatgctaacaacgcaatcaaaacttacaagtacaatgccttcacctttatcccaatgaaccttttcgaacagttcaagagagctgccaacctctatttcttggcgctcctgatcctgcaagccgtgcctcaaatcagcaccctcgcgtggtacaccaccctggtgcctcttctggtcgtgctgggagttaccgctatcaaagatctggtggatgacgtcgcaagacacaagatggataaggagattaacaacagaacctgtgaagtgatcaaggatggccgctttaaggtggccaagtggaaggaaatccaggtgggggacgtcatacgcctgaagaaaaatgacttcgtcccagccgacatccttctcttgagctcatcagaaccaaactctctgtgctacgtggagactgctgagttggatggagaaaccaaccttaagtttaagatgtcgctcgaaatcaccgatcaatacctgcagcgagaagataccctcgctactttcgatggattcatcgagtgcgaggagcctaataacagactggataagttcactggcactctcttctggagaaatacctcgttccctctcgatgccgacaagatcctgcttcggggatgtgtcattagaaatactgacttctgccacggacttgtgatcttcgccggagcggacaccaagattatgaagaactcgggaaagactcggttcaagcgcaccaaaatcgactacctgatgaattacatggtctataccatctttgtggttctcattctccttagcgccggtttggccatcggacacgcctactgggaggcccaggtgggaaacagctcgtggtacctgtacgacggagaggacgatacgccgtcgtaccgggggttcttgatcttttggggatacatcattgtcctcaatactatggtgccgatttcgctgtacgtgtcggtggaggttatccggctgggccagagccatttcattaactgggatctgcaaatgtactacgcggaaaaggacaccccggcaaaggcacggaccactaccctgaatgagcagctgggccagatccactatatcttctccgacaaaaccggtacgctgactcagaacatcatgacctttaagaaatgttgcatcaacggacagatctacggtgatcatagggacgcgtcgcagcacaatcataacaaaatcgagcaggtggatttctcgtggaacacctacgcggatggcaaacttgcgttttacgaccactaccttatcgagcagatccagtccggtaaggagccagaggtgcgccagttcttcttcctgctcgccgtctgccacactgtcatggtggaccggaccgacggacagctgaattatcaggctgcgtccccagacgaaggcgccctggtcaacgccgctcggaattttggattcgcattcctggctcggacgcaaaataccattaccatctcggaactcggaaccgaacggacctacaatgtgcttgcgattctggactttaactcagataggaaaagaatgtcaatcatcgtgcgtaccccagaggggaacatcaagctgtactgcaagggcgccgataccgtgatttacgaaagactccaccgcatgaaccctaccaagcaggagactcaggacgcccttgacatcttcgccaacgaaaccctgcggacgctttgcctgtgctacaaggagatcgaagagaaagaattcactgagtggaacaagaaattcatggccgcttccgtggcgagcactaatcgagacgaagcactcgacaaagtctacgaagagatcgagaaggacttgatcctgcttggcgctaccgcgatcgaagataagctgcaggacggcgtgcccgagactatcagcaagctggctaaggcagacatcaagatctgggtcctgactggtgacaagaaggaaacggcagaaaacatcgggttcgcatgtgaactgctcaccgaggacacgaccatctgttacggagaggacattaacagcctgctgcatgcccggatggaaaaccagcgaaacagagggggagtctacgccaagttcgcccctccagtgcaagaatcgttctttccgccaggagggaatcgcgcgctgattatcaccggatcatggctgaacgaaatcctgctcgagaaaaagaccaagagaaacaagatcttgaagctcaagtttccacgcaccgaggaagaacgccgcatgcggacgcagtcaaagaggagactggaagccaagaaggaacagagacagaaaaactttgtggatctcgcgtgcgagtgctcggccgtgatctgctgccgcgtcacgcctaagcaaaaggccatggtggtggatctggttaagcgctacaagaaggcgatcaccctcgcgatcggcgatggagctaacgatgtcaatatgatcaagactgcccatatcggggtgggcatcagcggacaggagggcatgcaggctgtgatgtcatcggactactcgttcgcgcagttccgctacctccaacggctgctgctggtgcatggacgatggtcttacatccgcatgtgcaagttcttgcgctacttcttctacaagaatttcgccttcactctggtgcacttctggtacagctttttcaacggatactccgcacaaaccgcttacgaggactggttcattaccctgtacaacgtcctgtacacgtcactgccagttctgctgatgggacttctggaccaggatgtgtctgataagctctccctgagattcccaggcctctacatcgtgggacaacgggatctgcttttcaattacaagcggttcttcgtgtccctcctccatggcgtactcacttcgatgatcctgttctttattccactcggcgcttacctccaaaccgtcggtcaggacggagaagctccatccgactatcagtcattcgccgtcaccattgcctccgctctggtcatcaccgtgaacttccagatcggactggacaccagctattggacctttgtgaacgccttctccattttcggatccatcgcgctgtactttggaatcatgtttgatttccattccgcgggaatccacgtgttgttcccttcggctttccaattcaccggaaccgcctccaatgcactgaggcaaccgtacatctggttgaccattatcctcgcagtggctgtctgtctcctgccggtggtggcgatccgcttcttgagcatgaccatctggccatcggagtccgacaaaatccagaagcaccggaagcggctgaaagccgaagaacagtggcagcgccggcagcaggtgttccgtagaggcgtgtctactcgaaggtcggcgtacgccttcagccatcagagggggtacgcagatctgattagctccggacggtcaatcaggaaaaagcgcagcccgcttgacgccatcgtggcggacggaactgcggaataccggcggaccggcgattcc

SEQ ID NO: 7258 - DNA, 3753 bp, Artificial Sequence
  Description of Artificial Sequence: Synthetic coding sequence
atgagcactgaacgggacagcgaaactacgttcgacgaagacagtcagcccaacgacgaggtggtgccatacagcgatgacgaaactgaagacgagcttgacgaccagggcagcgccgtggaacctgagcagaaccgcgttaacagagaggcggaagagaaccgcgagcccttcaggaaagagtgtacttggcaggtaaaggccaacgacagaaaatatcacgaacagccacacttcatgaatacaaagtttctgtgtatcaaggaaagcaaatacgccaataacgcaataaaaacctacaagtacaacgcgttcacctttatccctatgaacctgtttgagcagttcaagcgggccgctaacctttacttcctcgcactgctgatcctgcaggccgtgccccagatttcaacgttggcatggtacactacactggtgcccctgctcgtggtgttgggcgtcacggccatcaaagatctggtcgacgatgtcgcccgccataaaatggataaggagatcaacaaccgcacgtgcgaggtaataaaagacgggaggtttaaggtcgcaaaatggaaagaaatccaggtcggagacgtgatacgccttaagaaaaacgactttgtgccagctgacatattgttgctgtcttcctccgagcccaactctctttgttacgttgagactgcagagttggatggggagactaatttgaagtttaagatgagtcttgaaatcaccgatcagtacctccaacgagaggacaccctggccacatttgacggattcattgaatgcgaggagcccaacaaccgactcgataagttcacaggtacactcttctggcggaacacgagcttccccttggacgccgataagattctgctgagaggatgtgtgatcaggaacacagacttctgtcatggactggtcatctttgcaggagccgacactaaaattatgaaaaactctggaaaaacaagatttaagcgcactaaaatagactatcttatgaattatatggtgtacactatattcgtggtgctgattctgctctccgcaggcctggcaataggacacgcctactgggaggcccaagtgggtaatagttcctggtacctttacgatggcgaagatgacactccatcctacaggggcttcctgattttctggggctacattatcgtcctgaatacaatggttccaattagtctctacgtctcagtcgaagtgatcagactgggccagtctcacttcattaattgggatttgcagatgtactatgctgaaaaagacaccccggcaaaggcacgcaccaccactttgaatgagcagcttgggcaaatccactacatcttttccgataaaacggggaccctgactcaaaacataatgaccttcaagaaatgctgtataaatggccagatctacggtgatcaccgggacgcctcccaacacaatcataacaagattgagcaggtagatttctcttggaatacctatgccgatgggaaactcgccttttacgaccattatcttatcgaacagatccagtccggcaaggagccagaggtgcgacagttttttttcctgcttgccgtctgccacacggtgatggtcgatagaactgatgggcagctgaattaccaggctgcgtctcccgacgagggagcgttggttaacgccgctcgcaacttcggctttgcatttctggctaggacacagaatactattacaattagcgagctcggcactgagcggacatataacgtgctggcaattctggatttcaatagtgaccggaaaaggatgagcatcatcgtgaggactcccgagggcaatatcaaactctactgtaagggagcagatacagtgatttacgagaggctccatagaatgaatcccacaaaacaggaaacccaggacgcactggacattttcgccaacgaaacccttagaactctgtgcctgtgttacaaggagatcgaggaaaaagagtttaccgagtggaacaagaagttcatggccgcatctgttgcatccacgaatcgagacgaggccctcgataaagtatatgaagagatcgagaaggacctcatactgctcggcgcaaccgctatagaggacaaactgcaggatggagtcccagagaccattagcaaacttgcgaaggctgatatcaagatctgggtgctgaccggtgacaagaaagagactgctgagaatatcggatttgcatgcgaacttctcactgaagatacgacgatctgctacggggaggatataaattcccttctgcacgctcggatggaaaatcaaagaaacaggggtggagtgtacgccaagtttgccccgccagttcaggagtctttttttcccccgggtggcaatagggctctgatcatcaccggcagttggctcaatgaaatcttgctggagaaaaagacaaagagaaacaaaatactgaaattgaagttccccagaacagaagaagagagacggatgaggacccaaagcaaacggaggcttgaagcgaagaaggagcagagacagaaaaacttcgtggatttggcttgcgagtgctccgccgtgatctgctgtagggtgacgccaaaacagaaggctatggtagttgatctcgtgaaacggtacaaaaaagctatcacccttgccataggtgatggtgccaacgacgttaatatgataaaaaccgctcacattggcgttggcatcagcgggcaggagggtatgcaggctgtcatgtcctcagactactctttcgctcagttccggtatttgcaaaggctgctgctcgttcatgggcgctggtcatatatacggatgtgtaagttccttcggtactttttttacaaaaatttcgctttcactttggtgcacttctggtactcattttttaatggttattctgcacagactgcttacgaagattggtttattaccctgtacaacgtcctgtatacctccctgccagttctcctcatgggtctgctcgaccaggatgttagtgataaactgagcctgagattcccggggctttatattgtggggcagagggaccttctgtttaactacaagagattttttgtcagtctgctgcacggggtgctgactagtatgatcttgtttttcattcctctgggggcgtatctccagaccgtgggccaggatggggaagctcctagtgactatcagtcattcgcagtgactattgcctccgctctggtgatcaccgtcaattttcagattggcttggatacgagttactggacttttgtaaacgcatttagcatttttgggtccatcgccttgtatttcgggattatgtttgactttcattccgctgggattcacgtactttttcctagcgctttccagtttactggtaccgctagtaatgcccttcgacagccatatatctggctgacaatcatccttgcagtagcggtgtgtcttcttccagtagtcgccattagatttctgagtatgaccatctggcctagcgaatctgacaaaattcagaagcacaggaagcgcctcaaggccgaggagcagtggcagcggaggcagcaagtgtttaggcggggtgtgagtacccggagaagtgcttatgcctttagtcaccagagaggatatgcggatctcatatcttccggacggtccatccgaaagaaacgaagtccactggatgccattgtcgcagacggcactgcagagtaccgcaggacaggcgactca

SEQ ID NO: 7259 - DNA, 3753 bp, Artificial Sequence
  Description of Artificial Sequence: Synthetic coding sequence
atgagtaccgaaagagacagcgaaaccactttcgacgaggacagtcagcccaatgatgaggtcgtgccctatagcgacgatgagactgaagacgaactggatgatcagggaagtgccgtggagcccgagcagaaccgcgtgaaccgggaagcagaggaaaaccgcgagcccttccggaaagagtgtacgtggcaggtaaaggccaacgatcgcaaatatcatgagcagccacatttcatgaatactaaattcctttgcatcaaggaatccaagtatgccaacaatgcgattaaaacatataaatacaatgcatttactttcattcctatgaacctcttcgaacagttcaaacgggccgcaaacctctacttcctggctctgcttattctgcaggccgtaccgcaaatatccactctggcttggtacaccaccttggttcctttgttggtggtgctgggcgttacagcaataaaggacctcgtagacgacgttgcccggcacaagatggataaggaaattaacaacagaacctgtgaggtgatcaaagatggtcgttttaaagtcgccaaatggaaggagattcaggtgggcgatgtgatccgcctgaagaaaaacgacttcgtgcctgccgacatcctgctcctgtccagcagcgagcccaactctctgtgttatgtcgagaccgccgagctggacggagagacaaatttaaagtttaaaatgtccctcgagattacagatcagtacctccaacgagaggacactctcgccacgtttgacggctttattgaatgcgaagagcccaataaccgtctagataaatttaccgggacgctgttctggaggaataccagcttccccttggatgcggataagattctgctccgtggttgtgtgattcgtaataccgatttttgccacggcctggtgatctttgccggcgccgatactaaaattatgaagaattcagggaagacccggtttaagagaacaaaaattgattacctgatgaactacatggtctacaccatctttgtagtattgattctgctaagcgccggcttagcaatcggccatgcctattgggaggcacaggtgggcaactcatcctggtacctttacgatggagaagatgatactccatcttaccgaggcttcctgattttctggggttacattatcgtgctgaataccatggtgccgatctctctgtacgtgagcgtggaagtgataagactcgggcagagtcactttataaactgggatcttcagatgtactatgctgagaaggacacaccagctaaagcccggaccactacacttaacgagcaattaggacaaatccattacatttttagcgacaagaccggaactttgacccagaacattatgactttcaagaaatgttgcatcaatggccagatctatggagatcatcgcgatgctagtcagcacaaccacaacaagatcgaacaggtggactttagctggaatacctacgcagatggcaagctcgccttttatgaccactatttgatcgagcagatacagagcgggaaagagccagaagtgcggcagtttttcttccttctggcggtatgtcatacagttatggtggaccgcacagacggccagctgaactatcaggcggcctcccctgatgaaggcgcactcgtgaatgcggcccgcaatttcggctttgcattcctggcccgtacacagaatacaattacgatctccgagttgggcacggaacggacatacaatgtactagccatcttagattttaactctgaccgcaagcggatgagtataatcgtcagaacccccgaagggaatattaagctttactgcaaaggggccgacacagtcatctatgagaggctacacagaatgaacccgacaaagcaggaaactcaagacgcgcttgatatattcgccaacgaaaccctccgtaccttatgcctgtgctacaaggagatagaagaaaaagagttcacggagtggaataagaaatttatggcggcaagtgtggccagcacaaaccgagatgaagctctagataaggtgtacgaggaaatagagaaggatctaatattactgggagctactgctatcgaagacaagctacaggatggagtaccagagaccatatccaagcttgctaaggccgacatcaaaatctgggttttgactggagacaagaaagagacagctgaaaacatcggatttgcctgcgagcttctgactgaagacacgactatatgctatggtgaggacatcaactcacttctgcacgcccggatggagaaccagagaaatcggggcggagtgtacgcaaagttcgcacctcctgtgcaggagtccttcttcccaccgggaggcaaccgagccttgattatcactggatcgtggctgaatgagatcctgttggaaaagaaaacaaagcgcaataaaatccttaagctcaaattccctcgcaccgaagaggaacgacgtatgagaacccagagcaaacgaaggcttgaggccaaaaaagagcagcgtcaaaagaacttcgtggacctcgcatgcgagtgcagtgcagtgatctgctgtagagtgacccctaagcagaaagccatggtggttgaccttgtgaaacgctacaaaaaggcaattaccctggccatcggagacggggccaatgacgtgaacatgattaaaactgcccatattggagtggggatctctgggcaagaaggcatgcaagcggtgatgagcagcgactactcttttgctcaattccgatatctgcaaagattactgttggtgcatgggaggtggtcctatattagaatgtgcaagtttctacgctactttttctacaagaacttcgccttcacactcgtccacttttggtatagtttcttcaacggctacagcgctcaaacagcctatgaagattggttcataactctgtacaacgttctgtatacaagcctccctgtattgctgatgggattgctcgaccaagatgtttcagataagctttctctccgatttccaggactgtacattgtgggtcagcgagacctgcttttcaattataaaagattttttgtctcactgctgcatggagttctgaccagcatgatcttgttcttcatacccctgggggcgtatctgcagactgttggacaggacggcgaggcccctagcgattaccagtcattcgctgtaacgatcgcaagtgctctggtgatcaccgtcaactttcagataggcctcgatacatcttactggaccttcgtcaacgcattctcaattttcgggagcatagccctgtattttggtatcatgttcgactttcacagtgccgggatccatgtcctcttccccagcgctttccagtttactggaaccgcctccaacgccctgcgtcagccttacatctggcttactatcattttggccgttgctgtttgtctgctgcccgtagtcgcaatacgctttcttagcatgacaatttggccctctgagtctgacaagatacagaagcataggaagcgcttaaaggcagaggaacaatggcagaggaggcagcaggtgttccggcgcggggtgagtaccaggaggtcagcgtatgcttttagccaccaaaggggctacgccgatttaataagctcgggacgatccatcagaaaaaagcgctcacctctcgacgccatcgtggccgacgggaccgctgagtaccgcaggaccggcgacagt

SEQ ID NO: 7260 - DNA, 3753 bp, Artificial Sequence
  Description of Artificial Sequence: Synthetic coding sequence
atgtccaccgaacgcgattcagagactactttcgacgaggatagccaacctaacgatgaggttgtgccctactctgacgatgagaccgaggacgaactagacgaccagggaagcgcagtggagcccgagcagaaccgggttaatagggaggctgaggagaaccgtgagccatttagaaaggagtgtacgtggcaggtgaaggcaaatgatcgcaagtatcatgagcagccccatttcatgaacaccaaattcctatgcattaaggaaagcaaatatgccaataatgcgattaagacttataaatataatgcattcaccttcattcccatgaacttgtttgagcagtttaagagagccgcaaatttgtacttcctcgcgctgctaatccttcaggccgtgcctcagatttccacactggcctggtacactacactggttccattgctggtagtcctcggtgtcaccgcaataaaggatctggtcgatgatgtggcacggcacaagatggacaaagagatcaataataggacctgtgaggtcatcaaagatggacggttcaaagtggccaagtggaaggagatacaggtgggagacgtgatccgcttgaagaaaaatgattttgtgcctgcagacatcctactgctcagcagctccgaaccaaactctctgtgctatgttgaaacggccgaactcgacggcgaaacaaaccttaaatttaaaatgtctctggagatcaccgatcaatatcttcagagggaggatactcttgccacatttgacggcttcatcgagtgcgaggagcctaacaataggctggacaaattcaccggaaccctattttggcgcaatacttcatttcccctcgacgcagataagatcctgctaaggggctgcgttatcaggaataccgatttttgtcacgggctggtgatcttcgccggagctgatactaagattatgaagaacagtggcaagactagattcaagcgaacaaagattgactacctgatgaactatatggtttacactatttttgttgtcctcattctcctgtctgccggattggctatcgggcacgcttactgggaagctcaggtcggcaactctagctggtatctgtatgatggtgaagacgatacaccatcctaccgagggttcctgattttttggggatatattattgtgctgaacaccatggtgccaatttcactgtacgtgtctgtggaagtgattcgactgggccagagccacttcattaactgggatctgcaaatgtactacgctgaaaaggacacacctgctaaggctagaacgactacactgaatgagcagctgggtcagatccactacattttctcggataaaaccggaactttgactcaaaatataatgacatttaagaagtgttgcataaacgggcaaatttacggcgatcacagggatgctagtcagcataatcacaacaagatagagcaggtggatttttcgtggaatacttatgcggatggaaaactggcattctatgatcattatctgattgagcagatccagtctggtaaggagccggaggtgcgacagtttttttttctgctggctgtgtgccacacagttatggtggaccgcactgacgggcagctcaattatcaggccgcctcccccgatgagggagccctcgtcaacgcagcacggaacttcggctttgcctttctggcccggacccagaatactattaccatctccgagctcggtacggagcggacgtacaatgtcctggccattctcgattttaactccgatcgcaagcggatgagtattattgtaagaactcctgagggtaatattaaactgtattgtaaaggggccgacaccgtgatatacgaacgccttcaccgcatgaacccaaccaagcaagaaacccaagacgcccttgacattttcgccaatgaaacgctgagaaccctgtgcttgtgttataaagagattgaggaaaaagaatttacagaatggaataaaaaatttatggcagcctccgtggcttccacgaacagagacgaagccctagataaagtatatgaggagatcgagaaagatcttattctcttgggcgctactgccattgaagacaagctgcaggatggagtcccagagacaatttctaagctcgccaaagcagacatcaaaatctgggttctcacaggcgacaagaaggagacggcagaaaacatcggttttgcatgtgaactgctgacggaggatactacaatctgttatggtgaggacattaatagcctgctacacgcaaggatggagaaccagcgcaaccggggaggtgtctacgctaagtttgctccaccagtgcaggagtcttttttcccacctggaggtaaccgcgccttaatcatcaccggatcctggttgaatgagattttgctggagaagaagactaaaaggaataaaatactgaagctgaagttcccaaggactgaggaggagagacgcatgcggacccaaagcaaacgaaggctggaggctaagaaagagcaaagacagaaaaattttgtggatttggcttgtgaatgctccgccgtgatttgctgtagagttacacctaaacaaaaggcaatggttgtcgatctagtgaagcgatacaagaaagccatcactttggctatcggtgatggggccaatgatgtaaatatgatcaagactgcccacattggcgtgggtatctccggccaggagggcatgcaggctgtgatgagctctgactattccttcgcccagttcagatacctgcagcggctgctactggtgcatggtcgctggagctacatcagaatgtgtaaattcctccgctactttttctataaaaatttcgcatttaccttagtccatttttggtattccttcttcaatggatacagtgcccagaccgcatatgaggattggtttatcactttgtataacgtactgtatacatcactacccgtattgttgatggggttgcttgaccaggacgtgtctgataagctttcactaagatttcctggcttgtatatcgtcggtcagcgggacctgttattcaactataagagattttttgtgtctctcttgcatggggtccttacctctatgattttgttcttcattcccctgggggcttatttgcaaaccgtcggccaggatggagaagccccctccgattaccagtccttcgctgttaccatcgcctctgcactggttatcaccgtaaattttcagatcgggctcgacacctcttactggacgtttgtgaacgcttttagtatcttcggatcgattgccctgtacttcggaatcatgtttgactttcactccgccggcattcatgttctttttccaagcgctttccaatttacgggcacagctagtaacgccctaagacagccttatatttggcttactatcatactggcagtagctgtgtgcctgctgccagtcgttgcgattagatttctgagtatgacaatttggcccagcgaaagcgacaagattcaaaaacaccgaaagaggctgaaggcggaggaacagtggcagaggcgtcagcaggtctttcgccgcggggtgtcgacacgaagatctgcctacgcatttagccaccagcgcggttacgcagatttgatctcttcagggagatcaattaggaagaagcggagtcctttggatgccattgtcgctgatggtactgccgagtaccgccgcactggcgattct

SEQ ID NO: 7261 - DNA, 3753 bp, Artificial Sequence
  Description of Artificial Sequence: Synthetic coding sequence
atgagcactgagagggattcagagacgacattcgatgaagactcgcaacccaatgacgaggttgtgccgtactccgacgacgaaaccgaggacgagctggatgaccagggctctgctgtggaacccgaacagaatcgcgtaaaccgcgaggccgaggagaatagagaaccttttagaaaagagtgtacctggcaggtgaaggctaatgaccgaaaataccacgaacaaccccatttcatgaacacaaaatttctttgcattaaggaatccaaatacgccaataatgccatcaagacctacaaatataatgcattcaccttcataccgatgaacctatttgaacagtttaaaagggcagccaatctgtattttctggctcttttgattctccaagctgttcctcaaatttcaactttggcttggtataccacgctggtgcctctcctggtcgtgctgggggtgaccgccatcaaagacttggtggacgacgtggctcgacacaagatggataaggaaatcaacaacaggacatgtgaggttatcaaagacggccgatttaaagtggcgaaatggaaggagatccaagtgggggacgtgatacggctcaagaagaatgacttcgtgcccgccgatatactgctcctaagctcctctgaacccaacagcttatgctatgtcgaaaccgcggaattggacggcgagacaaatttgaagttcaaaatgtcccttgaaattaccgaccagtatctgcagagagaagacaccctggccacttttgacggcttcatcgaatgcgaagagccgaacaaccgccttgataagtttactggcactttgttctggcgaaataccagcttcccactggacgcggataaaatacttctaaggggatgcgtgatacgaaacacagatttctgtcacggactagtaattttcgccggggctgataccaagatcatgaagaactccggaaagacacgatttaaacggactaaaattgactatcttatgaactacatggtgtacacaatctttgtcgtgttaatcctcttgtcagcaggcctggccatcggtcacgcgtattgggaggcacaggttggtaactcatcttggtatctgtacgatggtgaggacgacactccctcctataggggattcttgatcttctgggggtatatcattgttttaaacaccatggtgccaatcagtctatacgtgagcgtggaagtgatccgactgggccagagccatttcatcaactgggatttgcagatgtactatgcggaaaaagacacaccagcaaaggctcgaaccactaccttgaatgagcagcttggacaaatacattacatcttttcagacaagaccggtaccctgacccaaaacataatgacatttaagaagtgttgtattaatggccagatctacggagaccatcgggacgcttcacagcacaatcataataagattgagcaagtggattttagttggaatacatatgccgacgggaagttggcattctacgaccactatctgatcgaacaaatccagagcgggaaggaacccgaggttcgacagtttttttttttactagccgtgtgccacaccgtgatggtcgacaggactgatggacaactgaattatcaggctgcatctccagatgagggtgctctagtcaacgcagctcggaactttggcttcgcattcttggctagaacccaaaacactataactattagcgagcttggcactgaaaggacatataatgtactggccattctggattttaattctgatcggaaaaggatgtccatcattgtgagaacacccgaaggtaacataaagctctattgcaagggagctgatacagtgatttacgagagattgcatagaatgaacccgacaaagcaggaaacccaggatgccttggacatcttcgccaatgagactctgagaactctttgtctctgctataaggagatagaggaaaaggaatttaccgagtggaacaagaagtttatggccgcgtccgtagcctctaccaatagggacgaagccctagacaaggtgtatgaagaaattgagaaggatctgattctactgggcgcgacagccattgaggataagttgcaagatggtgtgcccgaaacaatttccaaactcgctaaggctgatatcaaaatctgggtcctcaccggcgacaaaaaggagacagccgagaatattggctttgcttgtgagctgctgactgaagataccaccatttgctatggcgaggacattaattcacttttgcacgcaaggatggagaatcagcgaaacagggggggagtctatgcgaaattcgctcccccggttcaggaaagtttcttccccccaggaggaaatcgtgcactgattataacaggttcttggctcaatgagatcttgctggaaaagaaaaccaagcgaaataaaatcttaaaactcaagttcccgagaaccgaagaggagcgtaggatgcgaacccagagcaaaaggcgactagaagccaagaaggagcagcgacaaaagaactttgtcgatctggcttgtgagtgtagcgccgttatttgttgccgagtgactccgaaacaaaaagccatggtggtcgatctcgtcaagcgttacaagaaggccattaccttagcaattggggacggcgcgaacgatgtaaatatgatcaagaccgcccatataggcgtaggcatcagtgggcaggaggggatgcaagccgtgatgagctcggattactccttcgcacaatttagatacctccagcgactgctgttagtacacggcagatggagttacatcagaatgtgtaaatttttgcgatactttttttacaaaaatttcgcattcacgttagtacacttctggtactctttctttaacggatacagcgcacagaccgcctacgaagattggttcatcactctgtacaatgttctgtatacatcactccctgtgctgttaatgggcttacttgatcaggatgtgtccgataaactgagccttcggttccctggtttgtatatcgtcggccagagggatttattgtttaactacaagcgattcttcgtttccctcttgcatggagtccttacaagcatgatcctgttctttattcctttgggcgcctacctgcaaacagtcgggcaggatggagaggcgccaagtgactaccagtcttttgcagtgaccattgcctctgctctcgtgatcacagtgaacttccagattggtctagacactagctactggaccttcgtaaacgctttcagcattttcggttcaatagccttgtactttggaatcatgttcgactttcatagtgctggtatccacgtcctgttcccgtctgcgtttcagtttaccggtactgcatctaacgcacttaggcagccatatatatggttaactatcatcctggccgtggctgtttgcctcctgcccgttgtcgcaatccgattcctctctatgactatttggccatctgaaagtgataagatccagaaacatcgaaagagactcaaggcggaagaacagtggcagcgaagacagcaggtatttcgtagaggtgtgagcactcgacgatcagcttatgctttcagccatcagcgggggtacgcagatctaattagttcaggaaggtccatcaggaaaaaacgatcccctctggatgcaatcgtggccgatggcactgctgagtaccgaaggaccggcgactcc

SEQ ID NO: 7262 - DNA, 3753 bp, Artificial Sequence
  Description of Artificial Sequence: Synthetic coding sequence
atgagcactgagagggattccgaaactacctttgatgaagattcgcagcctaatgacgaagttgtcccatacagcgatgatgaaacggaggatgagcttgacgatcaaggaagcgcagtggaaccagagcagaacagagtgaatagagaagcagaagaaaatcgcgaacctttcagaaaagaatgtacttggcaagtcaaggctaatgaccgcaagtaccatgaacaacctcactttatgaacactaagttcctgtgtattaaggagtcgaagtacgcaaacaatgcaattaagacgtacaagtacaacgcttttaccttcattccaatgaatctttttgagcagtttaagcgggccgcaaatttgtactttcttgcgctgcttatcctgcaagcagtccctcaaatatcaactcttgcctggtacaccaccctggtcccactgcttgttgttctcggcgttaccgccatcaaagacctggtcgacgatgtggcaaggcataagatggataaagagatcaataaccgtacctgtgaagtgattaaagatggtcggttcaaggtggcaaagtggaaggagattcaggtgggagacgtcatccgtctgaagaagaacgactttgtccctgccgatattctgttgctgtcctcatcggagccaaactcgttgtgttacgtggaaactgcagagctggatggcgagactaacctgaagtttaagatgtcgctggaaattactgaccaatacctccaacgtgaagataccctcgcaacgtttgacggatttatcgaatgcgaggaacctaacaaccggcttgataagtttactggtactctgttctggcggaacacctcatttccactggatgccgacaagatcctgcttaggggctgtgtgattcgtaatactgatttttgtcacggccttgtgatttttgcaggtgcagacactaagattatgaaaaacagtggaaaaactcgattcaaaagaacgaagattgactatctgatgaactacatggtgtacactatcttcgtggtgctgatcttgctgtcggcaggtctggcgatcggacatgcctactgggaagcccaggtggggaactcatcctggtacctctacgacggagaggatgacactcctagctatagagggtttctcattttctggggttacattatcgtccttaataccatggtgccgatttcgctgtacgtctccgtggaagtgatccggctggggcaatcgcatttcatcaactgggatctgcaaatgtactacgcagaaaaggataccccagccaaagcacgaactaccacgctgaatgaacaactgggacagattcactacatattctcggataagacgggtactcttactcagaacatcatgactttcaaaaagtgttgtattaacggtcaaatctacggagatcatagggatgcatcgcagcacaatcataacaagattgaacaggtcgatttctcgtggaacacgtacgccgatggtaagctcgcgttctatgatcactaccttatcgaacagattcagagcgggaaggagccggaagtgcggcagtttttctttctcttggcagtttgccatactgtcatggtcgataggaccgacggacagctcaattaccaagcagcatccccagacgaaggggcactggtgaatgcagcacgaaatttcggttttgcgtttttggctcggactcagaacaccataactatctcggaactcggaactgaaagaacctacaatgtgctggcaattctcgatttcaatagcgatcggaagagaatgtcaattatcgtgcgcactcctgagggaaatatcaagctgtactgcaagggtgcagatactgtgatctacgagcgccttcatagaatgaacccgaccaagcaagagactcaagatgcattggacatctttgccaacgaaactctcaggactctgtgcctttgttacaaggaaattgaagaaaaggaattcaccgagtggaataagaagttcatggcagcctcggttgcgtccactaacagagatgaggcgctggataaagtgtacgaagaaattgaaaaggacctgattctgctgggagcaacggccatcgaagataagctccaggatggagtcccagaaaccattagcaaacttgctaaagcagacattaagatttgggtccttaccggtgataagaaagagactgctgaaaacattgggttcgcctgcgagcttctgacggaggataccaccatttgctacggagaggatatcaactcacttctgcacgctcgcatggaaaatcaaaggaaccgaggcggggtgtacgcaaagttcgcacctccagtgcaagaatcgttttttcctcctggtggaaatcgagccttgattatcactggctcctggctgaacgagattctgctggagaaaaagaccaagcggaacaagattctgaagctcaaatttccccgcaccgaagaagagaggagaatgcggactcagtccaagagacgacttgaagccaagaaggaacaacgacagaagaactttgtggatctggcatgtgaatgtagcgccgtgatatgctgcagagtcactcctaagcaaaaggcaatggtcgtcgaccttgtcaaaaggtacaagaaagcaatcactcttgcgatcggtgacggggcaaacgatgtgaatatgattaagaccgcccatatcggagtgggaatctccggacaggaggggatgcaggcagtcatgtcctcagattactcgttcgcgcaatttcgttatcttcagcgccttctgcttgtgcacggaagatggtcatacatcaggatgtgtaagtttctgcgctactttttctataagaactttgcatttacgctggtccacttttggtactccttcttcaatggttactccgcacaaactgcatatgaggattggtttatcactctttacaacgtcctgtatacctcccttccagtcctgctcatgggcctccttgatcaggacgtcagtgacaagctgagtcttaggttcccaggactgtacatcgtgggacaacgggacctgctgtttaactacaaaaggttttttgtgagcctgctgcacggcgtccttaccagcatgattctgttcttcattccgctcggtgcctaccttcagaccgtgggccaggacggggaagccccatcggactaccaatcctttgcagtcaccattgcgtcagccttggtgattactgtgaacttccaaattggtcttgacacttcgtactggacgttcgtgaatgcattttccatatttggatcgatcgcgctctactttgggattatgtttgacttccactccgctggcattcatgtgctctttccatctgcattccaatttaccgggactgcaagcaacgcactgaggcaaccatacatctggctgactataatcttggcggtcgcggtgtgcctcctgcccgtggtggcaataaggtttctgagcatgactatttggccctcagagtccgataagatccaaaaacatcgtaaacggctcaaagcagaagaacagtggcagcgcagacagcaagtgtttcgacggggcgtttcaacgagacgatccgcatacgcattttcacatcaacggggctacgcagacctgatcagctcgggaaggagcatacggaaaaagaggtcgccccttgatgccatcgtggccgatggaactgcagagtaccggcgtaccggggactcg

SEQ ID NO: 7263 - DNA, 3753 bp, Artificial Sequence
  Description of Artificial Sequence: Synthetic coding sequence
atgagcactgagagagactccgaaactacatttgacgaggatagtcagcccaatgacgaagtagtgccttacagtgacgacgagaccgaggatgagctggatgaccagggatctgcggtggagcccgaacaaaatcgagtaaatagagaggctgaggagaatagagagccatttcggaaagagtgcacttggcaggtcaaggctaacgacagaaagtatcatgaacagcctcattttatgaacactaagttcctgtgcataaaggagtcaaaatatgcaaataatgcaattaagacgtacaagtacaacgcgttcacatttattcccatgaacctattcgagcagttcaaacgcgccgccaacctttatttcctggctctcctgattctgcaggctgttcctcagatctcaacgttggcgtggtacactacgttggtcccactgctggttgtactcggcgttacggccataaaggatctggtggatgacgtagcaagacacaaaatggacaaggagataaacaaccgtacttgtgaggtgattaaagatggtagatttaaggttgccaagtggaaggaaatccaagtgggtgatgttattaggcttaagaagaacgattttgtccccgctgatatcctgctcctaagctcatccgagccaaactccctttgctacgtggagaccgccgagctggacggtgagacgaacttgaagttcaaaatgtctttggaaatcacagaccagtacttgcagcgagaagacaccttggcaaccttcgacggattcattgagtgcgaggagcccaacaatcgcttagacaaattcacaggaacgctgttctggcgcaatacctcttttcccctggatgcagacaaaattctgttgcgaggctgcgtgatccgaaacaccgatttctgtcacggcctggtcatatttgctggcgccgacacaaagatcatgaaaaatagcggcaagactaggtttaagcggactaaaattgactatctgatgaactatatggtatacaccatcttcgtcgtattgatactattatcagccggcctggccatcggtcatgcctattgggaagcacaggtcggcaattcctcctggtacctgtacgacggggaggatgataccccaagttatcggggtttcctgatcttctggggttacatcatagtccttaacaccatggtgcccatctccttgtacgtcagcgtagaggttatccgcttgggccagtctcatttcatcaactgggacctgcaaatgtattacgccgagaaagataccccagctaaggcacgaacaactaccttaaacgagcagctaggccaaatacactacattttcagcgataagactggcactctgacccaaaatattatgactttcaagaagtgttgtatcaatggacagatttacggagaccaccgtgatgcatcccagcataaccacaataagatcgaacaggtagatttctcttggaacacatatgccgatggtaagctggctttttatgaccactacctgatcgaacagatccagtctggcaaggaaccagaggtgcggcagtttttcttcctgctggccgtatgtcatactgtaatggtggatcggactgatgggcagttgaattaccaagcagcatccccggatgagggtgccctggtgaacgccgcgagaaactttggcttcgcctttctcgctcgtacccagaacacgatcaccatctctgagctgggcacagaacgtacttacaatgtgctcgctattctcgacttcaatagtgatcggaaaaggatgagcatcatcgtacgaacacccgaagggaacatcaagctctactgtaagggggcagacaccgtgatttatgagcgcctccacaggatgaatcccactaaacaagagacccaggatgctctggacatcttcgcgaatgaaactctgcggaccctgtgcctttgttacaaggagatagaagaaaaagagtttacagaatggaataaaaagttcatggcggcctccgtagcttctacaaaccgagacgaagcattggataaggtgtatgaggaaatcgaaaaggatctgatcctgctcggcgccacagctattgaagataagttgcaagacggtgtgcccgagacaatcagcaaactagcgaaggccgacattaaaatctgggtgctcacaggagacaaaaaagagactgccgagaatattggcttcgcgtgtgagttactaacggaggacaccactatatgttatggggaagacatcaactctctgctgcacgcacgcatggagaatcagagaaatagaggcggtgtgtatgcaaaattcgccccccctgtgcaggaaagctttttcccacctgggggcaatcgtgcactaatcattacaggaagctggctgaatgagattcttcttgaaaagaagacaaagcgcaacaagattctgaagctcaaattccccagaacagaggaagaacgaagaatgaggactcagtcaaagcgacggctggaggctaagaaggaacagcggcagaaaaacttcgtagacctggcctgtgaatgcagtgctgtgatctgctgtagggtgacacctaagcaaaaggctatggtagtggatctagttaaacggtacaaaaaagctatcacccttgcgattggtgatggcgccaatgacgtgaacatgatcaagacagcccacatcggggtgggaatctccggccaagaaggcatgcaggcagtgatgtcttctgactactcgttcgcccagttccgctacctgcagagattactgctggtgcacggtagatggagctacattcgcatgtgcaagtttcttaggtacttcttctacaaaaacttcgcattcaccctggtgcatttctggtacagcttctttaatggatattccgctcagacggcatacgaagattggttcattacgctgtacaacgtgttgtacactagccttcctgtactgttaatgggtctcctggatcaggacgtgtctgacaaactgtccttgaggttccccggtctatacatcgttggacagagagatttactattcaactataagaggttttttgtgtcgttacttcatggtgtgttgacttccatgatattgtttttcattcctcttggggcctacctgcaaaccgttggccaagacggcgaggcacccagtgactaccaaagcttcgctgttacaatcgcgtcggccctggttattaccgttaattttcagatcggcctagatacttcatactggaccttcgtcaatgccttctctattttcggctctattgccctctacttcggcataatgttcgatttccacagcgctggaatccacgtactgtttccttccgcgtttcaattcaccggcacggcctcaaatgcccttcggcaaccatacatttggctgactattatcctagctgtagctgtctgtcttctgcctgtggtagcgattcgttttctctccatgactatttggccctccgaatcagacaagatccagaagcataggaaaagacttaaagcagaggagcagtggcagcgaagacagcaagtgttcagaagaggagtctccacaaggagaagtgcctacgccttcagtcatcagcgtgggtacgcggacctaatatccagcggccgttccatacggaaaaagaggtcacccctagatgcgatcgtggcggatggcactgctgagtatcggaggactggcgattcc

SEQ ID NO: 7264 - DNA, 3753 bp, Artificial Sequence
  Description of Artificial Sequence: Synthetic coding sequence
atgagcactgagcgcgacagcgagaccacgttcgacgaggattcccagccgaatgatgaagtcgtgccatattccgacgatgaaacggaagacgagctggatgaccaggggagcgccgtggaaccagaacaaaaccgcgtcaatcgcgaggcagaggagaaccgggagccctttcgcaaagagtgtacatggcaggtcaaagctaatgatcggaaataccatgaacagccgcactttatgaatactaaattcctgtgtatcaaggagagcaagtacgcgaataacgcaatcaagacctataagtataatgccttcaccttcatcccaatgaacctgtttgaacagttcaagcgcgctgccaacctgtacttcctggctctgctcattctgcaagcagttccgcagatatccaccctggcgtggtacaccaccctggtgccactcttggttgtactgggcgtgaccgccatcaaggatctggtcgatgatgttgcaagacacaagatggataaagaaattaataataggacgtgtgaggtgatcaaggatggacgattcaaggtggcaaagtggaaggaaatccaagtgggcgatgtgatccgcctgaagaagaacgactttgtgccggccgacatcctgctgctgagctcatccgaaccaaacagtttgtgctacgtagagacagctgagttagatggcgagaccaaccttaagtttaagatgagcctggaaatcaccgatcaatacctgcagcgcgaggacactctggcaacttttgatggcttcatcgagtgtgaggaaccaaataatcgtttggacaaatttaccggtaccctgttctggcgcaatacgtccttcccgctggacgcggataagatcctgctgcgcggctgtgtcatccgtaataccgatttctgccacggtctggtcatcttcgcgggcgctgatacgaagatcatgaagaatagtgggaagactcgatttaaacgcacgaagatcgactacctgatgaattacatggtctacactatctttgtggtgctgattttgttgtctgccggcctggcgattggtcacgcatactgggaagcacaggttggcaacagctcgtggtacctgtatgatggcgaggacgacactccgtcatataggggtttcctgatcttttgggggtacataattgttctgaacacaatggtcccgatctcactgtacgtaagcgttgaggttatcaggctgggccagagccactttatcaactgggatctgcagatgtactatgccgagaaggacaccccagcaaaggcccggactacaaccctcaatgaacagctgggccagattcactacattttttccgacaaaaccggtaccctcacccaaaacattatgacattcaaaaaatgctgcattaatggtcagatctatggtgaccaccgtgacgcctctcagcataatcataataagattgaacaggtagacttctcttggaacacctacgcggatggtaagctcgccttttatgatcactacctgatcgagcagatccaaagcggaaaggaacctgaagtccgacagttcttttttttgctggctgtttgccatacggtgatggtggaccgcacggacggtcagcttaactaccaagcagcgagcccggatgagggtgctctggtcaatgctgcgaggaattttgggtttgccttcctggcccgtactcagaacacgatcaccattagcgaactgggtaccgaacgtacctacaacgtcctggcgatcctcgacttcaattcagatcgtaaacgtatgtctattattgtccgcacccctgagggcaacatcaaactgtattgtaagggtgcagacacggtcatctacgagcgcctgcaccgcatgaaccctaccaagcaagaaacgcaggacgctctggacattttcgcaaacgaaactctgaggaccctgtgcctatgttataaagaaattgaggagaaggaattcaccgaatggaacaaaaaatttatggctgctagcgtggcaagcaccaatcgggatgaggcgcttgacaaggtttatgaagaaatcgaaaaggacctgatcctgctgggtgcaaccgccatagaggataagctgcaggacggtgtgccggagacgattagtaaactggccaaagcggatattaaaatctgggttctcaccggggataaaaaggaaaccgctgagaacatcggcttcgcctgcgagttgctgacggaggacaccactatttgctatggtgaagacatcaatagcctgctgcatgcgaggatggagaatcagcggaatcgcggtggcgtgtacgccaagttcgctccaccagtccaggagtccttctttccaccgggggggaaccgagcgttgattatcaccggcagctggctgaacgagatcctcctggaaaaaaaaacgaagcgtaacaaaatcctgaaactgaagtttccacgcaccgaggaggaaaggcgcatgcgcacacagtccaagcgtaggttggaggctaagaaagaacaacgccagaagaactttgttgatctggcttgtgagtgcagcgcagttatttgctgtagggtcacgcctaagcaaaaggccatggttgtggacctggtaaagcgctataaaaaagcaattaccctggccatcggtgacggcgcaaacgatgtcaacatgattaaaacggcacatatcggcgttggcatttcagggcaggaaggaatgcaagcggtcatgtccagcgattactcttttgcacaatttcgctacttacagaggctactgcttgtgcatgggcgctggagctacatccgcatgtgtaagttcctgcggtattttttttacaaaaactttgctttcactctggtccacttttggtactcattctttaatggttatagcgcgcagacagcatacgaggattggttcattaccctctataacgtcctgtacacatctctgccagtgctgctgatgggcctgctggatcaggacgttagcgacaaactgtcgcttcgcttcccgggactgtatatcgtcggtcaaagagatctgctgttcaactataagcgcttttttgtgtccctattgcacggtgtgctgactagcatgatcctgtttttcatcccgctcggggcatacctgcagacagtggggcaggatggtgaggccccgtctgactaccagtcgtttgcagtcaccattgctagtgcccttgtgatcacggttaatttccaaatcggtttggacaccagctactggacatttgttaacgctttcagcatctttggaagcatcgccctctacttcggcattatgtttgattttcacagtgcgggcatccatgttctgttcccgagtgcctttcaatttactgggaccgcgtctaacgcgttacgccaaccatacatttggcttacaattatcctggcggttgctgtctgcttgctgccggtggtggctatacggttcttgtccatgactatatggcctagcgagagcgacaaaatccagaaacataggaaacggctgaaagcagaggaacagtggcagcgccgccagcaggtgttcagacgcggtgttagtacgcgccggagcgcatacgccttttctcaccagcgcggttatgcggatctgatcagcagcgggcgcagcattcgcaagaaacgatccccactggatgcgatcgtggccgacggaacggccgagtacagaagaacgggagatagc

SEQ ID NO: 7265 - DNA, 3753 bp, Artificial Sequence
  Description of Artificial Sequence: Synthetic coding sequence
atgagcaccgagcgggacagcgagaccacattcgacgaggacagccagcctaatgacgaggtggtcccatactccgacgatgaaacagaagacgagctggacgaccagggctccgccgtggagccagagcaaaatcgtgttaaccgcgaagccgaagaaaatagagaaccgtttaggaaggagtgcacatggcaggtaaaggccaacgatcgaaagtaccacgagcagccacatttcatgaacaccaagttcctgtgcatcaaggagtccaaatatgccaataacgcaatcaagacctataaatataatgctttcacatttatcccgatgaacctctttgagcagtttaagcgagcggccaatttgtactttctggctctgctgattcttcaggcagtaccgcagatttcaaccttggcctggtataccacactcgttccattgctggtggtactaggcgtgacagctattaaagacttggtcgatgacgtggcgaggcataaaatggacaaggaaatcaacaaccgtacctgcgaggtgattaaagacggtcggtttaaggtggccaaatggaaggaaatccaggtgggagatgttatccgcctgaagaaaaatgattttgtccctgccgatatactgcttctgtcttcaagcgagcccaacagcttgtgctacgttgaaaccgctgagcttgatggagaaactaacctgaagttcaagatgagtctggagattaccgaccagtacctccagcgcgaggatactctggcaaccttcgatggctttatagagtgtgaggagcccaataaccgcctggataagttcacgggaactctgttctggcgaaatactagctttccactggacgctgataagatactgctcagaggctgcgtgatcaggaacactgatttctgtcatgggctggttatatttgctggtgctgacaccaagatcatgaagaattcagggaagacgcgatttaaacgcaccaaaattgactatctaatgaactacatggtctatacgatttttgtagttctgatactcctttcggccgggctcgcaataggacacgcatattgggaagcccaagttgggaattctagctggtatctctatgatggcgaggacgacaccccctcttaccggggatttttaatcttttggggttatattatagtcttgaatacaatggttcctatctctctgtatgtgtcggtggaggttattaggcttgggcagagtcacttcatcaactgggatctccaaatgtattacgctgaaaaagatactcccgcaaaagccagaaccaccacgctgaatgagcagctgggtcagatacactatatctttagtgataagaccggtacattaacccagaatatcatgacatttaagaagtgctgtatcaatggacagatctatggtgaccatagagacgcgtcgcaacacaaccataacaaaattgagcaagttgactttagctggaatacctatgctgatggaaagttggcgttttatgatcactacttaatagaacagattcagtctgggaaggagccggaagttcgtcagttctttttcctgttggctgtatgtcatacagtgatggtggatagaacagacgggcagctcaattaccaagcagcttcacccgatgagggtgcgctcgtgaatgccgcccggaactttggtttcgccttcctggcccgcacacagaacacaattactattagtgaactggggacagagcgaacatataatgtgttggccattctcgactttaatagcgaccgaaaaaggatgagcatcatcgtgaggactccggaggggaatatcaaactgtactgcaaaggagccgataccgtgatatatgaacgccttcataggatgaatccgactaagcaggagactcaagatgctctggatatatttgcaaacgaaaccctacgaaccttatgcttgtgttataaggagattgaggaaaaagagttcaccgagtggaacaagaagttcatggctgcttctgttgcatcaactaatagagatgaagccctggacaaagtatacgaggagatcgagaaagatctgattctgctgggggccacagcaatagaggacaagctacaggacggcgtgcccgagaccatctccaagcttgctaaggctgatatcaaaatctgggtgcttacaggggacaagaaagagacagcggagaatatcgggtttgcctgcgagctgctgacagaggacactactatttgctacggggaagatatcaacagtttgttgcatgctcggatggaaaatcagaggaatcggggcggggtatatgcaaagttcgcacctccagtacaagagagcttcttccccccgggaggcaaccgagctctgatcatcaccgggtcttggttgaacgaaattctcctagagaaaaaaacaaagcggaataagatactaaaacttaagttccccagaaccgaagaagagcgcaggatgcgaactcagtcgaagaggaggttagaggcaaagaaggaacagcgccaaaagaattttgtcgatctggcctgtgaatgttctgccgtaatctgctgtagagtaaccccgaagcaaaaagcgatggtcgtggacctggtaaaacgctataagaaagccatcaccctggcaatcggcgacggagctaacgatgtgaacatgattaaaacagcccacatcggcgtcggtatttccggccaagaaggaatgcaggccgtgatgtcttcggattactcatttgcgcaattccgttaccttcagaggcttttgcttgtgcatggacggtggtcctatatccggatgtgcaagttcctgcgctactttttctacaagaacttcgcatttacactcgtgcacttttggtactctttttttaatgggtacagcgcgcagactgcgtacgaggactggtttataacactgtacaatgttctctacaccagcttgccagtgttgctcatggggctgttggaccaggatgtctccgacaaactgtctctccgctttccaggcctctacattgttggccagcgcgacctgttgtttaactacaaacgctttttcgtgtccttgttacacggggtactgacctccatgattttgtttttcatcccactcggagcatacctccagacagtcgggcaagacggcgaggctcccagcgattaccagagcttcgcagtgaccatcgcctccgctctggtgattacggtcaactttcaaattgggctcgacactagctactggacctttgtcaacgccttcagtatctttggcagcatcgcactctactttggcattatgttcgactttcactccgccgggattcacgttctgtttccctcggcattccagttcaccggcacagctagcaacgctcttagacaaccctacatctggctcaccatcatcctcgcagtagccgtttgtctgctacctgtagttgctattcggtttctgagtatgacaatttggccttcagagtccgacaaaattcagaaacatcgcaagcggctaaaagccgaggaacagtggcaacggcggcagcaggtgtttcggaggggagtcagcactcggcgctcagcttatgcctttagtcaccagagaggatatgccgaccttataagctccggcagaagtattagaaagaaacggagtcccttggatgctatcgttgccgacgggaccgccgaatacaggagaaccggggattcc

SEQ ID NO: 7266 - DNA, 3753 bp, Artificial Sequence
  Description of Artificial Sequence: Synthetic coding sequence
atgagcacagaacgcgatagtgagacaacctttgatgaggatagccagcccaacgatgaggtggtcccttactcggatgatgagacagaggacgaactggacgaccagggaagtgccgttgagccagagcagaaccgcgttaatagagaggcggaagagaatcgcgagcctttccggaaggaatgtacttggcaggtgaaggccaatgacaggaaataccacgagcagcctcattttatgaatacaaagttcctgtgcattaaagaaagcaagtacgccaacaacgctattaagacctacaaatacaacgctttcacctttataccaatgaacctgttcgaacagtttaaaagggccgccaatctgtactttttagccttgctgattttacaagccgtacctcagatctcaaccttggcttggtacaccaccctggtccctcttctggtggtgcttggggtgactgcaatcaaagatctcgtcgatgatgtggcaaggcacaagatggacaaagaaatcaacaaccgcacttgcgaggttatcaaagatggtagatttaaggtcgcaaagtggaaggagattcaggttggggatgtaattagactgaagaagaacgatttcgtgcccgccgacattctgttgctgtccagcagtgagccgaactccctttgttacgtcgaaactgctgagttggatggagagaccaatctcaagttcaaaatgagcctcgagattaccgatcagtacctgcagagggaggatactttggctaccttcgatgggttcatagaatgcgaagagccaaataacaggttggataagtttactggcacactgttctggaggaacacttcgttcccacttgacgcggataaaatacttcttcgtggatgtgtgataaggaacacagatttttgccacggactggtaatatttgcaggagcggacacgaaaatcatgaaaaacagcggcaagactagattcaaaaggaccaagatcgattacttgatgaattatatggtttataccattttcgtggtgctaatactgcttagtgcaggtctggccatcgggcacgcatactgggaagctcaggtcggtaacagcagttggtacctgtacgatggggaggatgacacaccatcttaccgcggattcctcatcttctgggggtacatcattgtactgaacaccatggttccaattagcctgtatgtgtccgtggaggttatccggctcgggcagtcacatttcattaactgggacctgcagatgtactatgccgagaaagatacccctgccaaagcacgcaccaccactctcaacgagcagctggggcaaatccattatatcttttccgataaaactggcaccctcacacaaaacattatgacctttaaaaagtgttgcatcaacggccagatctatggagaccatagagatgcaagtcagcataatcacaataaaattgaacaggttgactttagttggaatacatatgctgatggtaagttggcattttatgaccattatctgatagaacagatccagtccggcaaagaacctgaagtccgccagtttttctttctgctggcagtgtgtcataccgtgatggtcgaccgcactgatggacaactgaactatcaggctgctagccctgacgaaggtgcacttgtgaatgcggcaaggaatttcggctttgctttcctggcaagaacacagaacactattactatatctgagctgggcaccgaacggacgtacaatgtgctggccattcttgacttcaacagcgataggaaaaggatgtctatcattgttaggactccagagggaaacatcaagctgtactgcaagggcgccgacactgtgatttacgagcgacttcaccgtatgaaccctaccaagcaggaaactcaggatgccttggatatctttgcaaacgagacgctgagaacactgtgcctttgctacaaagaaatcgaggaaaaagagttcaccgaatggaacaagaaattcatggctgcctctgtcgcgagcactaaccgagatgaagcgctggataaagtctacgaagaaatagagaaggatttgatcttactgggtgccacagcaatagaagacaagttgcaggatggagtccccgaaactattagtaagctcgctaaagcggatattaagatctgggtccttaccggagacaagaaagagaccgctgagaacatcgggtttgcttgcgagctccttaccgaggatactactatttgctatggcgaagatattaattctctgctgcatgctagaatggaaaatcaacggaacagaggtggagtttatgctaaattcgcaccccctgtacaggagtcatttttccccccaggaggcaatagagctttaataataaccggatcatggctgaatgagatcctgcttgaaaaaaaaaccaagcggaacaaaatcttaaaactgaagtttccccgaaccgaggaggaaagaaggatgaggactcagtccaaaaggaggttggaagcaaagaaagaacaacggcagaaaaattttgtggacctggcctgcgaatgtagtgccgtgatttgttgtagagtcacacctaagcagaaagctatggtggttgacctcgtgaagaggtataagaaggcaatcacacttgccataggagatggagctaacgatgtgaatatgattaaaaccgcacacattggcgtcggcattagtggccaggagggaatgcaggccgtcatgtccagcgattattcattcgcacagttcagatatttacagaggctccttctcgtccatggcagatggagctacatccgtatgtgcaagttcctcagatatttcttctacaaaaatttcgccttcaccctcgtgcacttctggtactcttttttcaatgggtatagtgcccaaaccgcctatgaggattggtttatcacactgtacaatgtgctgtacacaagccttcccgtgttgttgatgggccttctggatcaggatgtgagtgacaagctgagcctacggtttccaggcctctatatcgtcggacagagagatctcctgtttaactacaagaggttctttgtctcccttctccacggtgtgttgaccagcatgatattgttctttattccactgggcgcatatttgcaaacagtaggacaggacggcgaggctccttccgactaccagtcttttgcggtgactatagccagcgccctcgtaatcacagtcaacttccagataggccttgatacctcttactggacctttgtcaacgctttcagcatcttcggaagcattgcactgtattttggaatcatgtttgatttccacagcgccgggatccatgttctgtttccctcggcgttccagtttacaggcactgccagcaacgccctgcgccagccgtatatttggcttactattatcctggccgtggccgtgtgcctcttgcctgttgttgcaattcgtttcctcagcatgaccatctggccctccgaatccgataagatccaaaagcaccgcaaacgccttaaggctgaagagcagtggcagcgcaggcaacaggtttttcgcagaggcgtctctacaaggaggagtgcctatgccttttctcaccagcggggctacgcggaccttataagcagcggaaggtctatcagaaaaaaaaggagcccgctggacgcaatcgtagcagatggtaccgctgagtataggcgcaccggggatagc

SEQ ID NO: 7267 - DNA, 3753 bp, Artificial Sequence
  Description of Artificial Sequence: Synthetic coding sequence
atgtctaccgagagggatagcgagacaacatttgatgaggacagccaacctaacgacgaagtagtgccatatagtgatgatgaaacggaagacgagttggacgatcagggcagtgcggtcgaacctgaacagaatagggtgaatagagaagccgaggagaatcgggaacccttccgcaaagaatgcacctggcaggtcaaggcaaacgatcggaagtaccatgaacagccgcatttcatgaatacgaaatttctatgcataaaggagtccaaatacgcaaacaacgccattaagacttataaatataacgcattcacctttatccccatgaacttattcgaacaattcaaacgagccgcgaatctttatttcctcgcactgctaattttacaagctgttccacaaatttcgaccctggcttggtacactacgctcgtccctctgttagttgtgctgggggtgacggcgattaaggatctcgttgatgacgtggctaggcacaaaatggataaggaaataaacaaccggacttgcgaggtcattaaggatggcagattcaaggttgcaaagtggaaggagatccaagtgggggacgtcattcgccttaagaaaaatgatttcgtaccagctgacattctgttgctctcttcctcggagcctaatagtctttgttacgtggaaactgctgagctggacggcgaaactaatcttaagttcaagatgtcacttgagatcaccgaccagtatctgcaacgggaagacaccctggctacattcgatggttttatcgaatgcgaagagccaaacaacagacttgataagtttactgggactctgttttggaggaacacatcattcccgttagacgccgataagattctgttaaggggatgtgttatacggaatactgatttttgtcacggccttgtcatattcgctggcgcagacaccaaaatcatgaaaaattcggggaaaacccgattcaagcgaacaaaaattgactatttgatgaactacatggtgtacactatcttcgtggtgttgatcctcctgagcgcgggcttagcaattgggcatgcttattgggaggctcaggtcgggaattcttcttggtatttgtacgatggtgaagatgatacaccaagttaccggggcttcctgattttctggggctacattatagtattaaataccatggtgcctatatccctgtacgtgtcagtggaggtcatccgcctcggccagtcacactttatcaactgggatctgcagatgtactacgctgagaaagacacaccagccaaggctcgcacgaccaccttgaatgagcagctgggccaaatccattacatattctccgacaagacaggcacgctcacccagaatattatgacatttaagaagtgttgcatcaacggacaaatatatggtgatcaccgggacgcctcccaacataatcataacaaaatagaacaggtggatttttcatggaatacttacgcagatgggaaattagcgttctacgaccactacctcatcgagcagatacaaagcggaaaggagcctgaggtccgccagttcttcttcctcttagcggtttgtcacacagtgatggtggataggaccgacgggcaacttaactatcaggctgctagcccagatgaaggcgctctggtcaatgccgcccgaaacttcggcttcgcctttctcgcaagaacccagaatacaattaccatatccgagctgggaacagagagaacttacaacgtgctcgcaatcctggacttcaacagcgacagaaagcggatgtccatcatcgtgcggacgcccgagggaaatatcaagctgtattgcaaaggagccgatacggtcatctacgagcggctacaccgtatgaacccaacaaagcaggagacacaggacgcgctcgatatcttcgctaacgagacgctgcgcactctgtgcttgtgttacaaagagattgaagaaaaggaattcactgagtggaataaaaaattcatggccgcttctgtggcctcaactaatagagacgaggccctggataaggtgtatgaggaaatcgagaaggatctgatcttactcggagctaccgcgatagaagacaagctgcaagacggtgtccccgaaaccatttctaagctggctaaagcagacataaaaatttgggttttgacaggcgataaaaaggagacagcggaaaacattggttttgcttgtgagctgctgaccgaggacaccaccatatgttacggagaggacatcaattcactcttgcacgcacggatggagaatcaacgcaaccgcggaggggtctacgccaaatttgcccctccagtgcaggagagttttttccccccaggtgggaatcgagctctgatcattacaggcagttggctgaatgagatcctgttagagaaaaaaaccaagcgtaataaaatcctgaagctgaagttcccaagaacagaggaggagcgtcggatgcggacacagtccaaaaggagactagaggcaaaaaaggagcagcggcagaaaaattttgtggatctcgcatgcgagtgttccgcggtcatttgctgtagagtgacaccaaagcaaaaggctatggtggttgatttggtcaagcgttacaagaaagccatcacgctggcaattggggacggcgcaaatgatgttaacatgattaagaccgcgcatatcggcgttggaatctccgggcaggagggcatgcaggccgtgatgagctccgattattcatttgcccagttcaggtatctgcagcgcctcctcctagtgcatggtcggtggtcctacatccggatgtgcaagttcctgaggtactttttctacaagaacttcgcctttaccctagtccacttttggtattctttttttaacgggtacagcgctcagacagcttacgaggattggttcatcaccctgtacaacgtgttgtacacgagtttgcccgtgctgttgatggggttgttggaccaggacgtgtcagacaagctgtctcttcgtttccctggtctctacatcgtgggacagagagacttgttattcaattacaagcggtttttcgtgtctctactccatggagtgttaacctccatgatcctattttttattccgctaggggcttatcttcagaccgttgggcaagacggggaggctccaagcgactaccagtcatttgccgtaactatcgcatccgctcttgtgattaccgtgaactttcaaattgggctggatacatcctactggacgtttgtgaatgcgttcagtatcttcggcagcatcgctctctattttgggattatgtttgattttcactccgctggtatccatgtgctgttccctagcgcttttcaatttactggcacggcctctaacgccctgagacagccttacatctggttgactataatccttgccgtggctgtgtgcctcctgcctgtcgtcgctattcgattcctgagtatgactatctggccctcagagtctgataagattcaaaagcaccgaaagcgattaaaggctgaggagcaatggcagcggcggcaacaggtgtttaggaggggcgtgagcaccagacggtcagcctacgcattctcacaccagcgtggctacgctgatctgatcagttctgggcggtctattcgaaaaaagcggtctccactcgacgcaatcgtggctgacggaactgccgagtatcgcagaaccggggacagc

SEQ ID NO: 7268 - DNA, 3753 bp, Artificial Sequence
  Description of Artificial Sequence: Synthetic coding sequence
atgagcaccgaaagggacagcgaaaccaccttcgacgaggactcgcagcccaacgacgaggtcgtcccgtactccgatgacgaaaccgaggacgagctggacgatcagggcagcgcggtggagcctgaacaaaatcgcgtcaacagagaggctgaagagaatcgggaaccttttcgcaaggaatgtacctggcaggtgaaagccaatgatcgaaagtaccatgagcagccacatttcatgaacactaagtttctttgcatcaaagaatcgaagtacgctaataacgcaatcaagacctacaagtataacgctttcacctttattccaatgaacctgttcgaacaattcaagcgcgccgcaaacctttacttcctcgcgctcctgatccttcaggccgttccacagatcagcaccttggcatggtacactaccctcgtgccgctcctggtcgtgctgggagtcaccgccatcaaggacctggtcgacgacgtggcgcgccataagatggacaaagagatcaacaacaggacttgcgaagtcatcaaggacggacgctttaaggtggcgaagtggaaggaaattcaagtgggagatgtcatcagacttaagaagaatgattttgtgccagcggatatcctgctcctctcctcaagcgagccgaattccctgtgctacgtggagactgcagagctcgatggagagacgaacctgaagttcaagatgtcacttgaaatcaccgaccagtacctgcaacgcgaagatactctggcgacgttcgacggttttatcgaatgtgaagaaccgaataaccggctcgataagtttactggaacgctcttttggcgcaacacgagcttcccactggatgccgacaagatcctcttgagaggatgcgtgatcagaaacaccgacttttgtcacgggctggtgatcttcgctggagcggacaccaaaatcatgaagaattcgggaaagacccgtttcaagcggaccaaaatcgactatctgatgaactacatggtatacactattttcgtcgttctgatcctcctgtcggccggtctggccattggccacgcctactgggaggcccaggtggggaactcgtcctggtacctttacgatggagaggatgacaccccatcgtaccgaggattcctgatcttctggggctacatcatcgtcctgaataccatggtcccgatctccctttatgtgtcagtggaagtgatccggcttgggcagtcgcacttcatcaactgggacttgcaaatgtactatgccgaaaaagatacgccggccaaggcgcgcacgaccacgctcaacgagcaactcggacaaatccactacatctttagcgacaaaactggaactctgacccaaaacatcatgactttcaagaagtgctgcatcaacggacagatctacggagatcacagagacgcatcccagcacaaccacaataagatcgagcaggtagacttcagctggaacacgtacgcggacggcaaattggctttctacgatcactacctcatcgaacagatccagtcgggcaaggaacctgaagtgcgccagttcttctttttgctggccgtctgccacactgtgatggtggatcgcaccgatgggcaactgaattaccaggccgcaagccctgacgaaggtgcactggtgaacgcagcgcggaacttcggattcgcctttctggcgaggactcaaaacactatcactatcagcgagttgggcaccgagcgaacctataatgtgttggcaatcctggactttaactcggacaggaagcggatgtcaatcatcgtgagaactccagagggcaatatcaagctctactgcaagggagcggataccgtgatctacgaacgtctccataggatgaacccgaccaagcaggagacgcaagatgccctggacatctttgcgaacgagactcttcggacgctgtgcctctgttacaaggagatcgaagaaaaggaattcaccgaatggaacaaaaagtttatggcggcctctgtcgcgtcgactaatcgcgatgaagcgctggataaggtgtacgaggaaatcgaaaaggacctgatccttctgggcgcgacggccatcgaggacaagttgcaggacggcgtcccagaaaccatcagcaagctcgccaaggcagacatcaagatctgggttctcaccggcgacaaaaaagagactgccgaaaacatcggtttcgcctgtgaactgctgaccgaggacaccaccatctgctatggagaggatatcaactcgctgctgcacgcgagaatggagaatcaacgcaaccggggcggagtgtacgcaaagttcgctccgccagtgcaggaatcattcttcccgccggggggtaacagagcgctgataatcaccgggagttggctgaacgaaatcctcctggaaaagaaaacgaaaagaaacaaaatcctcaaactgaagtttccgcgcaccgaagaggagcgccgcatgcggacgcagtcgaaaagacggctcgaagccaaaaaggagcaacgccaaaagaactttgtcgatctcgcatgtgagtgttccgcggtgatttgctgcagagtgaccccaaagcagaaagcgatggtggtcgacctggtgaagcgctacaagaaggcgattacgctcgctatcggagatggggccaacgacgtcaatatgattaagaccgcccatatcggagtcgggatctcaggacaggagggaatgcaggctgtgatgagctcggactactcgttcgcccagttcaggtatttgcagcggctgctgctggttcatggccgctggagctacatccgcatgtgcaagttcctgcggtacttcttctacaaaaactttgccttcaccctggtccatttctggtactccttcttcaacggatacagcgctcaaaccgcatacgaggactggttcattacgctctacaatgtgttgtacacctcactgcccgtgctgctgatgggcctgctcgatcaagacgtcagcgacaagctctccctgcggttccccggcctgtatatcgttggtcaacgcgacctcctgtttaactataagagattctttgtgtcacttctgcatggggtgctgactagcatgatcctcttctttatccccctcggtgcctacctgcaaactgtgggccaagatggcgaagcaccgagcgattaccagagcttcgccgtcaccatcgcgtccgcgttggtcatcaccgtcaacttccaaatcggactggacacgtcgtactggactttcgtcaacgctttcagcattttcggatcaattgcactgtacttcggaatcatgttcgattttcactcggcgggcatccacgtgctgttcccatcggccttccagttcaccgggacggcctcgaacgcgctgagacagccgtacatttggctcacgatcatcctggccgtcgctgtctgtctgctcccggtggtggcaatccggtttctgtcgatgactatctggccgtcagaatccgataagattcagaaacacaggaagcgcctgaaggcggaagagcagtggcaacggaggcagcaagtgttcagacggggggtgtccactcgtcggtccgcatacgctttctcccaccaacggggatatgccgacctcatctcgtcagggagaagcatccgcaagaagcggtcccctctcgatgcgatcgtggcggacggcactgcagaatacaggcggaccggagattcc

SEQ ID NO: 7269 - DNA, 3753 bp, Artificial Sequence
  Description of Artificial Sequence: Synthetic coding sequence
atgtcaaccgagcgggactcggaaaccacctttgacgaggactcccagcctaacgacgaggtggtgccatacagcgatgacgaaaccgaggatgagctcgacgatcaaggttcggccgtcgagccagaacagaatcgcgttaaccgcgaagcagaagaaaaccgggaacctttcagaaaggaatgcacctggcaggtgaaggccaacgatcgcaagtaccacgagcagccacatttcatgaataccaaatttctgtgcatcaaagagagcaagtatgcgaacaacgctatcaaaacctacaagtacaacgcgttcaccttcattccaatgaacctgtttgagcaattcaagagagctgcaaatctgtacttcctggcactgctgatcttgcaggctgttccacagatctcaaccctggcgtggtacaccacgctggtgccgcttcttgtggtcctgggagtgaccgccattaaggacctggtcgacgatgtggcgcggcacaaaatggacaaggagatcaacaatcgcacctgcgaagtgatcaaggacggccgcttcaaagtggctaaatggaaggaaatccaggtgggcgacgtgatcagactgaagaagaatgatttcgtgccggccgatatcctgctgctctcgtcgtccgaaccaaattccctgtgctacgtcgaaactgctgaactggacggagaaacgaatttgaagttcaagatgtcacttgaaatcaccgaccagtacctgcagagggaagatactcttgcgacctttgatggttttatcgagtgtgaggaaccgaataacagactcgacaagttcaccggaacgctcttctggcgaaacacttcctttccgctggatgcagacaagatccttctccgcggttgcgtgattagaaacactgacttttgccatggcctggtgatcttcgctggcgccgatactaaaatcatgaagaactcgggcaagaccagattcaagcgtactaagatcgactatctgatgaactacatggtgtacactatcttcgtggtcctgattctcctgtcagcaggactggcaatcggacacgcctattgggaagcccaagttggaaattcctcatggtatttgtacgacggggaggatgacaccccatcgtacaggggatttttgatcttctggggttatatcatcgtgctgaacactatggtgcctatctctctgtacgtgtctgtcgaagtgataagactcggccagtctcacttcatcaactgggacctccagatgtactacgccgaaaaagacacccctgccaaggcgcggacgaccaccctgaatgaacagctcggacagatccactacatcttctcggataagacgggtactctgacccagaacataatgactttcaagaagtgctgtatcaacggacagatatacggggatcacagagacgcgtcgcagcacaaccataacaaaatcgaacaggtcgacttctcatggaatacgtacgcggatggcaagctggcgttctacgaccattacctcatcgaacaaatccaatcgggaaaggaacctgaagtgcgacagttcttcttcctgctcgcagtgtgccataccgtcatggtcgacaggaccgatggtcaactgaattaccaggcggccagccccgacgaaggcgcgctggtcaacgcagccagaaactttggattcgccttccttgctcgaacccagaacaccatcaccatctccgaactggggacggaaagaacttacaatgtcctggccatcctggacttcaacagcgatcggaagaggatgagcatcatcgtgcggaccccggaaggaaacatcaagctctactgcaagggcgccgacaccgtgatctacgaacggctccatcgcatgaacccgactaagcaggaaacccaggacgccctggacatcttcgcgaacgaaacccttcggactctctgtttgtgctacaaggaaatcgaggaaaaggagttcaccgagtggaacaaaaagttcatggctgcgtccgtggccagcaccaacagagatgaagccttggataaggtgtacgaagaaatcgagaaggacctgatcctgctgggagctactgccatcgaggacaagctgcaggacggagtcccagaaacgatctccaaactcgccaaagccgatatcaagatctgggtgttgactggggacaaaaaggaaaccgctgagaatatcgggtttgcatgtgaactgctgactgaggacactactatctgttacggagaggacataaactcactgcttcacgcacgaatggagaaccagagaaatcggggaggagtctatgccaaatttgcgccgcctgtgcaggagtcattcttcccgccaggcggtaaccgggccctcatcattaccggaagctggctgaacgaaatcctgcttgaaaagaaaaccaagcgcaataagatcctgaaactgaaattccctcggactgaggaagagcggcgcatgcgtactcagtcaaagcggagactggaggctaagaaagaacaaagacagaaaaacttcgtagatctggcatgtgagtgcagcgcagtgatttgttgccgggtgacccctaagcagaaggcgatggttgtggacctggtgaaaaggtacaagaaagctatcaccctcgccatcggcgatggagcgaacgacgtgaacatgatcaaaaccgcccacatcggggtgggaatctcagggcaagagggaatgcaggctgtcatgagctctgactactccttcgcacagttccgctacctccagcggctcctgctcgttcacggacgctggtcgtacatccgcatgtgcaagtttttgcggtactttttctacaagaatttcgccttcacccttgttcacttttggtacagcttcttcaacggctactccgctcagaccgcctacgaggactggttcatcactttgtataatgtcctgtacacttcactgccggtgctgctgatgggactcctggaccaggatgtgtccgacaagctgtcgctgagattcccgggactgtacatcgtgggacaacgcgacttgctcttcaattacaagagattctttgtctccctcctgcatggagtgctgacctcgatgatcctgtttttcatccctctcggagcttacctgcagaccgtgggccaggacggtgaagccccctccgactatcagtcattcgcagtgactatcgcgtcggccctcgtgatcaccgtgaactttcagatcggcctcgacaccagctactggacgtttgtgaacgcattcagcatcttcggatcgatcgccctgtactttggtatcatgttcgatttccactcagctgggatccatgtgctcttcccgtccgcgttccaatttacgggaactgcgtcgaacgccctgagacaaccttacatttggcttactatcattctcgccgtcgctgtttgcctgctcccggtggtcgctatcaggtttctctcaatgaccatctggccgagcgaatccgacaagatccaaaaacaccggaagcggctcaaggcagaggaacaatggcagcggagacaacaggtgttccgccggggggtgtccactcgccggtcggcttacgccttcagccaccaacggggctacgctgacctgatctcgagcggacgcagcattcgaaagaagcggtccccgctggacgcaatcgtggccgatggaactgccgagtacaggaggaccggagactca

SEQ ID NO: 7270 - DNA, 3753 bp, Artificial Sequence
  Description of Artificial Sequence: Synthetic coding sequence
atgagcaccgagagggacagtgagactacatttgatgaagacagtcagccaaatgatgaagtcgtcccttactccgatgacgagactgaggacgaactggatgatcagggatctgccgtagaaccagagcaaaatagagtgaatcgggaagcggaggagaatcgggaaccctttcgtaaggagtgtacttggcaggtcaaggccaatgataggaaataccatgaacagccgcatttcatgaacactaaattcctgtgcatcaaagaatccaaatatgcgaacaacgccataaagacctacaaatacaacgccttcacctttatcccaatgaacctcttcgagcagtttaagcgcgcggctaacctctatttcctcgcattattgattctgcaggccgtgccccagattagcacattagcatggtacaccactctcgtacctctgctggtcgtccttggcgttacagccatcaaggatctggtcgatgatgttgccaggcataagatggataaggaaattaataacaggacttgtgaagttatcaaggatggaagatttaaagtcgcaaagtggaaggagattcaggtgggcgatgtgatccgactgaagaagaacgactttgtgcctgccgacattctgctgttgagttcgtctgagccgaactccctgtgctacgtcgaaacagccgaacttgatggtgagacgaatcttaagttcaagatgtccctcgaaataacagaccagtacttgcagagggaagacaccctcgcaactttcgatggatttattgagtgtgaagagccaaataaccggttggacaagttcacagggaccctcttctggagaaacacttctttccctcttgacgctgataagatattgctgcggggttgcgtgatcaggaataccgacttctgccacggattggtgattttcgctggagccgacactaagatcatgaagaattccgggaagacccggttcaaaaggacgaagatagactacctgatgaactacatggtttacactatattcgttgtcttgattttgttgtcagctggtcttgcgataggtcatgcttactgggaggcgcaagttggaaatagtagttggtacctgtacgacggcgaagatgataccccttcttacagggggttcctcattttctggggatatatcattgtgctcaacaccatggttcccatttcattatacgtgtccgtggaggtgattcgccttggacagagccatttcatcaactgggacctccagatgtattacgccgagaaagatacgcccgcaaaggctcggactacaaccctcaatgagcagttgggacagattcactacattttttctgataagacaggtacgttgacgcaaaatatcatgacttttaaaaaatgctgtatcaacggccaaatctatggggatcaccgcgacgctagccagcacaaccacaacaagattgagcaggtggatttctcttggaatacctatgcggatggcaagttagcattttacgatcactacctcatcgaacagatacagagcgggaaggagcccgaggtgcggcagttcttcttcctgttggccgtgtgtcacactgtgatggtggacagaactgacggccagctgaactaccaagctgcatctccagatgaaggcgccctggttaacgcagccagaaacttcgggttcgctttcctagcaagaactcagaacaccataacaatctctgaactgggaactgagcgcacttacaacgttctggctatacttgactttaatagtgatcgcaagagaatgtccatcatagtgaggacacccgaaggcaacattaaactgtactgcaaaggggccgacacagtgatatacgagcgccttcaccgcatgaacccgacaaaacaagaaacccaggacgctcttgacatattcgccaatgagacgttgcgaactctgtgtctgtgctataaggaaattgaggaaaaagagttcacggagtggaataaaaagtttatggctgctagcgtcgcttcaaccaaccgggatgaggccctggacaaggtgtacgaagagatcgaaaaggacctgatcctcctgggggcaaccgctattgaggataagctgcaggatggtgtgccagagaccatctccaagttggccaaggctgacatcaagatctgggtgctgaccggagataaaaaggaaaccgccgagaatatcggatttgcttgcgaactgttgacggaagacaccacgatctgctatggggaggatatcaattccctgctgcacgccaggatggaaaatcagaggaaccgggggggcgtgtatgctaagttcgccccgcctgtgcaagaatccttcttccccccagggggtaatcgggcccttattattaccggctcctggctgaatgagattctcttggagaagaagacgaagagaaacaaaatcctcaagttgaagtttccccggacggaggaggaacgacgcatgaggactcagagcaagagacgactagaggccaagaaggagcaaaggcagaagaacttcgtcgacctggcctgcgagtgctccgccgtgatttgttgcagagtgacccctaaacagaaagctatggtggtcgacttggtgaagaggtacaaaaaggcgataacattagccatcggtgacggcgccaatgatgtgaacatgattaagacggctcacatcggcgtcgggatcagtgggcaggagggcatgcaggcggtcatgtcttccgattacagtttcgcacagttcaggtacctgcaaagattgttactggttcatggcaggtggtcatacatccggatgtgcaaatttctccgttacttcttctacaagaactttgcctttaccctggtccacttctggtattcatttttcaacggatacagtgcgcagaccgcttacgaggactggttcataaccttgtacaatgtcctatatacgagccttcccgtcctgttaatgggactcctcgatcaggacgtgagcgacaagctcagcctgaggttccccggcctgtacattgtcggacagagggacctgctcttcaattacaagcggtttttcgtgagtctgttgcacggcgttctaacctcaatgattctgttctttatccccctgggtgcatatttacagactgtgggccaggacggggaagcacctagcgactaccaatcattcgctgtgacgatcgccagcgccctggttatcactgtgaactttcagatcggcctcgacacatcctactggacctttgtcaacgctttctctatcttcggctctatcgccttgtacttcgggatcatgttcgactttcactcagccggtatacacgtactgttccctagtgcattccagttcaccggcaccgctagtaacgctctgagacaaccctatatatggctcactatcatcctcgcagtagcggtatgcttgttaccagttgtagcgatacggttcctctccatgactatctggccttctgagagtgataaaatccagaaacatcggaagcgattgaaggcggaagaacagtggcagagaaggcagcaagtgtttcgcaggggtgtgagtactcgaagaagcgcctacgctttctcacatcagagaggctatgccgatttgatatcctcagggaggagcattaggaagaagagatctcccctcgacgcgatcgttgctgatggcacagccgagtatcgacggaccggcgattcg

SEQ ID NO: 7271 - DNA, 3753 bp, Artificial Sequence
  Description of Artificial Sequence: Synthetic coding sequence
atgtcgaccgagcgcgattccgagacgacctttgacgaagattcgcagcccaatgatgaagtcgtgccctacagtgacgacgagactgaagatgagctggatgatcagggttccgccgttgagcccgagcagaaccgggtcaatcgtgaggctgaagaaaaccgcgagcccttccgcaaagagtgcacctggcaagtgaaggcaaacgacaggaagtaccacgaacagccgcatttcatgaacaccaagttcctgtgtattaaagaaagcaagtatgccaacaatgcaatcaaaacttataagtataacgcctttacctttattcctatgaacctcttcgaacagttcaagcgtgcagctaacctgtacttcttggctctattaatcctccaagccgtcccccaaatctccactctcgcatggtacactacgcttgtccccctgcttgtcgtgcttggtgtcaccgctattaaagaccttgtggacgatgtcgcgcgccacaaaatggacaaagagatcaacaaccgtacatgtgaagttattaaggatggccgcttcaaggtcgctaagtggaaagagatccaggtcggtgatgtgatccgcctgaagaagaatgacttcgttccggctgacattcttctgctatcctcctctgagcctaatagtctgtgttacgtggagactgccgaattggacggtgagactaacttgaagttcaagatgtctctggagatcaccgaccagtatttgcaacgtgaggacaccctggccaccttcgatggattcatcgagtgcgaggaaccaaataaccgcttagacaaatttaccggaactcttttctggaggaacacatccttccccctagacgccgacaagatcttgctgcgcggctgtgtcatccggaacaccgatttctgccatggcctggttatcttcgccggggccgatacgaagatcatgaagaacagcggcaagaccaggttcaagcgcactaagatcgattacctcatgaattacatggtatacaccatcttcgttgtactcattttgttgagcgccggattggccatcggccatgcctactgggaagcccaggtcggaaacagttcctggtacctctacgacggtgaggatgatactccatcgtaccgtggtttcctgatcttctgggggtacatcattgtcctgaacacaatggtgccaatcagcctatacgtctcagtggaggtgatccgtctgggtcagagccatttcattaattgggacctacaaatgtactacgcggagaaggatacccctgctaaggcaagaaccaccacattgaacgaacagttgggacagattcactatatcttctcggacaagaccggcacactgactcaaaacatcatgactttcaagaagtgctgcatcaatggccagatttatggtgaccaccgcgacgcgtcgcaacacaaccacaacaagatcgaacaagttgatttctcctggaacacctatgcggatggcaagttggccttttacgaccactacctgatcgagcagatccagtcggggaaagaacccgaggtgcgccagtttttcttcctgctggctgtctgtcacacggttatggtggaccggacagatggtcagctgaactatcaggcggcctcgcccgacgaaggtgccttggtcaatgctgctcgcaacttcgggttcgcttttttggcccgtacacagaacaccatcaccatcagtgagctaggtaccgagcgtacatacaacgtgttggctatcctggattttaactccgaccgcaaaaggatgtcgatcatcgtccgcacgccagaaggtaacatcaagctttactgcaagggcgcagacactgttatttatgagcgccttcacaggatgaacccgaccaagcaagagacacaggatgctctggacatcttcgccaacgagacacttcgtacattgtgcctctgctataaagagatcgaagagaaggaattcaccgagtggaataagaagttcatggcggcttccgtcgcctctacgaacagggatgaagccctggacaaggtctacgaggagatcgagaaggacttgattctgttgggcgccaccgctatcgaggataagctgcaggatggcgtccctgagacaatctctaagctcgccaaagccgacattaagatatgggtcttgaccggtgacaaaaaggagaccgctgagaatatcggctttgcctgtgagctgctgaccgaagatacaacaatttgctacggcgaggacatcaactccctgttgcatgcccgtatggaaaatcagcgtaaccgtggcggtgtttacgctaagtttgccccccctgtccaggagagcttttttccgcccggtggcaatcgcgccctgatcatcaccggaagctggctcaacgaaattctgctcgaaaagaagacaaagcggaataagatccttaagctaaaattcccgagaaccgaggaagagcggcgtatgcggacccagtcaaagcgccgcctagaggccaagaaggagcaaaggcagaaaaacttcgttgacctggcttgtgagtgcagtgcagtgatctgctgccgcgtcactcccaagcaaaaggcgatggtggtcgacctagttaagcgctacaagaaggccattaccctagctattggggacggtgctaacgatgtcaatatgatcaagacagcccacattggagtcgggatttcaggacaggaaggtatgcaggccgtgatgtcatccgattacagtttcgcacagtttaggtatctccagagattgttgcttgttcatggacgttggtcgtacatccgcatgtgtaagtttctgcggtacttcttctacaagaacttcgctttcactctcgtgcacttctggtactcgttcttcaacggctactcagcacagaccgcgtatgaggattggttcattacactctacaacgtgctctatactagccttccggttctccttatgggcctgctcgatcaggacgtgagtgacaagttgagcctccgcttcccaggactgtacattgtcggccagcgggatctgctgttcaattacaagcgcttcttcgtatccctcttacatggagtactcacgagcatgatccttttcttcatcccgctcggtgcgtacttacagacggtcggtcaggatggcgaagctccgtcggactaccagagctttgccgtcacaatcgcctcggctttggtcatcaccgtgaacttccagattggtcttgatacttcctattggacgttcgtcaacgcattcagcatcttcggttctattgcactctactttgggattatgttcgacttccactccgcaggtattcacgtgctctttccctcggccttccagttcaccgggactgctagcaatgccctgcgccagccatacatctggcttaccatcatcctggccgtggccgtctgtctcctgcctgtggtggccatcaggtttctgtctatgacgatctggcccagtgagtccgacaagatccagaaacatcggaagcggcttaaagccgaggaacaatggcagcggcgccagcaggtgttccggcgcggcgtgagcacccgccgcagcgcctatgccttcagtcaccagcgcggttacgcagacttgatctctagtggccgtagcatccgcaaaaaaagatcgcctctcgacgccattgtcgctgacggcacagctgaatacaggcgcactggcgattcc

SEQ ID NO: 7272 - DNA, 3753 bp, Artificial Sequence
  Description of Artificial Sequence: Synthetic coding sequence
atgtcgaccgaaagagactcagagacgacttttgatgaagattcgcaacctaacgacgaagtggtgccatacagcgatgatgaaactgaagatgaattggacgatcagggctccgcggtggagcccgagcagaacagagtaaaccgggaagccgaagagaaccgggaaccttttcggaaagaatgcacttggcaggtgaaagcaaacgatagaaagtaccatgaacagccgcactttatgaacactaagtttctttgtattaaggaatcgaagtacgccaacaacgcaatcaagacgtacaagtacaatgcttttacgtttattcccatgaatcttttcgaacagttcaagcgagccgccaacctttactttcttgcattgctgattttgcaagccgtgccccaaataagcaccctggcatggtacacgacgctggtaccgcttctggtcgtcctcggagtgaccgccattaaggatctcgtagacgatgtggcgcgccataagatggataaggagatcaataaccgaacctgtgaggtgattaaggatggtcgctttaaagtggcaaagtggaaagaaatacaagtgggcgatgtgatcaggcttaagaagaacgatttcgttcctgcggatattcttctgctgtcgtcgtccgaacccaacagcctgtgttatgtagaaaccgcggaacttgacggcgagactaatctcaaattcaagatgagtctggaaatcaccgatcagtacctgcaaagagaggatactctcgcaacgtttgacggtttcattgaatgcgaggagcctaacaatagactggacaaattcaccggtaccctgttttggcgaaacacctccttcccgttggacgcagataagattctcctgcgaggatgtgtgatacgcaacaccgatttttgtcacggattggtgatcttcgccggggcggataccaaaatcatgaagaactcgggtaagactcgttttaagcggactaagatcgactacctgatgaactacatggtttatacgatatttgtggttctcattcttttgtcggcaggacttgcaatcggacatgcatactgggaagcacaagtcgggaatagctcctggtacctttatgacggcgaagatgatactccttcctaccgcgggttcctcatcttttggggatacataatagtgcttaatactatggtgccgatatcgctctacgtcagcgtggaagtcatacgtcttggacagtcccacttcatcaactgggatctgcagatgtattatgcagagaaagataccccagcaaaggcccggacgactactcttaatgaacagctcggacaaattcattacattttctccgataagaccggtactcttactcagaacattatgactttcaaaaagtgctgtattaacggccaaatctacggggatcacagagacgcaagtcaacacaaccataacaagattgaacaagtcgattttagctggaacacttacgccgacggcaaattggctttttacgatcattaccttattgaacaaattcaatcgggaaaggaacctgaggtgcggcagtttttctttctgttggcggtctgccataccgtgatggtcgatagaactgacggccaacttaactaccaagctgcctcaccagatgagggagcattggtcaacgccgcacgcaacttcggttttgcatttctggctcgaacgcagaatacgatcaccatcagcgagcttggtactgaacgtacctacaacgtccttgccattctggacttcaattcggatagaaaaagaatgtccatcattgtgcgaacccctgaaggaaacattaaactttactgcaagggagccgataccgtcatctacgagcgtctgcatcgtatgaatccgaccaaacaagaaacccaagacgcgctcgacatttttgccaacgagactcttcggaccctgtgtctttgttacaaggaaatcgaggaaaaggagtttactgaatggaataagaaattcatggcagcttcagtggcaagcactaacagggacgaggcactggataaggtgtacgaagaaattgaaaaggatcttatactgctcggggcaaccgcgatcgaagataaactccaggatggagtgcctgaaaccatctccaaacttgcaaaagcagacataaagatctgggtcctgactggtgacaagaaggagacggcagaaaacattggttttgcatgcgagcttttgaccgaggacactaccatttgttacggagaggatatcaattcactgctgcatgcccgaatggagaaccaaaggaatagaggaggcgtctacgcaaagtttgccccgcctgtgcaggaatcattctttccaccaggtggcaatagggcgttgatcattaccgggtcatggctgaacgagattctcctcgaaaagaaaaccaaacgaaataagattctgaaacttaagttccccagaaccgaagaagagcgccgcatgcgcactcagtccaagcgcagactggaagcaaaaaaggagcagcggcagaagaattttgtggatctggcatgtgaatgttcggcagtgatctgctgcagagtgaccccaaagcaaaaagccatggtggtcgatctcgtcaaaaggtacaaaaaggcgatcactctcgcgataggagacggcgcaaatgatgtgaatatgatcaaaactgcccacattggcgtgggtattagcggtcaggaaggaatgcaggcagtcatgtcctccgattattcttttgcccaatttaggtacctgcaacggctgctgctggtgcatggacggtggtcctacattagaatgtgtaagtttctgcgttactttttctacaagaactttgcattcaccctggtgcacttttggtacagctttttcaacggatacagcgcccaaaccgcatacgaggactggttcatcaccctgtataatgtgctttacaccagcctccccgtgctgctcatgggacttttggatcaagatgtttcagataagctcagcctccgctttccaggactgtacattgtggggcagagagatttgcttttcaattacaagcgattctttgtctctcttctccatggggtcctcacttcgatgattctgttctttatccctcttggagcatacctgcaaactgtcggtcaagacggcgaggccccttcagactaccaatcgttcgcggtgactattgcatcggcgctggtcataacggtgaattttcaaatcggattggataccagctactggacttttgtgaacgcattttccatctttggttcgattgcgctgtactttggaatcatgttcgattttcactcagccggaattcatgtgcttttcccgtcggcgttccagtttaccgggactgcatctaatgcacttcgccagccctacatatggctgacgatcattcttgctgtcgctgtgtgtctgttgccagtcgttgcaattagattcttgtctatgaccatttggccatcggaatcggataagatccaaaagcatcgcaagcggttgaaggccgaagaacaatggcagcggagacaacaggtgttcagacggggtgtctcaactcggcgaagcgcttacgccttttcgcatcagagagggtacgcggacttgatttcgtcgggccgttccattaggaagaagcggtcgccactcgacgcaatcgtggctgacggtaccgctgagtaccgtaggactggagactct

SEQ ID NO: 7273 - DNA, 3753 bp, Artificial Sequence
  Description of Artificial Sequence: Synthetic coding sequence
atgtccaccgaaagagattccgaaactaccttcgatgaggactcgcaacccaatgatgaagtggtgccctacagcgacgacgagactgaggatgagcttgacgaccagggatcggccgtggaaccagagcagaaccgagtgaacagggaggccgaggaaaacagagagcctttccgcaaagagtgcacttggcaagtcaaagcgaacgatagaaagtatcacgagcagccgcacttcatgaataccaaatttctgtgcattaaagaatcgaaatatgcgaacaatgccatcaagacgtacaaatacaacgcatttactttcataccaatgaacctgtttgagcaattcaagcgcgccgcgaacctgtacttcctggctttgctgatcctgcaggcggtgccacaaatctctactctcgcctggtacactactctcgtcccgcttctggtggtgctcggagtgactgccatcaaggacctggtggatgatgtcgcccggcataagatggataaggaaatcaacaaccgaacctgcgaggtcatcaaggatggacggttcaaagtggccaagtggaaagagattcaggtgggagatgtcatccgcctgaaaaagaatgactttgtgcctgccgacatcctcctgctctcctcttcagagccgaattccctgtgctacgttgaaaccgccgagttggacggcgaaaccaacctcaagtttaagatgtcccttgaaatcactgatcagtaccttcagagagaagataccctggctacctttgatggtttcatcgaatgtgaggaacctaacaaccggctggacaagtttaccggtacccttttctggcgcaacacgtcgttcccgctggacgccgataagatcttgcttcgtggttgcgtgattcgcaataccgacttctgccacggcctcgtcattttcgccggagctgacacgaagatcatgaagaattccggaaaaactcgcttcaaacgcaccaagatcgactacctgatgaattacatggtctacaccatctttgtcgtgttgatcctgctctcggccggattggcgatcgggcacgcgtactgggaagcccaagtggggaattcgtcgtggtatttgtacgacggtgaggacgacaccccaagctacaggggcttcctgatcttttggggatacattatcgtcctgaatactatggtgccgatttctctctacgtttcagtggaagtgatccggctgggacaatcacactttatcaattgggatctgcaaatgtactacgcagaaaaggacactccagcaaaggcgcggaccaccactttgaatgaacagctgggacagattcattacatcttctcggataagaccgggactctgacccagaacataatgacttttaagaagtgctgcattaacggacagatctacggagatcaccgagatgcgtcgcagcacaaccataacaagatcgaacaggtggatttctcgtggaacacttacgcagatggcaaactcgcgttttatgaccattatctgatcgaacaaatccagtcgggcaaagagccggaagtccgacaattctttttccttctggccgtgtgccataccgtgatggtggatcgcaccgacggccagttgaactaccaggccgcgtcccctgatgaaggagccctcgtcaacgccgccaggaactttggctttgccttcctggcgcggactcagaacacgatcactatttcagagctgggaactgagagaacctacaacgtgctggcgatcctggacttcaattccgacagaaagagaatgtctatcatcgtccggaccccggaaggaaacatcaagctctactgcaagggagcagacaccgtcatctacgaaagactccatcggatgaatccgactaagcaggaaacccaggatgctctggacatcttcgccaacgaaactctcaggaccctctgcttgtgctacaaggaaatcgaagaaaaagaattcactgagtggaacaagaagttcatggctgcctccgtggcgtcaaccaatagagacgaggctctggacaaggtgtacgaggagatcgagaaggacctgatcctgctcggagccaccgccattgaagataagttgcaggacggagtgccggaaaccatctcaaaactggctaaagcggacataaagatctgggtgcttacgggagacaagaaggaaactgcagagaacatcgggttcgcttgcgagctcctgactgaggacactacgatctgctacggtgaggacatcaattcgctgcttcatgcacgcatggagaaccagaggaaccggggaggggtgtacgcaaaattcgccccgccagtgcaggagtcgttttttcctccgggcggtaatagagcgcttatcataaccggatcgtggctgaatgaaatccttcttgaaaagaaaactaaacggaataagatcctgaagttgaagttcccgcgaacggaggaagaacggaggatgcgcacgcagtccaagcggagactggaagcgaaaaaggagcagcggcagaaaaactttgtggatctggcttgcgaatgcagcgccgtgatctgctgccgcgtgaccccaaaacaaaaggccatggtggttgacctcgttaagcgctataagaaggctatcactctcgctattggtgacggagcaaatgacgtgaatatgattaagacggcgcacatcggagtgggtatttccggacaggaaggaatgcaggctgtcatgtcctctgactactcctttgcccagttcagatacctgcaacggctgctcctggtccacgggaggtggtcgtacatccgtatgtgtaagttcctgcggtacttcttctacaagaatttcgcgttcaccctggtccacttctggtactcgtttttcaatggctactccgcgcagaccgcgtatgaggactggttcatcaccctttacaatgtgctgtacactagcctgcctgtcctgctcatgggactcctcgaccaagacgtttctgacaagctctccctgcgctttcctggactctacatcgtggggcagcgggatttgctgttcaactacaagcggttcttcgtcagcctcttgcacggtgtgctgacctcgatgatcttgttcttcatcccactcggcgcctacctgcaaactgtgggacaggatggtgaagcaccgtcagattaccagtccttcgcagtcaccattgcgtcagccctggtcattactgtgaacttccagatcggcctcgatacgagctactggaccttcgtgaacgcattcagcatctttggatccatcgcgctgtatttcgggataatgttcgactttcatagcgcaggcatccatgtgctgtttccttcggcgttccaattcactggcaccgcctcgaacgccctccggcagccttacatctggctcactatcatcctggccgttgctgtgtgcctgctgccagtcgtggccatcaggtttctgtccatgaccatctggccgagcgagtccgataagatccagaagcacaggaagagactcaaggcggaggagcagtggcaacggcggcagcaggtattccggcgcggagtgtccacccggagatcggcctacgccttttcccaccaacgcggatacgcggatctcatctcgtcgggccgcagcatccggaagaagcggagccccctggacgcgatcgtggccgacggtacggctgagtacagaagaaccggggactcg

SEQ ID NO: 7274 - DNA, 3753 bp, Artificial Sequence
  Description of Artificial Sequence: Synthetic coding sequence
atgagcactgagcgggattctgagacgacttttgacgaagatagtcagcctaatgatgaagtggtcccgtactcggatgatgagacagaagatgagctcgacgaccaaggcagcgccgtggaacccgaacagaatcgggtcaacagagaggctgaggagaatagggagcccttccggaaggagtgtacctggcaggtgaaggccaatgatagaaagtaccacgagcagccccatttcatgaatactaagtttctctgcattaaggagtccaaatacgcaaataacgccatcaaaacctataaatacaatgcattcacctttatacccatgaacttattcgaacagttcaaacgggccgccaatctttacttcctggctttactgatactgcaggctgtgccccaaataagcaccttagcttggtatactaccttggtgcctctgctggtggtgcttggggtaaccgctataaaggacctggtagacgacgtggcacggcacaagatggacaaagagatcaacaatcggacctgcgaagtgataaaggacggccgctttaaggtggcaaagtggaaggagattcaggtgggcgatgtaatccgcttgaagaaaaatgattttgttccagctgacatcctccttctttcttcgagtgagccaaacagcctctgctatgtcgagactgcggagctcgacggagagaccaatctgaagttcaaaatgtctctggaaattaccgaccagtacctgcagcgcgaagatactctggccacatttgatgggttcattgaatgtgaagaacctaacaatcgccttgataaatttacaggcaccctgttttggagaaacacctcgttcccactagacgcggacaaaattctactacgaggctgcgtcatccggaataccgacttttgccacggtctggtcatctttgctggagcggatacgaagataatgaagaattccgggaagactcgctttaaacggacaaagattgactacctaatgaactatatggtgtacactatattcgtggtattaattctgttgtccgccgggctcgccataggccatgcttattgggaggcccaggttggcaactcttcttggtatctttatgacggggaggatgatacaccctcctaccgaggcttcctgattttttggggttatattattgtcctaaatacgatggtgccgatcagcttatacgtcagcgtagaagtcattcgcctgggacaatctcatttcatcaactgggatctccaaatgtattacgcagaaaaagataccccagcgaaggctagaaccacaaccctgaatgaacagctcggacaaatccactacatcttttcggataaaacagggacactcacacagaatataatgaccttcaaaaagtgctgcatcaatgggcagatttatggagaccaccgggatgcttcccagcataaccataataagatcgagcaagtggactttagctggaacacttatgccgacggcaaattggccttctatgatcactatttgatcgaacagatccagtccggtaaagagcctgaggttagacagttttttttcttgcttgcagtgtgtcataccgtcatggtggataggaccgatggacaacttaactaccaggcagcaagcccagatgaaggcgcactggtgaatgcggctaggaatttcggcttcgcattccttgccagaacacagaatactataacaatctcggagctgggaacggagcgcacatacaacgtgctcgccattcttgacttcaatagtgaccgtaagagaatgagtataatagttagaactcctgaaggaaatatcaaattatattgtaagggagctgacaccgtaatttacgagcgtttgcacaggatgaacccaactaagcaggagacacaggatgctctcgacatcttcgctaatgagactttgagaaccctctgtctgtgctacaaggagatcgaagagaaggagtttaccgaatggaacaagaaattcatggcagctagcgtggcctccaccaatcgtgatgaagccctcgataaagtgtacgaagagatagagaaggatctcattctgttgggcgcaacagccattgaggataagctacaggacggagtccctgaaacaatcagtaaacttgcaaaggctgacattaaaatatgggtactgactggcgataaaaaggagacagcggagaacatcggatttgcctgcgaacttctaaccgaggacactactatctgttacggggaggacattaactcgctcctccacgctcggatggagaaccagaggaacagagggggtgtgtatgcaaaatttgctcctcccgtgcaggaatcattctttcctcccggagggaatcgcgctctgataataactgggagttggctcaacgagatcttgttggagaagaaaaccaaaaggaacaaaatactgaagttgaaatttcctcgcactgaggaggagcgtcgaatgcgcactcagtccaaacgccgcctggaagccaagaaagagcagcgccagaaaaacttcgtggatctcgcatgcgagtgctccgccgtgatttgttgtcgagttacaccaaaacagaaggccatggtggtggacctggtgaaacggtataaaaaggctattacccttgccattggcgatggagccaatgatgtgaatatgataaagaccgctcatatcggagttgggatctccggccaagaggggatgcaagctgtcatgtcttctgattactcattcgctcagtttagatatcttcagcggctgttactggtacacggacgctggtcgtacatcagaatgtgcaagtttctgcggtatttcttctacaaaaattttgcctttaccctcgttcatttctggtacagtttctttaatggctatagcgcccagactgcctacgaggattggtttatcacactttacaacgttctgtacacaagtttacccgtgctgttaatgggactgcttgaccaggacgtgagcgataagctgtcactaagattccctggcctctacattgtggggcaacgcgatctgctcttcaactataagcgtttcttcgtatcactcttgcatggggtcttaacttcaatgattcttttctttattcctctaggtgcatacctgcagacagttggtcaagacggtgaggcaccgtctgattaccagtccttcgcagtgacaatagctagcgcattggtcatcacggtgaatttccagatcgggcttgacacttcttactggaccttcgtgaatgcgttttcgatctttgggtctatcgcgctatattttgggatcatgtttgactttcacagtgccggaattcacgtactcttccccagcgctttccagttcacaggaacagcgagtaatgcgttgcgtcagccctatatttggctgaccattatccttgctgttgccgtctgtctgcttccagtggtggcaatccgttttttgagcatgaccatttggccgtctgaatccgacaagattcaaaaacaccggaagcgacttaaagccgaggaacagtggcaaaggaggcagcaagtgttccgccgtggcgtgagtacccgccgcagcgcatacgcattcagccaccagcggggttacgccgacctgatcagttcagggcggagcatccggaaaaaacgatctccccttgatgctatcgttgcagacggtactgccgagtatagacgtacaggtgactct

SEQ ID NO: 7275 - DNA, 3753 bp, Artificial Sequence
  Description of Artificial Sequence: Synthetic coding sequence
atgtccaccgaacgcgattcggaaaccaccttcgacgaagattcgcagcccaacgatgaggtggtgccctacagcgatgatgaaaccgaagatgaacttgacgaccagggaagcgcagtcgaacctgagcagaatcgtgtcaaccgggaagccgaggaaaacagggaaccttttcggaaggaatgtacctggcaagtgaaggctaacgatcgcaaataccatgaacaaccacacttcatgaataccaagttcctttgcattaaggagtccaaatacgcgaacaacgcgatcaaaacctacaagtacaacgcgtttacgtttattccgatgaatctttttgaacagttcaaaagggcagcgaatctctacttcctcgccttgctgattcttcaggctgtccctcagatcagcacccttgcgtggtacacgacgcttgtgccgttgctcgtggtgctgggtgtaacggccattaaggacctggtggatgatgtcgcaagacataagatggacaaagagataaacaataggacctgtgaagtcattaaggatggacgctttaaggtggccaagtggaaagagattcaggtgggggatgtcatcagattgaaaaagaacgattttgtgcccgcagatatactccttctgtccagctcagaacctaactctctgtgctacgtcgagacggcagaactggacggtgaaaccaatctgaagttcaaaatgagcctcgagattacggatcaatacctgcagagggaagatacccttgcgacttttgacgggtttattgagtgtgaagaacccaataacaggctggataagtttactggtactctcttttggagaaacacttcatttcctctcgatgctgataagatcctgctcagaggatgcgtcatcagaaacaccgatttttgtcatggactggtgatttttgccggagcagacaccaagataatgaagaactcaggaaagactcgttttaagagaactaaaatcgattacctcatgaattacatggtgtacacgatttttgtggtgcttattctgctctccgcaggtctggcaattggtcacgcctattgggaagcccaagtgggtaactcctcctggtacctctacgatggcgaagatgatactccttcgtacagaggatttcttatcttttggggctacataattgtgcttaacactatggtgccaatctccctgtatgtgtccgtggaggtgattcggcttggacagtcgcacttcattaactgggatctgcagatgtactacgctgaaaaggataccccagcgaaggcaagaaccacgactctgaacgaacaactcggacagatccattacatattctcagataagactggtactctgactcagaatatcatgacctttaagaaatgctgcattaatggtcagatctacggtgatcatcgagatgctagccaacataatcacaataagattgaacaggtggactttagctggaacacttacgcagatgggaaacttgcattttacgaccactacctcattgagcagattcaatcgggaaaagaacctgaagtgcgccagttctttttccttcttgccgtgtgtcacactgtgatggtcgatcggaccgatggacagctgaattaccaagccgcatcgcctgacgaaggtgctctggtgaatgcggcgcggaactttggattcgccttcctcgcacgcacccaaaacaccattaccatttcggagcttggtacggaaaggacttacaatgtgcttgccattctggactttaactcggatagaaaaagaatgagcatcatcgtcagaaccccagaaggaaatatcaagttgtactgcaaaggggctgacactgtgatctacgaaaggctgcaccgcatgaatcccaccaagcaagaaacccaggatgcactcgacatatttgcaaacgaaaccctcagaaccctgtgcctgtgttacaaggagatagaagagaaggagtttaccgagtggaacaagaagtttatggcagcatcggtggcctccaccaaccgcgacgaggcactcgataaggtgtacgaagaaattgagaaagacctcatacttcttggggcaactgccatagaagataagttgcaagatggcgtgccagaaactatttcgaagctcgcaaaagccgacattaagatctgggtcctgaccggcgataagaaagaaactgcagagaacattgggtttgcatgtgaacttctcaccgaagataccaccatttgttacggtgaggatatcaactcacttcttcacgcgcgtatggagaaccagcgtaaccgcggcggagtgtatgccaagttcgcgccacctgtgcaggaatcgttctttcctccaggggggaaccgggcactgatcattaccgggtcctggcttaacgaaatcttgttggagaagaaaactaaacgaaacaagattctgaagctgaagtttccgcgaactgaagaagaaaggcggatgcgcacccagtcgaagcgccgtctggaggcaaagaaggaacagcggcagaaaaactttgtcgacttggcttgtgagtgtagcgcagtgatctgttgccgtgtcacccctaagcaaaaggcaatggtggtggatctggtgaagaggtataagaaggcaataactcttgcgattggagatggagcaaacgatgtgaacatgattaagaccgcccacattggggtgggcatatcgggtcaagaaggaatgcaagcagtgatgtcatcggattacagctttgctcagtttcgttacctccaacggctgctcttggtgcatgggagatggagctacattaggatgtgtaagtttcttcgctacttcttctacaaaaactttgcgttcaccctggtgcatttttggtactcgttctttaacgggtacagcgcacaaaccgcatacgaagattggttcatcaccctgtacaacgtgctgtacacctcgctgcctgtccttctcatgggactccttgatcaggatgtgtcagataagctgtcactgcggtttcccgggctttacatcgtggggcaaagagatttgctgtttaactacaagagattctttgtctcgctgcttcacggagtgcttacctcgatgatcctcttctttatcccccttggtgcatacctccaaactgtgggtcaagatggggaagcacctagcgattaccagtcgtttgcagtgaccatcgcaagcgcactggtgatcactgtcaattttcaaatcggcctggacacttcgtactggactttcgtcaatgccttttcaattttcgggagcatcgctctgtactttggaatcatgtttgatttccactccgcgggcattcatgtgctctttccgtccgctttccagtttactggaaccgcgtcaaacgcactgagacagccttacatttggttgactatcattcttgcagtcgcagtctgccttctgcctgtggtcgcaattcgatttctctccatgaccatctggccttctgagtcggacaagatccaaaaacaccgaaagagacttaaggcagaagagcagtggcagcgcaggcagcaagtgttccggcggggtgtctcgactcgtcgctcggcatacgcatttagccatcaaaggggctacgcagatcttatatcaagtggacgctcaattcggaagaagcgcagccccctggatgcaattgtggcagacggtaccgctgaataccgccgaaccggcgattca

SEQ ID NO: 7276 - DNA, 3753 bp, Artificial Sequence
  Description of Artificial Sequence: Synthetic coding sequence
atgtcgacggagcgcgactcggaaaccacctttgacgaagatagccaaccgaacgacgaagtcgtgccatactccgatgacgaaaccgaagatgagctggatgaccaaggatccgccgtggaaccggaacagaaccgcgttaacagagaggccgaagaaaatcgggaaccatttaggaaggagtgcacctggcaggtcaaggccaatgatcgcaagtaccatgagcaaccacactttatgaataccaaattcctgtgcatcaaagaatcaaagtacgcgaacaatgcgataaagacgtacaagtacaatgcattcacttttatcccaatgaatctgtttgaacaattcaaacgcgccgcgaacttgtactttctggccctgctgattctgcaagcggtgccgcagatctccaccctcgcttggtacaccaccctcgtcccgctgttggtggtgctcggagtgacggcaatcaaggacctggtggacgacgtcgcacgccacaagatggacaaggaaatcaacaacagaacttgtgaagtgatcaaggatggaagattcaaagtggcgaagtggaaagaaatccaggtcggcgatgtgatccgcctgaagaaaaatgacttcgtccctgcagatatcctcctcctgtcctccagcgaaccgaacagcctgtgttacgtggaaaccgccgagctggacggagaaactaatctcaagttcaagatgtcactggagatcactgaccaatacctccagcgcgaggacactcttgccactttcgatggcttcatcgaatgcgaagaaccgaacaaccgcctggacaagtttaccggaaccctcttttggcgcaacactagctttcctctggacgccgataagatcctcctccggggatgcgtcatcagaaacacggacttctgccacgggctggtgatcttcgctggagcagatactaagattatgaagaactccggaaaaaccagattcaagcgcaccaaaatcgactacctgatgaattacatggtgtataccatcttcgtggtgctgatcctcctgtcagcaggccttgcgattgggcatgcctactgggaggctcaggtgggcaacagcagctggtacctgtacgatggagaggacgacaccccgtcctatagagggttcctgatcttttggggctacattattgtcttgaacactatggttcccataagcctttacgtctcggtcgaagttatccggttgggacaatctcatttcatcaattgggatttgcagatgtactacgcggaaaaagacacccctgctaaggcgagaactacgactctgaacgaacaactcggacagatccactacatcttctccgacaaaaccggtactctgactcagaacatcatgacttttaagaagtgctgcatcaacggacagatctatggagatcatcgagacgcttcacagcataaccacaacaagatcgagcaggtggacttctcatggaacacgtacgccgacggaaagctggcgttctacgaccattaccttatcgaacagatccaatcgggaaaagaaccggaggtgcgccagtttttcttcttgctggccgtctgccatactgtcatggtggatagaactgacggacagctcaactaccaggccgcttccccagacgaaggagcactggtgaatgcagctcgcaacttcggatttgcgttccttgcacggacccagaacactatcactatctcagagctcggcaccgaacgcacttacaatgtgctggcaattctcgacttcaactccgaccgaaaaagaatgtcgatcattgtgcggacgcctgaggggaacatcaagctctactgcaagggagcagataccgtgatatacgagcggcttcacaggatgaacccgaccaagcaagaaactcaggacgctctggatatcttcgccaacgaaactctgcgaacgctgtgcctctgctacaaggagattgaggaaaaggagtttaccgaatggaacaaaaagtttatggccgcctccgtcgcctccactaatcgcgacgaggctctggacaaggtgtacgaggagatcgagaaggacctcatcctgctgggagctaccgctattgaggataagctccaggacggtgtgcctgagacgatctcgaagttggctaaggcagacatcaagatctgggtgctgaccggtgacaagaaggagactgcagaaaacattggcttcgcctgcgaactgctgaccgaggacactaccatctgttatggggaagatatcaactcactgctccatgctagaatggagaaccagagaaaccgcggtggcgtgtacgccaaattcgccccgccggtgcaagaatctttcttcccgcccggcgggaaccgagcgctcatcattacgggatcatggctgaatgaaattctgctggaaaagaaaaccaaacgaaacaagatcctgaagctgaagttcccgcgcactgaggaagaacggcgcatgaggactcaatcgaaaagacgacttgaagcgaagaaagaacagagacaaaagaacttcgtagacctcgcctgtgaatgcagcgccgtgatctgttgcagagtgacgccgaaacaaaaagctatggtcgtcgacttggtcaaaagatacaagaaagccatcacccttgcaatcggggatggagcaaacgatgtgaacatgatcaagacggcacacattggagtgggaatctcaggacaggagggaatgcaggcggtgatgtcatcagactactcattcgcacaattccgctacctgcaaagactgctcttggtccatggcagatggtcttatatccgcatgtgtaagttcctcaggtactttttctacaagaatttcgctttcacgttggtccatttctggtactcgtttttcaatggttactccgcccaaaccgcctacgaggactggttcatcaccctgtacaatgtcctttacacctccctgccagtgctcctgatgggtctgctggatcaggatgtgtccgacaaactctcccttcggtttccgggcctctacatcgtgggccagcgcgacctcctgttcaactacaagcggttcttcgtgtctctgctgcatggagtcctgacgagcatgatcctgttcttcattcctctgggagcttacctgcaaaccgtcgggcaggacggagaagcaccgagcgattaccaatcttttgcggtgaccatcgcatctgcactggttattaccgtgaatttccaaatcggactcgataccagctactggaccttcgtgaatgctttctctatcttcggaagcatcgcgctgtacttcggaattatgttcgacttccactcagcaggcatccacgtgcttttcccttcagccttccagttcactggaaccgcctcgaacgcattgcgccagccttacatctggctgactattatcctggccgtggcagtgtgtctgctccccgtggtcgcgattaggttcctttcaatgaccatctggcctagcgaatccgacaaaatccaaaagcaccgcaagcggcttaaggccgaggaacagtggcagcgccgccagcaagtgttccgcaggggagtgtcgacccgcagatccgcctatgcgttcagccaccagcggggctacgccgacctcatttcatcggggcggtccatccgcaagaagcgctcaccattggatgcaatcgtggcagatggcactgccgagtacaggcgtaccggtgactca

SEQ ID NO: 7277 - DNA, 3753 bp, Artificial Sequence
  Description of Artificial Sequence: Synthetic coding sequence
atgagcactgaacgagattcagaaactacttttgatgaggatagccagcccaacgatgaggtcgtcccgtactccgacgacgaaactgaggacgaactcgatgatcagggatcagccgtggaacctgaacaaaacagggtcaaccgagaagcagaagagaatcgtgaaccatttagaaaggagtgtacttggcaagttaaagcaaacgatagaaaataccacgaacaacctcatttcatgaacactaagttcctgtgcatcaaggaatcaaagtacgcaaacaacgcaattaagacttacaagtacaatgcatttacgtttattccaatgaacctttttgaacagtttaaacgcgcggctaacctgtactttctggcattgctgattttgcaagccgttcctcaaatttcgactctggcctggtataccactcttgtgccattgctcgtggtccttggcgtcactgcgattaaggatcttgtggatgatgtggcccgccataagatggataaggagattaacaataggacctgtgaagtgattaaagatggaagatttaaggtggcaaagtggaaagagattcaggtcggcgacgtgattagactcaagaaaaacgatttcgtccccgccgacattctgctcctctcgtcctcagaaccaaactccctttgttacgtggaaaccgcagaattggatggcgaaaccaatttgaagtttaagatgtcactggagataactgatcagtaccttcaacgagaggataccctggcgacttttgatggattcatcgaatgcgaagaaccgaataacagactggacaaattcactggtaccttgttttggcgcaatacttcgtttccgctggatgcggataagattcttcttcgcggatgtgtcatacgaaacactgacttttgtcacggacttgtcatttttgcaggagcagacaccaagattatgaagaactcgggcaagacgagattcaagcgcactaagattgattacctgatgaactacatggtctacaccatcttcgtggtgcttattcttcttagcgcaggtttggcaataggccacgcctactgggaagctcaggtgggtaacagctcatggtacctgtacgacggagaagatgataccccatcctaccgtggattccttatcttctgggggtacattatcgtcctgaacaccatggtgcctattagcctgtacgtgtcagtggaagtgatacgactgggccaatcccatttcataaactgggatcttcaaatgtactacgcagagaaggacactcccgccaaagcacggaccactacccttaacgaacagctgggacagatacattacatcttttccgataaaaccggcactctgacccaaaacattatgaccttcaaaaagtgctgtattaacgggcaaatctacggcgaccatagagatgcatcacaacacaaccataacaagattgaacaagtggatttttcttggaatacttacgcagatggaaagctggctttttacgatcactacctgattgagcaaatccaatccggaaaggaacctgaggtccggcaattcttcttcttgctggcagtctgccataccgtgatggtggacaggactgatggacagctcaactaccaggcagcatcccctgacgaaggagcactggtgaacgcagcaagaaactttggttttgccttcctcgcaagaactcagaatactatcactattagcgaactgggaaccgaaaggacctacaacgtgttggccattcttgatttcaatagtgaccggaagagaatgtcgatcatagtgcgtaccccagagggaaacattaagctgtattgcaagggtgccgacaccgtgatttacgaacgtctccaccgaatgaatccaaccaagcaggaaacccaagacgcactcgacattttcgcgaacgagacgctgcgcactctttgtctgtgttacaaggaaattgaggaaaaagaatttaccgaatggaataagaagtttatggcagcctcagtcgcaagcactaatagggacgaggccctggacaaggtgtacgaagaaatcgagaaggatctgatcctgctgggagcaaccgccatcgaagataaactgcaagacggtgtgccagaaactattagcaaacttgctaaggcggacataaagatctgggtgctgacgggagacaagaaggagactgctgaaaacatcggattcgcctgtgaactcctgactgaggacactaccatttgctacggtgaggacatcaatagccttctccatgcccgaatggaaaatcaaaggaaccgcggtggagtttacgcaaagtttgctcctcccgtccaggagtcgttctttcctcccggcgggaaccgggccctgatcatcaccggctcatggcttaatgagatactgctcgagaagaaaactaagagaaataagatacttaaacttaagttcccgagaactgaagaggaacgcagaatgaggacgcagtcgaagagacgccttgaggcaaagaaagaacaaagacaaaagaactttgtcgatctcgcctgcgaatgtagcgcggtgatctgctgtcgcgtcacgcctaagcaaaaggcaatggtggtggaccttgtgaaacgctacaagaaggccatcacccttgccataggtgacggcgcaaacgacgtcaatatgattaagactgcacatataggagttggaatctccggccaagaaggcatgcaagccgtcatgtcctcagattacagctttgcccaatttagataccttcagcggctcttgttggtgcacggcagatggtcctacattcggatgtgtaagtttctccgctacttcttttacaaaaactttgcatttacgctcgtccatttttggtactcgttctttaatgggtactcggcccagaccgcctacgaagattggtttatcactctgtataacgtgctctacacgtcactcccagtgctgctcatgggcctcctggaccaggatgtctccgacaaactcagcctccggtttccaggactctacattgtggggcagcgggatcttcttttcaactacaagagatttttcgtctccctgcttcatggtgtcctgacttccatgatcctgttctttattccactgggcgcgtacctgcagaccgtggggcaagatggtgaagcaccttccgattaccagagctttgcagtcacgatcgcatcggcgctcgtcattaccgtgaacttccaaatcggacttgacacctcgtactggacttttgtgaacgcgttttccatctttggatcgattgcactgtactttggcatcatgtttgatttccactctgccggaattcatgtccttttcccctccgcttttcagttcaccggcactgcaagcaatgcgctgcgccagccctacatttggcttactattatccttgcagttgccgtctgtctgctcccggtggttgcaataaggttcttgtcgatgaccatttggccatccgaatccgataagattcaaaagcatcgaaagcgcctgaaggcagaagaacagtggcagcgcagacagcaggtgtttaggaggggagtgagcacccggcgctccgcatacgcatttagccaccagcgcggatacgcagacctgatcagctccgggcgatcaatcaggaaaaagagatcgccactggatgcaattgttgctgacggaactgccgaataccgccgaactggcgactcc

SEQ ID NO: 7278 - DNA, 3753 bp, Artificial Sequence
  Description of Artificial Sequence: Synthetic coding sequence
atgtctaccgaaagagactcggaaaccactttcgatgaggattcacagccaaacgacgaagtggttccgtactcagatgatgagactgaagatgaactggacgatcagggatcagccgtggaacctgaacagaaccgcgtgaacagggaagcggaagagaacagggagccgttccggaaggagtgcacttggcaggtcaaggcaaacgacagaaaataccacgagcagccgcactttatgaatactaaattcctgtgcatcaaggagtcaaagtacgcgaataacgccatcaagacttacaagtacaacgcattcaccttcatcccgatgaatcttttcgagcagttcaagagggcagcaaatctgtacttcctggcgctcctgatcctgcaggccgtgccgcagatctcgactttggcatggtacaccacgctcgtcccgctgctggtcgtcctcggagtgactgcgatcaaggatctggtggatgatgtggcacggcacaagatggataaggaaatcaataacagaacttgcgaggtgatcaaggacgggcggttcaaagtagcgaagtggaaagaaatccaggtgggcgacgtgatcagacttaagaagaacgactttgtcccggcagacatcttgcttctgtcctcctcagaacctaactccttgtgttacgtggaaaccgcagaactggatggagagactaacttgaagttcaagatgagcctggaaatcaccgatcagtacctgcaaagagaggatactctcgctacctttgatggattcatcgagtgtgaggagcctaacaatcggctggataagtttactgggaccctcttctggagaaacactagcttcccgctggatgcggacaagatcctcctgagggggtgtgtgatcaggaacactgatttttgccacggactggtgatcttcgcgggcgctgacaccaagatcatgaaaaactcaggtaagacccggttcaagcggacgaaaattgattacctgatgaattacatggtctacaccattttcgtggtgctcatcctcctcagcgccggactggctatcggacatgcctactgggaagcacaagtcggtaactcatcttggtacctgtacgatggcgaggacgataccccttcctatcggggattcctgatcttctggggatacatcatcgtgctgaatacgatggtgccgatctccctgtacgtctcagtcgaagtgatccgcctgggccaaagccactttatcaactgggacctgcaaatgtattacgctgaaaaggacactcctgcaaaagctagaacgacgactctgaacgagcagttgggccaaatccattacatctttagcgataagactggaactctgactcaaaacattatgactttcaagaagtgctgcatcaacggacagatttacggcgaccatagggacgcctcgcagcataaccacaacaagatcgaacaggttgatttttcgtggaatacttacgctgacgggaagctcgccttctacgatcactacctgatcgaacagatccagtccggaaaggagccagaggttcgccaattctttttcctgctggccgtgtgccacacggtgatggtggatagaaccgacgggcaactgaactaccaggcggcatcgccggacgaaggggcgcttgtgaacgccgcacgaaatttcggattcgcattcctggcgcggacccagaacactattaccatcagcgagcttggaactgagcgcacctacaacgtgctcgccatcctggacttcaattcggatagaaagagaatgtccatcatcgtgaggacgcctgaggggaacatcaagctctactgcaaaggggctgacaccgtgatctacgaacgattgcaccggatgaatccgaccaagcaggaaacgcaggatgccctggacatcttcgcaaatgaaactctgcggacgctgtgtctgtgctacaaggaaattgaagaaaaggaattcacggagtggaacaagaagtttatggcggcatcggtggcatcgactaatagagatgaagcccttgacaaagtgtacgaagagatcgaaaaggacctgatcctccttggcgccaccgccattgaggacaagctgcaagatggagtgccagaaaccatctccaaactggccaaagccgacatcaaaatctgggtcctcaccggagacaagaaggagactgccgagaatatcgggtttgcttgcgagctgctcaccgaagatactactatttgctacggagaggacatcaattccctcctgcatgccagaatggaaaatcagagaaaccgcggaggagtctacgccaagttcgccccacctgtccaagaatcgttttttccccccggaggaaatagggccctcatcatcactggcagctggctcaacgaaatcctgctggaaaagaaaacgaaaagaaacaaaatcctcaagctcaagtttcctcgtactgaagaggaaagacgcatgagaacgcagtccaaaaggcggctggaagcgaagaaggagcagagacagaagaatttcgtcgatctggcgtgcgaatgctcggcagtgatctgctgccgcgtgaccccaaagcagaaggcgatggtcgtggatctggtgaagcgctacaaaaaggctatcacgttggctatcggggacggagccaatgacgtcaacatgatcaagaccgcccacatcggagtgggtatcagtggtcaagaggggatgcaagctgtgatgtcctcagactactcattcgcgcagtttcgctatctgcagagactgctgctggtgcacggacggtggtcttacatcagaatgtgcaagttccttcggtacttcttctacaagaatttcgccttcactctggtgcatttctggtatagctttttcaacggatacagcgcgcaaaccgcttacgaagattggttcattaccctctacaacgtcctgtacacctcactgccagtgctcctgatgggactcctcgatcaggatgtgtcagacaagctctctctgcgcttcccgggactttacatagtgggacaacgggacctgctgttcaactacaagcgcttctttgtgtcgttgctgcatggagtgctgaccagcatgatcctgttcttcatcccacttggagcgtacctgcagactgtgggacaggacggcgaagccccaagcgactatcagtcattcgccgtcactatcgcgtcggcattggtcattaccgtgaattttcagattggcctggacacctcgtactggactttcgtcaacgcgttcagcatcttcggctcgatcgcgctgtacttcggaatcatgtttgacttccatagcgccggcatccacgtgctctttccaagtgcctttcaattcactggcactgcatccaacgccctgagacagccgtacatctggctcactatcatcctcgccgtcgcggtctgtctgctgccagtggtggcaatcaggttcctgtccatgactatctggccatccgagtctgacaagatccagaagcaccggaaacggcttaaggccgaagagcaatggcagaggcgccaacaagtgttcaggcggggagtctcaactcgcaggtccgcctacgctttctcgcatcagaggggctacgccgatctcatctcctcgggacgctcgatccgcaagaagaggtcccccctcgacgcgatcgtcgcggacggaactgccgaataccgccgcactggtgacagc

SEQ ID NO: 7279 - DNA, 3753 bp, Artificial Sequence
  Description of Artificial Sequence: Synthetic coding sequence
atgagtactgagagggactctgagaccacgtttgatgaggactcgcaacccaacgatgaggtggtaccgtactccgatgatgagactgaggacgagcttgatgatcagggatcagcagtggagccagagcaaaatagggtgaaccgcgaggcggaagagaacagagagcctttcagaaaggaatgtacttggcaggtcaaggccaacgatagaaaatatcatgagcagccgcattttatgaacaccaagttcctttgcatcaaagagagtaaatacgcgaataacgctattaaaacctacaagtataatgctttcacctttatccctatgaacctgttcgaacaatttaagagagcagctaatctctatttcctagcactcctaatcctgcaagcagtaccgcaaatttcaacgttggcgtggtacaccaccctggtccctttgctcgtcgtccttggagtgaccgctatcaaggacctcgttgatgacgttgcaagacacaagatggataaagagattaataaccgcacttgcgaagtgattaaagacggaagatttaaggtcgccaagtggaaggagatccaagtcggtgatgtaatcagactaaagaagaacgatttcgtccccgcggacatattgttgctctccagctctgaaccaaactcgttgtgttatgtcgagaccgccgaattggatggtgagaccaacctcaaattcaaaatgtcactggagatcacggatcaatatcttcagcgggaggacactctggccacttttgacggctttattgaatgcgaggagccaaataaccgtctcgataagttcaccggaactcttttttggaggaatactagcttccccttagacgccgataagattctgttacgggggtgtgtaatcagaaacacagatttctgccacggcctggtgatatttgcaggtgctgacactaagattatgaagaatagtgggaagacgcgtttcaaaaggactaagatcgactaccttatgaactatatggtgtacaccatttttgtagtccttattcttctatctgccggcctggcgattgggcacgcctattgggaagctcaggttggtaattcttcttggtacctgtacgatggggaggatgacaccccctcctacaggggtttcctgatcttctggggttacatcatcgttctaaacaccatggtacctatcagtttgtatgtttcggtcgaagtgatccgactcggtcagtctcattttattaactgggatcttcaaatgtattatgcggagaaagataccccggccaaagcccgtacaaccacacttaatgagcagctgggtcagattcattatatcttctcagacaagacaggtacacttacacagaacataatgacgtttaagaagtgctgtattaacggccagatttacggcgatcatcgcgatgcctcccagcacaatcacaataaaatcgagcaggtggacttcagctggaacacctatgcagatggtaagctcgccttctacgaccactatctcatcgagcagattcaatccggtaaagaaccagaagtgcgacagtttttcttccttcttgccgtgtgtcacacagtgatggttgaccgtacggacggtcagctcaactatcaggctgcttctccggatgaaggagcacttgtcaatgctgcccgcaatttcggtttcgcttttttggctcgaactcagaataccattacaatttctgagcttggtactgaaaggacctataacgtgctcgccattctcgacttcaactcagataggaaaagaatgtccatcattgttcggaccccagaaggtaacatcaagctgtattgtaagggtgctgatacggttatctatgaaaggctgcacaggatgaatcctacaaagcaggaaacccaggatgcactagacattttcgcgaacgaaacattgcgaacgctctgcctttgctacaaagaaatcgaagaaaaggagtttaccgagtggaacaagaagtttatggctgcctctgtggcatcgacaaatcgcgacgaagcgttggataaagtctacgaggaaatagagaaggacttaattttgctcggcgccacggccatcgaggataaactgcaagacggagtccccgagacgatttcgaagttagccaaagcggacataaagatctgggttcttacgggcgacaagaaagagacggcggagaacatcggttttgcttgtgagcttctgacagaagatacgacaatttgttacggggaagacatcaactcgctgcttcatgcgcgtatggaaaatcagcgaaatcgcggaggtgtttatgctaagttcgcacctccagtccaagaatctttcttccctcccggtggcaaccgggctcttatcatcaccggttcttggctgaatgaaatcctcttagagaaaaagacaaagagaaacaaaattctcaagctgaagttcccacgaactgaggaggaacggcgtatgagaactcagtcaaaaaggcggcttgaagctaagaaggaacagcgacagaagaactttgtggacctcgcttgtgagtgctccgccgtgatttgttgtcgagttacccctaagcaaaaggccatggtcgttgacctcgtcaagcgatacaaaaaggctataacactagcaattggggacggagccaacgacgttaatatgatcaagacggcgcatataggagtcggtattagcggacaagaaggcatgcaagctgtaatgagcagtgattattcgtttgcgcagttccgttacctccaaagactactgttggtacatggtaggtggtcgtacattcgcatgtgcaaatttctccgctactttttctacaaaaattttgccttcaccctagtacatttctggtattctttctttaatggctattctgcgcagacagcctacgaagattggttcattacgctctataacgttctttacacctccttgcctgtgcttttgatggggttgctcgatcaggacgttagcgacaagctttcgctacgcttcccgggattgtatatcgttggacaacgtgatttacttttcaactacaagcgtttcttcgtttcattactccatggagtcttaacgtctatgatcttgttcttcatcccgcttggagcttacttgcaaaccgtcggtcaagacggcgaggccccttctgattaccaatccttcgccgtgacgatcgcttctgcccttgtgatcactgtcaatttccagatcggactggacacgagctactggacttttgtaaatgcattttcaatattcggcagcatcgctttatactttggtatcatgttcgactttcattcagccgggattcatgtgctattcccttctgcatttcagttcactggtactgcctctaatgcgctgcggcagccctacatctggttgaccatcatcctggccgtggccgtctgtcttttaccggtcgtggccatccgctttctgtccatgacaatctggccctcggagtccgacaaaatccagaagcatcgtaagcggttgaaggcggaagagcagtggcaacggagacagcaagtatttcgtcgtggcgtctctacccgtcggagcgcatatgcgttctcacaccaaaggggttatgcagacctaattagttcaggtcgtagcatccggaagaagaggtccccccttgacgctattgttgctgacggcacagccgagtaccggcgtaccggtgactcc

SEQ ID NO: 7280 - DNA, 3753 bp, Artificial Sequence
  Description of Artificial Sequence: Synthetic coding sequence
atgtcaaccgagcgggactcagaaacaactttcgacgaagactctcagcctaatgatgaagttgttccatattctgatgatgaaactgaagatgaattggatgatcaaggatctgccgtagaacccgagcaaaaccgagtcaatcgagaagctgaggaaaatcgtgaaccatttagaaaggaatgcacttggcaagtgaaagcaaatgaccggaaatatcatgagcagccccactttatgaacacaaagtttctatgtattaaagaatcaaaatatgctaacaatgccattaagacttacaagtacaatgcatttactttcattccaatgaatttgtttgagcaattcaagagagcagcgaatctttacttcttggcattgcttattcttcaagctgtaccacagataagtacgctcgcatggtatacaacactagtgccattgttagttgttctcggagtaacagctataaaggatttggttgatgatgttgcaaggcacaaaatggataaagagattaataaccgaacatgcgaagtgatcaaagacggaagattcaaagtagcgaagtggaaagaaatccaagttggagatgtcattcgactgaaaaagaatgattttgtaccagctgatattcttctgcttagtagttcagagcctaattctctctgctacgtcgaaactgcggaactcgatggagaaacaaatttgaaattcaaaatgtcgctagagataacggaccaatatcttcagcgtgaagatacactcgctacatttgacggattcatcgaatgcgaagaaccaaataatcgactcgacaagttcacaggcacattgttctggaggaatacaagtttcccactggatgctgataagatattattacgtggatgtgttattcgtaatactgatttttgtcatggattggtcatctttgcaggtgccgatactaaaattatgaagaatagcggtaagacacgcttcaagagaactaaaatcgattacctcatgaactacatggtctacactattttcgttgtcctcatattattatctgcaggactggcaatcggacacgcttattgggaagcgcaagttgggaattcttcttggtacctttacgatggagaagatgatacaccaagttatagaggcttccttatcttttggggatatattatcgtacttaacacgatggttcctataagcttgtacgtatccgtggaagttattcgcctaggacaatcgcacttcatcaactgggatctccaaatgtactatgctgagaaagacaccccagctaaggcacgaacaacgacccttaacgaacaactggggcaaattcactatattttttcggataagacgggaactttgacccagaatattatgacgttcaagaagtgttgcatcaatggacagatttacggcgatcatcgcgacgcctcgcaacacaaccataacaaaattgagcaggtcgacttcagttggaatacgtacgctgatggcaaactcgcattctatgatcattacttgatcgaacagattcagagtggaaaagagcctgaagtaaggcaattcttcttccttcttgcagtatgtcacactgttatggtggataggaccgatggacaacttaattaccaagcagcaagtccagatgagggagcactagttaacgcagctcggaatttcggattcgcgttccttgcacgaacacagaatacaattactatatcagagttgggaacggaaagaacttacaacgtacttgcgatcctcgatttcaattccgatagaaagcgtatgtcaatcatcgttcggacaccagaaggtaatatcaagttatattgtaaaggagcagacaccgttatatatgaacgtttgcatcgaatgaatcctacgaagcaagaaacacaagacgcactagatattttcgctaatgagactttgaggaccttgtgtctctgctacaaagaaatagaggagaaggaattcactgagtggaataaaaaatttatggctgcatcggtagcaagcactaacagagacgaagccttggataaagtttatgaggaaattgaaaaggacctcatcttgttaggtgctaccgcaattgaggacaaacttcaagatggagtacctgagacaatttctaaacttgccaaggcggacataaaaatttgggtactgaccggtgataaaaaggagactgcggagaacattggatttgcatgcgagctactaactgaagacacaacaatttgctacggagaggacatcaactcattactccacgccagaatggaaaaccaacgaaatcgcggaggtgtttatgctaaatttgctccaccggtacaagaatcattcttcccgcctggtggaaatagagcgttgattataactggatcgtggctaaatgagatactcttggaaaaaaaaactaaaaggaataagatactgaaactcaaattcccacgaaccgaggaagaaagaagaatgagaacacagtcaaaacggagactggaggctaaaaaggaacagagacagaaaaattttgttgatttggcttgcgaatgttccgcagttatctgctgtagagttacaccaaaacaaaaagctatggttgttgacttggtgaaacgatataaaaaggctataactctcgcgattggagatggagcaaacgatgttaatatgattaagactgctcacatcggagttggtatttctggacaagaaggaatgcaagccgttatgtcatctgactacagcttcgcccaattccgctatttacaacgtctattattggtgcacggacgatggtcatatattagaatgtgtaagttcctccgatacttcttctataaaaacttcgcattcaccctggtacatttttggtacagctttttcaatggctatagtgcacaaacagcttacgaggattggttcatcactctctataatgttctttacacatcactgccagttcttctcatgggtttacttgatcaagacgtttcggataagctctcacttcgatttccaggactttatattgtcgggcaaagggatcttctatttaattacaaaagattcttcgttagtttgctgcacggagttctgacttccatgattctcttttttatcccgttgggagcatatcttcagacggtgggtcaggatggtgaggcaccaagtgattaccaatcattcgctgtgaccattgcgagtgctttggtcattacagttaattttcaaataggcttggacacttcgtactggacattcgttaacgctttttccatttttggatcaatcgccttatactttgggatcatgtttgatttccacagtgctggcattcatgtcctatttccatcagcctttcagttcactggaactgcttctaacgcccttaggcaaccttatatttggttaactatcattcttgctgtggctgtgtgcctgctcccagtcgttgcaatcagatttttgagtatgacaatttggccttcggaatctgataaaatccaaaaacaccgcaagcgtttaaaagccgaggaacagtggcagcgtagacaacaggttttcagacgaggagtgtcaacccgacgaagtgcctacgccttctcacatcaacgaggttatgcggacttaattagttcgggacggtcgattcgtaaaaagcgttcccccctcgacgccattgtcgcagatggtaccgccgaatatagaagaactggcgattca

SEQ ID NO: 7281 - DNA, 3753 bp, Artificial Sequence
  Description of Artificial Sequence: Synthetic coding sequence
atgtcgaccgaaagagattccgaaacgacctttgatgaggattcccagccgaacgatgaggtggtgccatattcggacgacgaaaccgaggacgaactggatgatcagggaagcgccgtggaacccgaacaaaaccgggtcaaccgcgaggcagaagagaacagagaaccgttccggaaggaatgcacttggcaagtgaaggccaacgaccggaagtaccacgaacagccgcatttcatgaataccaaattcctttgcattaaagagagcaagtatgccaacaatgccatcaagacctacaaatacaatgcattcaccttcatccctatgaacctgtttgaacagttcaagcgcgcggccaatctgtatttcctggctcttctcatcctccaagcagtgccacaaatctccactctcgcctggtatactaccctggtcccgctgctcgtcgtgctgggcgtcactgcgatcaaggatctggtggacgacgtggccagacataagatggataaggagatcaacaatcgcacctgcgaagtgatcaaagatggccggtttaaggtcgctaaatggaaagaaatccaagtgggggatgtgatcaggctcaagaagaatgatttcgtgcctgctgacatcctccttctctcctcaagcgagccgaattcgctctgctacgtcgagacggcagaactcgacggagaaaccaacctgaagttcaagatgtccctggaaatcaccgaccagtaccttcagcgcgaggatactctggctaccttcgacgggttcatcgaatgtgaagagccgaacaaccgcctggacaaattcaccggcactctcttttggcggaacacctcttttcctctcgacgcagacaaaattctgctgcggggatgcgtcatcaggaacactgacttctgccacggcctggtcatcttcgcgggggcagataccaagatcatgaaaaactccggcaagacgagattcaagagaactaaaatcgactacctcatgaattacatggtgtacactattttcgtggtccttatcctgctgtctgctggactggctattggccacgcgtactgggaggcccaggtcggcaattcgtcctggtacctctacgacggagaggatgatactccaagctatagaggttttcttatcttttgggggtacatcatcgtcctgaacactatggttcctatctccctctacgtgtcagtggaagtgatccgcctggggcagtcgcacttcatcaattgggacctgcaaatgtactacgccgagaaggataccccggcaaaggccagaactactacgctgaacgaacagctgggacagatccactacattttttcagacaagaccggaacgcttactcaaaatatcatgaccttcaagaagtgttgcatcaatggccaaatctacggcgaccaccgcgatgcatcacagcataatcacaacaagatcgaacaagtagacttctcctggaacacttacgcagatggtaagctggcattttacgatcattacctcattgagcaaatccagagcggaaaagaacccgaggtgaggcagttctttttcctgcttgcggtgtgccacactgtcatggtggaccgtactgacggccagctgaactaccaggccgcgtcaccagacgaaggagctctggtcaacgccgcgcggaacttcggattcgcgtttttggctcggactcagaacaccatcacgatcagcgagctgggaacggaaaggacctacaatgtcctggctattcttgacttcaactcagaccgcaagcgcatgagcatcatcgtgcgcaccccagaaggaaacatcaagctctactgcaagggagccgacaccgtgatttacgaaagactccatcggatgaaccctaccaaacaagaaactcaggatgcgctggacatcttcgccaatgagactttgcgcaccctgtgcctctgctacaaggagatcgaagaaaaggagttcaccgaatggaacaagaagttcatggctgcctcggtggcctccaccaatcgggatgaggctctggacaaagtctacgaggaaattgaaaaagacctcatactcctgggagcaactgccatagaggataaactgcaggacggtgtgcccgaaaccatcagcaaactggccaaggcggacatcaaaatctgggtgctgactggagacaagaaagaaaccgccgaaaacattggattcgcctgtgaattgctgaccgaggacactaccatctgttacggtgaagatatcaattcgctcctgcacgcgcgcatggagaatcagcggaacaggggaggggtgtacgccaagttcgcccctcctgtgcaggagagctttttcccgccgggaggcaacagggcgcttatcatcactggtagctggttgaacgaaatcctgctggaaaagaaaaccaagcgaaataagatcctgaagctcaaatttccgcgcactgaagaggaacggagaatgagaacccagtcaaagcgccgattggaggcgaagaaggagcaacgacagaagaatttcgtggatctggcttgcgagtgcagcgcggtcatctgttgtagagtcactccgaaacagaaagcgatggtggtggacctcgtcaagcggtacaagaaggccattaccctcgccatcggagacggcgcaaacgacgtgaacatgatcaagaccgctcatattggagtgggaatctcaggtcaggagggcatgcaggcagttatgtcgtcagactatagtttcgcccagttccggtatctgcaacggctcctgctcgttcatggacgctggtcctacattagaatgtgcaagttcctgaggtacttcttctacaaaaacttcgccttcaccctcgtccatttctggtactcattctttaacggatactccgcgcaaacggcgtacgaggattggttcatcactctgtacaacgtgctttacacctcgcttccagtgctgctgatgggactcctggaccaagatgtgtcggacaagttgtccctgaggttcccgggcctgtacattgtcggtcagagggacctcctcttcaattacaagcgcttcttcgtgtccctcctccacggagttctgactagcatgattttgttttttatcccgctgggggcgtacttgcaaacggtgggacaagacggggaggccccgagcgattaccagtccttcgccgtgactatcgcatcagcgctggtcatcactgtgaacttccagatcggactggacacctcgtactggacctttgttaatgctttttcgatctttgggtctatcgcactctacttcggaatcatgttcgacttccactcggcgggaatccacgtgttgttcccctcggcattccagttcactggcactgcctccaacgccttgcggcagccctacatctggctgactatcatcctggcagtggccgtgtgcctgttgccagtggtggccatccggtttttgtcaatgaccatttggccaagcgagagcgacaagatccaaaagcaccgcaagagactgaaggcggaagaacagtggcaacgtcgccagcaggtatttcgccggggagtgtcaacgcggcggtccgcctacgccttctcccatcaacgcggatacgctgatctgatctcgtcggggcgctcgattcgcaagaaaagatccccactcgatgctatcgtcgccgacggtaccgcagagtaccgccgaaccggcgattcg

SEQ ID NO: 7282 - DNA, 3753 bp, Artificial Sequence
  Description of Artificial Sequence: Synthetic coding sequence
atgtccacggaaagagactcggagacaactttcgatgaggacagccagcccaacgacgaagtggtgccctatagtgacgatgaaaccgaagacgaactggatgaccagggtagcgccgttgagccagaacagaatcgtgtgaaccgggaggccgaggaaaacagagagccatttcggaaagagtgcacctggcaagtcaaggcaaacgaccgcaaatatcacgagcagccgcattttatgaacacaaagtttttgtgcatcaaggaaagcaaatatgctaacaatgcaatcaagacttataaatacaacgccttcacttttatcccgatgaacctgtttgagcagtttaagcgagctgcaaacctgtattttcttgcactgctgattctgcaggccgtcccccagatctcgacattagcttggtatactaccttagtccccctgcttgtagttctgggcgtgacagccatcaaggacttggtcgacgatgtggccaggcacaagatggacaaagaaataaataaccggacctgcgaagtcataaaggatgggcgcttcaaggtggccaaatggaaggagatacaggtaggcgatgtgatccgacttaagaagaatgattttgtgcccgctgacatactcctgctgagttcatccgaaccgaattctctgtgctacgttgagacggccgagctggacggagagaccaatttaaaatttaaaatgtctcttgagatcactgaccagtacctgcagcgagaagataccctggctacattcgatggcttcattgagtgcgaggagcctaacaacaggcttgataagttcacaggcaccctgttctggaggaacacttccttcccattagatgctgacaagatcctgctgcggggctgcgtgatcagaaacacagacttctgtcacggactggtcatttttgccggtgccgacacaaagataatgaagaacagcggcaagacaaggttcaagcggacgaaaattgactacttgatgaactatatggtgtacaccatttttgtggtcctgatacttctaagcgccggcctcgcgatcggccacgcttattgggaggctcaggtgggcaacagttcttggtatctgtatgacggcgaagacgatactccatcctatcggggcttcttaatcttttggggatacataattgtgctgaatactatggtaccgatatccctctatgtaagcgtcgaggtgatcaggctgggtcagtcccattttatcaattgggatctgcagatgtactatgccgaaaaggatacccccgccaaggcccggacgaccaccttgaatgaacagctcgggcagatccactatattttcagtgacaaaacaggtacattgacacaaaatattatgacttttaaaaagtgctgcataaacggacagatttacggggaccacagggacgctagccagcacaaccacaacaaaatcgaacaggtggacttttcctggaacacttatgccgatggcaagctagcattttacgatcactacctgatcgagcagatccaatcaggaaaggagccagaagtgcgtcagttcttctttctactggcagtctgtcataccgttatggtggatcgcacagacggccagctgaactatcaggctgcgtcgcccgacgaaggcgccctagtcaatgctgcacgcaactttggatttgcgttcctggcacgcacgcagaacactatcacaatatcagagctgggcaccgagcgaacctataatgtcctcgctattctggacttcaactcagatcgtaaacgcatgagcattattgtgcggacaccagagggtaatataaaattgtattgcaaaggagctgatacagtgatatacgaacggttgcacagaatgaatcctacgaagcaggaaactcaggatgctctcgacatctttgctaacgagacgctcaggactctctgtctgtgttacaaagaaattgaagaaaaagaattcactgagtggaataaaaaatttatggcagcctctgtcgcgagcactaatagggatgaggcgttggataaagtgtacgaggagattgagaaggatctgattctacttggagctacagcgattgaagacaagctgcaggacggtgtgcccgagaccatctcaaagctggctaaggcagacatcaaaatctgggtactgaccggtgacaagaaagaaaccgcagagaatatcggatttgcttgtgagctactaacagaagatacaacaatctgctatggagaggatatcaactccttgctccacgcccgcatggagaatcagcgtaatcggggaggagtctacgcaaaattcgctccaccagtacaggaatcttttttcccaccagggggaaatagggcactgatcattacaggatcctggctgaacgaaattttgctggaaaagaaaacgaagcggaacaagatattaaagctgaaatttccgaggactgaggaagaaaggcgcatgcgtacacagtccaagcgtcgactagaggcaaagaaggagcagaggcagaagaacttcgtcgacctcgcatgcgagtgtagtgccgttatatgttgccgagtgacaccgaagcagaaagccatggtggtggatctggtgaaaaggtataagaaagccatcacactcgccattggcgacggagcgaacgatgtgaatatgattaaaacagcccacattggcgtcggcatcagcggccaggagggtatgcaggcagtgatgagtagtgactactcattcgcccaattcaggtatctgcaaagactgctcctggtgcacgggcggtggagctatatccggatgtgcaaatttctccgttattttttttacaaaaacttcgcgtttacattggttcatttttggtacagctttttcaacggctactcagctcagactgcttatgaggactggtttatcactctttacaatgtgctgtacacttccttgcctgtactccttatgggtcttctggaccaagacgtttctgacaaactgagtttacggttccctggcctttacatagtcggccagcgcgatctcctattcaactataagagatttttcgtgtccctccttcacggggtgcttacatcaatgatcctgttttttattcccctcggagcctatctgcaaacagtggggcaagacggagaggccccttctgactaccagtcgtttgcagttacaatagcaagtgcattagtaataacagtgaatttccaaatcggtctggatacatcttactggactttcgtgaacgcattttccatcttcggatctatcgctctttacttcgggatcatgttcgacttccactctgctggcatacatgtgttatttccaagcgcctttcagttcactgggacagcctccaatgcgttgcgacagccatacatctggttaacaatcattctcgccgtggccgtttgcctgcttccagtggtggccataaggtttttaagtatgaccatatggccctccgagagcgataagatacagaaacaccgaaaaagactgaaggctgaagagcagtggcagagaaggcaacaggtttttcggcggggagtatccactagacgctctgcctacgcatttagtcatcagcgcggttacgctgacctgatctcatcagggagaagtatcagaaaaaagcggagccccctggatgccattgtggccgatgggactgcagaatacagacggacaggtgactca

SEQ ID NO: 7283 - DNA, 3753 bp, Artificial Sequence
  Description of Artificial Sequence: Synthetic coding sequence
atgtcaaccgagcgcgatagcgaaacaacctttgacgaggattctcagcccaatgatgaagttgtgccttacagtgatgatgagactgaggatgaactggatgaccaaggctctgcagtcgaaccagagcaaaacagggtcaatagagaggccgaagaaaatcgcgaacccttcaggaaggaatgtacctggcaggtgaaggcaaacgatcggaagtaccacgaacagccacattttatgaacacgaagtttctgtgtatcaaggagtccaaatatgctaataatgcaattaaaacttacaagtacaatgcctttacttttattcctatgaacctttttgagcaattcaagagagcggctaatttatatttcttggctctgctgatactccaggccgtccctcagattagcacattggcctggtataccacgttagtccctctgctggtcgttctaggagtgaccgcgatcaaggaccttgtggatgatgtggcgagacacaaaatggacaaggagatcaacaatcgtacttgcgaagttatcaaggacggtcgctttaaagttgcaaagtggaaggagatccaggtcggggacgtcataagactcaaaaaaaatgatttcgtaccagcagatatccttctgttgtcgagtagtgagcccaattcactgtgttacgtggagacagcagagctcgacggagaaaccaacctcaagtttaagatgtccctggaaattactgaccagtaccttcaacgggaggacacgcttgccacattcgatggttttattgagtgcgaagagccaaataatcgcctggataagttcacaggcactcttttctggaggaacacgagctttcccctcgatgcggacaagatactcttgcggggctgtgtgatccgaaataccgacttttgtcacggactcgtgatttttgccggcgccgacacaaagatcatgaagaactctggtaaaactcggttcaagcggaccaagattgactacctcatgaactacatggtctatactatcttcgtggttcttatcctactgtctgcaggattggccatcggacacgcatactgggaggcgcaggtagggaattcctcttggtacctctatgacggagaagatgatactcccagctaccgcggttttctcattttttggggctacatcattgtactgaatactatggtgccgatctccctgtacgtgtctgtggaggtcattaggctgggacagagccatttcattaactgggatctgcaaatgtattatgcagagaaagatacaccagctaaggctcgcactacgaccctaaacgaacagcttggccagatccactatatcttctcagacaagacgggcactctgacacagaatattatgactttcaaaaaatgttgcattaacggacagatttacggagatcaccgggacgcctcccaacacaaccacaacaaaattgaacaagttgatttcagctggaacacatatgccgatggtaaactcgccttttacgaccattacttaattgagcagatacagagtgggaaggagcctgaggtgcggcagttcttcttcctgctcgccgtatgccacactgtaatggtggaccggactgacgggcagctcaactatcaggcagcatcaccggatgaaggggcactcgtgaacgctgctcgtaactttggattcgctttcctggctagaacccagaatactattacaatctcagaattagggaccgaaaggacatacaacgtgttggccatcctggactttaacagtgaccgaaagcggatgagtatcatcgtacgaaccccggagggaaacatcaagttgtattgtaaaggggcagatactgtgatttacgaacgattgcatcgtatgaaccccaccaaacaggaaacccaagacgccctggacatcttcgcgaatgaaacattgagaactctatgcctgtgttacaaagagatcgaggagaaagaattcaccgagtggaataagaagtttatggcggcctcagttgcctctaccaaccgggatgaggctctggataaagtttatgaggaaattgagaaggatttaatccttttaggcgctaccgcaattgaggataaattgcaggacggggtgcccgaaactatctccaagctggctaaagccgacatcaagatctgggtgcttaccggtgacaagaaggagacggccgaaaacatcggattcgcttgtgaactcctgaccgaggacaccacgatatgttatggagaggatatcaactctctcttgcacgcgagaatggaaaaccaacggaacaggggcggtgtgtacgccaagttcgctccacctgtccaggagtcctttttccccccaggcggaaacagggcgctgatcatcacaggaagctggttgaacgagatccttcttgagaaaaaaacgaaacggaataaaatcctaaaattaaagtttcctcggacagaggaagaacgaaggatgcggactcaatccaaaagacgcctggaggcgaaaaaggagcagcgccaaaaaaactttgttgacctagcgtgtgagtgctctgcagtgatctgttgtcgcgtcacccccaagcagaaggctatggtcgtcgacctggtgaagcgctacaagaaggccatcactcttgcaatcggagatggagccaacgatgtcaacatgataaaaactgcccacatcggggtaggtatctctggccaggagggcatgcaggctgtcatgagcagcgattattcttttgcccagtttcggtatctgcagcgcctgctgctggttcacggacggtggtcttacatccggatgtgcaaattcctacgatattttttctataagaacttcgcctttaccctcgtacatttctggtacagtttctttaatggctattccgcacaaacagcatatgaggactggtttatcaccctctataatgtcctgtacacgtctctgccagtgctgctgatgggacttttggaccaggatgtgagcgataaactgtcattgagattcccggggttatacatcgtgggccagcgggacctactttttaactacaagaggttttttgtgagtttactgcatggtgtgcttacgtcgatgattctcttttttattccattgggggcgtatctacagaccgtaggacaggacggggaagccccctctgactaccagagcttcgccgtcacgatcgcgagcgccctggttattactgtaaacttccaaattggacttgatacctcttactggacatttgtgaacgctttttcaatctttgggtctattgccctttacttcggcataatgtttgacttccattctgccggcatccacgtactgttcccaagcgcatttcagttcaccggaaccgccagtaacgcactgcggcagccgtatatttggctcaccataatcttggccgtggcagtgtgcctgcttccagtggttgctatccgctttctcagcatgactatatggccttccgagtctgacaagattcagaaacatcgaaaacggctgaaggccgaggagcagtggcagcgcaggcagcaagtgttcagacgaggcgtgtcaactcggaggtcagcttacgccttttctcatcagaggggttatgccgatttgatctcttccggaaggtcgataagaaaaaagcggtctcctctagacgcaatcgtggccgacggtacggctgaataccgtcggacaggcgacagc

SEQ ID NO: 7284 - DNA, 3753 bp, Artificial Sequence
  Description of Artificial Sequence: Synthetic coding sequence
atgtctacggagagggattctgagaccaccttcgacgaagactcgcaaccgaatgacgaggtcgtgccatactcagacgatgagaccgaggatgagctcgacgaccaagggtctgcagtcgaacccgagcaaaatagggtaaatagagaggctgaggagaaccgcgagccatttagaaaggagtgtacttggcaggtcaaagcaaatgataggaaataccatgaacaaccacactttatgaacacaaagtttctctgcattaaggagtctaagtatgccaataacgccatcaaaacgtacaagtataatgccttcacctttattcctatgaacttgttcgagcagtttaagagagctgctaatctctactttttagcactgctcattctgcaggccgtaccccagataagtaccctggcgtggtacacaaccttggtgcccttgctggtcgtgctaggcgttacagcaatcaaggacctggtcgatgacgtggccaggcataagatggacaaggaaatcaacaaccgcacttgtgaagtcattaaggacggccgctttaaagtggctaaatggaaagaaatccaggtgggggacgttattcgtctaaagaagaatgattttgtgcccgcagacatccttctcttgagttcatcagaacccaattccctgtgttatgtcgaaaccgccgaactagatggcgagaccaatcttaaattcaaaatgtccttggagatcacagatcaatatttgcaacgggaagacacccttgctacattcgatggttttattgagtgtgaagagccgaataacagactggacaaatttaccgggaccttgttctggaggaacacatcctttcctttggatgctgataaaattctcctcaggggctgtgttattaggaataccgatttctgccacggtctggtcatctttgccggagctgataccaaaattatgaaaaacagcggaaaaacgaggttcaagcgtaccaagatagattacttgatgaactacatggtctacacaatctttgtggtcttgattcttctgtcagccgggctggctattgggcatgcctattgggaggcccaggtgggcaacagttcttggtacctttatgatggggaggacgacacgccctcatatcgagggttcctgattttctgggggtatatcatagttctgaacactatggtaccaatctccctgtacgtcagtgttgaagtcattaggctgggacaatcccatttcatcaattgggatttgcagatgtattatgcggagaaagatactccagccaaggccaggacaacaactctgaacgaacaattggggcagattcattacatcttttctgataaaacaggtacccttacccagaatatcatgacctttaaaaagtgctgcattaatgggcagatatatggcgatcatagggatgctagtcagcacaaccataacaaaatagaacaggttgatttctcgtggaacacttacgctgatggaaaattggctttctacgaccattatctgattgaacagatccagagcggaaaagagcccgaggtaaggcaattctttttcctgctagccgtgtgtcacaccgtgatggtggatagaactgacggccagctgaattatcaggctgccagtcctgatgaaggggccctcgtgaatgcagcgcggaattttgggtttgctttcttggccagaactcagaacactatcactatcagtgaactggggacagagcggacctataacgtcctcgcaatattagatttcaattccgatcgcaagcgcatgagcatcatcgtgcggactccagaagggaacattaaactatattgcaagggggcagatacagtcatatatgagagactgcacaggatgaaccccacgaaacaggagacccaggacgcattggatatctttgccaatgagacccttaggacgctctgtctatgctacaaggagattgaggagaaggaattcacagagtggaacaaaaaatttatggccgcttctgtcgcaagtaccaatcgggacgaggccttagacaaggtgtatgaggaaattgaaaaggacttaatcttgttgggcgcaactgctatagaggataaacttcaggacggcgtacccgagacaattagcaagcttgctaaagccgacatcaagatctgggtgctgaccggcgataaaaaagagactgctgagaatataggcttcgcgtgcgagctgctgacagaggacacgacaatctgctatggcgaagatattaacagtctcttacacgcgcgtatggaaaaccagcgaaaccgtggcggcgtctatgcgaaattcgctcccccggttcaggaatctttttttccaccgggcggcaatagagccctgattattacaggaagctggctcaacgaaattctgttggaaaagaagacgaagagaaacaaaatcctcaaactgaagttcccaagaacagaagaagagcgcagaatgaggactcagtctaagcggcgccttgaggcgaagaaggaacagcgtcagaagaacttcgtggatctcgcatgcgaatgtagtgccgtgatatgttgccgcgtgactccaaaacagaaagccatggtggtcgatctggttaagcgctacaagaaggctattaccctggctattggagacggagcaaatgacgtgaatatgattaagaccgcgcatatcggggtgggtatcagcggacaggagggaatgcaggctgttatgtctagcgattactcttttgctcagttccgctacctccagcgactcttgcttgtgcacggccgttggtcgtacattcgtatgtgcaaatttcttcgctacttcttttacaaaaactttgcgtttacactggtccacttctggtactcattttttaatggctatagcgcgcaaacagcctatgaggattggtttatcaccctgtacaatgtgctctacacttcattgcctgttctgctcatgggccttctcgatcaggacgtctcggataaactctccctacgctttcctggtctgtacattgtaggccaaagggacctgcttttcaactacaaaaggttcttcgtgagcttgctgcacggtgttctcacctcaatgatcctgttttttatacctctgggcgcatacctgcaaacagtgggccaagatggggaggccccctctgattaccaatccttcgctgttacaattgcttccgcgctggtgatcaccgttaactttcagattgggctcgacacctcatactggactttcgtcaacgcattctctatttttggatccatcgctctgtattttggcattatgttcgattttcattcagcagggattcacgtgctgttcccatctgcgtttcagttcactggtaccgcttccaacgcactacggcaaccatacatttggcttactatcatcctcgccgttgccgtctgtctgctgcctgtggttgcaatacggtttttgagcatgacaatttggccaagcgagagcgacaaaattcagaaacaccgcaaacgactgaaagccgaagagcagtggcagaggcgtcagcaggtttttaggagaggtgtatccacacgaaggtctgcctacgctttcagccaccagcgggggtatgctgacctcatctcctctgggaggtcaatcaggaaaaagaggtctccactggacgctatcgtggcggacggcacagcagagtaccggcgcacaggagactcc

SEQ ID NO: 7285 - DNA, 3753 bp, Artificial Sequence
  Description of Artificial Sequence: Synthetic coding sequence
atgtcgaccgaacgcgattcagaaaccactttcgacgaggactcccagccgaacgatgaggtcgtcccgtacagcgacgatgaaaccgaagatgagctggatgatcagggatcggctgtggagccggagcagaatagggtgaacagagaagcagaggaaaaccgcgagccgttcagaaaggaatgtacgtggcaagtgaaagcgaatgacagaaagtaccatgaacagccgcatttcatgaacactaagttcctgtgcatcaaagagtcaaagtacgctaacaatgccatcaagacctacaaatacaatgcgttcactttcatccctatgaatcttttcgaacaattcaaaagagccgccaacctgtactttctggccctgctgattttgcaagccgttccgcagatctcgacgctggcatggtacaccacgctggttccgctcctcgtggtgctgggagtgacggccatcaaggacctcgtcgacgacgtggcacgccataagatggacaaagagattaacaacagaacctgtgaagtcattaaagacggaaggttcaaggtggccaagtggaaagagatacaggtgggcgacgtgatccgcttgaaaaagaatgattttgttcccgccgacatcctgctcctcagctcatcggaaccaaacagcctctgctacgtggaaaccgcagaactggacggagagactaacttgaagttcaagatgtcattggagatcactgaccaatacctccaaagagaagatacgctcgccaccttcgacggctttatcgagtgcgaagaaccgaacaaccggcttgacaagtttactggaacgctgttctggaggaacacttccttcccgctcgatgctgacaagatcctcctgcggggatgtgtgatccgcaacactgatttctgtcacggcttggtgatcttcgcgggtgctgacactaagatcatgaagaattcgggaaagacccggttcaaacggaccaagatcgactacctgatgaactacatggtctacaccattttcgtcgtgctcattctgctcagtgcgggactggccattggacacgcctactgggaagcccaagtcgggaacagcagctggtacctctacgatggcgaagatgatactccatcgtacagaggatttctgatcttttggggatacattatcgtgctcaacaccatggtcccgatctcgctgtatgtctccgtggaagtcatccggttgggacaaagccacttcatcaactgggacctgcaaatgtactatgcggagaaggacactccggcaaaagcccggaccaccaccctgaacgaacagctggggcagatccactacattttctcggataaaacgggaactttgactcagaatatcatgactttcaagaaatgctgcatcaacggacagatttacggagatcatcgggacgcatcacagcacaatcacaacaaaatcgagcaggtggacttcagctggaatacttatgcagacggcaaactcgcattttacgatcattacctcatcgaacagatccaatcagggaaggagccggaggtgcggcaattctttttcctgcttgcggtctgccacactgtgatggtggaccggaccgacggccaactgaactaccaagccgcatccccagatgaaggagccctggtcaatgctgcgcgcaatttcggattcgccttcctcgccagaacccaaaataccatcaccatctctgaattgggaaccgaacggacctacaatgtgctggctatcttggacttcaattcggaccggaagagaatgagcataattgtgcggacccctgagggcaacatcaagctctactgcaaaggagcagacactgtgatttacgaacggctccaccggatgaaccccacgaagcaagaaactcaggacgccctggacatctttgccaacgaaaccctcagaaccctgtgtctctgctacaaggagatagaagagaaggaattcactgaatggaacaaaaagttcatggccgcatcggtcgcgtctactaaccgcgatgaagccttggacaaagtgtacgaagagatcgagaaggacctgatcctgctgggtgcgactgcgatcgaagataaacttcaggatggagtgcccgagactatttcgaagctggccaaggcggacatcaaaatctgggtgctgaccggcgataagaaggaaaccgcggaaaacatcgggttcgcctgcgaactgctgaccgaagataccacgatctgctacggagaggacatcaacagcctgctgcacgcgagaatggaaaaccagcgaaatagagggggagtctacgcaaagtttgcgcctccggtccaggaatcctttttcccaccggggggcaatagagccctgatcatcaccggaagctggctcaacgagatcctgctggaaaagaaaacgaagcgcaacaagatcctgaaacttaagttccctcgcaccgaagaagagagaagaatgagaactcagtcaaagcgccggctcgaagccaaaaaggagcaaagacagaagaatttcgtggacttggcgtgcgaatgctcggcagtgatctgttgccgcgtgacccctaagcagaaggccatggtcgttgatttggtgaagagatataagaaggccattactctggccataggagacggagcgaacgacgtgaacatgatcaagactgcgcacatcggagtgggaatttcgggacaggaggggatgcaagcagtgatgtcatcagactacagcttcgcgcagttccgatacctccagcgcctgctgctggtgcacggaagatggagctacatcaggatgtgcaaattcctgcggtacttcttctacaagaattttgccttcaccttggtgcacttctggtacagttttttcaacggatactcggcacagaccgcctacgaagattggttcattactctgtacaacgtgctttacacttcactgcctgtgctgctgatgggactgttggatcaggacgtgagcgataagctgtcccttcggttcccggggctctacattgtgggccagagggatctcctgttcaattacaaaaggttcttcgtgtcgctgctgcatggtgtccttacctccatgattcttttctttatcccgctgggcgcgtaccttcagaccgtgggacaagatggagaggcaccttcagattaccaatccttcgcggttactattgcgtcggctctggtcatcactgtgaatttccagatcggacttgacacctcctactggacttttgtcaacgctttctcaatctttggatcaatagccttgtattttggcatcatgtttgacttccactcagctggcattcacgtcctttttccctctgccttccagtttacgggcactgctagcaacgccctcagacagccctatatctggctgaccatcattctggccgtcgcggtctgcctcttgccggtggtcgcgatccgcttcctctcgatgactatatggccgtccgagtccgacaaaatccagaagcaccgcaagcggctcaaggccgaggaacagtggcagcgacgccaacaggtctttcgcagaggggtgagcacgcgccgctctgcttacgcattctcacaccagcgcggatacgctgacttgatttcgtccgggaggtcgatccgcaagaagagatcgccactggacgcaatcgtggcggacggaaccgccgagtatcggcgtaccggagactcc

SEQ ID NO: 7286 - DNA, 3753 bp, Artificial Sequence
  Description of Artificial Sequence: Synthetic coding sequence
atgtcgacggaacgcgattccgaaacgacctttgatgaggactcacaacctaacgatgaggttgtgccatactctgatgatgaaaccgaggatgaactggacgatcaaggctcggcggtggagccggagcagaaccgggtgaacagagaagcagaggagaaccgcgaaccatttcgcaaggaatgtacttggcaggtgaaggcaaacgatagaaaataccacgaacaaccgcatttcatgaatactaagtttctgtgcattaaggaatccaagtacgcaaacaacgctattaagacttacaagtacaatgcattcacctttatcccaatgaacctctttgagcagtttaagcgagcagctaatctttacttcctggcccttcttatccttcaagcagtgccccagatttcaactctcgcatggtacacgactcttgttcctctcctggtcgtgctcggtgtgacggctatcaaagaccttgtcgatgatgtggcaagacacaagatggacaaggaaatcaacaaccggacttgtgaagtgattaaggatggcagatttaaggtggccaaatggaaggagattcaggtgggtgacgtgattcgattgaagaagaacgattttgtccctgcagatattctgctgctttcgtcctcggaacctaattccctgtgctacgtggaaactgcagaattggatggtgaaaccaacctgaagttcaaaatgtcacttgaaattactgaccaatacctccagcgagaagataccctggctacctttgatggcttcattgaatgtgaggagccaaacaacagacttgataagtttactggaactcttttctggagaaacacgtcatttcccctggacgcagataagattcttctgagaggatgtgtgatcagaaacacggatttttgtcatggacttgtgatatttgctggcgccgacaccaagattatgaagaactccggaaagactagattcaaaagaaccaagatagactaccttatgaactacatggtttacaccattttcgtcgtgttgatattgctctcagcaggtctggcgattgggcatgcctactgggaagcccaggtcggtaactccagctggtacctgtacgatggtgaggatgatacccctagctatagaggctttctgatcttttggggatacataatcgtgctgaacactatggtgcccatttcactttacgtctcagtggaagtgattcggctgggacaaagccatttcataaactgggatctccaaatgtactacgcagaaaaggatacccccgccaaagcgaggaccaccaccctgaacgagcagctcggtcaaattcactacatattcagtgataagaccggtactttgacccagaatatcatgaccttcaagaagtgctgcattaatggtcagatttacggagatcatagagatgcctctcaacataaccataacaagattgaacaggtcgacttttcgtggaatacttacgctgatggcaaacttgcgttttacgatcactaccttatcgagcaaatccagagtggaaaagaacccgaggtgcggcagttcttttttctgctcgctgtgtgccacaccgtgatggtggaccggaccgatggacaacttaactaccaagccgcgtccccagatgaaggagcacttgtgaatgcggctcgtaatttcggattcgcatttctcgcacggacgcaaaacactattaccatctcggaacttggtaccgagaggacttacaacgtcctcgccatcttggactttaactcggatcgtaagcgcatgtcaattatcgtgcggactcctgaaggtaacataaagctgtactgcaagggagcagatactgttatctacgaacgcctgcaccgcatgaaccctaccaaacaggaaacccaggatgcgcttgacatatttgcaaatgaaaccttgagaacgctttgcctttgttacaaagaaatcgaggaaaaggaatttaccgaatggaataagaagtttatggcagcaagcgttgcatctaccaaccgggatgaggcgcttgacaaggtgtacgaggaaatcgaaaaggacctgatacttctgggcgcgaccgctatcgaagataagttgcaggatggtgtccctgaaactatctcaaagctggcgaaagcagacattaagatctgggtgctcaccggagataagaaggagactgcagaaaacattggatttgcatgcgaactcctgaccgaggacactacgatctgctacggtgaagatatcaactcgctgctgcatgcacgaatggaaaatcagcggaaccggggaggcgtctacgcaaagtttgcgccaccagtccaagaatctttctttccccctggaggtaatcgcgcgttgataatcactggatcctggcttaatgaaattctccttgagaagaaaactaaaaggaacaagatccttaagctgaaatttccaaggaccgaagaggaacgcagaatgagaactcaatcaaaacggcgacttgaagcaaagaaggaacagcggcaaaagaactttgtggaccttgcatgtgaatgttccgcagtcatttgttgtcgcgtcactcccaagcaaaaagctatggtggtcgatctggtcaagagatacaagaaggcaatcaccctcgcgatcggagatggggctaacgacgtgaacatgatcaaaactgcgcatattggcgtggggatttcaggacaagaaggcatgcaggccgtgatgtcatcggactacagcttcgctcagttccggtacctccagcgtctgctgctggtccatgggcgatggtcatatatccgtatgtgtaagttcctgcgatactttttctacaagaacttcgcctttacccttgtgcatttttggtattcctttttcaatggttactcggcccaaaccgcatacgaggattggttcatcactctgtacaacgtgctttacacctcgcttcctgtccttctcatgggtctgctggaccaagatgtgagcgataagctctctttgcggtttcctggattgtacattgtcggacagagggatttgctctttaactacaagcggttttttgtgtcgcttctgcatggagtgctcaccagcatgatccttttctttatcccgcttggtgcatacctgcaaaccgtgggtcaagatggcgaagctccatcggattaccagtcgtttgcagtgaccattgcatccgcacttgtgatcactgtgaatttccaaataggacttgacacttcctactggaccttcgtaaacgcattctccatcttcggctccatcgcactctactttggtattatgtttgattttcattcagccgggattcatgtcctgttcccctccgcatttcagtttactggtactgcatcaaatgccctgcgccagccctacatctggttgactattatccttgccgtcgcggtgtgtctgttgcctgtggtggctattcggttcctgagcatgaccatatggccctcggaatccgataagattcagaagcatcggaagcggctgaaagcagaagagcagtggcagaggcgccaacaggtgtttcgcagaggtgtgagcacgcgccgctcagcttatgcattcagccaccagcgtggctacgcggacctgatttcatccgggcggtcgattcgtaagaaacggagccctttggatgccatcgtcgcagatgggactgcagagtatcgtagaactggcgatagc

SEQ ID NO: 7287 - DNA, 3753 bp, Artificial Sequence
  Description of Artificial Sequence: Synthetic coding sequence
atgagtacagagcgcgacagcgagaccacctttgatgaggattctcagcctaacgatgaagtcgtcccctactctgatgacgagaccgaggatgagctggacgatcaaggcagtgccgtggaacctgaacagaatcgtgttaatcgggaggcagaagaaaaccgcgaaccattccgcaaagagtgtacatggcaggtgaaggcgaacgacaggaagtaccacgagcagccgcattttatgaataccaaattcctgtgcatcaaggagtctaagtatgccaataacgcaataaaaacctataagtataatgcgttcacttttattcccatgaatctgttcgagcagttcaaacgcgccgctaacttgtacttcctagccctgttgattttacaagctgtccctcagattagcactctggcctggtacactacactcgtgcccctgctggtcgttctgggagtgactgcgatcaaagatctggttgacgacgtagcccgccacaaaatggacaaggaaataaacaaccgcacctgcgaggttatcaaggatggaaggtttaaagtggcgaaatggaaggaaatccaggtcggagatgtaattagactgaagaagaacgatttcgtgcctgctgatatcctcctcttgtcttcgagcgaaccgaactccctttgctacgtagaaacggccgaacttgatggggagacaaacctgaagttcaagatgagcctggaaataaccgatcagtatctgcagagggaggacactctggcaacctttgacgggttcatagagtgcgaagaacccaataacaggctggataaattcactgggactttgttctggcgcaatacatcatttcccctggacgcggacaaaattcttctgaggggctgcgttattcgcaacaccgacttctgccatgggctggtgatcttcgccggggccgatacaaagattatgaagaatagcggaaaaactcgcttcaagcggaccaagatcgattacctaatgaattacatggtgtatacaatctttgtggtcttgatactgctgtccgccggcctggccatcggccatgcttactgggaggcacaagtggggaacagcagctggtacctatacgacggtgaggacgacactcccagctatagagggttcctgatcttctggggatacattatcgtgctcaacacaatggttccgatttccctttacgtaagcgtcgaggtcatccgcttaggccagtcacattttattaattgggaccttcagatgtactatgcggaaaaagacacacccgccaaggcccgcacaaccaccctcaacgagcaactgggacagattcattacattttcagcgacaagaccggcactctcacccagaatattatgacgttcaagaaatgttgcataaatggtcaaatatatggtgatcatagagacgcgtcccagcacaaccacaataagatcgagcaggtagacttctcctggaacacatatgccgatggtaagctagctttttacgatcattatctaattgagcagatacagtcggggaaggagccagaagttcggcagttttttttccttctggccgtgtgtcacactgtgatggtcgataggacagatgggcagcttaattaccaggccgcctcaccggatgagggggccctggtgaatgctgctagaaacttcggcttcgccttcctggctcggacccagaatacgatcaccatctccgagctcggcacagagcggacctataatgttcttgccatcctcgatttcaacagcgaccggaagaggatgtccataatcgtgagaacccctgagggcaacattaaactctattgtaaaggcgctgataccgtaatttacgaacgcctgcaccgcatgaaccctactaagcaggaaacgcaggatgctctggatatctttgccaacgagaccctccgtaccctgtgtctgtgctataaggaaatcgaagagaaagagttcaccgagtggaataagaagttcatggctgcgagcgtggcatccacaaacagggacgaggccctcgacaaggtctacgaagaaattgagaaggacctaatactgctgggcgccacagccattgaggacaaacttcaggacggagtaccagagaccatcagtaagctcgccaaggcagacatcaagatctgggttttgaccggggacaagaaggaaacggccgagaatatcgggttcgcgtgtgaattgctcaccgaagatactacaatctgttacggtgaagacattaacagtctgcttcatgcaagaatggagaaccaacgcaacagaggtggcgtgtacgccaaatttgctccaccagtgcaggagagctttttccctcctgggggcaatagggccctgatcattacgggatcttggctaaatgagattctcctggagaagaagactaagaggaacaagatccttaagcttaagttcccccgaactgaagaagagcgtcgcatgcgaacacagtcgaagcgtcgactagaggccaagaaagagcagcggcagaaaaactttgttgatctggcctgtgaatgttccgccgtgatctgctgtcgagttacccccaagcaaaaggccatggtcgtggatctggtgaagagatataaaaaagccattaccctggccataggagacggcgcgaatgacgtcaacatgattaagaccgcccacatcggcgttgggatatccggtcaggaggggatgcaggccgtgatgtctagcgattattcgttcgcccagttccgctatttgcagcgtctgttattagtgcatggaagatggtcgtatatacgaatgtgtaagttcctaaggtactttttttataaaaactttgcctttacactagtgcatttctggtacagcttcttcaacggatatagcgcacagactgcgtacgaggactggttcatcacgctgtataacgttttgtacacatctttaccagtcttgttgatggggctgttggatcaggatgtgtctgacaaactttcacttcggttcccgggtctctacatcgtaggacagagagacctgctgttcaactataagcggttctttgtctccttactgcatggagtgctgaccagcatgattctcttcttcatccccctgggtgcctacctgcagactgtcggacaggacggggaagccccctccgactaccagtcttttgcggttaccatagcgtccgctctggtgatcactgtgaactttcagattggtctggacacatcttattggactttcgtcaacgcctttagtatcttcgggagtatagccctgtattttggcattatgttcgattttcatagcgcgggcatccatgtgcttttcccatcagccttccagttcacgggcaccgcatctaacgcccttagacagccatacatctggctcacaattattctagccgtggccgtttgcctgctccctgtagtcgctataaggtttctatctatgacaatatggccctcagaatctgataagattcagaaacaccgaaagagactcaaagccgaagagcagtggcagcgaagacaacaggtcttcaggaggggcgtgtccacgcgacgctcggcttatgctttcagccaccagcgggggtacgctgacctgatttcctccggtcgctcgatccgcaaaaagcgctccccacttgatgcaatcgtggccgatgggaccgccgagtatagaaggaccggtgattcc

SEQ ID NO: 7288 - DNA, 3753 bp, Artificial Sequence
  Description of Artificial Sequence: Synthetic coding sequence
atgtccacggagcgggacagcgagactacatttgatgaagacagtcaaccaaatgacgaggtggtaccttactcagatgacgaaacagaggacgagctcgatgatcaagggtccgcagtcgaacctgagcaaaacagagtgaacagagaagcggaggaaaatagggagccatttagaaaggaatgcacttggcaggtgaaagcaaacgaccggaaataccacgagcaacctcatttcatgaatacaaagtttctgtgcatcaaagagtccaaatatgctaacaacgcaattaaaacctataaatataatgcctttacctttatacccatgaacctgttcgaacaatttaagagagccgccaatctctacttcctcgccctgctgatccttcaagcagttccccaaatctccacccttgcttggtacactacccttgtacccctgctggtggtcctcggcgtgactgccattaaagacttggtggacgatgtcgctcgccataaaatggacaaagagatcaacaataggacatgcgaagtgataaaggacggaaggttcaaagtggccaaatggaaggaaatccaggttggggatgttatcaggttgaagaagaacgattttgttccggcagatatcttgctgctcagcagctcagagcctaatagcctttgttatgtggagactgccgagctggacggcgagaccaatctgaaattcaagatgagcctcgaaattaccgaccaatatttgcagagagaagacacactggccactttcgacggattcatcgaatgcgaagagccaaacaacaggctggacaaatttaccggcacattgttttggcgcaacacaagcttcccactcgacgctgacaagattttgctccgggggtgcgttatccggaacacggacttttgccatggtctcgtgatattcgccggagccgacactaaaatcatgaaaaatagtggcaaaacacggttcaagaggactaagatcgactacctgatgaactatatggtgtacactatcttcgtggtgctgatcctcctgtccgccgggctggccatcggtcacgcatactgggaagcacaggtggggaactccagttggtatttgtacgatggcgaggacgacaccccctcttatcgcggtttcctcatcttttgggggtacatcatcgtgctcaacaccatggtgccgatctccttgtatgtgtctgtggaggtgatcagactcggacaatcccatttcattaactgggacttgcagatgtactacgcagaaaaggacactcctgctaaggctagaacaactacacttaatgaacagttggggcagatccactatatctttagtgataagaccggaactctgactcagaatataatgacctttaaaaagtgttgtattaacggccagatatacggagaccaccgagatgcaagccaacacaatcacaataagatcgagcaggtggacttcagctggaatacttatgccgacgggaaactggcattctatgatcattacctgattgaacaaatccaaagcggtaaggaaccagaagtgagacagttcttttttctgcttgcggtatgtcacaccgtaatggtcgacaggaccgacgggcaattgaattaccaggcggccagtccagacgaaggtgcactcgtaaatgccgctcggaacttcggctttgcctttctggctcgcacccaaaataccatcacgatcagtgagctcggaactgaacgaacgtacaacgtactggccattctggactttaattccgacagaaaaagaatgagtattatcgtcaggacccctgagggcaacatcaagttgtattgcaagggcgctgacaccgttatttacgagcgcctccaccgaatgaaccctactaagcaagagactcaagatgcgcttgatatatttgccaatgaaaccctcaggacactgtgtctttgctacaaagaaattgaggaaaaagagttcactgagtggaataaaaagttcatggcggccagcgtcgcttccacaaaccgagacgaagccctggataaggtttacgaagaaatcgaaaaagatttgatcctgctgggcgccactgcgatcgaggataaacttcaggacggcgttcctgagactatttcaaagctggctaaggctgatattaaaatttgggttttgaccggagataagaaagagaccgccgaaaacatcggttttgcgtgtgagctgctcaccgaggatacgactatatgctatggtgaagacattaactcactgctccatgctcggatggagaaccagagaaacagaggcggcgtctatgccaagtttgctccaccggtgcaggaatcattcttccccccaggtgggaatcgcgctctcattattaccggttcttggttgaacgaaattctcctcgagaagaagaccaagaggaataaaatacttaagctgaagttcccccgcaccgaagaagaaagaaggatgagaacccagtcaaaaaggagactggaagctaagaaggagcagcgccagaaaaacttcgtagatcttgcatgtgagtgttctgccgtgatttgctgtagagtgacaccgaagcagaaagccatggtggtggatttggtgaagcgctacaagaaggctataaccctcgccatcggcgatggcgcgaatgatgtgaatatgattaagaccgcacacatcggagtaggcatcagcggtcaggagggcatgcaggctgtaatgagcagtgattattcattcgcacagtttcggtacctgcaacggctccttttggtccatggtaggtggtcttatatccggatgtgcaaattcctgagatacttcttctacaagaattttgctttcacccttgtgcacttttggtatagtttcttcaacggctatagtgctcaaaccgcttatgaggattggttcatcactctgtacaacgtgctgtacacttccctccccgtactgctgatgggcctgctggatcaggatgtcagcgacaaactgagcctgagatttccaggcctgtacatcgtcggacagcgcgatctgctgttcaattacaaacgcttctttgtcagcctgctccatggagtcctgacatctatgattctgttcttcatacccctgggtgcttacctgcagactgtggggcaggacggtgaggcccccagcgactaccagagcttcgccgtcaccatagcttctgccctggttatcactgtcaactttcagattggactcgacacatcttattggacttttgtgaatgcatttagtatcttcgggtccattgcgctgtattttgggatcatgttcgacttccattcagcaggtatccacgtgctgtttccttcagcttttcagtttacaggaaccgcgagtaacgctctgcgccagccatacatttggctcacgatcattcttgccgtggcagtgtgcctgctgcccgttgtcgcgatcaggttcttgtctatgactatctggccctccgaatctgacaagatccaaaagcacaggaagcgactgaaagccgaggagcagtggcaacggcgccagcaggtgtttcgcaggggggtaagcaccagaaggtccgcatacgccttctcacatcaaagagggtacgccgaccttataagcagcgggcgcagcatacggaagaaaagaagccctttggatgcgattgtggcagatggcacagcagagtaccggagaactggcgattca

SEQ ID NO: 7289 - DNA, 3753 bp, Artificial Sequence
  Description of Artificial Sequence: Synthetic coding sequence
atgagtactgagcgggacagcgagactaccttcgacgaggactctcagcctaatgacgaagtggtgccatactcagatgatgagaccgaggacgagctggatgatcagggcagtgctgtcgagcccgagcagaatagggtcaatagggaggccgaagaaaaccgggagccctttcggaaagagtgcacctggcaggtcaaggctaacgacagaaagtaccacgagcaaccacactttatgaacacgaaatttttgtgtattaaggagtctaagtatgcaaataacgcaattaaaacttacaagtacaatgctttcacatttatccccatgaacctgtttgaacaatttaaacgggcggcgaacctgtatttcctggccctcttgatcctgcaggcagttccccagatctcgactctcgcttggtatacgacgctcgtacccctgctggtggttctgggcgtcacagcaattaaggatttagtggacgatgtggctcgccataaaatggacaaagagataaataaccgaacctgtgaggttatcaaggatggacgatttaaagtggcgaagtggaaagaaatccaggtcggagacgtcattaggcttaagaagaacgactttgtgcctgccgatattctgctcctaagctcgagcgaacctaacagcctttgctacgtggagactgccgagttagatggtgaaaccaacttgaaattcaagatgtctctggaaatcactgatcagtacctccagagggaggacacactcgcaacctttgacggttttattgagtgcgaagaacctaataatcgcttggacaagttcactggaaccctgttttggagaaatacatcttttccgttggacgccgacaagatactgttgcgcggctgcgtgattaggaatacagatttctgccatggattggtgatctttgccggcgccgatactaagatcatgaagaacagtggaaagacgcgattcaagcgtactaagatcgactatcttatgaattacatggtgtacactatcttcgttgtgctcattctcctcagtgcaggcctcgctatcggacatgcttattgggaggcccaggtgggcaactcatcttggtatctttacgatggggaggacgatacccctagttacaggggattcctcatcttctggggttacataatcgtgctgaacacaatggtgcctatatccctttatgtgtccgtggaagtcattcgcctgggtcaatcacattttatcaattgggatctccagatgtactatgccgagaaggataccccggctaaagcgagaactactaccctcaatgaacaactcggacaaatccactacatctttagtgataagaccggaactctaactcaaaacataatgacttttaagaaatgttgcatcaacggacagatctatggggatcacagagatgccagtcaacacaaccacaacaagatcgagcaagttgacttttcgtggaacacgtatgctgacggcaaactggcattttacgatcactatctcatcgaacagattcagagcgggaaagaacccgaagttaggcaattcttttttcttctggccgtgtgtcacaccgttatggtggaccgcacagacggacagctgaattatcaagccgcgagccctgacgagggcgcgttggtgaatgctgcccgaaattttggcttcgcattcctggcccggacgcaaaacaccatcactatctccgagctgggcacagagaggacctataatgtccttgcaattcttgatttcaactccgaccggaagagaatgtccataattgtgaggacaccagaaggtaacattaaactgtactgcaagggggctgatacagttatttatgagcgcctgcaccgcatgaatccaaccaagcaagagacccaggatgctctggatatattcgccaacgaaaccctccgcacactgtgcttgtgctataaagagatcgaagagaaggaatttacagagtggaacaaaaagttcatggccgcttcagtggcaagtaccaatagagacgaagccctggacaaggtgtacgaggaaatcgaaaaagacttgattcttctgggagccacggcgatcgaagacaaactgcaggacggcgtccccgaaactatttcaaagctggccaaggccgacattaaaatctgggtgttaaccggagataaaaaagaaactgcggagaatatagggtttgcatgcgagctcctcaccgaggatacgactatatgttatggggaggacattaatagcctgctgcacgcaaggatggagaaccagaggaacaggggtggcgtctatgctaagtttgctcccccagtccaggaatctttctttccacccggggggaatcgagcactgataattactggctcttggttaaatgagatccttttggaaaaaaaaacaaagcgtaacaaaatcctcaaattaaaattcccacggacagaagaagaaaggcggatgcggacacagtcgaaaagacggctggaggcaaagaaggagcagaggcagaagaactttgtggaccttgcctgcgagtgttccgcggtgatctgctgtagagtaactcctaagcagaaagcaatggtggtggacctggtgaagcgatacaaaaaagccatcacacttgctatcggagacggagctaatgacgtcaatatgattaagacagcacatattggcgtggggataagtggccaggagggcatgcaagcggtcatgagctcagactactcttttgcccagttcaggtacctacagcggttactccttgttcacggccgctggtcctacataagaatgtgcaagtttcttaggtactttttttacaagaattttgcattcaccttggtgcacttctggtatagtttctttaatggatattccgcccaaactgcctatgaggactggttcatcaccctttacaacgtgctctacacctccctgccggtgctcctgatgggcctgttggatcaagatgtgtccgacaagctgtccctgcgattcccagggctgtacatcgtcggccagcgtgatctccttttcaattacaaacgattctttgtgtcccttctccatggcgtgttgacaagtatgatcttgttttttattccgctgggggcctacttacagactgtgggccaagatggcgaggctccatcagattaccagagctttgccgtgacaattgcaagcgcactagttattacagtgaatttccagatagggctggatacctcatactggacctttgtgaacgccttctctatcttcggctctattgcactttactttggcatcatgttcgactttcactctgcagggatacacgtgctattcccctccgcatttcagttcacagggactgcatccaacgcactcaggcagccatatatatggttgacgataatcttagctgtggccgtttgcttgcttcctgtggtcgccattcggtttctgtccatgacaatttggccaagcgaaagcgacaaaattcagaagcacagaaagaggctcaaggctgaggaacagtggcaacgacggcagcaggtgttccgtcggggggtgtcaaccaggaggagcgcttacgccttcagccaccaaaggggttacgcagacctcattagttctgggagatccatccgcaaaaaacgttcccctctggacgccatagtagccgacggaacagccgagtataggcggacgggagactcc

SEQ ID NO: 7290 - DNA, 3753 bp, Artificial Sequence
  Description of Artificial Sequence: Synthetic coding sequence
atgagcactgaacgggatagtgaaactacgtttgatgaggacagccagccgaatgacgaggtcgtgccgtactctgacgatgaaaccgaagatgaactggatgaccagggaagcgctgtggaaccggaacaaaatagagtcaatcgcgaggcggaggaaaatcgcgagccgtttcgcaaggagtgtacctggcaggtcaaagcgaacgatcgcaagtaccatgagcagccgcactttatgaataccaagtttctgtgcatcaaagaatctaagtacgcgaataacgcaatcaaaacctacaaatacaacgccttcacctttattccgatgaacctgttcgagcaattcaagcgggccgccaacctgtacttcctggctctcctgatcctgcaggctgtccctcagattagcaccctcgcatggtacactaccctggtgcccctgctcgtggttctgggagtgactgccatcaaagatctggtggatgacgtcgcaagacacaagatggataaggagatcaacaacagaacctgcgaggtcataaaggacggcaggttcaaggtcgcgaagtggaaggagattcaggtgggcgacgtaatccgcctgaaaaagaacgatttcgtccctgctgatattctcttgcttagcagctcagagccaaatagcctctgctacgttgaaaccgccgaactcgatggagagactaacctcaaattcaagatgtcgctggaaatcactgaccagtacctgcaacgagaggacacgctggccaccttcgacggattcatcgagtgcgaggaaccaaacaacaggcttgacaagttcaccggaacccttttctggcgaaatacgagctttccgctggatgctgacaagatcctgctgcgcggctgcgtgattagaaacactgacttctgccacggtctggtcatctttgccggggcagacaccaaaatcatgaaaaactccgggaaaactcgctttaagcggacgaagatcgattacctgatgaactatatggtgtacacgatttttgtcgttctcatcctgctgagcgccggcttggcgatcggacatgcatactgggaggcacaggtgggaaacagttcgtggtacttgtatgacggagaagatgacactccgagctacagaggtttccttatcttctggggctatatcatcgtgctgaacacgatggtgcctatctcactgtacgtgtccgtggaggtgatccggctgggtcaaagccacttcatcaattgggaccttcagatgtactacgccgagaaggacaccccggccaaggcgaggaccaccactttgaacgaacagctcggtcaaattcactacatcttcagcgataagactgggaccctgacgcaaaacatcatgactttcaagaagtgttgcatcaacggacagatttatggggaccacagggacgcgtcgcaacataaccataacaagattgagcaagtggatttctcgtggaatacctacgccgatggcaagctcgcattctacgaccactacctcatcgaacaaatccagtcgggaaaggaaccagaagttcgccaattcttcttccttctcgctgtgtgccacactgtgatggtggatcgcaccgacggccaactgaattatcaggcggcatccccagatgagggcgcactggtgaacgcggcccgcaacttcggattcgcgtttctggcgaggacccagaataccattactatctcggagctggggactgaacgcacctacaatgtgctggcaatcctggacttcaacagcgatcgcaaacgaatgtccatcatagtgcgcactcccgaggggaatatcaagctgtactgtaagggcgccgacaccgtgatctacgagcgccttcaccgcatgaaccccaccaaacaggaaactcaggacgcgctggatatctttgccaatgaaaccctccgcacgctgtgtctctgctataaggagatcgaggaaaaggagtttacggaatggaacaagaagttcatggcggcgtcggtcgcctccactaaccgggatgaagctctggacaaggtctacgaagaaatcgagaaggacttgatcctcctcggagcaacggccatcgaggacaaactgcaggacggtgttccagaaaccatctcaaagctggcgaaagccgacattaagatatgggttcttactggagacaaaaaggaaaccgctgaaaacatcggattcgcatgtgagttgttgacggaagataccactatctgctacggcgaggacatcaactcgcttctgcacgctagaatggaaaatcaacgtaacagaggaggagtgtatgccaagttcgcccctccggtgcaagagagtttcttccctcctggaggcaatcgggcactgattatcaccggcagctggcttaatgagatcctcctcgaaaagaaaactaagagaaataagatcttgaagctgaaattcccacgcaccgaagaggaacgtcgtatgagaacccagagcaagcgcagactggaggccaaaaaagagcagcggcaaaagaacttcgtcgatcttgcctgcgagtgctcggccgtgatctgctgtcgtgtgactccgaagcagaaagcaatggtcgtggatctggtcaagcggtacaagaaggccatcactctcgctatcggagacggagctaacgatgtgaacatgatcaagaccgcccatatcggagttggaatcagcggacaagaaggcatgcaggccgtgatgtcgtcggactactcgtttgcgcagttcaggtacctccagcgccttctgctggtacacgggcggtggtcctatatcaggatgtgcaagttcctccgctacttcttctacaagaatttcgccttcactctggtgcatttctggtactccttcttcaacgggtacagcgcgcagacggcctacgaggactggttcattacgctgtacaacgtgttgtatacttccctgccggtgctcctgatgggcctgttggaccaggacgtgtcagacaaactgtcacttcgcttccccggattgtacattgtcggacagagggacctgctcttcaactacaaaagattcttcgtgtcgttgctgcatggagtcttgacttcgatgattctgttcttcattccgcttggcgcatacctgcaaactgttggacaggatggtgaagcaccgtccgactaccagtccttcgcggtcactatcgcctcagccctcgtcatcactgtcaattttcagatcggattggatacttcatactggacttttgtgaacgccttctcgatcttcggatcgatagccctgtactttggcatcatgttcgatttccacagcgcgggaattcacgtgctgtttccgtccgcgttccagtttaccggaactgccagcaatgccctgcggcaaccgtacatttggctcactatcatcctggccgtggcggtctgcctcctgcccgtcgtggccatccgcttcctctccatgaccatctggccttcggaatcggacaaaatccagaaacatcgcaaacggttgaaggccgaagaacaatggcagcggcgccagcaggtgttccgccgcggcgtgtccactcggagatcggcctacgccttttcgcatcaaagaggttatgcggacctcatcagcagcggaagatcaatccggaagaaacgttcgccgctggacgccatcgtggcggacggcaccgcagaataccgccgcacgggggattcc

SEQ ID NO: 7291 - DNA, 3753 bp, Artificial Sequence
  Description of Artificial Sequence: Synthetic coding sequence
atgagcacggagcgcgattcggagactacgtttgatgaagatagccaaccgaacgatgaggtggtcccttactctgatgacgagacagaggacgaattggacgaccagggttcagcagtcgaaccggaacagaacagagttaatcgagaagcagaggaaaacagagaaccgtttagaaaagagtgcacgtggcaagtcaaagcgaatgatcgcaagtatcacgagcagccgcattttatgaacacgaaattcctttgtattaaggagagtaagtatgcaaacaatgcaattaagacctacaaatataatgctttcacatttattccgatgaacctatttgaacaatttaaacgcgcggcgaacttgtactttttggcactgctgattttgcaggccgttccccagattagcacattagcatggtacacgacattagttccgcttttagtcgtcctgggcgttacagccattaaggaccttgtcgacgatgtagctaggcataaaatggataaagagatcaacaatcgcacatgcgaagtcattaaagatggaagattcaaagtggcaaagtggaaggaaatacaggttggggatgtaatccgcttgaaaaaaaacgattttgtgcctgcggatattttgcttctttcgagttctgaacctaattcactgtgttatgttgaaaccgcagaattggacggagaaacaaacctgaaatttaaaatgtccttagaaattaccgaccagtatttgcagagagaggacacccttgcgacatttgacggctttatcgaatgtgaagaaccgaacaacaggctggataaatttacgggaacactgttttggcggaatacgtcatttccgctggatgccgataaaatcctgcttcgtggttgcgtaatccggaatacagatttttgccacggccttgttatttttgctggtgcggacacgaagatcatgaagaactcagggaaaacgcgttttaaacggacgaagatagattatctgatgaattacatggtatatacgatctttgtggtgcttatattgctttctgcagggttggcgatcggacatgcttattgggaagcccaagtgggcaacagcagctggtacttgtatgatggcgaagatgacacaccatcctaccggggattcctaattttttggggctatataatcgtattaaatactatggtgcctattagcctttatgtctcagttgaagtaatccgacttggccaatctcactttataaattgggaccttcagatgtattatgcggaaaaggatacaccggcaaaagctcgcacgacaactctgaacgaacagttagggcagattcattacattttttcagataaaacaggtacattaacacagaatattatgacatttaagaaatgttgtattaatggccagatctatggcgaccatcgtgacgcttcccaacataatcacaacaaaatcgagcaggttgatttttcttggaacacttacgccgatggcaaattggcgttctatgatcactaccttattgaacagattcaatctggcaaggaaccggaggttcggcaattcttctttttgttggcagtctgtcatacagttatggtcgatcgcaccgacggacagcttaactatcaggcagctagtccggacgaaggcgcgttagtgaatgcagcacggaattttgggtttgcgtttctggccaggacacaaaacacaatcacgatttccgagctgggaacagaacgcacgtataacgttttggcgattttagattttaactcggaccggaagcgcatgagcatcattgtaaggacccctgaaggaaacattaaactgtactgcaaaggcgccgacacagttatatatgaacgattgcaccgtatgaaccctacgaaacaggaaacgcaagatgcgttggatatttttgcaaacgagacacttcgaactttgtgcctgtgttataaagaaatcgaagagaaagagttcacggaatggaataaaaaatttatggctgccagcgtcgccagtactaatagagacgaggctcttgacaaggtttatgaggaaatagaaaaagatcttattcttttaggtgcaaccgcgatcgaagacaagttgcaagacggagttccggaaacaatatcgaagctggccaaagctgatattaaaatttgggtccttacaggagataagaaagaaacggcagagaatatcggtttcgcctgtgaacttcttactgaagatactacaatatgctatggcgaagatatcaatagcctgttacacgctcgtatggagaatcaaagaaacagaggaggtgtttatgccaaatttgctcctccggtgcaagaaagcttttttcccccggggggaaatcgcgcactgataatcacagggagctggcttaatgaaatactactagaaaaaaagacaaagagaaacaagattttgaaactgaaatttccgcggactgaagaagaacgtcggatgagaacccaatctaaacgcagactggaagcaaaaaaggagcaacgtcagaaaaactttgtagacctcgcatgcgagtgctctgcagttatatgttgccgtgttacacccaaacagaaagcaatggttgtagatttagtgaaaagatataaaaaagcgattactctcgcgattggagatggagctaacgacgtcaatatgatcaaaacagcacatataggagtgggaatctctggccaggagggaatgcaggcggtaatgagctccgactatagtttcgcacagttcagataccttcaacggttactgctggtacatggaagatggagctatatacgcatgtgcaaattcttaagatactttttttataagaactttgcgtttactctcgtgcacttttggtatagttttttcaacggttattccgcacaaacagcttatgaggattggtttattacgctgtataatgttttatatacgagcttaccagttttacttatgggcctcttagatcaagacgtgtcagataaactttctctgcgctttcccgggctgtacatagtaggccaacgggatttactgttcaattataaacgttttttcgtgtctctgttacatggagtgcttacatctatgattcttttttttattccgctcggagcctacttgcaaacggtcggccaagatggcgaggcgccgtctgactaccagtcatttgcagttacaattgcaagcgctttagtaattacagtgaactttcaaataggcctcgatacaagttactggacatttgtgaacgcgtttagcatttttggatcaatcgcactgtattttggcattatgtttgactttcacagtgccggcattcacgttctgtttccttctgcgtttcagttcacaggcacagcttccaatgccctgcgccaaccatatatttggttaacgatcatactagccgtcgctgtatgccttctaccggttgtagctatcagatttttatcaatgacaatctggcctagcgaaagcgacaaaattcaaaaacaccgcaagcggctcaaagctgaagaacagtggcagaggcgccagcaagttttcaggcggggcgtgtcaacacgccgttcagcatacgctttcagccatcagcgcggttacgccgacttaattagctctggacgctcaatcaggaaaaagcgttcccctttagatgctatcgtagcagatggtacagctgaatataggagaacgggagactcg

SEQ ID NO: 7292 - DNA, 3753 bp, Artificial Sequence
  Description of Artificial Sequence: Synthetic coding sequence
atgtccactgaaagagactccgaaactacttttgacgaggactcgcagcctaacgatgaggtcgtgccatactcggatgacgagacggaagatgagctcgatgaccagggatcagcagtggaacccgaacagaatagagtcaatcgggaggcagaagaaaatagagagccatttaggaaagagtgcacctggcaagtcaaggcaaacgatcgtaagtatcacgaacaacctcatttcatgaacactaagtttctctgtataaaggaaagcaaatacgctaataacgcaatcaaaacttacaagtacaacgcttttaccttcattcccatgaacctgtttgaacagttcaagagagccgcaaatctttacttccttgcacttctgatccttcaagcagtcccacaaatctcaactctggcatggtataccactcttgtgccgctgctcgtggtgcttggagtcaccgcaattaaggatctggtggatgatgtcgcaaggcataagatggataaggagataaacaacagaacgtgtgaggtgataaaggacggaagatttaaggtggccaaatggaaggagatccaagtgggtgatgtgatccgactcaagaagaacgattttgttcctgccgacattttgctcctttcgtcgtcagagcccaattccttgtgctacgtggaaactgcagaacttgacggagagactaacctgaagtttaagatgtctttggaaatcaccgatcagtacctgcagcgagaggacactcttgcaacctttgacgggtttatagagtgcgaagaacccaacaacagattggacaagtttaccgggacgctcttttggagaaatacttcctttcctctggatgccgacaagatacttctgagagggtgtgtgatacgcaataccgacttttgtcacggattggtcatttttgccggcgctgatacgaagattatgaagaattccggtaagaccagattcaaacgcactaagatcgattacctgatgaactacatggtgtacacgatttttgtcgtcctgatccttctctcggcagggcttgccataggacatgcgtactgggaagcacaggtgggaaacagttcgtggtacctttacgacggggaagatgataccccctcctaccgggggttcctgattttctggggctacattattgtgttgaacactatggtacctatttcattgtacgtcagcgtcgaagtcatccggcttggacaatctcatttcatcaactgggatcttcaaatgtactacgccgagaaggataccccggctaaggcgcggactactactctgaatgaacaactcgggcagatacactacattttctcagacaagactggaactcttacccaaaacattatgacctttaagaagtgctgtattaacggtcagatttacggggaccatcgcgacgcctcacagcacaaccacaataagatagaacaggtggatttttcttggaatacctatgcagacggcaaactggcattttacgaccattaccttattgagcagatccaatccggtaaagaacctgaagtccgccagttcttttttctccttgctgtctgtcataccgtgatggttgaccggacggatggacagctgaactatcaagcagcatcgccggatgagggtgcactcgtcaacgcagcacggaattttggtttcgcgttccttgctagaacgcagaatactattaccatttcggaactcggaaccgaacggacctacaacgtcctcgctatcctcgactttaactccgacagaaagcgaatgtcgattatcgtgcgcactccagaagggaacattaagctgtactgcaaaggtgcagataccgtgatttacgagcgtctgcatcgaatgaaccccactaagcaggaaacccaagatgcactggacatctttgccaacgaaactttgagaaccctgtgcctgtgttacaaggagattgaggaaaaggagttcaccgaatggaacaagaagtttatggcggcgagcgtggcatcaaccaatagagacgaggcactggataaagtgtacgaagagattgaaaaggatttgatactccttggtgcgaccgcaattgaagataaactgcaggacggagtgccagaaactatctccaaacttgcgaaggcggacattaagatttgggttctgactggagataagaaggaaaccgcagaaaacatcggattcgcatgtgaactgctgactgaggatacgaccatttgttacggcgaggatatcaattccctccttcatgcccgcatggaaaaccaaagaaacaggggcggagtgtacgcaaagttcgcgccacccgtgcaagagtcattctttcctcccggcgggaacagagcacttatcatcactggatcctggctgaacgaaatccttctcgaaaagaaaaccaagagaaacaaaatactgaagttgaaatttccacggactgaggaggagcgccggatgagaactcagtccaagcggaggctggaagccaaaaaggaacagaggcaaaagaacttcgtcgatctggcttgtgaatgctcggcggtgatttgttgcagggtcacccctaagcagaaggcaatggtggtcgatctggtgaagagatacaaaaaggcaattacgctcgcaattggagatggcgcaaacgatgtgaatatgataaagaccgcccacattggagtgggaatatccggtcaggagggcatgcaggcagtcatgagctcggactactcgtttgcacagtttcggtatcttcaaagactcctccttgtccatggtagatggagctacattagaatgtgtaaattccttcgatacttcttctacaagaatttcgcctttaccctcgttcatttttggtacagctttttcaacggatactccgcacagaccgcctacgaagattggttcataaccctttacaatgtgctgtatacttccttgccagtgctgctgatgggacttctggatcaagacgtgtcggacaagctctctctccggttccctggtctgtacatcgtgggacagagggaccttctcttcaactataagagattcttcgtcagcctgctccatggagtgcttacctcgatgatccttttctttataccgctcggtgcctacctgcaaactgtgggtcaggatggcgaggctccctcagattaccagtcgtttgccgtgactattgcttccgcgcttgtgatcaccgtgaactttcaaatagggctggatacttcctactggacctttgtcaatgcttttagcatatttggatcgattgccctctactttggaattatgtttgattttcactcggcaggtatccatgtgcttttccccagtgcgtttcagttcaccggaaccgcatcgaacgctcttaggcagccgtacatttggttgaccattattcttgccgtggcggtgtgtcttttgccagtcgtggctattaggtttctgagcatgactatctggccctcggaatctgataagatccagaaacatcgcaagcgcttgaaggcagaagaacagtggcagcgtcggcaacaggtgtttagaaggggtgtgagcacccggcgaagcgcctacgcattcagccatcagaggggttacgctgaccttattagcagcggtagatcgatcaggaagaagcgatcccctctggacgccatcgtggctgatggtaccgccgagtacaggcgaactggtgattcg

SEQ ID NO: 7293 - DNA, 3753 bp, Artificial Sequence
  Description of Artificial Sequence: Synthetic coding sequence
atgtcgaccgaacgggactcagagactactttcgatgaagattcgcagccaaacgacgaggtggtcccgtactcggatgatgaaaccgaagacgagctcgacgaccaaggttcagcagtggaaccggaacaaaaccgcgtgaaccgcgaggccgaagagaatagggaaccgttccggaaagagtgcacttggcaggtgaaagcaaatgaccggaaataccacgaacagccccatttcatgaacaccaagttcctctgcatcaaggaatcaaagtacgcaaataacgccatcaaaacctacaagtacaatgcattcaccttcatcccgatgaacttgttcgaacagttcaaacgggctgccaacttgtactttcttgcgttgctgatcttgcaagccgtgccgcagatctcgactctcgcgtggtacaccacgctcgtcccactcctcgtcgtgctgggagtgacggccatcaaggatctggtcgatgatgttgctcggcataagatggacaaggaaattaacaacaggacctgcgaggtgatcaaggatggacgcttcaaggtcgccaaatggaaggagatccaagtgggcgatgtgatccgcctcaaaaagaacgactttgtgcctgcggacatcctcctgttgtcctcatcagaaccgaactcgttgtgctacgtggagacggcagagctggatggggaaaccaacctcaagttcaagatgagcctggaaatcaccgatcaatacttgcagcgcgaagacactctggcgacctttgacggttttatcgaatgcgaagagccgaacaaccgtttggacaagtttactggaactctgttttggcggaacacctccttcccgttggacgccgacaaaattctgctgcggggatgcgtgatccggaacacggatttttgccatgggctggtcatctttgcaggagctgacaccaagatcatgaaaaactccggaaaaactcggttcaagcgcactaagatcgattacctcatgaactacatggtctacaccatctttgtggtgctgatcctcctgagcgcggggctggcaatcggacatgcgtactgggaggcccaagtgggaaattcgtcctggtacctttacgacggtgaggacgacaccccgtcctaccgcggatttctgatcttctgggggtacatcatcgtcctcaacaccatggtgcctatctcgctgtacgtcagcgtggaggtgatccggctgggccagtctcacttcatcaactgggatcttcaaatgtattacgccgaaaaagacacgcccgctaaggcgcggaccaccactctgaacgaacaattggggcaaatccactacatcttcagcgataagaccggcaccctgactcagaacatcatgaccttcaagaagtgctgtatcaatgggcagatctacggcgatcatcgagatgccagccagcacaatcacaacaagatcgaacaggtcgacttctcgtggaatacctacgcggacggtaaactggcattttacgatcactacctcatcgaacagatccagagcggaaaggagcctgaagtgaggcagttcttcttccttttggcggtgtgccatactgtcatggtcgaccgcactgacgggcagctcaattatcaggcagcgtcacccgatgagggagccctggtcaatgcggccaggaattttggtttcgccttcttggcgcggactcaaaacaccatcaccatctcggaactcggaacggaacgcacgtataacgttctcgcgatccttgatttcaattcggacaggaagagaatgagcatcatcgtgcggacgccggagggaaatatcaaactgtactgtaagggggccgacaccgtcatctacgagagactccaccggatgaacccgaccaagcaagaaacccaagacgcgctggacatcttcgccaacgagactttgaggactttgtgtctgtgttacaaggaaatcgaagaaaaggagttcaccgagtggaacaaaaagttcatggccgcttcggtcgcgagcaccaaccgcgacgaggccctggacaaagtgtacgaagagatcgagaaagatttgatcctgcttggcgcgaccgcgatcgaagataagctgcaagatggagtgcctgaaaccattagcaagctggcaaaggcggatatcaagatctgggttctgactggagacaagaaagaaactgcggagaacatcggatttgcttgcgagctccttaccgaagataccaccatctgctacggtgaggacattaatagcctcctgcatgcccgcatggaaaaccagcgcaaccgaggaggggtctacgctaaatttgctccgcctgtgcaagagtcgttctttccaccgggcggcaatcgcgcactgataatcacgggatcctggctgaacgaaattctgctggaaaagaagactaagcgcaataagatcctgaagctcaagttcccccgcaccgaggaggaacggagaatgcgcacccagtccaagagacgcctcgaggccaaaaaggagcaacggcaaaagaacttcgtggacctggcatgcgaatgttcagcggtgatctgctgccgggtgactccgaagcagaaggcaatggtggtggatctggtcaaacgctacaaaaaagccatcactcttgccatcggtgacggcgccaacgacgtgaacatgatcaaaactgcgcatatcggagtgggcatctcagggcaggaaggaatgcaggccgttatgagttcagactactccttcgcccagttccgctacttgcagagactgctgctcgtgcacgggcgctggtcgtacatacgcatgtgcaagttcctgcgctacttcttctacaagaatttcgctttcactctggtgcacttctggtactcattcttcaatggctactcggcccagactgcttacgaggattggttcatcactctgtacaacgtgctctacacctcgttgccggtactcctgatgggactgctggatcaggatgtctcggacaagctgtccctgcggttcccgggactgtacatcgtcgggcagcgtgacctgttgttcaactacaagcggttcttcgtctcgctcctgcacggggtcctcacctcgatgatcctgttcttcattcctctgggggcctacctgcagactgtgggacaggatggagaagcaccatccgattaccagagcttcgccgtgaccatcgccagcgctctggtgatcactgtgaacttccaaatcggactggacactagctactggaccttcgtcaacgccttctcgattttcggatcaatcgcgctctacttcggcatcatgttcgacttccacagcgccggaatccacgtgctcttcccttcggcattccaatttactggaaccgccagcaacgcgctcaggcagccatacatttggctcacgataatccttgccgtggctgtgtgcctgctgcctgtggtggctatacgcttcctgtccatgaccatctggccgtcagagtcggataagatccagaagcatcgcaagagactgaaggctgaagaacaatggcagcggcggcaacaggtgttccggcgcggtgtgtctacccggcggagcgcatacgcctttagccaccagaggggatacgccgacctgatctcatcgggacgcagcatccggaagaagcgctcccctctggacgccattgtcgccgacgggactgcagaatacaggcggaccggagactcg

SEQ ID NO: 7294 - DNA, 3753 bp, Artificial Sequence
  Description of Artificial Sequence: Synthetic coding sequence
atgtccacggagcgcgactcggagacgactttcgatgaggattcccaacccaatgacgaagtggtcccgtactccgatgatgaaactgaggacgaactggacgaccaaggcagcgctgtggaacctgagcagaatcgcgtgaatcgggaagccgaagaaaatcgggagccattccggaaagagtgcacctggcaggtcaaagccaacgataggaagtaccacgaacagccgcacttcatgaataccaagttcctgtgtatcaaggagagcaagtatgctaacaacgccatcaagacttacaagtacaatgcatttaccttcatccctatgaacctgtttgaacaattcaagcgggcggcgaatctctacttcctggctctgcttatactgcaggcggtccctcaaatctcgactctggcctggtacactaccctcgtgccactcctggtggtcctgggcgtgactgccatcaaggacctggtggatgatgtcgcacgacacaaaatggataaggagatcaataaccgcacgtgcgaagtgatcaaggacggccgcttcaaggtggcaaaatggaaggaaatccaggtgggagatgtgatccgcctcaagaagaatgactttgttccggcggatatcttgcttttgagcagcagcgagccgaattccctgtgctacgtcgaaactgctgagctggatggcgaaactaacctgaaattcaagatgtcactggaaatcacggatcaatacttgcagcgcgaggacactctggccacgttcgacgggttcatcgaatgtgaggaaccaaacaatcggctggataagtttaccgggacgcttttctggaggaatacctcgttcccgctggacgctgacaaaatcttgctgcgcggatgcgtcatccgcaacactgacttctgccacggccttgtgattttcgccggtgccgacaccaagatcatgaaaaactccggaaaaacccggttcaagcgcactaaaatcgattatctgatgaactacatggtgtacactatcttcgtcgtcctcatcctcctgtcagccggcctggctatcggtcatgcatactgggaggcacaagtgggcaactcgtcctggtacctttacgacggtgaggacgacactccgtcataccgcggattcttgatcttctggggatacattatcgtcctgaacacgatggtgccgatctccctctacgtgagcgttgaggtgattcggctgggacaatcccactttatcaactgggacctccagatgtactacgctgagaaggacaccccagccaaagcccgtaccacgaccctgaacgaacagctgggacaaatccattacatattctcggacaagaccggcactctgacccagaacatcatgacgtttaagaaatgctgcatcaatgggcagatatacggagatcatagagacgcttcacagcacaaccataacaagatcgaacaggtggacttttcctggaatacctacgcggacggaaaactggccttctacgaccactacctgatcgaacagattcagtctggtaaagagcctgaagtccgccaattcttcttcttgctggccgtgtgccacaccgtgatggtggaccggaccgatggacagcttaactaccaggcagccagccccgatgagggagcgctggtcaatgcggcacggaatttcggttttgcattcctggcgcggactcagaacactatcactatctccgaactgggcacggagcggacttacaatgtgctggccatcctcgatttcaatagcgacagaaagcgcatgtcgatcattgtccggaccccggaagggaacatcaagctgtactgcaaaggggcagacactgtgatctacgagcggctccatcgcatgaacccgaccaagcaggaaacccaagatgctctcgatatcttcgccaacgaaaccctgcgcactttgtgtctctgctacaaagagatcgaggaaaaagagttcacggagtggaacaagaagttcatggccgcgtcggtggccagcactaacagagacgaggcgttggacaaggtgtatgaagagattgaaaaggacctgatcctgctcggagcgactgccattgaagataagttgcaggacggggtgcctgaaaccatttcgaagctcgccaaggccgacattaagatctgggtgctcactggagacaagaaggagacggcggagaacattggttttgcttgcgagctgctcactgaagataccacgatttgctacggcgaggacatcaactcacttctccacgcccgcatggaaaaccaacgcaaccggggaggcgtctacgctaagttcgccccaccggtgcaggaatccttcttcccaccgggaggtaaccgcgcacttatcatcacgggatcgtggctgaatgagatcctgctcgaaaagaaaactaagagaaacaaaatcttgaagctgaagttcccgcgcactgaggaagagagaagaatgagaactcagagcaaacgtagactcgaagccaaaaaggagcagcgccagaaaaacttcgtggatctggcatgtgaatgctcggcagtcatttgttgcagggtgactccgaagcagaaggcgatggtcgttgacctcgtcaagaggtataagaaggccataacgctcgcaatcggcgatggtgccaacgatgtgaatatgatcaagaccgcccacatcggggtcggaatctcgggacaggaaggaatgcaagcagtgatgtcaagcgactactcattcgcccagttccggtacctccaacgccttcttcttgtgcatggtaggtggtcgtacatccgcatgtgtaagtttttgcggtactttttctataagaactttgccttcactctggtgcacttttggtactccttcttcaacggctactcagcccagaccgcatatgaggactggtttatcactctttacaacgtgctgtacacctcgctgccggttctgctgatgggactgttggatcaagacgtgagcgacaagttgtcgctgcggttcccgggactgtacatcgtcggtcagcgagacttgctctttaactataaacggttcttcgtctcgctgcttcatggagtcctgacctccatgattctcttcttcatcccgctcggagcgtatctgcaaactgtgggccaggacggagaggctccttccgattaccagtcttttgccgttactatcgcctcagcactggttatcactgtgaacttccagataggcctcgacacttcctactggaccttcgtgaatgcgttcagcatcttcggcagcatcgctctgtacttcgggatcatgttcgacttccactccgcgggaatccacgtgctgtttccctcagcttttcaattcactgggactgcatcaaacgcgctgcgccagccgtacatctggctgaccatcatcctcgccgttgctgtgtgtctcctccctgtggttgccatccgcttcctttccatgactatctggccttcggagtcggataagatccagaagcatcgcaaaagactgaaggcggaagaacagtggcaaagacggcaacaggtgttccggagaggcgtgtcgactcggcgctcagcgtacgcttttagccatcaacgcggctacgccgacctgatctccagcggacgctcaatccgcaaaaagcgcagcccactcgacgctatcgtggctgatggaactgcggaataccggcggaccggagactcg

SEQ ID NO: 7295 - DNA, 3753 bp, Artificial Sequence
  Description of Artificial Sequence: Synthetic coding sequence
atgagcacggaacgcgatagtgagactaccttcgacgaggactctcaacccaacgacgaggtggtgccctactctgatgacgaaactgaagatgaactcgacgatcagggcagtgccgttgaacctgagcagaacagggtgaacagagaggcagaggagaacagggagccctttaggaaagagtgtacatggcaggtcaaggccaatgaccgtaagtatcatgagcaaccacactttatgaatactaagttcctgtgcataaaggaaagtaagtacgcgaataatgctattaagacttacaagtacaacgcgttcaccttcatcccaatgaatctgttcgagcagttcaagcgagctgctaacctctactttttggcccttctgatactacaggccgtcccccagatctccaccctggcatggtacacgacattagttcctctattggtggttctgggagtaacagccataaaagacttagtagatgacgtagccagacacaagatggacaaagagattaataatcgcacatgtgaggtcatcaaagatgggcgttttaaagttgcaaaatggaaagagatacaggttggggatgtgattagactgaaaaagaatgacttcgtgcctgccgacatccttctcttatcatcatctgagcccaacagtctttgctacgtcgagactgcagagctcgacggggaaacgaatcttaaatttaaaatgtcccttgagatcacagaccagtacctgcaacgcgaggacacccttgcgacctttgacggatttattgagtgtgaggagccgaataacagactggacaaatttacaggcacgctgttttggaggaacacgtcatttccattggacgccgataaaatcctgttgagaggatgcgtgattaggaacactgatttttgtcatggtctggtcatttttgccggggccgatacaaagatcatgaagaactcaggaaaaaccagattcaagcgaacaaaaatagattatttaatgaattatatggtgtataccatttttgttgtgttgatcttgctatcagctgggctagccattggacacgcctactgggaagcccaggtgggtaacagcagctggtatctttatgacggagaagacgacactcctagctacaggggctttttgatattttgggggtacatcatcgttctgaacactatggtccccataagcttgtacgtgagcgtggaggtgataagattaggccagtctcactttatcaattgggacttgcaaatgtattacgccgaaaaggacacgcccgccaaagcgagaacaacaacactgaacgagcagctcggtcagattcactatattttcagtgataagacaggaacactcacccagaacatcatgaccttcaagaagtgctgtatcaatggacagatctatggtgaccatcgagacgcctctcagcataaccacaataaaatcgaacaggttgacttcagttggaacacttacgcagatggaaaattagcattttatgaccactatctaattgagcagatccagtcaggtaaagaaccggaggtgcgccagttctttttcttactggccgtctgtcacaccgtgatggtcgaccgtactgacggacagctaaactatcaggcggcgagccctgatgaaggcgccctcgtgaatgccgcccggaactttggattcgccttcttagcccgtacacagaacactatcacaatatccgagcttgggactgaacgcacatataacgtcctcgcaatcctggattttaattccgaccgtaaaagaatgagcataatagtgaggacccccgaggggaacatcaagctgtattgcaagggcgcagacacagttatctatgagcggctgcaccggatgaaccccaccaaacaggagacacaggatgccctagacatctttgccaatgagactcttcggaccttatgcctctgctataaagaaattgaagagaaagaattcactgaatggaacaagaaatttatggccgctagtgttgcttctaccaaccgcgatgaggccctggacaaggtgtacgaggaaatagaaaaagatctcatcctattgggggccacagctatcgaggataagcttcaggatggcgtgcccgagaccatatcaaaacttgctaaggccgacataaagatctgggtgctcaccggtgataagaaggagacagctgaaaacattgggtttgcttgcgaactgctcactgaggacactaccatttgctatggggaggatatcaacagtttgttacacgctcggatggaaaatcagagaaatcggggcggggtctatgccaagttcgccccacccgttcaggaatctttttttccacctggcggcaaccgggccttgattatcacaggaagctggcttaatgagatactgctagagaaaaaaaccaaaaggaataagatactgaagttgaagtttccgcgcactgaggaggaacggagaatgcgaacccagtccaaacgcagactagaggcaaagaaggaacaaaggcagaaaaactttgtggacctggcttgtgaatgttccgcggtgatttgttgtagggtgacccccaagcagaaagctatggtagtcgatttggtgaagagatacaagaaagcaatcacccttgccattggcgatggagccaacgacgtaaatatgatcaaaaccgcccacataggtgtcggcatctccggccaggagggcatgcaagcagttatgagttcagactactcctttgctcagtttcgctatctgcagaggctcctcctggtgcatgggagatggagctatattcgaatgtgcaagttcctccggtattttttctacaagaacttcgcattcacactggttcacttctggtactccttctttaacgggtatagcgcacagacggcctacgaggattggtttattaccctctataatgtgctttacacatcactgcctgtactcctgatgggcttactcgatcaagacgtgtccgataaattgagtctgaggtttcctggcctgtacatagtgggacagagggatctgctgtttaattataagcggtttttcgtctcgctgttgcacggcgttttgaccagcatgatcctgttttttattcctttaggcgcgtacttgcagaccgtaggccaggacggcgaggcaccctccgattatcagtctttcgcagtgacaatcgcgtccgctttagtcattacagtcaatttccagatagggctggacacaagctactggacatttgtgaacgcattttccatttttggcagtattgcactatatttcggaattatgtttgatttccatagcgccggcatccacgtgttatttccttcagcctttcaattcacaggcactgccagtaatgctctacggcagccgtacatttggctcacgataatcctggctgtggccgtttgccttctccctgttgtcgcaattcgcttcctctctatgactatatggccaagcgagtccgataagattcagaagcatcgtaagcgtctgaaggctgaggagcaatggcagcggcgtcagcaagtgtttagacgtggcgtgtccacacgacggtctgcctatgccttctctcaccaacggggttatgccgacctgatatcctcaggacgctctatacgaaaaaagaggagtcccctggatgctattgtcgccgacggcaccgccgaatatcgacgaacaggagacagt

SEQ ID NO: 7296 - DNA, 3753 bp, Artificial Sequence
  Description of Artificial Sequence: Synthetic coding sequence
atgagcacagagagagattccgaaactacttttgatgaggattctcagcctaatgatgaggtggtgccatactccgacgacgagaccgaggacgaattggacgaccagggtagtgcagttgagccagagcagaatagggtgaatagggaagccgaggagaatcgcgagcccttccgcaaggagtgtacttggcaggtcaaagcaaacgataggaagtaccatgaacagccccattttatgaacacaaaattcctctgcatcaaggagagcaaatatgctaacaacgctatcaagacatacaaatacaacgctttcaccttcatcccaatgaacttgtttgagcaattcaagcgtgcagcaaacctgtactttcttgctctcctgatcctgcaggccgtacctcagatctccactctggcatggtacactacccttgtgccactgctggtcgttttgggagtgaccgccataaaggatctcgtggacgacgtggcaaggcacaagatggacaaagaaatcaacaatcgtacatgtgaagtaattaaggatggcagattcaaggttgcaaagtggaaagagattcaggttggcgacgtgatcaggctgaagaaaaatgacttcgtgcctgctgacatacttctgctctcttcatcagagcctaattctctctgctacgttgaaacagcagaactcgacggcgagacaaatctcaagttcaagatgagcctggagatcactgaccagtacttgcaacgcgaggacaccttggctactttcgacggctttatcgaatgcgaagagcctaataacaggctggataaatttaccggtacccttttctggagaaatacctcatttcccctggatgcagataagatcctgctgcgcggttgcgtgatccgtaacaccgatttctgccatggattggttatctttgccggcgccgatactaagattatgaagaacagcggcaagactaggtttaagcgcaccaaaatcgattatcttatgaactatatggtgtataccatctttgtggtgctcatccttctgtccgctggacttgccatcggacacgcctattgggaggctcaagtgggtaactcatcatggtacctgtatgatggagaggacgacactccttcctaccgcggcttcctgattttctggggctatattatcgtcctgaatactatggtgccaatctcactgtatgtgtccgtggaggtgattcgtcttggtcagtcacactttattaattgggacctgcagatgtactacgcagagaaagatacccccgccaaagcaaggactacaactttgaacgagcagctgggccagatccactatatcttctcagataagaccggaacccttacccaaaacatcatgactttcaaaaaatgctgcataaacggccagatctatggcgaccatagggacgcttcccagcacaatcataataagatcgaacaagtcgatttttcatggaatacctacgcagatggtaaattggccttctacgaccattatcttattgagcaaatccagtcaggtaaagagcctgaggtccgtcaatttttctttctcctggccgtgtgccacactgttatggtagacaggactgacggacagctgaattaccaggctgcttcccctgatgaaggtgctctggtaaatgcagcccgtaactttggatttgcattcctggctaggactcagaacaccatcaccatatctgaactgggaactgagcgcacttataacgtgctggctatcctggacttcaactctgatcgcaaacgtatgtctataatcgttcgtactcccgagggcaacataaagctgtactgcaagggtgcagacaccgtgatttatgagcgcctccatagaatgaaccctactaagcaagagacccaggacgccctggacatatttgcaaacgagaccctgaggactttgtgtttgtgttacaaggagatcgaagaaaaggagtttacagagtggaacaaaaaattcatggccgcctcagtggcatcaactaaccgtgacgaagctctggataaggtctacgaggagatcgagaaggacctcattctgcttggcgcaacagcaattgaagataagcttcaagacggtgtgcccgagaccatctccaagttggctaaggccgacattaagatatgggtgctgacaggagacaagaaagagactgccgagaacattggattcgcttgcgagcttctcacagaggacaccacaatctgttatggagaggacatcaactccctcctgcacgccagaatggaaaaccaaagaaaccgtggtggagtctatgctaaattcgctccccccgttcaggaatccttctttcctcccggcggtaacagagccctcatcatcacaggcagttggctgaacgaaatcctcttggagaaaaagacaaagagaaacaagattctgaagctcaagtttccaagaacagaagaagaaaggaggatgagaacacagagcaagcgtaggttggaggccaagaaggaacagaggcagaagaactttgtggatttggcttgtgaatgctccgccgtcatttgctgcagagttacccctaagcaaaaggctatggttgttgacctcgtgaaacgctataagaaggctatcaccctggctatcggcgacggagccaacgacgtcaacatgataaagaccgctcacatcggagtaggtatatcaggacaggagggtatgcaggccgtcatgtccagcgactattccttcgcccagtttagatatttgcagcgtctcctcctcgtccacggcagatggagctacatccgtatgtgcaagttcctgaggtacttcttctacaaaaattttgctttcaccctcgttcatttctggtatagcttctttaacggttactctgctcaaactgcttacgaggattggttcattacactctataacgtactgtacacaagcctgcctgtacttctcatgggcctgcttgaccaagacgtcagtgacaagttgtctctgcgcttccccggactttacatcgtgggtcaaagggatcttctgttcaattacaagcgcttcttcgtctctttgctgcatggtgtacttactagtatgatcctgtttttcataccactgggagcatacctccagacagttggccaggatggagaggctccctcagattaccaatccttcgctgtcacaattgccagtgcactcgttatcactgtgaactttcagatcggcctggataccagctattggacattcgttaatgcattcagcatctttggttccattgccctgtactttggcatcatgttcgatttccactctgctggaatacatgtccttttccctagcgcattccagttcactggaacagcctctaacgcactcagacaaccctacatctggctcacaatcattctggcagtggccgtatgcctcttgcccgtcgtggcaatccgttttctctccatgaccatatggccttccgaatcagacaaaatccaaaaacaccgtaagagactgaaggcagaggaacaatggcagaggaggcaacaggtgttccgtcgcggcgtgtccactcgtagatctgcatatgctttcagccaccagagaggttacgccgatttgatctcctccggtcgtagcataagaaaaaagcgtagccctctcgacgctattgtggccgatggcaccgccgaataccgtcgcacaggcgacagc

SEQ ID NO: 7297 - DNA, 3753 bp, Artificial Sequence
  Description of Artificial Sequence: Synthetic coding sequence
atgtcaacggaacgagacagcgaaaccaccttcgatgaggattcacagccaaatgacgaggtggtgccgtactccgacgacgaaactgaggacgaactggacgaccaaggatcggcagtcgaacctgaacagaatcgggtgaaccgggaagccgaagaaaatagagagccatttagaaaagagtgcacctggcaggtgaaggcaaacgatcgcaaatatcatgagcagccgcatttcatgaacactaagtttctgtgcattaaagaaagcaagtatgcaaataacgcaattaagacgtacaaatacaacgcattcactttcatccctatgaatctgtttgaacagtttaagcgggctgcgaatttgtacttccttgcccttctcatcctccaggcagtgccgcagatctccactctcgcgtggtacactactcttgtgcctctgctggtggtgctgggcgtgaccgccattaaggatctggtggatgatgtcgcaagacacaaaatggataaggaaatcaacaacagaacttgtgaagtcataaaggacggccgctttaaagtggccaagtggaaggaaatccaagtgggtgatgtgatccgacttaagaaaaacgattttgtaccagcggacatcctgcttctgtccagcagtgaacctaactctttgtgttacgtggaaaccgccgaactcgatggcgagacgaaccttaagttcaaaatgtcactggaaatcaccgatcaatacctgcaacgcgaagatactcttgcgacgtttgacgggttcatcgaatgcgaggagccaaataaccgcctggacaaattcactggaactctcttctggaggaatacctcctttccactggatgcggataagattctcctccgcggctgtgtgattagaaacactgacttttgtcatgggttggtgatttttgcaggagctgatactaagattatgaagaactccgggaaaactcgctttaagaggaccaagattgattacctcatgaactacatggtgtataccattttcgtagttctgatcctcctttcagcagggctcgcaattggtcacgcgtactgggaggcacaagtcggtaactcttcgtggtacctttacgacggggaagatgataccccctcgtacaggggttttcttatcttctggggttatatcatagtgcttaatactatggtccccatttcactgtacgtgtccgtagaggtgatcagactgggtcaaagccatttcattaactgggaccttcaaatgtattacgccgaaaaggatactcctgccaaggcacggactactactttgaatgagcagctgggccaaatacattacatcttttcggataagaccgggacgctgacccagaacatcatgacgtttaagaagtgctgcataaacggtcagatctatggtgaccatcgagatgcatcacagcacaaccataacaagatagagcaagttgattttagctggaacacgtacgcagatggaaagctggcattttacgatcattaccttattgaacaaattcaatccggtaaggaacctgaggttcgccaattcttcttcttgcttgcagtctgtcataccgttatggtggatcgtaccgacggccaactgaattaccaggctgcgtcgcccgatgaaggtgcactggtgaacgcagcccggaattttggttttgcttttctcgccagaacgcaaaacaccattaccattagcgaacttggaactgaaaggacgtacaacgtgctcgcaatcctcgatttcaattccgatagaaagcggatgtccataattgtgagaacccctgaaggtaacatcaagttgtactgtaagggtgctgatacggttatctacgaaagactgcacagaatgaatcctacgaagcaagagactcaggatgcgttggacatattcgctaacgaaacgctccgtactctctgtctctgttacaaagaaatcgaagaaaaggaatttactgaatggaataagaaattcatggcagcaagcgtcgcatcgactaaccgagatgaagcacttgacaaggtctacgaagagattgaaaaagatttgatacttctgggcgcaaccgcaattgaggacaaacttcaggatggagtccctgaaactatcagcaaactggctaaggcagatatcaagatttgggtgcttactggtgacaagaaggaaactgctgagaatataggatttgcttgtgaacttcttaccgaagataccaccatctgctacggagaggacattaactcgcttctgcacgcaagaatggaaaatcaaagaaacagaggaggcgtctacgcaaagttcgcacctcccgtgcaagaatcgttcttccctccaggaggaaatcgagcactcatcattaccggatcctggctgaacgaaattctgctggagaaaaagaccaagcgaaacaagattcttaaacttaagttcccacgtactgaagaagagcggagaatgcggacccaatcgaagcggagactggaggcaaaaaaggagcagcgccagaagaacttcgtcgatttggcatgcgagtgttcggcagtgatttgctgtcgggtcacgccaaaacaaaaggcaatggtcgtggacctggtgaagaggtacaaaaaagcaatcaccctcgccattggcgatggagcgaatgatgtgaatatgatcaaaaccgcacatatcggtgtgggtatctcggggcaggaagggatgcaggctgtgatgagctcagactactcgtttgcccaatttcggtacctccaaagactgctccttgtgcacgggcggtggtcatacatccgaatgtgtaagtttctgagatacttcttttacaaaaacttcgcatttacccttgtccatttctggtacagctttttcaacggctactcggcacaaactgcatacgaggactggttcatcactctttacaacgtcttgtatactagcctccccgtgctccttatggggttgctggatcaagacgtgtcggataaactgtccttgcgcttcccaggactgtacatcgtgggacaaagagatctgctgttcaattacaagcgcttttttgtaagccttcttcacggcgtgcttaccagcatgattctgttctttattccgctcggtgcgtaccttcaaaccgtgggccaggatggagaggccccttccgactaccaatcctttgcggtcaccatcgcgagcgcactcgttatcaccgtcaacttccagatcggtctggatactagctactggactttcgtgaacgcattttccatcttcgggtccattgccctgtactttggaattatgttcgactttcattccgccggtattcacgtgctttttccctccgcatttcaatttaccggcactgcgtctaacgcactcaggcaaccatacatctggttgaccatcatcctggcagtggctgtctgtctgcttccggtggtggcgattcgttttctgtcaatgaccatttggccttcagagtcggataagatacaaaagcaccggaagcgcctgaaggcagaggaacaatggcagagacgccaacaagtctttcgcaggggagtgtccacgcgaagatcggcctatgcattttcacaccagagaggatacgcagaccttatctcgtcaggaagatcaattcgaaaaaagcggtcgccgctggatgccatagttgcagacgggaccgccgagtatcgcagaacgggtgactcg

SEQ ID NO: 7298 - DNA, 3753 bp, Artificial Sequence
  Description of Artificial Sequence: Synthetic coding sequence
atgtccacggaacgggactctgagaccacctttgatgaggatagccagccaaatgatgaagtggtgccttacagcgatgatgagaccgaggatgaactcgacgaccaaggttccgcagtcgaaccagaacaaaatcgagtcaacagggaagcagaagaaaacagagagccttttagaaaggaatgcacctggcaagtcaaggccaacgataggaagtaccacgaacagccccattttatgaacactaaatttctctgtatcaaagagagcaagtatgcaaacaacgcaatcaagacatataagtacaacgcgttcacatttattccgatgaacttgtttgaacaattcaagagagccgccaatttatactttctggcactgctgatcctccaggccgtaccccagatctcaacccttgcttggtataccaccttagtaccactgctggtcgtcctgggcgttacggctattaaagacctggtcgacgatgtggcccgccataaaatggataaggagatcaataacaggacgtgcgaagtaatcaaagatggccggttcaaagtggcgaaatggaaggaaatccaagttggcgatgtgattagactgaaaaaaaacgactttgtgccagcagacatactgctgctgagctcaagcgagcctaacagcctttgttacgttgaaactgccgaactggacggagagacaaacctgaagtttaagatgagcctcgagattacagatcaataccttcaaagggaagatactcttgccaccttcgacggattcatcgaatgcgaggagcccaacaaccggcttgacaagttcaccggaacacttttctggaggaacacatcctttccgctggatgctgacaagatccttcttaggggatgcgttattagaaacacggacttttgtcacggcctggtaatctttgccggcgcagacacaaagatcatgaagaactccgggaagaccaggttcaagaggactaaaattgactatcttatgaactacatggtctacaccatcttcgtcgttcttattctcctgagtgctggcctagctatagggcatgcctactgggaggctcaggtggggaacagctcgtggtacttgtacgacggagaagatgacacacccagctatagaggattcttgattttttggggatatattattgtcctcaacacaatggtgccgatctccctttacgtgagcgtggaggtcatcagactgggccagagccatttcatcaactgggatttacagatgtactatgctgaaaaagatactcccgcgaaagctcggaccactactctgaacgagcagcttggccagatacattacatcttttcagataaaacaggaaccctgacccagaatattatgaccttcaagaagtgttgtattaacggacagatctacggtgaccacagggacgcttctcagcacaaccataacaagattgagcaggtcgatttcagttggaacacgtatgctgatggaaaactggcattctatgaccactacctcatcgaacagatacagagcggtaaagaacccgaagtgaggcagttttttttcttgctggccgtgtgccatactgtgatggtggatagaacagacgggcagcttaactatcaagccgcctcaccagacgagggagctctcgtcaacgctgccagaaactttggcttcgctttcttggctaggacacagaatacaatcacaatctctgagctaggcaccgaacggacctacaacgtccttgccatcctggacttcaactctgacagaaagaggatgagcatcatcgtgagaacacccgagggcaatattaaactgtactgcaaaggggcagatacagttatttatgaacggctgcaccggatgaacccaaccaaacaggaaacccaagatgctcttgatatcttcgcaaacgagaccctccgtaccctatgtctatgctacaaggaaattgaggaaaaggaatttacagagtggaataagaagttcatggccgcttctgtcgcctcaacaaaccgtgatgaagcactcgacaaagtgtacgaggaaatagaaaaagacttgatactgctgggggcaaccgctatcgaggacaagttgcaagatggagtccctgagacaatcagtaagcttgccaaggcggatattaaaatctgggttttgaccggcgacaagaaggagaccgctgaaaatatcggatttgcatgcgagcttctgacagaggataccaccatctgctacggagaagacatcaattccctgcttcatgccagaatggaaaaccaacggaacagaggaggagtgtacgccaagtttgcgccgcccgtgcaagagagcttctttccaccaggcgggaacagagccttgattatcaccggctcctggctgaacgagatcctgcttgaaaagaagaccaagaggaacaaaatcctgaagctgaaattcccacggactgaagaagagcgcagaatgaggacacaaagcaaacgtagacttgaagctaaaaaggagcagcgccagaagaactttgtggacctcgcctgtgaatgctccgccgtgatctgttgccgggttactcccaaacagaaagcaatggtcgtggacctcgtgaaaaggtacaagaaggctatcaccctcgccatcggggacggagccaatgacgtgaacatgattaagacagctcacatcggagtcggaattagcgggcaggaaggcatgcaggctgtcatgagtagcgattactccttcgctcagtttagatacctccaaagactgctgcttgtccatgggagatggagctacatccggatgtgtaagtttctgcgctacttcttttacaagaacttcgctttcactctggttcacttttggtattccttttttaatggctatagtgcccagacagcctacgaggattggtttattacgctgtacaacgtcctttacactagccttcccgtgcttctcatgggattgttggaccaggacgtgtccgataagctgagtctgcgcttccccggactgtacatagtgggccaacgcgatctgctttttaactacaagagattttttgtgagcctgcttcatggggtgttgacgtctatgatcttgttcttcattccattgggagcgtatcttcagacagtgggacaagatggcgaggcaccatctgattaccagagtttcgccgttaccattgcctctgcactggtgattacagtgaactttcagatcggactagatacttcatactggacattcgtcaacgctttttctatcttcggctctattgcgctgtattttggcattatgttcgatttccacagcgcaggcattcacgtgctgttcccaagcgcctttcagttcacaggcacagcctcaaacgccttgcgacagccctacatatggctgaccatcatcctggctgtcgccgtgtgcctgctgccggtagtggctataaggttcctgtcgatgacgatttggccatccgagagtgacaagattcagaaacatcgcaagaggttaaaggctgaggaacagtggcaaaggagacagcaggtctttaggaggggagtatccaccaggcgatccgcttacgctttctcccaccagcgcggatacgccgacctcataagcagcggcagatcgatacgcaaaaaaaggagtcctctggatgcgatcgtagcggacggaactgccgagtacaggcgcacaggggacagc

SEQ ID NO: 7299 - DNA, 3753 bp, Artificial Sequence
  Description of Artificial Sequence: Synthetic coding sequence
atgtcaaccgagagagacagcgaaaccacattcgatgaggatagccagcctaatgatgaagtggtgccctactccgatgacgagactgaggatgagttggacgaccagggctccgccgtcgaaccagagcagaaccgagtcaacagggaagcagaggaaaatcgtgaaccttttaggaaggagtgtacatggcaagtaaaggcaaatgatcgcaagtaccacgaacagccgcatttcatgaacactaaatttctttgtatcaaagagtctaaatatgccaataacgccattaagacctataaatataatgcatttaccttcatacccatgaatcttttcgaacagttcaagcgggccgcgaacttgtatttcctggcattacttatactgcaggccgtgccccagatcagcacgctcgcctggtacacaacactggtccctctcctggtggtcctgggcgtcaccgccattaaggatctggtagatgatgtggctcggcacaaaatggataaagagatcaacaaccgcacctgtgaagtaattaaagacggccggtttaaggtggctaagtggaaggagattcaagtgggtgacgttattaggctgaagaaaaacgactttgttcctgctgacatcctcctgctgtcatccagcgaacccaacagcttatgttatgtggagactgccgagctggatggcgagactaatctcaaattcaagatgtccctcgagataaccgaccagtacctgcagagagaagatacgctggcaaccttcgacggtttcattgaatgcgaagaacctaataaccgattggacaagtttactggcactctgttctggcgcaacacgagcttcccactagacgccgacaagatccttttgcggggttgtgttatccgcaacaccgatttttgccacggtctcgtaatattcgctggagccgatactaaaatcatgaagaattcgggaaagactcgttttaagcggactaagattgattacctgatgaactacatggtgtatacaatcttcgtggtacttatcctcttgagcgcaggattggccatcggtcacgcgtactgggaggcacaggtcggcaacagcagttggtatttgtatgatggcgaagacgacaccccttcctatcgagggtttctaattttctggggatatatcatcgtccttaataccatggttccgatttcactgtacgtctccgtggaggtcatccgcctgggacagtcacacttcataaattgggatctgcagatgtactacgccgaaaaggataccccggccaaagccaggactactacacttaacgaacagctgggacagatccattacatcttcagcgacaagacaggaacactgacccagaatatcatgaccttcaagaagtgctgcatcaatgggcagatttacggggatcacagagacgcgagtcagcataatcacaacaagattgagcaagttgacttctcttggaacacgtatgccgacggcaagctcgccttttatgatcattatctcattgaacagattcagagcggcaaggaacctgaggtgaggcagttcttcttcctgttggccgtctgccatacggtaatggtggatcgaactgatgggcaactgaattaccaggcagcatctcccgacgagggagcgctcgtgaatgccgctagaaatttcggctttgcatttctggccagaacccaaaacaccatcacaatcagcgaactcggcactgaaaggacgtataatgtgctggcgatcctggactttaacagtgatcgcaaaagaatgagcattatcgtccggacgccagagggaaacatcaaactgtattgtaagggcgctgacactgtgatttacgagcggctccaccgtatgaatcctaccaaacaggaaacacaggacgccctagacatttttgctaacgaaaccctcagaacactttgtttgtgttacaaggagatagaggaaaaagaattcacggaatggaacaagaaatttatggcagcttctgtggcctccacgaacagagatgaggctctggacaaggtgtatgaggaaatcgagaaagacctaatcctgcttggggcaaccgctatcgaagacaagctgcaggacggagtgcctgaaacaatttccaagctagccaaggctgacatcaagatttgggtgttgaccggcgacaagaaagagaccgcggagaacatcggatttgcatgtgagttactgacagaggataccacgatctgctatggcgaggatattaactccctgcttcacgccaggatggagaaccagcgcaaccggggtggcgtctatgccaaatttgctcctcccgtgcaagaaagcttctttccgcccgggggaaatcgggccctgattattacagggtcctggctgaacgagatactccttgaaaagaagactaaaaggaacaagatcttgaaattgaaattcccaaggacggaagaggaacgacggatgcgaactcagtcaaagagaaggctagaggcaaagaaagaacagcgacagaaaaactttgtggacttggcctgtgagtgctctgccgtgatttgctgtcgagttaccccaaagcagaaggccatggtggtggacctggtgaagcggtacaagaaggcaatcaccctggcaataggggacggggctaatgacgtgaatatgattaaaactgcccacatcggcgtgggaattagtggacaggagggcatgcaggccgtgatgtctagcgactacagtttcgcgcagttcaggtacttgcagcggctcctgctggtgcacggtcgatggtcctatattcggatgtgcaaattcctgaggtacttcttttacaaaaatttcgcatttacgctggtgcacttctggtactcttttttcaacggctacagtgctcagacagcatatgaagactggtttattacactgtacaatgtgctgtacacatcacttcctgtgctactcatggggctgctggatcaggatgtctccgataagctctcattgcgatttcccggactctatatagttggccagagggacctcctgtttaactacaagcgattttttgtcagcctgctacatggagtcctcacttctatgatccttttttttatcccgctgggcgcatatctacagacagtgggccaggacggggaggccccttctgattatcagtcatttgcggtgacaatcgcaagcgctttggtcattaccgtgaacttccagatcggtctcgatacaagctattggaccttcgtcaacgctttctccatctttggctcgattgcgttgtacttcggtatcatgtttgatttccactcagccggtattcacgtgctcttcccctccgctttccagtttacgggcaccgccagtaatgcattgcgtcagccgtatatatggctcacgatcatattggccgttgcggtttgtctactccctgttgtggccattagattcctgagtatgactatttggcccagcgaatcggacaagatccagaaacatagaaagaggctcaaagccgaagaacagtggcagagaaggcagcaggtgtttcgtaggggagtgagtacccgtcggagtgcctatgctttctctcatcagcgcggttacgcagatttgatttccagcggcaggagcatcaggaagaaaagatctccactggacgccatcgtagccgatgggacagccgaatatcgacggactggcgattcc

SEQ ID NO: 7300 - DNA, 3753 bp, Artificial Sequence
  Description of Artificial Sequence: Synthetic coding sequence
atgtcaacagaacgtgatagcgaaactaccttcgatgaagactcacaaccaaatgatgaggtcgtcccctactcagatgatgagacagaagacgagctggatgaccagggaagcgccgtggaacccgaacagaatagagtgaatagagaagccgaggagaatcgtgaaccatttcgtaaggaatgtacctggcaagtcaaagcaaacgatcggaaataccacgaacaaccacacttcatgaacacgaaattcttatgcattaaggagagcaaatatgcaaataacgctattaaaacctacaagtataatgccttcacatttatacccatgaatctgtttgaacaattcaagagagcggcaaacttgtactttctcgccttgttaattctgcaagccgttccccagatttcgactctcgcctggtacactacccttgtgccattgctggtggtccttggcgtgacagctataaaggaccttgttgacgatgtagctaggcataagatggacaaggagattaacaatagaacttgcgaagtcatcaaggatggcaggtttaaagtggctaagtggaaggaaatccaagtcggggacgttataagactgaagaagaatgattttgtgcccgcagatatccttttgttgtcttcctccgaacctaactccttgtgctatgttgagacagcagaactcgatggagagacgaatctgaagtttaaaatgagcctggagatcaccgatcagtatctccagagagaagacacactggccaccttcgatggcttcatcgagtgcgaagaacctaataatcgactggacaaatttaccggcacactgttttggagaaacaccagtttcccactagatgccgataaaatccttttaagaggatgcgtgataaggaatacagatttctgccacggcctggttattttcgctggcgccgacactaagataatgaaaaattctggaaagacaagattcaaaaggactaagattgattaccttatgaattacatggtgtacaccatcttcgtagtgttaatcctgcttagtgccgggctcgcaattggccacgcatactgggaagcacaagtagggaattcctcgtggtacctgtacgacggtgaggatgataccccatcatatcgcggcttcttgattttctggggttacataattgtcttgaataccatggtgcccattagcctttacgtgtccgtggaagtcattagactcggccaaagccacttcataaactgggacctccagatgtactatgccgagaaggacactcctgcaaaagcaaggacaacaactctgaatgaacagctgggacagatccactacatattttcagacaaaactgggactttaacccagaacatcatgactttcaagaagtgttgcatcaatggacagatatatggtgatcatcgtgacgcgtcacagcacaaccacaacaaaattgagcaggtggacttctcgtggaatacatatgccgatggcaagttggccttctatgatcattacctgatcgagcaaatacagtcgggcaaggaaccagaggtgcggcagtttttctttctcttagctgtctgtcacactgtcatggtcgataggacagacggtcagttgaattatcaggcagcttcaccagatgaaggggcacttgtcaatgccgcccggaattttggatttgcctttcttgctcgaactcagaatacgatcacaatctccgaattgggaactgagcgtacttacaatgttctggccattttagattttaatagcgacagaaagagaatgtctataattgtgcggactcccgaaggcaacattaagctgtactgtaagggagccgacaccgtgatttatgaaagactgcaccggatgaatcctacaaaacaagagacacaagatgcattagacattttcgccaacgagacactgaggactctgtgcctgtgctacaaagaaattgaagaaaaagagttcacagagtggaataaaaagttcatggcggcaagcgtggcttctaccaacagggacgaggctttggacaaggtctacgaggaaattgagaaggatttaattctactcggcgctactgccatcgaagacaaactccaggatggcgtgccagaaactatctccaagcttgcaaaggctgatatcaagatctgggtcctcactggagacaaaaaggaaactgcagagaacatcggtttcgcgtgcgagctcttgacggaagacacaacaatttgttacggagaggatattaattcattgttgcacgcgagaatggaaaaccaacgaaaccgcgggggagtttatgcaaaattcgcacctcccgtccaagagtcattcttccctccaggagggaatcgagcgctgataataaccggctcttggctgaacgagatcctccttgaaaagaagacaaaaagaaacaaaattctgaagctcaaatttccgcgtacagaagaggagagaaggatgcgcacgcaatccaaacgcaggcttgaggcgaaaaaagaacagagacagaaaaatttcgtggatcttgcgtgtgagtgtagcgccgtgatatgttgtcgagtcacacccaaacagaaagccatggtagtagatctcgttaaacgatataagaaggctattaccctggccatcggagatggcgccaatgatgtgaatatgatcaagacagcccacattggagtcggcatctctggacaggaaggaatgcaggccgtcatgtcttccgactattcgttcgcacaattccggtacctgcagaggttgttgttggtgcacggcagatggagctatattcgcatgtgtaagtttctgagatatttcttttataagaattttgcctttaccctggtccatttttggtattcgtttttcaacgggtattcagcccagaccgcctacgaagactggtttataacattgtacaatgtgttatatacatctttaccggtgttgcttatggggttgcttgatcaagatgtgtccgacaaactgtcactgcgtttcccgggcctctatatcgtggggcaacgagacttactgttcaattacaaaagattctttgtgtccctgctgcacggggtactgacttctatgattctatttttcatcccactgggagcttaccttcagaccgtgggccaggacggcgaagcccccagcgattaccagtcttttgccgtgactatcgcttccgctttggtgatcaccgtaaatttccagatcggcctggacacaagttattggacttttgtgaatgccttctctatctttggcagtatcgctctttatttcggcatcatgtttgacttccacagcgcaggcatccacgtcctttttccatccgccttccagttcactggaaccgcatctaatgccctgcgccaaccatacatctggttaaccatcatcctggccgtagcggtctgtctattgcccgtggttgctatccgatttctgtcaatgacaatctggcctagcgagagtgataaaattcagaaacataggaagagactgaaagccgaagagcagtggcaacgacgtcaacaggtctttcgaaggggagtcagcaccagacgcagtgcttacgccttttcgcatcaaagaggctacgcagacttgatctcgagcggccgatcgataaggaaaaaaagatcaccactggacgcaatcgtggctgacggtaccgccgagtatcggcgtaccggagatagt

SEQ ID NO: 7301 - DNA, 3753 bp, Artificial Sequence
  Description of Artificial Sequence: Synthetic coding sequence
atgtctactgaaagagactcagaaaccactttcgacgaggattcgcagcctaatgacgaggtggtgccatactcagacgacgagactgaagatgagctggatgaccaaggaagcgcagtggaaccggaacaaaacagggtcaacagagaagccgaagaaaacagagaaccctttaggaaggaatgcacgtggcaggtgaaagcgaacgacaggaagtaccacgaacaaccgcactttatgaacactaaattcctgtgcatcaaggagagcaagtacgctaacaacgctatcaagacttacaagtacaacgccttcaccttcatcccgatgaacctctttgaacagtttaagcgcgccgcgaacctgtacttcctggcgcttctcatccttcaggcagtccctcagatttccactctggcttggtacaccactctggtgccactgctcgtggtgttgggagtgactgcaattaaggaccttgtggatgacgtcgctagacacaagatggataaggagatcaacaaccggacctgcgaagtgatcaaggacggacgcttcaaagtagctaagtggaaggaaatccaagtcggagatgtgatccgcctgaagaaaaatgacttcgtacctgctgacatcctcttgctttccagctcagagccaaattcactgtgctacgtggaaactgccgagctcgatggggaaaccaacctgaaattcaaaatgtccctggaaatcaccgaccagtacctgcagcgcgaggacaccctggccacgttcgatggattcatcgaatgcgaggagccaaataaccgccttgacaaattcactggaaccctcttctggcggaacaccagcttccctctcgatgccgacaagatccttcttaggggatgcgttatccggaatactgatttctgccatggcctggtcatctttgctggggccgacactaagatcatgaagaattcgggcaagacccggttcaaacgcaccaagatcgattacctgatgaactatatggtgtacactatcttcgtggtcctgattctgctgtcggccgggctggctatcggacacgcctattgggaagcacaagtcggcaactcgagctggtacctctacgacggagaggacgatacgccgtcgtacagaggctttttgatattctgggggtacatcatcgtgctgaacaccatggtcccaatttccctgtacgtgtcagttgaggtgatcagactcggacagtcccacttcataaactgggacttgcagatgtactacgcggaaaaagatactccggcaaaggcgcggaccaccaccctcaacgagcagttggggcagatccactacatcttctccgataaaactggtactttgacgcagaatatcatgacgttcaaaaagtgctgcatcaacggtcaaatctacggcgaccatcgtgacgcttcgcaacataatcacaataagatcgaacaagtcgacttcagctggaacacctacgccgacgggaaactggccttttacgatcattacctcattgaacagatccaatcaggaaaggaaccggaagtgcgccagttcttcttcttgttggcggtctgtcacaccgtgatggtggaccgcactgatggccagctgaattaccaggcggcgagccccgacgagggagctctcgtcaatgccgctcgcaattttggcttcgcatttctggcgcgtactcaaaacaccatcaccatttccgaactgggaaccgagcgcacgtacaacgtcttggccatcctggacttcaactcagaccggaagagaatgtcgatcatcgtccgcactccggagggaaatatcaagctctactgcaagggagcagacacggtgatctacgagcgcctgcaccggatgaacccaactaagcaggaaactcaagacgcactggatatcttcgcgaacgagactcttagaaccctgtgtctgtgctataaagagatcgaggagaaggaattcactgaatggaacaaaaagttcatggccgcttccgtggcttctacgaaccgcgacgaggcactggacaaagtgtacgaggagatcgaaaaagacctcatcctgctcggagcgaccgctattgaagataaactgcaagacggcgttcctgagactatctccaaattggcaaaggccgatatcaaaatctgggtcctgaccggtgacaagaaggaaaccgcggaaaacatcggcttcgcctgcgagttgctcactgaagataccaccatctgctacggcgaggatatcaactcgcttcttcacgcccggatggaaaatcagcggaatagaggaggggtctacgctaagttcgccccgccggtccaggaatccttttttcccccgggaggcaatagggccctcatcatcaccggatcctggctgaatgaaatactcctggaaaagaaaaccaagcgcaacaagatcttgaagctcaagttcccgcgcaccgaggaggaacggcgcatgcgcacccagagcaaaagacggcttgaggcgaagaaggaacagcggcagaagaattttgtcgacctcgcctgtgagtgctcagcggtgatctgttgccgggtgacccctaaacagaaggcaatggttgttgacctcgtcaagaggtacaaaaaggcaatcaccctcgccatcggcgatggagcgaacgatgtaaacatgatcaaaaccgcgcatatcggagtgggaatatccggtcaggaaggtatgcaggccgttatgagcagtgattactccttcgcacaatttcgatacctgcagcggctcctgctggtccatggacgatggagttacatccgaatgtgtaagttcctgcgttacttcttctataagaacttcgccttcacgctcgtccacttctggtactcgttcttcaatggctactcggcccaaacggcctacgaagattggtttatcactctttacaacgtcctgtacacttccctgcccgtgctgcttatgggactgctcgatcaggacgtgagcgataaactttcgctccgcttcccaggactgtacatagtcggtcagcgcgacctcctcttcaactacaagaggttctttgtgtccctgctgcatggggtgctgacttctatgatcctgttctttatcccgcttggagcgtacctgcagaccgtgggacaggatggagaagctccatccgactatcaatcgtttgctgtaactattgcttccgccctcgtgattaccgtcaattttcagattggactcgacacgtcctactggactttcgtgaatgccttctcaattttcggatcgatcgcattgtacttcggtatcatgttcgattttcattcagcaggtatacacgtgctctttcctagcgcgttccaatttactggcactgccagcaatgcgttgagacaaccctacatctggctgactattatcctggccgtggcagtgtgtctcctgccggtcgtcgcaatccggttcctgagcatgaccatttggccctccgaaagcgacaagattcagaagcaccgcaagaggctcaaggcagaagagcaatggcagcgtcgccaacaagtgttccgccgaggagtgtcgactcggcggtccgcttatgcgttcagccatcagcgcgggtacgccgacttgatctcgtcgggacgctcgatccgcaagaaaaggtccccactcgacgccatcgtcgcagacgggaccgcagaataccggagaacgggtgattca

SEQ ID NO: 7302 - DNA, 3753 bp, Artificial Sequence
  Description of Artificial Sequence: Synthetic coding sequence
atgtccacagaaagggatagcgagaccacctttgatgaggactcccagccaaatgacgaggtcgtgccttacagcgatgacgagacggaggatgagcttgacgatcaggggagcgctgtggagcccgaacagaatagggtgaatagagaagcggaagaaaatagagagcctttccgaaaggaatgtacgtggcaagtaaaagccaatgatagaaagtaccacgaacagccgcacttcatgaacacaaaattcctttgtataaaagaatctaagtatgccaataacgccataaaaacctataaatacaacgccttcaccttcattccaatgaatctgttcgagcaattcaaaagagctgccaacctgtactttttggccctcttgatcttacaggcggttccccagatatccacactagcttggtacacaaccttagttcctctgctggtggtgctgggagtgaccgcgattaaggacctggttgatgacgtggctcgacacaagatggataaggaaataaacaacagaacgtgtgaggtgattaaggacggccgattcaaggtcgccaaatggaaggagatccaggtaggtgacgtgattaggctcaagaaaaatgattttgtgccagccgatatccttctactctcttcgagtgaacccaacagtctttgctatgtggaaactgccgaactcgacggggaaaccaatcttaagtttaagatgtcattggaaattaccgaccaatacctccagagggaagacactttggcaacatttgacggatttatcgagtgcgaggagcctaataacaggctggataagttcaccggcacccttttctggcgaaacacttctttccccttggatgcggataagattcttctaagaggttgtgtgattcgtaacactgacttctgtcacggcctcgtgatctttgctggggcagatactaaaatcatgaagaactctggaaagacccgatttaagcgcaccaaaatagactacctgatgaattacatggtttacacaatattcgtggttcttattctgttgtcagcaggcctcgccattggccatgcgtattgggaagcccaagtgggaaatagctcctggtatctttacgacggcgaggacgacaccccctcctaccgtgggttcctcatcttttggggttacataatcgtgctgaatactatggtgcccatctccctgtatgtaagcgtcgaagtgatacgcttgggccagagccattttattaattgggatcttcaaatgtactatgctgagaaagacacccctgccaaggcccggactactactctgaatgagcaactcgggcaaattcattacatctttagtgataagaccggaaccctgacacagaatatcatgacctttaagaagtgttgcattaatggacagatctatggcgaccacagagacgcttcccagcataatcataacaaaatcgagcaggttgatttctcctggaacacctacgccgacggcaaattagccttttacgaccactatcttattgaacagattcagtccggaaaagagcccgaagtacggcagttcttcttcctcctagctgtatgccatactgtgatggtagatcgcaccgatgggcagctgaattatcaggcagcatccccagacgagggagccctggtcaatgccgcacgtaacttcggattcgcctttttggcaagaacccaaaatactataactatctccgaactgggcaccgagagaacctacaatgtgcttgccattctcgactttaattctgaccgcaaacgaatgtccatcattgtgagaactcctgaggggaatattaagttatattgcaagggtgccgataccgtaatctacgagaggctgcaccgtatgaacccgacgaagcaagagacacaggatgctctcgacatttttgccaacgagaccctgcgtacgctgtgcctctgctataaagagattgaggaaaaagagtttacagaatggaacaagaagttcatggccgcatctgtcgcgtcaacaaaccgcgacgaggccttggacaaagtttacgaagagatcgaaaaggatctgattctactgggcgcgaccgcgatagaagacaagctccaggacggagtacctgaaacaatctctaagctcgccaaagcagatatcaagatttgggtgctcacgggagataagaaggaaacggcggagaacatcggcttcgcctgcgaattgcttactgaggacacaacgatttgttacggcgaagacattaactctcttctgcacgcaagaatggaaaaccagcggaaccgtggtggagtgtatgctaaatttgctccccctgttcaagagagttttttcccaccaggcgggaacagagccctgatcatcacagggtcctggctgaacgagatcctgctagaaaagaaaacaaaacggaataaaatactgaaacttaagtttcctaggactgaggaggagcgtaggatgcgcacccagagcaagcgtaggctcgaagcgaagaaagagcagcggcagaagaatttcgtggatttggcatgcgagtgttcagcagtgatttgttgtcgcgtcactcctaaacagaaggccatggtcgtggatctggtcaaaaggtacaagaaggcaatcacacttgcgataggtgacggcgcaaatgacgtgaacatgatcaagactgcgcatattggggtgggcatttctggacaagagggcatgcaggctgtgatgtccagtgactactccttcgcacaatttcggtacttgcagcgcctactgctggtgcacggcaggtggagttatatccgcatgtgcaagtttctccgctattttttttataaaaactttgcttttacgttggtacacttctggtactccttttttaacggttatagtgcacagaccgcttatgaggattggttcatcactctatataacgtcctttataccagcttacctgttctcttgatggggctactggaccaggatgtaagcgacaagctatccttgcggtttccaggactctacatagtgggacagcgggatctcctatttaattacaagaggttctttgttagcctcctgcacggggtccttacaagcatgatcctcttttttattcctttgggggcctacttgcaaacagtcggccaagacggcgaagccccttccgattatcagtctttcgctgtgacaatcgcctccgcactggtgatcaccgtaaacttccaaatcgggctggacacttcgtactggactttcgtgaacgcatttagtatcttcggttccatcgcgctgtacttcggcatcatgtttgacttccattccgctgggattcacgtgctcttcccttcagccttccagttcactggtactgcatctaacgccttgcggcaaccctacatctggcttactattattttagcagtcgccgtgtgtctattgcctgttgtagcgattagattcctgtctatgactatttggccctccgagagtgacaagattcagaaacatcgtaaaagactcaaagccgaagaacagtggcaacggagacagcaagtttttcgcaggggcgtgagcaccaggcggagcgcctatgcattttcacaccagcgtgggtatgcagatctgattagctcaggaagatctattcgaaagaagcggtctcccctcgatgcgatcgtggctgacggaactgccgagtaccgtagaaccggggactca

SEQ ID NO: 7303 - DNA, 3753 bp, Artificial Sequence
  Description of Artificial Sequence: Synthetic coding sequence
atgagcactgagcgcgactctgagactactttcgatgaggacagccagccgaacgacgaggtcgtgccttactcagacgacgaaaccgaggacgagctggatgatcaaggcagcgccgttgaaccggaacaaaacagagtgaacagagaggcggaagagaacagagaaccgttcaggaaggaatgcacctggcaagtcaaggccaatgacagaaaataccatgaacagccccatttcatgaacactaagtttctctgcatcaaggaatctaagtacgccaacaacgccatcaagacttataagtacaacgcgttcaccttcatcccgatgaacctttttgaacagtttaagcgcgcggccaacctgtacttcctggcccttctcatcctccaggcggtgccacagatctcgaccctggcttggtacaccacgctcgtcccgctcctggtggtgctcggagtaaccgcgatcaaggacctggtggacgatgtggctcgccataagatggacaaggaaatcaacaaccgcacttgtgaagtgataaaagacggacggtttaaagtggccaagtggaaagaaatccaggtgggtgacgtgattagactcaagaaaaatgatttcgtgccggctgacatcctgcttctctcctcatcggagccaaattcactctgctacgtggaaaccgccgagctggacggcgagactaacctgaagtttaagatgtccctcgagatcacggatcagtacttgcagcgggaggacacgctcgccacctttgacggcttcatcgagtgcgaggaacctaataacagattggacaagttcaccgggacccttttttggcgcaacacttcattccccttggacgcagataagattctgctgaggggatgcgtgatccggaatacggatttttgccacggtctggtcatcttcgccggggccgacaccaagatcatgaaaaactccggaaagaccagattcaaacggaccaagatcgattacctcatgaattacatggtgtacactatctttgtggtcctcatcctgctgagcgccggcctcgccatcggccatgcatactgggaggcgcaggtggggaattcgagctggtacctttacgatggcgaggatgacactccatcctaccggggcttcctgatcttctgggggtacattattgtgctgaacactatggtgcctatctctctgtacgtcagcgtggaggtgatcagattgggccaatcgcacttcatcaactgggacctgcaaatgtactacgcagaaaaggatactcctgcaaaggcgcggaccaccaccttgaacgaacaactcggacagatccactacattttctccgacaagacgggcactctcacccaaaacatcatgaccttcaagaaatgctgcatcaacggacagatctacggcgaccaccgggacgcctcccaacacaatcacaacaaaatcgagcaggtggatttctcgtggaacacttacgcagacgggaagctcgctttctacgatcactaccttatcgaacagatccagtctggaaaagagcccgaagtgcgccaattcttttttcttctggccgtgtgccatactgtgatggtcgaccgcaccgatggacagctgaactaccaggcagccagcccagatgaaggagcactggtcaatgctgccagaaatttcggtttcgcttttctggctcggactcagaacactatcactatcagcgagcttggaactgagcgcacttacaacgtcctggcaatcctcgactttaacagcgatagaaagcggatgtccatcattgttcgcactccggagggcaacatcaagctgtactgcaaaggagccgataccgtcatctacgagaggctgcatcgcatgaacccgactaagcaggaaactcaggatgcgctggacatcttcgccaacgagacgctgcggactctctgcctgtgctacaaagaaatcgaagagaaggaattcactgagtggaacaaaaagtttatggctgcctctgtggcatccaccaaccgggacgaagcactggacaaagtgtacgaagaaatcgagaaggacctgattctcctcggagcgactgccatcgaagataagctgcaggatggggtgcctgaaaccatctcaaagctggcaaaagccgacatcaagatatgggtgttgaccggagataagaaggaaacggcagagaatattgggtttgcctgtgaactgctcacggaggataccaccatttgctacggagaggacatcaactcactgctgcatgctcggatggaaaatcaaagaaatcggggaggcgtttacgctaaattcgcaccgccagtgcaagagtccttcttcccacctggtggaaaccgcgcgcttatcatcaccggaagctggctcaatgagatcctgctggaaaagaaaacgaagcggaacaaaattctgaagctgaagttcccacggaccgaggaagaacgccggatgaggacgcagtcgaaacggcggctggaggccaagaaggaacaacgccagaaaaacttcgtggacctggcctgcgaatgtagcgccgtgatctgctgcagagtgacccctaaacagaaggccatggtggtggatctcgtcaagcgttacaagaaggccatcactcttgccatcggcgacggcgctaacgatgtgaacatgatcaagaccgcccacatcggcgtcggaatctcgggtcaagagggtatgcaggcagtgatgtcgagcgactactcgtttgcccagttccgctatctgcaacgcctgctcctggtgcatggtagatggtcgtacattcgcatgtgcaagtttctgcggtacttcttctacaagaatttcgctttcacgctggtgcatttctggtacagcttcttcaacggatactcagcgcaaactgcgtatgaagattggttcatcacgctgtacaatgtcctgtacacttcgctgccggtgctgctgatgggacttctggaccaggacgtttcagacaaactttcgctccgttttcctgggctgtacatcgtgggccaaagggatctcctcttcaattacaagcggttcttcgtctcgttgttgcacggagtgctcacctccatgatcttgttcttcatcccactgggagcatatctgcagactgttggacaggacggggaagctccgagcgactaccagtccttcgcggtgaccattgcgagcgctctggtgatcaccgtcaacttccagatcggacttgacacttcgtactggaccttcgtgaacgccttcagcatcttcggttccattgccctgtacttcggaatcatgttcgatttccattcggcaggaatccacgttctgtttccgagcgcattccaatttaccggcaccgcctccaatgcgctccggcaaccatacatctggctcactatcatccttgctgtggccgtgtgtctcctcccagtggttgccatcagattcctctctatgaccatctggccgagcgaatcagacaagatccaaaagcacagaaaacggttgaaggccgaggaacaatggcagcgccgccagcaggtgttccgccgaggtgtgtcgactcggcggagcgcctatgcgttcagccatcagcgcggatacgcggatctcatcagctcaggacgctcgatccgcaagaagcgcagcccgctcgacgccatcgtcgcggatggaaccgccgaataccggaggaccggagactcc

SEQ ID NO: 7304 - DNA, 3753 bp, Artificial Sequence
  Description of Artificial Sequence: Synthetic coding sequence
atgagcactgagcgagattcagagaccacttttgatgaagactctcagcccaacgacgaagtcgttccttactccgatgacgagaccgaagatgagcttgatgaccagggctctgcagttgagcctgaacagaaccgagttaacagggaggctgaggagaatcgtgaaccatttaggaaggaatgtacgtggcaagttaaggcgaatgataggaagtatcatgagcagccccattttatgaatacaaaatttttatgcatcaaagagagtaagtacgctaacaatgctattaagacttacaagtacaacgctttcacatttatacctatgaacctctttgagcagttcaagagggctgctaacttgtatttccttgctctgttgattcttcaagcagtgccccaaatttccacgctggcttggtacacaaccctggtgcccttgctggtcgttttgggtgttacagctataaaggacctggtcgatgatgtcgcacgccacaagatggataaggagattaacaaccgaacctgcgaagtcattaaggacggccgcttcaaggtggcgaagtggaaggaaatccaagtgggcgatgtgatacggctgaaaaagaatgacttcgtgcccgctgacatcttgctcttatcgtcatcagaacctaattccctctgttacgtcgaaaccgccgagctggacggggagaccaacctgaaatttaagatgtcgctcgagatcaccgatcagtatctgcagcgggaagacacgctggcgaccttcgatgggtttatcgagtgcgaggagcccaataatcgtcttgacaagttcaccggaacgctgttctggaggaacaccagcttcccccttgatgccgataaaatccttctcaggggatgtgtaattcggaacactgacttctgccatggccttgtaatcttcgctggtgccgataccaaaattatgaagaactccggcaaaacacgtttcaaaaggacaaaaatagattacctgatgaactatatggtgtatacgattttcgtggtattgatcctgctgtctgccggtttagccatagggcatgcatattgggaggcacaagtggggaacagttcgtggtacctctacgacggtgaggatgatacacccagctatcgtggattcctgatcttctggggatatattattgtgctgaacacgatggtacccatctctctctacgtctccgtggaagtgatccgcctcggtcagtcgcatttcattaactgggacttgcagatgtattatgctgagaaggatacacccgccaaagcccgcaccacaaccctcaacgagcaactgggccagatccactatatattttccgacaaaaccggtaccctcacccaaaatattatgacattcaagaaatgttgcatcaacggacagatttacggcgaccatcgagatgcctcccagcacaatcacaataaaattgagcaagttgacttctcgtggaatacatatgctgatggaaaactggccttttatgatcattatctcatcgaacaaatacagagcggcaaagagccagaggtacgccaatttttcttcttgttggctgtttgccatacagtgatggtggatagaaccgacggtcagctgaactatcaagccgccagtcctgatgagggcgccttggttaacgcagccagaaattttgggttcgctttcctcgcacgcacccagaataccataactattagtgaactcggaactgaaaggacctacaatgttctcgcaatcctggactttaactccgacaggaagcggatgtccattattgtccggactcccgagggcaacataaaactgtactgtaaaggggctgatacagtcatctatgaacggctgcacagaatgaatcctaccaaacaggaaacacaagatgccctcgacatctttgccaatgagactctgcggaccctctgtctttgctacaaggagattgaagagaaggagtttacagagtggaataagaagtttatggccgcctccgtcgcatcaacgaatagagatgaggccttagataaagtgtatgaggagatcgagaaagacttgatcctgctgggggctactgccatcgaggataagctgcaagacggtgtccctgagactatctccaagctcgcgaaagcggacattaagatctgggtcctgaccggcgataagaaagagactgctgaaaacatagggttcgcctgtgagttacttacagaagacactactatatgttacggagaggatattaatagtttgctgcacgcacgcatggagaaccaaaggaatagaggtggcgtttacgcaaagtttgctccacctgtccaggaatccttcttcccacccggcggaaatcgcgcacttattataaccgggtcatggttaaatgaaattctattagaaaaaaaaacaaagagaaataagatattaaaacttaaattcccgagaacggaggaggaaagaaggatgcgaacacagtccaaacgacgtctcgaagctaaaaaggaacagagacaaaagaattttgtggacttggcttgtgaatgctcagcggtgatctgctgtagggttacacctaagcagaaggcaatggtggttgacttggtcaagcgttataaaaaggccattaccttggccatcggagatggagccaacgacgtgaatatgattaaaaccgcccatataggagtgggcatctctggacaagagggcatgcaggcagtgatgtcctccgactactccttcgcccaattcagatacctgcagagactcctgctggtgcatggtaggtggtcttatatcaggatgtgtaaatttctccggtattttttctataaaaactttgcattcactctggtgcacttttggtattcgttttttaatggctattctgcccagacggcctatgaagattggtttatcacactctataatgtgttatatacaagcctgcccgtgctcctcatggggcttctggaccaggacgtgtccgacaagctgtcactcaggtttcccggtctttatatcgtcggtcagcgcgaccttctgtttaactataaacgatttttcgtctccctgcttcatggtgtgctgacctctatgatcctattctttataccccttggcgcttaccttcaaacagttgggcaagacggtgaggccccatccgactaccagtcttttgcagtgacgatagcctctgcccttgtcataactgtaaattttcaaatcggtcttgatacctcctattggaccttcgtgaacgcattctctatcttcggcagtatcgcactgtacttcggcattatgttcgactttcactctgctggaatacacgtgttgttcccttccgcattccaattcacaggcaccgcttctaatgctctgcgccagccctacatctggctgactattatcctggccgtggccgtctgtctcctccccgtggtggcaatcaggttcttgtcaatgaccatatggccatccgagagcgataagattcaaaaacatcgcaaacgtttgaaggcggaagagcagtggcagagacgccaacaagtttttcgtaggggcgtatccaccagaagatccgcctacgcattctcacaccagaggggttacgctgatctgatctctagtgggagatcgattaggaagaagagaagtccccttgacgccatcgtcgcagatgggaccgcagaatacaggcgaacaggggactcg

SEQ ID NO: 7305 - DNA, 3753 bp, Artificial Sequence; identical to SEQ ID NO: 7265
  Description of Artificial Sequence: Synthetic coding sequence

SEQ ID NO: 7306 - DNA, 3753 bp, Artificial Sequence
  Description of Artificial Sequence: Synthetic coding sequence
atgagcaccgaacgcgatagcgaaaccaccttcgacgaggactcgcagcctaatgacgaggtcgtgccgtactcagacgatgagactgaggacgagcttgacgaccaggggagcgcagtggagcctgagcagaacagagtgaacagagaagcagaggagaatcgggaaccctttcggaaagaatgcacttggcaggtgaaggcgaacgacagaaaataccacgagcagcctcactttatgaacaccaaattcctctgtatcaaggagagcaagtacgcgaacaacgcaatcaagacctacaagtacaacgccttcacttttatcccgatgaatctgttcgagcagttcaagcgcgccgcaaatctctactttctggcactgttgatcctgcaggcggtcccgcagatcagcactctcgcttggtacacgaccctcgtgccactgcttgtcgtcctgggcgtgaccgcaatcaaagatcttgtggacgatgtggcccggcataagatggataaagagatcaataacaggacctgcgaagtcatcaaggacggcagattcaaagtggctaaatggaaggagatccaggtgggagacgttatcagactgaagaaaaacgatttcgtgcctgctgacattttgctgctcagctcgtcggaaccgaacagcctgtgctacgtcgagactgccgaactggacggggaaaccaacctgaagttcaagatgtcgctggaaatcactgatcagtacctgcaacgggaggatacgttggctactttcgatggttttatcgagtgcgaggaaccgaataaccgactggacaaattcaccgggactttgttctggcgaaacacttcgttcccgctggacgcggataagatccttcttcggggatgcgtcattcgcaataccgacttctgccacggactcgtgatcttcgcaggagcagatactaagataatgaagaattctgggaaaacgagatttaagcgcacgaaaatcgattacctgatgaattacatggtctacacgatctttgttgtgctgattctgctctccgccggtttggcgatcggacacgcttactgggaagcacaggtcggaaattcctcgtggtacctgtatgacggagaagatgacaccccttcataccgaggatttctcatattctggggatacatcattgtgctgaacaccatggtgccgatcagcctctacgtgtctgtggaagtgatccgcctggggcaatcacactttatcaactgggaccttcaaatgtactacgctgaaaaggacactccagccaaggctagaaccaccaccctgaacgagcagctcggacagatccactacatcttctcggataagactggtactttgacccagaacatcatgacgttcaagaaatgttgcatcaacggacaaatctacggtgaccacagggatgcctcacagcacaatcacaacaagatcgagcaggtcgacttttcatggaacacttatgccgacggcaaactcgcgttctacgaccattacctgattgaacagatccagtccgggaaggaaccggaagtccgccaattcttcttcttgctggccgtgtgtcacaccgtgatggtcgatagaactgacggtcaactcaactaccaagcagcctcgcctgacgagggagcgctggtcaacgccgcgcggaactttggatttgccttcctcgccagaactcagaacaccataaccatttccgagctggggactgaacgcacctacaacgtcctggccatcctggatttcaactcggaccgcaaacggatgtctatcatcgtgagaaccccagagggtaacatcaagctgtactgtaagggtgccgatacggtgatctacgagcgcctccacagaatgaacccgaccaagcaggagacgcaagacgcgctggatatctttgctaatgaaactctccggactctgtgcctgtgctataaagagattgaagagaaggaattcactgagtggaacaagaagttcatggcggcttcagtggcatcgaccaacagagacgaggctctggacaaggtctacgaagaaatcgaaaaggacttgatcctgttgggagccactgcgatcgaggacaagctgcaagacggagtccctgagactatctcaaagctggcaaaggcagatatcaagatctgggtgttgactggagacaagaaggaaaccgcggagaacatcgggtttgcctgtgaactcctgaccgaagatactactatctgctacggagaagatatcaattcgctgctgcacgcccggatggaaaatcaacgcaaccgcggcggcgtctacgcaaagttcgcacccccagtccaagaatccttcttcccacccggcggtaacagagccctcatcatcactggctcgtggctgaatgagatcctgctggaaaagaaaaccaagcgcaacaagattctcaagctcaaattccctcggactgaagaagagagacggatgagaactcaaagcaagcgccgcctcgaagcaaagaaggaacaaagacagaagaatttcgtggacctcgcatgtgaatgctctgcggtgatctgctgccgcgtcacgccaaaacagaaggctatggtggtggatctcgtgaaaaggtacaaaaaggccataaccctggctatcggggacggggccaatgacgtcaatatgatcaagactgcgcatattggtgtggggatctccggccaagagggaatgcaggcggtcatgtctagcgactactcctttgcccaattccggtacctgcagcgccttttgctcgtgcatggacgctggtcctacatccgaatgtgcaagttccttcggtactttttctacaaaaactttgcgttcactttggtgcatttctggtactcttttttcaatggatactcggctcagactgcatacgaggactggttcatcaccctgtacaatgttctgtatacgtcgctccctgtgctgttgatgggacttctcgaccaggacgtgtcagacaaactctcactccgcttcccgggactgtacatcgtgggacagagggacctgctctttaactacaaaagattcttcgtgtcactcctgcatggagtgctgacgagcatgatcctgtttttcatccccctgggagcttatttgcagaccgtcggacaggacggagaagccccgtcggattaccaatcctttgccgtcactatcgcctcggccctggtgatcacggtgaattttcaaatcggactcgataccagctactggacgttcgtgaacgctttttcaatcttcgggagcatcgctctgtacttcggaatcatgtttgacttccattccgccggtatccacgtcctctttccgagcgcttttcaattcactggcaccgcgagcaatgcacttcggcaaccgtacatttggctgacgatcatcttggccgtggccgtgtgcctgctgccagtggtggctatccggttcttgtccatgactatctggccttcggaatccgacaagatacagaagcaccggaagcgcttgaaggctgaagagcagtggcagagacggcagcaagtgttcaggcgcggtgtgagcacgcgtcggtcagcttatgccttctcccaccagcggggatacgcggacctgatctcctccgggcgcagcatccggaaaaagaggtcaccgctcgatgctattgtggctgatggaactgccgaatatagacggaccggagactcg

SEQ ID NO: 7307 - DNA, 3753 bp, Artificial Sequence
  Description of Artificial Sequence: Synthetic coding sequence
atgtcgacggaacgagattcggaaacgacgtttgatgaagattcgcaaccgaatgatgaagtagtaccgtattcggatgatgaaacggaagatgaattagatgatcaaggttcggcggtagaaccggaacaaaatcgagtaaatcgagaagcggaagaaaatcgagaaccgtttcgtaaagaatgtacgtggcaagttaaagcgaatgatcgtaaatatcatgaacaaccgcattttatgaatacgaaatttctatgtataaaagaatcgaaatatgcgaataatgcgataaaaacgtataaatataatgcgtttacgtttataccgatgaatttatttgaacaatttaaacgagcggcgaatttatattttctagcgttattaatactacaagcggttccgcaaatatcgacgctagcgtggtatacgacgttagtaccgttattagtagttttaggtgtaacggcgataaaagatctagtagatgatgtagcgcgtcataaaatggataaagaaataaataatcgtacgtgtgaagtaataaaagatggtcgttttaaagttgcgaaatggaaagaaatacaagttggtgatgtaatacgactaaaaaaaaatgattttgtaccggcggatatattattattatcgtcgtcggaaccgaattcgttatgttatgtagaaacggcggaactagatggtgaaacgaatctaaaatttaaaatgtcgttagaaataacggatcaatatctacaacgtgaagatacgttagcgacgtttgatggttttatagaatgtgaagaaccgaataatcgattagataaatttacgggtacgctattttggcgaaatacgtcgtttccgttagatgcggataaaatattattacgtggttgtgttatacgaaatacggatttttgtcatggtttagttatatttgcgggtgcggatacgaaaataatgaaaaattcgggtaaaacgcgttttaaacgtacgaaaatagattatttaatgaattatatggtatatacgatatttgttgttctaatattactatcggcgggtttagcgataggtcatgcgtattgggaagcgcaagttggtaattcgtcgtggtatctatatgatggtgaagatgatacgccgtcgtatcgaggttttctaatattttggggttatataatagttttaaatacgatggttccgatatcgttatatgtatcggttgaagtaatacgattaggtcaatcgcattttataaattgggatttacaaatgtattatgcggaaaaagatacgccggcgaaagcgcgtacgacgacgttaaatgaacaactaggtcaaatacattatatattttcggataaaacgggtacgttaacgcaaaatataatgacgtttaaaaaatgttgtataaatggtcaaatatatggtgatcatcgtgatgcgtcgcaacataatcataataaaatagaacaagtagatttttcgtggaatacgtatgcggatggtaaattagcgttttatgatcattatttaatagaacaaatacaatcgggtaaagaaccggaagtacgtcaatttttttttctactagcggtatgtcatacggtaatggtagatcgaacggatggtcaactaaattatcaagcggcgtcgccggatgaaggtgcgttagtaaatgcggcgcgaaattttggttttgcgtttttagcgcgaacgcaaaatacgataacgatatcggaattaggtacggaacgaacgtataatgtattagcgatactagattttaattcggatcgaaaacgtatgtcgataatagtacgaacgccggaaggtaatataaaattatattgtaaaggtgcggatacggttatatatgaacgattacatcgtatgaatccgacgaaacaagaaacgcaagatgcgttagatatatttgcgaatgaaacgctacgtacgttatgtctatgttataaagaaatagaagaaaaagaatttacggaatggaataaaaaatttatggcggcgtcggttgcgtcgacgaatcgtgatgaagcgttagataaagtatatgaagaaatagaaaaagatttaatattattaggtgcgacggcgatagaagataaactacaagatggtgttccggaaacgatatcgaaattagcgaaagcggatataaaaatatgggtattaacgggtgataaaaaagaaacggcggaaaatataggttttgcgtgtgaattactaacggaagatacgacgatatgttatggtgaagatataaattcgctattacatgcgcgtatggaaaatcaacgaaatcgtggtggtgtatatgcgaaatttgcgccgccggttcaagaatcgttttttccgccgggtggtaatcgagcgttaataataacgggttcgtggttaaatgaaatactattagaaaaaaaaacgaaacgtaataaaatattaaaattaaaatttccgcgtacggaagaagaacgacgaatgcgaacgcaatcgaaacgacgtctagaagcgaaaaaagaacaacgacaaaaaaattttgtagatctagcgtgtgaatgttcggcggtaatatgttgtcgagtaacgccgaaacaaaaagcgatggtagttgatctagtaaaacgatataaaaaagcgataacgttagcgataggtgatggtgcgaatgatgtaaatatgataaaaacggcgcatataggtgttggtatatcgggtcaagaaggtatgcaagcggttatgtcgtcggattattcgtttgcgcaatttcgatatttacaacgattactattagttcatggtcgttggtcgtatatacgtatgtgtaaatttctacgttattttttttataaaaattttgcgtttacgttagtacatttttggtattcgttttttaatggttattcggcgcaaacggcgtatgaagattggtttataacgctatataatgtattatatacgtcgttaccggtactattaatgggtctattagatcaagatgtatcggataaactatcgttacgttttccgggtctatatatagttggtcaacgagatctattatttaattataaacgtttttttgtttcgctactacatggtgtattaacgtcgatgatactattttttataccgctaggtgcgtatctacaaacggttggtcaagatggtgaagcgccgtcggattatcaatcgtttgcggtaacgatagcgtcggcgttagtaataacggttaattttcaaataggtttagatacgtcgtattggacgtttgttaatgcgttttcgatatttggttcgatagcgctatattttggtataatgtttgattttcattcggcgggtatacatgtattatttccgtcggcgtttcaatttacgggtacggcgtcgaatgcgctacgacaaccgtatatatggctaacgataatattagcggttgcggtatgtttattaccggtagttgcgatacgatttctatcgatgacgatatggccgtcggaatcggataaaatacaaaaacatcgtaaacgtctaaaagcggaagaacaatggcaacgtcgtcaacaagtttttcgacgtggtgtttcgacgcgacgttcggcgtatgcgttttcgcatcaacgtggttatgcggatttaatatcgtcgggtcgatcgatacgaaaaaaacgatcgccgctagatgcgatagtagcggatggtacggcggaatatcgacgaacgggtgattcg

SEQ ID NO: 7308 - DNA, 3753 bp, Artificial Sequence
  Description of Artificial Sequence: Synthetic coding sequence
atgagcacagagagggacagcgagacaactttcgatgaggactcgcagcccaacgatgaggttgttccttattcagatgacgaaacagaggatgagctggacgaccagggctcagcagtggagcccgaacagaatagggtgaaccgggaggccgaggaaaatagggagccttttaggaaagagtgcacatggcaggtcaaggcaaatgacaggaagtaccatgagcaaccccactttatgaacaccaagttcctttgcatcaaggagtctaaatatgcaaataacgccatcaaaacctataagtataacgcatttacatttatccccatgaacctgtttgaacagttcaaacgtgctgctaatctttactttttggcgctgttaatcctccaggcagtgccacagatatctacactggcctggtataccaccctggtgcccctgttggttgtgctgggggtcacagcaattaaagacttggtggatgacgtagcccgccataaaatggataaggaaatcaacaataggacgtgcgaggtgattaaggatggccgcttcaaagtggccaaatggaaagaaatccaggttggagacgtgattagactgaaaaagaatgatttcgtgccagccgatatacttctgctgtctagtagcgaaccaaattccctctgttatgttgagaccgccgagttggatggcgagaccaaccttaagttcaaaatgagccttgaaatcacagatcagtacttgcagcgggaggatacactggctactttcgacggctttatagaatgcgaagaacctaacaataggctcgacaagttcacaggcactctgttttggagaaacacctcgtttccgctggacgccgacaagatcctgttgcgtggctgtgtaatccggaatacggacttctgccatgggctggttatattcgctggcgccgacactaagatcatgaaaaattctggaaagacacggttcaaacgcactaaaattgactacctcatgaactacatggtgtacactatctttgtagtgttgatcctgctcagcgcaggattagctattgggcacgcatactgggaggctcaggtcggaaattcttcctggtacctctatgacggtgaagacgacactcctagctaccgggggtttttaatattttggggctacattatcgtcttgaacaccatggtaccaattagcctctatgtttcagtcgaggtgatacgactgggacagtctcattttataaattgggatctccagatgtactatgctgagaaggacaccccggcaaaagctaggaccactaccctaaatgaacagctaggccaaattcattacatcttttcagacaagactgggacactaacacaaaatattatgacttttaaaaagtgttgcatcaacggacagatctacggcgatcacagagacgccagtcagcataaccacaacaaaatcgaacaggtggatttctcttggaatacttatgctgacggcaagctcgccttctacgatcactatttaatagaacagattcaaagcgggaaggagcccgaggttcgccagtttttcttcctcctggccgtgtgtcataccgttatggtagatcggacagatggacaacttaattatcaggcggcctcaccggatgaaggggctctcgtaaatgctgcccgcaacttcgggtttgctttcttggcacggacacagaataccatcacgatatccgaattgggaaccgagagaacatacaatgtgctcgcaatcttagacttcaacagcgatagaaagcgtatgtccattattgttaggactcctgaaggcaacattaaactgtattgtaaaggggccgacaccgtgatctatgaacgcctacacagaatgaatccaactaagcaggagactcaggacgccctggatattttcgctaatgagacactgagaacgctctgcctttgctacaaggaaatcgaagagaaggagttcacagagtggaataagaagttcatggccgcatccgtggccagtacgaatcgagatgaggctctcgacaaagtgtacgaggagatcgagaaggacttaatactgctgggcgccactgccattgaagacaagctgcaggatggcgtcccggagacaatcagcaaactggcgaaagccgatattaaaatatgggtgctcacgggagacaaaaaagaaacagcagaaaatatcggattcgcgtgcgaattactgacggaggatacaaccatctgttatggagaagacatcaatagtttgctccatgcacgcatggagaaccagcgaaacagggggggcgtctacgctaaatttgctcccccagtacaggaaagcttctttccccccggcggcaacagagcactgattattacagggagctggctgaatgagattctgctcgaaaagaagactaaacggaacaaaatcttgaaattaaagtttccccggaccgaagaggagcgtcgaatgaggacccagtcaaaaaggcgtctggaagcaaaaaaggagcaacgccaaaagaactttgttgatctcgcatgtgagtgctccgctgttatatgctgtagggtcacgcccaagcaaaaggctatggtggtggatttggtcaagcggtacaagaaagccataactcttgcaatcggagacggcgcaaacgacgttaacatgatcaaaaccgcccatattggcgtgggaatcagtgggcaggaaggcatgcaggcggttatgagctccgactattcctttgcccagttccgatacctgcagcgcctgctgctggtccacggccgctggagctatatccgcatgtgcaagttcctccgctacttcttctacaaaaattttgccttcactttggtccacttttggtattcattcttcaatggctacagtgcccagacagcatatgaggactggttcatcactctgtacaatgtgctgtatacttctttgcccgttctattaatgggcctgttagaccaggacgtcagcgataaactatcattgcgattccccggcctgtacatcgtgggtcagagagacctgttatttaactataagcgcttcttcgtctccctactgcatggagtgcttaccagcatgattcttttcttcattcctttgggcgcctacttgcagaccgtcgggcaggacggcgaagccccctctgactatcaaagcttcgccgtgactatagccagcgcgttagttatcacagtaaattttcaaattggtctggatacatcttattggacctttgtaaatgcttttagcatcttcggatcaattgctttatacttcggcattatgtttgacttccacagcgccggtattcatgtgcttttcccatcagccttccagtttaccggtaccgcctctaacgccctcagacaaccctatatctggctaaccatcatactcgctgtggcagtgtgtttgctccctgtggtcgcgatccgctttttgagcatgaccatttggcccagcgaatctgataaaatacagaagcaccggaagcgcctcaaagcagaggagcaatggcagagacgtcaacaggtgtttcgccgtggagtgtctactcggcgcagtgcatacgccttctcccaccaacgtggctatgcagacctgatatcgagtggccgctcgattcggaagaagcgatccccactggatgcgattgtggctgatggtacagcggagtaccgacgcacgggagactcc

SEQ ID NO: 7309 - DNA, 3753 bp, Artificial Sequence
  Description of Artificial Sequence: Synthetic coding sequence
atgtctaccgagcgagacagtgaaacgacattcgacgaggattcacaaccaaatgacgaggtcgtcccctatagtgatgacgagaccgaagatgagctggatgaccaggggagcgctgtggaacccgagcagaacagggtgaaccgtgaggctgaggaaaacagggaaccttttcgaaaggaatgcacgtggcaggttaaagctaacgaccgaaaataccacgaacaacctcatttcatgaacacaaagtttctctgtattaaggaatcaaaatatgctaacaacgccattaaaacttacaagtataacgcttttacgttcatcccaatgaatctgttcgaacagtttaagcgagctgccaatctgtacttccttgctctgctgatcttgcaggcggtccctcagatatctaccctcgcatggtacacaactctggtgccattgttagtggtattaggcgtgactgccattaaggacctcgtcgatgatgtagcccgccataagatggataaggaaatcaacaatcgtacatgtgaggtgataaaagatggccgattcaaagtagctaagtggaaggaaatccaggtcggtgacgtgattcggttaaagaaaaatgactttgtgcctgctgacatacttctgctgtcctcctcagaacccaactccttatgctatgtggaaacggcagagcttgacggcgagacaaacctgaagtttaaaatgagtctggaaattaccgaccaatacttacagagggaggataccctggccacttttgatggattcatcgagtgtgaagagcccaataaccgtctcgacaagttcactggcacactcttctggagaaacacatcttttcctctggacgccgacaagatactgctgcgaggatgcgtgatacgaaacacagacttctgtcatggcctcgtgattttcgcaggagccgataccaagataatgaagaacagcggcaaaactaggtttaagaggaccaaaatcgactaccttatgaattatatggtgtatactattttcgtggtgctgatactgctgtcagctggtctagccatcgggcatgcatactgggaggcgcaggtgggtaactcttcctggtatctttacgacggggaagacgacacacctagctatcgaggcttcctcatcttctgggggtacatcattgttctgaacaccatggtgcctatttcactttatgtgagcgtagaagtgatccgcttgggacagtcacacttcataaattgggacttgcagatgtactacgcagaaaaagatacgcccgcgaaagcaagaactactaccctgaacgaacagttgggccagatacactatattttttccgacaagaccggcacccttacacagaacattatgactttcaagaaatgctgcattaacggtcaaatctacggcgatcacagggatgcttctcaacataatcataacaagatcgagcaggttgacttttcatggaatacatatgctgatggtaagctggcattttatgatcattatctcatcgagcagattcagtcaggaaaagagcccgaggtccgacagttctttttcctattggccgtgtgtcacaccgttatggtcgatcgcaccgacgggcagttaaactaccaagccgcgtctccagacgaaggtgcactggtgaatgctgctagaaacttcggtttcgcctttctggccaggactcagaacacaatcacaatcagtgagctgggaacagaacggacatataacgtgctggctattctggacttcaacagtgatcgtaagcgtatgtcaattatcgtgcgtactcctgagggaaatatcaagctttattgcaaaggggcagataccgtgatctacgaacgccttcatagaatgaacccaaccaagcaagaaacacaggatgctctcgacatctttgcaaacgagacactgcggactctctgcctgtgctataaagagattgaagagaaggagtttaccgaatggaacaagaaatttatggctgcttccgtagccagcactaatagggacgaggctttggacaaagtctacgaagagatagagaaggatctcatccttctgggggccactgccatcgaagataaactacaggatggtgtgcccgaaacgatttcaaagctcgccaaggccgacatcaagatctgggtcctgactggggataagaaggaaaccgcggaaaatattgggtttgcatgtgagctgttgaccgaggataccacaatctgctacggcgaggatattaactccttgctgcacgccagaatggagaatcagaggaacagaggaggcgtgtatgcgaagttcgcgcctcctgtccaagagtcctttttccctccggggggcaaccgagccctgattatcaccggatcctggcttaacgagatcctgctagaaaagaagacaaaacgtaataaaattctgaaactgaaatttccgcgtacagaagaggaacgtcgaatgcgaacgcagagcaaacggcgactcgaagctaagaaggagcagaggcagaaaaacttcgtggacctggcttgcgagtgcagcgccgtgatttgctgccgtgtcactcctaagcagaaggccatggtcgtggacctggtcaaaagatataagaaagccatcaccctcgccataggagacggggccaatgatgttaacatgataaaaactgcccacataggcgtggggatctctggccaggaaggcatgcaagcggtcatgtccagtgactattcattcgctcagtttaggtatctgcagcgacttctgttagtgcacgggcggtggtcttacattcgcatgtgtaagtttctgagatacttcttttacaaaaatttcgcgttcaccttagtgcacttttggtacagtttctttaatggttacagtgcccagactgcgtacgaagactggtttatcaccctctataacgtgctctatacttccttacctgtcctcctgatgggcctgctggaccaggacgtgagcgacaaactgtccctgagattcccgggcctgtatattgtcggccagagggatctcttgttcaactacaagcggtttttcgtctctctgcttcacggagtgttaactagtatgatccttttcttcataccacttggggcatacttgcaaactgttgggcaggacggcgaggcaccatctgactaccaaagcttcgctgtaacaattgcctcggcacttgtgattacagtaaattttcagatcgggctcgacacatcttattggactttcgtaaatgctttctcaattttcggctcaatagccctctatttcggcataatgtttgactttcacagtgccggaatacacgtactgtttccgtccgctttccaatttaccggcacagcatccaatgccctacgtcaaccatatatttggctgactattattttagctgtagctgtatgcctgctccccgtcgtggccatacgctttctgtcgatgactatctggccgtccgagtcggacaagattcaaaaacataggaaaagactaaaagctgaagaacagtggcagaggcgacagcaagtttttagacgaggggtgtccacccgaagatcagcatacgccttctcgcaccagagggggtatgccgatctcatctcctcaggcaggtctatccggaaaaagcgtagccccctggacgccatcgtggccgatggaacagccgaatataggaggacaggcgattct

SEQ ID NO: 7310 - DNA, 3753 bp, Artificial Sequence
  Description of Artificial Sequence: Synthetic coding sequence
atgtcgaccgagcgtgattcagaaaccacttttgacgaggattcccaaccaaacgatgaagtggtgccctactcagatgatgaaactgaagatgaactggatgatcagggttccgctgtggaacctgaacagaaccgagtcaatcgcgaagctgaggagaatcgggaaccctttagaaaggagtgtacctggcaagtcaaggccaatgatagaaaataccatgagcaacctcactttatgaacactaagtttctgtgtataaaggaatccaagtatgcaaacaacgccatcaaaacttacaagtacaacgcattcacttttatccctatgaatttgttcgagcaattcaagagagcagctaacctgtacttcctggcactcttgattcttcaggcagttccacaaatttcgaccctggcatggtacactaccctggtccctctgcttgtggttctgggagtgacggcgattaaggatcttgtggacgacgtggcacgccacaaaatggataaggagattaacaaccgaacttgcgaggttatcaaggacggtcgttttaaggtggcaaagtggaaggagatacaggtgggagatgtgatccggctgaagaaaaacgattttgtcccggcagacattcttcttctgtcctcctcggagccaaattcgctgtgctacgtggaaactgcagaattggatggcgaaaccaacctgaagtttaagatgtccctggagattaccgatcaatacctccagcgcgaggacactcttgccacttttgatggctttatagaatgcgaagaacctaacaataggctcgacaaattcactggaactttgttttggaggaacacttcatttccccttgacgcagacaaaatactgcttcgcggatgtgtgattcggaacaccgacttttgtcatgggctggtgatttttgccggggcagatactaagataatgaagaattcggggaaaactcggtttaagaggaccaaaatcgattacttgatgaactacatggtgtataccattttcgtggttctcattctgctgagcgccggattggccataggacacgcttattgggaggctcaggtgggaaattcctcctggtacctttacgacggggaagatgacaccccaagctatagagggtttctgatcttttggggttacattatcgtgctgaatacgatggtgccaatttcgctctacgtgtcagtggaggtgattagacttggccaatctcactttatcaactgggatctccagatgtactacgcagaaaaggataccccggcaaaagcacggactacgaccctgaacgaacagctcggacagatccattacatctttagcgacaagacgggtactcttacccagaatatcatgacttttaagaagtgttgtatcaacgggcagatctacggtgatcacagagacgcatcgcaacataaccacaataagattgaacaggtcgactttagctggaacacctacgcagatggaaagttggcgttctacgaccattacctcattgaacaaatacaatcgggaaaggaacccgaagtgaggcaattcttttttctccttgctgtgtgtcataccgtgatggtcgatagaaccgatggtcagcttaactaccaagcagcaagccctgatgaaggagcactggtgaacgccgcaagaaatttcggattcgcattccttgcccgcacccagaataccatcaccatatctgaattgggcaccgagagaacttacaacgttctggcaattttggactttaactctgatagaaagaggatgtccatcatagtcagaactccagaaggaaacattaagctgtactgtaagggagcagatactgtgatttacgaaagactgcatcgtatgaaccccactaaacaggagactcaagatgcccttgatatctttgcgaacgaaactctgaggacgctgtgtctgtgctataaagaaattgaggaaaaggaatttactgagtggaacaagaaattcatggcagcctccgtggccagtacgaatcgagatgaagccctggataaggtgtacgaagaaatcgagaaggacctgattctcctgggtgcgactgcaattgaggataaacttcaagatggtgtgccggaaaccatctcgaagctcgcaaaggcagacatcaagatttgggtgctgacgggcgacaagaaagaaactgccgaaaacataggtttcgcttgtgagctgctcaccgaagatactaccatctgctatggggaggacattaacagtctgcttcatgccagaatggaaaatcagcggaacagaggaggagtctacgcaaaattcgcacccccagtccaggagtcgttttttcctccggggggcaatcgggcgctgatcattaccgggtcgtggctcaacgaaatactccttgagaagaaaacgaaaaggaacaaaattctcaagctgaagtttccacgcacggaggaggaacggcgcatgagaacccagtccaagcggagactcgaagccaagaaggaacaaagacagaaaaacttcgtggatctggcctgcgaatgctcggcagtgatttgctgtcgagtcacgcctaaacagaaggcaatggtggtggatctggtgaagcggtacaagaaagcaatcactttggccataggtgatggtgcgaatgacgtaaacatgatcaaaactgcacatatcggggtcggaatttccggccaagagggaatgcaagccgtcatgtcctccgactactcatttgcacaatttaggtacttgcaacgtttgctcttggtgcacggtcgctggagctacattcgtatgtgtaaattcttgagatactttttctacaagaatttcgcttttactctcgtgcatttctggtactccttctttaacggctacagcgcccaaacggcctacgaggattggttcattaccttgtataatgtgctttacacgtcgctgccagtgctcctgatggggctcctcgaccaggatgtctcggacaagctgtcgttgcgctttcccggactttacattgtgggtcagcgcgatctcttgttcaattacaaacggttttttgtctcccttttgcatggggtgcttacctcgatgattctcttcttcatccctttgggagcctaccttcaaaccgtgggtcaagacggtgaagccccatcggattaccagtcgttcgcggtcaccattgcatccgcgctcgtgatcacggtgaacttccaaattgggctcgatacgagctactggacctttgtgaatgcgttctccattttcgggtcaatcgcactgtactttggcatcatgttcgacttccactcggctggtattcatgtgttgtttccctccgcctttcagttcacgggtaccgcatcgaatgcacttaggcaaccatacatttggcttaccatcattctggcagtcgcagtgtgtctgcttcctgtcgtcgcaatcagatttctctccatgaccatttggccatccgaatccgataagatccaaaaacaccgcaaaagactcaaggcagaggaacaatggcagagacgacaacaagtctttcgtagaggagtgtcaacccgtaggtcagcgtacgcatttagccatcagcgcggatacgcagacctcattagctcaggcagatcgattcgaaagaagagatcgcctttggacgcgattgtggcggacgggactgcggaataccgccgcacgggtgactcc

SEQ ID NO: 7311 - DNA, 3753 bp, Artificial Sequence
  Description of Artificial Sequence: Synthetic coding sequence
atgagcactgagcgcgatagcgaaaccacttttgatgaggatagccaaccaaacgatgaggtcgtcccttacagcgatgacgaaaccgaggacgaacttgatgaccaaggatcggcagtcgaacctgaacaaaacagggtcaatcgcgaagccgaggagaatagggagccgtttcgaaaggaatgcacttggcaagtcaaagccaacgatcgcaagtatcatgaacaaccacactttatgaataccaaattcctgtgcatcaaagagtcaaagtacgccaacaacgccattaagacctataagtacaatgcgtttacctttattcccatgaaccttttcgaacaattcaagagagcagcaaacttgtactttctggcactgcttattctccaggcagtgccgcaaatcagcactcttgcctggtacactactcttgtgccactgctggtggtcctgggagtcactgcaattaaggacctggtggatgatgtggcgcgccataagatggataaggagataaacaaccgtacctgtgaggtgataaaggacggtaggtttaaggtcgcaaagtggaaggaaatccaggtgggggatgtgattaggctgaaaaagaatgactttgtgcctgcagatattctgcttctgtcctcatcagaacccaactcgctgtgctacgtcgaaaccgcagaactggatggtgaaactaacctcaaattcaagatgtcccttgagattaccgaccagtaccttcaaagagaagatacgctcgcaacttttgatggtttcatagaatgcgaagagccgaacaatagactcgataagtttactggtaccctgttttggcggaacacctcattcccacttgacgctgacaagatactgctccggggctgtgtcattagaaataccgatttttgccatgggctggtcatctttgcaggagcagataccaagattatgaaaaactcgggtaaaacccggtttaagcgtaccaaaattgattatctcatgaattacatggtgtacacgatcttcgtggtgttgattcttttgagcgccggactggccatcggtcacgcgtactgggaagcacaggttggaaattcttcctggtacttgtacgatggggaagatgataccccttcctatagggggttccttatcttttggggttacataatcgtgctgaatacgatggtgccaatctcactttacgtgtcggtggaagtgataagacttggacagagccacttcataaactgggacctgcaaatgtactacgcggaaaaggatactccagcaaaggcacgcaccactactctgaatgaacaacttggacagattcattacattttctcggataaaactggaactctgacccaaaacataatgacctttaagaagtgttgtattaacgggcagatttatggcgaccatagagatgcatcccaacataaccataacaaaattgaacaagtggacttttcctggaatacttacgccgatggtaagctcgcattttacgatcattacttgatcgaacagatccaatcaggaaaggaaccagaggtgcggcaattcttttttctcctggccgtgtgtcatactgttatggtagataggactgatggtcagctgaattaccaagcggcatctccagatgagggtgcgcttgtaaatgcggcacgtaatttcggattcgccttcctggcaaggacccagaacacgatcaccatttccgagcttggtaccgagagaacgtataacgtgcttgccattctggacttcaactctgacagaaagcgcatgtccattatcgtgcggacgccagaaggcaacataaagttgtactgtaagggcgcagataccgtaatctacgagcgcctccaccggatgaatcccactaagcaggaaacccaggatgctctggacatatttgctaacgaaacgctcagaactctgtgcctttgttacaaggagatcgaggagaaggaatttactgagtggaacaagaagtttatggctgcatcagttgcctccaccaacagagacgaagcacttgataaagtgtacgaagaaatagagaaggacctgattctgcttggtgcaaccgcaatcgaagataaacttcaagatggcgtcccagaaactatttctaaacttgcgaaggcagacattaagatttgggtacttaccggagataagaaggaaacggcagagaacatcggttttgcttgtgagcttctgacggaggacaccaccatatgttatggagaggacatcaactctctccttcatgccaggatggaaaatcagcgtaaccgtggaggtgtgtacgccaagtttgcccctcctgtccaagagtcatttttccctcctggagggaatcgagcattgattatcaccggatcctggcttaatgaaattcttcttgagaaaaagactaaacgaaataagattctgaaattgaagtttccccgaaccgaagaagaacggcgcatgcggacgcagtccaaacggaggctggaagcaaagaaagaacagcggcaaaagaacttcgtcgaccttgcctgtgaatgctcagcggtcatctgctgtagagtcacgccgaagcagaaggcaatggtggtcgatctcgttaaacgttacaagaaggcaatcactctcgcaataggagatggcgcaaatgacgtgaacatgatcaagactgcgcatataggtgttggaatttcaggccaagagggcatgcaggccgtgatgagctcggattacagttttgcccagttcagataccttcagcgccttctgctcgtgcacggtcgttggtcgtacattcgtatgtgtaagtttttgaggtatttcttttacaaaaactttgcatttactcttgtgcacttttggtactcgttcttcaatggctactctgcacaaaccgcatatgaggattggttcattacgctttacaacgtgctctacacttcgctccccgtgctgctcatggggctcctggaccaagacgtctcggacaagctgtcgctgcgttttcccggactgtacatcgtgggccagcgtgatcttcttttcaactacaaaaggttttttgtctcccttttgcacggagtgctgacctcgatgatcctcttctttatacctttgggagcctacctgcagactgtcggtcaagacggagaagccccttccgattaccaatcctttgcggtgaccatcgcctcggctctcgtcatcaccgtcaactttcaaataggtctggatacgtcatactggacctttgtcaacgcgtttagcatctttggttcaatcgcactgtacttcggcattatgttcgattttcattctgctggtatccatgtgctttttccttcagcattccaattcaccggcaccgccagcaatgcgttgcgccaaccctacatctggctcaccattatactggcagtcgctgtctgtctgctccctgtggtggcgattagatttctgtcgatgactatttggccatcggaatcggacaagattcaaaagcaccggaaacggctcaaggcagaagaacaatggcagcgacgacagcaagttttccggcgaggcgtgtccacccggagatcagcctacgcgtttagccatcagcggggatatgccgatctcatctcgtccggcagaagcattcgcaaaaagagatcgcctctcgacgctattgtggcagacggtactgcggaatataggagaactggggacagc

SEQ ID NO: 7312 - DNA, 3753 bp, Artificial Sequence
  Description of Artificial Sequence: Synthetic coding sequence
atgagcaccgaaagggactcggagacgaccttcgacgaggattcgcagccaaacgatgaggtggtgccttactcggacgacgagacggaggacgagcttgacgatcaggggtcagcggtggaacctgaacagaatagagtaaaccgcgaagccgaggaaaacagggagccatttcggaaagaatgtacttggcaggtgaaggcaaacgatcgcaagtaccatgaacagcctcatttcatgaatactaaattcctgtgcatcaaggaatcaaaatacgcaaacaacgcaattaagacgtacaagtacaacgcatttacgttcatacctatgaacctctttgaacagtttaagagagcagcgaacctgtactttctggcacttcttatcctgcaagcggttccacagatctcaaccctggcctggtacactacccttgtgcctctgctcgtggtcctgggtgtgaccgcgatcaaagatttggtcgacgacgtggcaagacataagatggataaggagataaacaaccgaacttgtgaggtcattaaggacggcagattcaaggtggccaaatggaaggaaattcaggtcggagacgtgatccggctgaagaagaatgattttgtgcccgcagatattctgctcctttcatcctcagaaccaaattccctctgttacgtggaaaccgccgaacttgacggtgaaactaacctcaaattcaaaatgtcgctggaaataaccgaccaatacttgcagcgggaagatactctcgccaccttcgatggtttcattgaatgtgaggagcctaacaatagactcgacaagttcaccgggacgcttttttggcgcaatacttctttcccactggacgcagacaagatactcctgcggggttgtgtcatccgcaacaccgacttctgtcacggtctggtgatctttgcaggcgcagatacgaagatcatgaagaattcgggtaaaaccagatttaagcgcaccaaaattgattatctcatgaattacatggtttatacgatttttgtcgttcttatcctcttgagcgcaggcttggcgattggacacgcctactgggaggcccaagtgggtaactcgagctggtacctttacgacggcgaagatgacaccccctcctatagaggatttctgatcttttgggggtacatcattgtcctgaacaccatggtccctatctcgctgtacgtctccgtcgaagtgattcgtcttggccagtcacactttatcaattgggacttgcaaatgtactacgctgaaaaggatacccctgcgaaagcaaggaccaccacgttgaacgagcaactcggacaaatacattacatattctcagacaaaactggcactctcacccagaacattatgacctttaagaagtgctgcattaatggacaaatctatggtgaccatcgggacgcatctcaacataaccataacaagattgagcaagtggatttctcctggaacacctacgcggatggaaaacttgccttctacgatcattaccttatagaacagatccagtcagggaaagagccggaagtgagacaattctttttccttctggccgtgtgtcacactgtcatggtggatcgtaccgatggacaactcaattaccaggccgcctcccccgatgaaggggccttggtaaacgccgccagaaactttggtttcgctttcctcgcccgtacccaaaacacgatcaccatctcggaacttggaactgaaaggacctacaacgtgctggcaattctggatttcaactcggatcgcaagcgaatgagcattattgtccggacccctgaaggtaacatcaagctctactgtaagggagcagacactgtcatatacgaacggctgcacagaatgaacccaactaaacaggaaacccaagacgcacttgatatcttcgcgaatgagactctgcgaaccctttgcctgtgctacaaggaaattgaagagaaggagtttactgaatggaacaaaaagtttatggcagcctcagtcgcatctaccaatagagatgaagcactcgacaaagtgtacgaggaaatagagaaagatttgattcttctcggtgcgaccgctatagaagataagctccaagacggagtacctgaaactatcagtaagctcgccaaagccgacattaagatctgggtcttgaccggagacaaaaaggaaactgcggagaacattgggtttgcctgtgagcttctgaccgaagataccactatttgctacggagaggacataaacagcctgctccacgcgcgtatggaaaaccagcgcaatagaggcggggtgtacgcaaaattcgcacctcccgtccaagagtcttttttccccccaggtggaaatagagcactgatcatcaccgggagctggctcaacgagattctgcttgagaaaaagacgaagagaaacaagatccttaagttgaagtttccccggaccgaggaagaaagaagaatgcggacccagtccaaaagacgacttgaggcgaaaaaggaacagcgccagaagaacttcgtggacctggcatgtgaatgctccgcagtcatctgttgtagagtgacgcctaagcaaaaggctatggtggtcgacctcgtgaagaggtataagaaggcaataactctcgcgattggtgatggcgcgaacgatgtcaacatgattaagaccgcccatattggcgtgggaatctcaggtcaggagggaatgcaagccgtgatgtcctcagattactcattcgcacaatttcggtaccttcagaggcttctcctggttcatggaaggtggtcctacatccgcatgtgtaagttcctgagatacttcttctataagaactttgcattcacgctggtgcacttttggtacagcttctttaatggatactcggcccaaaccgcttacgaggattggttcataactctttacaacgtgctctatacttcactgccagtcctccttatggggcttctcgaccaagatgtctcggataagctcagccttagatttcctggcctttacatcgtgggtcaaagagatctccttttcaattacaagcggttttttgtgtcccttcttcatggggtgcttacctccatgattctctttttcattccacttggagcatacctccagaccgtggggcaagatggagaggcaccctcggattaccaatcgtttgccgtcactatcgcatccgctctggtgatcaccgtgaattttcagatcggtcttgacacctcctactggactttcgtcaatgccttttcgatttttgggagcatagccctctactttggaatcatgttcgattttcattccgcaggcatccatgttttgttcccttccgcttttcaatttactggcaccgccagcaacgcacttcgccagccctacatttggctgaccataattcttgccgtcgcagtgtgtttgctgcccgtcgtcgcaattagatttctttcaatgactatctggccgagcgagtccgacaagattcaaaagcacagaaagagactcaaggcagaggaacagtggcagcgcaggcaacaggtgtttagacggggtgtctcaacccggcgatccgcctacgcattttcgcatcagcgcggctacgcagatctgatttcgagcggaagaagcattaggaaaaagcggtcgccacttgatgcgattgtggcagatggtactgcagaataccgaagaacgggagatagc

SEQ ID NO: 7313 - DNA, 3753 bp, Artificial Sequence
  Description of Artificial Sequence: Synthetic coding sequence
atgtccacggaacgcgattcggaaactaccttcgacgaggactcgcagccgaatgatgaagtggtgccgtacagcgacgacgaaaccgaggatgaactcgacgatcaaggaagcgcagtggaaccagaacaaaaccgcgtcaaccgggaggctgaggaaaacagggagccgttccgcaaagagtgcacctggcaggtcaaagctaacgatcgcaagtaccatgaacaaccacacttcatgaacaccaagttcttgtgtatcaaggaatccaagtacgccaacaatgcaatcaagacctacaagtacaatgcattcacgttcatccctatgaacttgttcgagcagttcaagcgcgccgctaacctgtacttcttggcactgctgatcctgcaggcggttccacagattagcactctggcgtggtacactactctggtgcccctcctggtggtcctgggcgtgactgcaatcaaagatctcgtcgacgatgtggcgcggcacaaaatggacaaggagatcaacaaccgcacttgcgaggttatcaaggacggacgctttaaagtggccaaatggaaggaaatccaggtgggtgacgtcattcgcttgaagaagaatgattttgttccagcggatatcctgctgctgagctcatccgaaccgaactcgctctgttacgtcgagactgcagagctggacggggaaactaatctgaagtttaagatgtcgctcgaaatcactgatcaatatctgcagcgggaggatactttggccacgttcgacggctttatcgaatgtgaggaaccgaacaaccgcctggacaaattcactggaacccttttctggagaaacaccagcttcccactggatgccgacaagatcctccttcggggatgcgtgatccggaacaccgacttctgccatggactggtgatcttcgccggggcagacacgaagatcatgaagaacagtggaaagactcgctttaaacgtactaagatcgactacctgatgaattacatggtgtatactatcttcgttgtgttgatcttgctcagcgcgggattggcaatagggcacgcttactgggaggcgcaggtcggcaattcgtcctggtacctgtacgatggagaagatgacactccctcgtaccggggattcctgattttctggggttacatcatcgtcctcaacactatggtgcctatctccctttacgtctcagtggaagtgatcaggctggggcagtcccatttcatcaactgggacctgcagatgtactacgccgaaaaggatactccagccaaagcacggacgactaccctcaatgagcaactcggtcaaattcattacatcttctcggataagaccgggaccctgactcaaaacatcatgaccttcaaaaagtgctgcatcaatggacagatctatggcgatcacagagatgcctcccaacacaatcacaataagatcgagcaagtggatttttcatggaacacttacgccgacgggaagctggctttctacgaccactaccttatcgaacaaatccagtcaggaaaggagccggaggtcaggcagtttttcttcctccttgcggtgtgccacaccgtgatggtcgaccgcactgatggacagctgaactaccaagccgcctcgcctgacgaaggcgctcttgtgaatgccgcccgcaacttcgggttcgctttcttggctcggactcagaataccatcactatctcggaattggggactgagagaacctacaatgtcctcgcaatcctcgactttaactcggatcgcaagcgtatgtcgatcatcgtccggacccctgagggcaacattaagctctactgcaagggggctgacaccgtcatttacgaaagactccaccgcatgaacccaaccaaacaggaaactcaggacgccctggacatctttgccaacgaaactctgcgaacgctgtgtctctgctacaaggaaatcgaagagaaagagttcaccgagtggaataagaaattcatggctgctagcgtcgcatcgaccaatcgggatgaggccctcgacaaggtctacgaggaaatcgagaaagatctgatccttctgggagccactgccatcgaagataaactgcaggacggagtgccagagactatcagcaaactggccaaagcggacatcaagatttgggtgctgaccggcgacaagaaggaaactgcggagaatatcggattcgcatgcgagctccttaccgaggataccaccatctgttacggcgaggacatcaacagcctcttgcacgcccgcatggagaatcaacggaatcgcggaggggtgtacgctaagttcgctccaccggtgcaggaatccttcttcccaccgggaggaaaccgcgcacttatcatcaccggcagctggctgaacgagatcctccttgagaaaaagactaaacggaacaagatcctcaagctgaagttcccgcggactgaagaggagagaagaatgcgcacgcagtccaaacgcagactcgaagcgaagaaggaacagcgccagaagaatttcgtggacctcgcgtgcgaatgttcagcggtgatctgttgccgcgtgactccgaagcagaaggctatggtcgtggacttggtcaagaggtacaagaaggccatcaccctggcgatcggagatggtgccaacgacgtgaacatgatcaagactgctcatattggtgtgggtatctccggccaggaaggtatgcaagccgtgatgagctccgactactccttcgcccagttcaggtacctccaacgcctgctgttggtgcacgggcgctggagctacatacggatgtgcaagttcctgcgctacttcttctacaagaatttcgccttcaccctcgtccacttctggtacagcttctttaatgggtactcggcccagactgcctatgaggactggttcattaccctctacaacgtgctgtatacttccctccccgtgttgctgatgggactgctcgatcaggacgtctcagacaaactgtcgctccgttttccaggactgtacatcgtgggtcaacgcgacctgctgttcaattacaaacggtttttcgtgtcgctcctgcatggggtgctgacctccatgatcctgttcttcatccctcttggggcatacctgcaaaccgtcggccaagacggcgaagcgccgtcggactaccaatccttcgcagttactatcgcttctgcactggtgatcaccgtgaactttcaaatcgggctggatacttcctactggactttcgtgaacgcgttttcgatcttcggatccatcgccctctactttggcattatgttcgatttccattcagcaggaatccacgtgcttttcccttcagcgttccaatttactgggactgcttccaatgctctgcgccagccatacatctggcttactatcatcttggctgtggcggtgtgcctgctcccggtggtggctatccggtttttgtcaatgaccatctggccgtcggagagcgacaagatccagaaacaccggaagcgcctgaaagcagaagaacaatggcaaaggagacagcaagtgtttagaaggggcgtgtcaactcgccgctcagcttacgccttcagccaccagcggggctacgccgacctgatctcctcgggaaggtcgatccgcaagaagcgctcgccgctggacgcaatcgtggccgacggtaccgcggagtatagacgcactggggacagc

SEQ ID NO: 7314 - DNA, 3753 bp, Artificial Sequence
  Description of Artificial Sequence: Synthetic coding sequence
atgtcgaccgaacgagactctgagacgacatttgacgaagattcccagcccaatgatgaggtcgtaccgtactcggatgatgaaactgaggatgaattagatgaccaggggagcgccgtggaacctgaacagaaccgggtgaatagagaagccgaagaaaacagagaacccttcagaaaagaatgtacctggcaagtcaaagccaacgaccgaaagtatcacgaacagccgcattttatgaacacaaaattcttgtgtattaaggagtctaagtatgccaataacgctattaagacctataagtataacgcgttcacgtttattcctatgaatctttttgagcaatttaagagagcagccaacctatatttcctggcactgctgatcttgcaggccgtacctcaaatctctactctcgcgtggtacactactctggtgccgctgctggtggttcttggggtcactgcaattaaagatcttgttgatgacgtcgccagacacaagatggacaaagaaataaacaacagaacctgtgaggttatcaaagacgggcgattcaaggttgccaaatggaaggaaatccaggtgggagacgtaataaggttaaagaaaaatgacttcgtgcctgcagacatcctcctgctatcttctagtgagccaaatagcctttgttacgttgaaacagcagagctcgacggtgaaactaaccttaagttcaaaatgtccttggaaataaccgatcagtacctgcagagagaagacactctggccacatttgatgggttcatcgaatgtgaagaacctaataacaggctggataagttcactgggacactcttctggaggaatacttcattccccctggacgccgataagattctgctgaggggctgcgtgatcaggaacacggatttttgccatgggctggtgatctttgccggggcagacaccaaaataatgaaaaattctggtaaaacgagattcaaaagaacaaaaattgactatctgatgaactacatggtttataccatttttgtggtgttgattctcttaagcgccggcttagcaatcggccatgcctactgggaggcccaggttggaaattcaagctggtacctctatgacggcgaagatgatacaccatcttatcgaggtttcctgatcttttgggggtacattatcgtactgaacacaatggttcccatctcactgtacgtgtcagttgaagttataagactcggtcaatctcattttataaactgggatttgcagatgtactatgctgagaaagacacccccgctaaggcccggacaacaacactgaatgaacagctgggacaaattcactacatttttagtgacaagaccgggactctcacccagaatattatgacgtttaagaagtgttgcatcaacgggcagatatacggggaccacagagatgcatctcagcataatcacaataagatagagcaggttgacttttcatggaatacatatgctgatggcaagctggctttctacgatcactacctgatcgagcaaatacagagcgggaaggagcctgaggtaaggcaattcttctttcttctcgccgtatgtcataccgtgatggtggaccgcactgacgggcagctaaattaccaggctgccagccccgatgagggagcgctcgttaatgctgccaggaattttggatttgcatttctcgctcgcacgcaaaacaccatcaccatctctgagctgggtaccgaaaggacatataatgtgctagcgatcctcgattttaactccgaccgaaagagaatgagtatcatcgtcagaactcccgagggcaacataaaactctactgtaagggcgcggacaccgtgatttacgaacgtctgcacaggatgaacccaactaagcaggagactcaagatgcactggatatcttcgcgaacgagacccttagaactttatgtttgtgctacaaagaaatcgaagaaaaggagttcacggaatggaacaaaaaatttatggctgccagtgtggcttctaccaacagagacgaggctttggacaaggtttacgaagaaatagagaaggatcttatcctgcttggggccacggctatagaagataagttgcaagatggcgtgcctgaaaccattagcaagctcgctaaagccgatatcaagatatgggtcctcaccggggacaaaaaggaaaccgccgagaacatcgggtttgcatgcgaactattaacagaggatacaacgatctgctacggagaagacataaactctctgcttcacgcgaggatggaaaatcaaaggaacagaggaggagtgtacgccaaattcgcgccgcctgtgcaggaatccttttttcctccaggtggcaatcgagcccttatcataactggaagctggctgaacgagatactcttggagaaaaagacaaagcgaaataaaattctgaagcttaagttcccacgaaccgaagaggagcgaagaatgcggacccagagcaaaaggagactcgaagctaagaaggagcagcgacagaaaaattttgtcgacctggcatgtgaatgttccgccgtgatttgctgtcgagtcacccccaagcagaaggctatggtggtcgatctggtaaaacgctacaagaaagctataactttggcaatcggagacggagccaacgatgtgaacatgatcaagaccgcgcacatcggggtgggaatttctggacaggagggtatgcaggctgtaatgtcatcagactacagcttcgctcagttccgatatctgcagagattattgctcgtacacggccgctggtcttacatacgtatgtgcaagttcctccgttacttcttctataaaaacttcgcatttaccctcgtgcacttttggtattccttctttaatgggtattcagctcagactgcctacgaagactggttcattacactgtataacgtactctacacaagcctgccggtgttgctgatgggactgctggatcaggacgtgtcagacaagctttcactacgtttccccggcctgtacatcgtaggacagcgagacctgctgttcaattacaaaaggttttttgtgtccctgctccacggggtgctcacatccatgatactcttctttatcccgctgggagcgtaccttcagaccgtggggcaagacggcgaggcaccctcagattatcagtcatttgctgtgaccattgcctctgctttggttattaccgtcaattttcagattggcttggacactagttactggacgtttgtcaacgcattctctatcttcggctcaatcgccctctactttggaattatgttcgacttccactctgctgggattcacgtgctcttcccgagtgcctttcagtttaccggtaccgcttcaaacgctctcaggcagccttatatttggctcacaatcatcctagcagtggctgtctgtttgctgcccgttgtggctattcggttccttagcatgacgatatggccgagtgaatctgataagatccagaaacatcgaaaacggctgaaggcagaggaacagtggcagagaagacagcaggtgtttaggaggggcgtgagtacgcgaaggagcgcttacgcattttcccaccagcgagggtacgcggacctcatctcatcaggccgaagcatccgaaaaaaacgaagcccactggacgcaatcgtggctgatgggacagcagaatatcgacgaactggtgatagt

SEQ ID NO: 7315 - DNA, 3753 bp, Artificial Sequence
  Description of Artificial Sequence: Synthetic coding sequence
atgtctacagaacgggacagcgaaacaactttcgacgaggattctcagccgaatgacgaagtcgttccatactctgatgatgagaccgaagacgagctggatgatcagggttccgctgttgaacccgaacagaatagggtgaatcgggaagctgaagaaaatagagaaccctttcgcaaagagtgtacatggcaggttaaagcaaacgatcgaaagtaccatgagcagccccacttcatgaacacgaagttcctgtgcatcaaggagtcgaagtatgctaacaacgcgattaagacctataaatacaacgcctttacctttattccgatgaatttattcgaacaattcaaacgcgctgcgaatctgtacttcctggccctgctgatcctgcaagcagtgccacagataagcacgttagcttggtacacaaccttggtacccctgcttgtagttttgggggtgacagctataaaggatttggtggatgacgttgctagacacaaaatggataaagagatcaataatagaacatgcgaggtcatcaaagacggacggttcaaggtggccaagtggaaagagattcaggtcggtgacgttattcgattaaaaaaaaacgatttcgtcccagccgacatcctgcttctatccagttcagagcccaattcattgtgctacgtggaaaccgcagagctggacggggaaaccaatcttaaatttaagatgtcactggagatcaccgatcagtacctgcagcgcgaggacactttggctactttcgatggctttatcgaatgtgaggagcccaataatcggctagacaagtttacggggaccctcttttggaggaatacttctttccctcttgatgctgataaaatcctgcttcggggctgtgtgattcggaatacagacttctgccacgggctggtgatcttcgctggcgctgataccaagatcatgaaaaactccggtaagacacgattcaaacgcactaagattgattaccttatgaattacatggtgtacacgatattcgtggtactcattttactttccgctgggctagcgattggacatgcgtactgggaggctcaagtggggaactccagctggtacctctatgatggcgaggatgatactccttcctatagaggttttctcattttttggggttacataattgtgctgaacacgatggtccctatttccctttacgtttctgtcgaggttatcaggcttggccagtcccacttcattaactgggaccttcagatgtattacgctgagaaggacacccctgccaaagcaagaacaaccaccctaaatgaacagctaggtcaaatccactacatcttctccgataaaactggtacattaactcagaacatcatgacctttaaaaagtgttgtataaatgggcaaatttacggagaccatagggacgcaagccagcacaatcacaacaagatcgaacaggtcgatttttcgtggaacacatacgcggacggcaagcttgctttctatgaccactaccttatcgagcagatccagagcgggaaagagcctgaggtaagacagttctttttcctgctcgccgtgtgccacaccgttatggtggaccgtacagacgggcaactgaactatcaggccgctagcccagatgagggcgcattggtgaatgcagccagaaatttcggattcgccttcctggcacgcacccagaataccattacaatcagcgagctgggaactgaacggacctacaacgtactggctatactcgacttcaattcagatagaaagcgcatgagcatcatcgtccgaacgccggaagggaacattaaactatactgcaagggcgctgacactgttatctacgagcgactgcacaggatgaacccgactaaacaagaaactcaagacgctctggatatctttgctaacgaaaccctaagaaccttgtgtctgtgctataaagagatcgaggaaaaagaattcaccgagtggaacaaaaaattcatggctgcctccgtggcgtcaactaatagggacgaagcacttgataaggtctatgaagagatcgagaaggatcttatccttttaggagcaacagcaatcgaggacaagcttcaagacggagtccccgaaacaatctctaaattagcgaaggctgatataaaaatctgggtactgacgggcgataaaaaggaaacggctgaaaatattggcttcgcctgtgagcttctgaccgaagacacaaccatctgctacggagaagacataaactcactcctgcatgctaggatggagaaccagcgcaatagaggaggtgtgtatgccaagtttgccccgcccgtacaggaaagcttcttcccgcccgggggcaacagggctcttattatcacagggtcctggctcaatgagatcctgctggagaaaaaaaccaagcgaaataagattttgaagctgaaattcccccgtaccgaagaggagagacgcatgcggacccagagcaaacggcggcttgaggctaaaaaggaacaaagacagaagaatttcgtagaccttgcctgcgagtgctccgctgtcatctgctgtagagtgacgcccaagcagaaggcgatggttgtagatctagtgaagcgctacaagaaagccattactctcgctattggcgatggcgcaaatgatgtgaatatgataaagaccgcgcatatcggcgttgggattagcggccaggagggtatgcaggcagtgatgtctagtgactacagtttcgctcagttccgctatctccagcggctgctgttggtgcacggccgatggagttatatccggatgtgtaagttcctcaggtattttttctacaaaaatttcgcgttcacattggtacacttctggtacagcttttttaatggttactccgcacagacagcatatgaagattggtttattacgctttacaatgtgctatatacctcactgccagttctcctgatgggactattagaccaggatgttagtgacaaactatccttacgcttccccgggctatatatagtaggacagagagacctgctgtttaattataagcggttttttgtatcactcctgcacggggtgctgacaagtatgatcctcttctttattcctctcggggcctatcttcaaaccgtcggccaggatggggaagccccttcggattaccagagtttcgctgtgactattgcttctgccctggtaattacagtcaatttccagattggactcgatacctcatactggactttcgtgaacgctttctccatctttggctcaatcgctctttactttgggatcatgttcgatttccatagcgctgggatccatgtgctgtttccttcagccttccagtttacggggacggcgtccaacgcactcagacaaccctatatttggctgaccatcattctcgcagtggccgtttgtctgctccctgtggtggcaatcagattcctgtcaatgaccatttggccttccgaatcagacaagatacagaagcatagaaagagactgaaggcggaggagcagtggcagcgcagacaacaagttttcaggagaggagtctcaacccgacggtctgcgtatgcttttagccatcagcgcggatatgcagatctgatttcatcgggtcgctcaattcgcaagaagcggagcccccttgatgccattgtggcggatgggactgctgaatatagaaggacaggggactcc

SEQ ID NO: 7316 - DNA, 3753 bp, Artificial Sequence
  Description of Artificial Sequence: Synthetic coding sequence
atgagcaccgagcgagactcggagactacctttgatgaagattcccagccaaatgatgaggtggtgccttactcggatgatgaaacggaggatgaattggatgaccaaggatcggcagtggagcctgagcaaaatcgcgtgaacagggaggcagaagaaaacagagaaccatttcgtaaggaatgtacctggcaagtgaaggcaaatgatcggaaataccatgaacaaccacatttcatgaatactaagttcctgtgtataaaggaatctaagtatgcaaataacgcaatcaaaacttacaagtacaatgcattcaccttcattccaatgaacttgtttgaacagttcaagagagccgccaacctttactttctggcacttctcatccttcaggcagtgccccaaatttctacccttgcttggtacaccacccttgtgcctctccttgtggtgctcggtgtgactgcgattaaggatctggtcgatgacgtggcccggcacaaaatggacaaggagataaacaacaggacttgtgaagtcattaaggacgggagatttaaggtggcgaagtggaaggagatccaggtgggtgatgtgattagacttaagaagaatgatttcgtgccagcagatatcctcctgctgtcgagttcggaacctaattcactttgttacgtggaaacggcagagctggatggtgagactaacctgaagtttaagatgagcctggagatcaccgatcaatacctgcagcgagaagataccctcgcaacctttgatggctttattgaatgtgaggaacccaacaataggctcgacaagtttaccggaaccttgttctggagaaacacgtccttccccctcgatgctgacaaaatcctcctgcgaggttgtgtgattagaaacactgatttttgccatggcctcgtcatcttcgccggtgcagacactaagatcatgaaaaactcagggaaaactagattcaagagaaccaagatcgattatctgatgaactacatggtgtacactatattcgtggtgcttatcctgctgtctgcaggacttgcaatcggtcatgcgtactgggaggcgcaggtgggcaactcctcgtggtacctctacgatggtgaggacgatacgccatcgtaccgtggttttctcatcttttggggctacatcatagtgctgaacaccatggtcccaatttcgctgtatgtctcagtcgaggtgattagattggggcaatcccatttcatcaattgggaccttcagatgtactacgccgaaaaagataccccagcaaaggcccgaactaccactcttaacgaacaactgggacaaattcactacattttctccgacaaaactggtactctgacccagaacattatgacgtttaagaagtgttgcattaacggccagatttacggcgaccaccgagacgccagccaacacaatcacaataagattgaacaagtggattttagctggaacacttacgcagacggcaaacttgccttttacgatcattacttgattgaacaaattcaatccggaaaggagccagaagtgaggcaattctttttccttctcgcggtgtgccataccgtgatggtggataggaccgatggacagctgaactaccaggccgcctccccagatgaaggagcactcgtgaacgcagcacggaacttcggttttgcctttctggcaagaacccagaacaccattaccatttcggaactggggactgagagaacttacaacgtcctggcgatccttgatttcaactcggaccggaagcgaatgtcgattatcgtccggacccctgaagggaatatcaaactgtactgtaagggtgcagataccgtgatttatgaaaggcttcaccggatgaaccccaccaagcaagaaacccaagatgcacttgacatatttgcaaatgaaactcttagaactctttgcctttgttacaaggaaatcgaggaaaaggagttcactgaatggaataagaagttcatggcagcctcggtggcaagcaccaatagggatgaagcgcttgacaaggtgtacgaggagattgagaaagatcttatactcctgggagcaaccgcgatcgaggacaaactgcaagatggcgttcccgagacgattagcaaactggccaaggcagacattaagatttgggtgctcactggagacaaaaaggagactgcagaaaacatcggattcgcgtgtgaacttcttaccgaagatactaccatctgttacggcgaggacatcaattcgctgcttcatgcgagaatggagaaccagaggaataggggaggagtctacgcaaagtttgcaccccctgtgcaagaatcatttttcccacctggcggaaatcgtgcactcatcattaccggaagctggctcaatgagatcttgctggagaaaaagactaaaagaaacaagattctcaaactgaaatttccacggaccgaagaagaacgccggatgcgaactcaatcgaagcgtagacttgaagcgaagaaggaacagcgtcaaaagaacttcgtcgatctggcttgcgaatgctccgctgtgatttgttgcagggtcaccccgaagcagaaagcaatggtggtggaccttgttaaaagatacaagaaagcgatcaccctggcaatcggcgatggcgccaacgatgtcaacatgatcaagactgcacacattggagtcggcattagtggccaagaaggtatgcaggcagtcatgagctctgattattcattcgcacaatttaggtacttgcagcgcctcttgcttgtgcatggacgttggtcttacattagaatgtgtaagtttctgcggtactttttctacaaaaacttcgcctttactctggtgcacttctggtactcgttctttaacggctactccgcgcaaacggcctacgaggactggttcatcaccctttacaacgtgctgtacacctccctgccagtgcttcttatgggacttcttgatcaggatgtcagcgataaactgagcctccgttttccaggactctacatcgtgggtcagcgggatttgcttttcaactacaagcgtttctttgtgtcccttctgcatggcgtgctcactagcatgattctgtttttcatccctctgggtgcataccttcagacggtgggacaggacggcgaggcgccctcggactaccagtcctttgcagtgactattgcttcagcactcgtgattacggtgaactttcaaattggattggatacttcgtactggacctttgtgaatgcgtttagcattttcggttccatcgcactttactttggtataatgtttgatttccattcggcaggaatacatgtgctctttccatccgcatttcagtttaccggcactgcaagcaacgccctcagacaaccgtacatttggctcaccatcatcctcgcagtggcggtctgtctgctgcctgtggtggctatacgttttctgtcgatgaccatctggccaagcgagtcagataagatacagaagcaccgcaagcgccttaaggcagaagaacaatggcaacggcgtcagcaggtgtttcgccggggtgtgtcgaccaggcgaagcgcatacgcgttttcccaccaaagagggtacgccgacctcatttcgtcaggacgatcgattagaaagaagcgctcccctcttgatgcgattgtggcagacggaacggcagagtaccgccggaccggagactcc

SEQ ID NO: 7317 - DNA, 3753 bp, Artificial Sequence
  Description of Artificial Sequence: Synthetic coding sequence
atgagcaccgaacgcgacagcgaaactacgttcgacgaggactcccaacccaacgatgaggttgtcccgtactctgatgatgaaactgaagatgaacttgacgatcagggatcggccgtggaaccggagcaaaatcgcgtgaatcgcgaagcagaggagaatagggaaccgttcagaaaggagtgtacgtggcaagtgaaggcaaacgaccggaagtaccatgagcagccgcactttatgaataccaagttcctctgtatcaaagagtcgaagtatgccaacaacgcgatcaaaacctacaagtacaatgcattcaccttcatccccatgaacctgtttgaacaattcaagcgggccgcaaacctgtatttcctcgcccttctgatcctgcaagctgtgccgcagattagcactctggcgtggtacaccaccctggtcccactcctggtcgtgctgggagtgaccgctatcaaggacctcgtggatgacgtggcccggcacaaaatggacaaggaaatcaacaaccgcacttgcgaagtgatcaaggatggacggttcaaagtggccaagtggaaggagatccaggtgggagatgtgatccggctcaagaagaacgacttcgtacctgcagatatactcttgctgtcaagctccgagccaaattccctctgttatgtcgaaacggccgagctggatggcgagactaacctgaagttcaagatgtccctggaaatcactgaccagtacctgcagcgagaagatactctcgcgactttcgatgggttcatcgaatgcgaagaaccgaacaatcggctcgacaagttcaccggaactttgttctggagaaacaccagctttccgctcgacgcggacaagattctgcttcgcggctgcgtgattaggaataccgacttttgccacggcctcgtgatcttcgcgggggcggacaccaagatcatgaagaacagcggaaagactagattcaagcgcaccaagatcgattacttgatgaactatatggtgtacactatcttcgtagtgctgatccttctcagtgccggactcgcaatcggacatgcctactgggaagcgcaggtcggaaattcgtcctggtacctctacgacggagaggacgacaccccgtcgtacagaggatttctgatcttctgggggtacatcatcgtgctgaatactatggtcccgatctcgctgtacgtgtcggtggaagtgatcagactcgggcaatcgcacttcatcaactgggatctgcagatgtactatgcggagaaggacaccccagccaaagcgcggaccactaccttgaatgaacaactcggacagatccactacatctttagcgacaagactggtactcttacccagaatatcatgactttcaaaaagtgttgcatcaacggccagatctacggtgaccatagagatgcctcgcagcataatcacaataagatcgaacaagttgatttttcgtggaacacctacgcagatgggaagctcgccttttacgaccactacttgatcgagcagatccaatccggtaaagagcctgaggtgcggcagtttttcttcctgctcgcagtgtgccatactgtgatggtggatcggaccgacggacagttgaactaccaggcagcctccccagacgaaggagcgcttgtcaacgcggcccggaactttggatttgcattcctggcccggacccaaaacaccatcaccatcagcgaactcgggacggagcgcacttacaacgtgctggccatcctggactttaactctgatcgcaagcgaatgtcgatcattgtgaggactcctgagggaaacatcaagctgtactgcaagggggccgacaccgtgatctacgaacggttgcacagaatgaaccctaccaaacaggaaacccaggacgccttggacatattcgccaacgaaaccctgcgcacgctgtgcttgtgctacaaggagatcgaagaaaaagagttcacggaatggaataagaagttcatggcagcctctgtggcgtcaaccaacagggacgaggccctcgacaaagtgtacgaggagatcgagaaggatctgatcctgctgggcgccaccgcgatcgaggacaagctccaggacggagtccctgaaactattagcaagctggccaaggcggatatcaagatctgggtgctgaccggggataagaaagaaactgctgagaatattggtttcgcctgcgaactgctgactgaagataccacgatctgctacggcgaagatatcaacagcctgctgcacgcccgaatggagaatcagcggaataggggtggagtctacgctaaattcgctccaccggtgcaagagtcattcttccccccaggaggaaaccgggcactgatcatcactggatcgtggctgaacgagatcctcctcgagaaaaagaccaagaggaacaagatcctgaagctcaagtttccgcggaccgaagaggaacgccggatgagaactcaatcaaagcgccggctggaagcgaagaaggagcagcggcagaagaactttgtggacctggcttgcgaatgctccgcggtgatctgttgtagagtcactccaaagcaaaaggccatggtggtggatctggtgaagaggtacaagaaagccattactctggctatcggcgatggtgctaatgacgtgaacatgatcaaaactgcgcacatcggggtgggcatctcaggacaggaaggaatgcaagcggtgatgtctagtgattactcgttcgcgcaattccgctacctgcagcgcttgctgctggtccatggacgctggtcctatattcggatgtgtaagttcctccgctactttttctacaagaatttcgccttcaccctggtgcacttctggtactcgttcttcaacggatactcggcgcagactgcttacgaggattggttcatcaccctctacaatgtgctgtacaccagccttcctgtgctcctgatgggcctgctcgatcaggacgtctcggataaactgagcttgcgctttcctggcctgtacatcgtgggtcagcgagacttgctgttcaattacaagcgcttcttcgtgtccctcctccatggtgtcctcaccagcatgattctgtttttcatcccgctcggagcctacctccagactgtgggacaagacggcgaggccccttcggactaccagtcgttcgctgtgactatagcaagcgcgctggtcataacggtcaatttccagatcggcctggacacgtcctactggactttcgtgaacgcttttagcatcttcggcagcattgccctgtatttcggcatcatgttcgacttccattcggcgggaatccacgtcctgttccctagcgctttccaatttactgggaccgcgtccaacgcgctccgccaaccgtacatttggctgactatcatcctcgcagtggcagtctgcctgcttcccgtcgtggccatacgcttcctgtcgatgactatatggccatcggaatcggacaaaatccaaaaacacaggaagaggttgaaggcagaagaacaatggcaacgccggcagcaggtctttagacgcggcgtctcgacgagacggtctgcttacgcgttctcgcaccagcgcggatacgcggacctgatctcatcaggaaggtccatcagaaagaagcggtcacccctcgacgcgatcgtggcggacggaaccgccgagtaccgccgcactggagactcg

SEQ ID NO: 7318 - DNA, 3753 bp, Artificial Sequence
  Description of Artificial Sequence: Synthetic coding sequence
atgtcgactgagcgggattccgaaacgacctttgacgaggactcacagccaaatgacgaagtggtgccgtactccgacgatgagactgaggacgagcttgatgaccaggggagcgccgtcgaaccagaacaaaaccgcgtgaacagagaagcagaggaaaaccgcgaacctttccgcaaggaatgcacctggcaagtgaaggcaaatgaccggaagtaccacgagcaaccacacttcatgaacactaagtttctctgcattaaggagtccaaatatgccaataatgccattaagacttacaaatacaacgcgttcaccttcatcccgatgaacctcttcgaacagtttaaacgggccgccaatctctacttcctcgcacttttgatccttcaagccgttcctcagatcagcactcttgcttggtacactacccttgttccgctgttggtggtcttgggagtgaccgcgatcaaggacctcgtggatgacgtggcaaggcacaaaatggataaagaaatcaacaatagaacttgcgaagtgatcaaagacggcaggttcaaagtggctaaatggaaggagatccaggtcggagacgtgatcagactgaaaaagaacgacttcgtgccagccgacattctgcttctctcctcctcggagccgaactcgctgtgctacgtggaaaccgctgaactggacggcgagactaaccttaagtttaagatgagcttggaaatcaccgaccagtacttgcaaagggaagatactctcgcgaccttcgacggatttatcgagtgcgaagagccaaacaaccgcctggacaaattcaccgggacccttttctggcggaatacttcctttccactggatgccgacaagattctcctgcgcggatgcgtcatccggaatactgatttctgccacgggctggtgatcttcgctggcgctgacaccaagattatgaagaacagcggaaagacccggtttaagcggacgaagatcgactacctgatgaattacatggtctacaccatctttgtcgtgttgatcctgctctccgcgggactggctatcggtcacgcatactgggaggcacaggtgggtaactcatcctggtacctgtatgatggagaagatgacactccttcataccgcggattcctgatcttctggggttacatcatcgtcctgaacactatggttcccatctcactgtacgtgtcggtggaagtcatccgcttgggacaatcgcacttcatcaactgggacctccagatgtactatgctgaaaaagacactccggcgaaggcccggactactactctcaatgagcagctcggccagatccactacatcttctccgataagaccggcaccctgacccaaaacatcatgaccttcaaaaagtgttgcatcaacgggcagatctacggggatcatcgcgacgcctcgcagcataatcacaataagatcgagcaagtggatttttcatggaatacctatgcggacggaaagttggcgttctacgatcattatctgatcgaacaaatccagtcaggaaaagagccggaggtccgccagttcttctttctgctggccgtttgccataccgtcatggtggatagaaccgacggccagcttaactaccaggccgccagcccagatgaaggggcgctggtcaacgcggcgcgcaatttcggattcgcattcctcgctcgcacccagaacacgatcaccatctcagagctcgggactgagagaacttacaacgtgctcgccatcctcgacttcaattccgacagaaagaggatgagcatcatcgtgcgcaccccagaggggaacatcaaactttactgcaagggagcggataccgtgatctatgaacgccttcaccgcatgaacccgactaaacaagaaacgcaggatgcccttgacattttcgccaacgagacgttgagaaccctttgcctgtgttacaaagagattgaggaaaaggaattcaccgagtggaacaagaagtttatggccgcatcggtcgcttcgactaatagagatgaggcgctggataaggtgtacgaggaaatcgaaaaggacctgatcctccttggggcgaccgcgatcgaagataaactgcaggacggagtgcctgaaactatatcaaaactcgcaaaagcggatatcaagatctgggtgcttactggagacaagaaggaaactgccgaaaacattggatttgcatgcgaactgctgactgaggacaccactatttgctacggagaggacattaactctctccttcatgctaggatggaaaaccaacggaatcggggaggtgtgtatgccaagttcgccccgcctgtgcaagagagctttttcccccctggtggcaacagagccctgatcataaccggctcgtggctgaacgagatcctcctcgaaaagaaaactaagcggaacaagatcctgaagctgaaattccctcggaccgaggaagaaagacgcatgcgaactcagagcaaacgtagactggaggccaaaaaggagcagcgccagaagaattttgtcgatctggcatgcgagtgttcagctgtgatttgctgtcgggtcacccccaagcagaaagctatggttgtggacctcgtgaagcgatacaagaaggctatcacgcttgcaattggcgatggagccaatgacgtgaatatgatcaagactgcccacatcggagtgggcatcagcggccaagaaggcatgcaggccgtcatgtccagcgactactcgtttgcacagtttcggtatctccaacggttgctgctggtccacggaagatggagctatatccgtatgtgcaagtttcttcgctatttcttctacaagaacttcgccttcactctggtccacttctggtacagcttcttcaacggatattcggctcaaaccgcctacgaagattggttcatcactttgtacaacgtcctgtatacctctctgccggttctcctgatgggactgctcgatcaagacgtgtctgacaagctgtcgctccggttccccggtctttacatcgtgggacagcgggacctcctgtttaactacaagcgcttcttcgtctcactcctgcatggcgtgcttacctcaatgatcctgttcttcatcccactgggagcttacctccagacggtcgggcaagatggagaagctccttccgattaccagtcgtttgccgttactatcgcatcggcgctggtgatcacggtcaatttccaaatcggcctggatacctcatactggaccttcgtgaatgccttcagcatcttcgggtccatcgcgctctacttcggtatcatgttcgactttcacagcgctggtattcatgttctgtttccctccgccttccagtttaccgggaccgccagcaatgcactgaggcaaccatacatctggctgacgatcatacttgctgtcgcagtctgtctgctgccggtggtggctatccgcttcctgtcaatgaccatctggccgtcggagtcggacaagatccagaaacaccgcaagcggctcaaagcggaggagcagtggcagaggcgccaacaagtctttagaagaggagtgtctactcgcagatcggcctacgcattctcacaccaacggggctacgccgacctcatctcgtcagggcgaagcattagaaagaaaagaagcccgctggacgcgattgtggccgacgggaccgccgaatacaggaggaccggcgattcc

SEQ ID NO: 7319 - DNA, 3753 bp, Artificial Sequence
  Description of Artificial Sequence: Synthetic coding sequence
atgtccaccgagcgggacagcgaaactactttcgacgaagattcacagcctaatgacgaggtggtgccatattcggacgacgaaacggaggacgagctggatgaccagggttccgctgtcgaacccgaacagaatcgcgtcaaccgagaagcagaggaaaaccgcgagcctttcagaaaagaatgcacatggcaggtgaaagcaaacgatcgtaaatatcacgagcaaccacatttcatgaataccaagttcttgtgcattaaggagtcaaaatacgccaacaatgccatcaagacatacaaatataacgcttttacctttatccctatgaatctgttcgaacaattcaagagagccgccaacctgtatttcctggccttgttgattttgcaggctgtgccacagatatctaccttggcatggtacactaccttagtccctcttctggtggtgctgggagttactgccattaaagacctggtagatgacgttgcacggcacaagatggacaaggagatcaataaccgcacatgcgaggtgattaaagacggtcggttcaaagtcgccaaatggaaagagatacaagtcggcgatgtgatacgcctgaagaagaatgactttgtgcccgccgatatactcctcctttcctctagtgagccaaactccctgtgctatgtggagactgccgagcttgatggggagacaaacttaaaatttaagatgtcactagaaatcaccgatcaatatcttcagcgcgaagatacccttgccacctttgacgggtttatcgaatgcgaggagcccaataatcgcctggataagttcactggtaccttgttttggaggaatacttctttccctctggatgctgataaaattctgttacgaggttgtgtgatccggaatacagacttctgccacggtctggtcatcttcgccggagccgataccaagatcatgaaaaactccggaaagacacggttcaagcgcaccaagatagattacctgatgaattatatggtgtatactatctttgtggtgctgatcctgctgtctgccggactagccatcggccatgcctattgggaggcacaagtggggaactcatcttggtatctatatgacggggaggatgacacccccagttacagagggttccttattttttggggatatataatagtccttaacaccatggttcctatcagtttatatgtgtctgtggaggtaattcggctgggccagtcccatttcatcaattgggatttgcagatgtactacgctgagaaagacacacctgctaaagccaggacaaccaccctgaatgaacaacttggccaaattcattatatattcagtgataagaccggaacactgacccaaaatatcatgaccttcaagaagtgctgtatcaacggtcagatttacggcgaccaccgggatgcatcccagcacaaccacaataaaatagaacaggtggatttcagttggaacacttatgccgatggaaagctggcattttacgaccactatctaatcgagcagattcagtccgggaaggagcccgaggtgcgtcagtttttttttttgcttgctgtgtgccatacggttatggtagaccgcactgatgggcaattaaactatcaggccgcttcacccgatgagggtgcactggtgaacgctgccagaaatttcggattcgcctttctggcgaggacgcagaacacgataacgatcagcgagttgggcactgagcggacatacaatgttctggcaattcttgactttaactcagacaggaaacgcatgtcaattattgtccggacacccgaggggaacattaagctctactgtaagggggctgacactgtgatttatgaaagattgcataggatgaatccaaccaagcaagagactcaagatgccctcgatatttttgctaacgagacacttcgtactttgtgtctgtgctacaaagaaatcgaggaaaaggagttcactgaatggaacaagaaatttatggctgcgtccgtcgcctcaaccaaccgcgacgaggccctcgataaggtctatgaagagatcgagaaagacctgatactgctgggagccaccgcaatagaggataaactccaagacggtgtccctgagaccatttctaaacttgccaaagctgacatcaagatttgggttctgacaggtgacaagaaagaaaccgccgagaacatcggatttgcctgcgaattgttaacagaggatacgacaatttgctatggcgaggatatcaacagcctcctgcatgcccgcatggagaatcagcgtaatcggggtggagtgtacgcaaaattcgccccccccgtccaggaatctttcttccctccggggggaaacagagccctgatcataaccggatcctggctcaacgaaatcctcctagaaaaaaagaccaaacgcaacaaaatcctcaaactgaagtttccgcgtaccgaagaagagcggcgaatgcgtacacagtctaaaaggcgactggaagctaagaaagaacaaaggcaaaaaaactttgtggatctcgcgtgcgaatgctccgccgtcatctgctgccgagtgacccccaagcaaaaggccatggttgtcgacctggttaaacggtacaaaaaagccattaccctggctattggcgacggcgccaacgacgttaatatgatcaaaacagcacatatcggtgtcggaattagtgggcaagaagggatgcaggcagtgatgtcatctgattatagctttgcacagtttcgctatctgcagcgcttgctgctggttcacggccgctggagctatatccgcatgtgcaagtttctgcggtatttcttctataagaacttcgctttcacgctggtccacttctggtattcatttttcaacggatattccgcccaaacggcatatgaagactggtttatcaccctgtataatgtgctttacacaagccttcccgttttgttgatggggctgctcgatcaggatgtttcagacaagctgtccctgagattccctggtttatacattgtgggacagcgagatttgctcttcaactataaacgcttcttcgtgagcctcttgcatggcgtgttgacgtcaatgatcctgttttttatcccattgggtgcctacttgcaaactgtgggacaagatggcgaagcaccatctgattaccagtctttcgcggtgaccattgccagcgctctagttattaccgtcaattttcaaattgggctggacacctcttattggaccttcgtgaatgctttttctatctttggatccatcgccctgtactttggcatcatgttcgatttccactctgctggtatccatgtgctgttcccaagcgcttttcagtttacaggaactgcatccaacgcactgcgccaaccatacatttggctaaccattatcctggcagtcgcggtctgcctgctccccgtggtggcaatcagatttctgagtatgactatttggccaagcgaaagcgacaagatccaaaagcaccggaagcggctcaaggcagaagagcaatggcagcgcaggcagcaagtgttccgccgcggcgtgtctaccagacgctcggcttacgcgttttcacaccagagaggctacgccgacctaatttccagtggtcgatctatcaggaagaaaagatcccctcttgatgccattgttgccgatgggactgctgagtatcgtaggacgggtgactca

SEQ ID NO: 7320 - DNA, 3753 bp, Artificial Sequence
  Description of Artificial Sequence: Synthetic coding sequence
atgtcaacggagcgggattcagagactacctttgatgaggacagtcaaccaaatgacgaggtagtaccttactctgacgacgagacagaggacgagctggatgaccaggggagcgcagtggagcctgagcagaaccgcgtcaaccgggaagcggaggaaaaccgcgagccctttagaaaggagtgtacatggcaagtgaaggcaaatgataggaaatatcacgagcagccccacttcatgaacactaaattcttgtgcattaaagagtctaaatacgctaataatgccatcaaaacatataagtacaacgcatttacatttatccccatgaacctgtttgagcagttcaaacgagccgccaatctgtatttcctcgcactcctgattctgcaggccgttccacagatctctacgttggcctggtacacaactctggtgccactgcttgtggtgctcggagtgacagcgattaaagacctcgttgacgatgttgcccgccacaaaatggacaaggaaattaacaacagaacctgtgaggtcatcaaagacggtaggtttaaagtggctaaatggaaagagattcaggtgggcgacgtgataaggcttaagaagaatgacttcgtgcccgccgatattcttcttctgtcctccagtgaacctaatagtctctgctatgtagaaaccgccgaactggacggagagacaaacctcaaatttaagatgagcttggagatcacggaccaatacctgcagcgagaggataccttggcaacattcgacgggttcatagagtgtgaagagcctaataacaggttggacaagtttacgggtaccttgttttggaggaacacgtcctttcctttggacgcagataaaatcctgctgcgcggatgcgtcatcaggaacactgacttttgtcacggcctggtcattttcgccggagcagatacaaagatcatgaagaacagcggcaagactcggtttaaaaggactaagatcgactacctgatgaactatatggtatacactatctttgtggtgctgatattgctgagtgctggcttggccattgggcatgcttactgggaagcacaggtgggcaacagttcttggtacctttacgacggtgaagacgacaccccatcctataggggattccttatcttctggggatatattatcgtactcaataccatggttcctatttccctctatgtgtccgtagaggtcatcaggcttggtcagagtcatttcatcaactgggacctgcaaatgtactacgccgaaaaggacactccagctaaggccagaaccaccacattgaacgagcagctcggacagattcactatattttctccgacaagactggtacccttacacaaaatatcatgacattcaaaaagtgctgcatcaacgggcagatttacggcgatcaccgagatgcttcccagcacaatcataataagatcgaacaggtcgatttctcatggaacacatatgctgatggtaaacttgctttctacgaccactatctgattgagcagattcagtccgggaaggaaccagaagtcaggcaattcttttttctgttggccgtgtgtcacacagtgatggtggaccggactgatggacagctgaattaccaggccgcctctccagacgagggagccctggtcaacgccgcacgcaactttggttttgcctttctcgctagaacacaaaacacaatcacaatatctgagctggggactgaaagaacgtataatgtgctggccatactcgacttcaattctgatcggaaaaggatgtccatcatcgtaaggaccccagaaggaaacattaaactttactgtaaaggtgctgacactgtaatttacgaacgcctgcaccgaatgaaccccactaagcaggagacacaggatgccctggacatctttgccaacgagacacttcggacattgtgcctttgttacaaggagattgaagagaaagagtttacggagtggaataagaagttcatggctgcttccgtcgcgtctaccaacagagacgaggccttggacaaagtgtatgaggaaatcgagaaggaccttatccttcttggggccacagcaattgaagacaagctgcaggatggagtaccagagacaatctcaaaactggctaaggccgatattaagatatgggtgctcaccggtgataaaaaggagactgctgaaaatatcggctttgcttgcgaattgctgactgaggacactaccatctgttacggggaagacatcaactctctgcttcatgccagaatggagaatcagagaaatcgaggtggcgtttacgctaagtttgcccccccggtgcaggaatccttctttcctcctggaggaaacagagcactgataataacggggagttggcttaacgaaatacttttggagaagaaaactaagaggaacaaaattctcaaattgaaattcccacggacagaagaggagcgaagaatgcgcacccaatccaagagaaggctggaggcaaagaaagagcaaaggcagaaaaattttgttgacctggcttgtgaatgcagcgcagtgatctgttgtagggtgaccccgaagcagaaggccatggtcgtggaccttgttaaacgatataaaaaggcaattaccctggcaattggcgacggagccaatgacgttaatatgatcaaaaccgcacacatcggtgtgggaatcagtgggcaggaagggatgcaagctgtgatgagctctgattacagttttgcacagtttagataccttcagcggctgctcctggtgcatggccgctggtcttacatcaggatgtgcaaatttctgaggtacttcttttataagaacttcgcattcacgctggtacatttttggtactccttttttaacggttattccgctcaaacagcttacgaggactggttcatcaccctttataacgtgctgtacaccagcctgccggttctgctcatggggctcctggatcaggatgtgagcgacaagctgagtttgagattccccggtttgtatatcgttggccagcgagatcttctcttcaattacaaacgatttttcgtttcactcctccatggggtcctcacatccatgattttgttctttatcccactgggggcctatctccaaacggtgggccaggatggggaggctccatcagactaccagagctttgcggtgacaatagcgtccgccttggtgattacagtcaattttcagatcggactggacacatcctattggaccttcgtcaacgccttctctatctttggctcaattgcactttactttggtattatgtttgattttcactcagcaggcatccatgtgttgttccccagcgccttccagttcaccggaactgcttctaatgctcttagacaaccttatatttggctgacaatcattttggctgtggctgtgtgcctgctgccagtcgtcgcaatcaggttcctgagcatgacgatctggccctcagagagcgataagatccaaaagcacagaaagcgcctgaaagcagaagagcagtggcagcgacgccagcaggtgtttagaaggggcgtctccacgaggcggtcagcttacgccttctcccaccagaggggatacgccgatctgatctctagcggtcgctcaatccggaagaagcgaagccctcttgacgctatcgttgccgatgggaccgccgagtatagaaggactggggactct

SEQ ID NO: 7321 - DNA, 3753 bp, Artificial Sequence
  Description of Artificial Sequence: Synthetic coding sequence
atgagcactgaacgagattcagagaccacctttgatgaggattcgcagcccaatgacgaggtggtgccatactccgacgatgagacagaagacgagctggatgaccagggctctgctgtagagccagaacagaatcgtgtgaaccgtgaggcagaggagaacagggaacccttcaggaaggagtgtacctggcaggtgaaggccaacgaccgcaagtatcacgagcagccacatttcatgaacaccaagtttctgtgcataaaagaaagcaagtacgccaataatgctatcaagacctataaatacaatgctttcacctttattccaatgaatctgttcgagcagtttaaacgagccgccaatctgtactttctggctctgcttatcctgcaggccgtgccccagatctccactctagcgtggtacaccacccttgtgccactgctggtggtgctgggtgtgacggccataaaggatctggtggatgacgttgcacgccataaaatggataaggagattaataataggacttgcgaagtcattaaggatggaagattcaaggtggccaaatggaaagaaatccaagtcggggacgtgatacgccttaagaagaatgactttgtgcccgcagacattttactgttaagctctagcgaacctaacagcctgtgctacgttgaaactgcagagctggatggtgaaacaaacctgaaattcaaaatgtctttggaaataaccgaccagtatctgcagagagaagacaccctggccacttttgacgggttcatcgagtgcgaagagcccaataacaggctcgataagttcacaggcacactgttttggaggaacacttctttccctctagacgcagacaaaattctgttgcgcgggtgcgtgatacggaataccgatttctgtcatgggctggtgatctttgctggggctgacaccaagatcatgaagaactcgggcaagacaagattcaaaaggacgaagatcgattacctgatgaattacatggtttatacaatctttgtggtgcttattctgctttcagcagggttggctattgggcatgcctactgggaagcacaagtgggcaactcttcatggtatctgtatgatggcgaagacgatacaccatcatatagagggttcctgatcttttggggctacataattgtgttgaatactatggtacccatttcactctatgtcagtgttgaagttatccggctggggcagagtcatttcatcaactgggacctgcagatgtactatgcagaaaaggacacccctgctaaggcacgaaccacaaccctgaacgagcagctggggcaaattcactatatcttttcggataagaccggcaccctaacacagaacatcatgacatttaagaagtgctgcatcaacggtcaaatctacggagatcatagggatgccagtcagcataaccacaacaagatcgaacaggtagatttttcctggaatacctacgccgatggaaagctggccttctacgaccactaccttatcgaacagatccagtccggcaaggagcctgaggttcgccagtttttctttttgctggcggtgtgccacaccgtcatggttgatagaaccgatggtcaattaaattaccaagccgcatcccctgacgagggggctttagtgaacgcagcacggaacttcggttttgcctttctagctaggacccagaatacgatcacaatctcagaactcggcaccgagaggacatacaacgttcttgcaatcctggatttcaactctgatcgtaagcgaatgagcataatagtgcgcacaccagaagggaatatcaaactgtattgcaagggcgccgacaccgtgatttatgagagactgcatcgcatgaatcccaccaagcaagagacccaggacgctcttgacatcttcgcaaatgaaacactgcgcaccctgtgtctttgttacaaggagatcgaggaaaaagagttcaccgagtggaataaaaagttcatggccgcctctgtggccagtacgaatcgcgatgaagccctggacaaggtttatgaggaaatcgagaaggatctgatcctgctcggagcaaccgccattgaagataagctgcaggacggagtcccagagaccatctctaaattggccaaagccgacattaagatctgggtcctgacaggcgataagaaggaaaccgcagagaatatagggttcgcttgcgagttgctgacagaggataccacaatctgttacggcgaagatataaactccctgttacacgcaagaatggagaatcagagaaatagagggggtgtgtatgccaaattcgcccccccagtgcaagagtcctttttcccgcccggtgggaaccgggctttgataatcacaggaagttggttaaatgagatcctcctggagaaaaagacaaaacgaaacaagatcctgaagctgaagttcccccgtactgaggaggagcggagaatgagaacgcaaagcaagcgtcggctggaggctaagaaggagcagagacagaagaactttgtggatctggcttgtgaatgttcagccgtaatttgctgcagggtgaccccaaaacagaaagcaatggtggtagacctcgtaaagaggtacaagaaagcgatcacactggcaattggggacggcgcaaacgacgtcaacatgattaagaccgcgcatattggagtgggcataagcggccaggagggcatgcaagccgtgatgtccagcgactatagtttcgcacagttccggtaccttcagaggcttctgttagtacatggcaggtggtcttacattcggatgtgcaagttcctacggtacttcttctataagaactttgccttcacccttgtgcatttctggtattcttttttcaacgggtatagtgcacagaccgcgtatgaggactggttcattaccctgtacaacgtcctttatactagccttcccgttctgcttatgggtttgctcgaccaggacgtaagcgataagctgtctctgagattccctggactttacatagtgggtcagcgcgatctgctgttcaactataaacgcttttttgtcagccttctccacggcgtgctgacttccatgatactattctttatacccctgggagcttacctccagactgttgggcaggacggggaagcccctagcgattaccaatcattcgcagttaccatagcatcagctttggtcataaccgtgaatttccaaattggtctggatacgagttattggacttttgtcaatgccttctcaattttcggttccattgccctatacttcggcataatgtttgatttccacagcgcaggaatacatgtactcttcccttccgcctttcaatttaccggtacagctagcaatgctctccgtcagccttacatttggctgactataattctagccgtggcagtgtgtctcctccccgttgtggccattcgattcctttccatgaccatctggccatcggagtcggacaagattcagaagcacaggaagcggctgaaagccgaggaacagtggcagaggcgtcagcaggtttttcggcgcggcgtgagcacccggaggtccgcctatgcattcagccatcagagaggatacgccgatctgataagctctggacgtagcattaggaagaagcgcagtcctttagacgcaatcgtggctgacgggaccgccgagtaccggaggaccggcgattca

SEQ ID NO: 7322 - DNA, 3753 bp, Artificial Sequence
  Description of Artificial Sequence: Synthetic coding sequence
atgagcaccgaacgggattctgagactacgtttgacgaggatagccaacctaacgacgaggtcgtcccctatagcgacgatgaaaccgaggatgaactggatgatcaggggtctgccgttgagccggaacagaaccgggtcaaccgggaggcagaggagaatcgcgaaccttttcggaaggagtgcacatggcaagtaaaggccaatgacaggaagtatcacgagcagccacacttcatgaatactaaattcctgtgcatcaaggaatcaaaatatgccaacaatgcgatcaagacatataagtacaacgccttcaccttcataccaatgaacctgttcgaacagttcaagagggctgcaaatctctattttctggccttgctgattctgcaggccgtgcctcagatctccacactggcatggtacactactctggtgccgcttttggtggtactgggagtgaccgcgatcaaggatcttgtggatgacgttgcaaggcataagatggacaaagagataaacaatagaacttgcgaggtcatcaaagatggacggttcaaggttgcaaaatggaaggagattcaagtgggcgatgtaatcagactgaagaagaatgacttcgtgcctgccgacatcttactactttccagttctgaaccaaactctttgtgttatgttgagaccgccgaactggacggggaaaccaacctgaaattcaagatgtccctggagataacagaccaatatttgcagcgagaagacactttggctactttcgacggtttcatcgaatgtgaggagcccaataatcggctcgacaaattcaccggtaccctgttctggcgcaatacttcattccctctggacgcggacaagatcctgctcagggggtgcgtgatccgaaacactgatttttgtcacgggctggtaatcttcgctggtgccgacaccaagattatgaaaaacagcgggaaaacccgatttaaaagaaccaaaatcgattacctcatgaactacatggtgtataccatcttcgttgttctgattcttctttccgctggcttggcgataggacacgcttattgggaagcccaggtggggaattcctcctggtatttatacgatggggaggatgacacaccgagttacagaggtttccttatcttttggggatacatcatcgtgctcaacaccatggttcctatctccctttacgtgagtgtcgaggtgattcgtctgggacagtctcatttcatcaactgggacttacagatgtactatgctgagaaggatacgccggccaaggcgcgcacaaccaccctgaacgagcagttgggtcagatacattacattttctctgataagacaggaacccttacccagaacataatgacatttaagaaatgttgcatcaatggccagatatacggagaccacagagacgcatctcaacataatcacaacaagatcgagcaggtcgatttttcatggaacacatacgccgatgggaagctcgccttttatgatcactatctcatagaacagatccaatcaggtaaagaaccggaagtcagacagttcttcttcctcctcgccgtgtgtcacacggttatggttgatcggactgatggtcagctgaattatcaagcagcaagcccggatgaaggcgcattggttaatgccgctcggaacttcggctttgccttccttgcccggacccagaatacgatcactatttccgagctgggcaccgagcgtacctacaacgtcctagccatacttgatttcaacagcgaccgtaaacggatgagcataattgtgcgtacccctgaaggcaacatcaaattgtattgcaagggcgccgacacagtgatatatgaaaggcttcaccggatgaacccaaccaaacaggaaacccaggacgccctggatatttttgccaatgagacgttgcgaaccctgtgcctgtgttacaaggaaatcgaagaaaaggagtttaccgaatggaataaaaagttcatggcggcttcagtggcatctaccaatcgggacgaggccttagataaggtctacgaggaaatcgaaaaggacctgattctgctcggcgcaaccgccattgaggataaactgcaggacggtgtgcccgaaaccatctctaagctggccaaagccgatatcaaaatatgggttttaaccggtgacaaaaaagagacagcagaaaacatcggatttgcatgcgagctcttgaccgaagatacgaccatctgttatggggaggacataaatagtctcctgcacgctaggatggagaaccagagaaaccgcggaggtgtgtacgccaagttcgcgcctccagtacaggaatcattcttcccacccgggggcaaccgggcactcattatcactgggtcatggttgaacgagatcctgctggagaaaaaaacaaagaggaacaagatcctgaaactgaaattccccagaacagaggaggaacgccgcatgagaacacaatccaagcggaggctcgaagcgaagaaggaacagcggcagaaaaactttgtggacctggcttgcgaatgctccgcagttatctgctgccgggtgacgcccaagcagaaagctatggtcgttgacctcgttaagcgctataaaaaggccatcacactggcaatcggggatggggctaacgatgtgaatatgatcaagacagcgcacatcggagtgggtatctccggacaggagggaatgcaggcagtaatgagctctgactatagctttgcccagtttagatatctgcaacgtcttctgctggttcacggacggtggtcttatatccgtatgtgcaaattcctgcggtattttttctataaaaactttgcttttactctcgtgcacttttggtactcattctttaatggctattctgcccagacggcctacgaagactggtttattactctgtataatgttttgtacacatcattgcctgtccttctcatgggactgttggaccaggatgtgtccgacaaattgtccctccgcttccccggcttgtatatcgtgggtcaaagagacctcctattcaattacaaacggtttttcgtatctctgctccacggagtcttgacctctatgattctgttttttatcccattgggagcatacctgcagaccgtcgggcaggatggagaagcccccagcgattatcagagctttgctgtgaccatagccagtgcacttgtcataactgtcaatttccagatcggcttagacacctcttactggacattcgtgaacgctttctcaattttcggcagcatcgctttgtattttggaataatgttcgactttcactcagccggcattcacgtcctgttccccagtgcttttcagttcaccggcactgcttctaatgctttaaggcagccctacatctggttgactataatcctagcggtggctgtgtgtctcttgccagtggtagcgattagatttctttcaatgactatttggcccagtgagagcgacaaaatacagaaacaccggaaacgcttaaaagctgaagaacagtggcagaggcgacaacaggtgtttcggcgcggcgtgtctacccgacgcagcgcttacgcctttagccatcagcgggggtacgccgatctgatcagctccggcagatctatcaggaagaagagaagccccctcgacgctattgtggcggatggcactgccgagtatcgtagaactggcgattcg

SEQ ID NO: 7323 - DNA, 3753 bp, Artificial Sequence
  Description of Artificial Sequence: Synthetic coding sequence
atgtcgaccgaacgcgactccgaaaccacctttgacgaagattcacaacctaacgacgaagtggtgccatactccgatgatgaaactgaggatgaacttgatgatcaaggatccgccgtcgaacctgaacagaatcgtgtgaaccgagaggcagaagaaaatagagaaccttttcggaaggaatgcacttggcaagtgaaggcgaatgatcgaaagtatcatgaacaaccacactttatgaataccaaattcctgtgcattaaggagtccaagtacgctaacaacgcgatcaaaacctacaaatacaatgcattcacgttcatccctatgaaccttttcgaacaattcaagagagcggctaacctttactttctggcactgcttattctgcaggcagtgccacaaatttcgactctcgcctggtacaccactctggtgcccctgctcgtggtgctgggtgtgaccgcaatcaaggaccttgtggatgacgtggcgagacacaaaatggataaggagatcaacaaccgcacctgcgaggtgattaaagatggaagatttaaggtcgcaaagtggaaggaaatccaagtgggtgatgtcattagattgaaaaagaacgactttgtgcccgcagatatcctgctcctcagctcgtccgaaccgaactccctttgttacgtggaaactgcagaactggatggggaaaccaatctgaagtttaagatgagcttggaaattacggaccaataccttcagagagaggataccctcgcaacctttgatgggtttattgagtgtgaagagccgaacaatagacttgataagttcactggaaccttgttctggcgcaacacctcatttcctcttgatgcagacaagatccttctgcggggttgcgtgattcgaaatacggacttttgccatggacttgtgatatttgcaggagccgataccaagattatgaagaacagcggtaaaacccgatttaagagaactaagattgattacctgatgaattacatggtatacaccatcttcgtcgtgcttattctcctctccgccgggctcgcaatcggacatgcatactgggaagcacaagtcggcaattcaagctggtacttgtatgatggagaggacgataccccttcataccggggctttctcattttctggggatacattattgtgcttaacactatggtgccaatctcgttgtacgttagcgttgaagtcatccggctcggccagtcgcacttcattaactgggacctgcaaatgtactacgccgaaaaagacaccccagcaaaggcccgcactaccactctgaacgaacaactcggacagatccattacatattctcagataaaactggaaccctcacccagaacatcatgacctttaagaagtgttgtattaacggtcaaatctacggggatcatcgtgatgcgtcccagcataaccacaataagattgaacaagtggactttagctggaacacttacgcagacggcaaacttgcattttacgaccattaccttattgagcaaattcagtcgggaaaggaacccgaagtgcgccaattcttctttcttctggccgtgtgtcataccgtgatggtggatagaaccgacggacagctgaattaccaagccgcctccccggacgagggtgctctggtcaacgccgcacgaaacttcggatttgcatttctcgccagaacccaaaatactataactatttcggaactgggaaccgagagaacttacaacgttctggctattttggatttcaactccgatagaaagaggatgtccataattgtcagaacccctgaagggaacatcaagctgtactgcaaaggggcagatactgtgatttacgagcgccttcatcgcatgaatcctactaagcaggagactcaagacgcacttgatatctttgcaaatgaaaccctcaggaccctttgtctctgctacaaggagatcgaagagaaggagtttaccgaatggaacaagaagtttatggccgcaagcgtggcctcgacgaaccgggacgaggcccttgataaagtgtacgaagaaattgaaaaggatctcattctgcttggtgcaaccgcaattgaagataagctgcaagatggagtgcctgaaactatatcaaaacttgcgaaggccgacataaagatctgggtgctgaccggggataagaaagaaaccgccgagaatattggattcgcatgcgagcttctgacggaggacaccactatttgttacggagaagatatcaactccctgcttcatgccaggatggaaaaccaacgtaatcgaggaggagtgtacgcgaagttcgctcctcccgtgcaagaatcattctttcctcctggaggcaaccgtgcgctgatcataaccggatcctggttgaacgaaatccttctcgagaaaaagactaagcggaacaagatactgaagctgaagtttcctcggacggaggaggaacgcagaatgcggactcagtcaaagcgcagactggaagcaaagaaggagcaaagacagaagaatttcgtcgatcttgcgtgcgaatgttctgcggtgatctgctgtcgagttactcctaagcaaaaggccatggttgtggatctggtgaagcgatataagaaagcgatcacgcttgccatcggcgacggtgcaaacgatgtgaatatgatcaagaccgcccatataggggtgggcatttccggacaagagggaatgcaggcagtcatgtcgtcagattacagctttgcacagttccggtacctccagcgcctgcttcttgtgcatggtcggtggtcttacatccgaatgtgtaagtttcttcggtacttcttttacaagaacttcgcatttacgctcgtccatttctggtacagcttcttcaacggttactcagcacaaacggcctacgaagattggttcattactctgtacaacgtgctttacacctcactgccggtactcctcatgggacttctggatcaggacgtgtcggataagctcagcctcaggttcccaggactgtatatcgtggggcaacgggatctgttgttcaactacaagagatttttcgtttcgctcctgcacggagtgcttacttcgatgatcctctttttcatacctctgggtgcctacctgcagaccgtgggtcaggatggcgaagccccatccgactaccagtcctttgcggtgaccatcgcgtcggcactcgtgattaccgtgaatttccagattgggttggacacttcgtactggacctttgtgaacgccttttccatctttggatccattgcgttgtacttcggaataatgtttgattttcatagcgcaggcattcatgtgctgtttccctcggcattccaattcactggaactgcgagcaatgcactgaggcaaccttatatctggctcactataatccttgcagtggctgtgtgtctccttccggtcgtggccattcggtttctgtccatgacgatttggccctctgaatccgataagattcagaagcaccgaaagcggctgaaagcagaggagcaatggcagaggcggcaacaagtctttcggcgtggcgtctcaaccagaaggtcagcatatgcgttttcgcaccaaaggggatacgccgaccttatctcttcggggcgctcaattaggaagaagcgctcgccattggacgcaatcgttgcagatggaaccgctgagtaccgacggaccggtgattcc

SEQ ID NO: 7324 - DNA, 3753 bp, Artificial Sequence
  Description of Artificial Sequence: Synthetic coding sequence
atgtcaaccgaacgcgatagcgaaactacgtttgacgaggactctcagcccaatgacgaggtggttccctactcagatgacgaaaccgaggacgagctggacgatcaggggagtgccgtagagcccgagcagaatagggtgaaccgggaggccgaggagaatcgagagccatttagaaaagaatgcacttggcaagttaaagcaaatgacaggaagtatcacgagcagcctcactttatgaataccaagtttctctgcatcaaggaatcaaaatatgccaacaacgccatcaagacgtacaaatacaatgccttcacctttatacctatgaacctgttcgagcagtttaaaagggccgctaatctctacttccttgcgctacttatcctacaggcagtgccccagatctccaccctagcctggtataccactctagttccacttctggtggttctcggcgtcacagccatcaaggacctcgtcgatgacgtcgccaggcacaaaatggacaaggaaattaataatcggacgtgcgaagtcataaaagatggaaggtttaaagttgcaaagtggaaggagattcaggtaggggatgtgattcgacttaagaaaaatgactttgtaccggcggatatactcctcctctcatcctccgagcccaactcactatgctatgtcgaaacagctgagctggacggcgaaactaatctgaaatttaagatgtctctcgagataacagaccagtacctacagagggaagacactctggcaacctttgatggttttattgagtgtgaagagcccaataacagattggataaattcaccgggaccttattttggagaaatacaagcttccccttggatgctgacaagatcctgctcagaggatgcgttattcgtaatactgacttctgtcatggactggtgatttttgctggggctgacacaaagataatgaagaactcagggaagaccagatttaaaagaacaaagatcgattatctgatgaattatatggtatatactatattcgttgtgttgatcttgttgtcagcaggcctggccataggacacgcttattgggaagcccaggtcggaaattcatcctggtatctgtacgacggagaggacgatacaccatcatatcgaggttttctgatcttctgggggtacatcattgtgctgaatactatggtgccaatttctctttatgtcagcgtggaggtgatacggctgggccagtcccactttatcaattgggacctgcagatgtactatgctgagaaggacaccccagcaaaagccaggactactacccttaacgagcaacttgggcaaatccattatatattctctgataaaaccggaaccctgacccagaacattatgacatttaagaagtgttgtataaacggtcagatctacggggatcatcgggatgcctcgcagcacaaccataataagatcgaacaggtggatttttcctggaatacttatgcggacggaaagctggccttttatgatcattatctgatcgagcagatccaatccggaaaggagccggaagtgcggcagttcttcttccttcttgccgtgtgtcatacggtgatggtcgaccgaaccgatgggcagctcaattaccaagccgcatctccagacgaaggggccctggttaacgcagcccggaatttcggcttcgcattcctggcccgcacacaaaacacaatcaccatcagcgagctgggaaccgaacgcacgtacaacgtcttggccatccttgactttaactcagacagaaaaagaatgtctattatcgtcagaaccccagaagggaatatcaagttgtattgtaagggcgcagacaccgtcatctacgaaagactccacaggatgaatcctactaagcaggaaactcaggatgccctggatattttcgccaacgaaacactgcgtactctatgcttgtgctataaagagatcgaggagaaagagttcacggagtggaacaagaagttcatggcagctagtgtggcttctaccaatagagatgaggccctcgacaaggtgtatgaagaaatagagaaggacttgatcctcctgggcgcaacagcgatagaggataagctgcaagatggtgttcccgagaccatcagtaagcttgccaaggccgacataaaaatttgggtcctcacgggggacaaaaaggagaccgcggagaatatagggttcgcctgcgaactcttgactgaggacactaccatctgctatggcgaagatatcaattccttacttcacgccagaatggagaatcagaggaacaggggcggtgtgtacgccaagttcgcccctcccgttcaggagagtttctttcccccaggcggaaaccgcgccctcattattactggctcatggctcaacgaaatactccttgagaagaaaacgaagcggaacaaaatactgaagcttaagtttccccgtacagaggaggaacgtcgaatgcgcacccaatccaagcggaggctcgaggccaagaaggagcaaaggcagaaaaacttcgtcgatctggcgtgtgaatgctccgcagtgatctgctgcagggttacaccaaaacagaaggctatggtggtggacctggtgaagcgatacaagaaggcaatcactcttgccatcggggacggcgccaacgatgtgaatatgataaagaccgcgcatatcggagtcggtattagcgggcaagaggggatgcaagctgtcatgtctagtgactacagtttcgctcagtttaggtatctccagaggctgctgctggtgcacggcaggtggagctatattagaatgtgcaagttcctgcgatacttcttctacaagaatttcgccttcacactggttcacttttggtattcattctttaatggttacagtgctcaaaccgcttacgaggactggtttatcactctgtacaacgttttgtacaccagcctgcctgttctgcttatgggcctgctcgatcaggacgtatcagataagctgtctctacgttttcctggcctgtatatcgtgggccagcgggatttacttttcaattataaaagattcttcgtgagcttactccacggggttctgacttccatgattctgttctttatccctctgggagcctaccttcagaccgtaggccaagatggtgaagccccttccgattaccagtcatttgccgttacaatcgcgtcagcgctggtaattaccgtaaattttcagattggcctggatactagttactggaccttcgtaaacgcattctccatttttgggagcatcgccctctatttcggcataatgtttgattttcactcagctggaattcatgtgttgttcccaagcgcttttcagttcacagggactgcctccaacgcactgcgccagccctacatatggttgaccatcatactcgctgttgctgtctgtctgctccccgtggttgccatcaggttcctgagtatgaccatatggccttcggaatccgacaagattcagaagcacaggaagcgactcaaggccgaggaacagtggcagaggaggcagcaggtgtttcgccgaggtgtgagtacacggagaagtgcctatgcattttcccatcaacgaggatatgccgacctgatatcatccggacgcagtattcggaaaaagcggtcgccactggacgcaattgtggccgacgggaccgccgaatacagacggaccggagattca

SEQ ID NO: 7325 - DNA, 3753 bp, Artificial Sequence
  Description of Artificial Sequence: Synthetic coding sequence
atgtccaccgaacgcgattcggaaactacgtttgacgaagattcgcaaccaaatgacgaagtggtgccttattcagatgatgaaactgaggacgaacttgacgatcaagggtccgcagtggagcccgagcagaatcgcgtgaaccgtgaggccgaggagaatcgcgagccatttaggaaagaatgcacttggcaggttaaggcaaatgatcgaaagtaccatgaacaacctcatttcatgaacactaagtttctgtgtattaaggagtccaagtacgccaacaatgccattaagacttacaaatacaacgcatttacctttataccaatgaacttgtttgaacaattcaagcgggctgcaaacctctattttcttgcactcctgattcttcaagccgtgccacagatttcaactttggcttggtacactacccttgtcccacttttggtggtccttggagtgaccgcgataaaagacctggtggacgatgtggcccgtcacaaaatggacaaggagataaacaacaggacttgtgaagtgattaaagatggtagatttaaggtagctaaatggaaagagattcaggtcggcgatgtgatccgccttaagaagaatgactttgtgccggcggatattctcctcctctcatcgtcagaaccaaactcgctctgttacgtcgaaaccgccgaacttgatggagaaaccaatctgaagttcaaaatgagccttgaaatcaccgaccagtacctccaacgagaggacaccctcgcgaccttcgatggctttatcgaatgtgaagagcccaataaccggctggataagttcaccggcactctgttttggcgtaacacttcctttcctctggacgccgacaagattcttttgcgtggatgcgtgattagaaacactgacttttgccatggcctggttatctttgcaggcgccgataccaagatcatgaagaattcgggcaagactagattcaaaaggaccaagatcgactaccttatgaactacatggtgtacactattttcgtagtccttatcctcctgtcagcaggtctggctataggccatgcctactgggaagcacaggtcggaaatagctcatggtacctgtacgatggtgaagatgataccccgtcgtaccgaggttttctgattttctggggctacatcatcgtcctgaacaccatggttcctatttcgctctacgtgtcggtggaagtcattagattggggcaatcacatttcattaactgggacctgcaaatgtactacgcggaaaaggatactcctgccaaggcccgtaccactaccctgaacgagcaactgggacaaatacactacatctttagcgacaagaccggaaccctgacccagaacatcatgacttttaagaagtgttgtatcaacggccagatctatggggatcaccgcgatgccagtcaacataatcataacaagatcgaacaggtggacttctcctggaatacctacgccgatggaaagctggcattttacgatcattaccttattgagcaaattcaatccggaaaggagccagaggtccgccagtttttctttctcctggcagtctgtcatacggtgatggtggataggaccgatggacaactgaattaccaagcagcctcgccagatgaaggagcgttggttaacgccgcaagaaacttcggtttcgcattccttgcacggacccaaaatactattaccatatccgaactcgggactgagcggacctacaatgttcttgccatccttgactttaacagcgatcgcaaacggatgtccattattgtgcgaactccagagggtaacattaaactttactgtaagggcgcggacaccgtgatctacgaaaggctgcatcgtatgaacccaactaaacaagaaacccaggatgctttggacatttttgccaatgaaaccctgaggactctttgtctttgttacaaggaaattgaagagaaagagtttactgagtggaacaagaagtttatggctgcatcagtcgcatcaacgaaccgggacgaggcacttgataaggtctacgaagaaatcgaaaaggatctcattctgcttggagccaccgcaattgaagataagctccaagacggggtcccagaaaccatatctaaactcgcaaaggcagatatcaagatatgggtgcttactggagataagaaggaaactgctgaaaacatcggatttgcatgcgagctgctcaccgaggataccactatttgctacggcgaagatatcaactccctccttcacgcaagaatggagaaccaacggaaccgtgggggagtgtacgctaagttcgcgcccccagtgcaggagagctttttcccaccaggaggcaatagggcactgatcattaccggatcgtggctgaatgagattttgctcgagaaaaagactaaacggaacaagattctcaagttgaagtttccacggaccgaagaggaaagaagaatgcgaacgcagagcaagcggagacttgaagcaaaaaaggagcaacggcaaaagaatttcgtggacctggcatgcgaatgcagcgcagtcatttgttgtcgagtgactccaaagcagaaagccatggtggtggatctcgtcaaaagatataagaaggcgatcacccttgccataggggatggggctaatgatgtgaacatgattaagaccgcgcacatcggtgtgggaatttcgggccaagaaggaatgcaagcagttatgagctctgactactccttcgcacagttcaggtacttgcagagacttctgctcgtccacggccgatggagttacatccgtatgtgtaagttcctcaggtacttcttctacaagaattttgctttcacgcttgtgcacttttggtactccttctttaacggctactcggcacagacggcgtacgaagattggtttatcactctgtataacgtcctttacacttccctgcctgtgctcctcatggggctcctggatcaagacgtgagcgataagctgtccctccggttcccaggactctacatcgtaggacagagagatctcctgtttaactataagagatttttcgtcagccttttgcatggggtcctgacttcgatgattctgtttttcattcctctgggcgcataccttcaaaccgtgggtcaagacggtgaagccccgtcagattatcagtcgttcgcagttaccattgcgagcgcactcgtgataactgtcaacttccaaatcggactcgacactagctactggacttttgtgaatgcattttcgatctttggaagtattgcactctactttggtattatgtttgattttcattcggctggtattcatgtgctttttccttccgcattccaatttaccggtaccgcttcgaacgcactgcgccagccttacatttggttgaccatcatcctcgcagttgcggtctgccttcttccggtggtggcaataagattcctctccatgaccatttggccgtcagagagcgataagatccaaaagcacagaaagagacttaaagcagaggagcagtggcaacggcgccagcaggtctttaggcggggagtgtccacccgcaggagcgcctacgcatttagccaccagcggggatacgccgatctgataagctcaggtaggtcaataagaaagaaacgctctccgcttgacgccattgtggcggatggcaccgctgaatacagaagaactggtgactcg

SEQ ID NO: 7326 - DNA, 3753 bp, Artificial Sequence
  Description of Artificial Sequence: Synthetic coding sequence
atgagcacagagcgcgacagtgaaaccacttttgatgaagattcccagcccaacgacgaggtcgtaccttactctgacgatgagactgaagatgagctggacgatcaaggtagcgcagtggaacctgagcagaaccgcgtgaacagggaagcagaagagaacagagaaccgtttcggaaggagtgcacttggcaggtaaaagcaaacgatagaaaatatcatgagcagcctcatttcatgaacaccaaatttctttgtattaaagaaagcaagtacgccaataacgctatcaagacatataaatacaatgcatttacatttattcctatgaacctcttcgagcagtttaagcgggctgccaatttgtacttccttgcgttactaatattgcaggcggtcccccagattagcactctggcctggtatacgaccctcgtgcctctgttggttgtgctgggagttacagccattaaagatttagtcgatgacgttgccagacacaagatggataaagaaatcaataaccgcacctgtgaggttataaaagacggacggttcaaggtggccaaatggaaggagatccaggttggggacgtcattaggctgaaaaaaaatgattttgtccctgcagacatccttttactctcatctagcgagcccaactctctgtgttatgttgagactgccgagttggatggagaaactaatctcaaatttaagatgtcccttgagataactgaccagtacttgcaaagagaggacacgctggcaaccttcgatgggttcatagagtgcgaagagcccaacaaccgcttggacaagttcaccggcacgctgttttggcgtaacacatctttccctttggacgcagataaaatattactgcgcgggtgcgtcattcggaatacagacttctgccacggcctggtgatattcgccggcgccgataccaaaataatgaagaactctggcaagacccgatttaaacgcaccaaaatcgactatctgatgaattatatggtgtatacgatatttgtggtgttaatactgttgagcgctggtctagcaataggacacgcttattgggaggcccaggtcgggaattccagctggtacctctacgatggcgaggacgacacaccctcttatagaggctttttgatcttctggggctatattattgttctgaataccatggttcctatatctctgtatgtttctgtggaagtcattaggctaggtcagagtcacttcatcaattgggaccttcaaatgtactatgcagaaaaagatacacctgccaaagcacgcacgactactttaaatgaacaattggggcagatccactacattttctccgataagacagggactcttactcagaatatcatgacattcaaaaaatgttgtattaatggccagatttatggagatcatcgcgacgcctcccagcacaatcataacaagatagagcaggtggatttcagctggaatacatacgccgacggaaagctcgccttttatgatcattatctcatagagcagatccagagcgggaaagagcctgaggtccgacagttcttcttccttctggccgtgtgtcacacagtgatggtcgatagaaccgacggtcagctcaactaccaggcagcttccccggacgagggtgccctggtcaatgcagcccgaaattttggctttgcattcctcgcgagaacccagaataccatcaccattagtgaattaggcaccgagcgtacatataatgtgctggcaatcctggatttcaactccgatcggaagcgcatgagcatcattgtgcgaaccccggaaggtaacattaaactgtactgtaaaggtgccgatactgtgatctatgagcgtttgcataggatgaaccccaccaagcaagagactcaggacgccctggatatcttcgctaacgagacgctgaggaccctgtgtctttgctataaggagatcgaggagaaagagttcacagaatggaacaagaaatttatggcagcgagcgtggcgagcacaaacagggatgaagccctggataaagtgtacgaggagatcgagaaggatctcattctgctgggagccacagccattgaggacaagttgcaggacggggtgcccgaaaccataagtaagctcgcaaaggccgacatcaagatctgggtcctaactggtgacaagaaggagaccgctgagaacatcggatttgcatgtgagttgttgaccgaggacaccaccatttgctacggggaggacatcaacagcctcctccacgccagaatggagaaccagaggaacaggggaggagtgtatgccaaatttgccccgccggtgcaggagagctttttccccccggggggcaatcgggcacttattattacaggcagctggttgaacgagatcctactagaaaaaaagaccaaaagaaataaaatacttaaactgaaattcccaaggaccgaggaagaacgccgcatgcggacgcagagcaagcgccgcctggaagccaagaaggaacagcggcagaaaaattttgtggatctggcttgtgagtgcagcgcagtgatatgctgccgagttacacctaaacagaaagccatggtcgtggatcttgtcaagagatacaaaaaggctatcaccctggccattggggatggggccaatgacgtgaacatgatcaaaactgcccacattggggtgggtatctcgggacaggaaggcatgcaggcagtaatgagctccgattacagctttgcacagttccgctatctacagaggttactcctggtgcacggtcggtggagctacatccggatgtgcaagttcctgcggtatttcttctataagaattttgccttcacattggtgcatttctggtactctttttttaatggttattcagcccagaccgcctatgaggactggttcatcacactgtacaacgttctctacacctcactacctgtactgttgatgggactgttagatcaggatgtttctgacaaacttagtctgagatttccagggctttacattgttggtcaaagagatttgctgttcaattacaagcgcttcttcgtctctttgttgcatggagttctgacgtccatgattttgttcttcatcccgctgggggcatacctacaaaccgtcgggcaagacggtgaagcaccttccgactaccagtcctttgccgtgaccattgcgtctgcacttgttatcacagtgaatttccagattggtctggatacttcttattggacattcgtcaacgcattttcaatttttggcagtatcgctctctattttggaatcatgtttgatttccatagcgcgggtatccatgtcctgttcccctctgcgtttcagtttactgggacggccagtaatgcattgaggcagccctatatatggctgacaatcattctcgctgtcgccgtctgcctcctgccagtagtggcaatccgtttcctcagtatgacaatttggccatccgaatccgataagattcagaagcatcggaagaggttgaaggctgaagaacagtggcagcggcgacagcaagttttcaggcggggagtgagtactcgccggagcgcatacgctttctctcatcagagaggatatgcggacctcatcagttctgggagaagcataaggaagaagcgaagccctctggatgccattgttgctgacggcactgctgagtatcgcagaaccggggattca

SEQ ID NO: 7327 - DNA, 3753 bp, Artificial Sequence
  Description of Artificial Sequence: Synthetic coding sequence
atgagtaccgagcgcgactctgagaccaccttcgatgaagactctcagccgaacgacgaagtggtcccctattctgatgatgagacggaagatgaattggacgaccagggcagcgcagtggagcccgagcagaaccgcgtgaacagagaagccgaagaaaaccgggaacccttcagaaaggagtgcacctggcaggttaaggcgaatgataggaagtaccatgaacaaccccactttatgaatactaaatttctgtgcatcaaagagtcaaagtatgcaaataatgccatcaaaacatacaagtataatgcttttactttcattccaatgaatctatttgaacagttcaaacgagccgccaatctatatttcctggctctgctcattctccaagcagttccacagataagcacgctggcttggtacactacccttgtcccccttctggtcgtccttggggtcactgcaattaaagatcttgtggatgatgtagctcggcacaagatggacaaggaaataaacaaccgcacttgtgaggtgataaaagatggaagattcaaagtggctaagtggaaagagattcaggtgggagacgtgatccgcttaaagaagaatgactttgtcccagcagacattcttcttttgtcaagctccgagccgaatagtctttgctatgtggagactgccgagctggatggggagacaaaccttaaatttaagatgagtctggagatcactgatcaatatctgcagcgggaagatacgctggccacattcgacggctttatcgaatgcgaagagcctaataacaggctggataagtttacgggcactctcttctggaggaacacctcgtttcctttggacgccgataagatcctcctgcggggctgtgtgatcagaaacaccgacttctgccacggtctcgtgatcttcgccggcgcagataccaaaataatgaaaaattcaggaaagaccaggttcaaacggacgaaaattgactatctcatgaactatatggtatacaccattttcgtggtgctcatactgctgtccgctggccttgctatcggacacgcatactgggaagcccaggtggggaactcgagttggtatctctacgacggtgaagacgatacaccctcctaccgcgggtttttaatcttctggggatacattatcgtgttgaacactatggttcccatcagtctttatgtatctgtggaagtgatccgccttgggcagtcacactttatcaattgggacctccaaatgtattatgcggagaaggatacccccgccaaggcaagaaccacaacattgaatgaacaacttggccaaatccattacatcttttctgacaaaacgggaacactgacacaaaatatcatgacatttaagaagtgctgcatcaacggacagatttacggagatcatagagacgctagccagcataaccataacaaaattgagcaggtggacttctcgtggaatacttatgcagatgggaaacttgctttctatgaccattatctcatagaacaaattcaaagtggcaaggagcccgaggttagacagttctttttcctgttagccgtgtgccacacagttatggtcgaccggaccgacgggcaactgaattaccaagccgctagccccgatgagggggccttagtcaacgcggcacgcaatttcggcttcgcgttcctggcccgcacacaaaatactatcacaatctccgagctcggcacggaaaggacgtacaacgtgttggctatccttgacttcaactccgatagaaagcgaatgagcattatagtcaggacccccgaggggaatatcaaattgtactgcaagggcgccgatacggtgatctacgagcggctacataggatgaacccaactaagcaggagacgcaggacgcattggacattttcgccaatgaaacactgcgcacgttgtgcctttgctacaaggagattgaggaaaaggaatttaccgagtggaataaaaagtttatggccgcatcagtggcttcaacgaaccgcgacgaggccctggacaaagtatatgaggagattgagaaagatctgatcttgctaggcgccacagccatagaagacaaactgcaggacggcgttcccgaaacaatttctaaactcgctaaagctgacatcaagatatgggtgttaacaggggataagaaagagacagctgaaaacattggattcgcatgtgaactgcttaccgaggacacaactatctgctacggggaagacatcaattcactcctccatgccaggatggaaaatcagcgcaatagaggcggcgtctacgctaagtttgctccccctgtgcaggagtcttttttcccacctggggggaatagggctctcattattactggaagttggcttaacgaaattcttttggaaaaaaaaactaaacgtaataagattcttaaattgaagttcccacgcacagaggaagagcgcaggatgcgaactcagagtaagcgccgtctagaagcaaaaaaagagcagaggcagaaaaacttcgtggacctcgcctgcgagtgctcagcggttatttgctgtcgggtcacgcctaaacaaaaggctatggtggtggatttggtgaaacgatacaaaaaagcaattaccttggccattggggatggcgctaatgacgttaatatgatcaagactgcccatataggtgtggggatttctggccaggagggtatgcaggctgttatgtcttcagactactcgtttgcacagtttagatacctccaaagattgttactggtgcacggacgctggagttatattaggatgtgcaagttccttcggtactttttctataagaatttcgcatttaccctggttcacttctggtatagtttcttcaacgggtacagtgcccaaaccgcttacgaggactggtttatcaccctctataacgtgctttataccagcttgccagtcctgctgatgggcctgctggaccaggacgtgagcgataaactctctctgcggtttccgggactctatattgtcggacagcgcgatctgcttttcaattataagagattttttgtgagccttctgcacggtgtgttaacctctatgattctgttctttatccccctcggggcctacctgcaaactgtcgggcaagacggggaggccccttctgactatcagtcatttgcggtgaccattgcctcagccttggtcatcacagtgaactttcagattggtctcgacaccagctattggaccttcgtgaatgccttctcaattttcggctcaatcgctctgtatttcggaataatgttcgattttcacagcgctgggatacacgttctgttcccctctgcttttcaatttacaggaaccgctagtaatgccctgaggcaaccatacatatggctcacaatcatcttggccgtcgccgtgtgtttgctgccagtggtcgctattagatttctgtctatgacaatctggccatctgaaagcgataaaattcagaagcatagaaagcgattgaaggccgaagagcagtggcaacggcgtcaacaggtcttccgccgcggtgttagcacacggcgatccgcctatgccttctcacatcagaggggatacgctgatctaatttcctccggcaggtccatccgcaaaaagcgttctcccctcgacgccatcgtcgcagacggcaccgcagaataccgacgtacaggcgattcg

SEQ ID NO: 7328 - DNA, 3753 bp, Artificial Sequence
  Description of Artificial Sequence: Synthetic coding sequence
atgagcactgaacgcgattcagagaccaccttcgacgaagattcacagcctaacgatgaggtggtgccgtacagtgatgacgagacagaagatgagcttgacgaccagggcagtgcggtcgagcctgaacaaaaccgcgtgaaccgggaggcagaggagaatcgagaaccatttaggaaggagtgtacttggcaggtaaaggctaatgaccgaaagtatcacgagcagccacacttcatgaacaccaagtttttgtgtattaaggaatctaaatacgccaacaatgccattaagacttacaagtacaatgccttcacgttcatccccatgaacctgttcgaacaattcaaacgcgccgcgaacctctacttcctcgctctgctcattcttcaagcagtacctcagatatcaaccctggcctggtatacgactctggtgccactcctggtggtgctcggggtgaccgccatcaaggacctcgtcgacgacgttgcccgccacaagatggacaaagaaattaataatcggacatgcgaagttataaaggacggacgttttaaggtagctaagtggaaagaaattcaagtgggcgatgtcattcggctgaagaagaatgatttcgtccctgctgatattttacttctgagctcatctgaaccgaattcactttgctacgtcgagactgctgagctcgacggtgagactaatctgaagtttaagatgtctttggagataacggatcaatacctccagcgcgaggacacgctggcaacctttgacgggttcatcgagtgtgaagaacccaacaaccgtctcgataaattcaccgggacccttttctggcgcaacacatctttccctcttgacgccgataagatactccttcgagggtgtgttatccgtaataccgacttttgtcacggtcttgtgatctttgccggggccgacactaaaatcatgaagaacagcggtaagactaggtttaaaagaacaaaaattgactatttaatgaattatatggtgtatacaatctttgttgtgttgatattgttgagcgcagggttagccatcgggcatgcatactgggaagcacaggtgggcaactcctcttggtacctgtatgacggagaagacgatactcctagctatcgtggttttttgatcttctgggggtacatcatcgtgctcaacactatggttccaatttccctgtacgtgtccgttgaagttattaggctggggcaatcccacttcattaactgggatctacaaatgtactacgccgagaaagatactcccgctaaggcccgcacaacgaccttgaacgagcaactgggacagatacattatatttttagcgacaagacaggaaccctgacacagaacattatgacctttaaaaagtgttgtattaacggacagatttatggcgatcaccgggacgcaagccagcacaaccacaataaaatcgagcaggtggatttctcctggaatacttatgctgacggcaagctcgctttttatgatcactacctaatcgaacagatccaaagcggaaaggagcccgaggtccgccagtttttcttcctactcgctgtgtgtcacacagtcatggttgatagaacagacggccagcttaactaccaagctgcttctcctgacgagggtgctctggttaatgcagccaggaactttgggtttgccttcctagctagaactcaaaataccatcacaattagtgaattggggaccgagagaacttacaacgtgcttgccattcttgacttcaatagcgatcggaagcggatgtctattatagtgagaacacctgagggcaatatcaagttgtattgtaagggtgctgacactgtaatttatgagaggctgcaccgaatgaaccctacgaagcaggaaacccaagatgctctggatattttcgcgaatgaaacccttcgcacactctgcctctgttacaaggagatagaagagaaggagtttacagagtggaacaagaagtttatggctgcttcggtggcctccacaaaccgggacgaggccctggacaaggtttacgaggagatcgagaaggatttgatcctgctgggagctactgcgattgaggacaagctgcaagacggggtccccgaaacaatctcgaagctagcgaaagcagacatcaagatttgggtgctgactggagacaaaaaggagactgcagagaacatcggcttcgcgtgcgaactgcttacagaggatactaccatctgctacggtgaagatattaactccctgctccatgcccgcatggagaatcaaagaaaccggggaggagtgtacgccaaatttgctcctccagtgcaggagtccttcttccctccaggcggcaatagggctctgattatcaccggaagctggttgaacgagattctgctagagaaaaaaaccaagagaaataaaatcttgaaattgaaatttcctagaaccgaggaggaaaggagaatgcggacacagagcaagagaaggctggaggccaagaaggaacaacgacagaagaactttgtggatctggcctgcgaatgcagcgcggtgatctgttgtcgcgtaacaccaaaacaaaaagcgatggtggtggatctggtcaagagatacaaaaaggcaattaccctcgccataggggatggcgcaaatgatgtcaatatgataaaaactgcccacattggtgtgggcattagcggtcaggagggtatgcaggcggtcatgtcttcagactattcttttgcacaattccgatacctccagcggctgcttttggtgcacggcagatggagttacattcggatgtgcaaatttctacgatactttttttacaagaacttcgcattcactctagtgcatttctggtattccttcttcaacggatattctgctcagactgcatacgaggactggttcattacgctttacaacgtcctttacactagccttccggttcttttgatgggactcctcgatcaagatgtgtccgataagttatccctgcggttccccggattatatatagtgggtcagagagatcttttgttcaattacaagagatttttcgtgtctctactacacggggtcctgactagcatgattctctttttcattccacttggcgcctatctgcagaccgtcggccaggacggggaggccccgtctgattaccagtccttcgccgtcactatcgccagtgctctggtgattactgtcaatttccagattggcctggacactagttactggacgtttgtgaatgcgtttagcatctttggctcgattgcattgtactttggtatcatgttcgacttccattcagcaggcatacatgttcttttcccatccgccttccaatttacgggtacagcctccaacgcactgcggcaaccatacatctggttgactattattcttgccgtagccgtttgcttgctgcctgttgtggcaattagatttctcagcatgacaatatggccgagcgagagtgataaaatacagaaacatcgaaagaggttgaaggctgaagaacagtggcagcgaagacaacaggtgttccgcagaggtgtgtccacaagacgttccgcatacgctttctcacaccaacgaggctatgcggatctgattagttctggccgctccattaggaagaaaagaagtcccctggacgcaatcgtggctgacggaacggctgaatatcggaggaccggggacagc

SEQ ID NO: 7329 - DNA, 3753 bp, Artificial Sequence
  Description of Artificial Sequence: Synthetic coding sequence
atgagcaccgagcgtgacagcgagacgacatttgacgaagatagccagcctaatgatgaggttgtcccatacagtgatgatgagacagaggatgaactagacgaccaaggaagcgcagttgaaccagaacagaacagggtcaatagggaggcggaggaaaatagggagccctttagaaaagaatgcacttggcaggtgaaggcgaatgacagaaaataccacgagcagccccattttatgaataccaaatttttgtgcatcaaggagagcaaatatgccaacaatgcaatcaagacttacaaatataatgcttttactttcatacctatgaatcttttcgaacagtttaagcgcgctgcaaacctctattttctcgctcttctgatcttgcaggctgtgccgcaaattagcacactcgcctggtataccaccctggtccccctcctcgtggtgcttggtgtgacagcgatcaaggatctggtcgatgatgtggccaggcacaagatggacaaggagatcaataaccgtacttgtgaggtgataaaagacggacggtttaaagtggccaagtggaaggagatacaagtgggagacgtgattcggctcaagaagaacgattttgtgccggccgacatcttgctgcttagctccagcgagcctaactctctctgttacgtggagacagccgagctcgatggcgagaccaaccttaagtttaaaatgtcccttgaaatcactgaccagtatctgcagcgggaagatacactcgctacatttgatggctttattgaatgtgaggagccgaacaaccgtctggacaaattcactggtaccctcttttggcggaatacaagtttccctttggatgccgataagatcctcctgagaggctgcgtgattcggaacacagatttttgccacggcctcgtgatcttcgccggcgccgatacaaaaatcatgaagaactcaggcaaaacaagattcaagcgtacgaagatcgactacctgatgaattacatggtctataccatttttgttgtcctgatcctgctttcagcgggactggccattgggcatgcttattgggaggcccaggttggcaactccagctggtatctttacgacggcgaagacgatacaccatcataccgtgggtttcttatcttttggggctatatcatagtactaaacaccatggttcctatatcactgtatgtaagcgtcgaggtgatccgcctgggccaatcacactttattaactgggatctgcagatgtattacgccgagaaggacactcctgccaaagcacgcactacaaccctcaatgagcaactgggccagattcattacatcttttccgataagaccggtaccttgacacagaatatcatgacctttaaaaagtgctgcataaatggtcaaatatacggcgaccaccgcgatgcgtcccagcataaccacaacaagattgagcaggtcgatttcagttggaacacatacgccgacggaaagctcgcattttacgaccattatctcattgagcagattcagtcgggtaaggaacctgaggtacgccaattctttttcctcctggcagtatgtcacacagtgatggtggatcggacagatggacagctgaattaccaggctgctagccccgatgagggcgcccttgtgaatgccgcccggaacttcggctttgcatttctcgcccgtactcaaaatactatcactattagtgagcttggcaccgaaaggacttataatgttctggcgattcttgactttaactcagataggaaaagaatgtctatcatcgtccgtactccagagggcaatattaaactctattgtaagggtgctgacaccgtgatctacgaaaggttgcacagaatgaacccaacaaaacaggaaacccaagatgccctggatatatttgctaacgagaccttgcgtactctgtgtttatgctataaagaaattgaggagaaggagttcaccgaatggaataaaaagtttatggccgctagcgtggcaagcacaaatcgggatgaagcacttgataaagtgtacgaggagatcgaaaaggatctgattttactcggcgcgacagctatcgaagacaaactgcaggacggggtgccagagaccatttcaaaactagccaaagcggacattaagatttgggtgctgactggcgataagaaggagaccgccgaaaacatcggctttgcatgtgagctacttacagaagacacgactatctgttacggcgaagatatcaactccttgctgcatgctcgtatggagaatcagaggaatcgaggaggagtttatgctaaattcgccccccccgttcaggagagcttttttcctccgggtggcaacagggctcttattattacaggctcgtggctgaatgaaattctgctcgagaagaaaaccaagcgcaataaaatactgaaactgaaattcccaaggacagaagaagagcggagaatgcgaactcagagcaagcgtcgtctggaggcaaagaaagagcagagacaaaagaacttcgtggatctcgcgtgtgaatgttcagccgtgatctgttgtcgcgttacccccaagcagaaagccatggtggtggacctggtgaaacggtataaaaaggcgattacactagccatcggggatggcgccaatgacgtcaatatgatcaagaccgcccacataggggtgggcatttctggacaggagggaatgcaggcggtgatgtcatctgactacagctttgcccagttcaggtacttgcagcggctcctgcttgtccacggaagatggtcctacatccggatgtgcaaatttctgagatatttcttttacaaaaattttgcatttactttagtgcacttttggtacagctttttcaacggttactccgcgcagacagcctacgaggattggttcatcaccctctataacgtgctttacacatcccttcccgtgctcttaatgggcttactggaccaagatgtgagcgataagctaagtcttcggttccccgggctgtatattgtgggccaacgcgaccttctgttcaactataaacgtttcttcgtcagtttgctgcacggtgtcctcacatctatgattctcttcttcatccctctcggggcttacctgcagaccgttggacaggacggcgaggctccgagtgactatcagagcttcgccgtgaccattgcttctgcactggtcatcactgtcaattttcagatcgggctggatacatcttattggaccttcgtaaacgctttcagtatattcggatcaatcgccctctatttcggcatcatgttcgattttcattcagctgggattcatgtacttttccctagtgcattccagtttactgggacagcctctaacgccctacgtcagccatacatttggctcacgatcatcctggccgtcgccgtctgcttgcttcccgttgtggccatacggttcttgtccatgaccatctggccttccgagtcagataaaatccagaagcaccgcaaacggctgaaggcggaagagcagtggcaacggaggcagcaggtgttcaggcggggcgtgtcgacgagacgaagcgcatatgctttctctcatcagagaggctacgccgacttaatcagttctggacgctctattaggaaaaaacgcagcccactggatgcaatcgtggccgatggcacagctgaataccggcggacaggcgactca

SEQ ID NO: 7330 - DNA, 3753 bp, Artificial Sequence
  Description of Artificial Sequence: Synthetic coding sequence
atgtccactgaacgcgattctgaaactacttttgatgaggacagtcagccaaacgacgaagttgtcccatattctgatgatgaaactgaggatgaactggatgatcagggaagtgccgtggaaccagagcagaaccgggtgaacagagaagccgaagaaaatagagaaccattcagaaaagaatgcacatggcaggttaaggctaatgatcggaaatatcatgaacagccccacttcatgaatacaaagttcctgtgtataaaagaatcaaaatacgcaaacaacgcgattaaaacttacaaatataatgccttcactttcatcccaatgaatcttttcgaacagttcaaacgcgctgccaatctttatttccttgcactcctcatccttcaggccgtccctcagatttcaactctcgcgtggtatacaacactagtgccactcttagtagtgcttggggttacagccatcaaagatctggttgatgatgttgctaggcacaaaatggataaagaaataaataatagaacttgtgaagtcataaaggatgggcggtttaaagtcgctaaatggaaagaaatccaggttggggatgtcatccggctgaaaaaaaacgatttcgtcccagcagatatccttcttctctcttcctccgaacccaattccctctgctacgtagaaacagctgaacttgatggggagacgaaccttaagttcaaaatgtccctcgaaattacagatcagtatctgcagcgagaagatacgcttgctactttcgatggattcatagaatgcgaagaacccaataaccgcctggacaaatttacaggaacactcttctggagaaacacttcatttccactagatgctgataaaatacttctcagagggtgcgttatcagaaacacagatttttgtcatggactcgtgatattcgccggagctgatactaagataatgaaaaactcaggaaaaacaagattcaagcggactaaaatcgactatctgatgaattatatggtgtatacaattttcgtggttcttatactgctctctgcaggacttgccataggacacgcctactgggaagcccaagtagggaactcaagttggtatctatacgatggggaagatgatactccttcatatcgggggttcctaatcttctgggggtatattatagttctcaacactatggtgcccatcagtctgtacgtgtcggtggaagtcatccgactggggcagtcccacttcatcaactgggacttacagatgtattatgctgagaaggacacacccgctaaagcccgtacaactacgctcaatgaacagctaggacagatccattatattttctctgacaaaacaggaacattaacacagaacatcatgacgttcaaaaaatgctgtattaacgggcagatatacggagaccatcgcgatgcttcacagcataatcacaacaaaatagaacaagtcgatttttcttggaatacttacgctgatggaaaactggccttctacgatcattatcttatagaacagatccagtcagggaaagaacccgaagtgaggcagttcttctttctcctagcagtgtgccatactgttatggttgatagaacagatgggcagctcaactaccaggctgcctcacccgatgaaggagctttagtcaatgcagctcggaattttgggttcgctttcctcgctagaactcagaacacaatcacaatatcggaacttgggacagaacgtacatataacgtcttggctatcctagattttaatagtgatcggaagcggatgagtattatcgtgagaacacccgaaggaaacataaaactttattgcaaaggagcagatacagtgatctatgaaaggctgcaccgaatgaaccccactaaacaggagactcaggacgccctggatatattcgctaacgaaacacttcgcacattatgcctatgctataaagaaatagaagaaaaagaatttactgaatggaacaaaaaattcatggccgctagtgtggcttcaactaaccgcgacgaagcattagataaagtgtacgaagagattgaaaaagatctaatcctgcttggggccacagcgatagaagataaactccaggacggggttccagaaacaatctccaagctcgcaaaagcagatatcaagatctgggtgctcacaggagataagaaagaaactgctgaaaacatcggatttgcttgtgaattattaacagaagatactacaatatgttatggggaagatataaacagtctcctccacgcacgcatggaaaatcagaggaacagggggggggtgtacgctaaattcgccccacccgtacaggagtcgtttttcccccctggaggaaatcgcgcactcataataactgggagttggcttaacgagattctcctggaaaaaaaaactaaacggaacaaaattctgaaactcaaattcccaaggactgaggaggaaagaagaatgaggacacagtcaaaaaggagactggaagctaagaaagagcagaggcagaaaaactttgtggatctggcttgcgaatgcagtgctgttatttgctgtagggtaacgcctaagcagaaagccatggttgtggatctggttaagcgatataaaaaagcaatcacactggcaataggagacggggccaatgatgtgaacatgattaaaacagcacatataggggtggggatctcaggacaggaaggaatgcaggctgtcatgtcttccgattactccttcgctcagttcagatatctgcagcgacttctactcgttcacgggcggtggtcctatatacggatgtgtaaatttttgaggtatttcttctataaaaacttcgcttttacacttgttcatttctggtattctttcttcaacggatattcagcccagacagcttatgaagattggtttattacactatataacgtcctgtacacttccctaccagttctcctaatgggactcctagatcaggatgtatccgacaaattgagtctcaggtttcccgggctctatattgtgggacagagagatctcttattcaattataaaaggttctttgtctctcttctgcatggggtgctgacttctatgatcctcttctttattcctctaggggcctacctccaaactgtgggacaggatggagaagctccctcagattatcagtcattcgcagttacaatagcctctgccctagtcataacagtcaattttcagatagggctggatacaagttattggacttttgtaaatgctttttccatcttcggatctatcgcactgtattttgggataatgtttgatttccatagtgccgggatacacgtgctcttccccagtgccttccagttcacagggacagcgtctaacgcattgagacagccctatatctggctaacaatcatactcgctgtggcagtgtgcctcctccccgtggtagccattcgctttctgtcaatgactatatggccttctgagtccgataaaatccaaaagcatcgaaaacggttgaaagccgaagagcagtggcagagacggcagcaggtgtttaggcgcggggtatctactagacgctctgcatatgccttctctcaccagcgagggtacgctgatctaatttcctcaggaaggtcgatccgcaagaagcggtctcctttagatgcaatagtcgcagatggaactgccgagtatcggcggacaggggactct

SEQ ID NO: 7331 - DNA, 3753 bp, Artificial Sequence
  Description of Artificial Sequence: Synthetic coding sequence
atgagcaccgaacgcgattccgaaactacgtttgacgaggacagccaacctaatgatgaagtcgtgccgtactcagacgacgagactgaagatgaactcgacgatcagggatccgccgtcgagcccgaacagaaccgtgtgaacagagaggcggaagaaaaccgtgagccgttccgcaaggaatgcacctggcaggtgaaggccaatgaccggaagtaccacgagcaaccccacttcatgaatactaagtttctctgcatcaaggagagcaagtacgccaacaacgccatcaagacctacaaatacaacgccttcaccttcatccccatgaacttgttcgaacagttcaaaagggcggccaacctctacttcctggccctgctcattctccaggcggtgccacaaattagcactctcgcttggtataccactctcgtgccactcctggttgtcctgggcgtgaccgccatcaaagacctggtggacgacgtggcgcggcataagatggacaaggagatcaataaccgaacttgcgaagtgatcaaggatgggagattcaaggtggcaaaatggaaggaaatccaggtgggagatgtgatccggctgaagaagaatgatttcgtcccagcggatatactgctcctgagctcctccgaaccgaactccctgtgctacgtggaaaccgcggagctggacggcgagacgaacctgaagttcaagatgtcgctggagattaccgatcagtacctccagagggaggacactctggctacctttgacggtttcatcgagtgcgaggagccaaataacaggctggataagtttactggaactctcttctggcgcaatacttcctttccattggacgcggacaagatcctcctccggggatgcgtcatccggaacaccgacttttgtcatggtttggtcatcttcgctggcgctgataccaagatcatgaaaaactctggcaagacccggtttaagcgcaccaaaattgactacctcatgaactacatggtgtacactatcttcgtcgtcctcatcctgctgtccgctggactcgccatcggacatgcatactgggaggcccaagtgggaaactccagctggtacctgtacgatggcgaagatgacaccccttcgtaccggggattcctgatcttctggggatacatcatcgtcctgaacaccatggtcccgatctcgttgtatgtctctgtggaggtgattcggctgggacaatcccatttcatcaattgggacctgcagatgtactacgccgaaaaggacaccccggcaaaggcaaggacgaccacgcttaacgaacagttgggacagattcattacatcttcagcgataaaaccggcaccctcactcagaacattatgaccttcaagaagtgctgcattaatggacagatctacggagatcaccgggatgcctctcagcacaatcacaataagatcgagcaagttgacttctcctggaacacgtacgctgatggaaagctggctttctacgatcattacctgatcgaacagatccagagcgggaaggaaccggaggtccgccagttctttttcctgctcgccgtgtgccacactgtcatggtggatcgcactgatggtcagctcaactaccaagccgccagcccagatgagggagccctggtgaacgccgcacggaatttcgggttcgcctttctggcacgcactcagaacaccatcactatctcggaactcggaaccgagcggacctataacgtgctggcaatcctcgacttcaatagcgaccgcaaaagaatgtccatcatcgtgaggaccccggaaggtaacattaagctgtactgcaagggagccgatactgtgatctacgaacgcctgcaccggatgaatcctactaagcaggaaacccaagacgccctcgatatcttcgcgaacgaaaccctgcgtaccctgtgtctctgctacaaggagatcgaagaaaaggaattcaccgagtggaataagaagtttatggcggcctccgtggcctcaaccaacagggacgaggccctggacaaagtgtacgaagaaatcgagaaggatctcatcctgctcggagccactgccatcgaagataaactgcaggatggagtgccggaaaccatcagtaaattggctaaggccgacatcaaaatctgggtcctgactggtgataagaaggaaactgcggaaaacatcggatttgcttgtgagctcctcactgaagatactaccatctgttacggggaggacatcaattccctccttcacgcccggatggagaatcagagaaaccggggaggagtctacgctaagttcgccccgccagtccaagagagcttcttccctccaggtggaaatcgcgcgctcatcattaccgggtcgtggctgaacgaaatcctgctcgagaagaaaaccaagcggaataagatcctcaaattgaagttccctcgcactgaggaggagcgtcgcatgaggacgcaaagcaagcggcgcctcgaagctaagaaagaacaacgccaaaagaactttgtcgacctggcgtgcgagtgctcagcggtgatctgctgccgggtcactccaaagcaaaaggctatggtcgtggacctggtgaaacgctacaagaaggctatcaccctcgccatcggggacggagcaaatgatgtgaacatgatcaaaactgctcacattggagtggggatctccggacaggagggaatgcaggccgtgatgtccagtgactacagcttcgcacagtttcggtacctgcagcggctgctcctggtgcacggacgctggagctacatcagaatgtgcaagttcctgcgctactttttctacaagaactttgcattcaccctggtccatttttggtactcattcttcaacgggtactcggctcaaactgcctacgaggactggttcattacgttgtataatgtcttgtacacctcgctcccggtgctccttatgggactcctggaccaagacgtgtcggacaaactgtccctgagattccctgggctgtacattgtgggacaacgggacctgcttttcaactacaaacgcttctttgtgtcgctgctgcatggagtgcttacttccatgatcttgttctttatcccactcggagcatacctgcagactgtgggccaagacggtgaagcgccatccgactaccagtcgttcgccgtgactatcgcgtcggcgctggtgatcactgtgaactttcaaattggcctggatacctcgtactggaccttcgtgaacgccttctccatctttggctcgatcgcactctactttggcattatgtttgattttcactccgccggaatacacgtcctgttcccaagcgccttccaattcacgggaaccgcctcgaatgcgttgcggcagccgtacatctggctgactatcattctggccgtggccgtttgcctgctcccggtcgtcgcgatacggtttctgagcatgaccatctggccatcagagtcagacaagatacagaagcacagaaagaggctcaaggcggaagagcaatggcagaggagacagcaggtgttccggcggggagtgtcaacgcgccggtcggcttacgccttctctcaccagcggggctacgccgacttgatctcgagcggccggtccatccgaaagaagagatcaccgctcgatgcaatcgtcgcggatggaacggcggaatatcgccgcactggggactcg

SEQ ID NO: 7332 - DNA, 3753 bp, Artificial Sequence
  Description of Artificial Sequence: Synthetic coding sequence
atgtctacagaacgggactcggaaacaacgtttgacgaagactcccaaccaaatgacgaggttgtgccttatagcgacgatgagactgaggacgagcttgacgatcagggtagcgccgtagaaccagaacagaatagggtcaatcgcgaggcagaagagaatcgggagccattccggaaagaatgcacatggcaggtgaaagccaacgatcgaaagtatcatgagcaaccccactttatgaacacaaagtttctttgtataaaggaaagcaaatacgcaaataatgccatcaaaacctacaagtataatgcctttacattcataccgatgaacctgtttgaacaattcaaacgcgctgccaacctttacttcctagctttgttgattttgcaggccgtgccgcagatcagtacattagcatggtacaccacacttgtgccacttctggtcgtgttaggggtcaccgcgattaaagacctcgtggacgatgtggcacgccataaaatggataaagaaatcaacaatcggacgtgtgaggtgatcaaggatgggagattcaaggtcgctaagtggaaggagatccaggtgggcgacgtaatacgcctgaaaaagaacgactttgtgccagcagatattctgctcctgtctagttccgaaccaaacagcctgtgttacgtagaaacagctgagttggatggggaaactaatttgaagttcaaaatgtcccttgaaatcactgatcagtatctgcagcgggaggacacacttgcaactttcgatggttttatcgagtgtgaagagccaaacaataggctggacaagttcaccggaacgttgttctggaggaatacttcttttccgctggacgccgacaaaattctgctccgaggttgtgtcatccgcaacactgatttttgtcacggattggtcatcttcgctggtgctgacacaaagatcatgaaaaattctggtaagacaagatttaagagaacaaagattgactacttgatgaactacatggtgtatactatttttgtagtactcatactgctctcagctggactagccatcggtcatgcctattgggaggcgcaggtgggcaactcctcttggtacttgtatgatggcgaggacgacacgccctcctacaggggcttcctaatcttctgggggtatattatagtcttaaacacaatggttccaatcagcctgtacgtgagcgtagaggtgatcagactggggcagagccacttcatcaattgggacttacagatgtactatgctgaaaaggacacgccggctaaggcccgcaccacgaccctgaacgaacaattaggccagattcactacatcttctctgataaaactggcaccttaacacagaatatcatgacattcaagaagtgctgcataaacggacagatctacggcgaccacagggacgcttcgcaacacaatcacaataagattgaacaggtggatttttcctggaacacttatgctgatggcaagctggccttctacgatcactacctgattgaacagatccagtcaggcaaggaaccagaggtcaggcaattcttcttcctgctggctgtgtgtcatacagtgatggtggaccgcacggatggtcagctcaattaccaggccgcctctccagacgaaggtgcactggtgaacgccgccaggaatttcggttttgcctttctggccagaacgcagaataccattaccatctctgagctgggcacggaacggacttacaatgtgctagctatcctggattttaactcagaccgtaaacgcatgtctattatcgttcgaacgcccgaaggtaacattaagctgtactgtaagggcgccgacaccgtgatatatgaacgcctgcataggatgaaccccaccaagcaggagacccaagacgctctggatatattcgctaatgagactctgcggacactgtgcctgtgttacaaggagatcgaagaaaaagaatttaccgaatggaacaaaaaatttatggcagcttctgttgcctcaacaaatagagacgaagccctggataaggtttacgaagaaatcgagaaagatctcatacttttaggtgcaactgcgatcgaggacaaactccaggatggcgtgcctgaaactatatctaagctggccaaagcggatatcaagatttgggtgctgacaggagataagaaagagacagcggagaacattggcttcgcatgtgaactgctcacagaagataccacaatctgctatggcgaggatataaattcacttcttcacgcccgcatggaaaaccagagaaacaggggaggcgtttacgctaagttcgccccaccggtgcaggaatccttcttcccacctggcggtaacagggccttaattattaccggttcgtggcttaacgaaatactcttagaaaagaaaacaaagcggaacaaaatcctgaagctaaagtttcccagaactgaagaggaacgccgaatgcggacgcagtccaagagaaggttggaggctaaaaaagaacagcgccagaagaactttgttgatctggcatgcgaatgctctgctgtcatctgctgccgggtgacgccgaaacaaaaagctatggtggtggacctggtcaagcgatataagaaagctatcaccctggcgattggcgatggggcaaatgacgtgaacatgataaaaaccgcacatatcggagttggcatatccgggcaggaaggcatgcaggccgttatgagctccgactacagttttgcacagttccggtatcttcagaggctgctgcttgtgcacgggcggtggagctatatccgcatgtgtaaattcctaaggtacttcttctacaagaatttcgcctttacactcgtgcatttctggtattccttctttaatggatacagtgcacagaccgcttatgaggattggttcataacactgtataatgtgctgtatacctccctgccggtcctgctcatgggattactagatcaagacgtgtctgataagctgtccttacgtttccctggcctttatattgtaggccaaagggatttattgtttaactacaagcgttttttcgtgagtctgctgcatggagtactgacctcaatgatcctgttctttatccccttgggagcgtatttacagaccgtgggccaggacggcgaagccccttcggactatcagtccttcgcagttacgatagcctctgctctcgtgatcaccgtgaactttcagataggattggatacaagctactggacgtttgtgaatgcattcagcattttcggatccatagccctctacttcgggatcatgtttgactttcattcagccggaatccacgtcttgttcccaagtgccttccagttcacagggaccgcctctaatgccctgagacaaccttacatttggctgacaatcatcctggccgtcgctgtttgcctactccccgtagttgccattaggtttctgtctatgacaatttggccttctgaaagcgacaagattcagaaacacagaaagcgcctaaaggcagaagaacaatggcaacgccgtcaacaggtgtttcggcggggcgttagcacaaggagatctgcgtatgcctttagccaccagagaggatacgccgatcttatctccagcggcaggagtatccgcaaaaagaggtcccctttggatgcaatcgtggccgacggaacagctgagtaccgccgaaccggcgattcc

SEQ ID NO: 7333 - DNA, 3753 bp, Artificial Sequence
  Description of Artificial Sequence: Synthetic coding sequence
atgagcaccgagcgggacagtgaaacaacattcgacgaggattctcagccgaacgacgaagtcgttccgtatagcgatgatgagaccgaggatgagttggatgaccaggggagtgccgtcgagccggaacagaatcgcgtcaatcgcgaggcagaggaaaacagggagccgtttcgaaaggagtgtacctggcaggtgaaagctaacgacagaaagtatcacgaacaaccgcactttatgaataccaagttcctgtgtatcaaggaaagcaaatacgccaacaatgcgattaagacctacaaatataacgctttcaccttcatcccaatgaatttgtttgagcagttcaaacgtgccgcgaatctctacttcctagccctcctcatactccaagcagtgcctcaaattagtactcttgcttggtatacaaccttggtgcccctcctagtagtcctgggcgtcactgctatcaaagatctcgtcgacgacgttgcccgccacaagatggacaaagaaattaacaatagaacatgcgaggtcatcaaggacgggagatttaaggtggccaaatggaaagaaatccaggtgggagacgtgatacggttgaagaagaatgactttgtaccagccgacatactcctacttagttcctctgaacctaacagcctgtgctacgtggagacagccgagctcgacggtgaaacgaatctgaagttcaagatgtccctcgagatcaccgaccagtacctacagagggaggatactctggctacgtttgacgggtttattgagtgtgaggagccaaataacaggctggacaaattcactggaaccctgttctggcgaaatacttccttcccactggatgctgacaagatcctgcttagggggtgcgtgatcaggaataccgatttctgtcatgggctggtgatcttcgctggggccgatactaaaattatgaagaacagtggcaagaccaggttcaagcgtacaaaaatcgactacctgatgaactatatggtgtacacgatctttgtcgtcctgattctgctcagtgcgggtttggccattggacatgcgtattgggaagcccaggttggaaactcctcatggtatctgtacgatggcgaagatgatacccccagttatcgaggatttcttatcttttggggatatattatagtgctaaacactatggtacctattagtctctacgtgagtgtggaggtgatcaggctgggccaatctcatttcattaactgggaccttcagatgtattatgcggagaaggatacacccgctaaggcacgaaccaccaccctcaacgaacagctaggccagatccattacatattcagtgacaagacgggcacccttacccagaatatcatgaccttcaagaagtgttgtatcaacggccagatatatggtgatcacagggatgcttcccagcacaaccataacaaaattgaacaggtggatttcagctggaacacatatgccgacggtaagttggccttctacgatcactatctcatagagcagatccagagtggaaaagagccagaagtgaggcagttcttcttcttgctggcggtgtgccacaccgtgatggtagataggaccgacggccagctcaattatcaggctgcttcgcccgatgagggggccctggttaacgccgccaggaactttggtttcgcattcctagctagaacccagaatacgataacaatctcggaactcggcactgagcgcacatacaatgttctcgccattctggatttcaacagcgatcgtaagaggatgagcataatcgtgcgtacccctgagggtaacataaaattgtattgcaaaggtgccgataccgttatttatgaacgtctacacagaatgaatccgacgaaacaggaaactcaagatgctctggacatctttgcaaacgaaactctgaggaccctgtgtctatgttataaggaaattgaggagaaggagtttacagagtggaacaagaaatttatggctgcatctgtggcctccaccaatagggacgaggccctggacaaagtttacgaagagatcgagaaggatctcatactcctgggcgccaccgccatcgaagataagctacaagatggtgtgcccgagaccattagcaagctggctaaggccgatattaagatctgggtcctcacaggggacaaaaaggagacagcagagaatattgggttcgcttgcgagctcctaaccgaggatacaaccatctgctatggagaagacatcaatagtctcctccatgctagaatggagaatcagaggaaccgaggtggagtatatgccaaattcgcccctcccgtgcaggagtcgttctttcctcccggcgggaatagggctctaatcatcaccgggtcatggctgaacgagatcctcttggagaagaagacaaagagaaacaagattctgaagctcaagtttcccaggaccgaagaagagcgcagaatgcggacacagtcaaaacggcgtcttgaagctaaaaaagagcagcgccagaaaaactttgttgatctggcatgtgaatgcagcgcggtgatctgttgccgcgtgacgccaaagcaaaaggcgatggttgtcgacctggttaagcgttacaagaaagctatcacactggccatcggggatggagctaatgatgttaatatgatcaaaaccgctcatatcggcgtggggatcagtggacaggaggggatgcaagccgtaatgagttctgactactccttcgcccagttccgctatctccagaggctcctgctcgtccacggccgttggtcttatataaggatgtgtaaattcctgaggtactttttctataaaaattttgctttcacgctcgttcacttctggtattcgttctttaatgggtactctgcccagactgcctatgaggactggttcatcaccctctataacgtcctctacacctcattgccggtgctcctaatgggcttgttggatcaggatgtctcagataagctaagtctgaggtttcccggcctgtatattgtcgggcagcgagacctactgttcaactacaaaaggttctttgtcagcctgcttcacggagtgttaacttccatgatactcttcttcatccctctgggagcttacttacagaccgtgggtcaagacggagaggcaccgagcgactatcaaagcttcgccgtcacaatcgccagcgccttagtgatcaccgtgaatttccagattggactagatacttcctactggaccttcgttaacgccttttccatttttggaagcatagctctctacttcggcattatgttcgacttccactccgccggaatccacgttctgttcccgtcagcctttcaattcacaggcacggcgtcgaatgctcttagacagccatacatttggctgaccattatcttagccgtggcagtgtgtcttctcccagtagtggccatccgtttcctcagtatgaccatttggccttccgagtcagacaagatacagaagcacaggaagcggctgaaggccgaggagcagtggcagcgccgccagcaggtttttcggcggggggtatcaactaggcggtctgcctatgctttctctcatcagcgtgggtatgccgaccttatatcaagtggaagatccatacggaaaaaacgtagccctctcgacgcaatcgtggcagacggcacggccgaataccgacgcaccggggattcg

SEQ ID NO: 7334 - DNA, 3753 bp, Artificial Sequence
  Description of Artificial Sequence: Synthetic coding sequence
atgtctaccgaacgagactcagaaacgacttttgacgaagacagccaacctaatgacgaggttgtgccttacagtgatgatgagacggaggacgagctggacgaccagggttcagcggtcgagccggagcagaatcgggtgaacagggaagccgaagagaacagagagccgtttaggaaagagtgtacctggcaagtgaaggccaatgatcggaaatatcacgagcagccccacttcatgaacacaaagtttctatgcatcaaagagagcaaatatgcaaacaatgcgatcaagacttataagtataatgccttcaccttcatccccatgaatttgttcgaacagttcaagcgtgccgcgaacctctactttctggcacttctgattttgcaagccgtgccccagatatcaaccttggcctggtatacaaccctcgttcccctgctcgtagtgctgggagttaccgctatcaaagatctggtagatgacgtcgcacggcataaaatggataaggagattaataaccgaacttgtgaagtgattaaggatggaaggtttaaagttgcaaagtggaaagagatccaagtaggtgacgtgataagactaaaaaaaaatgactttgtccccgcggacattctcctcctgagcagctccgaaccaaattctctgtgttacgtggaaaccgctgagttggacggggagactaatctgaagtttaaaatgtcccttgagatcacggaccagtatcttcagagggaggatacattggcaaccttcgatgggttcatcgagtgtgaggagcccaacaaccgactcgataaatttaccggaacactgttttggcgtaatacgtcctttcctctcgatgctgacaagatcctgctaagaggctgcgtcatccggaatacagatttctgtcacggattggtcatctttgccggggccgatactaaaattatgaaaaactctggcaaaacacggtttaaaagaactaaaattgactatctgatgaattatatggtctacactattttcgtggtcctgatactattgagcgcgggcctggccatagggcacgcgtattgggaagctcaagtgggcaattcctcttggtacttgtatgacggtgaggacgacactccttcataccgagggtttcttattttctggggatacattatagtgcttaacactatggtccccatttctctgtatgtctctgtggaagtgataaggctgggtcagtctcatttcataaattgggacctacagatgtactatgccgaaaaggacacacctgcaaaagctagaaccacaacacttaacgaacaattagggcagattcattatatcttctcggataaaacagggaccctgacccagaacatcatgacctttaagaaatgttgcattaatggacaaatttacggtgaccacagagatgctagccagcacaaccacaacaaaatcgaacaagtcgacttctcgtggaacacatatgctgacggcaagctggcgttttacgatcattacctgatcgagcaaattcagagtggtaaagagcccgaggtcaggcaatttttttttttgctggcagtctgtcatacagttatggtagacagaaccgacgggcagttgaattatcaagctgcctctccagacgaaggggctcttgtgaacgccgcccgaaatttcgggtttgcctttctagcaaggactcagaataccatcactatttctgaactcggaaccgagcggacatacaacgtgttagctatactggacttcaatagcgacaggaaacgtatgtcaatcattgtgaggaccccagaaggaaacatcaagttgtactgtaaaggagctgataccgtgatttatgaaagactccatcggatgaaccccacaaagcaggaaactcaggatgccttggatatcttcgctaatgagacattgcgcaccctgtgtttgtgctacaaagagatcgaagaaaaagagttcacggaatggaataaaaagtttatggctgccagtgtggcaagcactaatagggatgaggcgctagacaaggtatatgaggaaatcgagaaggatctgatactactgggagctacagctatagaagataagctgcaggacggagtgcccgagacaatcagcaagttagccaaggccgacatcaagatctgggtcttaaccggggataaaaaagaaacagctgaaaacataggcttcgcatgcgaactgctcacggaggatactacaatctgttacggcgaagacataaacagtttacttcatgcgcggatggagaatcagcggaaccgaggtggagtgtatgcaaagtttgccccccctgtacaggagtcattttttcccccgggaggcaatcgggccctgatcatcactggatcctggctaaacgaaattctgctcgagaaaaagacaaagcgcaacaaaatcctgaaactcaagtttcctagaacagaggaggaacgcaggatgcggactcaaagcaagaggaggcttgaggccaaaaaggaacagcgccagaaaaactttgtggacctggcatgcgaatgcagtgctgtgatatgttgcagggtcacaccaaagcagaaggctatggtggttgacctggtcaagaggtacaaaaaagcaattactctagcaataggggacggtgctaacgatgttaatatgataaagactgcccacatcggcgtgggaattagcgggcaggagggaatgcaggccgtgatgtctagtgattacagttttgctcagtttcgctatttgcaaaggttattactggtccacggaaggtggtcttacattaggatgtgtaagttcctgaggtactttttttataagaactttgccttcacactagttcatttttggtacagcttttttaacggctatagcgcacagacggcctacgaggactggttcataactctgtataacgtattatacacatccttgccagttttgctgatggggctcctggatcaggacgtctcagacaagctgtctctaaggttcccagggctgtatatcgtgggccagcgggatcttctgtttaattataaacggttcttcgtcagtcttttgcatggcgtgctaacctcaatgattctgttctttattccgttgggcgcttacctccagactgttgggcaggacggggaggctcccagcgactaccagagctttgcagtgaccattgcctccgccttggttataacggttaactttcagatcgggctggacacgtcctactggaccttcgttaatgccttctccattttcggttctattgcactgtactttggcataatgtttgatttccacagtgcaggtatccacgtcctttttccttcagcctttcaatttacaggcacagcctccaacgccctacggcagccatatatttggttaactatcattcttgccgtggcagtctgcctgctccccgtcgtcgctattagatttctcagcatgaccatatggccaagtgaatccgacaaaattcagaaacatagaaagagacttaaggctgaggagcagtggcagaggcgacagcaggtgttccggcgcggagtgtccacccggaggtccgcttacgcctttagtcatcagcggggctacgccgacctcattagctccggccggagcatcagaaagaaacgctctcccctggacgcaattgtcgccgacgggactgccgaatatcggcggacgggtgacagc

SEQ ID NO: 7335 - DNA, 3753 bp, Artificial Sequence
  Description of Artificial Sequence: Synthetic coding sequence
atgagcaccgaacgagactcagagacgacctttgatgaggacagccaacctaatgatgaggtggtgccgtactcagatgatgaaaccgaagatgagctggatgatcaaggaagcgccgtggaacccgaacagaacagggtgaacagggaagcagaggaaaacagagaaccgtttaggaaagagtgtacctggcaggtgaaagcaaatgataggaagtaccatgagcaaccacacttcatgaacaccaaattcctctgcattaaggagagcaagtacgcaaataacgctatcaagacttacaagtacaatgctttcaccttcatccctatgaacctgttcgagcagtttaaacgagcggcaaatctgtacttcctcgcgctgctgatactccaggcggtgcctcagatcagcacgctggcttggtacactactttggtgccgctgctcgtggtcctcggagtcactgccattaaggaccttgtcgacgatgtggcccggcataagatggacaaggagattaacaatcggacttgtgaagtgatcaaggacggacggtttaaggtggccaagtggaaggaaatccaggtcggggacgtgattcgcctcaagaagaacgattttgtgccggcggacatcctgctgttgagctcctcggaaccaaactcactctgttacgtggagactgccgaacttgacggcgaaaccaacctgaaattcaagatgtcccttgaaatcactgaccaatacctgcagcgagaagataccctcgctaccttcgacggattcatcgaatgtgaggaaccgaataacaggttggataagttcactggcacccttttctggagaaatacgagcttccctctggacgccgataagatccttctcagaggctgcgttatccgcaatactgatttctgccacggcctcgtgatcttcgccggggcggataccaagattatgaagaactccggaaaaactagattcaagcgcactaagatcgattacctcatgaactacatggtctacacgatctttgtggtcctgatcctgctctcagcgggtctggctatcggccacgcatactgggaggcccaagtgggaaactcctcctggtacctgtacgacggggaagatgacactcccagctatcgggggtttctgatcttctggggatacatcatagtcctgaatactatggtgccgatcagcctctacgtgagcgtcgaggttattcgccttggccaatcccacttcatcaattgggatctgcagatgtactacgctgagaaagacactccagcgaaggctcggaccaccactctgaatgagcagctcggacaaatccattacatcttttcggataagaccgggaccctgacgcagaatatcatgactttcaagaagtgctgcattaacggccagatctatggcgaccaccgcgacgcatcacagcacaaccacaacaaaatagagcaggtcgattttagctggaatacttatgctgacggaaagctggccttctacgaccactacctgatcgaacaaatacagagcggaaaagaacctgaagtgagacagttcttcttcctgctggcggtgtgccatactgtgatggtcgatcgcactgacggacagctgaattaccaagctgcatccccagacgagggcgccttggtcaacgctgcgcggaacttcggattcgccttcctggcgagaacccagaacaccatcaccatctcagagctgggaacggagcggacttacaacgtgctggcaatcctcgacttcaactccgacagaaaaagaatgtccatcattgtccggactccagaaggaaatatcaagctgtactgcaagggagcggacactgtcatttacgagcgcctgcaccgcatgaatccaacgaaacaggaaacccaggacgccttggacatcttcgctaacgaaaccctgcgcaccctctgcctttgttacaaggaaattgaggagaaagagttcacggaatggaacaagaaattcatggcggcttcggtggcctccactaatcgcgacgaggcgttggacaaggtgtacgaagaaatcgaaaaagacctgatcctgttgggagcgactgcgattgaagataaactgcaagatggggtcccagaaaccatctcaaaacttgcgaaggccgacatcaagatctgggtgctgaccggtgacaaaaaggaaaccgctgaaaacatcggctttgcgtgcgaactgcttactgaagatactacgatctgctacggggaggacatcaactcgctgctgcatgcaagaatggagaatcagcggaacaggggcggagtctacgcgaagttcgcgccgccggtgcaagaatcgtttttcccgccaggcggaaaccgggcgctcatcattaccggctcgtggctcaatgagatcctcctcgaaaagaaaaccaagcggaacaagatcctgaagctgaagttcccgcggacggaggaggaacgccggatgcgcacccagtcaaagcgccggctggaagccaaaaaagagcaacgccaaaagaacttcgtcgatctggcttgcgaatgttcggcggtgatctgttgccgagtgactccgaaacagaaggcgatggtggtggacctcgtcaagcggtacaagaaagcaatcacgttggccattggtgacggcgccaacgacgtgaacatgattaagaccgcacacatcggagtggggatctcgggacaggaggggatgcaggccgtcatgtccagcgactactcgttcgcacagtttcggtacctccagagactgctgcttgttcatgggcgctggtcctacattcggatgtgtaaattcttgaggtactttttctacaagaacttcgctttcactctcgtccacttctggtactcatttttcaatggatacagcgcccaaaccgcgtatgaggactggtttatcaccctgtataacgtgctctacacctctctgccagtcctcctgatgggacttctggatcaggatgtgagcgacaagctgtcgctgagattccctgggctgtatatcgtgggacaaagggacctgctgttcaattacaagaggttcttcgtgtcgcttctgcatggagtcctcacctccatgattctcttcttcatcccgcttggagcatatctgcagaccgtgggtcaagacggggaagcgcccagcgactaccagtcgtttgcagtgactattgcctcagccctggtgatcaccgttaactttcagatcggcctcgacacctcatactggacgttcgtcaacgcgttctccatctttggatcaatcgccctgtatttcggcatcatgtttgacttccactcggcgggaatccatgtcctcttcccttcggcattccagttcaccggcaccgcgtcgaacgcactgagacagccctacatctggcttactatcatcctcgccgtggccgtgtgcctgctcccggtggtggcgataagatttttgtcgatgaccatctggccttcagagtccgacaaaatccagaagcacagaaaacggctcaaagccgaggaacaatggcagcgccgccagcaggtgttcagaagaggtgtctcgactagaaggtcggcctacgccttctcccaccaacgaggatacgcggacctgatctccagcggacggagcatcaggaagaagcgcagcccgctcgatgctatcgtcgcagatggaactgccgagtacagaagaactggagactcc

SEQ ID NO: 7336 - DNA, 3753 bp, Artificial Sequence
  Description of Artificial Sequence: Synthetic coding sequence
atgtcaaccgaaagggattcggaaaccacctttgatgaagatagtcaaccaaatgacgaggtggtaccctattcagacgacgaaactgaggatgagcttgatgatcaaggatccgccgtggaacctgagcaaaatcgcgtcaaccgagaagcagaagaaaaccgcgaaccatttcgtaaggagtgtacttggcaagtcaaagcaaacgatagaaaataccacgagcagcctcactttatgaataccaaatttctctgtattaaggaatctaaatacgcaaataacgctattaagacgtacaagtacaacgccttcactttcattccgatgaacctctttgaacagtttaaacgcgccgcgaacctgtactttctggcgctcctgatactgcaagccgtcccacaaatttccacgctggcatggtacactaccctggtgccacttctggtggttctgggggtcactgccattaaggacctcgtggatgatgtggcacggcataagatggacaaggagataaacaatcgcacctgtgaggtgattaaagacggtcgattcaaagttgcaaagtggaaagagatccaggtgggcgacgttattagactcaagaagaacgatttcgtccccgcagacattctgctcctgtcctcctcggagcctaactcactctgctacgtggaaaccgcagagctcgacggagaaactaatctcaagtttaagatgtcacttgaaatcactgatcaataccttcaacgtgaagatacgctcgcaacctttgacggattcattgaatgtgaagaacctaacaaccggctggacaaattcaccggaactctcttttggcgcaacacttctttcccactggatgccgataagatcctcctgagaggttgtgtgattagaaatactgatttttgtcacgggcttgtgattttcgcaggcgcagatactaagatcatgaaaaactcgggcaagactcgattcaagcgtaccaagatcgactacctgatgaattacatggtctacaccatctttgtggtcctgatacttctttcggcgggtctggcaattggccatgcatattgggaagcccaggtcggaaattcgtcgtggtacctgtacgatggggaggatgacaccccttcatatagaggattcctcattttctgggggtacataattgtgctgaataccatggtccccattagcctctatgtcagcgtcgaagtgatacggttgggccaatcgcatttcatcaactgggaccttcagatgtactacgccgaaaaggacaccccagccaaggcacgtaccactaccctgaatgaacagcttggtcagatccattacatctttagcgataagactgggactttgacccaaaacatcatgacgttcaaaaagtgctgcataaacggacagatttacggcgatcatagggatgctagccagcacaatcataacaagattgagcaagttgacttctcgtggaatacctacgctgacggaaagctcgctttttacgatcattacttgattgaacagattcagtccggcaaagaacctgaagtgcgacagttcttctttcttcttgcggtctgtcatactgtgatggtggatcgaacggatggacaacttaactaccaggccgcgtctcccgacgaaggagcgttggtcaacgcagcgcgaaactttgggtttgcattccttgcacgtacgcaaaatacgattactatctcggagctgggaactgaacgcacttacaatgtgttggcaattcttgatttcaacagcgaccgaaagaggatgtccatcatagtgcggacccctgagggaaacattaaactctattgtaagggcgccgatactgtgatttacgaacgtctgcacaggatgaaccccaccaagcaggagactcaagacgcacttgacatatttgcaaacgaaacccttcgtacgctttgcctttgctacaaagaaatcgaagaaaaggaattcaccgagtggaacaagaagtttatggcggcatcggtggcctccaccaaccgcgatgaggcccttgataaggtctatgaggaaattgaaaaggatttgattcttctgggtgccacggcaatcgaggataagctgcaggatggagtgcccgaaactattagcaagctcgcaaaagcagacatcaagatctgggtgctcactggggacaaaaaggagactgcagaaaacatcggttttgcatgcgaactgctgactgaagataccacgatctgctacggtgaagatatcaactccctgctgcatgcaaggatggaaaaccaaagaaaccgcggcggagtctacgcaaagtttgcccctcctgtccaagagtcgttttttccaccggggggcaacagagcactgataatcactggaagctggctgaacgagatcctcctggagaaaaagaccaagcggaacaagattctgaaacttaagttcccacgtactgaagaagaacgtagaatgcgaacgcagtccaagagacgcctggaagcaaagaaggagcaacgccagaagaattttgtggacctcgcctgtgagtgttcagctgtcatttgttgccgagtgactcccaagcaaaaggccatggtggtcgacctggtcaagcgttacaagaaggccatcactcttgcaataggcgatggtgctaatgatgtgaacatgatcaagaccgctcatatcggcgtggggatttccggtcaagagggaatgcaggccgtgatgtccagcgattactcctttgcacaattccggtaccttcagcgactgcttctcgtgcatggtcgctggagctacatcagaatgtgtaagtttctgaggtacttcttttacaagaatttcgcttttactctggtgcacttttggtactccttctttaacggatactccgcgcagactgcgtacgaggactggttcataaccctctacaatgtattgtacactagcctgcctgtccttctcatggggttgcttgatcaagacgtgtcagacaaactctctctcagatttccaggattgtacattgtgggccagcgggatctgcttttcaattacaaacgattcttcgtgagcctgctgcatggagtgttgacttcgatgatccttttctttatcccactgggtgcataccttcaaaccgtcggtcaggacggagaggcgccatcggattaccagagctttgcagtcacgattgcatccgcgctcgtgattaccgtgaattttcaaattggactcgatacgtcctactggactttcgttaacgcctttagtatattcggatcgatcgccctgtacttcggtattatgtttgactttcacagcgcaggaattcatgtgctgtttccttccgcatttcaattcacgggaaccgcctccaacgcactcagacaaccttacatttggctgaccattattctggccgtggcggtgtgtcttttgccagtcgtagctataagatttctgtcaatgactatttggccatcggagtccgataagattcaaaaacatcgtaagagacttaaggcagaggaacagtggcaacgcagacagcaggtctttcgtcggggtgtgtccacccgccggagtgcctacgcattttcacatcaaaggggctacgcagatctcataagctcgggtcgctccattagaaagaagaggtcgccactggatgcgattgtggcggatggaaccgccgaatatagacgcactggtgattcc

SEQ ID NO: 7337 - DNA, 3753 bp, Artificial Sequence
  Description of Artificial Sequence: Synthetic coding sequence
atgagtaccgaacgcgacagcgagacgacctttgatgaggactcgcaacctaacgacgaggtcgtaccatattccgacgatgaaacagaggatgaactggatgaccaggggtctgcagtcgaacctgagcagaacagggtgaatagagaggccgaagaaaaccgcgaaccatttagaaaggagtgtacctggcaggtgaaagccaatgataggaaatatcatgaacagcctcactttatgaatacaaaatttctgtgcattaaagagtcaaaatatgcgaacaatgcgattaagacatacaagtacaacgctttcacgtttattcctatgaacttgttcgagcagttcaaacgcgccgccaacctttattttctagccctgctcatactccaggccgtgcctcagatctccacactcgcatggtacactactctcgtcccacttttggtggtgctaggcgttacagctattaaagacctcgtggatgatgttgccaggcataaaatggacaaggagatcaataatcggacctgtgaggtcatcaaggatggcagattcaaggtagctaaatggaaggaaatacaggtcggagacgttatccggctgaaaaaaaatgactttgtgcctgccgacatcttgctcctgtcatccagtgagcctaatagtttgtgttatgtggagactgccgagctcgacggcgagactaatctgaagttcaaaatgagtttggagataaccgatcagtacttgcaaagagaggatacgctggcaaccttcgacggatttatcgagtgtgaggagcccaacaaccggttggacaagtttactggtacccttttctggaggaacacatctttccccctcgacgctgataagattttgctgcgcggatgcgttatccggaacactgacttttgtcacggcttagtcatattcgccggcgcggacaccaagattatgaagaattcaggaaagactcggttcaaacgcaccaagatagattatctgatgaattacatggtgtatacgatctttgtagtcctaatcctgttgtcagctggcctggcaatcggacatgcatattgggaggcccaggttggaaacagctcatggtacctctatgacggcgaggatgacaccccttcttaccgcggcttcctgatcttctggggctacatcatagtactgaacactatggtacctatcagcctttacgttagtgtcgaagtcatacgattgggccagagccactttatcaactgggaccttcagatgtactatgccgagaaggatacgcccgcaaaggctcgcaccactaccctgaatgagcagctgggacagattcactacatcttctcagataagaccgggactctcacccagaatattatgacattcaaaaagtgctgcattaatggacaaatctacggggaccaccgcgatgcaagtcagcacaaccacaataaaattgagcaggtggacttctcctggaacacatacgcggatggaaaattagcgttctatgaccactacttgattgagcagattcagagcggcaaggaacctgaggtcaggcagtttttcttcctcctagccgtttgccatacagtgatggtggatcggacggacggtcagctgaactaccaggctgcgtctccggacgagggtgccctggtaaatgctgcccgaaattttggatttgcatttttggccaggactcagaataccataactatctccgagttaggaactgagaggacctacaatgtgttagccattctggatttcaattcggataggaagcgaatgtctattatcgtacgcactccggagggaaacattaaactgtactgcaagggggcagacaccgtgatctatgagcggctgcaccgtatgaatcctaccaagcaagagactcaggacgctctggacatctttgccaatgagacactccgcacgctgtgtttatgctacaaggagatcgaggaaaaggagttcactgaatggaataagaagtttatggcagcctccgtggcctcaaccaacagggatgaggccctcgataaggtatatgaggaaatcgaaaaggacctgattctgctgggggctactgccatagaagataagctgcaggacggagtgcctgagacaatcagtaagctggccaaagcggacatcaaaatctgggtgctgactggcgacaaaaaggagaccgccgagaatatcggcttcgcttgcgagttgctgactgaggacactacaatctgttatggtgaggacattaatagcctactacacgctagaatggaaaatcagcggaaccgaggtggcgtgtatgctaaattcgcccctcccgtgcaggaaagtttttttccccctgggggcaatcgtgcactgatcatcaccgggagctggctgaatgaaatcctcctggagaagaaaactaagaggaataaaattctcaagttgaagtttccacggaccgaggaagaacgccgcatgcgcacacagtctaagagaagactggaagccaaaaaagaacaacggcagaagaactttgtggacctggcctgtgagtgtagtgctgtgatctgctgccgtgtgacccccaagcagaaggcgatggtcgtggatctcgtcaaaaggtataagaaagccattacactggccattggagatggggccaacgatgtgaatatgatcaagacagcgcatatcggggtgggtataagtggacaggaaggtatgcaggccgtcatgtcctcagattattcattcgcccaatttaggtatctgcagaggctgttgcttgtgcacggaagatggtcctacattagaatgtgcaagtttctgcgttacttcttttacaaaaactttgcattcaccctggtgcacttctggtacagcttttttaacggttacagcgcgcaaactgcctatgaggattggttcatcacactatacaacgtgttatatacctccttacctgtccttttgatgggcttgttagatcaggacgtgtccgacaaactgtcattaagattccctggcctatacatcgttggccagagagatctcttattcaattataagcgatttttcgtgtccctccttcacggagtgctgacatctatgattctcttttttataccactgggtgcctacctgcagaccgttggacaagacggcgaggccccttctgattatcagtcctttgctgtgacgattgcatccgcacttgtgataaccgtgaactttcagatcggcctggacacctcatactggactttcgtaaacgcattttccatatttgggagcatagcgctgtattttggaataatgtttgattttcactctgctggcattcatgtgcttttcccttcagcctttcagtttactggaaccgcttcaaatgcgctccggcagccatatatttggctgacaataatccttgctgtcgcagtctgtcttctcccagtggtggcgattcgatttctgagcatgaccatttggccctctgagtcagataaaattcaaaaacaccggaaacgtctaaaagccgaggaacagtggcagcggagacagcaagttttcaggaggggcgtgagtaccaggaggagcgcctacgctttctctcaccaacgcgggtacgccgatttaatcagttctggtagaagcatacgtaagaaaaggtcaccactggacgcgatcgttgctgatgggaccgccgagtatcgtagaaccggcgactca

SEQ ID NO: 7338 - DNA, 3753 bp, Artificial Sequence
  Description of Artificial Sequence: Synthetic coding sequence
atgtcgacggaacgcgactccgaaactacctttgacgaagatagccagccgaatgacgaagtggtgccctacagcgacgatgaaactgaggatgagcttgacgaccaaggatccgccgtcgaacctgagcaaaacagggtgaatagagaagcagaagaaaatcgagagccattcagaaaggaatgtacctggcaagtgaaggcgaacgataggaagtaccacgagcaaccacactttatgaacacgaagtttctctgcattaaggagagcaaatacgccaacaacgcaatcaagacctacaagtacaacgcttttacgtttatacctatgaacctgtttgaacagtttaagcgagccgcaaatctctactttttggcactcctgatacttcaggccgtcccgcaaattagcaccctggcatggtacactaccctcgtccccctgttggtcgttcttggagtgactgcaatcaaggatttggtggacgatgtggcacgccacaaaatggataaggaaatcaataatcggacgtgtgaagtgattaaggacgggcgttttaaggtggcaaagtggaaggagatacaagttggagatgtcattagacttaagaaaaacgatttcgtgccagcagacattctgcttctttcttccagcgaaccaaactccctgtgctacgtcgaaaccgccgaactcgatggtgagactaacctgaagttcaaaatgtcactggaaatcaccgatcaatatctgcaaagggaagatacccttgctacttttgacggctttatcgaatgtgaagaacctaataacagacttgacaaattcactggtaccctcttctggcgtaatacctccttccctctggatgcagacaagattcttcttcggggatgcgtcattcgcaataccgatttttgtcatggacttgtgatttttgccggagccgacaccaagattatgaagaactccggaaagaccagattcaagcgaactaagattgattacctcatgaattacatggtgtacacgatttttgtggtcctgattctcctgtcggcaggactggcaatcggccacgcatattgggaagcgcaggtgggaaacagctcatggtacttgtacgacggcgaggatgatacgccttcatacagaggatttctcattttctggggctacataatcgtgctgaatacgatggtcccaatttcgctttacgtctcagtggaagtgattaggcttggccaatcgcactttatcaactgggacctccaaatgtactacgcggagaaggatacccccgcgaaagccaggaccaccactctgaacgagcaactgggacagatacattacatcttttcagataaaactggaactctgacccagaatatcatgaccttcaagaagtgttgtataaacggccagatttacggtgatcatagagatgcatcacaacacaaccataacaaaattgagcaggtcgatttctcctggaacacgtatgcagatgggaagctggccttctacgatcattacttgattgagcagatacaaagcggaaaggagcctgaggtcaggcagtttttctttctgctggctgtgtgccataccgtgatggtggataggacggacggtcaacttaactaccaggccgcaagcccagatgagggagcacttgtgaacgccgccagaaatttcggttttgcgttcttggccaggactcaaaacacgatcactatctctgaactggggaccgagaggacttacaatgtcctcgccattctggacttcaacagcgatcgcaaacggatgtccattatagtcaggacgccagaaggtaacattaaactttactgtaagggagcagatactgtcatttatgaaagactgcatcggatgaatccaacgaagcaggagactcaggacgcacttgacatttttgcgaatgagactctgcggactctgtgtctctgttacaaggaaatcgaggaaaaggaattcactgaatggaataagaagtttatggcagcgtctgtggcgagcacgaacagagatgaagcgcttgataaggtgtatgaagaaatcgaaaaggatttgatcctgctgggagcgaccgcgatcgaagataaactccaagatggtgtgcctgagactatctcaaaactggcaaaagcggacataaagatttgggttctgaccggtgataagaaagaaactgctgaaaacatcggatttgcttgcgaactgctcaccgaggataccactatttgttatggtgaggatatcaactcgctgctgcacgcccgcatggaaaatcaacgtaataggggtggggtgtacgctaagttcgcacctccggtgcaggaatcgttttttccccccggaggcaatcgggcactcatcattaccggatcctggctcaacgagatcttgctggagaaaaagactaagcggaacaaaatcctcaaactgaaattccctagaactgaagaggagcgtagaatgaggacccagagcaagcgccggctggaagcaaagaaggaacagcgccaaaagaattttgtggatcttgcgtgtgaatgctctgcagtcatttgttgcagggtcaccccgaaacagaaggcaatggtcgtggatctggtgaagcggtacaaaaaggcaataactctcgcaattggtgacggtgccaacgacgtcaacatgattaagactgctcatatcggtgtggggatctcggggcaggaagggatgcaagccgtgatgtcgtcggactactcattcgcacaattcaggtacctccaaaggctgcttctggtgcatggccgctggtcctacattcgcatgtgcaagttcctgaggtactttttctataagaattttgcatttactttggtgcatttctggtactcgttctttaacgggtactcggcacaaacggcatacgaggattggtttatcaccctttacaacgtgctttacacctccctccccgtcctcctgatggggcttctggaccaggatgtctccgacaaacttagcctcaggttccctggactttacattgtgggtcaaagagacttgcttttcaactacaaaagatttttcgtctccctcctccacggtgtgctcacctcgatgatcctcttctttatacctcttggcgcttaccttcaaactgttggtcaggatggtgaagcaccaagcgactaccaatcctttgccgtgaccatcgcgtcagcactggttatcaccgtgaacttccagattggactggacacttcctactggacctttgtcaacgcatttagcattttcggatcgatcgccctgtactttggcatcatgtttgattttcactcggcgggcattcatgtgctttttccatcggcttttcagtttacgggtactgcctcaaatgcgcttagacagccatacatttggcttacgatcattttggcagtggccgtgtgtctccttcctgtggtggcaattcgatttctttcgatgaccatttggccttcagaatccgataagatccaaaagcaccgaaagcgtctgaaagcggaagaacagtggcaacgacggcagcaagtgtttagacgcggtgtgtccacgaggagatccgcttacgcattttcgcatcagagaggttatgccgatctgataagctccggtcgttccattcggaagaaaagatctcctttggacgcgattgtggcagacggcaccgcagaatacagaaggaccggagatagc

SEQ ID NO: 7339 - DNA, 3753 bp, Artificial Sequence
  Description of Artificial Sequence: Synthetic coding sequence
atgtcaacagaaagagattcagagacaaccttcgatgaagacagccaacccaatgatgaggtggtaccatattctgacgatgaaacagaagatgagttggacgaccagggaagcgctgttgagccggaacagaacagagtcaatcgggaggcagaagaaaatcgcgaaccgtttcgcaaagagtgtacatggcaggtgaaagccaacgatagaaagtaccatgagcaaccgcatttcatgaatacaaagtttttatgtataaaggaaagcaagtatgctaataatgccatcaagacatataagtacaacgcgtttactttcatacctatgaatctgtttgagcaatttaaacgcgcagcaaacctttattttcttgcattgttaatcctccaagctgtgccgcaaatatccacgctggcttggtacactacgctggtaccgctccttgttgtgctgggcgttacagcgattaaggatttggtagatgatgtcgctcggcataagatggataaagagataaacaaccgcacgtgtgaagttattaaggatggacggtttaaggttgcaaagtggaaggaaattcaagttggagatgttattcggttaaaaaaaaatgacttcgtacctgcggatattttgcttttgtcctcttctgaaccgaactctctatgctatgtagaaactgcagagcttgatggggaaacgaatcttaaatttaaaatgtctttggaaattacagatcagtatctgcaacgtgaggatacacttgcaaccttcgatggtttcattgagtgcgaggaacctaacaataggctggataaatttacgggtacccttttttggcgtaatacatcattcccactagacgcagacaagatcctacttcggggctgcgtcattagaaacacagatttttgccatggcttggttatctttgcgggagcagatacgaagattatgaagaattcaggaaaaacaagatttaaacggacaaagattgattacttgatgaattatatggtatacactatttttgtagttcttatcctccttagcgcaggcctggctattggccatgcctattgggaagctcaggttggaaactcctcatggtatctctatgatggagaggatgatacaccgagttatcgtgggttcctgatcttttgggggtacattatcgttctgaacacgatggtcccaatttcactgtatgtatccgtggaagtaattcgattgggtcaatcccacttcattaattgggacttacaaatgtactacgctgagaaagacactccggctaaagctaggacaactacgcttaacgagcaactaggccagatacattatattttcagcgacaaaactggcacacttacacagaatattatgacctttaaaaaatgctgcataaacggccagatctacggggatcatagggatgcatcacaacataaccacaataaaattgagcaagtcgatttctcgtggaatacttatgctgatggcaaattagctttttatgatcattacctgattgaacagatacagagcggaaaagaaccagaggtgagacaatttttctttctgctggcagtttgtcatacagtgatggtagatcgaacagacggccaattgaattatcaagccgcgtcaccagatgaaggtgcgttagtgaatgcagctagaaactttggatttgctttcttagcgcgcacacagaatacaataacaatatctgaacttggaactgaacgaacctacaatgtacttgctatcttagatttcaattctgatagaaagcgcatgagtattatcgttaggacaccggaaggtaatattaaactttattgtaaaggcgctgacaccgttatctatgaacgtcttcaccgaatgaatccgacgaaacaggaaacgcaggacgccctcgatatattcgcgaatgagacactccgcactctgtgcttatgttataaagaaatagaggaaaaagaatttacagaatggaataaaaaatttatggctgccagtgtagcttccacgaatcgggatgaggcattagacaaagtctatgaagaaattgaaaaagatttgattttactgggcgcaacagccattgaagataagttgcaagatggtgtgcctgaaacaatctctaaattggcaaaagcggatataaaaatatgggttcttactggcgataagaaggaaactgctgaaaatattggcttcgcttgcgagttactgacagaagatacgacgatctgctatggagaagatatcaacagcttgttacacgcaaggatggaaaatcaacgcaaccggggcggagtgtacgctaaattcgcacctccagtgcaggaatctttcttcccccccggcggcaatcgtgccttaataataacaggatcctggctgaacgaaatccttttagaaaaaaaaacgaaacgtaacaagatattaaaacttaagtttccgcgaacagaagaagagcggcgaatgcgcacacagtcaaaacgacggttagaagctaagaaagaacagcgccaaaaaaatttcgttgacctggcgtgcgagtgctccgcggtgatttgctgccgcgtcaccccgaaacagaaagcgatggtggttgacttagtgaaaagatataaaaaggctatcacgcttgctatcggagatggcgcaaacgacgtgaacatgattaagaccgctcatatcggcgtgggcataagcggccaagaaggaatgcaagccgtgatgagcagcgattattctttcgcacagtttagatatttgcaaagattgttgctggtccatggccgatggtcatatattcgtatgtgcaagtttttacggtattttttttacaaaaactttgcatttacactggtacatttttggtactctttttttaatggatactcagctcaaacagcgtatgaagactggtttattacgttatataacgttttatatacttctcttccagtactgctgatgggcctgttagatcaagatgtatctgataaattgagcctgcgttttccgggcctgtatatcgttggccagagggacctgctgtttaattataaacgttttttcgtatcgctgttacatggcgtgttaacatcaatgattttattttttatcccgctgggcgcgtatttacaaacggtcggtcaagatggtgaagctcctagcgattatcagtcgttcgcagtgacgatagcgagcgccctggttattacagttaacttccaaattggattggatacgagctactggacatttgtcaatgcctttagcatctttggatctatcgctttgtattttggcatcatgtttgacttccattcagcaggcatacatgtactgttcccgagcgcttttcaatttacaggaacggcatccaacgcgcttcgacagccgtacatttggcttacaatcattcttgccgtggcagtgtgtctgcttcccgtggtggctattcgtttcctgagtatgacgatatggccgagcgaatcagacaaaatccagaagcatcgtaaacgactgaaagctgaggagcaatggcaacggcgccaacaagtttttcgaaggggcgtctctacaagacgcagtgcttacgctttttcacatcaacgaggctatgctgatctgatttcgtctggaagaagtattagaaaaaaaaggagcccgctcgatgctattgtagccgatggtactgctgaatataggcgcactggcgattcg

SEQ ID NO: 7340 - DNA, 3753 bp, Artificial Sequence
  Description of Artificial Sequence: Synthetic coding sequence
atgagtactgagagggatagtgaaacaacctttgatgaggattcccagcccaacgatgaggtggtgccatacagtgacgacgagaccgaagatgagttagatgaccaggggtccgcagtggagcccgagcagaaccgggtcaatagagaagcagaggagaaccgcgagccattcagaaaggaatgcacctggcaagttaaagccaatgaccggaagtaccacgagcagccacattttatgaacaccaaattcctttgtatcaaggagtccaaatatgccaataacgcaattaaaacctataaatataatgctttcacatttatacccatgaacctgttcgagcagttcaagcgagccgctaacctttacttcctcgcactgttgattctgcaggccgtcccccagatctccaccctagcctggtatactaccctggtgcctctcctcgttgtgctgggggttacagcaattaaggacctggttgatgacgttgctcgccacaagatggacaaggagatcaacaatagaacctgcgaggtcatcaaagatggccgttttaaggtggcaaaatggaaagaaatccaggtgggcgacgtgatcaggctgaagaaaaacgattttgtgcccgctgacatcttgctattatccagttctgaaccaaactccctgtgttatgttgagaccgcagagctcgatggggagactaatcttaaatttaaaatgtccttggagatcacagaccagtatctgcagcgggaagatactctcgccacatttgacggctttattgaatgcgaggaacctaacaaccgcctcgacaagttcaccgggactttgttttggcgaaacacaagtttcccactagacgctgataagatcctgctgcgtggatgtgtgataagaaacaccgacttttgccacggattggtgatcttcgctggagccgacacaaaaatcatgaagaattccggcaaaaccaggttcaaaagaactaaaattgattatctgatgaactatatggtctatacaatcttcgtggtcctgattctgctgtccgccggcctggccatcggacacgcctattgggaagctcaggtcggcaatagtagttggtatctgtacgatggggaggacgacaccccttcttatcgggggttcctcattttttgggggtatattatcgttctcaataccatggtccccatctccttatacgttagcgtggaggtgatccggctcgggcagtcccatttcattaactgggacttgcagatgtattatgctgagaaagacactccagctaaagctagaaccaccaccttgaatgaacaactaggccagatccattacatcttttccgataaaactggcacattaacccagaatattatgacattcaagaaatgctgtattaacgggcaaatctatggcgaccatcgggatgcttctcagcataaccataacaagatagagcaagtagatttcagttggaacacctacgctgatggcaaattggccttctacgaccactacctgatcgaacaaatacagtccggcaaggaacctgaggttaggcaattcttcttcctgctggccgtatgccataccgtgatggtggaccgcaccgatggacagttaaactaccaggccgcaagcccagacgaaggggctttagtgaatgctgcaagaaattttggctttgccttcttagccagaacacagaataccatcaccattagcgagctgggcaccgagcggacctataacgtcctagccatcctggattttaactcagaccgcaaacgaatgtccataatcgttaggacccctgaagggaacatcaagctgtactgcaagggagctgacaccgtcatttacgagaggctgcatcgcatgaaccccaccaaacaggagacacaggacgccctggacatcttcgccaatgagaccctaaggaccctttgcctgtgctacaaagagattgaagaaaaagaatttaccgagtggaacaagaagtttatggctgcttccgtagcatccactaacagagatgaggcactggataaagtctatgaagagattgagaaggacctgattctcttaggcgccacagctatagaggataaactccaagatggcgtgccagagaccatttctaagcttgcaaaggccgacattaaaatatgggtgctgactggcgataagaaggagacagctgagaatataggcttcgcctgcgagttgttgacagaggacactaccatatgctatggggaggatataaactccttgctgcacgcacggatggagaaccagcgtaaccgaggcggagtgtacgctaaattcgctccccccgtacaggagtcattcttcccccctggcgggaaccgggcactgatcattacaggctcctggttaaatgaaattctcctagagaaaaagactaagaggaacaaaatcctgaaactgaagttcccaagaaccgaagaggagagaagaatgaggactcagagcaagcgccggctggaggccaaaaaggaacagcggcagaagaacttcgtagacctggcctgtgaatgttccgctgtgatctgctgtcgggtgacacctaagcagaaggctatggttgttgatctagttaaacggtataaaaaggctatcacattggccataggagatggagccaatgacgtgaacatgatcaaaaccgctcacatcggagtcggcatctctggacaggagggtatgcaggctgtcatgtcaagtgattattcctttgctcagttcaggtacctgcagcgcttactgctagttcacggtaggtggagttacattcgcatgtgcaaatttcttcggtacttcttttacaagaattttgccttcactctcgtgcatttctggtatagttttttcaatgggtacagtgcccaaacagcttacgaggactggttcataacactttacaacgtgctgtatacctctctgccagttttattaatggggctgctagaccaagatgtgtctgacaaactgtccttgaggttccccggcctttacattgtgggccagagggacctgctgttcaactataagagattttttgtaagccttttacatggagtcctgaccagcatgattctatttttcattcctctaggggcttacctgcagactgttggtcaagatggagaggctccctctgattaccagtcttttgcagtgactatagccagcgcactggtgatcactgtcaattttcagatcggactcgacaccagctattggactttcgtgaacgccttttccatcttcgggtctattgccctatacttcggcatcatgttcgactttcactccgccggtattcacgtgctgtttcccagtgcattccagtttacaggcactgcatctaacgccctccgccagccctacatctggcttacaataatcctcgctgtagctgtgtgtctgctgcctgtagtcgccatccgcttcctgtccatgactatttggccttccgaatctgacaagatacaaaagcaccggaaaagactcaaagcagaagaacagtggcaacgacgtcagcaggtgttcagacggggcgtttccacccgacgctccgcctatgccttcagtcatcaaaggggctacgctgacctaattagttcaggtaggagtatccgcaagaagaggagcccattagatgccattgtcgccgacggcaccgccgagtacaggcgcactggtgattct

SEQ ID NO: 7341 - DNA, 3753 bp, Artificial Sequence
  Description of Artificial Sequence: Synthetic coding sequence
atgagcactgagcgcgacagcgagactacttttgatgaggattcccagccgaatgacgaagtcgtcccttattcagatgacgagactgaagatgagcttgacgaccaaggaagcgccgtggaacctgaacagaatagggtcaaccgcgaggcggaagaaaatagagagccattccgcaaggagtgtacttggcaagtgaaggccaacgataggaaataccatgaacagccgcatttcatgaatacgaagttcctctgcataaaagaatcgaagtacgccaacaacgcgattaagacctacaaatacaacgctttcacctttattccaatgaatctgtttgagcagtttaagagagcagcaaatttgtactttcttgccctccttatcctccaagcagtcccgcaaatctcaaccctggcctggtacaccactcttgtccccctgctggtggtgctcggagtgacggcgattaaagacctggtggacgacgtcgcccgacacaagatggacaaagagataaacaacagaacttgtgaagttatcaaagacggtagatttaaggtggcaaaatggaaggaaatccaagtcggtgacgttattcggctgaagaagaacgatttcgtgcccgccgatatactccttctcagctcgtcagaacctaacagcctgtgttacgtggaaaccgctgagcttgatggggagactaaccttaagtttaagatgagccttgaaattaccgaccagtacctgcagcgtgaggacaccctggcgacctttgatggattcatcgagtgtgaagaacctaataaccggcttgacaagttcaccgggacccttttctggcggaatacttcgtttccacttgatgcagacaagatcctgcttagaggatgtgtgatccggaacaccgacttctgtcacggactcgtgattttcgcaggagcagataccaaaatcatgaagaatagcggtaaaactagattcaagcggaccaagattgattacctgatgaattacatggtgtacactattttcgtcgtgctgattcttctgtcggctggattggcgatcggacacgcctattgggaagcacaagtcgggaacagctcatggtacctctatgatggagaagatgatacccctagctacagaggatttttgattttctgggggtacataatagtgctgaataccatggtgccaattagcctgtacgtatccgtggaagtgataaggcttggccaatcgcactttatcaactgggatctccagatgtactacgcagagaaggacactcccgcaaaggcaagaaccactacgcttaatgaacagctcggtcaaattcattacatctttagcgataaaactggtaccttgactcaaaacataatgactttcaaaaagtgttgcatcaacggacagatttacggtgaccaccgggatgcgtcgcaacacaatcataacaagattgagcaggttgatttctcatggaatacctacgcggatggcaaattggccttttacgatcactacctcattgagcaaattcaaagcggcaaggaacctgaagtgcggcagtttttctttctccttgcagtgtgtcacaccgtgatggtggatcggactgatggacaactgaactaccaagcagccagcccagatgaaggtgccctggtcaatgccgcgagaaatttcggatttgcattcttggcacgaactcaaaacaccatcaccatatcagaactgggtaccgagaggacgtacaatgtcctggcaatactggacttcaattcggatcgcaaaaggatgtcgatcatagtcagaacccctgaagggaacatcaagctctactgtaagggagcagacactgtgatttacgaaaggttgcacagaatgaatcccaccaagcaggaaactcaagatgctctggatatctttgcaaacgaaaccttgcggactctttgtttgtgttataaggaaatcgaagaaaaggagtttactgagtggaacaaaaagtttatggcggcctccgtggcctcgaccaaccgcgatgaagcactggataaggtctacgaggaaatcgagaaggatctcatccttctgggcgcaaccgcgattgaagataagttgcaagatggagtgccggaaaccatctccaagctcgccaaggccgatatcaagatctgggtgctgaccggagacaagaaggagactgcggaaaacattggatttgcttgcgaactgctgactgaggacactacgatttgttatggagaggacataaactcccttcttcatgcacggatggaaaatcagagaaatcgaggtggagtgtacgcaaagtttgcgccccccgtccaagagagcttctttccacctggagggaaccgcgcgctgatcataaccggctcgtggctgaacgaaatacttcttgaaaagaaaacgaagcgaaataagattctgaaactgaagtttccacgaactgaggaagagcggaggatgaggacccagtccaagcgtcgtctggaagcgaagaaggaacaacgccaaaagaactttgttgatctggcatgtgaatgctcagcagtcatttgttgtcgcgttactccaaagcagaaggcaatggtggtcgatctggttaaacgctacaagaaggcaattacgcttgccattggggatggcgccaatgatgtcaacatgattaagaccgcacacattggtgtgggaatctcgggccaggagggtatgcaggcggtcatgtcatcggactactcgttcgcgcagtttagatacctgcaaagactgttgcttgtgcatggcagatggagctacattaggatgtgcaagtttctgcgatactttttctacaagaattttgccttcaccctggtccatttctggtattctttctttaacgggtattccgcccagacggcatacgaagattggttcataactctttacaacgtgctgtacacctcacttccagtgctgctcatgggactgctcgatcaagacgtttccgataagctgagccttagatttccaggcctgtacatagtcggtcagcgcgaccttttgtttaactacaaacgatttttcgtcagcctgcttcatggagtgttgacttcgatgattctgtttttcattcctctcggtgcctacttgcagaccgtgggtcaagatggagaagcaccttctgactaccagagctttgccgttactattgcatcagcactggtcattaccgtgaacttccagattggattggatacttcttattggactttcgtcaacgcatttagtatctttgggtcgattgctctttactttggaattatgtttgactttcacagcgccggtattcatgttctctttccttcagcttttcagttcactggcactgcatcaaacgcgcttcggcagccttacatttggcttaccatcattttggctgtggcagtctgcctcctgcctgtggtggctattcgctttctgtcgatgaccatctggccctccgaaagtgataagattcaaaaacatcggaaacgtttgaaggccgaagagcaatggcagaggcggcaacaagtatttagaagaggagtctctactagacggtccgcttacgcattctcccaccaacggggctacgccgatctgatctcatcaggccgatccattcggaaaaaacgctcacccttggatgccatcgtggctgatgggactgcagaataccgtcggacgggtgattct

SEQ ID NO: 7342 - DNA, 3753 bp, Artificial Sequence
  Description of Artificial Sequence: Synthetic coding sequence
atgtcaaccgaaagggatagtgaaactactttcgacgaggactcccaaccgaatgatgaggtggtgccctacagtgacgacgaaacagaggatgagttagacgaccaggggtccgccgttgaaccagaacagaaccgcgtgaaccgcgaggcagaggagaatcgcgaaccattccggaaggaatgcacgtggcaggtgaaggccaacgataggaagtaccatgaacagccccactttatgaacaccaaattcttgtgcataaaagagtctaagtatgccaataatgctatcaagacatataagtataacgcctttacatttatccctatgaacctatttgaacaattcaaaagggccgccaatctgtactttctcgccctcctgatactgcaggccgtgccccagatttcgaccctcgcctggtacactaccctggttcccctgctcgttgtgctgggagtcacagcgattaaggatctggtcgacgatgttgcacggcataagatggacaaagagattaacaatcggacctgcgaagtgatcaaagacggacgatttaaggtcgctaagtggaaggagatccaggtcggcgacgtgatcaggctgaaaaagaatgacttcgtgccagcggatattctgttactttcatcttcagaacccaacagcttgtgttacgtcgaaacagcagagctggacggcgaaactaacctcaagtttaagatgagcctagaaatcaccgaccaatacttacagagggaagataccttggccacctttgatgggttcatagaatgtgaagagcctaacaaccgcctggataagttcacaggtacgctgttttggaggaacacttctttccctctggacgccgacaagatcctactgcgaggctgcgtcattagaaataccgacttctgccacggactcgtgatctttgctggcgccgatactaagatcatgaagaactccgggaaaacccgcttcaagcgcactaagattgactatctcatgaattatatggtgtacacaatctttgtggttttgatcctgttgagcgcgggcctggcaataggacatgcatattgggaagctcaggtcggaaactcgtcatggtatctgtatgatggggaagacgacaccccatcctacagaggttttctgattttctggggatatattattgttctgaacaccatggtccctatttcactctacgtctcagtcgaggttattaggctcgggcaaagccacttcattaattgggacctgcagatgtactatgccgaaaaagatactccagccaaggcccgtacgaccactctaaacgaacagttaggccagatccattacattttcagtgacaagacagggacgctgacccagaatataatgacttttaagaagtgttgtatcaacggccaaatttatggggatcacagagatgcatcgcagcacaaccacaacaagattgaacaggttgactttagctggaatacctacgcagacggcaaattagccttctacgatcattacctgatcgaacagatccagtcagggaaagagcctgaggtcagacaattctttttcctcctggccgtgtgtcacactgtcatggttgatcggactgacggccagcttaattatcaggctgcatctccggatgagggagccctcgtaaacgccgctcgcaattttggctttgcatttctcgccagaactcaaaacaccataacaattagtgagctgggcaccgaacgtacctacaacgttctggccatccttgactttaactccgacagaaaaagaatgagcatcattgtgagaactcctgagggaaacatcaaattatactgtaagggcgccgatactgtgatctatgagcggctgcataggatgaaccctaccaaacaagagactcaggatgctctggacattttcgcgaacgaaaccctgagaaccttatgtctgtgttataaagaaatcgaggaaaaagaattcacggagtggaacaaaaaatttatggcggcatcggtggcaagcacaaacagagacgaggccctggacaaggtctacgaagagatcgagaaggacctgatcttgctgggtgccacagcaatcgaggacaagctccaggatggggtcccggagacgatttccaaactcgccaaggccgatattaaaatctgggtgctgaccggcgataagaaagagacagccgagaacatcgggtttgcatgtgaactgctgaccgaggacacaactatctgctatggagaagacattaattccctcctgcacgcgagaatggaaaaccagcggaatcgaggcggagtgtatgcaaagttcgccccacctgtgcaggagagcttttttccacctgggggcaatagagccttaatcataacgggcagttggctaaatgagattctacttgaaaaaaagaccaagaggaataagatactgaagctgaagttccctcgcacagaggaggaaaggcggatgcggacacaaagtaagaggagactcgaagccaagaaggagcagcgtcaaaaaaacttcgtcgacctcgcatgtgagtgcagcgccgtgatctgttgtcgcgtgacacccaagcagaaggccatggtggtggacctcgtgaagagatacaaaaaagccatcactctggccattggggatggtgccaatgatgtgaacatgatcaagacagcgcacatcggcgtcgggatctcaggccaggaaggaatgcaggccgtgatgagctctgactattctttcgctcagttccggtatctgcagcgtttactcttggtgcatggccgctggagttacattcgtatgtgtaagtttttacggtactttttctataagaattttgcatttacattggtgcacttttggtacagctttttcaatggctactctgctcaaaccgcatacgaggactggttcataaccctttataatgttctctatacaagcctgcccgtcttactgatgggccttttggaccaggacgttagtgataagttgagtttaaggttccccgggctatacatcgtgggccaacgggatctgctgttcaactataagcgcttctttgtgtctctgttacacggggtgctaacatctatgatcttgttcttcatcccactgggcgcatatctccagacagttggccaggacggagaggctccctctgattatcagtcgtttgccgtgacaatcgccagcgccctggttatcacggtcaatttccagattggcctggacacatcgtattggaccttcgtcaacgcctttagcatcttcggatccatagcactttattttggcattatgttcgacttccactcggcaggcatccatgtcttgtttccctcggctttccagtttacagggaccgcttccaatgcattgcgacagccttacatttggctaaccattatcctggccgtggccgtctgcctgctgccggtggttgccattaggttcttatctatgacaatctggccatcagaatccgataaaatccagaagcacaggaagcggctgaaagcggaggagcagtggcaacggcggcagcaggtctttcggaggggagtgtcaacgagaaggtctgcatacgccttcagccatcagcgagggtatgccgacctgataagttcaggcaggtccatacggaagaaaagatcacctctggacgctatagtcgcagacggaacagctgagtataggaggactggggatagt

SEQ ID NO: 7343 - DNA, 3753 bp, Artificial Sequence
  Description of Artificial Sequence: Synthetic coding sequence
atgtcgactgagcgcgacagcgagacgactttcgatgaggactcacagcccaatgacgaggttgtcccctacagtgacgacgagaccgaggatgaactggatgatcaggggagcgccgtggaacctgaacagaatcgggtgaaccgtgaggcagaggagaatcgggagcccttccgcaaggagtgcacatggcaggtgaaagcgaacgacaggaagtaccacgagcagccccattttatgaacaccaagtttctgtgcatcaaggagtcgaaatacgctaacaacgccattaagacgtataaatacaacgcattcacatttatccctatgaacctgtttgaacagttcaagagagcagccaacctgtatttcctggctctgctgattctgcaggcagtcccccagatcagtacccttgcatggtacactacattggtcccgcttctcgtagtgctaggggtgactgcaataaaggatctcgtggacgacgtcgctagacataagatggacaaagagatcaataaccgcacctgcgaggtgattaaggatggccgcttcaaggtggcaaaatggaaggaaattcaggtgggcgatgtgattcgcctgaagaaaaacgattttgttcccgccgacatcctgctcttatctagttccgaacccaattctttgtgttacgtggagaccgccgagctcgatggggagactaatttgaagttcaagatgtcgctagagattactgaccagtatctgcagcgagaggatacactcgctaccttcgacgggttcattgagtgtgaagaaccaaacaatcgcctcgataagtttaccggaaccctattttggaggaatacttctttccccctggatgccgacaagatcctgctacggggatgtgtgattaggaacacagatttttgtcacggtctggtgatttttgccggagcagacacaaagattatgaagaatagcgggaagactcggttcaagagaaccaaaatcgactacctaatgaactacatggtgtataccatctttgtagtgttgatcctcctctccgccggtctggctatcggccacgcttattgggaggcacaggttggaaattcctcctggtatctgtacgatggcgaggatgacactccatcatacaggggatttcttattttctggggttacatcattgtcctaaacaccatggtgccaatttctttgtatgttagtgtggaagtgatccgtctcggtcagtcccacttcattaactgggatctccagatgtattacgccgagaaagacactcctgcaaaagccaggacaactaccctcaatgaacagttaggacagatccattatattttctctgacaagacaggtaccctgacacagaacatcatgactttcaagaaatgctgtatcaatggtcaaatatacggtgatcaccgggacgccagccagcacaaccataacaaaatagagcaggtcgacttctcatggaacacatacgctgatggtaagctcgccttttatgatcactatctgatcgagcaaatccagtccggaaaagagcccgaggtcaggcagttctttttcctgttggcagtgtgccacaccgttatggtggatcgtaccgacggccagctgaattatcaggctgctagtccggatgaaggggccctagtgaatgcggcaagaaacttcggattcgcgtttttagccagaacacagaatacaatcacaatttccgagctcggcacagagagaacctacaacgttctggctatcctggatttcaattccgaccgcaagagaatgagcataatcgtcagaacccctgagggaaatatcaaactctattgtaagggcgcagacaccgtcatctacgaacgactgcaccggatgaacccaacaaaacaagagacccaggatgccctcgacatatttgctaatgaaacactgagaacgctttgcctgtgctacaaagaaatagaggagaaagagttcacagagtggaacaaaaagtttatggccgctagtgtggctagcacaaatcgcgacgaagccctggataaggtctatgaggagatcgagaaagacctcattctcttgggggctaccgccatcgaagacaagttgcaggacggggtgcctgagactatttccaagctcgcaaaggccgacatcaaaatctgggtgctaacaggggacaagaaggaaactgcagaaaacatcggctttgcatgcgagcttttaactgaagacacaaccatctgctatggagaggatatcaactctctgctgcacgctcggatggaaaaccagaggaatcgcggcggcgtgtacgctaagtttgctccccctgtgcaagagtctttcttcccacctggggggaatagggccctcataatcaccgggagctggctgaatgagattttgctggagaagaagaccaaacgaaacaagattttaaaattgaaatttccccgaacggaagaagaacgacgcatgaggacccaatccaaaagacggttagaggcgaagaaagagcagcggcagaagaacttcgtggacttagcttgtgaatgctccgctgtgatatgctgtagggtgaccccaaagcaaaaggccatggtggtggacctggtgaaaagatacaagaaggcaattactctcgccattggtgatggcgccaacgacgtgaacatgattaagacagcccatatcggagtgggaatatcaggccaggaaggcatgcaggccgttatgagtagtgactacagtttcgcacagtttagatacctgcagcgcctgctgctggttcatggccggtggtcatacatcagaatgtgtaaattcctgaggtactttttctacaaaaatttcgcattcacactggttcacttttggtactcgttcttcaacggatacagtgcccagacggcctatgaggactggttcatcaccctgtataacgttctctatacatcactcccagttctgcttatgggcctgttggaccaggatgtgtctgacaagctgagcctgcgcttccccggactctatatcgtgggccagcgcgacttgttgtttaattacaaaaggttctttgtttccctcctgcatggcgtcttgactagtatgatcctattcttcatcccgctcggcgcttacttgcaaacggttggacaagatggggaggccccttccgactatcagtcattcgccgtgacgattgccagtgctctagtgatcaccgttaacttccagatcggactcgacacctcctactggacttttgtaaatgctttctctatctttggttctatcgcattgtacttcggcattatgtttgatttccattccgcagggatccatgtcctattccctagcgcttttcaatttacagggactgcatccaacgccctgcgacaaccctacatctggctcactattatcttagctgtggcggtttgcctcctccccgttgttgcaatccggttcctgtctatgacgatctggcccagcgagtcggacaaaattcaaaagcataggaaaagactgaaggcagaagaacagtggcaacgcagacagcaggtgttcaggaggggagtcagtactagacggtctgcttacgctttctcacatcagagaggttatgcggatctgatctcaagcggacgcagtattcggaagaagagatctccccttgacgctatagtcgcggatggcaccgcggagtataggaggacaggagactct

SEQ ID NO: 7344 - DNA, 3753 bp, Artificial Sequence
  Description of Artificial Sequence: Synthetic coding sequence
atgtccactgagcgtgattccgagacgaccttcgacgaggacagccaaccgaacgatgaggtcgtgccgtactccgatgatgagactgaggacgagctcgacgaccaaggatccgcagttgaaccggaacagaaccgcgtaaatagggaggctgaggagaatagggaaccatttcgtaaggagtgcacctggcaagtaaaggccaacgatcgaaagtatcacgagcagccccactttatgaacacaaaatttctgtgcatcaaggagagcaaatacgctaacaacgcgattaaaacctataagtataacgcgtttactttcatccccatgaacctgttcgagcagtttaaacgcgcagccaacctgtattttctggcattgctgatactgcaggccgtgccacagatctcgacgctggcctggtacactacacttgtgccactcctcgttgtcttgggagtgacggcaatcaaggatcttgtggacgacgtggcgaggcataagatggacaaagagatcaacaatagaacttgcgaagtcataaaagacgggcggttcaaggtggcgaagtggaaggaaatacaggtgggtgacgttattcgtctgaagaagaatgatttcgtaccggccgacatcctgctgttgtcttcatcggagccaaattctttgtgctacgttgagaccgccgagcttgatggcgagacaaacctgaagttcaagatgtccttggagattactgaccagtatctgcagcgcgaggacacgctggcaaccttcgatggattcatcgagtgtgaggaacccaacaaccgtcttgataagttcaccggaacactgttctggaggaacactagttttccactcgacgcagacaagatattactccggggatgcgtgatcaggaatactgacttctgccacggcttggtcattttcgccggagctgacaccaagatcatgaaaaacagcggcaaaacccgcttcaagcgaaccaagatcgattatcttatgaactatatggtgtacacgatttttgttgtgctgatactgctcagcgcaggcttggctatcggtcacgcgtactgggaagctcaggtcggtaattcgtcttggtacctatatgatggagaagacgatacaccatcataccggggatttttgattttctggggctatattatcgtgctgaacaccatggtgccaatctccctgtatgtgagcgttgaggtcatcagacttggccagtcgcactttataaactgggacctgcagatgtactacgcggagaaggacaccccagccaaggcgaggacaactactctgaacgagcagctcggccaaatacactacatcttctccgacaagacggggacgcttacccagaacattatgacctttaagaagtgctgtattaatggacagatttacggagatcaccgcgacgcctcccaacacaatcacaacaaaatcgagcaagtcgacttctcgtggaatacatatgcggacgggaagctcgccttctacgatcattacctgattgaacagatacaatcgggcaaggaaccggaggtccgccagttcttcttcctgttagcagtgtgccataccgtgatggtagatcgaaccgacggccaacttaactatcaagcggctagcccagatgagggagctctagtaaatgctgcccgaaacttcggcttcgccttcttggctaggacccagaatacgatcacgattagtgagctgggcaccgagcggacctacaacgtattggcaatcctggatttcaatagtgaccgcaagcgaatgtcgatcatcgtgcgcacccctgagggaaacatcaagttgtactgcaaaggagccgatactgtaatttacgagagactgcaccgcatgaacccgacaaagcaagagacccaggacgcactcgatatcttcgccaatgaaactttgcgaacgctctgcctgtgctataaagagatcgaggaaaaagagttcacagagtggaataagaagttcatggctgcctctgtggcgtctacgaacagagatgaggctctcgataaagtttacgaggagattgagaaggatctgatactgctgggcgcgacggcgatcgaggacaagctccaggacggcgttcccgagacgattagcaaattggcgaaagccgatatcaagatctgggtacttactggagataagaaagagaccgccgagaacatagggttcgcctgcgagctgcttacggaggacacgacgatatgttacggagaggatatcaactctctgctacacgccaggatggaaaaccagcgaaaccgcggcggcgtgtacgccaagtttgctcccccagtgcaggagtccttcttcccaccaggaggcaatcgtgctctgattataactggatcctggctcaatgaaatcctactcgagaagaagactaagcgcaacaaaattttgaaactcaagttcccccgaaccgaagaagagcgtcgcatgagaacacagtcaaagaggcggctggaggccaagaaggagcagcgtcaaaagaacttcgtcgatctcgcatgcgaatgcagtgccgttatctgctgccgtgtcacgcccaagcagaaggccatggtggtggacttagttaagcgatataagaaggccattaccctcgcaatcggtgacggcgcgaacgatgtgaatatgatcaagacggcccatatcggtgtgggaatctccggccaggaaggtatgcaagcagtcatgtcaagcgattattcgttcgctcagtttcgctacctccaacggctgctcctggtccatggcagatggtcctatatccgtatgtgcaagtttcttagatatttcttctacaaaaatttcgcctttaccttggtgcatttttggtactcctttttcaacggatacagcgctcaaaccgcctacgaagattggttcattactctgtataacgtgctttatactagtttgcccgttttgttgatgggactattggaccaagacgtgagcgataaactctccttaagatttccaggtttatacatcgtcggccagcgagacctcctgtttaattacaagagattttttgtcagcctgttacacggtgtgctcacgtctatgatcctattcttcattccgttgggcgcatatctgcagacggttggccaggatggtgaggctccatcagattaccagtccttcgcagttaccatcgcgagcgcccttgtgataaccgtcaattttcagataggcctcgacacgtcgtactggaccttcgtcaatgccttctcaatcttcggcagtatcgccctttacttcggcatcatgttcgatttccattcagctggaatccacgtgttgtttccgtcggctttccagttcaccgggacagcctctaatgcgctgaggcagccatatatctggctcaccattatcctcgccgtggcggtgtgcctgctccccgtggtcgcaattcgtttcctcagcatgacgatatggcccagcgaatccgataagattcagaaacaccgcaagcgactcaaagccgaggagcaatggcagcgccgacagcaggtgtttcgacgcggagtctcaaccagaaggtctgcctacgccttctcgcatcagagaggctacgccgacctgattagttcgggaaggtctattcggaaaaagcgtagccccctggatgctatcgtggcggatggcacggccgagtaccgtcgaacaggcgattcg

SEQ ID NO: 7345 - DNA, 3753 bp, Artificial Sequence
  Description of Artificial Sequence: Synthetic coding sequence
atgtctaccgaacgtgattcagaaacaacatttgacgaggattcccaaccaaatgacgaggtggtgccgtactcagacgatgagactgaagacgagttggacgaccagggtagcgcggttgagcctgaacagaatcgcgtaaaccgggaggccgaggagaatcgcgagccatttcgtaaggagtgtacctggcaggttaaagctaatgaccgcaagtatcatgaacagccccatttcatgaacacgaagtttctgtgcattaaggagtcaaagtatgccaacaacgccatcaagacctataaatataacgcattcacatttatcccaatgaacctgttcgagcagtttaagagggctgctaacctctattttttggccctgctcattctccaggccgtgccccagattagcacgctggcttggtacacaactttagttccgttgctagtggtccttggtgtgaccgccatcaaagatttggtcgacgatgtggcacgtcacaaaatggataaggaaatcaataaccgaacatgtgaagtcatcaaggatggacggttcaaggtggctaagtggaaagagatccaggtaggtgacgtgatccgcctaaagaaaaatgactttgtacctgccgacatcctcctactgtcttcatccgagcccaattcactgtgctatgtcgaaaccgctgaactcgacggcgaaactaacttaaagtttaaaatgtccttggaaattacggaccaatacctgcagcgggaggacaccctggcaacatttgatggattcatcgaatgtgaagaaccaaacaatcgcttggacaaatttactggtaccttattttggcggaatacaagctttccgctagatgctgataaaatcctgcttagaggatgcgtaatcaggaacaccgacttctgccacggacttgtgattttcgcaggtgcagatacaaagatcatgaaaaattcaggcaaaaccagatttaaacggactaagattgactatcttatgaactatatggtgtacactatcttcgtggtcttgattttattgtccgccgggcttgccattggccacgcctactgggaggcacaggtcggcaatagcagctggtatttgtatgacggtgaagatgacacaccctcttatcgcggatttctgatcttttggggctatattattgtgcttaacaccatggtgcccatcagtctgtacgtatccgttgaagtgattcggttaggtcagtcccacttcatcaactgggatcttcagatgtactatgccgaaaaagatacccctgctaaagcgcggacaaccactctaaatgagcagctgggtcaaattcactatatcttctcagataaaaccggcacactgactcagaacattatgacattcaagaagtgttgcataaatggacaaatatacggcgaccatcgagacgcttcccaacacaatcacaacaagattgaacaggtagacttctcctggaatacatacgccgacggcaaactcgcattctacgaccactatttgattgaacaaattcagtcagggaaggaaccggaggttaggcagtttttctttctccttgcggtgtgtcatactgtgatggttgaccgcaccgatggacagctcaattaccaggctgcctcacccgatgagggagctctcgttaatgccgcccggaatttcgggtttgcctttctggccaggactcaaaacactattactatttccgagttagggacagagcgtacctataacgtgctggcaatccttgacttcaactctgataggaagcggatgtcaatcatagtccgcacccccgaaggaaacatcaaattatattgtaagggggctgataccgtaatatacgaacgcctgcaccggatgaaccccaccaaacaggagacgcaggatgcactcgatatctttgctaacgaaacacttcggacactatgcctctgctacaaggaaattgaggagaaagaatttactgaatggaataagaagtttatggccgcttccgtagccagcaccaaccgagatgaggccctggacaaggtgtatgaagagatcgagaaggatttgattctgctaggcgcaaccgctatcgaggacaaactacaggatggggtcccagaaactatatcaaagctagcaaaggccgacatcaagatctgggttttgaccggtgataagaaagagaccgcagaaaacatcgggtttgcgtgcgaattactgaccgaggacacaaccatctgctacggcgaagacataaactccctgttgcatgcccgaatggagaaccaaaggaaccggggtggagtgtacgcgaagtttgcaccgcctgtccaggaaagtttcttcccccccggtgggaacagggctctgatcataacagggagctggctgaatgagatcctattggaaaagaaaaccaaacgcaacaagatccttaagctgaaatttccgagaacagaggaggagcggcgaatgagaactcagtccaaaaggcggctggaagcgaagaaggagcagcgccagaaaaacttcgtggacctggcatgcgaatgcagtgctgtgatctgttgccgagtgaccccgaaacagaaagctatggtggtggacttagtgaaaagatataagaaggccatcactctggctattggagatggcgcaaacgacgttaacatgattaagacggcacacatcggagtgggcatctctggccaggaaggcatgcaggcggtgatgtcaagcgattattcgttcgcccagttccgatacttacaaaggcttctgctcgtgcacggcagatggtcgtacattcgcatgtgtaagtttctgcgttactttttctataagaacttcgctttcacacttgtccacttttggtattccttttttaatggctattctgcccagacagcatatgaggactggtttataacactatataacgtgctgtatacatctttacctgtcctattgatgggactgctggatcaggacgttagtgataagctgtcgttacggttcccaggactctacatcgtgggccagagagatctgttgtttaattacaagagattttttgtgtccctgctgcacggagttctgacgtctatgatattgttctttattccgctcggcgcatacctgcagaccgtgggacaggatggggaggctcctagcgactaccagtcattcgcagttacaattgcaagtgctctcgtgattacagttaactttcagataggccttgatactagctactggacctttgttaatgccttcagtatcttcgggagcatcgccctttatttcggcataatgtttgacttccactctgcgggcatccatgtgcttttcccctctgcctttcagttcacggggaccgcgtctaatgcgttgcggcaaccatatatatggctgaccatcattctggcggtggccgtatgcctgctgcccgtggtcgccatcaggttcttgagtatgacaatatggccatctgagagtgacaaaatccagaagcatagaaaaagactaaaggccgaggagcagtggcagcggcgccagcaggtgttccggcgaggcgtgagcaccaggcggagtgcatacgccttttcacaccagaggggatacgccgatctcatatctagcggtcgaagtattaggaagaagcggtcacctctggatgccatcgtggccgatgggacagctgagtaccgacggacaggagattct

SEQ ID NO: 7346 - DNA, 3753 bp, Artificial Sequence
  Description of Artificial Sequence: Synthetic coding sequence
atgtcaaccgagcgggatagcgagacaaccttcgatgaggattctcagcctaatgatgaggtggttccgtattccgatgacgaaacagaggatgaactagacgaccagggatcagccgtggagcccgagcaaaacagagtgaaccgcgaagcggaagagaaccgggagccgtttcgaaaggagtgtacatggcaggtcaaagctaacgatagaaaataccatgagcagccccactttatgaataccaagttcctgtgtatcaaggagtcaaagtacgccaacaatgcaattaagacttataagtataacgcattcaccttcattccgatgaatctgttcgaacaattcaagagggctgccaacctctactttctcgcgctgctgattctgcaagctgtcccccagattagtacactcgcctggtataccacattagtacctctgctcgtggtcctgggcgtgacagcaatcaaagacttggttgacgacgtggcaaggcacaaaatggataaggagataaacaaccgcacctgcgaggtgatcaaggacggaaggtttaaagttgctaagtggaaagaaattcaggtgggcgacgttattagactgaagaagaacgatttcgtgccagccgatatcctgcttttgagcagcagcgaacctaacagtctgtgttacgtggagacagcggagctggacggcgagacaaatttgaagtttaagatgtctctcgagatcaccgaccagtacctccagagggaggacactctggctacgtttgacggtttcattgagtgcgaagaaccgaataaccgcttggacaaattcactggcacactcttttggaggaacacatctttcccactggacgctgacaagattctgttacgtggctgtgtaatcaggaataccgatttctgtcacggcctggtaatcttcgccggtgcagacaccaagattatgaaaaactctggaaaaacgcgattcaaacgcacaaaaatcgactacttaatgaattatatggtctacaccattttcgtcgtgttaatacttctgagtgccggcctggcgataggccatgcttactgggaggctcaggttggtaattcctcttggtatttatatgacggcgaggacgacactcccagctatagggggtttctgatcttttgggggtatatcattgtgttgaatacaatggttcccatttcactgtatgtgtctgtcgaggtgattcgactcgggcagtcacatttcataaattgggacctacaaatgtattacgctgaaaaagacactcccgcaaaggctcggactaccaccctgaatgagcagttgggacaaatccattacatcttctccgacaagaccggcaccctgactcaaaacatcatgacatttaagaaatgctgcattaacggtcaaatctacggggatcaccgcgacgcttctcagcacaatcataataagatcgagcaggtggacttcagttggaatacgtacgccgatggcaagctggcattctacgatcactatctcatcgaacaaatacaatcagggaaagagccagaggtccgccagtttttctttctgcttgctgtgtgtcacaccgtgatggtggaccggacggacggtcagctcaactaccaggctgcatcgccagacgaaggggcgctggtgaacgcagctagaaacttcggctttgcattcctggcccgtacccagaacaccattaccattagcgaactgggaaccgaacgtacttataacgtactggctatcttggactttaacagcgaccgaaagcgaatgagcatcatcgtgagaactcccgaaggcaatataaagctgtattgcaagggcgctgataccgtgatttacgagaggttgcatcgcatgaaccccaccaaacaggagactcaggacgccctggatatttttgcgaacgagacactgcgcaccctctgcctgtgctacaaggaaatcgaggagaaagaatttaccgagtggaataagaaattcatggcggcaagtgttgcttcaactaatagagatgaagccctggacaaggtatatgaggaaattgagaaagacttgattttgcttggagcgaccgctattgaagataaacttcaggacggcgtgccagagacaatttccaagctggccaaggccgatattaagatttgggtgttaacaggcgacaagaaggagaccgcagagaatattggattcgcatgcgagttgctgactgaggataccaccatctgttatggtgaagacattaactctctgttacatgcacgtatggaaaaccagcggaaccgcggcggcgtgtatgcaaaattcgccccacctgtgcaggagtctttcttcccacctgggggcaatcgggctctgattattactggttcctggctgaatgaaatcctgcttgagaaaaagaccaagcgcaacaagatcctcaaattgaagtttccacggactgaagaagaacgtaggatgcgtacccagtccaaaagacgactggaggccaagaaggaacagcgccagaaaaacttcgtggatcttgcatgtgagtgctctgcggtgatttgctgccgcgtaactccaaaacagaaggcaatggtagtagatctggtaaagaggtacaagaaggcaattacgctggccatcggtgatggagctaatgatgttaatatgattaagaccgcccacatcggtgtcggtatctccgggcaagagggaatgcaagcggtgatgtcgagtgattattcattcgcacagttccgctacctgcagaggctactgctcgttcacggacgttggtcgtatattcgcatgtgcaagttcctacgctactttttttataagaacttcgctttcacactggtgcacttctggtactcatttttcaatggttactctgctcagacagcatacgaggactggtttatcacactgtacaacgttctttatacatctctcccagttcttctgatgggcctgctagatcaggacgtttccgataagctgagcctgcgttttccggggctctatatagtgggccagagggatctgctttttaattacaagcgtttctttgtctcactgctgcatggagtgctcacttccatgattctgtttttcatccctctgggggcttacctgcagacggtcggtcaagatggcgaggctccatccgactatcagtccttcgctgttacaattgcgagtgccctggtgatcacagtcaatttccagatcggcctggacacctcttattggacattcgtgaacgccttttccattttcggctcaatcgctttgtactttggtattatgtttgatttccattccgctggaatccatgtgttgtttccctcagccttccagttcacagggaccgctagcaatgccttgcgacagccttacatctggttgaccattatactggcagtcgccgtgtgtctgctgcccgtggtcgctattaggttcctgtccatgacaatctggccttccgagtcagacaaaatccaaaagcacagaaaacggcttaaggccgaggaacaatggcagaggagacaacaggtgttccgaaggggtgtgagcaccaggcgctccgcttatgcgttctctcaccagcgaggctacgcagatcttatctcgagtgggcgtagcatccggaaaaaacggtccccactggacgccattgtggcggacggaactgcagagtaccgtagaactggggacagc

SEQ ID NO: 7347 - DNA, 3753 bp, Artificial Sequence
  Description of Artificial Sequence: Synthetic coding sequence
atgtccactgaaagagactcggagacgaccttcgatgaagattcgcaaccaaacgacgaggtggtcccctactccgacgacgaaaccgaggacgagctcgatgatcagggatccgccgtggaacctgaacagaacagagtgaaccgggaagcggaagaaaaccgcgaacctttcagaaaggaatgcacctggcaagtgaaggccaatgacaggaaataccatgagcagcctcacttcatgaacaccaaatttctgtgcatcaaggaatcgaagtatgctaacaatgccattaagacctacaaatacaacgccttcacctttatcccgatgaacctgtttgaacagttcaagcgcgccgccaatctctacttcctcgccctgttgatcttgcaggccgtgccgcagatctcaaccctggcttggtacactaccctggtcccactgttggtcgtcctcggagttacggccatcaaagatctggtggacgatgttgccagacataagatggataaggaaatcaacaatcggacttgcgaggtcatcaaggatggcaggttcaaagtggcgaaatggaaagaaatccaagtcggagatgtcatccgcctgaagaaaaacgattttgtcccggccgacatacttctgctgtcctccagtgaacctaacagcctgtgctacgtggagactgccgagctcgatggtgaaaccaacttgaagtttaagatgagcctggaaatcactgatcaatatctccaaagagaggacaccctcgctaccttcgatggattcatcgaatgcgaggaacctaacaaccggctggacaaattcacggggactctgttctggagaaacacttccttcccgttggatgcagacaagattctcttgcgcgggtgcgtgatccgcaacaccgatttctgccacggacttgtgattttcgccggggctgataccaagatcatgaagaattcgggcaagaccagattcaaaaggaccaaaatcgactacctgatgaattacatggtgtacacgatcttcgtggttctgatcctcctgtccgcgggcctcgccattggacacgcctactgggaagcccaggtgggaaattccagctggtacctttacgacggggaggatgatactccgtcataccgtggatttctcatcttttggggttacatcatcgtgttgaacaccatggtgccaatctcgctgtacgtctccgtggaagtgatcagactcgggcaatctcacttcataaactgggatttgcaaatgtactatgccgagaaggacaccccggccaaggctcgtaccaccaccctgaatgaacagttgggccagatccactacatcttcagcgataagaccggcactctgactcagaatatcatgacctttaagaagtgttgtatcaacggccagatttacggagatcatcgcgatgccagccagcataaccataacaagatcgagcaggtcgatttttcctggaacacctatgctgacggaaagctggcattctacgaccattatctgatcgaacagatccaatccggaaaagaaccggaagtgcgccagttcttcttcttgctcgccgtgtgtcacactgtgatggtggaccgaaccgatgggcagttgaattaccaggcagcctcgccagacgagggcgccctggtcaacgcggcccgcaacttcggatttgcgtttctggcacggacgcagaacaccatcactatctctgaattgggaactgagcgcacgtacaatgttctggccatcctcgactttaacagtgaccggaagaggatgagcattatcgtgcggaccccggaaggtaacattaagctctactgcaaaggagctgataccgtgatttacgaacgactccaccgcatgaaccccaccaagcaagaaactcaagacgccctggacatcttcgcgaacgaaactctgagaactctctgtctgtgctacaaggagatcgaggaaaaggagtttactgaatggaataagaagttcatggcggcctccgtggcatccactaatcgcgatgaagcgctcgataaagtgtacgaagaaattgaaaaggacctgatcctgctcggggcaaccgccattgaggacaagctgcaggacggggtgccagaaaccatctcaaagctggcaaaggcggacatcaaaatctgggtcctgactggagataagaaggagactgcggagaacatcgggtttgcctgcgaactgctgaccgaggacaccaccatctgttacggagaggacataaacagcctcctgcatgcccgcatggagaaccagcggaatcggggcggagtttacgcgaaattcgcaccgccagtgcaggaatccttcttccctccgggcggtaatagggctctcatcatcactggtagctggttgaacgaaatcctgctcgaaaagaaaacgaaacgcaataagatcctcaagttgaagttcccgcgcactgaagaagaacggaggatgcggacccagtccaagcggcggttggaagccaagaaagagcaaagacagaagaattttgtcgacctggcgtgcgagtgctcggccgtgatctgctgtcgcgtgacccctaaacaaaaagccatggttgtggatctcgtgaagcgctacaagaaggcaattactctggcgatcggcgatggagctaacgacgtcaacatgatcaagaccgcgcacattggtgtcggaatttcgggtcaagagggaatgcaggcggtcatgtcgtccgactactcgttcgcccagttccgctacctgcaacgccttctgctcgtgcacggaagatggtcatacatccgcatgtgcaagtttcttagatacttcttctacaaaaactttgccttcaccctcgtccacttttggtacagctttttcaacggttacagcgcgcagaccgcctacgaggactggttcatcactctctacaatgtcttgtacacgagccttcctgtcctgctgatgggactgctggaccaggatgtgagcgacaaattgtcgctgaggtttccaggtctgtacatcgtcggacagcgcgacctcctgttcaactacaagaggttcttcgtctcactgctgcatggcgtgctcacttccatgatcctctttttcatccctctcggagcttacttgcaaacggtcggacaagacggagaggccccatccgattaccagtcatttgccgtgactatcgcatcggccttggtgattactgtgaacttccagatcggccttgatacgtcgtactggacctttgtgaacgcattcagcattttcggctcgatcgcgctgtacttcggtatcatgttcgatttccatagcgctgggattcatgtgctcttcccgtcggcattccagttcaccggaaccgcctcgaatgctcttcgacaaccatacatctggctgactattatcctcgccgtggccgtgtgcctcctcccggtggttgcgatccgcttcttgtcgatgactatctggccgtcggagtcggacaagatccagaagcatcggaagcgcctcaaagctgaagaacaatggcaacgtcggcaacaagttttccgcagaggagtgagcactcgccgcagcgcgtacgcattctcgcaccagcgcggatacgccgacctgatctcctcaggacgctccattcgcaaaaagcgttccccgctcgatgcgatcgtcgccgatggaacggctgaataccgccggaccggtgactcg

SEQ ID NO: 7348 - DNA, 3753 bp, Artificial Sequence
  Description of Artificial Sequence: Synthetic coding sequence
atgtcaacggagagggattcagaaaccactttcgatgaggatagccagccgaacgacgaagtggtgccttactccgacgatgaaaccgaagatgaacttgacgatcaaggatcggctgtggaacctgagcagaaccgcgtcaaccgggaggctgaagaaaacagagagccttttagaaaggaatgtacgtggcaggtcaaggctaacgaccgcaagtaccacgaacagcctcatttcatgaacaccaaattcctgtgcattaaagaatccaagtacgcgaacaacgcaatcaaaacctacaagtacaacgccttcaccttcatcccaatgaacctttttgaacaattcaagagggccgccaacttgtacttcctcgcgctgttgatcctgcaggccgttccgcaaatctcgactctggcctggtacaccaccctcgtgccgctgctcgtggtgctgggcgtcaccgccatcaaggacctcgtcgacgatgtggcccgccataagatggataaagaaatcaacaaccgcacctgcgaggtgatcaaggacggacggtttaaggtggccaagtggaaagaaatccaagtgggagatgtcattagactgaagaagaacgatttcgtcccggcagacatcctgctgctgtcatcgtctgaaccgaactccctgtgttacgtcgagactgcggagctggacggagaaaccaacctcaagttcaagatgtctcttgaaatcactgaccaatatctccagcgcgaagatacgcttgctactttcgacggctttattgaatgcgaagaaccgaacaaccggctcgataagttcaccgggaccctcttttggcgcaacacttcttttccactcgatgccgacaaaattcttttgcggggatgcgtgataagaaacactgatttctgccacggactggtgattttcgcaggagctgatactaaaatcatgaagaatagcggaaaaactaggttcaagcgcaccaagatcgattaccttatgaactacatggtgtacactatcttcgtggtgctgatcctgctgtcggcagggttggcaatcggacacgcatactgggaggctcaggtgggaaacagctcgtggtacctgtacgatggcgaagatgacactccgtcataccgggggtttctgatcttttggggctacattatcgtgctcaacaccatggtcccgatctcgctctacgtgagcgtggaagtgatcaggttgggacagtcgcactttatcaattgggaccttcaaatgtactacgccgaaaaggacacccctgccaaagccagaaccaccaccctcaacgagcagctcggtcagattcattacatcttcagcgacaagaccggcactctgacccagaacatcatgactttcaaaaagtgctgcattaatggccaaatctacggtgatcatcgcgacgcgtcacagcataaccataacaagatcgaacaagtggacttctcctggaacacctacgccgacgggaagttggccttctatgatcactacctgatcgaacaaatccagtcgggaaaggaacctgaggtgagacaattcttcttccttctcgcggtgtgccataccgtcatggtggaccgtaccgacggtcagctcaactaccaggctgcgtcgcccgacgaaggtgccctggtcaatgccgcacgcaacttcggattcgcattcctggccagaacccaaaacactattacgatatcagagctgggcaccgagagaacgtacaatgtcctcgctatcctcgatttcaactccgaccggaagcgcatgtccatcatcgtgcgcaccccggaagggaacattaagctgtactgtaagggcgccgacaccgtcatctacgaacggctgcaccggatgaatccaactaagcaggagactcaggacgccctcgacatcttcgcgaacgagactctgaggaccctgtgcctgtgttacaaggagatcgaagaaaaagagttcaccgagtggaataagaagttcatggccgcgtcggtcgcgagcaccaatcgggatgaggcgctggataaggtgtacgaggaaatagagaaagatctgatcctcctgggcgcgactgcgatcgaggacaagctgcaggacggggtccccgagactatctccaaactggccaaggccgacatcaagatctgggtgctgacgggagataagaaggagacggcggagaatatcggatttgcctgcgagctcctgactgaggataccaccatctgctacggtgaggacataaactccctcctgcacgcccgcatggagaatcaacggaatcggggaggggtgtacgcaaaattcgcgccaccggtgcaggagagcttctttccgccaggaggtaaccgagcccttatcatcaccggatcctggctgaacgaaattctcctcgagaaaaagacgaagcgcaataagatccttaaactcaagttccctcggactgaagaggagaggcgcatgcggacccagtcaaaacgccgcttggaggccaagaaagagcaaagacagaagaatttcgtggacctggcatgtgaatgctccgctgtgatctgttgccgggtgactccgaagcagaaggcaatggtggtggatcttgtgaagaggtacaaaaaggcaattacgctggcaatcggcgatggagcgaacgatgtgaacatgatcaagaccgcacacatcggagtgggcatcagcgggcaagagggaatgcaggccgtcatgtccagcgactactctttcgcccagttcagatacctgcaacgtctgctgctggtccacgggcgctggagctacattcgcatgtgcaagttcctccggtacttcttctacaagaatttcgcattcactctggtgcacttctggtactcctttttcaacggctattcggcgcagaccgcctacgaggactggttcattaccctctacaatgtgctgtatacctccctgccggtgctcttgatgggactcctggaccaggacgtgtcagacaagctctcactgcggtttccaggtctgtacatcgtcggccaacgggatctgctcttcaactacaaaagatttttcgtgtcactgctgcacggagtgctgacttcgatgatcctgtttttcattccactgggtgcatacctgcaaaccgtgggccaggacggagaagccccgtcagactaccagagctttgctgtcactattgcaagcgcgctggtgatcacggtgaacttccaaatcggactcgacacgtcatactggactttcgtgaatgcattctcgatatttggtagcattgcgctgtatttcggtatcatgttcgatttccactcggccggaatccacgtgctgttcccgtcagctttccaattcaccggcactgcatcgaacgcgctgagacagccatacatctggctcaccatcatcttggcagtggcggtgtgcttgctccccgtggtcgcgattcgcttcctgtcgatgaccatttggccctcggagtcggataagatacaaaaacaccgcaagcggctcaaagccgaagaacagtggcagcgcaggcagcaggtgtttagaagaggcgtgtcaactaggagatcagcctacgcattctctcaccaacgggggtacgctgacctgatctcaagcggccgctccatccgtaaaaagaggtcccctctggatgcaattgtggccgacgggactgccgaataccgccggacgggggacagc

SEQ ID NO: 7349 - DNA, 3753 bp, Artificial Sequence
  Description of Artificial Sequence: Synthetic coding sequence
atgtctactgagagagactctgagacaacctttgacgaagactctcaacccaacgatgaggtggtcccctacagtgacgacgaaactgaggacgaactagatgaccaagggtccgccgtcgagcctgagcaaaaccgcgtgaacagggaagcggaggagaatagagagcctttcaggaaagaatgcacctggcaggtcaaggccaacgaccgcaagtatcatgagcagcctcatttcatgaataccaaatttttatgcattaaagaatccaagtacgctaacaacgctataaagacctacaaatacaacgcattcacatttatccctatgaacctttttgagcaattcaaaagagctgcaaatctttatttcctcgcactcctgattttgcaagcggtgccacagatctcgacacttgcttggtatactactctggtccctctgctcgttgtgctgggcgtgaccgcaatcaaagaccttgttgacgacgtggcaagacacaagatggacaaagaaatcaacaacagaacatgtgaggttattaaggatgggcgctttaaagttgctaagtggaaagagatccaggtcggggacgtgataaggttgaagaagaacgactttgtccctgcagatatcctccttctttctagttcagaacccaacagcctttgctatgtggaaacagcagagcttgacggggagacaaacctcaaattcaaaatgtccctggagattacagatcaatacctgcagagggaggataccctcgcaactttcgacggatttatagaatgtgaggagcccaataacaggcttgataagttcactggcactctcttctggcggaacacaagcttccccttggatgcagataagatacttctgaggggctgtgtaattagaaacaccgatttttgtcatggactcgtgatcttcgccggagctgacaccaaaatcatgaaaaacagcggcaagacccgctttaaaaggaccaaaatcgattaccttatgaactacatggtgtacacaatctttgtggtgctcatcctgcttagcgcgggcctggccatcggtcacgcatattgggaagctcaggttggtaatagcagctggtacctgtacgatggagaggatgacacaccgtcttaccggggtttcctcattttttgggggtatatcatcgtacttaacacaatggtgcctatcagcctgtatgttagcgtggaggtcatccgccttgggcagtcacatttcatcaactgggatcttcagatgtactacgccgagaaagatacaccggcgaaggcacggactaccacactgaacgagcagctgggccaaattcactatatattttctgacaagacaggcaccttaacacagaacatcatgacttttaagaaatgttgcatcaatgggcaaatctacggagaccacagggatgcaagccagcacaaccacaacaagatcgaacaggtggatttcagctggaacacttatgccgacggcaagctggccttctatgatcactatctgatcgagcaaattcaatctgggaaagagccagaagtcaggcaatttttcttccttctggctgtgtgccacaccgtgatggtggatcgcacagacggccaactgaattaccaggctgctagccccgacgaaggcgcgcttgttaacgcagcaagaaactttggcttcgcctttttggcaagaacacaaaacaccatcactatcagcgaattagggacggaaagaacatataacgtactggccatcctagattttaacagtgaccgcaagcggatgagcatcattgtgcgtacacccgaaggtaacataaagttgtattgtaagggtgctgatacagtcatttatgaaaggctgcaccgcatgaacccaaccaaacaggagactcaggatgcccttgacatctttgctaacgaaaccttaagaaccctgtgcctgtgctacaaggaaattgaggagaaggagttcaccgaatggaataagaaattcatggctgccagcgttgctagtaccaacagggatgaagcgctcgacaaagtgtacgaggaaattgaaaaagacttaatccttctgggcgccactgcaatagaggacaaactgcaggatggcgtaccagaaacaatcagcaaactagcgaaggctgatattaaaatctgggtcttgactggtgacaaaaaggagacagctgagaatatcggattcgcatgtgaattgctcaccgaagatactacaatctgctacggggaagatattaactctctgctgcacgcaagaatggaaaaccaaagaaaccggggcggagtctacgccaagtttgcgccacctgtccaggagtctttttttcctccaggcggcaatagggctctgattataaccggctcttggctcaacgagattctgcttgagaagaaaacgaaaagaaacaaaattttaaaactgaagttcccgcgtaccgaggaggagaggcggatgcggactcagtcaaagcggaggcttgaggcgaagaaagagcaaagacaaaagaattttgtcgacctggcgtgcgaatgcagcgcagttatctgctgcagggttacccccaaacagaaagccatggtcgtcgacttagtcaaacgttacaagaaagccatcactctcgcgatcggcgatggtgcgaatgatgtgaacatgatcaagaccgctcatatcggcgtggggattagcggccaggagggtatgcaagcggtgatgtcatcagattattctttcgcccagtttaggtaccttcaacggttactgctcgtgcacggacgctggtcatacatccggatgtgcaaatttcttcgctactttttttacaaaaatttcgctttcactctggtgcatttctggtacagcttctttaacggctactctgcccaaacagcctacgaagattggtttatcacactgtataacgtgctgtatacaagcctgcctgttctgctgatgggcttgctggaccaggacgtgagcgataaactgagcctgagatttccaggactgtacatcgtgggtcaacgtgaccttctgttcaactacaagaggttctttgtgagtctgctgcatggggtgttgaccagtatgatattgttctttatcccgcttggtgcatacctgcagacagttggccaggatggcgaggctcctagcgattaccagagttttgctgttaccattgcctctgctctagtcatcactgtgaacttccaaatcgggctcgacaccagctactggacattcgtgaacgcttttagtatttttgggtctattgccctgtacttcggaatcatgtttgatttccactctgctggtatacacgtgctgttcccttctgcatttcagttcaccggcactgcaagtaatgctctgcggcagccgtatatctggctgacaataattctggccgtggcagtatgtctcctgcctgtggtagcgattagatttttgagcatgaccatatggccatccgaaagcgacaagatccaaaagcatcgcaagaggttgaaggcagaagaacagtggcagagacgccaacaagttttcaggcggggagtgagcacacgccgtagcgcctacgcctttagccatcagcgaggctacgcagatctgatcagtagcggaagatcgattagaaagaaaaggtcaccgctggacgctattgtcgctgacggcaccgctgaataccgccgtaccggcgactcc

SEQ ID NO: 7350 - DNA, 3753 bp, Artificial Sequence
  Description of Artificial Sequence: Synthetic coding sequence
atgtccacagagcgcgatagtgaaacaacctttgatgaggattctcagcctaatgatgaagtggtgccatactcagacgacgagacggaggacgagctggacgatcagggttccgcagtggaaccggaacagaatagggtaaatcgcgaggccgaagagaatcgcgaaccatttcgcaaagagtgcacatggcaagttaaagctaatgacaggaagtaccatgagcagccccatttcatgaacacaaagttcctgtgtataaaggaatctaaatatgcaaataatgctatcaaaacttataagtataatgcttttactttcatcccaatgaaccttttcgaacagtttaaacgggccgcaaacctgtattttttagcactcctcatactgcaggctgtgccgcaaatctcaaccctcgcctggtatactacactggtacccctcctggtggtcctcggcgtaaccgccatcaaggatctagtcgatgatgtggcaagacacaaaatggataaagagatcaataacagaacctgcgaagtgatcaaggatggaagatttaaggtggctaagtggaaagagatccaggtcggcgatgtgattagactaaaaaaaaacgattttgtgccagcagatatcttgctgctctcttcctctgaacctaattccctatgctatgtggagaccgccgaactggatggggagaccaacctcaaatttaagatgagcctggaaataacagatcagtatctccagagggaggataccctcgccacattcgacggcttcatcgaatgcgaggagcctaacaatcgcctcgacaaattcactggcacgctgttctggcggaatacctctttccccttggatgccgataagattctgctgagagggtgtgtcatcagaaacacagacttttgccacgggttggtaatattcgcgggcgctgatacgaagatcatgaagaatagtgggaagactaggttcaagcggactaagatcgattacttaatgaattacatggtctacaccatttttgtggtgctaatactgttatcggctggacttgccatcggtcacgcctactgggaggcccaggtgggaaatagctcatggtatctgtacgatggggaagacgacacgccctcttaccgcggttttcttatcttttgggggtatattattgtgctcaacaccatggtccccatctccctctacgtgagtgtcgaggtgatcagattgggacagtcacacttcataaactgggatctgcagatgtactacgctgaaaaggacactcctgccaaggcaagaacaacaacattgaatgaacaattgggacagatacactacatattcagcgataagactggcacactgacacagaatattatgacctttaagaagtgctgcataaatggacagatctatggcgaccacagggacgcgagccagcacaaccataacaagatcgaacaggtcgacttttcgtggaatacctatgccgatggcaagcttgcattttatgaccactatctgatcgaacagattcaatcagggaaagaaccagaggtgcgacagttcttctttctattggccgtctgtcatacagtgatggtggataggacagatggtcaactgaactaccaggcagcctcccctgacgagggggccctggtcaatgcggccaggaacttcggatttgcctttctcgccagaacccagaatacgatcaccatttccgagttgggcacagagagaacgtacaatgtcctcgccattctggattttaactccgatcgcaagcgcatgagcattatcgtacggacacccgaggggaatataaaactctactgcaagggcgcagacaccgttatttatgagaggttgcaccgcatgaatcccactaaacaggagacccaagacgcactggatatattcgctaatgagacacttcggacgctgtgtttatgctataaagagattgaagaaaaggaattcacggagtggaacaagaaattcatggccgctagcgtggcatctaccaaccgggatgaggcccttgataaggtgtatgaagaaatcgaaaaggatctgatcctgctcggggccacagcaattgaagacaaactgcaggacggcgtgccggaaaccatttcgaagctggccaaggccgacatcaaaatatgggttctgacgggggacaaaaaggaaacggcagagaatataggattcgcatgcgaactgctgactgaagacaccaccatatgctatggcgaagacattaacagcctcctacacgccagaatggaaaatcagcgtaaccgggggggcgtgtacgctaaatttgcaccccccgtgcaggagtccttcttcccaccaggagggaatcgggcactgatcatcaccggcagttggctcaatgaaattctcctcgagaagaaaaccaagagaaacaagattctgaaattaaaatttcctaggacagaggaagagagacgtatgcggactcagagtaaaaggaggctagaagcaaagaaggaacagagacagaagaattttgtggacctggcctgtgaatgcagcgccgtgatctgctgcagggtcacaccaaagcagaaagcgatggtggtcgacttagttaaacgatacaagaaagccatcaccctggcaatcggggacggtgccaatgatgtgaatatgataaagacagctcacatcggagttggcatatctgggcaagagggcatgcaggctgtgatgagcagcgattattcattcgcgcagttccgatatttgcagcggcttttactcgtgcacggacggtggtcttatatcaggatgtgtaagtttttgaggtatttcttttacaagaattttgcgtttacgctagtccacttctggtactctttcttcaatggctacagtgcacagacggcctatgaagactggttcattactctctataatgtgttatatacctctctacccgtcctgctgatggggctgctggatcaggatgtctctgacaagttatcgttacgttttccaggcttgtacatcgtgggccagagggacctgctgtttaactataaacggttcttcgtgtctctccttcacggcgtacttacctcaatgattctcttcttcattcctctgggcgcctatttacagacagtcggtcaagacggcgaagccccaagtgattaccagtcctttgccgtcaccatcgcgagcgctctggtcataactgttaacttccagattggcttggatacgtcttattggaccttcgtcaacgcctttagcatctttggtagcatagcactctacttcggtatcatgttcgactttcactctgcaggaatccatgtactctttccgagtgcatttcagtttactggaactgcatcgaacgctctgcgacaaccttacatctggctcaccatcattctcgctgttgcggtgtgcttactcccggtggtggcgatcaggttcctctccatgaccatctggccctccgagtcagacaaaatccagaagcaccggaaaagattgaaggctgaggagcagtggcagcgtaggcagcaggtgtttcggagaggcgtatcgacacgtcggtcggcctatgcgttttcccaccaacggggatatgcagacttgattagtagcgggcgctccattcgcaagaaacgctctccactcgacgctatcgtcgccgacggtactgccgaatacagacgcacaggcgactct

SEQ ID NO: 7351 - DNA, 3753 bp, Artificial Sequence
  Description of Artificial Sequence: Synthetic coding sequence
atgtctaccgaacgggatagcgaaactaccttcgacgaggattcccaaccaaacgacgaggtggtgccgtactccgatgacgagactgaggacgagctcgacgaccaaggatcagccgtggaaccagaacagaacagagttaaccgagaagctgaagagaatcgggaaccgtttaggaaggaatgcacttggcaagtcaaagccaatgatcgcaaataccatgaacagccccacttcatgaacactaagtttttgtgcatcaaagaaagcaagtacgctaacaatgctatcaagacgtacaagtacaacgcgttcaccttcatcccgatgaacctgtttgagcagttcaagagagccgccaatctttacttcctcgccctcctgatactgcaggcggtgccacaaatctccactctggcctggtacactactttggtgccgctcctggttgtcctgggcgtcacggctatcaaagaccttgtcgacgatgtggctagacacaagatggataaggagattaacaaccgcacgtgtgaagtgatcaaggacggccggttcaaagttgcgaagtggaaagaaattcaggttggagacgtgatccgcctcaagaagaacgacttcgtgccagctgacattctcctgctgagctcaagcgaacctaattccctctgctatgtggaaaccgccgaactggacggcgagacgaacctcaagttcaagatgtcccttgagattaccgaccagtacctgcagcgcgaggatactttggcaacttttgacggtttcatcgaatgcgaagaacccaacaacagactggacaagtttaccgggacgctcttttggagaaatacctctttcccgctggacgcagacaaaatcctgctccgcggatgtgtgatcagaaacacggacttctgccacggccttgttatcttcgctggagccgacaccaagattatgaagaattcaggaaagacgcgctttaaacgcacgaagatcgactacttgatgaattacatggtgtacactattttcgtggtgctcatcctgctgtctgcgggacttgccatcggccacgcgtactgggaagcccaagtgggcaattcgagctggtacctctacgatggggaagatgataccccatcataccgcgggttcctcattttctggggatacatcatcgtgcttaacaccatggtccccatctccctgtacgtgagcgtggaggtcatcaggctcggtcagtcgcacttcatcaactgggatttgcaaatgtactacgcggagaaagacaccccggccaaggcgagaactaccaccttgaatgagcagctcggacaaatccattacatcttcagcgataaaactggcactctcactcaaaacatcatgacttttaagaagtgctgcatcaatggacaaatctacggcgaccaccgtgacgcttcgcaacacaatcacaacaagatcgagcaagtggatttctcatggaacacctacgcagatggaaagctggctttctatgaccactacctgattgaacaaatccagagcgggaaagaaccggaagttcgccaattcttcttcctgctcgcagtgtgccataccgtgatggtggatcggactgacggccaactcaactaccaggctgcgtcaccagatgaaggtgcattggtgaatgcagcgcgcaatttcggcttcgccttcctggcgagaacccagaataccatcaccatttccgaacttggaaccgaacggacttacaacgtgctggcgatcctggactttaactccgatcgcaaacggatgtccataatcgtgagaaccccggaagggaatatcaagctgtactgcaaaggagcagatacggtcatctatgaacggctgcacaggatgaacccgaccaagcaagagactcaggatgcactggacattttcgccaatgagacgctcagaaccctctgtctgtgttacaaagagatcgaggaaaaggaattcacggaatggaacaagaagtttatggcggcttcggtcgcctccaccaatcgggacgaagcactggacaaagtgtatgaggaaatcgagaaggacctgatcctgctgggagcgacggccatcgaagataaactgcaagacggcgtgccagaaactatctccaaactggccaaggcagacatcaaaatctgggtcctcactggagataagaaagaaactgctgagaatatcggattcgcatgcgagctgctcactgaagataccactatctgctacggagaggatatcaacagcctcctgcacgccaggatggagaaccagcgcaacagaggcggcgtgtatgccaagttcgctccgccggtgcaagaatcattcttccctcctggtggcaatagagcactgattatcactggctcgtggctcaacgagatcctgctcgagaagaaaaccaaaagaaacaagatcctgaagttgaagtttccgcgcaccgaggaagaaaggcgcatgcgcactcaatccaaaagaaggctggaagccaagaaagaacaacgacaaaagaacttcgtggatctggcttgcgagtgttccgctgtgatctgctgccgggtgacgccgaagcagaaggcaatggtagtggatctcgttaagagatataagaaagcaatcactctggcaattggagacggagcaaacgatgtcaacatgatcaagaccgcccatatcggagtgggaatcagcggacaagaagggatgcaggctgtcatgagctccgactactcctttgcgcagttcagatatttgcagagactcctcctcgtgcacggaaggtggtcgtacattcgcatgtgcaagtttctcagatacttcttctacaagaatttcgcgtttaccctggtgcatttctggtactcctttttcaatggttactctgcccaaactgcctacgaggactggtttatcactctgtacaacgtcctgtacacctctttgcctgtgctgctgatgggactcctggaccaggacgtgtctgataaactctccctgagatttccgggactgtacatcgtggggcaacgggacctgctgttcaattacaaacgcttcttcgtgtcgcttctgcatggcgtgctgacctcgatgatcctcttcttcatcccgctgggggcctacctgcagactgtggggcaggatggtgaggctccgtcagactaccagtccttcgcagtgaccatcgcctcggcgctcgtcatcactgtgaatttccaaatcggactcgatacttcctattggaccttcgtgaacgccttctccatctttggatcgatcgcgctctactttggaatcatgttcgatttccacagcgccggaatccatgtgctcttcccttcagcctttcagtttaccggtactgcctccaacgctctccgccagccgtacatctggctgaccatcatcctggccgtcgccgtgtgtctgcttccggtggtggccatccgattcctgtcaatgactatctggccatcggaatccgacaagatccagaaacacagaaagagactcaaggctgaggaacagtggcagaggagacagcaggtctttcgtcggggagtctccacgcggcgctcggcgtacgccttctcacaccagcgcggctacgcagacctgatctcgtcgggacggagcatccgcaagaagagatcgccactcgatgccatcgtcgcagatggaaccgccgaataccggcgcactggagacagc

SEQ ID NO: 7352 - DNA, 3753 bp, Artificial Sequence
  Description of Artificial Sequence: Synthetic coding sequence
atgagcactgaaagggatagtgagacaacgttcgatgaggattctcagccgaacgatgaggtggtaccctattctgatgatgagacagaagatgagttggacgatcaggggtcggctgtggagcctgaacagaaccgggtgaaccgtgaagctgaggagaatcgagaacctttcaggaaggaatgtacttggcaggtcaaagcaaatgacaggaagtaccacgagcaaccccacttcatgaataccaaatttctatgcattaaagagtcaaagtacgccaacaacgcgattaaaacgtataagtacaacgcctttacattcataccgatgaacctgtttgagcagttcaagagagccgcgaatctttatttcctggctttgcttatactgcaggccgtgccccagatcagcacactcgcctggtacaccaccttggtcccactcctcgttgttctgggagtgacagccattaaggacttagtggacgatgtcgcaaggcataaaatggataaggaaatcaacaaccgcacatgtgaggtgatcaaagacggcaggttcaaggtggctaagtggaaagagatccaggtgggggatgttattaggctgaagaagaatgactttgtgcctgctgatattttgctgctttcctcttcggagccaaactctctctgttatgttgagaccgccgaattggatggagagaccaacctgaagttcaagatgtccttggaaattactgaccaatacctccagcgcgaggacacattggcaacctttgatggctttatcgagtgcgaggagccaaataataggcttgataagtttacaggcacgttgttttggcgaaacacatcatttccgctggacgccgacaagatcttgctacgtgggtgcgtgatccggaacactgatttctgtcacggacttgtcatattcgccggtgcggacacaaagatcatgaaaaatagcgggaagacgaggttcaagcgcactaagatcgattatctaatgaattacatggtctacacaatcttcgtggtacttattctgctttcggcaggtttggcgattggccatgcttattgggaagcccaggttggcaattccagctggtacttgtatgacggagaggacgacactccttcatacagaggatttcttatcttctggggctacatcatcgtcttaaataccatggtacccatcagtctttatgtgtcagtggaagttataagactggggcagtctcatttcatcaattgggatcttcaaatgtattacgccgaaaaagacacccctgcaaaagcacgtaccaccacactgaacgaacagctggggcaaatccattacatattctccgataagacgggcactttaacccagaatatcatgacttttaaaaaatgctgcatcaacggccaaatctacggtgaccaccgcgacgcctctcagcataatcacaacaagatcgaacaggtggatttttcctggaatacgtacgcggatggcaaattagctttctacgatcactatctgatcgagcaaatccaaagcggtaaagagcccgaggtacgccagttcttctttctcctggccgtgtgccataccgtgatggtggaccgtaccgacggccaactcaactatcaggccgctagtcccgacgagggggccctggtgaacgctgccaggaatttcgggttcgcattcctggctcggacgcagaacacgatcacaatctccgaacttgggactgaacggacttacaatgtgctggccatcctggattttaattcagaccgtaagaggatgagcattattgtcaggacacccgagggcaacatcaagctgtattgtaagggcgccgatacagtgatctacgaacggctgcaccggatgaacccaacaaagcaggagacacaagatgcattggacatttttgctaacgaaacactgcggacactgtgtctgtgctataaggaaattgaggagaaggagttcacagagtggaacaaaaaatttatggcggcgagtgtcgccagcacgaatcgggacgaagccctggacaaggtgtatgaagagatcgaaaaggacctgatcttgctgggcgctacagccattgaggacaagctgcaggacggagtccccgaaactataagcaaactggcgaaagcagacattaagatctgggtgctgactggggacaagaaagagacagctgagaatatagggtttgcctgtgaactgctcactgaagacacgactatttgctacggcgaggatatcaactctctactgcacgccagaatggagaatcagagaaatcgtggcggcgtgtacgcaaaattcgctccgcccgttcaggagagcttcttcccacccggaggcaatagggcactgataatcaccggaagttggctcaatgaaattttgttagaaaaaaagacaaaaaggaataaaattttgaagctaaaatttccccgtactgaagaagagaggagaatgagaacccagagtaagcgacgcctggaagctaagaaagaacagcggcagaaaaactttgtagacttagcctgtgagtgttccgcggttatttgttgccgggtgacgccgaagcagaaggctatggtggttgatctggtaaagaggtataagaaggccattacattggccatcggcgacggggctaatgacgtgaacatgattaagaccgcccacatcggggtcggcataagcggacaagaaggaatgcaggcagtgatgagcagtgactatagcttcgctcagttccgctatctgcaacgtctactccttgttcacggacgttggagctatattagaatgtgtaagtttctcagatattttttctacaagaactttgcatttaccctcgtccatttttggtacagcttctttaatggctattccgcacaaaccgcgtacgaggactggtttattaccctctacaacgttctctacacatctcttccagtcctgttgatgggcctgctggatcaggatgtgagcgataagctctcccttcggtttccaggtctttatatcgttggacaaagggatctgcttttcaattataaaagatttttcgtcagcctgttgcacggtgtgctgacctccatgattctgttctttatcccacttggcgcatatctgcagactgtcggccaagatggagaagctccgtccgattaccagagcttcgcggtgaccattgcatccgcgctggtgataaccgtgaactttcagatagggctggacacaagctactggactttcgttaatgccttttccatcttcggcagtattgctctttactttgggattatgttcgacttccacagtgccggaatccacgttctcttcccaagcgcttttcaatttactggtaccgcaagtaatgcactgcggcaaccctacatatggttgactatcatccttgctgtcgcagtatgcctcctgccagtcgtggcaattcgttttctgtctatgacaatctggccatccgaatccgataagattcagaaacaccgcaaaagactgaaagccgaagagcaatggcagagacgtcagcaggtgttcaggcgaggagttagtacaaggcgctcggcgtatgcgttctcgcaccagagaggctacgcagatctgatttcctccggccggtccatcaggaaaaagcgatctcctcttgacgccatcgtggcggacggcacagctgagtacaggaggaccggtgactcc

SEQ ID NO: 7353 - DNA, 3753 bp, Artificial Sequence
  Description of Artificial Sequence: Synthetic coding sequence
atgtccaccgaacgggattccgaaaccacctttgacgaagattcccagcctaatgatgaggtggtcccgtactccgacgacgagactgaggacgaactggatgatcaaggaagcgccgtcgagccagaacaaaatagagttaatagagaagccgaggagaacagagaaccgttccggaaagagtgcacctggcaagtcaaggcaaacgaccgcaagtaccacgaacagccgcacttcatgaacactaaattcctgtgcattaaagagtccaaatacgccaataatgccattaagacctacaagtataatgccttcactttcatcccgatgaatttgtttgaacagttcaagcgcgccgccaacttgtacttcctggcgctgcttattcttcaggctgtgccacaaatcagcacgctggcttggtataccactctggtcccgctcctggtggtcttgggagtgaccgcaatcaaggacctcgtggacgacgttgcgagacataagatggacaaagagattaacaacagaacctgcgaggtgatcaaggatggacgctttaaagtggcgaaatggaaagagatccaagtgggagacgtgatccgcctgaagaaaaacgattttgtcccggcagacatcttgctgttgtcctcttccgagccaaattctctctgctacgtggaaaccgctgagttggatggagagacgaatctgaagttcaagatgtccctcgagattaccgaccaatacttgcagagggaagataccctggccaccttcgatggctttatcgaatgcgaggaaccgaacaaccggcttgataagttcaccggaactctgttctggagaaacacgtccttcccactggatgccgacaaaattctgctccggggctgcgtgatccggaacaccgatttctgccacggactggttatcttcgcgggagcagacactaagatcatgaagaattccgggaaaactcgctttaagaggacgaagatagattacctgatgaactacatggtgtacactatctttgtggtgctcatcctgctgagcgctgggcttgccatcggtcacgcctactgggaagcccaagtgggtaacagctcgtggtacctttacgatggagaggacgacactccaagctatcgcggctttctgatcttttggggatacatcattgtgctcaacaccatggtgcccattagcctttatgtgtccgtggaagtgatcagactgggccagagccacttcattaactgggatctgcaaatgtattacgcagagaaggatacgccagccaaagcgaggacgactaccctgaatgaacaactcgggcagatccactatatcttctcggataagactggaaccctcactcagaatatcatgacttttaagaaatgctgcatcaacggacagatctatggcgaccatcgcgacgcgtctcaacacaaccacaataagatcgagcaagtggatttttcgtggaacacgtacgcggacggtaaattggccttctatgaccactacctcatcgagcagatccaaagtggcaaggagccggaggtcaggcagttcttttttctcctcgcggtatgccatacggtcatggtcgatcgaaccgacggccagctgaattaccaggcggccagcccggatgaaggagccctggttaacgcggcccgcaactttggttttgctttcctggccagaactcagaacactatcaccatttccgagctgggaaccgagagaacctacaacgtgttggctatcctggacttcaattcggatcgcaaacgcatgagcatcattgtcagaactcctgaggggaatatcaagctgtactgcaagggggcagacacggtgatctacgaacggctgcataggatgaacccgactaagcaggagacgcaagacgctctggatatctttgccaacgaaactctccggactctgtgcctgtgctacaaggaaatcgaagagaaggaattcactgagtggaacaaaaagttcatggccgcttcggttgcgtcaactaaccgggatgaagcgctggacaaggtgtacgaggaaattgaaaaggatctcatcctgcttggggccaccgccatcgaagataagctgcaggatggagtgccggaaaccatttccaagctcgcgaaggccgacattaagatctgggtcctgacgggcgacaaaaaggaaaccgccgaaaacatcggattcgcgtgcgagctgctcactgaggatactactatctgttacggagaagatatcaactccctcctgcacgctcgcatggaaaaccagcgcaatagaggaggagtgtacgccaagtttgcccctcctgtccaggaatccttcttcccgcctggggggaacagggcgttgatcatcaccggttcgtggctgaacgagatcctgctcgaaaagaaaaccaaacggaataagatcctgaagctgaaattccctcggacggaagaagaaaggaggatgcggactcagagcaagcgccggttggaagcaaagaaagaacagcgccagaagaatttcgttgacttggcctgcgagtgttcagcggtgatttgctgtcgggtgaccccgaagcagaaagcaatggtcgtggatttggtgaaacggtacaagaaagcgatcacccttgcgatcggagacggtgcaaacgacgtgaacatgataaagaccgcccacatcggcgtgggcatctcgggtcaggagggaatgcaggcggtgatgtcgtccgactacagcttcgcgcaattccgctacctgcagaggctcttgctggtccatgggcggtggtcctacattagaatgtgcaaattcctgcgctatttcttctataagaactttgcgttcaccctggtccatttttggtactcattctttaacggctacagcgcacaaactgcatacgaagattggttcatcaccctttacaacgtgctttacacttccctccctgtgctgctcatgggactcttggaccaagatgtctcggacaagctgtcactccgcttcccgggactctacattgtgggtcagcgcgacctgctctttaactacaagcgatttttcgtgtcgctgctccacggagtgctgacctcgatgattctcttctttatcccgctgggtgcctacctgcagaccgtgggccaagacggagaggctccgtccgattaccagtcgttcgccgtgaccatcgcttctgcactggtgatcactgtgaacttccagatcgggctggacacctcctactggactttcgtcaatgccttctcgatcttcggatccatcgctctctactttggcatcatgttcgacttccattccgcagggattcacgtgttgttcccgtccgcattccagttcactggaaccgcatccaacgcactgcgccagccttacatctggctgaccatcatcttggcggtcgcagtgtgcctgctgcctgtggttgcaatccgcttcctctctatgaccatctggccgtcagaatctgacaagatccagaagcatagaaaacgactcaaggcggaagagcaatggcaacggcggcaacaagtattcaggcggggagtgagcacgcgccgctcagcgtacgcttttagccaccagcgcggttacgccgacctcatcagctccggacgcagcatcagaaaaaagaggtccccgctggacgccatcgttgcagatggaactgctgaataccgtcggaccggagactca

SEQ ID NO: 7354 - DNA, 3753 bp, Artificial Sequence
  Description of Artificial Sequence: Synthetic coding sequence
atgtccaccgaacgagattccgagactaccttcgacgaagattcccagccaaatgatgaggtcgtgccttactcggatgacgaaactgaagatgaactggatgatcagggctccgcagtcgagcctgagcagaacagagtcaaccgggaggcagaagaaaaccgtgaaccattccgaaaggaatgtacttggcaggtcaaagcaaacgacaggaagtaccatgagcagccacatttcatgaacactaagttcctgtgtattaaggaatcaaagtacgcaaacaatgccatcaaaacgtataagtacaacgcctttaccttcattcccatgaacctttttgaacagtttaagagagcagctaatctttactttctggctctcctcatcttgcaggctgtcccccaaatctctacccttgcatggtacaccactttggtgccactgctggtggtcctgggcgttaccgccatcaaggatcttgtggacgacgtggcaagacataagatggataaagaaatcaacaacagaacttgtgaagtcatcaaggatggtagattcaaagtcgccaaatggaaggaaattcaggtcggagatgtcatcagacttaagaagaacgactttgtgcctgctgatatcctgcttctcagctcctcggaaccaaactctctgtgttacgtggagactgccgaactggacggcgaaaccaatctgaagtttaagatgtctcttgagattaccgatcagtacctgcaaagagaggatactcttgcaacctttgatggattcatcgaatgcgaggagccaaacaacaggctcgataagtttaccggcactcttttttggcggaacacctcgttcccactggatgccgacaaaattcttctgcgtgggtgcgtgatccgcaacaccgatttttgtcacggactggtgatttttgccggcgcagatacgaaaatcatgaagaattccgggaaaactcggtttaagagaactaagattgactaccttatgaactacatggtctacaccattttcgttgtgttgatcctgctgtccgccggactggcaatcggacacgcatactgggaagctcaagtcggaaattcatcatggtacctgtacgatggagaggacgatacccctagctatcgaggtttccttatcttttggggatacataattgtgcttaacactatggtgccaatctcgctctacgtgtcagtggaagtgatacgtcttggacagtcgcactttatcaactgggatctgcagatgtactatgcggaaaaggatactcctgcgaaagccagaactaccacccttaacgagcagcttggacaaattcactacattttctctgataagactggcactcttactcagaatatcatgaccttcaagaaatgctgtatcaacggtcagatttacggcgaccatagagatgcaagccaacataaccacaacaagatcgaacaagtggatttctcatggaacacctatgctgatggaaaacttgccttttacgatcattacctcatcgaacaaatacagagcggaaaggaacctgaggtgagacagttcttttttctgctggcagtgtgtcatactgtgatggtggaccgcactgatggacaactgaattaccaggccgcgagccccgacgaaggagcactcgtgaatgcagcccgcaactttgggttcgcgtttcttgcgagaactcagaacactattactatctcggagctcggtactgaaagaacttacaatgtgctcgcaattctggatttcaactcggatagaaagcgaatgtccattattgttaggactcctgaaggcaatatcaaactttactgtaagggagcagataccgtgatctacgagcgacttcatagaatgaacccaactaagcaagagactcaggacgcccttgatatcttcgcaaatgaaactcttaggaccctttgcctgtgttacaaggaaatcgaagagaaggaatttaccgagtggaacaagaagtttatggcagcatcggtggcatcgactaaccgggacgaagcacttgataaggtgtacgaagagatcgaaaaggatctcatacttctgggggcaactgcaattgaagataagctccaagacggtgtcccagaaactatttcgaagctcgcaaaagccgacataaagatatgggtgctcaccggagataagaaggaaacggcagagaatatcggtttcgcatgtgaacttcttactgaagatactactatttgctacggggaggacattaactccttgcttcacgcgcggatggagaaccaaaggaaccgcggcggggtctacgctaagtttgcacctccagtccaggaatcattctttccacctggcggcaatcgggcactgatcataactggcagctggctgaacgaaattctgctggagaagaaaaccaaacgtaacaagatacttaaacttaagttccccagaactgaagaagaacgaagaatgagaacccaaagcaaaaggcgccttgaagccaagaaggaacagcggcaaaagaattttgtggacttggcatgtgaatgttcggcagtgatctgttgtcgggttaccccgaagcagaaagccatggtcgtggatctcgtgaagcggtacaagaaggctatcaccctcgcaattggtgacggagcaaatgatgtgaatatgataaagaccgcgcatataggtgtgggtatttccggtcaggaaggtatgcaagctgtcatgtcctccgattactcatttgcacagttccggtatttgcaacgactccttttggtgcatggtcgctggtcgtacattaggatgtgtaagtttctgcgctactttttctacaagaattttgcattcaccttggtgcacttttggtattccttctttaatggatacagcgcccagaccgcgtacgaagattggttcatcactctctataatgtgctgtacacttcgcttccagtgcttctgatgggcctcctggatcaagacgtctcagataagctgtccctgcggttccctggactctacatcgtggggcagcgagatctgctgttcaattacaaaaggttctttgtgtccttgctccatggtgtgcttactagcatgatcctgtttttcattccacttggggcatacttgcagaccgtgggtcaagacggcgaggcgccatcggattaccaatcatttgcagtgaccatcgcgtcagcacttgtgattaccgtgaactttcaaattggtctggatacttcgtactggactttcgtgaatgcattttctatctttggctcgatcgcattgtactttggaattatgtttgattttcatagcgccggaattcatgtgctgtttccttccgccttccaatttactggcaccgcatccaatgcactgagacagccttatatctggctcaccatcatccttgcagtggcggtctgtctccttcctgtggtggccattcggtttctctcgatgaccatctggccgagcgagagcgacaagatccagaagcacaggaagaggctgaaagcagaagaacaatggcaaaggcgccaacaagtgtttcgcaggggggtgtcaacccggcggtcggcatacgcattttcccatcaaagaggctacgcagacctgatttcgagcggaaggtccatcagaaagaagcggagccccctggacgccatcgtggcagacggaaccgcggagtatagacggaccggagattcg

SEQ ID NO: 7355 - DNA, 3753 bp, Artificial Sequence
  Description of Artificial Sequence: Synthetic coding sequence
atgagcaccgaacgtgactcggagactactttcgacgaagattcgcagcccaatgatgaagtggtgccttattccgacgatgaaaccgaagatgaactggacgatcagggtagcgccgtcgaaccagaacagaaccgggtcaacagggaagccgaagaaaatcgtgagccctttcggaaagagtgcacttggcaagtgaaggcgaacgacaggaagtatcacgaacaaccacactttatgaacaccaaattcctctgcataaaggagtcgaagtacgcaaacaacgcaattaagacctacaaatacaacgccttcacgtttatccctatgaaccttttcgaacagttcaaacgtgccgcaaacctgtactttcttgcccttctcattctgcaggcagtgccccaaatttccactctcgcatggtacaccaccctcgtgcctctgctggtcgtgctgggagtgactgcaatcaaggacctggtggatgatgtggcacggcacaaaatggataaagagatcaataatcgtacttgcgaagtgatcaaggacggacggtttaaagtggctaagtggaaggaaattcaggtcggggatgtgatccggctcaaaaagaacgactttgtgcctgcagatatcctccttctgtcctcatcggaaccaaattcgctttgctacgtggagactgcagaactggatggcgaaaccaacctgaaattcaaaatgtcgcttgaaatcactgaccagtacctgcaaagagaagatactctggccaccttcgatggttttatcgagtgtgaggaacctaataacagactcgacaagttcaccggaacccttttttggagaaacacctcgttccctctcgacgccgataagatccttttgcgcggttgtgtcatccgtaacactgacttttgtcatggactggtgattttcgcaggagcagatactaagattatgaagaattccggaaagacccgctttaagagaactaagattgactatctgatgaattacatggtgtacacgatttttgtcgtgcttattcttctttcggcgggcctggccattggccatgcatactgggaggcccaggtgggtaattcctcctggtacctctatgatggagaagatgacactccttcctataggggttttttgatcttttggggatacattatagtgctgaacactatggtgccaatcagcctgtacgtctcagttgaagtgattagacttggacaatcccactttatcaactgggatttgcagatgtactacgcagagaaggatactccagcaaaggcaagaactaccaccctgaatgaacagctgggacaaattcattacattttctcagacaagaccggtaccctgacgcagaacataatgactttcaagaagtgctgtattaacggccagatttacggggaccatcgtgatgcctcgcaacataaccataacaaaatagaacaggtggatttcagctggaatacctacgcagacggaaagctggccttctacgatcattaccttattgagcagattcaatcgggtaaggaaccggaagtgagacagtttttctttttgcttgccgtgtgccacaccgtgatggtggacagaacggacggacaacttaactaccaggcagcgagccctgacgaaggtgctttggttaatgcagcaagaaactttggttttgcattcctggcccgcacccagaacactattaccatttccgagttggggaccgaaagaacttacaacgtgctggccatacttgacttcaattccgatagaaagaggatgagcatcattgtcagaactcccgaaggtaatatcaaactgtactgtaagggtgcagatactgtgatatacgagaggcttcaccgcatgaacccgactaagcaagaaacccaggatgcacttgatatctttgccaatgaaactttgagaacgctttgtctttgttacaaagagattgaagagaaagaattcactgaatggaataagaagtttatggctgcgtcggtcgcatcaactaatcgagatgaagcattggacaaagtgtatgaagagattgaaaaggacctgatccttctcggtgcaaccgccattgaggacaagctgcaggacggagtcccagaaactatatcaaaacttgcaaaggcggatatcaagatatgggtgctcaccggagacaaaaaggaaaccgcagagaacatcggatttgcctgtgaacttctcaccgaggataccaccatctgttacggggaggacattaactcattgctccatgcaagaatggaaaatcaacgaaatcgtgggggtgtgtacgcaaagttcgctccgcctgtccaggagtcgttttttccccccggcggaaaccgcgctcttatcattaccggatcctggttgaatgaaattctcctggaaaagaaaactaagagaaacaagattctcaaattgaaatttcctcggactgaggaggagagacgaatgcgaactcaatcgaaacggagactcgaggcaaagaaggagcagcggcagaaaaactttgtcgatcttgcatgtgagtgttcggccgtcatttgttgtcgggtgacccctaagcagaaagcaatggtcgtggatctggtgaagaggtacaaaaaggccatcacccttgcaattggagatggagctaatgatgtgaacatgattaagactgcacacataggagtgggtatttcgggtcaagagggaatgcaagcagtgatgtcgtcagattacagctttgcacaatttagatacctgcagagattgcttcttgtgcacggacggtggtcatacatcagaatgtgtaaattcctgcgctactttttctacaagaattttgcattcaccctcgtgcatttctggtacagcttcttcaacggttactcggcccaaaccgcatacgaagattggttcattactttgtacaatgtcttgtacacttcgctgccagtgctccttatggggcttctggaccaagatgtgtcagataagctctcgctgagattcccaggtctgtacattgtcggtcaaagagatcttcttttcaactataagcgctttttcgtgtcacttctgcatggagtcctgaccagcatgattctcttctttattccacttggcgcatatctgcaaacggtggggcaagatggagaggcaccttccgactaccaatccttcgcagtgactattgcatcggcacttgtgatcactgtcaacttccagataggcctggacacttcgtactggacctttgtgaacgcattttccatatttggtagcatcgctctttactttggcatcatgttcgacttccactccgcaggtatccacgtcctttttccttccgctttccaatttactggcactgcctcaaatgcactgaggcagccttacatatggctcaccattatcctggcagttgcagtgtgtctcctgcctgtcgtagcgatcagatttctctccatgaccatctggccaagcgaatccgataagattcagaaacatagaaagcgactcaaagcagaggaacagtggcagagaaggcagcaagtgtttcgtcgtggcgtctcgactagaaggagcgcatacgcattctcacaccaaaggggttacgcagacttgatctcgagcggccgtagcattagaaagaagaggagcccactcgatgctattgtggcggatggcacggcagaatacaggagaactggagattcc

SEQ ID NO: 7356 - DNA, 3753 bp, Artificial Sequence
  Description of Artificial Sequence: Synthetic coding sequence
atgtctaccgaacgggacagcgagaccacatttgacgaggactcccagccaaacgacgaggtggtgccttattctgatgatgaaacagaggatgaactggacgaccagggatctgctgtggaacccgaacagaatagagtgaatcgggaggcagaagagaatagggaaccatttcgcaaagagtgcacctggcaggtgaaggccaacgatagaaagtaccacgaacagccccatttcatgaatactaaattcctgtgcattaaggagagcaagtatgccaataacgccattaaaacctataagtacaatgcatttacctttatccccatgaacttgttcgaacaattcaaacgggccgccaacctgtattttctcgcgcttctgattttgcaggctgtccctcagattagtacgctggcctggtatactacattagtgccattgttagtcgtactcggcgtgaccgccattaaagacttggtagatgatgtagcgaggcataagatggacaaagagataaacaatcggacttgtgaagtaattaaagacggaagatttaaagtcgccaaatggaaagaaatccaggtcggggacgtcatccggctcaagaagaacgacttcgtgcctgccgatattctcttacttagtagtagcgagccgaactctttgtgttatgtcgaaaccgctgagctagatggagagacaaaccttaaattcaaaatgtcgctcgagattacagatcaatacctgcagagagaggataccctggccacatttgacggctttatagagtgcgaagagcctaataataggttagacaagttcactggtaccctattttggagaaacacttcattccccctggacgctgacaagatattgttgcgggggtgcgtgatccggaacacggacttctgccacggccttgtcatcttcgccggagccgacactaaaataatgaaaaactctgggaaaaccagatttaagaggacgaagatagattacttgatgaactatatggtatacaccatcttcgtcgtcttgatcctgttgagcgcaggcctcgccattgggcacgcctactgggaggcccaggttggaaattctagctggtatctgtacgacggcgaggacgataccccgtcttaccgcggatttctaatattctggggttatattattgtgctgaacactatggtgcccatatcactgtatgtgagcgttgaagtgatcaggttggggcagtcccatttcatcaattgggatttgcaaatgtactatgccgagaaggatacacctgcaaaagctcgcaccactactctgaatgagcagctgggtcagatccattacatcttctccgacaagacaggaacactgacacagaatatcatgacctttaaaaagtgctgcattaatggccagatctatggagatcaccgggatgcgagccaacataaccacaacaaaatcgagcaagtcgatttctcctggaatacatatgcagatggaaagctcgctttctacgaccattacttgatagagcaaatccaatccgggaaggaaccagaggtgcgccaattctttttcttgctggctgtatgccataccgtcatggtggatagaacggacggtcaactgaattaccaagccgctagccctgatgagggcgccttggtcaatgccgcccgcaactttggattcgccttcctcgccaggacgcaaaacaccattaccatctctgagctgggaactgagcgaacatataatgtgcttgccatcttggattttaactccgacagaaaaaggatgtcgatcatcgttcggacccccgagggaaacataaagctgtattgcaagggcgctgacacagttatatatgagaggctccacagaatgaatcccaccaagcaagaaacccaggacgccctggacatcttcgccaacgaaaccttacgcactctgtgcctctgttacaaggaaatagaagagaaggagtttaccgaatggaacaagaaattcatggcagcatccgttgcctccactaacagggacgaggctctggacaaagtttatgaggaaattgaaaaagatttgatcttgctaggtgctactgcaatcgaggataagcttcaggatggtgtgccggagaccatttccaagctggccaaagccgacataaagatctgggtgctcacaggggacaaaaaggagaccgccgaaaatataggattcgcttgcgagttactgacagaagatacaaccatctgctacggcgaggatataaactctttgttgcacgcgagaatggagaatcaacgtaacagaggcggcgtgtatgccaaatttgccccccccgtgcaggaaagtttttttcccccggggggcaaccgagccctgatcattaccggttcatggctgaacgaaattctcttagaaaaaaaaacaaaacgcaacaaaatcctgaaacttaagtttcctagaactgaggaggagagacggatgcggacccagtccaagagacgccttgaggctaaaaaggaacagaggcagaagaatttcgtcgacctcgcttgcgagtgttcagcagtgatatgctgtcgcgtgacacctaagcaaaaagccatggtggtggacttggtaaagagatacaagaaagccatcaccttagctattggcgacggcgctaacgacgtcaacatgatcaagacagcccacatcggcgtcggaatctctggccaggagggcatgcaggccgtaatgtccagtgactactcttttgcgcagttcaggtatctacagagactgctgctggtacacggtcggtggtcttacatccggatgtgcaaatttttgcgatatttcttttacaagaactttgctttcacacttgtgcatttctggtacagcttctttaacggctactcagctcaaaccgcatacgaggactggttcatcaccctgtacaatgtgctgtatacatctctgccagtgctcctaatgggcctcctagaccaggatgtttccgacaagttgtccctgagattccctgggttatatatcgtgggccagcgcgatttgttgttcaattataaaagatttttcgtttctcttctgcacggcgtcttgacctctatgatcctcttcttcatccccttgggtgcctacctgcagacagtggggcaggacggagaggcaccatcagattaccagagtttcgccgtgacaatcgcatcggccttggttattacagtgaatttccagattggattggatacctcatattggactttcgtcaatgcgttctccatcttcgggtccatcgctctgtacttcggtataatgttcgattttcacagtgccggaatccacgtgctgttcccctctgccttccagttcaccggaacggcctctaatgccctcagacaaccctacatctggctgaccattatactcgctgtggccgtgtgtctcctgcctgtagttgccattcgcttcctatccatgaccatatggccttccgagagcgataagatacagaagcaccgcaaaagactcaaggctgaagagcagtggcagcgccggcagcaggtgttcagacggggggtcagcaccagacgctccgcttacgcattctctcaccagaggggctacgccgatctgattagtagtggccgcagcatccggaaaaaacgcagccctctggacgcaattgtagccgacgggacggcagagtatcggcggaccggcgattca

SEQ ID NO: 7357 - DNA, 3753 bp, Artificial Sequence
  Description of Artificial Sequence: Synthetic coding sequence
atgtcaactgaaagagatagtgaaacaacttttgacgaagatagtcaaccaaacgatgaagtagtaccttattctgatgatgaaactgaagatgaattagatgatcaaggatctgcagttgaaccagaacaaaatagagttaatagagaagcagaagaaaacagagaaccatttagaaaagagtgtacttggcaagtaaaagctaatgatagaaaatatcatgaacaacctcatttcatgaatacaaaatttctttgtattaaagaatcaaaatatgcaaataatgctattaaaacatacaaatataatgcatttacttttataccaatgaacttatttgaacaattcaagagggctgcaaatctttatttccttgctttattaattttacaagcagttccacaaatttctactcttgcttggtatactacacttgttcctttattagtagtcttaggagttacagctattaaagatttggttgatgatgttgctagacataagatggacaaagaaataaataatagaacatgtgaagttattaaggatggtagatttaaagtagctaaatggaaagaaattcaagttggtgatgttattagattaaagaaaaatgatttcgttccagcagatattcttttattgtcttctagtgaaccaaatagtttatgttatgttgaaactgctgaattagatggtgaaacaaatcttaaatttaagatgtctttagaaatcactgaccagtatcttcaaagagaagatacattagcaactttcgatggatttatagaatgcgaggaaccaaataacagattagataaatttacaggaactttattttggagaaatacatctttcccattagacgcagacaagattttattaagagggtgtgttattcgtaatacggatttttgtcatggtttagttatttttgcaggagctgatacaaaaattatgaagaatagtggtaaaacaagatttaaaaggactaaaattgattatttgatgaactatatggtttatacaattttcgtcgttcttattctcttatcagcaggtttagcaatagggcatgcatattgggaagcacaagttggaaactctagttggtatttatatgatggagaagatgacactccatcttatcgaggttttttaattttttggggatatataattgttctaaatactatggttcctattagtttgtacgtttcagtcgaagttattagattaggtcaatctcatttcattaattgggatttacaaatgtattatgctgaaaaagatacaccagctaaagcaagaactacaactttaaatgaacaattgggacagattcactatattttttctgataaaacaggaactttaacacaaaatatcatgacatttaagaaatgttgtatcaatggacaaatttatggggatcatagagatgcatcacagcataatcataataaaattgaacaagtcgacttctcttggaatacttatgcagatggaaaattagctttttatgatcattatttaattgaacaaattcaatctggtaaagaaccagaagtccgacaattttttttcttattggctgtctgtcatacagttatggtcgataggactgatggtcaacttaattatcaagctgcttctccagatgagggagcattagttaatgccgcacgaaatttcggatttgcttttcttgcaaggactcaaaacactattacaattagtgaacttggtacagaaagaacttataatgttttagcaattttagattttaattcagatagaaaaagaatgtcgattattgttcgtacacctgaaggtaatataaagttgtattgtaagggagcagatacagtaatttatgaaagattacacagaatgaatccaactaaacaagaaactcaagatgcacttgatatttttgcaaatgaaactttaagaacattatgtttatgttataaagaaatagaagaaaaagaatttactgaatggaacaagaaatttatggctgcttcagttgcttcaacaaatagagacgaagctttagataaagtctatgaagaaattgaaaaagatttaattcttttaggggcaacagcaattgaagataaattacaagatggagtacctgaaactatttccaaacttgcaaaagctgatatcaagatttgggttttaaccggggataaaaaggaaacggcagaaaatattggattcgcatgtgaattattaactgaagatactacaatatgttatggagaagatattaattctcttttacatgctagaatggaaaatcaaagaaatcgaggaggagtttatgcaaaattcgcaccacctgttcaagaatcattttttccaccaggaggaaatagagcattaattattactggatcttggttaaatgaaatccttcttgagaagaaaactaaacgaaataagattttaaaattaaagtttccaagaactgaagaagaacgtagaatgagaacacaatcaaaaagaagacttgaagctaaaaaagaacaacgacaaaagaactttgttgatcttgcttgtgaatgttcagctgtaatatgttgtagagttactccaaaacaaaaggcaatggtagttgatttagttaaaagatataaaaaggctattactttagcaattggagatggagctaatgatgttaatatgattaaaactgcacatattggagttgggatatctggacaagaaggtatgcaagctgtaatgtcatcagactattcatttgctcaatttagatatttacaacgtttactcttagtgcacgggagatggtcatatattagaatgtgtaagtttttaagatacttcttttataaaaactttgcttttactcttgtacatttctggtactcattttttaatggatatagtgctcaaactgcatatgaagattggtttattactttatacaatgttctttatacatcattaccagttttattaatgggtcttttagaccaagacgtgtcagataagttatctttaagattcccaggtttatatattgttggacagcgagatcttctttttaattataaacgattttttgtttcacttcttcacggagttttaacttcaatgatccttttctttattccactaggagcttatttacaaactgttggacaagatggagaagctccatccgattatcagtcatttgcagttacaatagctagtgcattagttattacagttaactttcaaattgggttagatacatcttattggacttttgttaatgcatttagtatctttggttcaattgcactttacttcggaattatgttcgattttcattctgctggaattcatgttttatttccatcagcttttcaattcacaggaacagcatctaatgctcttagacaaccatatatttggttaacaattattcttgctgtagctgtttgtcttttacctgtagttgctattcgatttttatcaatgacaatatggccttctgagagtgataaaattcaaaaacatcgtaaaagacttaaagcagaagaacaatggcaaagacgtcaacaagtttttcgtagaggagttagtactagaagatctgcttatgctttttctcatcaacgtggttatgctgatcttatttcatcaggaagatcaatacgaaaaaaacgtagtccattagacgctattgttgctgatggaacagctgaatatagaagaactggtgatagt

SEQ ID NO: 7358 - DNA, 3753 bp, Artificial Sequence
  Description of Artificial Sequence: Synthetic coding sequence
atgagtactgaaagggactccgaaacaaccttcgacgaggactcccagcccaacgatgaagtcgtgccatattccgatgacgaaactgaggacgagctcgacgaccagggctccgcggttgagccagaacagaatagagtgaaccgcgaggcggaggaaaatcgtgagccttttagaaaggagtgtacctggcaggttaaagcaaatgataggaagtaccatgaacaaccgcatttcatgaacaccaaattcctctgtattaaggagagcaaatatgctaataacgcaattaaaacctacaaatacaatgccttcactttcattcctatgaatctgtttgagcagtttaagcgtgccgccaacttgtattttttggcactgttgatactgcaagcagtgccccaaatcagcacattggcgtggtatacaaccctggttcccctgcttgtcgtacttggtgtgaccgccataaaggatctcgtagacgacgttgcaaggcataaaatggacaaggaaatcaacaacaggacctgtgaggtcattaaggacggccggttcaaggtggctaaatggaaggaaattcaggtgggtgatgtcatcaggctgaagaagaatgactttgtgccggcagacattctgttactgtccagttcagagcccaactccttatgttatgtcgaaaccgccgaattggacggggagacaaacttgaagttcaaaatgtccctcgagatcacggatcagtacctgcagcgtgaagacactctggcaacctttgatggcttcatcgaatgcgaggagccaaataatcgcttggataagttcactggtaccctgttctggcgcaataccagttttcccctggatgcggacaaaattctactgaggggatgcgtcatccgcaacacggacttctgtcacgggctagtcatctttgctggcgccgacacaaaaattatgaaaaattcaggaaagacccggtttaagcgaacaaaaattgattacctgatgaactatatggtgtacacaattttcgtcgtgctcatcctgttaagcgccggcttggccatagggcatgcttactgggaagcccaagtaggcaactcatcttggtacctatacgatggcgaagatgatacgcctagttaccgtggcttcttaatcttttgggggtatattatcgtactgaacactatggttccaatttcattgtacgtgtcggtggaggtgatcagattgggacagagtcactttatcaactgggacctccagatgtattacgcagagaaagatacacccgccaaggcgcggaccacaaccctgaacgagcaattgggacagatacattatatattctcagataagacgggcacactgactcagaacatcatgacgttcaagaagtgctgtataaacggacagatttacggcgaccatcgcgatgcatcccagcataaccacaataaaatagagcaagtagacttttcctggaacacatacgcggatgggaaactggcattctacgatcattaccttatcgagcaaattcagagcggcaaggagccagaggtgaggcagttcttcttcctactcgccgtctgtcataccgttatggtagatagaactgacggccagctgaactatcaggctgcatcccccgacgaaggcgccctcgtgaatgcagcgcggaactttggctttgcatttcttgctcgaactcagaataccatcaccatttcagaactcggaacagagagaacatataacgttctagccatcctggactttaactccgatcgcaagcgcatgtccattatagttcgcacgcctgaaggcaatatcaagctctattgcaaaggggcggataccgttatatacgagcgcctgcacagaatgaaccccacaaaacaagagacccaggatgccctggatattttcgcaaatgaaaccctgagaaccctgtgtctgtgctacaaggaaatcgaagagaaagaatttactgaatggaataaaaagttcatggcagcaagcgtggcgtccaccaacagagatgaggcactggataaggtgtacgaagaaattgagaaggacctgattctgttaggagctacagccattgaggacaagctacaggacggggtacctgaaactattagtaagttagccaaggcagacattaagatatgggttctgaccggagataaaaaggagactgcggaaaacattggattcgcctgtgagctgctaacagaagatacaactatctgttacggcgaggatatcaactcccttcttcatgctcggatggagaaccagcgtaacagagggggcgtttacgctaagttcgctcctcccgtccaggagagctttttcccccctgggggaaatcgcgccctaattataacaggctcttggctgaatgaaatactgctggaaaagaagaccaagcgaaacaagatactcaagctgaaattcccgaggacggaggaagaacgcagaatgaggacccagtccaagcgccgcttagaagctaaaaaggaacaaagacagaaaaatttcgtggatctcgcctgtgagtgtagcgctgtgatctgctgtcgcgtcacacccaagcaaaaagcgatggtggtggatctcgttaagcgatataagaaggcgattaccctggcaattggagacggagcgaacgacgtaaacatgatcaaaaccgcgcatatcggtgtgggcattagtggacaggaagggatgcaggctgttatgtcatccgattactcttttgcacagttcagatacctgcagcgtcttctattggtccatggcaggtggtcatatattcggatgtgtaaattcctgcggtatttcttctataagaattttgccttcactttggtccatttctggtactcgttttttaacggttatagcgcgcagactgcttacgaagattggtttatcacactgtataacgtcctgtacacctccctgcctgtgttgctgatggggctcctggaccaggatgtgtctgacaagttaagcctgaggtttccaggcttatacattgttggacaacgggaccttctcttcaactacaagagatttttcgtcagtctgctccacggcgtgttaaccagcatgatcctcttctttattcctttaggcgcgtacctgcagactgttggccaggacggcgaagcccccagcgactatcagtcattcgcggtaacgattgcaagcgccttggtgatcaccgttaacttccaaattggactggatactagctactggacttttgtcaatgcctttagcattttcgggtccatcgcactgtacttcggcataatgttcgacttccattctgccggaatccacgtgctctttcctagtgcgtttcagttcacgggaaccgctagtaatgccctacggcagccctatatttggttaaccatcatcttagctgtggccgtttgtttactgccagtagtggctatcagattcctatctatgacgatttggccaagtgaatccgataagatacagaaacaccgcaaacgactgaaggccgaggagcagtggcagcgcagacagcaggtgtttcgccgtggggtgtcaacaaggagatctgcatatgcctttagccaccagcgaggatacgccgatctaatttcatccgggcgctcaatcagaaaaaaacggtcacccctggacgcaatcgtggccgatgggacagctgaatatagaaggacaggtgactct

SEQ ID NO: 7359 - DNA, 3753 bp, Artificial Sequence
  Description of Artificial Sequence: Synthetic coding sequence
atgtctacagagcgggatagtgagacaacattcgatgaggattctcagcccaatgatgaagttgtcccctatagtgatgatgaaactgaagatgaactcgatgaccaagggtctgctgtagagcccgaacagaatcgggtaaatcgggaagctgaagaaaaccgtgaacccttcagaaaggaatgtacttggcaggtcaaagcaaatgataggaaatatcatgagcagccccactttatgaacactaaatttctttgcattaaagaatcaaagtatgctaataatgccattaaaacatataagtacaatgcattcacttttatccccatgaacttattcgagcagttcaaacgggccgccaatttgtattttcttgctctgcttatcctgcaggccgtgccacagatctctactttagcctggtacacaacactagtccccctcttggtggttctcggagtgactgcaatcaaggatctcgtagatgatgtggccaggcataaaatggataaagaaatcaataaccgaacttgtgaagtgatcaaagatggaaggtttaaggtggctaagtggaaagaaatccaggtcggagacgtgataagactgaagaaaaatgactttgtccccgctgatatattgctgctaagtagttcggaacctaactccctctgctacgtcgaaacagctgaactagatggggaaactaatctgaaattcaagatgtctctggaaataacagatcagtacttgcagagagaagatactctggccactttcgacgggtttattgaatgcgaggaacccaacaaccgacttgataaatttacaggaactctgttctggcggaatacatcatttcctctcgacgctgataaaattcttctccgagggtgtgttataaggaacactgacttctgccacggactcgttatatttgcaggagctgatacaaaaattatgaagaattctgggaaaactcgctttaaacgtacaaaaatagattatcttatgaattatatggtctatacaatattcgtggtccttatactgctctccgccggactcgcaatagggcacgcgtattgggaagctcaggtgggaaattctagttggtacctctatgatggggaggatgatactccttcataccggggattcctgatattttgggggtatataatagtgctcaacactatggtgccaatctcactgtatgtgtcagtcgaggttatcagactcggacagtcacacttcataaactgggatctacagatgtattatgctgagaaggatactcctgccaaagctcggactacaacactcaatgaacagctcggacagattcactatatattctcagataagacagggactctaacacagaacatcatgacatttaaaaaatgctgtattaacgggcagatatacggagaccatagggatgcctcacagcataatcataataagattgagcaggtcgatttcagttggaacacgtatgcagatgggaaactcgccttctacgatcattaccttattgaacagatacagtccgggaaagaacctgaagtcaggcagtttttttttctccttgcggtttgccacacggtcatggttgatcggacagatggacaacttaattaccaggccgcgtcacctgatgaaggggctctagtcaatgcagcaaggaacttcggatttgccttcttggcacggactcagaatacaatcactatctctgaactgggaacggaacggacttacaacgtgctcgccatccttgattttaactctgataggaaacgaatgtctattatcgtccggactcctgaaggaaatataaagctatattgcaagggagccgatacagttatctatgaaagactccaccggatgaaccccactaaacaggaaactcaggatgcactggatatctttgccaacgaaacacttcggacactatgtctttgttataaggaaatcgaagaaaaagaatttacagaatggaataaaaaattcatggccgcatccgtagcatccactaacagggatgaagccttggacaaagtgtatgaagagatagaaaaagatctcatattgctcggggctacagctatagaagataagctgcaggacggggtccccgaaacaatttctaaactagccaaggctgacattaaaatctgggttctcactggggataaaaaagaaactgccgaaaatatcgggttcgcttgtgagcttttgacagaggatacaactatttgttatggggaagatatcaatagtcttttgcacgcaaggatggaaaaccagaggaaccgggggggggtctacgccaagttcgcaccacccgttcaggagtctttctttccaccggggggaaacagggccctgatcataacagggtcttggctcaatgaaattctgttagaaaaaaagacaaaaagaaacaaaatactaaaattaaaatttcccagaactgaagaagaacgacgaatgagaactcagagtaaaagaaggctcgaagccaaaaaagagcagagacagaagaattttgtggatttagcttgtgaatgttccgcagtcatatgttgccgggtaactccgaaacagaaagccatggtggttgatctcgtcaagcggtataaaaaagcaataactctcgccattggagatggagccaatgacgtcaatatgattaagacagctcacatcggggtcgggatatccgggcaggaaggaatgcaggccgtcatgtcttctgattactcttttgcccagtttagatacttgcaaaggttgctgctcgtgcatgggcgatggagttatattaggatgtgtaaatttctcaggtatttcttctataaaaattttgcgttcactctcgtgcatttctggtattctttctttaatggatactctgcacagacagcctatgaagattggttcatcactctttataatgtactctatacatctctccctgttctgttaatgggactcctggatcaggatgtgtctgataagctttccctccgctttcctggactgtatattgtcggacaaagggatctgctctttaattataaacggttcttcgtttctctccttcacggggtactgacatctatgatcctcttctttatccctctcggagcatatctccagacagtcgggcaggatggagaagcgccgtcagattatcagtcctttgcagtcacaatagcaagtgcattagtgatcacagtgaatttccagatcgggttggatacttcttattggacattcgtgaatgctttctcaatatttgggtccattgccctttattttggaattatgttcgatttccattccgcaggaatccatgttttatttccctcggccttccaatttactggaacagccagtaacgcgcttcggcagccatatatttggctaacaatcatcctcgctgtagctgtatgtcttctgccagtcgttgcaataagatttttatccatgacaatatggccatctgagagtgataaaatacagaaacataggaaaaggcttaaggccgaagagcagtggcagcggcgccagcaggtattcagacggggggtatctactagaagaagtgcctatgccttttcccatcagcgagggtatgcagatttgatctcctcaggaagatcaattcgcaagaagaggtctcccctcgatgctatagtagctgatggaactgccgagtatcgaaggacaggagacagt

SEQ ID NO: 7360 - DNA, 3753 bp, Artificial Sequence
  Description of Artificial Sequence: Synthetic coding sequence
atgtccactgagcgggactctgagaccacctttgacgaggacagtcagccaaacgacgaggtggttccatactcggatgacgaaactgaagacgaactggacgaccagggctctgctgtcgaaccggagcagaaccgtgtcaatagggaggctgaagaaaatagggaacctttccggaaggagtgcacctggcaagtgaaagcaaacgaccgaaagtaccacgaacagccccactttatgaacacgaagttcctctgtatcaaagaatccaagtatgcaaataacgccattaaaacttataagtataacgcttttacatttatcccgatgaatctcttcgagcagtttaaacgcgcagccaacttgtatttcctcgcgctgctaatactgcaggctgtgcctcagatatcaactctggcctggtacaccacgcttgtgccattgcttgtcgtcttgggagtgaccgcaattaaggatctcgtggacgacgtggcccgccataagatggacaaggagataaacaacagaacttgcgaagtcattaaggatggtcgattcaaggtcgcaaaatggaaggagatccaggtgggggatgtgatccggctgaagaaaaacgacttcgtcccagccgacattttgcttctgtcatcgtcagagcccaatagcctgtgctacgtggaaaccgccgaattggatggtgagaccaatctgaaattcaagatgtccttagagatcacagaccaatatctgcagcgtgaggacactctggctactttcgacggatttatcgagtgcgaggaacctaacaatcgactggacaagttcacaggaacactgttttggcgcaacaccagcttccccctggacgccgataagatacttttacgagggtgtgtgatccggaataccgatttctgccatgggctggtaatttttgcaggcgccgacactaagataatgaaaaattcaggaaaaactcggttcaaaaggactaagattgactatctgatgaattacatggtgtacacaatctttgtggtcctgatcctgctcagcgccggtttggccatcggccatgcctactgggaagcccaggtgggcaattcgtcttggtatctctacgacggcgaggatgataccccttcgtatcggggatttcttatattctggggttacatcattgtgctaaacacaatggttccaatctctttatacgtaagcgtcgaagtgatccgactggggcagtcccacttcattaactgggatctccaaatgtactacgcagaaaaagacactccagccaaggcgagaaccactactcttaacgaacagctgggccagatccattacatatttagtgataagacgggcactctgacccagaacatcatgactttcaagaagtgctgcattaacggtcagatttatggtgatcaccgcgacgcctctcagcacaatcacaataagatcgagcaggttgacttcagctggaacacctatgccgatggaaagctggctttctacgaccattatctgattgagcagatccaaagcggtaaagagcccgaggttcgacagtttttcttcctgctggcggtctgccacaccgtgatggtggaccggacagatggacaattgaactaccaagcagcatcgcccgatgaaggcgccctcgtcaatgctgcacggaactttggttttgcctttctggcgagaactcagaacacgattaccatctccgagctgggaacggagcgaacgtataacgtgcttgctatcctggacttcaacagcgatcgaaagcgcatgtcaattatcgtgcgtactcccgaagggaacataaagctttactgcaagggtgccgacaccgttatctacgagagactgcaccgaatgaatccaactaagcaggaaacacaggacgctttggatatatttgctaatgagaccctccggaccttatgcctttgttacaaggaaatcgaagaaaaggaatttactgagtggaacaagaagtttatggcagccagcgtggccagtactaacagagacgaggccctcgacaaagtgtacgaagaaattgagaaggaccttatccttcttggcgctacagctatcgaagacaaactgcaggatggcgttcctgaaaccatctccaagctggctaaggccgatataaagatttgggtgctgactggtgataaaaaggagactgcagagaacatcggattcgcgtgcgagctgctgacagaggatacaacaatctgttacggcgaagatataaactcccttcttcacgccaggatggaaaaccagaggaatcggggcggtgtgtacgccaagttcgctccccccgtccaggagagcttctttcccccaggtggaaatcgtgctctgattatcactgggagttggctgaacgagatcctgctggagaagaagactaagcggaacaagattctgaaattaaaatttcccaggaccgaggaagagcgccggatgcggacgcagtctaagcggcgactggaagcaaagaaggaacagaggcagaagaacttcgtggaccttgcttgtgaatgctccgcagtgatctgctgtcgagtgacaccaaagcagaaagcaatggtagtcgacctggtcaaaaggtacaagaaagccatcacattggctatcggggatggggctaatgacgtgaacatgattaagacagcccatatcggggtgggcatctcaggccaggagggaatgcaggctgtcatgtccagtgactatagtttcgcccagttcaggtacctgcagaggctgctgctcgttcacggcagatggtcttatatccgcatgtgcaagttccttagatatttcttttacaagaacttcgccttcacacttgtccacttttggtactcgttcttcaacggatactccgcccagaccgcgtacgaagattggtttataaccttgtacaatgtgctgtacacatctctgccggtactgctgatggggctgctggaccaagatgtgtcggataaactcagccttcggttccctggcctgtatatcgtcggacagcgggatttattatttaattataagcgtttcttcgtgtccctgctgcacggcgtgctgacctccatgatccttttttttatcccactgggcgcctacctgcagaccgttggccaggatggggaggccccctccgactaccaatcttttgctgtgacgatcgcttcagccctggtcataaccgtcaactttcagatcggtcttgacacctcttactggacatttgtgaatgctttttccatcttcggatctattgccctttactttggtatcatgtttgatttccacagcgccggaatccacgttctgttcccctccgcctttcagtttaccggaacagctagcaacgcactgagacagccttacatctggctgaccataattcttgccgttgccgtgtgcctgctccccgtagtcgctatcaggttcctctccatgaccatttggccctccgagtcggacaagattcaaaagcataggaaaaggctgaaggccgaggagcagtggcagagacgtcaacaggtgtttcgacggggcgtaagtacaaggcgcagtgcttacgctttctctcaccagcgcggttacgcggacttgatctcatctgggaggagcatcagaaaaaaacggtcacctctagatgccattgtagctgatgggacggcggagtacagacgcacaggagactcc

SEQ ID NO: 7361 - DNA, 3753 bp, Artificial Sequence
  Description of Artificial Sequence: Synthetic coding sequence
atgagcacggaacgtgactccgaaacgacctttgatgaagattcgcagccaaacgatgaagtcgtcccatactcggatgatgaaaccgaggacgagctcgacgatcagggttcggcagtggagcccgaacagaaccgcgtgaacagggaagctgaggaaaacagagaaccctttcgcaaagaatgtacttggcaggttaaggcaaacgatagaaagtaccatgaacagcctcatttcatgaacacgaaatttctttgcattaaagaatctaagtacgcaaacaatgctatcaagacttacaagtacaacgcattcacctttatacccatgaacttgtttgaacagttcaaacgcgccgcaaatctgtactttctggcactgcttatactccaggctgtgcctcagatttcgaccctcgcttggtacaccaccctggtgcctcttcttgtggtcttgggcgtgaccgccataaaggacctggtcgatgatgtcgcaaggcataagatggataaggagatcaataaccgcacttgcgaagtcatcaaggacggtaggtttaaggtggcaaagtggaaggagatccaagtgggagacgtcatcagactgaagaagaatgactttgtgcctgccgatattcttctgctttcgtcctcagaaccaaatagcctttgctacgtggaaaccgcagaattggacggagaaactaacctgaaattcaaaatgtcgcttgaaatcaccgaccaatacctgcaacgggaagatactttggccacttttgacggatttatcgaatgtgaggaacctaacaaccggctggataagtttactggtaccctcttttggagaaacaccagctttccgctggatgcggacaaaattcttctgagaggctgcgtgataaggaacaccgacttttgtcatggtcttgtgatcttcgccggtgcagatactaagatcatgaaaaacagcggcaaaactagatttaagcgcacgaagattgattaccttatgaactacatggtctacacgatcttcgtggtgttgattctgctttcggcaggtctggcgattggacatgcatactgggaagcacaggtgggaaattcttcctggtacctgtacgatggggaggatgacactccatcctaccgcggcttccttatcttttggggttacataatcgtgttgaatactatggtgcctatctcactgtacgtgagcgttgaagttataagactggggcagtcccactttatcaactgggatctgcagatgtactacgctgagaaggatacgccagcaaaggcaagaaccaccactctgaacgaacagctcggacagattcactacattttctcagataagaccggaaccctgactcaaaacatcatgactttcaaaaagtgttgtattaacggccagatatacggagatcaccgtgatgcatcgcaacataaccataacaaaatcgaacaggtcgatttctcctggaacacttatgctgacggaaagctcgcattctacgaccactatctcattgaacagatacaatccggcaaggagcccgaggtccgacagttctttttcttgctcgcagtgtgccatactgtgatggtcgatagaactgatggacaactgaattatcaagccgccagccccgatgagggagcgttggtgaatgcagcacggaatttcggattcgccttcctcgcaagaactcagaataccattaccatttcggaacttgggaccgaaagaacctataatgtcctggccatactcgacttcaattccgacaggaagagaatgtccattattgtccggacgcccgagggaaacattaagctctactgtaagggagcggacaccgtgatttacgagcgactccatcggatgaatccaactaagcaggaaactcaagacgcactggatatcttcgccaacgaaaccctccgaactctgtgcctctgttataaggagatcgaagagaaggagttcaccgaatggaataagaagtttatggcggcttccgtcgcctcgactaacagagacgaagcgcttgacaaggtgtacgaagaaatagagaaggatttgatcctgctcggcgcaactgcaatcgaagataagctgcaagatggggtgccagagactatcagcaagctggccaaggccgacatcaaaatctgggtcctgactggggacaaaaaagagactgcagagaacataggatttgcatgcgaactgctcaccgaagatactacgatatgctacggcgaggacattaacagcctgctgcatgcgagaatggaaaatcaaagaaacaggggcggagtgtacgctaaattcgcacctcctgtgcaagaatcattctttccgccagggggcaatagagcgttgatcattactggatcttggctcaacgaaatcctgcttgagaaaaagactaaacggaacaagatccttaagctcaagtttccccgaacggaagaagagagacgcatgagaactcaatcgaaaagacgtcttgaagcgaagaaagagcagagacagaagaactttgtggacctggcttgtgaatgttcggcagtgatatgttgtcgcgtcacccccaaacagaaggctatggtcgtcgatcttgtgaagcggtacaaaaaggcaattactcttgccataggagatggcgcaaatgatgtcaatatgatcaagactgcacacatcggtgtgggaatatcaggtcaagaaggtatgcaggcagttatgtcatctgactactcgtttgcacaatttagatacctgcagcgacttctcctggtgcacggtcggtggagctacattcgcatgtgtaagtttcttcggtacttcttttacaagaacttcgcctttactctcgtgcatttttggtacagcttctttaacggctactcagcccaaaccgcatacgaagattggtttatcaccctgtacaacgtgctctatacgtcgcttcccgtccttctgatgggattgctggaccaagatgtctcggataaactttcgttgagatttcctggtctgtacattgtgggtcaacgtgatcttctctttaactacaagagatttttcgtgtccctccttcacggggtcctcacctccatgatattgttcttcatccctcttggggcgtatttgcagacggtgggtcaagacggcgaagcgccttccgattaccaatcatttgcggtgacgatagcctctgcacttgtcataaccgtgaattttcaaattggtcttgatacttcgtactggacctttgtcaatgcattctccatttttggaagcatcgccctttactttggaattatgtttgatttccattccgctggcatccatgtcctctttccaagcgcattccagtttaccggtactgcgagcaatgcactccgccagccatacatttggcttaccattatactggcagtggctgtttgtctgcttcctgtggtggcaatacgttttctttcgatgaccatctggccgtcggagtcagataagattcagaaacacaggaaacgtctgaaggcagaggaacagtggcagcggcggcaacaagtgttccgccggggagtgagcactcggcgctcggcatacgctttttcccatcaacgagggtatgcagatcttattagctccggacgaagcattaggaagaagcgctctcctctggacgcaattgtggcagacggaaccgctgaataccgccgcaccggggattcg

SEQ ID NO: 7362 - DNA, 3753 bp, Artificial Sequence
  Description of Artificial Sequence: Synthetic coding sequence
atgagcacggagagagacagcgagactaccttcgatgaagatagccaacctaacgatgaggtggtgccttactcggatgacgagactgaagatgagcttgatgatcagggatcagccgtcgaaccggaacaaaatagagtgaacagagaagctgaagaaaaccgagagccttttagaaaagaatgtacttggcaagtgaaagcaaacgacaggaaataccacgaacagcctcatttcatgaacactaagtttctttgtattaaggagtctaagtacgcaaacaatgccattaagacgtacaagtacaacgcatttacttttatccctatgaatctctttgaacagttcaagagagcagccaatctctactttctcgctcttctgattttgcaagcggttccacaaatctcgactcttgcatggtacactaccttggtccctcttctggtcgtgctgggtgtgactgcaataaaggatctggtggacgatgtggcacggcataagatggataaggagataaacaacaggacttgcgaagtcatcaaggacgggagatttaaggtggcgaaatggaaggaaattcaggtgggtgatgtgatcaggttgaagaaaaacgacttcgtaccagctgacattctgctcctgtcgagctcggaacccaactcactgtgctacgtggaaaccgccgagctcgatggcgaaaccaaccttaagttcaagatgagcctggaaataactgatcaatacctgcagcgggaggacactctggcgaccttcgacgggtttatcgaatgcgaagaaccaaacaacagactggataagttcaccggtaccctgttctggagaaatacttcctttccgcttgacgccgataagatactgctgagaggctgcgtcattcggaatactgacttttgtcatggacttgtgatcttcgcaggagcagatactaagattatgaagaattcgggaaaaacgaggtttaagaggactaagattgattaccttatgaactacatggtgtacacgatattcgtggtgcttattctgctgtcggccggattggccatcggccatgcgtattgggaggcacaagtcggaaacagcagctggtacctgtacgacggagaagatgataccccatcctaccgcggatttcttatcttctggggatacattatcgtgcttaacaccatggtgccaatatcactgtatgtctcagtggaggtgatcagactcggacaatcccacttcattaactgggacctgcaaatgtactacgctgagaaggataccccagctaaggccagaactactactcttaatgagcagctggggcaaatccattacatcttttcagataagactgggactcttacccaaaacataatgacttttaagaagtgttgcatcaacggtcagatttatggtgaccacagagacgcctcacagcataaccacaacaagattgaacaagttgatttcagctggaacacgtacgcagacggcaaacttgcattctatgatcattacctgatagaacagattcaatccggcaaggagccagaagtgagacaattcttcttcctgctggccgtgtgtcatacggtcatggttgatcgaacggacgggcagctgaactatcaagcagcaagccccgacgaaggagcccttgtcaacgccgcacgcaacttcggttttgctttccttgcacgcactcagaacaccattaccatttctgagttgggaactgaaagaacttacaatgtgctggccattctggatttcaactccgatcgcaagcgtatgtccattatagtcaggacgccagagggtaatatcaaactttactgtaagggggccgataccgtgatttacgagagactccaccgcatgaatcccaccaaacaagaaactcaggatgccctggacatatttgcgaatgaaactctgagaactctttgtctctgctacaaagagatcgaggagaaggagttcacggagtggaacaagaagttcatggcggcaagcgtggcttcgaccaaccgagatgaagcccttgataaggtgtacgaagagattgagaaggatcttatcttgcttggtgcaacggcaattgaagataagctgcaagatggagtgcctgaaaccataagtaaacttgcaaaggcagacattaagatttgggtgcttaccggggataagaaggaaaccgcagagaatatcggctttgcttgcgagctccttaccgaagataccactatatgttacggagaggatatcaactctttgcttcatgctcggatggaaaatcaaagaaacaggggaggtgtgtacgcaaagtttgcaccaccagtccaggagtcgttttttcccccaggtggaaatcgtgctctgatcattactggatcgtggctgaatgaaatcctgctggagaaaaagacgaagcgaaacaagatccttaaactcaagtttcctcgtacggaagaggaacgtcggatgcggacgcaatccaagcggcggcttgaggcaaagaaggagcagcgtcagaagaattttgtggatctcgcctgtgaatgctcagcagtcatctgctgtcgggtgacccctaaacaaaaggccatggtcgtggaccttgtgaagagatacaagaaggccataaccctcgcaattggagatggtgccaatgatgtgaacatgattaagaccgcgcatattggcgtgggtatttcggggcaggagggtatgcaggcagttatgtctagtgactacagctttgcacaatttagatacctgcagaggctcctgttggtgcacgggcggtggtcgtacattcgcatgtgcaagtttctcagatactttttctacaagaacttcgcatttacccttgttcatttttggtactcattcttcaatggttactcggcacagaccgcctacgaggactggtttatcactctttacaacgtcctttacaccagcctccccgtgctgctgatgggactcttggaccaggacgtgtcggataaactcagcctcagatttcccggtctgtacatagtgggccaaagagatctgctgtttaactacaagaggttttttgtgtcactgctccatggcgtgctgacctcgatgattttgtttttcatacctctgggtgcgtacctgcagaccgtaggacaagacggagaagcaccatccgactaccagtcatttgcagtgaccatagcgagcgcgcttgtgatcaccgtcaattttcaaatcggtctggatacctcatactggacctttgtcaatgccttttcgatttttggatccattgcattgtactttgggataatgttcgatttccattcggcaggaatccatgtcctcttcccatccgcctttcaatttaccggcacggcatcaaatgcattgcggcaaccatatatctggcttaccattatcctcgcagtggctgtgtgtctgcttccagtcgtggcaatccgcttccttagcatgactatttggccttctgaaagcgacaagattcaaaagcataggaagaggttgaaagccgaggaacaatggcaacgtcgccagcaagtgttccgacgcggagtgagcacgagacgcagcgcatacgccttttcacatcaacggggatacgccgatttgatctcctccggacggtcgatcaggaagaagcgatccccactggatgcaattgtggccgacggcactgccgaataccgaaggaccggcgattcc

SEQ ID NO: 7363 - DNA, 3753 bp, Artificial Sequence
  Description of Artificial Sequence: Synthetic coding sequence
atgtccactgagcgcgacagcgaaaccactttcgatgaggacagccaacctaacgacgaagtggtcccgtattcagatgacgagactgaggacgagctggatgaccagggatcagcagtggagcccgaacaaaaccgagtgaatagggaagccgaagaaaacagggagccattccgcaaggaatgcacctggcaggtcaaggctaacgaccgcaagtatcacgagcagccacactttatgaatacgaagtttctctgcatcaaggagtccaagtacgcgaacaacgccatcaagacctacaagtacaacgccttcaccttcattccgatgaatctgtttgaacagttcaagcgggcggccaacctttacttccttgctttgttgatcctgcaggctgtgccacaaatctcaacgctggcctggtataccactctggtgccgcttctggtggtgctgggtgtcactgcgattaaagatctcgtcgacgacgtcgcccggcacaagatggataaagaaatcaacaaccgcacttgtgaggtcattaaggacggaaggttcaaagtggcgaaatggaaagaaatccaggtcggggacgtgatccggctcaagaagaatgacttcgtgccagcggacattctcctgctgtcatcatcagaaccgaattcgctctgctacgtggagactgccgagctcgatggggagacgaatctgaagtttaagatgtcactcgaaatcaccgatcaatacctgcaacgcgaagatactctggctaccttcgacggcttcatcgagtgtgaagagcctaacaatcgcctggacaagttcactggaactcttttctggcggaacacgtccttcccgctggatgcagataagatcctcctcagagggtgcgtgatcaggaacaccgacttctgccacggcctcgtgatcttcgccggagccgataccaagatcatgaagaacagcggaaagaccagattcaagcggactaagatcgattacctgatgaattacatggtgtacactatcttcgtagtgctcatcctgctgtctgccggactggccatcggtcatgcgtactgggaagcccaggtcggcaactcctcgtggtacctgtacgacggggaggacgatactccttcgtaccgcggattcttgatcttctggggatacataatagtgcttaatactatggtgcctatctccctgtacgtttccgtcgaagtgatccggctgggccagtcccatttcatcaactgggacttgcaaatgtactacgccgagaaggacacgccggccaaggcacggactaccactctgaatgaacagcttggacaaatccattacatctttagcgataagactggaaccctgacccagaacatcatgacttttaagaaatgttgtatcaacggacagatctacggcgaccaccgcgacgcgtcccagcacaatcacaacaagattgaacaggtggatttctcgtggaatacctacgctgacggtaagctggccttttacgatcactacctcatcgagcagatccagtcgggcaaggagcctgaagtgagacagtttttcttcctgctggcagtctgtcacactgtcatggtggatcggactgatggccagttgaactaccaggcagcgtccccggatgaaggagccctcgtgaatgcggcccgcaactttgggttcgctttcttggcgagaacccagaatactatcacgatctcggaacttggcactgaacgtacttacaatgttctggccatccttgatttcaattcagacagaaagcggatgagcatcatcgtccgcaccccagaaggcaacatcaaactgtactgcaagggagcagatactgtgatctacgagcgcctgcacagaatgaacccgacgaagcaggagactcaagacgcgttggacattttcgctaatgagactctgagaaccctctgcctgtgctacaaagaaatcgaagaaaaggaatttactgagtggaacaagaagtttatggcggcatctgttgcgagcactaacagggacgaggctctcgacaaagtgtatgaggagattgagaaagatctgatcctcctgggcgccacggcaatcgaggacaaattgcaggacggagtgccggagactataagcaagctggccaaagccgacatcaagatctgggtcctgaccggcgacaagaaggagactgcggagaacatcgggtttgcgtgcgaactcttgaccgaggacaccaccatttgttacggcgaggatatcaacagcctgttgcacgcccgcatggaaaaccagcggaataggggaggagtttacgctaagttcgctcctccagtgcaggaatcgttcttcccgcctggaggaaaccgggcattgatcatcactggcagctggcttaacgaaatcctgctggaaaagaaaaccaaaagaaataagattttgaagctgaagttcccgaggaccgaagaggaacggcggatgcgcacccaaagcaagcgccgcctcgaggccaaaaaagaacaacggcagaagaatttcgtggacctggcctgtgaatgctccgccgttatctgttgcagggtcacccctaaacagaaggcgatggtcgtcgatctggtgaagcgctacaagaaggcaatcacgctcgctataggcgacggagctaacgacgtgaacatgatcaaaactgcacatatcggagtgggaatctccggacaagaaggcatgcaggccgtgatgtcatccgactacagcttcgcccagtttagatacttgcagagacttctcctggtccatggccgctggtcgtacatcagaatgtgtaaattcctgagatacttcttctacaagaacttcgcgtttaccctggtccacttctggtactcgtttttcaacggatactcggcgcagaccgcatacgaggactggttcatcactctgtacaacgtgttgtacaccagcctgccggtgctcctcatgggcctgcttgatcaagacgtgagcgataagttgtcacttagatttcctggcctgtacattgtgggacagcgggatctccttttcaactacaaaagattctttgtgtccttgctgcacggagtcctgacctcgatgatcctcttcttcatcccgctgggagcttacttgcagactgtgggacaagacggtgaagcgccgtccgactatcaatcgttcgccgtgaccatcgcaagcgccctggtgatcactgtgaatttccagatcggcctggatacttcctactggactttcgtcaacgcatttagcattttcggcagcatcgccctgtacttcggcatcatgttcgatttccacagcgcaggaatccatgtgcttttcccttccgctttccagtttaccgggaccgcatccaacgccctgcgccagccgtacatctggctcaccatcatcctcgcggtcgcggtgtgtctgctgccggtggtcgctatccgcttcttgtcgatgaccatctggcctagcgaatcggataagattcagaagcatcggaagagactgaaggctgaggaacagtggcaacgaaggcagcaggtctttagaaggggggtgagcacgaggagaagtgcctacgccttcagccaccagagaggatacgctgaccttatctcgtcaggtaggtcgatcagaaagaaacggtcgcctctggacgcgattgtggcggacggaaccgctgagtaccgccgcactggtgatagc

SEQ ID NO: 7364 - DNA, 3753 bp, Artificial Sequence
  Description of Artificial Sequence: Synthetic coding sequence
atgtcgacggaacgtgattcggaaacgacgtttgatgaagattcgcaaccgaatgatgaagttgtaccgtattcggatgatgaaacggaagatgaactagatgatcaaggttcggcggtagaaccggaacaaaatcgagtaaatcgtgaagcggaagaaaatcgagaaccgtttcgaaaagaatgtacgtggcaagtaaaagcgaatgatcgaaaatatcatgaacaaccgcattttatgaatacgaaatttctatgtataaaagaatcgaaatatgcgaataatgcgataaaaacgtataaatataatgcgtttacgtttataccgatgaatttatttgaacaatttaaacgagcggcgaatctatattttttagcgttattaatattacaagcggtaccgcaaatatcgacgttagcgtggtatacgacgttagttccgttactagttgtactaggtgtaacggcgataaaagatttagtagatgatgtagcgcgtcataaaatggataaagaaataaataatcgtacgtgtgaagtaataaaagatggtcgttttaaagtagcgaaatggaaagaaatacaagtaggtgatgtaatacgtttaaaaaaaaatgattttgtaccggcggatatattattattatcgtcgtcggaaccgaattcgttatgttatgtagaaacggcggaattagatggtgaaacgaatttaaaatttaaaatgtcgttagaaataacggatcaatatctacaacgtgaagatacgttagcgacgtttgatggttttatagaatgtgaagaaccgaataatcgtctagataaatttacgggtacgttattttggcgtaatacgtcgtttccgctagatgcggataaaatactactacgtggttgtgttatacgtaatacggatttttgtcatggtttagtaatatttgcgggtgcggatacgaaaataatgaaaaattcgggtaaaacgcgttttaaacgaacgaaaatagattatctaatgaattatatggtatatacgatatttgttgttttaatactactatcggcgggtctagcgataggtcatgcgtattgggaagcgcaagtaggtaattcgtcgtggtatctatatgatggtgaagatgatacgccgtcgtatcgaggttttttaatattttggggttatataatagtattaaatacgatggttccgatatcgttatatgtatcggtagaagtaatacgtttaggtcaatcgcattttataaattgggatttacaaatgtattatgcggaaaaagatacgccggcgaaagcgcgtacgacgacgttaaatgaacaattaggtcaaatacattatatattttcggataaaacgggtacgctaacgcaaaatataatgacgtttaaaaaatgttgtataaatggtcaaatatatggtgatcatcgtgatgcgtcgcaacataatcataataaaatagaacaagtagatttttcgtggaatacgtatgcggatggtaaactagcgttttatgatcattatttaatagaacaaatacaatcgggtaaagaaccggaagtacgtcaatttttttttctattagcggtttgtcatacggtaatggttgatcgtacggatggtcaactaaattatcaagcggcgtcgccggatgaaggtgcgttagtaaatgcggcgcgaaattttggttttgcgtttttagcgcgtacgcaaaatacgataacgatatcggaattaggtacggaacgtacgtataatgtactagcgatactagattttaattcggatcgaaaacgtatgtcgataatagtacgtacgccggaaggtaatataaaattatattgtaaaggtgcggatacggttatatatgaacgattacatcgtatgaatccgacgaaacaagaaacgcaagatgcgttagatatatttgcgaatgaaacgttacgaacgctatgtctatgttataaagaaatagaagaaaaagaatttacggaatggaataaaaaatttatggcggcgtcggttgcgtcgacgaatcgtgatgaagcgctagataaagtttatgaagaaatagaaaaagatttaatattattaggtgcgacggcgatagaagataaactacaagatggtgttccggaaacgatatcgaaactagcgaaagcggatataaaaatatgggttttaacgggtgataaaaaagaaacggcggaaaatataggttttgcgtgtgaactattaacggaagatacgacgatatgttatggtgaagatataaattcgttattacatgcgcgtatggaaaatcaacgaaatcgtggtggtgtatatgcgaaatttgcgccgccggtacaagaatcgttttttccgccgggtggtaatcgtgcgctaataataacgggttcgtggttaaatgaaatactattagaaaaaaaaacgaaacgaaataaaatattaaaattaaaatttccgcgtacggaagaagaacgtcgaatgcgtacgcaatcgaaacgtcgtctagaagcgaaaaaagaacaacgacaaaaaaattttgtagatttagcgtgtgaatgttcggcggtaatatgttgtcgtgtaacgccgaaacaaaaagcgatggtagttgatctagtaaaacgttataaaaaagcgataacgttagcgataggtgatggtgcgaatgatgttaatatgataaaaacggcgcatataggtgtaggtatatcgggtcaagaaggtatgcaagcggtaatgtcgtcggattattcgtttgcgcaatttcgttatctacaacgtttactattagttcatggtcgatggtcgtatatacgtatgtgtaaatttttacgatattttttttataaaaattttgcgtttacgctagtacatttttggtattcgttttttaatggttattcggcgcaaacggcgtatgaagattggtttataacgctatataatgttctatatacgtcgttaccggtactattaatgggtttattagatcaagatgtatcggataaactatcgttacgatttccgggtctatatatagttggtcaacgtgatctattatttaattataaacgtttttttgtatcgctactacatggtgtactaacgtcgatgatactattttttataccgttaggtgcgtatttacaaacggttggtcaagatggtgaagcgccgtcggattatcaatcgtttgcggtaacgatagcgtcggcgctagttataacggtaaattttcaaataggtctagatacgtcgtattggacgtttgtaaatgcgttttcgatatttggttcgatagcgttatattttggtataatgtttgattttcattcggcgggtatacatgtactatttccgtcggcgtttcaatttacgggtacggcgtcgaatgcgctacgtcaaccgtatatatggctaacgataatattagcggttgcggtatgtctattaccggtagtagcgatacgttttttatcgatgacgatatggccgtcggaatcggataaaatacaaaaacatcgtaaacgattaaaagcggaagaacaatggcaacgacgtcaacaagtttttcgtcgtggtgtatcgacgcgtcgttcggcgtatgcgttttcgcatcaacgtggttatgcggatctaatatcgtcgggtcgttcgatacgtaaaaaacgatcgccgttagatgcgatagtagcggatggtacggcggaatatcgacgtacgggtgattcg

SEQ ID NO: 7365 - DNA, 3753 bp, Artificial Sequence
  Description of Artificial Sequence: Synthetic coding sequence
atgtctactgaacgcgatagcgaaactaccttcgatgaggacagccaaccaaacgacgaggtcgtgccgtacagcgacgacgaaaccgaggatgaactcgatgaccaaggctcggccgttgaaccggaacagaaccgcgtcaacagagaggctgaggagaaccgggaaccattccgaaaagagtgcacctggcaagtgaaggcaaacgaccgcaagtaccacgagcaaccgcactttatgaatactaagttcctttgcatcaaagaatccaaatatgccaacaacgcaatcaagacgtacaaatacaatgcgttcacctttatcccaatgaatctgttcgaacaattcaagagggccgcgaatctgtacttcctcgctttgctgatcctgcaagcggtgccacagatctcaactctcgcctggtacactactctggtgccacttctggtggtgctcggggtgaccgcgatcaaggatctggtggacgacgtcgcccggcacaagatggacaaggagatcaacaaccggacctgcgaggttatcaaagacggcagatttaaggtggcgaagtggaaggagatccaggtcggcgatgttatccgcctcaagaaaaatgattttgtccctgcggacatcctgctgctgtcctcctcagaaccgaattcgctgtgctacgtggagacggcggaattggacggggaaaccaacttgaaattcaagatgtccctcgagatcaccgaccagtacctgcaaagagaagataccctggctacctttgatggattcatcgagtgcgaggaaccaaacaataggcttgataagtttaccggaaccctcttctggcggaacacttcgttccctctggatgcggataagatcttgctgcgggggtgtgtcatcaggaatacggacttttgccacggattggtcatttttgcaggggcagacaccaaaatcatgaagaactcaggaaagaccaggtttaagcgcactaaaatcgattacctgatgaattacatggtgtacactatcttcgttgtgctcattctcctcagtgctgggctcgcaatcggtcatgcctactgggaggcccaagtgggaaactcgagctggtacctctacgacggagaagatgacaccccgtcctaccggggttttctgatcttttggggctacatcatcgtcctgaacactatggttcctatctccctgtacgtgtcggttgaggtgatacgcctggggcagtcccatttcatcaactgggacctgcagatgtactacgctgagaaggacaccccggcgaaggcccgcactactactttgaacgagcaactgggacagattcactacattttctcagacaagaccggaactctcactcaaaacatcatgactttcaagaagtgttgcatcaatgggcagatttacggcgaccaccgcgacgcgtcccagcataatcataacaagatagagcaagtggacttcagctggaatacctacgcagacgggaaactggctttttacgaccattacctgatcgagcagatccaaagcggtaaagaaccggaggtgagacaattctttttcctgttggccgtgtgccacactgtcatggtcgatagaactgacggacaattgaattaccaggccgctagcccagacgaaggagcccttgtgaatgccgcgcggaactttggattcgctttcctcgcgagaacgcaaaacaccattaccatcagcgaactgggaactgagcggacctataacgtgctggccatcttggacttcaactccgaccgaaagcgcatgtccatcatcgtgaggacgcccgaaggaaacatcaagttgtactgcaagggagcggataccgtgatttacgagcgcctgcatcgcatgaatcccaccaaacaggaaacccaggatgcactggacatctttgctaatgaaaccctccggactttgtgcttgtgttacaaggaaatcgaagaaaaggagtttactgaatggaacaaaaagttcatggctgcgagcgtggcttcgactaacagagatgaggctcttgacaaggtctacgaggagatcgaaaaagatttgatcctgcttggggccaccgctatcgaggataagctgcaagacggggtcccagaaacgatctcaaaactggcgaaggcagacataaagatctgggtccttaccggggacaaaaaggagactgcggaaaacatcggattcgcatgtgagctgctgaccgaagatactaccatctgctacggagaggacatcaacagcctcctccacgcacgcatggaaaatcagcggaacagaggaggcgtgtacgcaaagttcgcgccgcccgtccaggagtcgttctttccgccgggcgggaatagggctctgatcattaccggaagctggctgaacgagattctgctggaaaagaaaaccaagcgcaacaagattctcaagctgaaatttccccggaccgaggaggaaagaagaatgcgcacgcagagcaagcggcggctcgaggcgaaaaaggagcagcggcagaaaaactttgtcgatctggcatgcgaatgctctgctgtgatctgttgtcgggtgactccgaagcagaaggccatggtcgtcgacctcgtgaagagatacaagaaagccatcactctggcaatcggggatggtgcgaacgacgtgaatatgattaagactgcccacatcggcgtgggcatttccggacaggagggtatgcaagctgtaatgtcatcggattactcatttgcacagttccgatacctgcagaggctgctgctggtgcacggacgatggtcgtatatccgcatgtgcaagtttttgagatacttcttctacaagaatttcgcattcactctcgtgcatttttggtacagcttcttcaacggatactcggctcagactgcatacgaggattggttcattaccctctacaatgtgctgtacacctcgctcccagtcctcctgatgggattgcttgatcaggacgtgtccgataaactctccctgcggtttccagggctctatatcgtgggccaacgggacctgctctttaactataagaggttcttcgtgtcgctcctccacggcgtgctgacttcaatgatcctgttcttcattccacttggagcctacctccagaccgtgggccaagatggcgaggccccatcggactaccagtcattcgcggtgaccatcgcgtccgcactggtgatcactgtgaacttccagatcggactggacacttcctactggacttttgtgaatgcgttttccatctttggttccatcgccctctatttcggaatcatgtttgactttcattcagccggaatccacgtgctgttcccctccgctttccagtttaccggtactgcctcgaatgcactccgacaaccgtacatctggctgaccatcattcttgctgtggcagtttgcctcctgcctgtggtcgcgatccgctttttgtctatgaccatttggccgtcagagtcggacaagattcaaaaacaccgcaagcgactgaaggcggaggaacagtggcagcggcggcaacaagtgttccggcgcggagtctccacgagacgctcagcatacgctttctcacaccagcgggggtacgccgaccttatcagctctggccgctcgatccgcaagaagcgctccccgctcgacgcaatagtggcagacgggaccgcagaataccggcggactggcgattca

SEQ ID NO: 7366 - DNA, 3753 bp, Artificial Sequence
  Description of Artificial Sequence: Synthetic coding sequence
atgtctaccgaacgggattcggagactacctttgacgaggattcccaaccgaacgatgaagtcgtgccatacagcgacgatgagactgaggacgaactcgacgaccaaggatcagctgtagaaccggaacagaaccgtgtgaatagggaggcggaagaaaaccgcgagccattccgtaaagaatgcacttggcaggtgaaggcaaacgacagaaagtaccatgaacagccgcacttcatgaataccaagttcctttgcattaaggaatccaagtacgcaaacaatgccattaagacttacaagtataacgccttcactttcatcccgatgaatctgtttgaacagttcaaacgggccgccaatctttacttccttgctctgctgatcctgcaagcagtgccccaaatctccaccctggcgtggtacaccacccttgtgccacttctcgtggtcctgggcgtcactgcgattaaagacctcgtggatgacgtggccagacacaaaatggataaagaaatcaacaatcggacttgcgaggtgatcaaggacggacgattcaaggtggccaagtggaaggagatccaggttggggacgtgatccggttgaaaaagaatgacttcgtcccggccgatatacttctgttgtcatcctcggagcctaattcgctctgctacgtcgaaactgcggagctcgacggagaaactaatctcaagttcaagatgtcgctggagatcacggatcagtatctgcagagagaagatacgctggcaaccttcgacggattcatcgaatgtgaagaaccgaacaatcgcctggataagttcactggaactctcttctggcgcaacacttcgttcccgctggatgccgacaaaatactgcttcgggggtgtgtgatccgcaatactgatttctgccacggactcgtgatctttgcgggtgccgataccaagatcatgaaaaactccggcaagacccggttcaagcgcactaagattgactacttgatgaactacatggtttacaccatcttcgtggtgctcatcctgctcagcgccggactggccatcggtcacgcttactgggaagcccaagtgggcaactcgagctggtacctgtacgacggagaggacgacactccttcctaccgaggtttcctgatcttttggggctatatcatcgtcttgaacacgatggtgccaatctcgctctacgtgtccgtggaggtcattcgcttgggtcagagccacttcatcaactgggacttgcagatgtactacgccgaaaaagacacccctgcaaaggcaaggactactaccctgaacgaacaactcggtcaaatacactatatcttcagcgataagactggtaccctgacccagaatatcatgaccttcaaaaagtgctgtatcaacggacaaatttatggggaccacagagacgcttctcagcataaccataacaaaatcgagcaggtggatttttcatggaacacctacgcagacggaaagctggcattctacgaccattatctgatcgagcagatccaatccggtaaggaacccgaggtgcgccagttctttttcctgctcgcagtgtgccatactgtcatggtggatcgcactgatggacaattgaactaccaagcggcgtcccctgacgaaggcgcgctggtgaatgcggctcggaacttcggattcgcctttctggctagaactcaaaacaccattacgattagcgaactggggactgagcggacgtacaatgtgctcgcaatccttgactttaactcggaccggaagcgcatgtcgatcattgttcgcaccccagaggggaatattaagctgtactgcaagggcgctgataccgtgatctacgagaggctgcatagaatgaacccaaccaagcaggaaactcaagacgccctggacatcttcgcaaatgaaaccctgaggacgctgtgcctctgctacaaggagatcgaagagaaggagttcaccgaatggaacaaaaagttcatggccgcctcagtggcgtccactaatcgcgatgaagccctcgataaggtgtacgaggaaatcgaaaaagatctgatccttctcggtgccactgccatcgaggacaagctccaggacggagtgccagagactatcagcaagctggccaaggccgatattaagatctgggtcctcaccggagataagaaggaaactgctgagaacattggcttcgcctgcgagctgctcaccgaagataccaccatctgctacggcgaggacattaattcgctgctccacgcgagaatggaaaaccagcgcaaccggggaggcgtctacgccaagttcgctccaccagttcaggagtcgttcttccccccgggaggtaaccgggccctgatcatcacgggcagctggcttaatgagatcctgctcgagaaaaagactaagcgcaacaagatcctgaaactcaaattcccgcgcacggaggaagaacgcagaatgagaactcaatcgaaacgccgactggaagccaagaaggaacaacggcagaaaaacttcgtggacctggcctgcgagtgttccgcggtgatctgctgccgggtcaccccgaaacagaaggcgatggtggtcgatctggtgaagagatacaagaaggctatcactctcgcgatcggggacggcgccaacgatgtcaacatgatcaaaaccgcccatattggcgtcggaatctcaggccaagagggaatgcaggcggtgatgtcgtcagactactcctttgctcagttccgctacctgcagcggttgctcttggtccacggaaggtggtcctacatcagaatgtgtaaatttctgcggtacttcttttacaaaaattttgcgttcaccttggttcatttttggtactcgtttttcaatggatacagcgcacagaccgcgtacgaggattggttcatcacgctgtacaacgtcctgtacaccagccttcctgtgcttctgatgggattgctcgaccaagacgtgtccgacaaactcagtctccgcttccctggactgtacatcgtggggcaaagggacctcctgttcaactacaagaggttctttgtctcgctgctgcacggagtgctcacctcaatgatcctgtttttcatccccctgggagcctaccttcagaccgtgggacaggacggggaagcacctagcgattaccagtcgttcgcagtcaccatcgcgtcagctctggtgatcactgtgaacttccaaatcggactcgatacctcctactggacctttgtgaatgcctttagcatctttgggagcatcgcactgtattttggaatcatgttcgacttccattctgccggcatccacgtcctcttcccgtcggctttccagtttaccggaaccgcctccaacgcactgagacagccgtacatctggttgactatcatcctggctgtggcggtctgtctgttgccggtcgtcgccatcaggttcctctcaatgacgatctggccgtcagaatccgataaaatccagaagcaccgcaagcgcctgaaagcggaagaacagtggcagcggagacaacaggtattccggcgaggcgtgagcacccggcgctcggcatacgccttcagccaccagcggggatacgctgacctgatctcatcaggacggtccattcgcaagaagagaagtcccctggacgctattgtggcagacggcactgcggaataccgcaggaccggagactcg

SEQ ID NO: 7367 - DNA, 3753 bp, Artificial Sequence
  Description of Artificial Sequence: Synthetic coding sequence
atgtctactgagcgggactcggagacgactttcgacgaagattcccagccaaacgatgaggtggtgccgtactccgatgacgaaactgaggatgaactcgacgaccaaggctcagccgttgaaccggaacaaaacagggtgaaccgcgaagccgaggagaacagagaacctttccgtaaggagtgcacttggcaggtgaaagcgaatgacagaaagtaccatgaacagcctcacttcatgaacacgaagttcctttgtatcaaggaatcaaagtacgctaataacgcgatcaagacgtacaagtacaacgccttcaccttcattccaatgaacctgttcgagcaattcaagcgggcagccaatctgtattttctcgcactgttgatcctgcaagctgtgccgcagatttccaccttggcgtggtacactactttggtgcccttgctcgtggtcctgggagtcaccgccattaaagacctcgtggacgacgtggcacgacacaaaatggataaggagatcaataatcggacgtgcgaggtgatcaaagacggtcgcttcaaggtggcgaagtggaaggaaatccaggtgggagacgtgatcagactgaagaagaatgatttcgtccctgccgatattcttctgctgtcaagctccgaacctaacagcctgtgctacgtggagactgctgagctggatggggaaaccaatttgaagttcaaaatgagcctggaaatcactgaccagtacctccaacgcgaggatacgctggccactttcgatggattcatcgagtgtgaagagccgaacaacaggctggacaagtttaccggaacgctgttctggagaaacacctcctttcccctggatgctgacaagatcttgctgcgcgggtgcgtgattcgcaacactgatttctgccatggcctcgtgattttcgcaggcgccgatactaaaatcatgaaaaactcaggaaagactcgcttcaagcgcaccaagatcgactaccttatgaactacatggtgtatactatcttcgtcgtgctgatcctgctgtcggctggccttgcaatcggccacgcctactgggaggcccaagtgggaaactcaagctggtacctttacgatggagaggacgataccccatcgtaccgcggcttcttgattttctggggatacattatcgtcctcaataccatggtgccgatctcgttgtacgtgtccgtggaagtcatccggcttggacagtcgcacttcattaactgggacctgcaaatgtactacgccgagaaagatacccctgcaaaggcccgcaccacgactttgaacgagcagctcggacaaatccattacattttcagcgacaagactggaactctcactcagaatatcatgaccttcaaaaagtgctgtatcaatggacaaatctacggagatcaccgcgacgcttcgcagcacaaccacaacaagatcgagcaggtcgatttttcttggaacacctacgccgacggtaagttggcgttctacgatcactatctgatcgaacagatccagtctgggaaggaaccagaggtgcggcagttcttttttctgttggcagtctgtcacaccgtgatggtcgacagaactgacggacagctgaactaccaagcggcatctccggacgagggggctttggtcaatgcagctcgtaatttcggtttcgccttccttgcccgcactcaaaacacgattactatctccgagctgggaacggagcgcacctacaatgtgctcgcaatcttggactttaactcggatcgaaagaggatgtcgatcattgtgcggaccccggaaggcaacatcaagctctactgcaaaggagccgacaccgtgatctacgaaagattgcataggatgaatcctaccaagcaggaaacccaggatgcattggacatcttcgctaacgagactctcagaaccctttgcctctgttataaggaaatcgaagaaaaggaatttaccgagtggaacaagaaattcatggccgcatccgtcgccagcactaaccgggatgaagccctggacaaggtgtacgaggagattgagaaggatttgatcttgctcggcgccactgccatagaagataagctccaggacggcgtcccggaaactatatcgaaactggcgaaagctgatatcaagatctgggtcctgacgggagacaaaaaggaaactgccgaaaacatcggattcgcgtgcgaattgctgactgaagataccactatctgctatggagaagatatcaactccctcctccatgcccggatggagaaccagaggaatcgcggcggagtttatgccaagttcgcgccgccggtgcaggagagctttttccctccaggagggaatcgtgcgctgattatcaccggcagctggctgaacgagatactgctcgaaaagaaaaccaagcgcaataagattctgaagctgaagttccccaggaccgaagaggaaaggcgcatgcgtacgcaatcgaagcggcggctggaagccaagaaggaacagcgccagaaaaacttcgtggacctggcatgcgagtgctcagcggtgatctgctgtagagtgaccccgaaacaaaaagcaatggtcgtggacctcgtgaagaggtacaaaaaagctatcacgcttgcgatcggcgacggagcaaatgatgtcaatatgatcaaaactgcgcacatcggcgtcggaatctctggacaggaagggatgcaggccgtcatgtcgtccgactattcgtttgcccaatttagatacttgcaacggctcctgctcgtgcatggccgctggtcctacatccgcatgtgcaaattcctgcggtacttcttctacaagaatttcgcattcactctggtgcacttttggtattcatttttcaacggatattccgcccagactgcctacgaagattggttcatcacgctgtacaacgtgctgtacactagcctccctgtgctgctcatggggctgctcgaccaggacgtcagcgataaactgtcgctgcgcttcccaggcctgtacatcgtgggccagcgggacctgctgttcaactacaaacgctttttcgtcagcctgctgcacggggtgctgacctcgatgatcctgttcttcatccccctgggagcttacctgcagactgttggacaggatggagaagcgccttcggactaccaatcgtttgctgtaactatcgcgtccgccctggtgatcactgtgaacttccagatcgggctggacacctcctactggacttttgtgaacgcattctcgatctttggatccatcgccctttacttcggcattatgttcgacttccactcagccggcatccacgtgctgtttcctagcgcctttcaattcactggcaccgcatccaatgcgctgcggcaaccgtacatctggcttaccatcatcctggcggtcgcggtgtgtctgctgcctgtcgttgccatccgcttcctttctatgactatttggccatccgaatcagataagatccagaagcatcggaaacggctgaaggccgaagaacagtggcagcgcaggcaacaggtatttagacggggcgtctcgactaggagatccgcttacgcgtttagccaccagcggggatacgcggacctgatcagctccggtcggtccattcggaaaaagcgctcgcctcttgacgccatcgtggcagacggaactgcagagtaccggcggactggagacagc

SEQ ID NO: 7368 - DNA, 3753 bp, Artificial Sequence
  Description of Artificial Sequence: Synthetic coding sequence
atgtcgaccgaaagagactctgaaaccacgtttgacgaggattctcagccaaacgatgaggtcgtgccctacagcgatgatgaaaccgaggacgagttggatgatcagggaagtgcagtcgagcctgaacaaaacagagtcaacagagaggcagaagagaaccgggaaccctttcgtaaggagtgtacttggcaggtgaaagcaaatgatcgtaagtaccatgagcaacctcatttcatgaacaccaagtttctttgcattaaggaaagcaagtacgctaacaacgcaattaagacttacaagtacaatgcattcacctttatccccatgaatcttttcgagcagtttaaacgcgctgcaaatctgtactttcttgcactgttgatcctgcaagcagtgccccaaatttcaacccttgcatggtacaccacgctggtgcctctccttgtcgtgcttggtgtgacggcgattaaagatctcgtcgacgacgtggccagacacaaaatggataaggaaatcaacaacaggacctgcgaagtgattaaggatggtagattcaaggtggcaaagtggaaggaaattcaagtcggtgatgtgatacgcctgaagaagaacgacttcgtgcccgcagatatcctgctgctctcttcgtcagagccaaacagcctttgttatgtggaaactgctgagctggacggagaaactaatctgaagttcaagatgtcccttgagataaccgaccagtacctccaacgggaagatacccttgcaacgttcgacggtttcatcgaatgtgaggaacctaataacagacttgacaagtttacgggcaccttgttctggaggaacacctcctttccactcgatgcagataagattctgctccgtggatgtgtgatacggaataccgatttctgtcatggactggtgatattcgcaggcgcagataccaagattatgaagaatagcggaaagactcggttcaagcgaaccaaaatcgattacctcatgaactacatggtctacaccatttttgtcgtgcttatccttctctcggccgggctggccattgggcacgcatactgggaggcccaagttggtaactcgtcatggtacctctacgatggagaggacgacaccccaagctacagaggctttctgatcttttgggggtacattatcgtgctgaacactatggtgcctatctccctgtacgtcagcgtcgaagtgattcggctcggacagtcccatttcataaactgggatctgcagatgtactatgcagaaaaggataccccggcaaaggctcgaaccactactcttaatgaacaacttggccagatccattacattttctcagacaagactggaactctcacccagaatatcatgactttcaagaaatgctgcattaatggccagatttacggcgaccatcgggatgcatcacaacataatcataacaagattgagcaagtggatttttcatggaacacttacgcggatggaaaacttgcattctacgatcattaccttattgaacagattcaatccggaaaggagccagaagtgcggcaattctttttcttgcttgccgtctgtcacaccgtcatggtggatcgcactgacgggcaactgaattatcaagctgcatcgccagatgaaggagcgctcgtgaatgccgcacgaaactttggatttgcttttctggcacgaacccaaaatacgattactatatcagaactcgggaccgaaagaacctacaatgtcctggcaatcttggatttcaattcggacagaaagcgaatgtccattatagtgcgcacccctgaggggaatatcaagctgtactgtaaaggagcggataccgtcatatacgaaagacttcataggatgaatccaactaaacaggaaacccaagacgcactggacatctttgcgaacgaaactctgagaactctttgtctttgttataaggaaattgaagagaaggaatttactgaatggaataagaagtttatggcagcctccgtcgcatcaactaatcgagacgaagccctggataaagtgtacgaagagattgaaaaggatcttattctgctgggagcgactgcaattgaggacaagctgcaagatggagtcccagaaactattagcaaactcgctaaagcagatatcaagatctgggtcctcactggtgataagaaggaaaccgcagagaatataggttttgcatgcgagctgcttactgaggacactaccatttgttacggcgaggacataaactcactgctgcacgctcgcatggaaaaccaacgtaacagaggtggtgtgtacgcgaagtttgcaccccctgtgcaggaatcgtttttcccaccggggggaaatcgggccttgataatcactggctcgtggctcaacgaaatccttttggagaaaaagaccaaacgtaacaagattttgaaacttaagttcccaagaaccgaagaagagcgtagaatgcgaactcagtcgaagcgaaggctggaggccaaaaaagagcagcggcaaaagaactttgtggacctcgcttgcgagtgtagcgcagttatttgttgtcgtgtgacccctaaacagaaggcaatggtcgtggatcttgtgaagcgatataagaaggcaatcactctcgcaataggcgatggcgcaaatgatgtgaacatgataaagaccgcacacattggagttggaatttcgggacaggaagggatgcaggcagtgatgtccagcgactattcgtttgcgcaattccggtacctccagcggctgctgcttgtgcacggtagatggtcgtacattagaatgtgtaagttccttcggtacttcttttacaagaattttgcgtttaccctggtgcacttttggtatagcttctttaacggatactcagctcaaaccgcgtacgaagattggttcatcaccctctataatgtgttgtatacctccctccccgtgcttcttatgggactgctggaccaggacgttagcgataagctcagcctgcgtttccccggcctgtacatcgttggtcagagagatctcctctttaactacaaacggtttttcgtctcgctcttgcacggagtgctcacgtcgatgattctgttcttcatccctcttggagcgtaccttcaaaccgtcggacaggatggcgaggcaccttcggattaccagtcgtttgcagtcaccattgcatcggcacttgtgatcaccgtcaacttccaaatcggtctggacacttcatactggacctttgtcaacgctttttctatattcggttcaatcgccctgtacttcggaatcatgtttgactttcattcggcagggattcacgtgcttttcccctcggcctttcagttcactggaaccgcaagcaacgcattgcggcagccctacatctggcttaccattatccttgcggtggctgtgtgtctgctcccagtggttgccatccggtttttgtccatgaccatttggccatccgaatctgataagattcagaagcatcgcaagcgcctcaaggcagaagaacagtggcaaagacgccagcaggtgtttcgcaggggagtgtccactcgaaggtcagcttacgcattctcgcatcagcgcggctatgctgatcttatcagctcagggcgttccattaggaagaagcgctccccgctggatgcgatagtggcagatggaactgcagagtaccgtaggaccggtgatagc

SEQ ID NO: 7369 - DNA, 3753 bp, Artificial Sequence
  Description of Artificial Sequence: Synthetic coding sequence
atgagcaccgaacgcgatagcgaaaccacgttcgatgaggactcacagcccaatgatgaagtcgtgccatactccgatgacgagactgaagatgaacttgatgaccaaggttccgccgtcgaaccagaacagaaccgggtcaatagagaagcagaagaaaatagggaaccttttcggaaagaatgtacttggcaggtgaaggcgaacgaccgcaagtaccacgaacaacctcactttatgaacactaagttcctctgcattaaagaaagcaagtacgcaaataacgccattaagacctacaagtataacgcatttactttcatcccaatgaatctgtttgaacagtttaagcgagccgcgaatctttactttctggcgcttctgattctgcaagccgtgccccagatcagcactctggcgtggtacaccactcttgtccccctgcttgtcgtcctgggcgtgacggctataaaggatctcgtggatgatgtcgcgagacacaaaatggacaaggagattaacaatcgcacctgcgaggtcatcaaggatggacgattcaaggttgcaaagtggaaagaaattcaggtcggtgatgtcattcgcctcaaaaagaacgactttgtgccagccgacatcctccttctttcaagctcggagcctaactctctttgctacgtggagacggctgaactcgatggagaaaccaatctgaaattcaaaatgtctcttgagattactgatcaataccttcagcgcgaagatacgcttgcaacctttgatggatttatcgagtgcgaggagcctaacaatcgcctggataagtttactggaaccctgttttggcggaacacttcctttccactcgacgcagacaaaattcttctcagagggtgtgtcattagaaacactgatttttgccatggcctggtcatttttgcaggtgcagataccaagattatgaaaaactcaggaaagactcgattcaagagaactaagatcgactaccttatgaactacatggtgtacactatctttgtcgttcttattctgctttcagctggtctggccattggacatgcatactgggaagcgcaagtgggaaattcgtcgtggtacctttacgacggagaggacgatacgccttcatacagaggtttccttatcttttggggatacatcatcgtgttgaatacgatggtgccaatttctctgtatgtttcggtggaagtgatccggctgggacagtcgcactttatcaactgggacctccaaatgtactatgccgagaaggatactcctgcaaaggctagaaccaccactctgaacgagcagttgggccagattcattacatcttttcagataaaactgggacccttactcaaaacattatgacctttaagaagtgctgtattaacggtcagatctacggcgatcacagagatgcgagccagcataatcataacaaaatcgaacaggtggacttctcatggaatacgtacgcagacggcaagttggcgttttacgatcactacttgatcgagcaaatccagagcggaaaagagccggaagtgaggcagtttttctttcttcttgcagtctgtcacaccgtgatggtggaccggacggacggacaactgaattatcaggcggcatcccctgatgagggagcgctggttaacgcagctagaaactttggctttgcctttttggcaaggacccagaataccataactattagcgaactcggtaccgaaaggacctacaatgtcctggccatactggatttcaattccgatagaaagagaatgtcaatcattgtccgcactcctgaagggaacatcaaactgtactgtaaaggagctgatactgtcatttacgaaagattgcataggatgaacccaactaagcaggagactcaggatgccttggatatctttgcgaatgaaaccttgcgtaccctgtgtttgtgctacaaagaaattgaagaaaaggagtttaccgagtggaataagaaattcatggcggcgtcagtggcatccaccaaccgcgatgaggcgcttgataaagtgtacgaagaaattgaaaaggatctgatacttctcggagcaactgcaatcgaggacaagctgcaagacggagtgccggagactataagcaagctcgcgaaggccgacatcaagatctgggtgctcactggagacaaaaaagaaaccgcagaaaacatcggctttgcctgtgaacttctgaccgaagatactactatttgttacggagaagatatcaactcgctgctgcatgccagaatggaaaaccaacgcaaccggggtggtgtgtacgcaaagtttgcccctcctgtgcaagaatcgttttttccaccaggaggcaatagggcactcatcatcactggttcatggctgaacgaaattctcttggaaaagaaaaccaagaggaataagatactgaaacttaagttccctagaactgaagaggaacggagaatgagaacgcagagcaagaggcgcctggaggcaaaaaaggagcaaagacaaaagaacttcgtggatcttgcctgtgagtgctcggcagtgatttgctgccgggtgacgcccaagcaaaaggccatggtcgttgatcttgtgaagagatacaagaaggcaatcacccttgcaattggagatggtgctaacgacgtgaacatgattaagactgcgcatatcggagtcggaatttcgggtcaagaggggatgcaggccgtgatgtcgtcggactactccttcgcccagtttcgttacctccagagactgctgcttgtgcacgggaggtggtcatatatcagaatgtgcaaattcttgagatactttttctacaagaacttcgcatttactctcgtccacttttggtacagcttctttaacggctactccgcccaaacggcatacgaagattggttcataactttgtacaatgtgctttacacgagtctgccagtgctcctgatggggctgctggatcaagatgtgtccgacaagttgagcctgagattccctggactgtatattgtgggtcagcgggacctgctgttcaattacaaaagatttttcgtgagccttctccacggggtgcttactagcatgattctctttttcatccctctcggtgcatacctccagactgtgggtcaggacggggaagcaccctcggattaccagagctttgcagtcaccatcgcatcagctttggtcattaccgtgaattttcagattggacttgatacctcctactggacttttgtcaatgcgttttcgattttcggttccattgcgctgtactttggaatcatgttcgatttccactcagcaggcattcacgtcctgtttccatccgcatttcagtttaccggaactgcttcaaatgccctgcgtcaaccatacatttggctcaccattattctggcagtggcagtgtgtctgctgcccgtggtggcaatacggtttctgtccatgaccatctggccatcagaatccgacaaaatacaaaagcacagaaagagactgaaggctgaagaacagtggcagagacgacagcaggtgtttcgccgtggtgtctcgacccgcaggagcgcttacgcatttagccatcaacgaggttacgcagacctgatatcgtccggcagatctatcagaaagaagcggtcccctctcgatgcgatagtggccgatgggaccgccgaatacagacgtaccggagattct

SEQ ID NO: 7370 - DNA, 3753 bp, Artificial Sequence
  Description of Artificial Sequence: Synthetic coding sequence
atgtctactgagagagatagtgagaccacatttgacgaggattcacagcctaacgacgaggttgtaccttacagcgacgatgaaaccgaagatgaactggacgaccagggatccgcagtggaacctgaacagaacagagtgaacagggaggcagaggaaaacagagagccttttaggaaggaatgcacgtggcaggttaaagccaacgacaggaagtatcatgaacaaccgcatttcatgaataccaaattcctgtgtattaaagaaagtaagtacgccaataacgcgattaagacttacaaatataatgccttcactttcatccccatgaacctgttcgagcaatttaaaagggcagcgaacctgtatttcctggctctcctcattcttcaagcggtgccacaaatatcaactttggcttggtacaccacgctggtcccactgctggtggtccttggcgttactgccatcaaagatctcgtcgacgatgtcgccagacacaaaatggacaaggaaattaacaataggacatgtgaggtcataaaggacggcaggtttaaagtagctaagtggaaggaaattcaggttggtgacgtgataaggctcaagaagaacgacttcgtgccagctgacatcttgctgttgagctcttctgagcccaatagcctctgttatgttgagaccgcggagcttgacggtgagaccaatttgaagttcaaaatgtccctcgaaattaccgaccagtacctgcagcgcgaagatactctcgcaacattcgacggattcattgagtgtgaagaacccaataaccgcctcgataagttcactggtaccctcttctggaggaacacatcatttcccctggacgctgacaagattttgctgcgcggttgcgtgatcagaaacaccgacttctgtcacggcctggtgatcttcgccggcgcggacacaaagataatgaagaactccggcaaaactcgctttaaaaggaccaagattgactaccttatgaactatatggtctacaccatatttgtggttctcattctgttgtcagcaggtcttgctatcggtcacgcctattgggaggctcaagtgggcaattcttcttggtatctgtacgacggcgaggatgacacaccttcctacaggggctttttgattttttggggatacatcattgtgctcaataccatggtgccgatctcactgtacgtaagcgttgaggttatcaggttgggacagtctcattttatcaactgggacctgcagatgtattatgccgaaaaggacacacccgctaaggctcgcaccaccacattgaacgaacagctgggacaaattcactacatcttctcagataagacaggtaccttgacgcagaatatcatgaccttcaagaagtgctgtattaacggccagatctatggtgaccaccgcgatgccagtcagcacaaccataacaaaattgaacaagtagacttttcttggaacacatatgccgatggcaaattggccttctacgatcattacttgatagagcagatacagtcaggtaaagagccagaagtccgccagtttttcttcctgttggcagtatgtcacacggtgatggttgatagaacagacggacagcttaactatcaagcagcgtcccccgatgaaggtgcattggttaatgcagctagaaatttcggttttgcttttttggccagaacccagaatacaatcacgatctccgagctgggtacggagaggacatacaacgtcctcgctattttggactttaacagtgatcgcaagcgcatgagcatcatcgtgagaacgcctgaaggtaacatcaagctgtactgtaaaggagcggatactgtgatatacgagaggcttcacagaatgaatcccaccaagcaggagacccaggatgccctcgatatttttgcgaacgaaacgctgagaaccctgtgtctttgctacaaggagatagaggaaaaggaattcacggagtggaacaaaaagttcatggctgcgagtgtggcgtctacgaatcgcgatgaggcactcgataaagtttacgaagagatcgagaaagacctgatccttcttggagctaccgctatcgaagataaactccaggacggagtgcccgaaactatatctaaactcgccaaagccgatatcaagatctgggtactgactggcgataagaaagagaccgctgaaaatatcggtttcgcctgcgagttgttgactgaagataccactatttgttacggagaggatatcaattctctcttgcatgctaggatggaaaatcagcgcaataggggcggtgtgtatgcaaaatttgcgcctccagtacaggaatctttttttcccccaggcggcaatagggcgctcatcatcaccggcagttggctgaacgagatcttgcttgagaaaaagactaaaaggaacaagatcctgaagctgaagttcccgagaactgaggaggaacgccgcatgaggactcagtccaagcgcaggttggaagctaaaaaggaacagaggcaaaagaacttcgtagatctggcctgcgagtgttctgctgtgatctgttgccgcgtcactcctaagcagaaggccatggtagttgacctggtcaagaggtataaaaaagctattacactggccattggtgatggtgcgaacgacgttaatatgattaagaccgctcacatcggcgtcggcatatctggtcaagaaggcatgcaagccgtcatgtcttccgactacagctttgcacagttcagataccttcagcgcctgctgctggtgcacggcaggtggagctatataagaatgtgcaagttcctgcgctatttcttctataaaaacttcgcgtttacgctggtccacttctggtactccttcttcaatggatactctgctcagactgcatacgaagactggttcataaccctctacaacgtgttgtacacatcactcccagtgctcctgatgggactccttgatcaggacgtaagtgacaagctgtcactgagattcccaggtctctacatcgtcggacagagggaccttctctttaactataaaaggttcttcgtttctctgcttcacggagtcctcacttccatgatccttttcttcataccactcggtgcctacctgcagaccgttggacaggacggcgaagcaccctccgattatcagagttttgctgtcacaatcgcgtccgccctcgtgattacagttaacttccaaattggattggacaccagttactggaccttcgtaaacgcctttagcatctttggctccattgctctttactttggtatcatgttcgacttccacagcgctggaatacacgtactgttccctagtgcttttcaatttacaggtacggcatcaaatgcattgcgccagccgtacatctggttgactatcatcttggccgtcgccgtctgcctgcttccggttgttgccattcgcttcttgagcatgacgatctggcccagcgaaagcgacaaaatacagaaacatagaaagagactcaaggccgaagaacaatggcaaagaaggcagcaggtgttcaggagaggcgtgtcaactcgccgcagtgcctacgccttttcccaccagcgcggctacgccgatctgatctcatccggtagatctattagaaagaaaaggagtccattggacgcaatagttgccgacggcacagctgagtatcgccgcaccggtgacagc

SEQ ID NO: 7371 - DNA, 3753 bp, Artificial Sequence
  Description of Artificial Sequence: Synthetic coding sequence
atgtcgacggaacgcgactctgaaactaccttcgacgaggacagccagcccaacgacgaggtcgtgccatactctgatgacgagacggaggacgagctagatgaccaaggatccgcagtggagccagaacagaaccgtgtgaatagagaagccgaggagaaccgagagccattccgcaaagagtgcacttggcaagtgaaagcgaacgaccgtaaatatcatgaacagcctcattttatgaataccaagttcttgtgtattaaagagtcgaagtacgccaataatgcaatcaagacttacaagtacaacgcattcacatttattcctatgaatctctttgagcagtttaaaagggccgccaatctctatttccttgcgttgcttattttacaagctgttcctcagatctctaccctcgcgtggtacaccacgcttgttccacttttggtggtgctgggcgtgaccgccatcaaagacctggtcgacgacgtcgcacgtcataagatggataaggaaatcaacaacaggacatgcgaagttatcaaagatggacggtttaaggttgctaagtggaaggagattcaagttggggacgtgatccgcctcaaaaagaacgactttgtaccagctgacattcttttactttcttctagtgaacccaatagtctttgctacgtggagacggcggagctagacggcgagacgaacctgaaattcaaaatgtcactcgaaatcacggatcagtacttgcagcgcgaagacacacttgcaaccttcgacggcttcattgaatgtgaggaaccaaataacagactggacaagtttaccggcacgctcttctggcgcaacacatccttccctctagatgccgacaagatactcctgaggggctgcgttatccgcaatacggatttttgtcacggacttgtgattttcgctggtgcggacaccaagatcatgaagaatagcggtaaaactcgcttcaaacgtactaagatcgattatctaatgaattacatggtgtataccatattcgttgtccttatcctgctgagtgccggactggccattggacacgcttattgggaagctcaggttggcaattcctcatggtatctttacgatggagaagatgatacgccgtcgtaccgtggctttcttattttttggggctacataattgtgttgaataccatggtccctatctctttgtacgtctcagttgaggtaatcagacttggtcaatcgcacttcatcaattgggatctgcaaatgtactacgcggagaaggacactccggcaaaggccagaacgacgactctcaatgaacagctcggccaaatacactacatcttctctgataagactggtacgctgacccagaatatcatgactttcaagaagtgttgcattaacggtcagatctatggggatcatagggacgccagccagcataatcataataaaattgaacaggttgacttttcctggaatacttacgccgatggtaaactagcattttacgatcattacctgattgagcagatccagtccggaaaggaaccagaagtgcgccagttctttttcttacttgcagtctgccatacggtaatggtagatcggaccgatggtcagttgaactaccaggcagccagcccggacgaaggagctctcgttaacgctgccagaaattttggcttcgcttttctagcacgtacacagaacacgattactatttctgaattggggacggagcgcacctacaacgtgctcgccatccttgattttaactcggaccgtaaacgtatgtcaataatagtccgaaccccagaggggaacattaagctttactgtaagggggcagatacagtcatctacgaacgcttgcaccgtatgaatcccacaaagcaggagacgcaggatgccttagatatttttgccaatgaaacgctgcgaactctgtgcttgtgttacaaggaaattgaagaaaaggagttcaccgaatggaacaaaaagttcatggccgccagcgtagcctcgaccaatagggacgaggctttagataaggtttatgaagagatcgaaaaggacttaatcctgttgggcgcgaccgctatcgaggacaaactccaggatggcgtgcctgagactataagcaagctcgctaaggcagacattaagatttgggtccttactggggacaagaaggagaccgctgagaacattgggtttgcttgcgagctgcttacagaagatactacgatttgttatggcgaggacatcaactccttgctacatgctagaatggagaaccaacgcaatcgagggggtgtctacgcaaagtttgcgccccccgtgcaagagagtttctttccacctggtggtaatcgagcgttgatcatcaccggaagttggttgaatgaaattcttcttgagaagaagacgaagcggaataagatccttaaactaaaattcccgcggactgaggaggagcggcgcatgcgcacccagtccaaacgacgattagaagcaaagaaagagcagcggcagaagaatttcgtagatctcgcctgcgaatgctccgccgtgatctgttgccgcgtcacgcctaaacaaaaggcaatggtggtagatttggttaagcgttacaagaaagccatcacgctcgctattggtgacggtgcaaatgacgtaaacatgatcaagaccgctcatatcggcgtcggtatttccggtcaagaagggatgcaggcagtcatgtctagcgattacagctttgcccagttccgatatttgcagcgtcttctcttggtgcatggtagatggtcctatatccgcatgtgcaaattccttcggtacttcttctataagaactttgcttttaccctcgtgcacttttggtactccttcttcaacggctactctgcacagaccgcttatgaggactggtttattaccctatacaacgtgttgtacacctctctcccagtactgttaatgggcttactcgaccaggacgtttctgacaagttaagcctccgattccccggcttgtacattgtaggtcagcgtgatctgctgttcaattataaacgattctttgtgagtttgctgcacggggtactcacgtcgatgattctattttttattccattgggcgcgtacctccagactgtagggcaagacggagaagctccaagcgattatcaatcattcgccgtcacaatcgcctcagctctcgtcatcaccgtcaacttccaaatcggcctggatacaagctactggacattcgtcaacgctttttcgattttcggcagcatcgccctttatttcggcatcatgtttgacttccattccgcgggaattcatgtcctgttcccttccgcgtttcaatttacgggcaccgcctcgaacgccctgcggcagccgtatatttggctaacgataatacttgcagtagctgtttgcctattacctgttgtcgctatcagatttctttctatgaccatatggccctctgaatctgataagatacaaaagcaccgtaagcgccttaaggcagaggagcaatggcagcgccgccaacaggtttttcgaaggggtgtcagcacgaggagaagtgcttacgctttttctcaccagcgcgggtacgctgatctgattagcagtgggcggtccattcgaaagaagcggtcacctcttgatgcaatcgtcgccgacggtaccgctgaatatcgccgtaccggagattct

SEQ ID NO: 7372 - DNA, 3753 bp, Artificial Sequence
  Description of Artificial Sequence: Synthetic coding sequence
atgtctaccgaacgagattcggagacaacttttgatgaagatagccagcccaacgacgaagtggtgccatactccgacgacgagaccgaggatgagttggacgaccagggttccgccgtcgagcccgagcagaatcgggtcaacagagaggctgaggagaacagggagccattccgcaaagaatgcacttggcaagtgaaggccaacgataggaagtaccatgagcagccacacttcatgaataccaagtttctttgtatcaaggagagcaaatatgcaaacaatgcaataaagacgtacaaatacaacgccttcacctttatacccatgaatctgtttgagcagtttaagagagccgctaacctgtactttctggctctcctgatcctgcaagcagttccccagatcagcacactggcctggtacactaccctggtgccactccttgtggtcctcggtgtaactgccataaaagatcttgtcgatgacgtggctcggcataagatggacaaagagattaataaccgtacttgcgaggtaatcaaagatggaaggtttaaagttgccaaatggaaagagattcaggtcggagacgttattagactcaagaagaacgattttgtgcccgcagatatattgctcctgagtagcagcgagccaaacagcctgtgctatgtggagaccgccgagctggatggagaaacgaaccttaagtttaaaatgtccctcgaaatcaccgaccagtacttgcagagggaagacacactggcaacctttgatggctttattgagtgcgaagagcctaacaaccgactggacaaattcacaggaacactgttttggaggaacacatccttccccctggatgcagataagattctgctgagaggttgcgtgatacgaaacaccgacttttgccatgggctcgtgatttttgcaggcgcagatactaagatcatgaaaaactcgggcaaaacgagatttaaaagaacaaaaattgattatcttatgaattacatggtttacaccatatttgtggtcctgatactgctctctgccgggctcgctatcgggcatgcttactgggaagctcaggtgggaaacagtagctggtatttgtacgacggtgaagacgacaccccttcttacagggggttcttaattttctgggggtatatcatcgtgctgaacacaatggtcccaatcagtctctacgtcagcgtagaagtgattcggctgggacagtctcacttcatcaactgggatctgcagatgtattatgccgagaaggatacccctgccaaggcacgtaccacaaccctgaacgagcagttgggacagattcactatattttctcagataaaaccggtacattgactcaaaacataatgactttcaaaaagtgttgtattaacggtcagatttacggggatcatcgggacgcctcccagcataaccataacaaaatcgaacaagtggactttagttggaacacatacgcggacggcaaattggccttctacgatcattacttaatcgaacagattcaaagtggaaaggaacccgaggtcaggcagtttttcttccttctggccgtgtgtcacaccgtgatggtggatcgcactgacggccagctcaattaccaggctgcatctcccgatgagggagcactggtcaacgctgcccggaactttgggttcgcttttttggcccggacccagaacaccatcacgatttccgaactgggaaccgagcgtacttacaatgtgctcgccatcctggactttaacagtgacaggaagagaatgagcatcattgtccggacaccggaaggcaacattaagctctactgcaagggggcagacacggtgatatatgagcggctgcatcggatgaacccaaccaaacaggagacgcaagatgcactggacattttcgctaatgagaccctccgcacactttgcctgtgttataaagaaatcgaggagaaggaattcacagaatggaataaaaaatttatggccgcaagtgtggcctctaccaacagggatgaggcattggataaggtttacgaggaaatagaaaaagatctcatccttttaggcgcaacagcaatcgaggataagctacaggacggagtgccggaaactatttcaaagctcgctaaggcggatattaagatctgggtcctgacaggggacaaaaaagagacagcggagaacattgggttcgcttgcgaactcttaactgaggacactaccatctgttatggcgaggacattaattctttgttgcacgcacgaatggaaaaccaacggaacagaggcggcgtgtatgcaaagtttgctccccccgttcaggaatcgttttttccgccaggtggtaatagggccttgataatcaccgggtcatggttgaatgagatcctgctggaaaagaagacgaaacggaacaagatcctaaagcttaagtttcctaggacagaagaggagcggcggatgagaacacagtcaaagaggcggctggaagccaagaaagaacaacgtcagaagaatttcgtcgacctagcatgcgaatgctcagcggtgatctgttgccgagtaacccctaagcagaaggccatggtagtggaccttgtgaagagatacaagaaggccattaccctcgccatcggtgatggcgccaatgatgtgaacatgatcaagaccgctcacatcggcgtgggcattagcggtcaggaaggcatgcaggctgttatgtcctctgattattcctttgcacagttcaggtaccttcaacgactactgctcgtacacggacgttggtcgtatatccggatgtgcaagtttttgaggtactttttttacaagaactttgcattcacactggtccacttctggtacagcttcttcaatgggtattccgctcagacagcttatgaggactggtttataactttgtacaatgtcttgtacacgtccctcccggtgttgctcatgggtctgctggatcaagatgtgtccgataagctcagtctgcggttccctggcctatatattgtgggccaaagagatctgttgtttaactacaaaagattttttgtctctttactgcacggggtactcacctccatgatcttattcttcattccactgggcgcttatctccagacagtcgggcaagacggcgaagcccccagtgattatcagtcctttgccgtcacaattgccagtgctctggtaattactgtgaacttccagatcggcctcgacacatcttactggacattcgtgaatgccttctccatcttcgggtccatcgctctgtatttcggaattatgtttgactttcattcagcaggcattcatgtactgttcccctccgcctttcagttcacagggaccgcatctaacgcgttacggcagccttatatttggttaactataatactggcggtggccgtctgcctcctacccgtggtcgctattcggttcctttcgatgactatctggccaagcgaaagtgataagatccaaaaacatcgaaaaagactgaaagcagaagaacagtggcaacgccggcagcaggtgttccggcgcggggtttccacccgaaggtcagcttatgccttctctcaccagcgcgggtacgccgatctgatttcttccgggagatccatccgcaaaaagcggtcaccactagatgcaattgtggccgatggcactgcagagtacaggcgtaccggcgacagt

SEQ ID NO: 7373 - DNA, 3753 bp, Artificial Sequence
  Description of Artificial Sequence: Synthetic coding sequence
atgtccacagagcgtgactccgagacaaccttcgacgaggacagccagccaaacgacgaggtggtgccttacagcgacgatgaaactgaggacgagctggatgatcagggctctgctgtggagccagagcagaaccgtgttaatcgcgaggctgaggagaacagagagcctttcaggaaagagtgtacctggcaggtaaaagccaacgaccgcaagtatcacgagcagccacacttcatgaacaccaagttcctttgtattaaagagtcaaagtacgctaataatgccatcaaaacatataaatataatgccttcacattcatccctatgaacctgttcgaacaattcaaacgcgccgctaatctgtacttcctggcactgcttattctgcaggccgttccacagattagcaccttggcttggtacaccaccctcgtgcctctgttggtggtgcttggtgtcaccgccatcaaagacctggtagacgacgtcgctaggcataagatggacaaggaaattaataataggacctgcgaggttatcaaggacggacgtttcaaggttgccaagtggaaagagatccaggtgggcgatgtcattcgcttgaagaagaacgatttcgtaccagccgacatactgctcttgagttctagtgagccaaactccctgtgttacgtcgagaccgccgagttggacggcgaaacaaacttgaagtttaagatgagtctggagattaccgatcagtaccttcagcgcgaggataccctggctacattcgatggatttatcgaatgcgaggaacccaacaatcgcctggataagttcacaggtactctgttttggagaaacacctctttccctctcgacgctgacaaaattctcctgagaggatgcgtgatccgcaataccgatttctgccacggtctggtcatcttcgcaggagccgacaccaagatcatgaaaaactcaggcaagaccaggttcaagaggactaagattgactacctgatgaactacatggtatacactattttcgtggtgctgatcctgctctccgctggcttggccataggtcacgcatactgggaggctcaggtgggaaattcttcttggtacctctacgacggcgaggatgacaccccctcttaccgcggcttcctcatcttctggggatatattattgtcctgaacaccatggtgcccatttcactgtacgtgtccgttgaagtgatcaggctgggtcaatctcatttcatcaactgggatttgcagatgtactacgctgagaaagatacacctgccaaagctcgcactacaaccctgaacgaacagttgggccaaatccactacatcttcagcgataagactggaactctgactcagaacattatgacattcaaaaagtgctgcattaacggtcagatttacggtgatcacagggatgcttcccagcacaatcataacaaaatcgaacaggtggatttctcttggaatacctatgccgacggcaagttggctttctatgaccactacctgattgaacagatccagagcggtaaggagcccgaggtgcgccaattctttttcttgcttgctgtctgccataccgtgatggttgaccgcaccgacggccaactgaactaccaagctgcttctcctgacgagggagccctggtcaacgctgctcgcaatttcggctttgctttcctggccagaacccagaacaccatcacaattagcgagcttggaaccgaacgtacttataacgtgctggcaatcctggatttcaattctgataggaagagaatgtctatcatagtgcgtactcccgagggtaacatcaagctctactgcaagggcgccgatacagtcatttacgaacgcctgcacagaatgaaccccaccaaacaagaaacccaagacgccctggacattttcgccaatgaaaccctccgcactctgtgtctgtgctacaaggaaattgaggagaaagaatttactgagtggaataaaaaattcatggctgctagcgttgcttcaactaatagggacgaggcactcgacaaggtgtacgaggagatcgagaaggacctgattctgctgggcgcaaccgcaatcgaagacaagcttcaggatggagttcccgagaccatttcaaagcttgccaaagctgacatcaaaatctgggtcctcaccggagacaagaaggagactgctgagaatataggcttcgcatgcgaactgctgaccgaggacactaccatctgctacggagaagacattaactcactcttgcacgcaaggatggagaaccagcgtaacagaggaggagtgtacgccaaattcgccccacctgtccaggaatctttcttcccccctggaggcaatcgcgctctgattattaccggatcctggctcaacgaaatcctgctggagaagaagactaaacgcaacaagatcctcaagcttaagttccctcgcaccgaggaagagaggcgtatgcgtactcagtcaaagcgtaggctggaggccaagaaggagcaacgccagaagaattttgtggacctcgcatgcgaatgttctgctgtgatctgttgtagggtgacaccaaagcagaaggccatggtggtagacttggtgaagaggtacaaaaaggcaatcactctcgctatcggcgatggcgccaacgacgttaacatgatcaagaccgctcacattggcgtgggaatcagtggccaggagggaatgcaggcagtgatgagctcagattattcctttgcccaattcagatacttgcaacgccttttgctggttcacggaaggtggtcctacatcaggatgtgtaagttcctgcgttacttcttttacaagaacttcgcatttacactggtccacttctggtatagtttcttcaacggttactcagctcagactgcttacgaagattggtttattactctgtacaacgtcctgtatacatctcttcccgtgttgctgatgggactgctggaccaggatgtgagcgataagttgagcctgcgtttccccggactctacattgtcggtcagagagaccttctgtttaactacaagagattttttgtctctctcctccatggagtgctgacctctatgatccttttcttcatccctcttggtgcctatctgcagactgtcggtcaggatggagaggcacctagtgactaccagtcttttgctgtcacaatcgcttcagctcttgtcatcacagtgaacttccagatcggattggacacaagttactggacattcgtaaatgccttctctatttttggttcaattgccctctatttcggcatcatgtttgattttcactcagccggtattcatgtgcttttccctagcgccttccaatttacaggcactgcttcaaacgccctgcgtcagccatatatttggctcaccatcatcctggctgtggccgtttgcctcttgccagtggtggcaatacgcttcttgtccatgaccatctggccctctgagtcagacaagatacaaaagcacaggaaacgcctgaaggctgaggagcagtggcaacgtagacaacaggtttttaggcgtggtgtgtccaccaggcgcagcgcttacgctttcagccatcagcgtggatatgctgaccttatcagttcaggtagatccatacgtaaaaaaagatctccccttgacgccatagtcgccgatggcacagctgagtacagacgcactggtgactcc

SEQ ID NO: 7374 - DNA, 3753 bp, Artificial Sequence
  Description of Artificial Sequence: Synthetic coding sequence
atgtctactgagcgtgactcggagacgacgttcgatgaagacagccagccaaatgatgaggtcgttccctactccgatgacgagaccgaggacgagctcgacgatcaggggtcggcagtcgagcctgagcagaaccgcgtcaatcgcgaggctgaagaaaaccgtgagccttttcgtaaggagtgcacgtggcaagtgaaggccaacgatcgtaaataccacgagcagccgcacttcatgaacacgaagttcttgtgcatcaaggagtccaagtacgcaaacaatgctatcaaaacatataagtacaacgcgttcacgttcatccctatgaacctgttcgagcagttcaagcgagccgccaacctgtacttcctcgcattgcttattttgcaggccgtgcctcagatctccaccttggcctggtacaccacgctggtgccgctcctggtcgtcctgggtgtcacggctatcaaggatctcgtcgacgacgttgcccgccacaagatggacaaagagatcaacaaccgcacctgcgaggtcatcaaggatggacgcttcaaagtggcaaagtggaaggaaatacaggtcggtgacgtcatccgtttaaagaagaatgacttcgtgcctgctgatatccttctgttatcttcatccgagcctaactcgttgtgctacgttgagaccgccgaactggacggtgagacaaacctcaagtttaagatgtccctggaaattaccgatcaatacctccaacgagaggacacgctggccacatttgacggtttcatcgaatgtgaggagcctaacaaccgtctcgacaagttcactggtacgctgttttggaggaatacgtctttccctctggatgccgataagatcctgctacgtggctgtgtcatcaggaacaccgacttctgccacggcctagttatcttcgctggtgcagacacgaagattatgaagaacagcggcaagactcgctttaagcgtaccaagatcgactacctcatgaactatatggtgtacacgatattcgtcgtgctcattctgctgtccgccggcctcgcaattgggcatgcctactgggaagcccaggtcggtaactcgtcttggtacttatatgatggcgaggatgataccccctcgtaccgtggttttctcatcttctggggttacatcatcgtcctgaacacgatggtccccatctcactttacgtgagcgtggaggtcatccggctcggccagtcccatttcatcaactgggatctgcagatgtactatgcagaaaaggacactcccgccaaggccaggaccaccacattgaatgagcagctggggcagatacattatattttttctgacaagactggtactctcacccagaacattatgactttcaaaaagtgctgcatcaacgggcagatatacggagaccaccgtgacgcctcccagcataaccataataaaatcgaacaggttgatttttcctggaatacttacgccgatggaaagttggcgttctacgatcattacctgattgagcagattcagagcggcaaggagcctgaggtgagacagttcttcttcctcctggctgtatgtcacactgttatggttgaccgtacggatggacaattaaactatcaggccgcgtctcccgacgagggagccttggtcaacgccgctcgtaactttggttttgcgttcttagcccgtacacagaacacgatcacgattagcgagctcggtactgagcggacctataatgtcctcgccatcctcgacttcaactccgaccgcaagcggatgtctatcattgttcgcacccctgagggcaacataaagctttactgtaaaggtgccgacaccgtcatatatgaacgcctgcaccgcatgaacccaacgaagcaggagactcaagacgcgctcgatattttcgctaacgagactctgcgcaccctctgtctgtgctataaagagattgaggagaaggaatttaccgagtggaacaagaagtttatggcagcctccgttgcctccactaaccgtgatgaagccctcgacaaggtttacgaagagattgaaaaggaccttattctgctgggcgcgaccgccatcgaagataagctccaagacggggtccccgagactattagcaagctggcgaaggcagatatcaagatctgggttcttactggtgacaagaaggaaaccgcggagaatatcggcttcgcctgcgaattgctgaccgaggataccaccatttgctacggagaggacattaatagtctgctccacgctcggatggagaaccagcgtaacagaggaggcgtctacgcgaaattcgctccccccgtccaggaaagcttcttcccccccggtggtaacagggccctgattatcaccggatcctggctgaatgagattctattggagaagaagacaaaacgtaacaagattcttaagctcaagttcccccgcacagaagaggagcgtcgaatgagaacccagagtaagcgtcgccttgaggctaagaaggagcaacgacagaagaacttcgtcgacctggcgtgcgagtgttcagcagtaatctgttgccgggtgacccccaagcaaaaggcgatggtcgttgacttggtcaagcgttacaagaaagctatcacccttgcgattggcgatggcgcgaacgacgtgaacatgattaagacggcccatatcggcgtgggtatctctggtcaggaaggcatgcaagccgtcatgtcctccgactactctttcgcccaatttcgctacttgcaaagactcctcttggtgcatggcaggtggtcttacatccgtatgtgcaagttcctgcgttattttttctacaagaacttcgccttcacgctcgtccacttttggtattccttcttcaacggttacagcgcccagactgcttacgaagactggttcatcactctctacaacgtgctgtacacatccctgccagtcttgcttatgggtctcctggaccaggacgtttctgataagctgtcactgcgcttccctggtctttacattgtggggcagagagaccttctgtttaactacaaacgattcttcgtgagcctcttgcatggagttctcacctccatgatcctcttcttcatccccttgggagcctacctccagacggtcggccaggacggtgaggcaccctcggactatcagtccttcgctgtcacgattgccagcgccctcgttatcaccgttaactttcagattggtctggacacctcctattggacctttgttaacgcgttctctatctttggatccatcgcgttgtactttggtatcatgttcgatttccattcagccggcatccacgtcctgttccctagcgccttccagttcactggcactgcctccaacgcactgaggcagccgtacatctggttgacgatcatcctcgccgtggccgtgtgcctgctgcccgtggtggcaattcgttttctctccatgactatctggccttctgagagtgacaagatccaaaagcaccgtaagcgtctaaaggccgaagaacagtggcagaggcgccagcaggtctttcggcgtggtgtctcgacccgccgttcggcctacgctttttcgcaccaacgtggctacgctgacctaatctccagtggccgatctatacgcaagaagcgtagccctttggacgcgatcgtcgcggatggaaccgccgagtaccgacggacgggtgacagc

SEQ ID NO: 7375 - DNA, 3753 bp, Artificial Sequence
  Description of Artificial Sequence: Synthetic coding sequence
atgtcgactgagagggacagcgagactactttcgatgaggattcacagcctaatgatgaagtcgtgccatactccgatgacgaaaccgaggatgaactggatgatcaaggcagcgcagtggagcctgaacaaaatagggtgaatcgagaagcagaggaaaaccgggaaccatttaggaaagagtgcacctggcaggtgaaggcaaacgatagaaaataccatgaacaacctcactttatgaacaccaagtttctttgtatcaaggagtccaagtatgcaaacaatgccatcaaaacctacaaatacaacgcattcacctttattccaatgaacctctttgagcagttcaagcgcgcagcaaacctttactttttggcactgcttatactccaggcagtgccacaaatctccaccctcgcttggtacaccactttggtgcctcttctggtcgttctcggagttactgcaatcaaggatctggtcgacgacgtggcccgacacaaaatggataaggagatcaacaataggacgtgtgaagtgataaaggatggaagatttaaggtggcgaagtggaaagaaatccaggtgggggatgttattcgtttgaagaaaaacgactttgtgccggcagacatccttctcctgtcctcgtccgaaccaaactccctctgctacgtagaaactgcagagctggatggcgaaaccaacctcaagtttaagatgtccctcgaaattaccgaccaataccttcaacgagaagatactctggcaacttttgatggatttatcgagtgcgaagaaccaaacaatagacttgacaagttcacgggtacccttttctggcgtaatacctcatttccacttgatgcagacaagattttgcttagaggatgcgtgatccgaaacactgacttttgtcatggtttggtcatttttgcaggcgcagataccaagatcatgaagaattcgggaaagactcggttcaaacgtacgaagatagattacctgatgaactacatggtgtatactatattcgtggtcttgattctcctgtcggcaggcctggcaattggtcatgcgtactgggaagctcaggtgggcaactcatcgtggtacctgtacgatggagaagatgacacgccatcctacaggggctttctgattttctgggggtacataatagtccttaacacgatggtgcctatatcactttacgtgtccgtggaagtgattcggcttggtcaatcccacttcataaactgggatctccaaatgtactacgcagaaaaagatacccccgccaaagcacgcacgactactcttaatgagcaactgggtcaaattcactacattttcagcgataagaccgggactcttactcagaatatcatgacttttaagaagtgttgcatcaacggtcagatttacggcgatcatcgcgacgcctcccagcataatcataacaagattgaacaggtcgacttttcctggaacacttacgccgatggcaaacttgcattttacgatcactaccttattgagcagatacagagcggaaaggaaccggaagtgaggcagttctttttccttctggcagtgtgccacacggtcatggtggataggaccgatggacaacttaactaccaagcagcaagcccggacgaaggggccttggtgaacgcggcaaggaactttggttttgcattcctggcccgaacccagaataccattaccatttctgagctcggtaccgaaagaacctacaacgtccttgcgattcttgacttcaattcggatcgaaaacgcatgtccatcatcgtcagaaccccagaaggaaacatcaaactttactgcaagggcgccgataccgtgatttacgaacgcctccatcggatgaacccgaccaagcaagaaactcaggacgcccttgatatctttgcaaacgaaaccctgagaactctctgcctttgttacaaggaaattgaggagaaagagtttactgaatggaacaaaaagtttatggcagccagcgtcgcgagcacgaacagagatgaggctctggacaaagtgtatgaagaaatcgaaaaggatctgatcctccttggtgcgaccgctatagaggataaacttcaagatggcgtgccagaaacgattagcaagctcgcaaaggcagacatcaagatctgggtgctgaccggcgacaaaaaggaaaccgcggagaatatcggctttgcgtgtgaactgctgacggaggataccaccatttgctacggtgaggacataaactccctgctccatgccagaatggaaaaccagcgcaaccgaggaggggtctacgctaagtttgcccctcccgtgcaggaatccttttttcctcctgggggaaacagggcgttgattatcactggttcgtggcttaacgagatcctcctggaaaagaaaaccaaaagaaacaaaattctgaagctgaagtttccacggactgaggaagaacggcgtatgagaactcaatcgaagaggagacttgaggcaaagaaggaacagcgtcaaaagaacttcgtcgatctggcctgcgagtgctcggcagtgatttgttgtagagtgacccccaaacagaaagcgatggtggtggacttggtgaagagatacaagaaggccattacgctcgccattggtgatggtgcaaacgatgtgaacatgatcaaaaccgcacatatcggtgtcggtataagcggacaggaagggatgcaagcagtcatgtcgtccgattacagcttcgcccaatttcggtacctccagcgcctgctccttgtccacgggcgctggtcgtacatacggatgtgtaagtttcttaggtactttttctacaagaactttgccttcactcttgtgcacttctggtactcctttttcaacgggtactctgcccaaaccgcatacgaagattggttcatcactctgtacaacgtcctgtacacgtctctgcctgtgctccttatgggcctgctcgatcaagatgtcagcgataagctctctctccgatttcccggcctgtacatcgtcggccagcgagacttgcttttcaactataagcggttttttgtgtccctcctccatggtgtgctgacctccatgattctcttcttcatcccacttggtgcatacctgcagaccgtgggacaggatggagaagcaccatcggattaccagtcatttgcagtgactattgcgtctgcactggtgatcacggtcaatttccagataggccttgacacgagctattggacctttgttaacgcatttagtatattcggatccattgcactctactttggaataatgtttgattttcattccgcagggatccacgtgctgtttccttccgcatttcaatttaccggaaccgcctcgaacgcactgagacaaccctacatttggttgactatcattctggcagtggccgtgtgtctgctgcctgtcgtcgccattagatttctgtcgatgactatctggccctcggagtccgataagattcagaaacatcgcaaacgcctgaaggcagaagagcaatggcaacgccgccagcaagtttttaggcgcggtgtgtcaacccgaagatcggcatacgccttttcccatcaaagaggatacgccgatctcatttcctcaggaagatccataagaaaaaagagatccccccttgatgcgatagtcgctgatggaactgccgaataccggaggacgggagattca

SEQ ID NO: 7376 - DNA, 3753 bp, Artificial Sequence
  Description of Artificial Sequence: Synthetic coding sequence
atgtctacagagcgggacagcgaaacaacctttgatgaggatagccagcctaacgacgaggtagtgccatacagcgatgatgagaccgaagacgagcttgacgaccagggctctgctgtcgagcctgagcaaaaccgtgttaaccgcgaagctgaggaaaatagagaacctttccgcaaagagtgcacatggcaagtaaaggcaaatgaccgcaaatatcacgaacagccccatttcatgaatacaaaattcctgtgcattaaggaatcaaaatacgcgaacaatgcaattaaaacctacaaatataatgcgttcactttcattcctatgaatttgttcgagcagttcaaacgcgcggctaacttgtattttttagccctgcttattctgcaagctgttcctcagatttccaccttggcttggtataccaccttggtgccattactggtggttctgggagtaactgcaatcaaagacctcgttgatgatgtggcaagacataagatggacaaggagattaacaatcggacctgtgaggttatcaaagacgggcgatttaaagtcgccaaatggaaggagatacaggtaggcgatgtgatccggttgaagaagaatgacttcgtgcctgcagacatcttgttgcttagttcaagtgaacctaattccctatgttacgtggagacggcagagctggacggcgagaccaatctgaagtttaagatgagcctcgaaattactgatcagtatcttcagagggaagataccctggccacctttgatggtttcatagagtgtgaggagcccaataatcgtctggacaagtttaccggtaccctgttttggagaaacacgtccttcccactcgacgccgacaagatcttactgcgaggatgtgtaattcggaacaccgacttctgccacggtttggtcatttttgccggcgccgacaccaagattatgaaaaactccgggaaaaccaggtttaagaggactaagatcgattacctaatgaactatatggtgtacaccatctttgtggttttgattttgctgagcgccgggctggcaataggccacgcctattgggaggctcaagtaggaaatagcagttggtacttgtacgacggtgaggacgacacaccaagctatcgggggtttctgatattctggggctatatcattgtgttgaataccatggtacctatcagtctgtatgtttccgtcgaggtgatcaggcttggccaatctcacttcattaactgggacctgcagatgtactatgccgagaaagacacccccgccaaggctaggacaactacactgaatgaacagttaggtcagattcactacatcttctcagataagaccggtactctgacacagaacattatgacattcaagaagtgttgtatcaacggccagatctatggagatcacagagacgcaagtcagcacaaccacaacaaaatcgagcaggttgacttctcatggaatacatacgcggacggaaagctggcattttacgatcattaccttatcgaacagatccagtcaggcaaggaaccggaggtccgtcagtttttcttcctgctagcagtgtgccacaccgtgatggttgaccgcactgacggacagttaaactaccaggcggcatcacccgatgaaggagctctggtaaacgccgctaggaactttgggttcgcttttcttgccaggactcagaataccatcacaatatcagagctcggtaccgagaggacatacaatgttttggctatacttgacttcaactccgatcgaaagcgtatgagcattatcgtgagaacgcctgagggaaacataaaactttactgcaaaggcgccgatacggtcatttatgagagactccaccgcatgaaccctactaagcaggaaacacaagacgcgctcgacatcttcgccaacgagacactgcggaccctctgcctgtgctataaggagatcgaggaaaaggaattcactgagtggaacaagaagtttatggcagcaagcgtcgctagcaccaatcgcgatgaagctctagacaaagtgtacgaagaaatcgaaaaggatctgatccttttgggagccaccgctatcgaggacaaattgcaggatggggttcccgaaaccatctcaaaacttgccaaggccgacataaaaatctgggtgcttacaggagataagaaagaaactgctgagaacattggtttcgcctgcgaactgttaactgaggatactaccatatgttatggagaggatatcaatagcctgctgcacgcccgcatggaaaatcagagaaatagaggcggggtgtacgccaagtttgcccctccagtccaggaatctttcttcccccccgggggaaacagagcgttgatcattacgggatcctggctcaatgagatccttctggagaagaagaccaaacggaataaaatcttgaaacttaaatttcccaggaccgaagaggaacgaagaatgcgcacccagtctaagaggcgcctggaggctaagaaggagcagaggcagaagaacttcgttgacctggcctgcgaatgttcagccgtgatttgctgcagggtcaccccaaaacagaaggctatggtggtggatttagtgaaaaggtacaagaaggctattacactggctattggggatggagccaatgacgtcaacatgatcaagacagctcacatcggtgtcgggatttcaggccaggagggcatgcaagctgtgatgagtagtgactattcatttgctcagttccggtatctgcaacgcctgttgctagtccatgggagatggtcatacatcaggatgtgtaagtttcttcgctattttttttacaagaattttgcatttaccttggtgcacttttggtacagtttttttaacggctactccgctcaaaccgcctatgaggactggttcatcactctgtataatgttctgtacacatcactcccagttctgctgatggggttgctggaccaggacgtttctgacaaactgtcactacggttcccaggactctacatcgtcgggcagagagacctgctgtttaattacaagcgctttttcgtgtccctgctccatggcgtgcttacctccatgatcttgttttttatccctctgggtgcgtacttacagacagttgggcaggacggagaagcgccttccgactaccagtcatttgctgtaaccatcgccagcgcactggtcattactgtgaactttcagatcgggttagacactagctattggaccttcgtgaacgctttttcaatctttggctcgatcgcactgtatttcggcataatgtttgacttccactccgctggaatccacgtgctgtttccatcagcgttccaattcaccggcaccgcctctaacgctcttcggcaaccatacatctggctcacaatcatcctggccgtcgctgtctgcttgctgccggtagttgctatacgcttcctctccatgacaatatggccctctgagtctgataagattcagaaacaccgaaagagactgaaggccgaggagcagtggcagcggcggcagcaagttttccgtcgcggggtgagcactagaaggtcagcctacgcattctcccatcagagaggttacgccgacctgataagctccggacgctcaatcaggaagaaacgatcgccactggacgcgatagtggccgacgggaccgcagaataccgccgcaccggggatagt

SEQ ID NO: 7377 - DNA, 3753 bp, Artificial Sequence
  Description of Artificial Sequence: Synthetic coding sequence
atgtcgacggagcgggattccgaaactaccttcgacgaggattcgcaaccaaatgatgaggtcgtgccgtactcggatgatgagactgaagatgaactggacgaccagggatccgctgtggaaccagagcaaaaccgcgtgaatagggaggcggaagaaaatcgggaaccttttcggaaggagtgtacgtggcaggtcaaggcgaacgaccgaaagtaccacgaacagccacacttcatgaacaccaagtttctttgcatcaaggagtccaagtacgccaataatgctattaagacttataagtacaacgccttcaccttcatcccgatgaatctcttcgagcaattcaagcgcgcggcgaacttgtacttcctggcactgctgattctgcaggccgtgccgcagatttcgacgcttgcctggtacaccactctcgtgccgttgttggtggtgctcggcgtgaccgcgatcaaagacctcgtggacgatgtggctcgccataagatggacaaagagatcaataaccgcacttgtgaggtgatcaaagacggaagattcaaggtggccaaatggaaggaaatccaagtgggagatgtcatccgactcaagaagaatgatttcgtgcctgcggacatcctgctcctgagctcgtccgaacctaactcactgtgctatgtggaaaccgctgagctggatggcgagactaacctgaagtttaagatgtctctggagatcacggaccaatacctccagcgcgaggacaccctggctacctttgacggcttcatcgaatgcgaggagcctaacaaccgcctggacaagttcacgggcaccctcttctggagaaacaccagcttcccattggatgctgataagatcctcctcaggggatgcgttattagaaacactgacttttgtcacggactggttatctttgccggagcagatactaagatcatgaagaactctggcaaaactagattcaaacgcaccaagatcgattacctgatgaattacatggtttacactattttcgtcgtgctcatccttctctccgccggacttgccatcggacacgcttactgggaggcacaagtgggcaattcgtcgtggtacctgtacgacggagaagatgatactccatcctaccgcggattcctgatcttttggggatacatcatcgtacttaacacgatggtgccgatcagcctgtacgtgtctgtggaggtgattcggttgggacagtcgcacttcatcaactgggacctgcagatgtactacgctgagaaagatactccggcgaaagcgcggaccactaccctcaacgagcagctgggccagatccactacatcttcagcgataaaaccgggaccctcacccagaatatcatgacctttaagaagtgttgtatcaacggtcaaatctatggcgaccatcgcgacgcgtcccagcacaaccataacaaaatcgaacaggtcgacttttcatggaacacttacgccgatggaaaactggcgttctatgaccactacctcatcgaacagatccagtcaggaaaggagcccgaagtgcggcagttcttcttcctgctggctgtgtgccacaccgtgatggttgacaggaccgatggacaattgaactaccaagctgcgtcccccgatgaaggggccctcgtgaatgcagcccgcaacttcggattcgcgttcctcgcccgcacgcagaacaccatcacgatctcagaattggggactgaacgcacctacaacgtcctggctattttggacttcaactccgaccggaagcgcatgtcgatcatcgtccggacccctgaggggaacatcaagctctactgtaagggggcagacactgtcatttacgaaagactccataggatgaatcctaccaagcaggaaactcaggatgcactggatatctttgcgaacgagactttgcgcaccctctgcctctgctacaaggaaatcgaagaaaaagaattcactgaatggaacaagaagttcatggcagcatccgtagcatccactaatcgggacgaggcgctcgacaaagtctacgaagagatcgagaaggacctgatcctgctgggagccactgccatcgaggataaactgcaagacggagtgccggaaacgatttccaaactcgccaaggccgacatcaagatatgggtgctgacgggggacaagaaagagactgcagagaacattgggtttgcctgcgagctcctgacggaggacactacgatttgctacggagaagatatcaactccctgctgcacgcccggatggaaaaccagagaaaccgcggcggagtgtacgccaaatttgccccaccagtgcaggaatcgttcttcccccctggtggaaatcgcgccttgatcatcaccggatcatggctcaatgaaatcctgctggagaagaaaaccaagcggaataagatcctcaaactgaagttcccccggactgaggaagaacgcagaatgcggacccagtcaaaaagaagattggaggcgaaaaaagagcagcgccaaaagaatttcgtggatttggcctgtgaatgttcggccgtcatctgttgtcgggttactcctaagcaaaaggccatggtcgtggacctggtcaaacgctacaaaaaggccatcactctcgccattggcgatggcgcaaacgatgtgaacatgatcaagaccgcacacattggagtgggcatctccggtcaagaaggcatgcaagccgtcatgtctagcgactactccttcgcgcagtttagataccttcaacgactcctgctggtgcacggaagatggtcgtacatcagaatgtgcaagtttctgagatacttcttctacaagaacttcgcgttcaccttggtccatttctggtacagcttcttcaacggctattccgcccagactgcttacgaggactggtttatcacgctctataatgtcctgtacaccagcctccccgtgctcctcatgggattgctcgaccaagatgtgtcggacaaactttcactccgctttccggggctgtacatcgttggacagagggatcttttgttcaattacaaacgattcttcgtgtccctgctccatggggtgctgacctcgatgatcctgttctttatccccctgggagcgtacctgcagactgtgggtcaggatggtgaggcgccgtcggactaccagtcttttgctgtgaccatcgcctccgccctggtcatcactgtcaactttcagattggactggacacctcctactggaccttcgtcaacgcattctcaattttcggatccattgcattgtacttcggaatcatgttcgactttcattcagcgggtatccatgtcctcttccctagcgccttccagttcaccggtaccgcctccaacgccttgagacagccgtacatctggctgaccatcatcctggccgtggccgtttgcttgttgcctgtggtggcaattcgcttcctctcaatgactatctggccctcagagtcagataagatccagaaacatcgcaaaaggctgaaggccgaagaacaatggcaacgccgccaacaggtgttcagaagaggagtgtcgacccgcagatctgcctacgccttctcgcaccagcggggctacgcagatctcatctcatcgggccgctcaatcagaaagaagagaagcccgctggacgcgattgtcgccgacggcaccgcggaataccggcgcactggagacagc

SEQ ID NO: 7378 - DNA, 3753 bp, Artificial Sequence
  Description of Artificial Sequence: Synthetic coding sequence
atgtccactgagcgcgactcggagactaccttcgatgaagactcgcagcctaacgacgaagtggtgccctattccgatgacgaaaccgaggacgagctggacgatcaaggctccgccgttgagccggaacagaatcgcgtcaacagggaagccgaagaaaatcgcgaaccgtttcgcaaggaatgcacctggcaagtcaaggcaaacgatcgcaagtaccatgaacaaccccatttcatgaacactaaattcctttgcatcaaagaatccaagtacgccaataacgccatcaagacttacaagtacaatgctttcactttcattccaatgaaccttttcgaacaatttaagcgcgctgccaacctttacttcctcgccctgctgatacttcaagccgttccacagatttcgaccctcgcctggtacaccactttggtgcctttgctcgtcgtgctcggtgttaccgcgatcaaggacctggtggatgacgtggcacgccacaagatggataaggagataaacaacaggacctgcgaagtgatcaaggatggtaggttcaaggtggccaagtggaaagaaatccaggtgggagacgttatccggctgaagaagaacgatttcgtgccagcagatatccttctgttgagctcttctgagccaaactcactgtgctacgtcgaaactgcggaactcgacggagagacgaacctgaaattcaagatgagcctggagataaccgaccagtatcttcaacgcgaagacactctcgccacttttgacggatttatcgagtgcgaagaacccaacaaccgtctggataagttcactggcactctcttctggcggaatacctccttcccgctggacgccgacaaaatccttctcaggggatgcgtcatcaggaacaccgacttttgccatggattggtcatattcgctggagccgatactaagattatgaaaaactcagggaagacccgcttcaaacggacgaagattgactaccttatgaattacatggtctataccatcttcgtggtgctgatcctcctcagcgcaggactggctatcggacacgcgtactgggaggcgcaggtgggcaactcgagctggtacttgtacgatggggaggatgacaccccttcttaccggggattcctcattttttggggctacatcatcgtcctcaacacgatggtccctatctccctgtacgtgtcggtggaagtcattagactgggtcaatctcacttcatcaattgggacctgcagatgtactacgcagaaaaggatacgccagctaaagcgagaaccaccactctgaatgagcaactgggccagatccactatatcttctctgacaagacgggaaccctgactcagaacattatgactttcaagaagtgttgtatcaacggccagatctacggcgatcatcgggacgcgagccaacataatcataacaagatcgagcaggtggacttttcctggaatacttacgccgacggaaagctggccttctacgaccactacctgatagaacagatccagagcgggaaagaacccgaagtgagacaatttttcttccttctggccgtgtgtcacaccgtgatggtggaccgcactgatggacaacttaattaccaggccgcgtcaccagacgagggcgctctggtcaatgccgcgcgcaatttcggtttcgcgtttctcgcccggacccagaacacgatcactatctctgagctgggcactgaacgcacctacaatgtcttggcaatcttggatttcaatagcgatagaaagcgcatgtcaatcatcgtcaggaccccagagggcaacatcaaactgtactgcaagggagcggacaccgtgatttatgagcggctccatcggatgaatccgaccaagcaagaaactcaagacgctcttgacatctttgcaaacgaaacgctccgcaccctgtgtctctgctacaaggaaatcgaagagaaggagtttaccgaatggaacaaaaagtttatggccgcctccgtggctagcacgaacagagacgaagcactcgacaaggtctacgaggaaattgaaaaggacctcatcctccttggcgcgactgcgatcgaagataaactgcaagacggggtgccggaaacgatctcgaagctggcgaaggccgatatcaagatttgggtgttgactggtgataagaaagaaaccgccgagaacattggattcgcttgcgaactcctgactgaagacaccaccatctgctacggagaagatatcaacagcttgttgcacgcgagaatggagaatcagagaaaccgcgggggcgtgtacgctaaattcgcaccgcccgtccaggagagctttttcccgccgggaggaaaccgcgctcttataatcacgggctcgtggctgaatgagatcctgttggagaaaaagacgaagagaaacaagattttgaaactgaaattccctcgaaccgaagaagagaggcggatgcgcacccaatctaagcgtcggctggaagcaaagaaggaacagcggcagaagaacttcgtggacctcgcttgcgaatgttcggcggtcatttgttgccgggtgactccgaagcagaaggctatggtcgtggatctggtgaagcgatacaagaaagccatcactctggccatcggagatggagccaatgacgtcaacatgattaaaaccgctcatatcggggttggaatatccggccaggagggaatgcaggccgtcatgtcctccgattacagcttcgcccaattccgctacctgcagcgcctcctgctggtccacggaagatggtcctacatcagaatgtgcaagttcctgagatacttcttttacaagaatttcgcgttcaccctggttcacttttggtactcgtttttcaatggttactcagctcagaccgcctacgaagattggtttatcactctgtacaacgtgctgtacacctcgcttccggtgttgcttatgggccttctcgaccaggatgtgtcggacaagttgagcctgcgcttccccggcctgtacattgtggggcagagagatctgctctttaactacaagagattcttcgtctccctccttcatggagtgctcacctcgatgatcttgttcttcatcccgctcggagcctacctgcagaccgtgggacaggacggcgaggcgccatctgactaccagtcatttgcagtgactatcgctagcgccctggtcattaccgtgaacttccagatcgggctcgacacttcctactggactttcgtgaacgcgttctcgatcttcggctcaatcgcgctctatttcggaatcatgtttgattttcactccgctgggatccacgtactgttcccgtcagccttccagttcaccggaactgccagcaatgcactgcggcagccatacatctggctgactatcatccttgcagtggccgtgtgcttgctgccggtggtcgcaatcagattcctgtcgatgactatctggccttcggagtccgataaaatccaaaagcacaggaaacggctgaaagccgaggagcagtggcagcggagacaacaagtgttccgccgcggagtctcgactcggcggagcgcttacgccttctcacaccaacgcgggtacgcggacctgatttcaagtggaaggagcatccggaagaaacgctcgccgctggacgctatcgtggcggacggaactgctgagtacaggcggactggggactcg

SEQ ID NO: 7379 - DNA, 3753 bp, Artificial Sequence
  Description of Artificial Sequence: Synthetic coding sequence
atgtctaccgagagggattcggagactaccttcgatgaggacagccagccaaacgacgaagtggtgccttactcagacgacgaaaccgaagatgaactcgacgaccagggcagcgcggtcgagccggagcagaatcgcgttaaccgggaagccgaggagaatcgggagccatttcggaaggagtgcacctggcaggtcaaggctaacgaccggaagtaccatgaacaaccccactttatgaacacgaaattcctgtgcatcaaggaatcgaaatacgcaaacaacgcaattaagacctacaagtacaatgcgtttactttcatccctatgaatctcttcgaacaattcaaaagggcagctaacctttacttcctggccctgctcatcctccaagccgtgccacagatctcaacgctggcctggtacactaccctcgtccccctgcttgtggtgctgggagtgactgccattaaggacctggtggatgatgtggcgcgccataagatggacaaggaaatcaataatcggacctgcgaggttatcaaggatggacggtttaaagtggccaagtggaaagaaatccaggtgggagacgtgattaggttgaagaagaatgacttcgtcccggccgatatcctgcttctgtcgagctccgaaccgaacagcctctgttacgtggaaaccgctgagcttgacggcgaaaccaaccttaagttcaagatgtccttggaaatcacggaccagtatctgcaacgggaggacacgctggccaccttcgacggattcatcgaatgcgaggagcccaacaaccgcctggacaagtttaccggaaccttgttctggcgaaacacgtccttccccctcgacgctgataagattctcttgcggggatgtgtgatccggaataccgacttttgtcacggcctggtcatcttcgccggagccgataccaagatcatgaaaaactctggaaagacccgcttcaagagaactaaaatcgactacctgatgaattacatggtgtatactatcttcgtggtgctgatcctcctttcggcgggactggccatcgggcatgcctactgggaggcgcaagtggggaactcgtcatggtatctgtacgatggagaggacgacactccgagctacaggggcttcctcatcttctggggatacatcatcgtcctcaataccatggtgccgatctcactctacgtgtccgtggaagtgatacgcctcgggcaatcccacttcatcaactgggacctgcaaatgtactacgctgaaaaagatactccagccaaggccagaaccactactctcaacgaacaattgggacaaatccactacatcttctcagacaagacgggaacgctgactcagaacattatgaccttcaagaagtgctgtattaacggacaaatctacggtgaccatcgcgatgccagccagcacaatcacaacaagatcgaacaggtggatttttcgtggaatacttacgcggacggaaagctcgccttctacgaccactacctgatcgagcagattcagtcaggaaaggagcctgaggtgcggcagttctttttccttcttgcggtttgccacactgtgatggtagacagaactgacggacagctgaactaccaagctgcgtcgcctgacgaaggagccctggtgaatgcagcaaggaactttgggttcgccttccttgcacggacccaaaacactatcaccatcagcgagctcggaaccgagcgcacttataacgtgctcgcaattcttgacttcaattccgatagaaaaaggatgtcgatcatcgtccggaccccggaaggaaatatcaaactctactgtaaaggagcagatactgtgatttacgagcggctccataggatgaacccgactaaacaggaaacccaagacgccctggatatcttcgcaaacgaaaccctgagaactctgtgcctctgttacaaagaaatcgaggaaaaggagttcactgaatggaacaagaaattcatggcggcctcggtggccagcactaaccgggatgaagcattggataaagtgtacgaggagatcgagaaagacctgatcttgctgggtgccacggcgatcgaagataagctccaggatggagtcccggaaactatctctaagctggccaaagcggacatcaagatctgggtcctgaccggagataagaaagaaactgctgagaatatcggtttcgcttgcgagctgctgactgaggacacgaccatctgctacggggaggacatcaactcgctcctgcacgcacggatggaaaaccagcgcaatagaggaggagtctacgcgaagttcgccccgcctgtgcaggaatccttcttcccgccgggaggcaatcgcgccctgatcatcaccggctcctggctgaatgaaatcctgctggagaagaaaactaagcgcaacaagatcctgaaactgaaattccctcgaactgaagaagaacggcgcatgcgcacccagtccaagcgcaggctcgaagccaagaaagagcagcgccagaagaatttcgtggacctcgcctgcgaatgtagcgcggtgatctgctgccgcgtcactccgaagcagaaggccatggtggtggacctggtcaagcggtacaagaaggctatcaccctggccattggagacggggctaatgatgtgaacatgatcaaaactgcccacatcggggtgggtatcagcggacaggagggcatgcaagcggttatgtccagcgactactcatttgcacagttccgctacctgcaaagattgctgctggtgcatggaagatggtcgtacatcaggatgtgtaagttcctgaggtactttttctacaaaaacttcgccttcaccctggtccacttctggtactcgtttttcaacgggtattccgctcagactgcctatgaggactggttcatcactctctacaatgtcctctacacctcgctgcctgtgctcctcatgggtttgctcgaccaggacgtctcggacaagctgtcgctgcggttccccggactctacatcgtgggacaacgggacctgctctttaactacaagcggttctttgtgagcctgctgcatggtgtcctgacctccatgattttgttctttatcccgcttggtgcatacctgcagactgtcggccaagacggagaagcgccttcagactaccagtctttcgcggtgactatcgcatcggcgctcgtcattactgtcaatttccagatcgggctggacaccagctactggaccttcgtgaatgccttctccattttcggctcaattgctctctacttcggcattatgttcgatttccatagcgcgggaatccacgtgctctttccaagcgcattccagttcactggtaccgcgtccaatgccctgagacagccttacatctggctgaccatcatcctcgctgtcgccgtctgcctgcttccagtggtcgccatccggttcctgtcgatgactatctggccttcggaatccgacaagatccaaaaacatcggaaacggctgaaagccgaagagcagtggcaacgccgccagcaggtgttccgcaggggagtgtcaactcgacggtcggcctacgctttctcacaccagaggggatatgccgatctgatcagctccggacgatcgatcagaaagaaacgttcaccactggacgccatcgtggccgacggaactgccgaatacaggagaaccggagattcc

SEQ ID NO: 7380 - DNA, 3753 bp, Artificial Sequence
  Description of Artificial Sequence: Synthetic coding sequence
atgtcaaccgaacgcgactctgaaacaacctttgatgaagactctcagccgaatgatgaggtggttccatacagtgatgatgaaaccgaagatgagcttgacgatcagggcagcgccgtcgagcctgagcagaaccgcgtgaatcgcgaggcagaagaaaacagagaaccatttcggaaggagtgcacatggcaggtaaaagctaacgaccggaaataccatgaacagccacatttcatgaacacaaaatttctctgcatcaaagagtcaaaatacgcaaacaacgctattaagacctacaagtacaatgcgttcacatttattcccatgaacctctttgaacagttcaagcgtgccgctaacctttactttctggccctattgatccttcaggcagtcccccagatcagcacgttggcatggtacacaaccctagtcccccttctcgtcgtgctgggcgtgacagctatcaaggatttggtggacgacgttgcccggcacaagatggacaaggagatcaataaccgcacatgcgaagtgatcaaggatggccgtttcaaggtcgcaaaatggaaagaaatccaagtgggcgatgtcatccgtctcaaaaagaatgattttgtacctgcagatattctcctgctctcctccagcgaacctaacagcttgtgctatgttgagacagctgaacttgacggcgaaaccaacctcaagttcaaaatgtctcttgagattaccgaccaatacctgcagagagaggatactttggccacatttgatgggttcatcgaatgtgaagaacccaataacagattagataagttcactggcacactgttctggagaaacacctcatttcccctggacgctgataagatcctcctgaggggatgtgtgatccgtaacacagacttttgtcacggactcgtgatctttgctggagcggatacgaaaattatgaagaatagcggaaagactcggttcaagcgcactaagattgattatctgatgaactacatggtgtacactatctttgtcgtgttaatattactttcagcaggcctggctatcgggcatgcttactgggaggcacaggtgggaaacagcagctggtacctgtatgacggcgaggacgacacaccgtcgtacagaggctttctgattttctggggatacattatagtgctcaacaccatggttccaatttctctctacgtttcagtggaggtgattcggcttggacagtctcattttataaattgggacctgcagatgtattacgcagagaaggatacccctgccaaggccaggaccacaactctcaacgaacaattgggccagatacattatattttttcagataaaactggcacccttactcagaacataatgacatttaagaagtgctgcattaacggtcagatttacggtgaccacagggatgcttctcaacacaaccataataagatcgaacaggtcgacttttcctggaatacatacgcagacggaaagctggccttctacgatcactatctgatcgagcaaatccaaagtggcaaagagcctgaggtgcggcagttctttttcctgctggccgtctgtcacacagtgatggttgataggacagatggacagctgaactaccaggctgcaagcccggatgagggcgctctcgtgaatgcagctaggaatttcggctttgcatttctcgcacgcacccagaacacaatcacgattagcgagctcggaactgaacggacatacaacgtgctggctatcttggacttcaatagcgatcggaaacggatgagcattatcgttaggaccccagagggaaacatcaagctgtactgcaagggagctgacacagttatctacgagaggctgcatcgcatgaacccaaccaaacaagagacacaggacgcattagatatcttcgcaaatgagacgctcaggacgctctgtttgtgttacaaagagatcgaagaaaaagagtttacagagtggaacaaaaaatttatggccgcttctgtggcatcaaccaacagggacgaagcattagataaggtctacgaggaaatcgaaaaagatctcatcctgctgggcgctacagccattgaagacaaactgcaggacggtgtccctgagaccataagcaaactggctaaggctgatattaagatttgggtgcttaccggggataaaaaagaaacagctgaaaatattggctttgcgtgcgaattactgaccgaggacacaaccatctgctacggagaagacatcaattcactgcttcacgccaggatggaaaaccaaagaaaccgtggcggtgtatacgccaaatttgctcctcccgttcaagagagtttcttcccacctggaggaaacagagcgctgataatcaccggatcttggcttaatgaaatcctcctggaaaagaaaaccaagaggaataaaatacttaaactgaaatttccccgtaccgaagaagagcggcgtatgcggacacagagcaagcgtagacttgaagctaaaaaagaacaaaggcaaaaaaattttgttgatctggcgtgcgagtgctccgcagtaatctgttgtagggtcactcctaagcaaaaggctatggttgtggacctggtcaagagatataagaaagccatcactctcgccatcggagacggcgccaatgatgtcaacatgatcaagacggcccatatcggagtgggtatctccggccaagaaggtatgcaagctgtcatgtccagcgattactcttttgcccaattccgttatctgcaacgtctgctgctggtgcacggccgttggtcctacatccgcatgtgtaaatttctgagatactttttttataagaactttgcatttacactggtgcatttttggtattcttttttcaacggctacagtgcacagactgcttacgaggactggtttatcaccctgtacaacgttctctacacttctctgcccgttctcctgatgggactcctggatcaagacgtgagcgacaaactttccctcagatttccaggactctatatcgtcgggcagcgcgatttgctctttaactacaaaagattctttgtctctctgctccatggagtgctgactagcatgatccttttttttattcctctcggtgcatatctgcaaacggtgggccaggacggcgaagcacctagcgactaccagagtttcgctgtgaccatcgccagcgctctcgtaattacagttaacttccagattggacttgatacatcttactggacctttgtgaatgccttctctatcttcggaagtatcgctctttactttggaatcatgttcgattttcacagcgccggtattcacgtgctgttccccagcgcatttcagtttactggcaccgcatccaacgctttgagacagccttacatctggctgacaattatcctcgcggtcgcagtgtgcttgctgcctgttgtggctatcagatttctttctatgacaatctggccttccgaaagtgataaaatccaaaagcatcggaaacggctgaaagccgaagaacagtggcagaggaggcagcaagtatttcggcgcggcgtctctactcgccgaagtgcctacgcattcagccatcaacgtgggtatgcggacctcatcagcagcgggcgctccattagaaaaaagcgcagtcccctcgacgccatagtggctgacgggacagctgaatataggaggaccggcgattca

SEQ ID NO: 7381 - DNA, 3753 bp, Artificial Sequence
  Description of Artificial Sequence: Synthetic coding sequence
atgagcactgagcgggacagcgagaccacgtttgacgaggattcccagcctaatgacgaagttgtcccatactccgacgacgaaacagaggatgagcttgatgatcaggggtctgctgtggagccagaacagaatcgggttaatcgggaggccgaggagaacagggaaccctttaggaaagaatgcacctggcaggtgaaagcaaacgacagaaagtatcacgaacagccacactttatgaataccaaatttttgtgtataaaggagtccaagtacgctaacaacgcaattaaaacatacaaatacaacgcttttacatttatccctatgaacctgttcgagcagttcaagcgagctgcgaacctgtattttctcgcccttctgattcttcaggcagtgccccagattagcacgcttgcatggtacacaactctggtccccctgctggtggttctgggtgtgactgcaatcaaggatctggtggacgacgtggcgcggcacaaaatggacaaggaaattaacaatcgcacatgtgaggttattaaggacggacgcttcaaagtcgccaagtggaaggagatacaggtgggggacgtcattcgcttgaagaaaaatgattttgtgccagccgacatacttctgctttccagctctgaacctaattccttgtgttatgtagaaaccgccgagcttgatggcgagaccaacctgaagtttaagatgtcacttgagattactgatcaatatttgcagagagaggacaccctggcgacatttgatggattcattgagtgcgaagagcccaacaaccgcctggacaaatttaccggtaccctgttctggagaaatacctccttccccctcgatgccgacaagatcttgctgagaggttgtgttatcaggaatacagacttttgtcacggactggtgattttcgctggagcagatactaagataatgaagaatagcgggaagactcgattcaagaggaccaaaattgattacttgatgaattacatggtatatactatctttgttgttctgattctgctttccgccggattggcaattggccatgcttactgggaagcccaggtgggaaactctagctggtacttgtatgacggcgaggacgatacaccctcctacaggggatttttgattttttggggttatattattgttttgaatacaatggtgccaatctcactgtatgtgtctgtcgaagtcatcaggttggggcagagtcattttattaattgggacttgcagatgtactacgccgaaaaggatacgcccgcgaaggccaggaccactaccctcaacgagcaactggggcaaatccattatatatttagcgacaagacgggaacactcacacagaatatcatgacatttaagaagtgctgcatcaatggacaaatatatggcgaccaccgggatgcctctcaacacaaccacaataaaattgagcaggttgatttcagctggaatacatacgctgatggtaagctggcattctacgaccactacctcatcgagcagatccagtcaggaaaggagcccgaggttagacaattttttttcctgctggctgtgtgccacactgtgatggtcgatagaacggacggtcaactgaattatcaggcagccagtcccgacgagggggcactggtcaacgctgcccgcaatttcggctttgctttcctggcgcgcacccaaaacacaatcactatttccgaattgggtaccgagcggacatacaatgtcctggccatcttggatttcaactccgaccgcaagcggatgagtattatcgtgcggaccccggagggcaacataaagctttattgcaaaggggcagatacagtcatttacgagcggctccataggatgaacccgacgaagcaggagactcaggacgcactggacattttcgccaacgagaccctgcgcacactctgtctttgttacaaagagatcgaagagaaggagttcaccgagtggaacaaaaagttcatggccgccagtgttgcaagtacaaaccgagacgaggcactggataaggtgtacgaggagattgagaaggatctgatcctgctcggcgccaccgcgatcgaggataagctccaggacggcgtgccagaaaccatttccaagctggcgaaagcggacattaagatatgggttcttacaggcgataaaaaggaaaccgctgaaaatatagggttcgcgtgcgaactcctcactgaagacactactatatgttacggcgaggacataaacagcctgcttcacgcaaggatggagaaccagagaaacagaggcggcgtctatgccaagtttgcaccccctgtgcaggaatctttttttccccctgggggtaatagagctttgatcatcaccggcagctggctgaatgagatcctgctcgaaaagaaaacaaagcggaataagatcttgaagctcaaattccctcggaccgaggaggaacgccggatgagaacacagtccaaaagacgactggaggccaagaaagaacagagacagaagaacttcgtggacctggcgtgcgagtgctctgctgtaatttgctgtagagtgacccctaagcaaaaggccatggtggtcgatctggtcaagagatacaagaaggcgatcacccttgcaattggtgatggagccaatgacgtaaacatgatcaaaacggcacacatcggggtgggaataagtgggcaagaagggatgcaggctgttatgtcctcagattactcattcgcacagttcaggtatctccagagacttctgttggtacacggccggtggagttacatccggatgtgtaagttcctgcggtactttttttacaagaacttcgccttcacgctggtgcatttctggtacagcttttttaacggctatagcgcccagaccgcctacgaagactggttcatcactctctataacgtgctttacaccagcctgccagtgctgctcatggggcttcttgatcaggatgtgtccgacaaattgtctctcaggtttccaggtctttacatagttggacagagagatttgctgttcaattataaaagatttttcgtaagtctgttgcatggcgtgctcacttctatgatcttgttcttcattccgctgggggcatatctgcaaacggttggtcaggatggcgaagcgcctagcgattatcaatccttcgcagttactattgcaagcgcactggtcattaccgtaaacttccaaattgggctggacacctcctactggactttcgttaacgctttcagcatctttgggagcatcgctctctattttggcatcatgttcgactttcattcagccgggatccacgtcctttttccctccgcattccagtttacaggcacagcaagcaacgccctgcgccagccctacatatggctgacaataatactggccgttgccgtctgcctgctgcctgtggtggccatccgatttttgagcatgaccatctggccctctgagtccgacaagatccaaaagcaccggaaaagactgaaagccgaggaacaatggcagcgccgccaacaggtattccgacgcggagtgagtacaagacggtccgcttatgcattctctcaccagagaggatacgccgatctgatctcctcaggccgctctataaggaagaagagatctcccctggacgccatcgttgcggatggaaccgcagagtaccgcaggacaggtgactct

SEQ ID NO: 7382 - DNA, 3753 bp, Artificial Sequence
  Description of Artificial Sequence: Synthetic coding sequence
atgagcactgaacgagattctgagaccacttttgacgaggatagccagcctaacgatgaagttgtcccctatagcgatgacgagacggaggacgaactagacgaccagggaagtgctgtggagccagagcagaatcgagtgaaccgagaagctgaagagaaccgcgaaccttttcgtaaggaatgcacatggcaggtcaaggcaaatgataggaagtatcacgagcagccacacttcatgaatacgaagttcctatgcataaaggaatccaagtatgcaaacaacgctattaagacttacaaatataacgcgttcacatttattcccatgaacctgtttgagcagttcaagcgcgcagccaacctctatttcttagctctgctgatcctccaggctgttccccaaataagcaccctggcgtggtacaccaccctcgtgcctttactcgtggtgctgggcgttacagccattaaggatcttgtggacgacgtggcaagacataaaatggataaagagatcaataatagaacttgtgaggttatcaaagatggaagattcaaggtggcaaagtggaaggaaatacaggtgggtgatgtaatacggctgaaaaaaaatgattttgtgcccgccgatatattgttgctgtctagctcagaaccaaacagcctatgttatgtagagacggctgagctggacggcgagacaaacctgaagttcaagatgtctctcgaaataacagaccagtacctacagcgtgaagatacactggcaactttcgatggtttcatagaatgcgaagagcccaacaacaggctggataagttcacgggcacactcttttggcgaaacacctctttccctttagatgccgataaaatacttttgagggggtgtgtaatcaggaacactgatttctgccatggccttgtcatttttgccggggcggacactaagataatgaagaacagtggtaaaacaagattcaaaaggactaagattgattatctgatgaattacatggtttatacaatcttcgtagtgttgattctgctcagtgccggactcgccattggccacgcctattgggaagcgcaggtcggcaactcaagctggtacctatacgacggagaggatgacaccccatcataccgtgggttcctgatattttggggctacataatcgttctgaataccatggtgcccatatcactctatgtatctgtggaggtgatacgcctaggacaatcccacttcatcaactgggatctgcaaatgtattacgccgagaaagataccccagcaaaggcccggactacaacgctgaatgaacaattgggccagatccattatatcttttcagacaaaacaggcacgcttacccaaaatatcatgacgttcaagaaatgttgcatcaatggccaaatttacggagaccacagagacgcctcgcagcacaaccataacaagatcgaacaggttgatttttcctggaacacatatgccgacggaaaattggctttctacgatcattatctgattgagcagatccagagcggtaaggagcctgaggtacgacagtttttcttcctgctcgcagtgtgtcacactgtgatggtggaccgcacagatgggcagctcaactaccaagcagcaagtcctgatgaaggagctctggttaacgccgctagaaatttcggattcgcatttcttgcacggactcagaatacgattacaatcagtgaactggggaccgagaggacctataacgtgcttgcgatattagactttaacagtgaccgaaagaggatgtcgatcatagtgaggacaccagaaggcaacataaagctctactgcaagggggctgatacagttatctatgaaaggctgcataggatgaaccccacaaagcaggaaacccaagacgctctcgacatcttcgcgaatgaaacgctaaggacactttgtctgtgttacaaagaaatcgaggaaaaggagttcaccgagtggaataagaaattcatggcggccagcgtggcttcaacaaatagagacgaggccttggacaaagtgtacgaagagatcgagaaggatcttattctcctgggtgctacagccattgaggacaagctacaggacggagtccctgagacgattagcaaactggctaaggccgacatcaaaatctgggttctgactggcgacaaaaaagaaaccgcagagaatataggctttgcctgtgaacttcttacagaggacaccaccatctgttacggggaagacatcaacagcctgcttcacgccagaatggaaaatcagagaaacaggggaggggtatatgctaaattcgctcctcctgtgcaggaaagctttttcccccctggaggaaaccgggcgcttatcattacaggttcttggctcaatgaaattttgctagagaaaaagaccaagcgtaacaagatattgaaactcaagttccctcgaacagaagaagagaggaggatgagaacccagtctaagcgacgcttggaagctaagaaagagcagaggcagaaaaacttcgttgatctggcatgcgagtgctctgcggttatctgctgcagggtaaccccaaaacagaaagccatggtagtcgacctcgttaagcgatacaaaaaagctatcaccctggctattggtgatggcgcaaacgacgtaaatatgatcaaaacagctcacatcggcgtcggaatcagcggccaggagggcatgcaagccgtaatgtcgtctgattactcatttgcgcaattcaggtaccttcaaaggttactgctggtccatggaagatggagttacatccgaatgtgtaaattcctgaggtacttcttttataaaaacttcgccttcacactggtgcacttttggtacagcttttttaatgggtatagcgctcagacggcctatgaggactggttcattacactttataacgttctgtacacatccttaccagtcctcctaatgggactgctggaccaggacgtgtctgataaactgtcactacgattccctggcctgtacattgtcggccagagagacttgttgtttaactacaagaggtttttcgtctcactgcttcatggcgtcctgacaagcatgattctattcttcattccgctgggggcctaccttcagaccgttggacaggacggggaagccccatccgactaccagagcttcgctgttactattgcatctgctctggttatcactgtcaacttccagatcggcctagacacttcatactggactttcgtgaatgcattttccatattcgggtcaatcgctttgtactttggcatcatgtttgattttcattccgccggcatccatgttctctttccgagcgcgttccagtttactggtaccgcaagcaacgcgctgaggcagccatacatatggctgacaattattctggctgtggccgtctgtctcctgcctgttgtggccattcgatttctctctatgaccatctggcccagcgagtccgacaagatccagaaacaccgtaaacgacttaaagcggaagagcaatggcagcggcgacagcaggtgtttaggaggggggtttcgacaagacgatcagcctacgccttcagccaccagcgtggctacgccgatctcatcagttctggacgatctatacgaaaaaagagatctcccctggacgccatcgtagctgatggaacagctgaatatagacgaactggcgattcc

SEQ ID NO: 7383 - DNA, 3753 bp, Artificial Sequence; identical to SEQ ID NO: 7356
  Description of Artificial Sequence: Synthetic coding sequence

SEQ ID NO: 7384 - DNA, 3753 bp, Artificial Sequence
  Description of Artificial Sequence: Synthetic coding sequence
atgagtactgaacgggattcggagaccacgttcgatgaagactcgcagcctaatgatgaggtcgtcccgtacagcgacgatgagactgaagatgaacttgatgatcaaggtagtgccgtcgagcccgaacaaaaccgtgtgaatcgagaggctgaggagaatagagaaccgtttcgaaaagagtgtacatggcaagtgaaggccaacgatcgtaaatatcacgaacagccacatttcatgaacaccaagtttctttgcatcaaagaaagcaaatatgctaataatgccattaagacatataaatataacgcttttacattcattccaatgaatttgtttgaacagtttaaacgggcggctaatttgtattttctggcgttgctgatcctacaagcagtgccacagatttctactctagcttggtacacaaccctggttcccctactcgtcgtcttaggagttacagctatcaaagatctcgttgatgatgtcgcgcgtcacaagatggataaggagatcaacaatcggacctgcgaagttattaaggatggaagatttaaagtggcgaaatggaaagaaatccaagttggcgacgtgatcagactaaagaagaatgatttcgtaccagctgacatccttcttctgagctcatctgaaccaaacagcttatgttatgttgagacagctgaactcgatggggagacaaatcttaaattcaagatgtctctggagatcactgaccagtacctccagcgggaagatactttggcaacatttgacggttttattgaatgtgaggaaccaaataatcggcttgacaagtttaccggaactttgttttggaggaatacgtcatttccgctggatgccgacaagattctattgcgcggatgcgttattcgtaatacagacttctgtcatgggttggtcatttttgctggagcagatactaagattatgaagaactcaggaaaaacccgattcaaacgtacaaagatagattaccttatgaattacatggtgtatacgattttcgtggttctcattctgctctcggcaggtttagccattggtcatgcctattgggaggcacaggttggaaattcttcttggtatctgtatgatggtgaagatgatactccatcctatcgaggtttccttattttttggggatacattattgtcctcaacactatggttccaataagtctatatgtatcggtggaagtcattcgcctcggacaatcgcactttatcaattgggatcttcagatgtactacgctgaaaaagatacgccagctaaggctagaaccaccactcttaacgagcagcttggacaaattcactacattttttccgacaagacgggtaccctaacacagaacattatgacatttaagaaatgctgtattaatggacaaatttatggtgaccatcgagatgcttcacaacataaccataataaaattgagcaagtcgacttttcgtggaacacttacgccgatggtaaactcgctttttacgaccactatcttatcgagcaaattcaatcaggaaaagagccagaggtgcgtcagttcttcttccttttggctgtttgtcatactgttatggttgatcgaacggacggacaacttaattatcaagcagcctctccagacgaaggagcgctagttaacgctgcacgaaattttggctttgcatttttagcaagaacacaaaacaccatcacaatttcagaattgggaacggagagaacatacaatgtactagctatccttgatttcaattccgatcgaaaacgaatgagcataatcgtacgaacaccagaaggaaatattaagctttattgtaagggtgcagacacggtaatctatgaaagattgcatcgaatgaacccaacgaagcaggaaacgcaggacgcattagacatattcgcgaacgaaactttgaggactttgtgtctttgttataaggaaatcgaggagaaagagtttactgaatggaacaaaaaattcatggctgcttctgtagcttccacgaatcgcgacgaggctttggataaagtttacgaagaaatcgaaaaggacttgattttattaggagcaacagctattgaagacaaactgcaagatggagttccagaaactataagtaaactcgcaaaggcagacatcaaaatttgggtcctaacaggagacaagaaagaaacagcagagaatattggcttcgcctgtgagctattgactgaagacaccacgatttgctatggggaggacatcaactcccttctccatgcacgtatggaaaaccaacgaaatagaggaggtgtttacgctaaattcgctccaccagtgcaagagtcatttttcccacccggaggaaaccgtgcacttattattaccggatcttggcttaatgaaattctgttggagaaaaaaaccaagcgcaataaaatcttgaaactcaagtttccgaggacggaggaagaaaggcgaatgcgaactcagtccaagcggcgattagaagctaaaaaagaacagcgacaaaagaattttgtcgatcttgcatgcgagtgttcggcggtcatatgctgcagagtaacccctaagcaaaaggcaatggttgtcgatttggttaaacgttacaagaaggctattacacttgccatcggggacggtgctaatgatgtgaacatgatcaaaaccgcacatattggagtcggaatatctggacaggagggtatgcaagccgtaatgagttcggattattcctttgctcaattccgttatctgcagagattgctgctagttcatggccgttggtcgtatattagaatgtgcaaattcttgaggtattttttctacaaaaatttcgcattcactctggttcatttctggtactcattcttcaatggatattctgcacaaactgcttatgaggattggttcattactctgtacaacgtcctctatacgtcacttccagttcttctcatgggactgttggatcaagatgtctcagataaactttctctacgttttccaggattatatattgttggacagagggatttgctgttcaattataagcgtttttttgttagtcttctgcatggtgttctaacgagtatgatcttgttcttcataccattgggagcatatctccaaactgtgggacaggatggagaggctccgtcagattaccagtcgttcgcagtaacgattgcgtctgcacttgttatcacagtgaatttccagatcggcctcgacacgtcttactggaccttcgtcaacgcgttctccatttttggatcaatagcactgtatttcggaatcatgtttgattttcatagtgctggaatacatgtgttatttccatcagccttccagtttacgggaaccgcgagcaatgctcttagacagccatatatttggttaacaataatcttagctgttgcagtttgcttgctgccagtggtggccatacgctttctttcgatgacaatatggccatcagagtctgataagatccaaaaacatagaaaacggttaaaggctgaggagcaatggcaaagaagacagcaagtttttagacgaggagttagtacacgacgttccgcttacgctttctcacatcaacgcggatacgccgatttgatatcaagcggccgatcgattagaaaaaagaggtcaccgttggatgcaattgtcgcggacggtactgcagaatatcgacgcactggagattct

SEQ ID NO: 7385 - DNA, 3753 bp, Artificial Sequence
  Description of Artificial Sequence: Synthetic coding sequence
atgtcgaccgaacgtgactcggaaaccacctttgatgaagattctcaacccaacgatgaggtggtgccttacagcgacgatgaaactgaagatgagcttgatgaccagggatccgcggtggagccagagcaaaacagagtcaaccgggaggccgaagaaaatagagagccttttaggaaggagtgcacgtggcaggtgaaagcaaacgatcggaagtaccacgagcagccccatttcatgaacactaagttcctttgcattaaagaatcgaaatacgcaaacaacgccatcaagacgtacaagtacaatgcattcacctttattccgatgaaccttttcgaacagtttaagcgggcagctaacctctactttctggcactcctgatcctgcaggcggttcctcaaatttcaacgctggcttggtacaccaccctggtccctctgctggtcgtgctgggtgttaccgcaatcaaggatctggtggacgatgtggccaggcacaagatggataaggaaatcaataatcgcacctgtgaagttatcaaagatggcaggtttaaggtcgccaagtggaaagagatacaagtgggagatgtgatacgacttaagaaaaacgactttgtgcctgcagacattctgttgctctcctcctcagagccaaattctctgtgttacgtggaaactgcagagctggacggggaaaccaatctgaagtttaagatgtccctggaaattaccgatcaataccttcagcgtgaggacactctcgcgacgtttgatggctttatagaatgtgaagaacctaataaccggctcgataagttcaccggaacccttttctggagaaacaccagctttcctctcgatgcagacaaaatccttctcaggggttgtgtgattagaaacactgatttctgccacggtctggtgattttcgcaggagctgacacgaagataatgaagaattcaggaaaaacccggtttaaacggaccaagatcgattaccttatgaattacatggtgtacacgatatttgtggtactcatcctgctttccgcaggactggcaatagggcatgcatactgggaggcacaagtgggcaactccagctggtacctgtacgacggagaagatgataccccttcgtatagagggtttctgatcttttggggctacatcatcgtgctcaacaccatggtcccaattagcctttacgtatccgtggaagtgattcggctgggacagtcacatttcatcaactgggatctgcaaatgtactacgcagagaaggatacgcctgccaaggcacggaccaccactctcaatgaacaacttggtcaaattcactacatcttttcggacaaaactggaacccttacccagaatatcatgacgtttaagaagtgctgcatcaatggacagatatacggagatcacagagatgcatcacaacataaccataacaaaatcgaacaagtcgacttctcatggaacacgtacgccgacggtaaacttgctttttacgaccattaccttattgaacaaatccaaagcggtaaggaacccgaagtgcggcaattcttctttctgctggctgtgtgtcacaccgtgatggtggatagaacggacggacagctcaactatcaggcagcctcgccagacgagggagcactcgtaaacgccgctcgcaactttggattcgcatttctcgcgcgcacgcaaaacactatcaccatttccgaattgggtactgaacgcacctacaatgtgctggcaattttggacttcaattccgaccggaagaggatgtcgattatcgtgcgaacccccgaaggcaacatcaagctgtactgtaaaggtgcagacaccgtgatttatgagcgcctgcataggatgaatccaactaaacaggaaacgcaggatgccctcgacatctttgcaaacgaaactttgcgaactctgtgtctttgttacaaggaaatagaggaaaaagaattcaccgaatggaacaagaagtttatggcagcaagcgttgcatccaccaaccgtgacgaagctcttgataaagtgtatgaggaaatagaaaaggacctcatcctccttggagcaacggcaattgaagataaacttcaagatggggtccctgaaaccatatcaaagttggcgaaggccgatatcaagatttgggtcctgaccggagataagaaagaaaccgcagagaatatagggttcgcctgcgaattgctgaccgaggacacgactatatgctacggcgaggacatcaactctctgctccatgcaaggatggaaaaccagcggaatcgtggtggtgtgtacgcgaagttcgcacctccagtccaagagtcattctttccaccgggaggtaatagggccctcatcattactggatcgtggcttaacgaaatcctgctggagaaaaagaccaagcgtaacaaaattcttaaacttaagttcccacgaaccgaggaagaaagacggatgcggacccagtccaagcgcaggcttgaagcgaaaaaggaacaacggcaaaagaattttgtggacctggcgtgtgaatgtagcgcagttatttgttgtcgtgtgacgcccaagcaaaaagcaatggtagtggatctggtgaagcggtacaaaaaggccattaccctggccattggagacggcgccaatgacgtcaacatgattaagactgcacatattggggtcggaatctccggacaagagggtatgcaagcggttatgtcatcagattactcgtttgcacagtttcgctacctccaacggctccttctggtgcacggtcgatggtcatacatcaggatgtgtaagttcctgagatactttttctacaagaattttgccttcaccctcgtccatttttggtacagcttctttaatggctactctgcacagacggcatacgaggattggttcatcaccttgtacaatgtgctctacacttcgcttcctgtgcttttgatgggtcttttggatcaggacgtgtccgacaagctgtcgctgagatttccaggtctttacattgtgggacagagagatctgcttttcaactacaagagatttttcgtctcactgctgcatggggtgcttacctccatgatactgttcttcatccctctgggagcctatcttcaaactgtgggacaggatggcgaggcaccttcggattaccagtcctttgcagttactattgcatcggctttggtgattaccgtgaacttccaaatcggacttgacactagctactggaccttcgtgaacgccttttcgatctttggttccatcgccctgtattttggaattatgtttgatttccattcggcagggattcacgtcttgtttccttccgcctttcaatttactggcaccgcatcaaacgctctgcgtcagccatacatctggcttaccattattctcgcagtcgccgtctgcttgctcccagtcgtggctattagatttctcagcatgaccatctggcccagcgaatccgacaagattcagaagcatcgcaagagactcaaggcggaggaacagtggcagcggcgacaacaggtctttcggcgcggcgtctctaccagacgcagcgcctatgcgttttcacatcagcgaggatacgcagatctgatttcgagcggaagatcaattaggaaaaagcgttcacctctggatgcaattgtggcagatgggactgccgaatacagacgaacgggtgattcg

SEQ ID NO: 7386 - DNA, 3753 bp, Artificial Sequence
  Description of Artificial Sequence: Synthetic coding sequence
atgagcactgagcgtgattccgaaacaacgttcgacgaggacagccaacccaatgacgaggtggtgccctacagcgatgatgagaccgaggatgaactggacgatcagggaagcgccgtggagcctgaacaaaatagggtcaatcgtgaggccgaagagaatcgcgaaccctttagaaaggaatgtacatggcaggtgaaggccaacgatcggaaatatcacgagcagccccactttatgaacaccaaatttctgtgtatcaaggagagtaaatatgccaataacgcgatcaagacttataagtacaacgccttcactttcattcctatgaacctgttcgagcagttcaaaagggcagcgaatttgtactttctggcactactgatcctgcaggcggttcctcagatcagtaccctggcatggtacacaaccctggtgcccctgctggtggtgttaggtgtgactgctatcaaggacctcgtggacgatgtcgcccgtcataaaatggataaagagatcaacaaccgcacatgtgaagttatcaaggatggccggtttaaagtggccaagtggaaggagatacaggtcggggacgttatccgtttgaaaaagaacgacttcgtaccggccgacattttgctgctaagcagctcagagcccaatagtctctgctacgtcgaaacagccgagctggatggagagactaatctgaagttcaaaatgtctttagagatcactgaccagtatcttcagcgagaagatacactcgccacattcgatggttttatcgaatgtgaagaacccaacaaccggctggataagtttacgggaaccttgttttggcggaatacatcattccccttggatgccgacaagatcctgctccgaggatgtgtcatcaggaacaccgatttctgccacgggttggtcatctttgccggtgccgatacaaagattatgaagaacagcggaaagacccggtttaaacggaccaaaattgattatctaatgaattacatggtttacacgatctttgtggtcctgattcttctatccgccgggctggcgatcggacacgcttactgggaggcgcaggtcggcaattcctcatggtatctgtatgacggcgaggacgacaccccctcctaccgaggtttccttatcttttgggggtatatcattgtgttgaataccatggtgcctatcagtctctacgtgagcgtcgaggtgatccggctgggtcagtcccacttcatcaactgggacctgcagatgtactacgcggagaaggatacccccgccaaagctcggactaccactctgaatgagcagctgggccagattcactacatcttttctgataaaacgggcacattgactcagaacatcatgacgttcaagaagtgctgcatcaatggccagatatatggagaccacagagacgcttcccagcacaatcataataagatcgagcaggtggacttctcttggaacacgtacgcagacggcaagttggccttttatgatcactatcttatagagcaaatccaaagtggcaaagagccagaagtcaggcagttcttcttcctactcgcagtttgccataccgtaatggtggatcggacagatggccagctgaactaccaggctgcttctcccgatgaaggggcgctggtcaatgcagccaggaactttggctttgcattcctggctcggacccaaaatacaatcactatctccgagttgggtaccgagcgaacatacaatgtccttgctattttggatttcaatagcgatcggaaacgcatgagtataatcgtacggactccggagggcaatattaagctatattgcaaaggcgccgataccgttatctatgagaggctgcataggatgaatcccacgaagcaggaaactcaggacgccttagatatctttgccaacgagactctcagaaccctgtgtctgtgctataaggagatcgaagagaaggagtttacagagtggaataagaagtttatggccgcttccgtggcttctactaacagggacgaggcactagataaagtgtacgaggagattgagaaagatctgattttactcggtgcaaccgcgatagaggataaactccaagacggtgtacctgagacaatctcgaaactcgcaaaggcagatattaagatttgggtactgacgggtgacaaaaaggaaacagcggaaaacattgggttcgcttgtgaattattgaccgaagataccacaatttgttacggtgaagacattaactcgctcctccacgctcggatggagaaccagcgcaatcgcgggggtgtctacgccaagtttgcccctccagtccaagagtccttttttcctcccgggggaaatcgcgcactcattataaccggttcatggctcaacgaaatcttgttggagaagaagacaaagaggaacaagatccttaagctcaaattccctcgcacagaggaagagcggcgcatgcgcacgcagagtaagagacggctagaggctaagaaagaacaacgccagaagaatttcgtggatctcgcttgtgaatgctcagctgttatttgttgcagagtgactcccaaacagaaagccatggtcgtcgatttggtgaaacggtacaagaaggccataactttggctataggagatggcgcaaatgatgtcaatatgatcaaaacagcccacatcggcgtcggaatatcgggacaagaaggcatgcaggctgtcatgagctctgactactccttcgcacagttccgctacttacagcggctgctgctggtgcacgggcggtggagttatatcagaatgtgcaaattccttagatattttttctataaaaattttgcttttactctggtgcacttttggtactcttttttcaatggctattctgcccaaaccgcctatgaagactggttcatcaccctgtataacgtgctgtacacttccctcccagtgcttctcatgggtttgcttgaccaggatgtctccgataagctgtcactcaggtttcccggtctgtacatcgtggggcagcgggacctgttattcaactacaagagattcttcgtaagcctcctacatggcgtgctcacctctatgattctgttttttataccccttggcgcatatcttcagacggttggccaagatggcgaggcaccaagtgattaccagagctttgccgtcaccatcgcttctgccttggtgatcaccgtcaatttccaaatcgggttggacacatcttactggacctttgtgaatgccttctccatattcgggtctatcgctctttactttgggattatgttcgattttcatagtgctggtatccatgttctgtttccctcagctttccaattcacgggcaccgccagtaatgcactcaggcagccatacatctggcttacaatcatcttggctgtcgccgtgtgtctgcttccggtagtggccattcgcttcctgagtatgacgatctggccctccgagtcagacaagatccagaaacatagaaagcggctcaaggcagaggagcagtggcagaggcgccagcaggtatttagacgaggcgtgtctaccaggcggagtgcctacgctttttcacatcagcgcggctatgcagatttgatctcgtccgggcgatcgatccgcaagaagagatctcccctggacgcaatagttgcagatgggactgccgagtatagaagaacaggagatagt

SEQ ID NO: 7387 - DNA, 3753 bp, Artificial Sequence
  Description of Artificial Sequence: Synthetic coding sequence
atgtctactgaaagagattccgagactacctttgacgaggattcgcaaccgaacgatgaagtggtcccatactctgatgacgagactgaggacgaactcgatgatcaaggatccgccgtcgaacccgagcaaaatcgggtcaacagggaagccgaggaaaacagagagccattcaggaaagaatgcacctggcaagtgaaagcaaatgaccggaaataccatgagcaacctcatttcatgaatactaagtttctctgtattaaggaatccaaatacgcaaataacgcaatcaagacctacaagtataacgcctttacctttatacctatgaaccttttcgaacagtttaagcgagcagcaaatctgtactttttggcgctgctgattttgcaagccgtgccccagattagtacgctggcatggtacactacccttgtgcccttgctggtcgtgcttggagtcactgcaatcaaggatcttgttgatgacgtggcgcgccataagatggataaagagattaacaaccggacttgtgaagtgattaaggacggaaggtttaaagtggccaagtggaaggagattcaagttggagatgtgattagacttaagaaaaacgattttgtccctgcagacatcctgcttctgtcatcctcagaaccaaatagcctttgttacgtggagactgccgaactggatggagagactaatctgaagtttaagatgtcattggaaataactgatcaatacctgcagagagaagatacccttgccacctttgatggctttattgagtgtgaagaacctaacaacagactggacaaattcacgggtacccttttctggcggaacacgtcgtttcctctggatgcagacaaaatacttctgcgcggttgtgtgattcgaaataccgatttttgtcatggactggtgattttcgcaggcgccgatactaagattatgaagaattcgggaaaaacccgctttaagcgtaccaagattgattacttgatgaactacatggtgtacacgatttttgtggtgctcatcctcctgtccgccgggttggccattggtcacgcatattgggaagcacaggtcggaaattctagctggtatctttacgatggtgaggatgacaccccatcgtaccggggttttctgattttctggggctacatcattgtgctgaacacgatggtgccgatctccctgtacgtgtcggtggaagtgattagactgggtcaatcacacttcattaactgggatcttcaaatgtactacgctgaaaaggacactccggcaaaggctagaactaccacgctgaacgaacagcttgggcaaattcactacatcttcagcgacaaaactggcaccctgacgcaaaacattatgacttttaagaaatgctgcatcaacggacagatatacggagatcaccgtgatgcgtctcaacacaatcacaataagattgaacaagtggatttttcatggaacacctacgccgatggtaaactggcgttttacgatcattacttgattgagcagatacaatcaggtaaggaacctgaggtgaggcagtttttctttctgctggccgtgtgtcatactgttatggtggaccggaccgatggccagttgaattaccaagcagccagccctgacgaaggcgctttggtgaacgcggcacgtaatttcggatttgcctttcttgctagaactcagaacaccattaccatatccgaacttggaaccgaaaggacctacaatgtccttgccattcttgactttaacagcgaccgaaagcgaatgtcaatcatagtgcgcactcctgagggaaacatcaagctgtactgtaagggtgcagacacggtgatttacgagcgtttgcatcgaatgaatcccaccaagcaggaaacgcaggacgcacttgacattttcgcgaacgaaacccttagaaccctgtgcctctgttacaaagaaattgaagaaaaggagtttaccgaatggaacaagaaattcatggcagcgtctgtggcgagcactaatagagacgaggcacttgataaggtctacgaagaaatcgagaaagacctcattcttttgggagcaaccgccattgaagataagctccaagacggagtccctgaaaccatttcaaagctggctaaagcagacattaagatttgggttctgaccggtgacaagaaggaaacggcagaaaacatcgggtttgcctgcgagctcctgactgaagataccaccatctgttacggagaagatatcaattcacttctccatgccagaatggagaaccagagaaatagaggaggcgtgtacgcgaagtttgccccgccagtgcaagaatccttcttcccacccggtggcaaccgggcactgatcataactggaagctggctcaacgaaatactgctcgagaaaaagaccaaacgcaacaagatactgaagctcaaattccctcggacggaggaggagcgcaggatgcgcacgcagtcaaaaaggcgcctggaagcaaagaaggagcaaaggcagaaaaactttgtcgatctggcatgcgaatgctctgcggtgatctgttgtcgtgtgactccaaagcaaaaggcaatggtggtggaccttgtcaagagatacaagaaggcaattactctggcaattggagatggggcgaacgatgtgaacatgatcaagacggcacacatcggggttgggatcagcggccaggaaggtatgcaggcggtgatgtcctctgattactcgtttgcccaattcagatacctgcaacgcttgctccttgtccatggccggtggtcctatatccgaatgtgtaagttccttaggtactttttctataagaattttgcttttacgctcgttcatttttggtactcgttcttcaacggatatagtgcccaaactgcatacgaggactggtttatcaccctctacaacgtcctttacacttcgcttccagtccttctcatgggattgctcgaccaagatgtctcagataaactgagcctcagattccctgggttgtacatcgtaggtcagcgcgatctcctcttcaattacaaacgcttttttgtctcgttgctgcatggggtgctgacgtccatgattctctttttcatcccgctgggtgcatacctgcaaacggtgggacaggatggtgaagccccctctgattaccaatcattcgcagtgaccatcgcctcggcactggtgataaccgtgaactttcaaatcggacttgatacttcctattggacctttgtgaacgcattttctatctttggttccatcgcactgtattttgggatcatgtttgattttcattcggctggcattcacgtgctgttcccatcagcattccagttcaccggaaccgcaagcaacgcgctgcgccagccatacatttggcttaccatcatcttggctgtcgcagtgtgccttctgcctgtggtggccattagatttctgtcgatgactatctggccgtccgaatcggataagatacagaagcatcggaaaaggcttaaggcagaggagcaatggcagaggcgacaacaggtctttagaaggggagtgtcgacgagacggagcgcatacgcattctcgcatcaaagaggttacgccgatcttatttcgtcggggcgctccatacgaaagaagcgaagcccacttgatgcgatcgttgcagatggaaccgctgagtacagaagaaccggagactcg

SEQ ID NO: 7388 - DNA, 3753 bp, Artificial Sequence
  Description of Artificial Sequence: Synthetic coding sequence
atgtcaacggaaagagacagcgagactacttttgatgaggattcccagccaaacgatgaagtggtaccctactccgacgatgaaactgaggatgagttggacgatcaggggtctgccgtagaacccgagcagaatagggtcaacagggaagctgaagagaatcgggaaccatttcggaaggagtgcacatggcaggtgaaagcaaatgacaggaaataccatgaacaacctcactttatgaacacaaaattcctgtgtattaaagaatcgaagtacgccaacaatgccatcaagacctataagtataatgccttcacttttatccctatgaacctgtttgagcaattcaagcgagctgctaacttgtactttctggcactcctaatcctccaggcagtaccccagatctcaactctagcctggtacacaactttagttcccctgctcgtcgtcctgggggtgaccgccataaaggatctggtcgacgatgtggcccgccataaaatggataaggaaatcaataatcgcacttgcgaggtcattaaggacgggaggttcaaggtcgccaaatggaaggagatccaggtcggtgacgtgattcgcctcaaaaaaaatgattttgtgcccgcagacatacttctactgagctcctctgaaccaaactcattgtgctatgttgagacggccgaattggacggggaaacgaatctcaagttcaaaatgagtttagagatcaccgaccagtatctccagagagaggataccctcgcgacatttgacggattcattgaatgtgaagaacccaacaacaggcttgacaagttcacgggaaccctgttctggcggaacacttcctttcccctggacgccgacaagatacttctgcgaggctgtgtgatccggaatactgacttctgtcacggcctggtgatttttgccggtgccgacactaagattatgaagaactccgggaagacccgtttcaaacgaactaaaatcgactacttgatgaactacatggtctacacaatctttgtggtgctcattctcctgtctgctggtctagccatcggccacgcctactgggaagcccaggtaggaaattctagctggtatctgtacgatggtgaagacgatactccctcttatcgaggattcctgatattctggggttacatcatcgtacttaacacgatggtgcccatttccctgtatgtgtctgtggaggtcattaggctgggccagtcccattttatcaattgggacctgcagatgtactatgctgaaaaagatacccccgccaaagctcgcacgaccacgctgaacgaacagctggggcaaattcactatatcttctccgacaaaacgggcactcttacccagaatatcatgaccttcaaaaaatgctgcatcaatggccagatctacggcgaccatcgggacgcctctcagcataaccataacaaaatcgaacaagttgatttctcttggaatacctatgcagatgggaagttggctttctacgaccattacctgatcgagcagatccagtctggcaaggagccggaggtgagacagttcttctttctgctggccgtgtgccatactgtgatggtggacaggacggatggccagctcaactatcaggcagccagcccagatgagggggcactagtaaacgccgcgcggaactttggattcgcttttcttgcaaggacccagaataccattacaatcagtgaactgggcaccgaacgaacttacaatgtgctggcaatccttgactttaacagcgacaggaaacgcatgtcgataatcgtcaggaccccagaagggaatatcaagctgtactgtaaaggggccgacacagtcatttatgaaagactgcatcggatgaatccgactaagcaggaaacccaggatgccctggatatcttcgccaatgagacgctgcgcacactctgtctctgctataaggagattgaagagaaggaattcaccgagtggaataagaagttcatggcggcatctgtggcctccacaaatcgagatgaagccctggataaagtttatgaagaaatcgagaaggatctgattctgttgggcgccacggccatcgaagacaagttgcaggacggggtgccagaaaccatctctaaactggcgaaagcagacattaagatatgggtgctcaccggggacaagaaagagacagctgagaacatcggctttgcatgtgagttgctgaccgaggacacaacgatttgctatggcgaggatatcaactctctcctgcacgcgaggatggagaaccaacggaaccggggaggtgtgtatgccaagtttgctcccccagtccaggagtccttcttccctcccggcgggaatagagcgttgataatcacggggagttggctgaatgaaatcctgctggagaagaaaaccaaaaggaacaagatccttaaactcaaattccctagaaccgaagaggaacgcaggatgcgtacccagagtaagagacgactggaagcgaaaaaggaacaaagacagaagaattttgttgatctggcttgcgaatgttctgcagtgatctgctgtagggtcacccccaagcaaaaggctatggtcgtggatctagttaaaaggtacaagaaggccatcacactagccataggggacggggcgaacgacgttaacatgatcaagactgcacacataggagttggcatcagcgggcaagaggggatgcaagctgtgatgagttccgattatagttttgctcagttcagatatctgcaacggctgttgctcgtgcatggtcgatggagctatattcgaatgtgcaagttcctgaggtactttttctataagaattttgccttcactctggtacatttctggtattcattctttaatggttattccgcccagacagcgtatgaagattggttcatcactctgtataacgtgctctataccagcttacctgtgctcctgatggggctgctggatcaggatgtgagtgacaaactatccctcagatttcctggtctttacatagtcggccagcgcgaccttctgttcaactataaacgatttttcgtgagtcttctgcatggagtgttgactagtatgatactgtttttcatccccctgggcgcctatcttcagaccgtggggcaagatggcgaagcgccctctgactatcagagctttgcagtcaccattgcgagcgccttggttatcacagtgaacttccaaattggcttagacactagttactggacctttgtaaatgccttttcgatatttggttctatcgcattgtatttcggtattatgtttgattttcactccgctggcatccatgtgctgtttccctcggcctttcaatttactgggacagctagcaacgccctgaggcagccgtatatctggctgacgatcatcctggccgttgcggtttgcctgctgccagtagtcgctatcagatttttgtcaatgacaatctggccctccgagagcgataagatccagaagcaccgaaagcgcctcaaagccgaagaacaatggcaaaggagacagcaagtattcaggcggggtgtctccacacggcggtccgcatacgccttttctcatcaacgagggtacgcagacctgatcagctcgggcagatctattcgaaagaagaggtccccactcgatgccattgtcgccgatggcaccgcggaataccgcaggactggggacagt

SEQ ID NO: 7389 - DNA, 3753 bp, Artificial Sequence
  Description of Artificial Sequence: Synthetic coding sequence
atgtctacagaacgagactctgaaactaccttcgatgaggactctcaaccgaatgatgaggtggtcccgtactccgacgatgagacagaggacgagctggacgatcagggaagcgctgtcgagccggaacaaaacagggtcaatagggaggcagaggagaacagggaaccattcaggaaggagtgtacttggcaggttaaggctaatgatcgcaagtaccacgagcagcctcatttcatgaacacgaagtttttgtgtatcaaagagagcaagtacgccaataatgcaataaagacctataagtacaacgccttcaccttcatcccaatgaatctgttcgaacaattcaaaagagccgctaatctctacttccttgccctgctgattcttcaggcagtaccgcagattagcacgttggcatggtataccaccctggtccctctgctcgtcgttcttggagtgaccgcaataaaggacttggtggatgacgtggctcgacacaaaatggataaggagatcaataaccgaacctgtgaggtgattaaagacgggaggtttaaggttgccaagtggaaggagatccaggtgggtgacgttattagactcaagaagaatgactttgtgcctgccgacatccttctcctctcatcatctgagccaaatagcctgtgttacgtcgaaaccgctgagttggatggtgagacgaacctgaagtttaaaatgagtctggaaattacggaccagtatctgcagagggaggacacgctggctacttttgacgggttcattgagtgcgaggagcccaacaaccgactcgacaagtttaccggcactctgttctggaggaatacttccttccccctcgacgccgacaagattcttctgaggggctgtgtgattcgaaacacagacttctgtcatggacttgtgatctttgccggcgccgataccaagatcatgaagaactcaggcaaaacacggttcaagcggacaaagatagactacttgatgaattatatggtgtacaccatttttgtcgtgctgattttgctctcagcaggccttgctataggccatgcttactgggaggcccaggtgggtaacagcagctggtatctctacgacggtgaagacgacaccccgagctaccgcggcttcctgatcttctgggggtatatcatcgtacttaataccatggttcccattagcttgtatgtcagcgtggaggtgatcaggctgggccaatcccactttatcaactgggatctccaaatgtactacgccgagaaagacacacctgctaaggccaggaccactacgctgaacgaacagctgggccagatccattacatcttctccgacaaaacaggcacccttacgcagaatatcatgactttcaagaaatgttgcattaatgggcagatctacggagatcacagagatgcatcacagcataatcacaacaaaatcgagcaggtcgacttttcctggaatacatatgcagatggaaagctggcattctacgaccattacctcattgaacagattcagtcaggcaaggagccagaagtgcggcagttcttttttttgctggcagtttgccacacggtgatggtggatcgcaccgacggacagttgaactaccaggccgcgtcacctgacgagggagcactcgtcaacgctgccagaaactttgggttcgcgttcctggcaaggacccagaatacaataacaattagtgagctcggaacagagagaacctataatgtcttggccatccttgacttcaactcagacaggaagcgcatgtcaattatcgttaggactccggaggggaacatcaaactgtattgcaaaggggctgatacagtgatctatgaaaggttgcaccggatgaatccaacaaagcaagaaacccaggacgccttggatatcttcgccaatgagactttgcggaccctgtgtctctgctataaggaaattgaggagaaggaatttactgaatggaataaaaagttcatggccgccagcgtggcttcaactaacagggatgaggctctggacaaagtgtatgaggagattgaaaaggatctgatcctgttgggtgctactgcaattgaggacaaattgcaagatggtgtgcctgagacaatttccaagcttgctaaagccgatatcaagatctgggtcctcaccggcgataagaaggagaccgcagagaatatcgggttcgcctgcgagcttctgacagaggacactaccatctgctacggggaggatatcaacagtctcctgcacgctagaatggagaaccagcgcaataggggaggcgtctacgctaagtttgcaccgcccgtgcaggagagtttttttccccccgggggcaacagggctctgatcatcacgggcagctggcttaatgaaattttgctcgagaagaagaccaagcgaaacaagatcctgaaactgaagttcccgcgaacagaagaggagagacggatgcgcacacaaagcaaaaggcgactcgaggcaaaaaaagaacaacggcagaagaattttgtggacctggcttgcgaatgctcagcggtgatttgttgccgagtgactcctaaacagaaagctatggtcgttgacctggtaaagagatacaaaaaggccatcacgctcgctattggagacggagctaacgacgttaacatgataaaaacagcccacatcggtgttggcattagcggccaggaggggatgcaggcagtgatgtctagtgattactccttcgcccagttccggtacctccagagacttttgctggtccatggacggtggagttacattcggatgtgcaagttcttgcggtactttttttataaaaattttgcttttacactggtgcacttctggtactccttcttcaacgggtactctgcacagaccgcttacgaagattggtttattactctgtataatgtactgtacacaagcttgcccgtgctgcttatgggacttttggatcaggatgtctcagacaagctgtccctgcggtttcctggcctgtacatagtgggacagcgggaccttttgtttaactacaaacggttctttgtaagtctcttgcacggggtgcttaccagcatgatcctgttttttattccattgggggcctatctccaaaccgttggccaggacggagaggcaccttcagactaccaatcattcgccgtgaccatcgctagcgccctggtgatcactgtaaatttccagatcgggctggacacaagctattggacatttgtgaatgctttctccatcttcggctcaatcgcactttactttggaatcatgtttgacttccacagtgccggtatccacgtgctctttcccagcgccttccagttcaccggcaccgccagtaatgccctgcggcagccttacatctggctgacgattattctggctgtggcagtctgtttgctccctgtggtcgcaattcggttcctctccatgaccatttggccttcagaatccgacaaaatccagaagcaccgcaaaaggcttaaagccgaggagcagtggcagcggcgacaacaggtgtttagacgcggtgtaagcaccagacggagcgcctatgccttctcacaccaacgggggtacgccgacctcatcagcagtgggcgctctatcagaaagaagagatcaccgctcgatgcgatcgtcgccgatgggacggccgagtatcggaggacaggagacagt

SEQ ID NO: 7390 - DNA, 3753 bp, Artificial Sequence
  Description of Artificial Sequence: Synthetic coding sequence
atgtcgaccgagcgcgatagcgagacgacctttgacgaggattcccagccgaatgatgaagtcgtgccttactctgacgatgagactgaggacgaattggatgaccaaggctcggccgtggagcctgagcagaaccgcgtcaatagagaagccgaagagaatcgcgagccgttcagaaaggaatgcacttggcaggtgaaggcgaatgatcgcaagtaccatgagcagccgcactttatgaacactaagttcctgtgcatcaaggaatcgaagtacgcgaacaacgccatcaagacttacaagtacaatgcatttaccttcataccgatgaacttgtttgagcaattcaagcgcgcagccaatctttacttcctggcgcttctgatcctgcaggcggttccgcaaatcagcactctcgcgtggtacaccacccttgtgccgttgctggtcgtgctgggcgtcaccgcgattaaggacctggtggatgacgtcgcccgccacaagatggacaaagaaatcaataatcggacttgtgaggtcatcaaggacggtagattcaaggtggccaagtggaaggaaatccaggtcggtgatgttattaggctcaagaaaaatgatttcgtgccagcagacatcctgctgctgtcctcctccgagcctaactccctgtgctacgtggaaactgctgagctcgacggcgaaactaatctgaaattcaagatgtcgcttgagatcacggaccagtatctgcaacgcgaagatacccttgcgacgttcgacggctttatagaatgcgaggaacctaacaatcggctcgacaaattcactgggacgctcttttggcggaacactagtttccctctcgatgccgacaagatcttgctgcgcggctgcgtgatccggaatactgacttttgtcacggactggtgatcttcgctggagcagacacgaagatcatgaagaacagcggaaaaactcgctttaaacgcactaagatcgactacctgatgaactacatggtctacacgatcttcgtggtgctcatcttgctgtcggcaggattggcgatcggacacgcctactgggaagcccaagtcggtaactcctcgtggtacctttacgacggcgaggacgataccccttcttacaggggattcctgatcttctggggatacatcattgtgcttaacaccatggtgcctatttcactgtacgtgtccgtggaagtgatccggctgggccagtctcacttcattaactgggatcttcagatgtactacgcagaaaaggacactccggcaaaggcacgcaccaccaccctgaacgagcagcttggacaaatccattacatcttctcagataaaaccggaaccctgactcagaacatcatgaccttcaagaaatgctgcatcaacggacagatctacggcgaccacagagacgcctcacaacacaaccacaacaaaatcgaacaggtggatttctcctggaatacctacgctgatggaaagctcgccttctatgatcattatctcatcgaacagatccaaagcggcaaggagcctgaggtgcgacagttcttctttctcttggccgtctgccacactgtgatggtggaccggaccgatgggcaactgaactaccaagctgcgtcgccggatgaaggagcgctggtgaacgctgccagaaatttcgggtttgctttcctggcgcggacccagaacaccatcaccatctccgagctcgggactgagcgcacttacaatgtgctcgcaatcttggatttcaattcggatcggaagcgcatgagcattatcgtccgtactccggagggcaacatcaagctctactgcaagggtgcagatacggtcatctacgaaaggctgcaccgcatgaacccgactaaacaagagacgcaagatgcgctggacatcttcgccaacgaaactctgcgcaccctctgtctgtgctacaaagaaatcgaggagaaggagtttaccgagtggaacaagaaattcatggcggcatccgtggcatcgaccaatagagatgaggccctcgacaaggtctacgaggaaattgaaaaggatctgatcctgttgggcgctaccgccatcgaagataagctccaagacggagtgccggaaaccatctcgaagctggcaaaggcagatatcaaaatctgggttctcactggggataagaaggaaactgcggaaaacattggattcgcctgtgagcttctgactgaggacactactatctgctatggagaggacatcaatagcctgctgcacgcgcgcatggagaatcaaagaaaccggggaggagtgtacgctaaattcgctccacccgtgcaggagtccttcttcccgcccggcggaaatcgggccctgatcatcactggatcatggctgaacgagatcctcttggaaaagaaaaccaagcgcaacaaaatcttgaagctgaagtttccaagaaccgaggaggagcgcagaatgcgcacccagtccaaacggagactggaagccaagaaggaacagcgccaaaagaacttcgtggacttggcctgcgagtgcagcgccgtgatctgctgtcgcgtcaccccgaagcagaaggccatggtcgtggatctggtgaagcggtacaagaaagccatcactttggcaatcggagacggggccaacgatgtgaatatgatcaaaaccgctcacatcggcgtgggaatctccggccaagaaggcatgcaagcggtgatgtcgtccgattactcgtttgcacagttccgctatctgcaaagattgctgctggtgcacgggcgctggtcgtatatcaggatgtgcaaatttctgagatacttcttctacaagaactttgccttcactctggttcatttctggtactcgtttttcaacggctactccgcccagactgcctacgaggactggtttatcacgctctacaacgtgctctacacgagtctcccagtgttgctgatgggactcctcgaccaagatgtttctgacaaactcagcctgcgctttccaggcctgtacatcgtgggacagcgcgacctgctgtttaactacaaaagattctttgtctcactcctgcatggggtgcttacctcaatgatcttgttcttcatcccgttgggagcatacctccaaactgtgggccaagatggcgaagctccgtcagactaccagtcgttcgccgtgaccatcgcttctgccctggtgatcacggtcaatttccagattgggctggacacctcatactggaccttcgtgaacgcattctcgatcttcggctcgattgccctctacttcggaattatgttcgacttccattccgccggcattcacgtcttgtttccgagcgccttccagttcactggcacggcctcaaatgcgctgcggcagccgtacatctggctcaccattatcctggccgtcgcggtgtgtcttttgccagtggtggcgatcagattcttgagcatgaccatctggccatccgagtcggacaagatccagaagcatcgcaagcgcctcaaggccgaagaacagtggcaacggagacagcaagtctttagacgaggggtcagcaccagacgaagcgcatatgccttctcgcaccagcggggatacgcggacttgatctcgtccggccggagcatccgcaagaaacggagcccccttgacgccatcgtcgcggatggtaccgctgagtaccggagaaccggcgacagc

SEQ ID NO: 7391 - DNA, 3753 bp, Artificial Sequence
  Description of Artificial Sequence: Synthetic coding sequence
atgtctacggagcgtgactcagagaccacatttgatgaggatagccaaccaaacgatgaagtggtgccttactcggacgacgaaacagaggatgagctggatgaccaggggtcagccgtcgagccagagcagaacagagtcaatcgggaagcagaggaaaacagggagccctttcggaaagagtgcacatggcaagttaaagcaaatgaccgcaaatatcatgaacagcctcacttcatgaataccaagtttttgtgtatcaaggaatctaaatatgcaaacaacgccattaagacctataagtataacgcgttcacatttattccaatgaacctctttgaacagtttaagcgggcggcaaacctgtatttcctggccctgctgattttacaggcggtgcctcagattagcacactggcttggtacaccaccctggttcctctgttggtggtcctgggcgttacagccataaaagatcttgtggacgacgtcgcaaggcataaaatggacaaagaaatcaataatagaacgtgcgaagtgatcaaagatggaaggtttaaggttgctaagtggaaagaaatacaggtgggggatgtcattagactaaagaaaaatgatttcgttccagcggatatcctgctactgtcttctagtgagcccaattctctgtgttatgtcgagaccgccgaactggacggcgagacaaatttgaagttcaagatgtctttggagatcaccgaccagtatttgcaacgcgaagatacactggcaacctttgacggcttcatcgaatgcgaggagccgaacaatagactggataaattcacaggcaccttgttttggcggaatacgtccttccccctggatgcagacaagatcctgctgagagggtgtgtgattcgtaacacggacttttgccacggcctagtgattttcgccggcgcagacacgaaaattatgaagaatagtgggaaaaccagattcaagagaactaaaatcgattatctgatgaattacatggtgtacacaatcttcgtggtgctgatacttctaagcgcaggtcttgccattggccacgcctactgggaagcacaggtgggaaactccagctggtacctatacgatggagaggatgacacaccctcttaccgtggctttttgatattttggggctacattatcgtgctgaacaccatggtccctatctctctgtacgttagtgtggaggttatcaggttgggtcagtcacattttattaattgggatctgcagatgtactacgctgagaaagatacgcctgccaaggctcgcacaaccacgctgaatgaacagctcggtcaaatccattatatcttctccgacaagaccggcaccctcacacagaacatcatgacgtttaagaagtgttgcatcaacggccagatctatggagatcatcgggacgcttctcagcataatcacaacaaaatcgaacaggtggatttctcatggaatacatacgcagatggtaaattggcgttctacgatcattatttaattgagcaaattcaaagcggtaaggaacctgaggtgcggcaattcttctttctgttggctgtgtgccacacagttatggtggacaggactgatgggcagcttaactaccaggccgcctctccggatgaaggcgccctcgtaaatgcggctcggaacttcgggtttgcctttctcgcacgaactcaaaacaccattacgatatccgaactggggaccgagcggacatataatgtgttggccattctggatttcaacagcgacagaaagagaatgtccatcattgtccgcacacctgaaggaaacatcaagctgtactgtaaaggggcggataccgtcatttacgagagactgcaccggatgaatccaaccaagcaggagacacaggatgctttggatatcttcgccaacgaaactctgcgtacactgtgcctctgctataaggagattgaggagaaagagtttacggagtggaacaaaaaatttatggctgctagcgtcgcctctaccaatcgcgacgaggcgctcgacaaggtctacgaggagatcgagaaagacttgatcctgctgggtgccaccgcaattgaggataaactccaggacggagtgccggaaaccataagcaagcttgcaaaggctgatatcaagatctgggtactgactggtgataaaaaggagaccgctgagaacatcggatttgcatgtgaactgctgaccgaggatacaaccatctgttacggagaggatattaactctctactacacgctagaatggaaaaccaacgcaacagggggggagtgtacgctaagttcgctccaccggtccaggagtcattttttccccccggcggaaacagggccctcattattaccggcagttggcttaacgaaatactactggagaagaagacaaagaggaacaaaattctgaagcttaaattcccaagaaccgaggaggaacggcggatgcgaacgcagagcaagaggagactggaggccaagaaggagcagaggcagaaaaacttcgtggacctcgcatgcgaatgcagcgccgtgatatgttgtagggtgactccaaagcagaaggccatggtggtcgatctcgttaaacgctacaaaaaggccattaccctggcgattggcgatggtgctaatgacgtgaatatgatcaagactgcgcacatcggtgtggggatcagcgggcaggagggaatgcaggcagtgatgtcttctgactattcgtttgctcagttcagatacctgcagagactcctgttggtgcacggcagatggtcttatatcagaatgtgtaagtttctacggtacttcttttacaagaattttgctttcacattggtccatttctggtactccttcttcaacggttatagcgctcagacggcttacgaggactggtttattaccctgtacaatgtgctgtacacctcccttcctgtcctcttgatgggcctcctggatcaagacgtgagcgataagttgagcttgagattcccaggcctgtatattgttgggcagagagacctgttgttcaattacaagaggttttttgtgagtctgctccatggagtgttgacatccatgatacttttttttatccccctgggggcatacctccagacggtaggtcaggatggggaggccccgagcgattatcagagctttgccgtcaccatcgctagcgctttggtcattacagtcaattttcagataggcctggacacctcttactggacctttgtgaacgcattttctatctttggcagcatcgccttgtatttcgggatcatgtttgatttccactccgctggtatacacgttctgtttccctctgcctttcagttcacgggaactgcatcaaacgcactgcggcaaccatatatctggcttacaattatcttggctgtcgctgtgtgcttattacccgtcgtggcaatcagatttctgagcatgacgatttggccatcagaatccgataagatccagaaacaccgcaaacgcttgaaagcagaagagcagtggcaacgtcggcagcaggtcttccgcaggggggtgagtactcgcagatctgcctatgccttttctcaccagcggggttatgcagacttgatttcaagtgggcgctccattcggaagaagaggtcacccctggatgccatagtcgctgacgggaccgccgagtaccggcgcaccggagactca

SEQ ID NO: 7392 - DNA, 3753 bp, Artificial Sequence
  Description of Artificial Sequence: Synthetic coding sequence
atgtcgaccgaaagagactcggagactacctttgacgaggattcgcagccgaacgatgaagtggtgccctacagcgacgatgaaactgaagatgaacttgatgatcaaggatccgcggtggagcccgaacaaaaccgagtgaatcgggaggctgaagagaatagagaacctttcaggaaggaatgtacctggcaagtgaaggcaaacgatcggaaataccacgaacaacctcatttcatgaacaccaagtttctttgcatcaaagaatcgaaatacgcaaataacgcaattaagacttacaaatacaatgcattcacctttattcctatgaacctgtttgagcagtttaaacgggcagccaatctttactttttggcactgttgatactgcaagcagtgccacaaatttcgacccttgcctggtacaccactttggtcccactgctggtggtgcttggcgtgactgcgattaaggaccttgtcgatgatgtggccaggcataagatggacaaggagatcaacaacagaacctgcgaagtgattaaggatggacgctttaaagtcgcgaagtggaaggaaattcaagtgggcgacgtgattcgcctgaagaagaacgattttgtgcccgccgacattcttctcctctcgagctccgagcccaatagtctgtgctacgtcgagactgcagaacttgatggagaaaccaacttgaaattcaagatgagcctcgagatcactgatcagtaccttcaacgggaagataccctcgcaactttcgacgggttcatcgagtgcgaagaacccaataacagactggacaagtttaccggaacgctgttttggagaaacacgtccttcccgctggacgcagataagattctgttgagagggtgtgtcattcggaacactgatttctgccacggattggtcatttttgcaggcgccgataccaagattatgaagaattccggtaagacccgttttaagaggaccaagattgattacctcatgaattacatggtctacaccatattcgtggttctgattcttctgtcagcaggacttgccataggacatgcttactgggaggcacaggttggaaactcctcctggtacctttacgacggtgaggatgataccccttcataccgcgggtttctgattttctggggatacattattgtgctgaacacgatggtgccaatttcgctctacgtctcagttgaagtgatacgtcttggtcagtcgcatttcatcaactgggacttgcaaatgtactacgctgagaaagacacccctgcaaaagcacgaactaccacgcttaatgaacagctgggacagattcactacattttctcagataaaacgggaactttgacccagaacattatgacttttaagaagtgttgtattaacggtcagatttacggtgaccatcgggatgcttctcaacacaaccataacaagattgaacaggttgattttagctggaacacttatgccgatgggaagctggccttctacgatcactacctgattgagcagatccagtcgggtaaggaaccggaagtaaggcagtttttcttccttctcgcggtgtgtcacaccgtgatggtggatcggaccgatggccagcttaactaccaggcggcgtcccctgatgagggtgcactcgtgaacgccgcgcgtaactttggatttgcgtttttggcccgcacccaaaatacgattactatctccgaacttggtaccgagcgcacttacaatgtgctggcgatccttgatttcaattcggatagaaagcggatgtccatcattgtgcgaacccctgaaggcaatatcaaactttattgtaagggagcggatactgtgatctacgagcggcttcatagaatgaaccctactaaacaggagacgcaagatgcactcgatatcttcgcaaatgagactctgagaaccctttgtttgtgctataaagaaattgaagaaaaagagtttactgagtggaacaaaaagtttatggcagcatctgtcgcgtcaaccaatcgcgacgaagcactggacaaggtgtacgaagaaatcgaaaaggatttgattctcctgggagcaaccgcgattgaggacaagctccaggatggagtgcccgaaactatatcgaaactggcaaaggcagatatcaagatctgggtccttacgggtgacaaaaaagaaactgcagaaaacataggttttgcatgtgagctgcttactgaagatactactatttgttatggcgaggacattaactcgctccttcatgcccgaatggagaaccagcggaatcgcgggggcgtgtacgcaaagtttgcccctcctgtgcaggagtcatttttccctccgggcggcaatcgggcactcatcattacgggttcgtggcttaacgagattctccttgagaaaaagactaaacgcaataagatcctgaaactcaagtttccacgtaccgaagaagaacgccgcatgagaacccaatccaagcgaaggcttgaagcgaagaaagaacagcgccaaaagaactttgtggacctcgcatgtgaatgtagcgccgtgatttgctgtcgagtgaccccaaaacaaaaggccatggtcgtcgacctcgtgaagagatacaaaaaggcaattactctcgcaattggggatggcgccaacgatgtgaacatgattaagaccgcgcatataggcgtcggaatatcgggtcaggaaggtatgcaagccgtgatgtcgtcagactactccttcgcccagtttagataccttcagcgtctgttgctggtgcatggccggtggagctatattcgaatgtgtaaattcctgcgttatttcttctataagaattttgcgtttactctggtgcacttttggtacagcttcttcaacggttactcggcacagaccgcctatgaggactggttcataaccctttacaacgttttgtacacgtccctgcctgtgcttctgatgggcctgcttgaccaagatgtgtcagacaagctgtcacttcggttccctggtctgtacatagtgggtcaacgggacctgctgttcaactacaagcgtttctttgtcagcctgctgcatggggtgctcacctcaatgattctgttctttataccacttggcgcttacctccaaacggtgggacaagatggagaagcgccgtcagattaccagtcctttgcagtgaccattgcgtcggcacttgtgattacggtgaattttcaaataggactggacacctcgtactggacctttgtcaatgcattttcgatatttggatcaatagcactttactttggtattatgtttgatttccattccgcgggaattcacgtgctctttcctagcgcatttcaatttactggtactgcttccaacgcacttcggcaaccatacatttggcttactatcattttggcggttgccgtttgcctcctccctgtcgtagcaatcagatttctgagcatgaccatttggccttcggaatcggataagatccagaagcatagaaagagactgaaggccgaggagcaatggcaaagaaggcaacaagttttccgacgcggtgtctcaactcggagatcagcatacgccttcagtcatcaacgcgggtatgccgatctcatctcaagcggaagatcgattcgcaagaaaagatcacctcttgatgcgattgtggccgatggaaccgccgagtataggcgtactggcgattcg

SEQ ID NO: 7393 - DNA, 3753 bp, Artificial Sequence
  Description of Artificial Sequence: Synthetic coding sequence
atgagcacagaacgggatagcgagacgactttcgatgaggactctcagccaaacgatgaggtggttccttactctgacgacgagacagaagacgaactggacgatcagggctcagccgtcgaacccgagcaaaaccgggtgaatcgagaagcagaagagaacagggagcctttccgtaaagagtgtacttggcaggtgaaagctaatgatcggaagtaccatgaacaaccccacttcatgaacaccaaatttctctgcataaaagagagcaaatatgcaaataacgccatcaagacctacaaatacaatgccttcacatttatccccatgaacttgttcgaacagttcaaaagggccgccaatttatattttctggcactgctgatcctgcaggccgtgcctcagatctctacactggcctggtatacgaccctggtgcccctcctggtggtgctaggcgtgacagctatcaaggatttggtggacgacgtggctcggcataagatggataaagaaatcaacaatcggacttgcgaggtgataaaggatgggcggtttaaagtggcgaaatggaaggagatccaggtgggtgacgttatacgcctcaagaagaatgattttgtgcctgcggatattctgctgctaagctcctcagagcccaattccctgtgctatgtggagacagccgagctcgatggtgagaccaacctgaagttcaagatgagcctcgaaataacggatcagtacctccagcgcgaagatactctggccacattcgacggattcatagaatgtgaagaaccaaataacagacttgataagtttaccggaaccttgttctggcgaaacacgagctttcctctcgacgcagataagattctgctacggggttgtgttattcgaaacaccgacttttgccatggtctggttatcttcgccggagccgataccaagataatgaaaaactcaggaaagaccagattcaagcggacaaaaatcgactacctcatgaattatatggtgtataccatctttgtagtgcttatactgctgagcgccggactggcaatcggtcatgcatactgggaagcacaggtcggtaactcaagctggtacctctacgatggcgaagatgatactccatcttatcgcggattcttaatcttttgggggtacatcatcgtgctcaataccatggtcccaatcagtttgtatgtcagtgtagaagttatcaggttgggccagtcccatttcatcaattgggacctccagatgtattacgctgaaaaggacacccctgctaaagcccggaccaccacccttaatgaacaacttggtcagattcattacatattttccgataagactggtactctaactcagaatattatgacgttcaaaaaatgctgtattaatggacagatttatggagaccaccgggatgcaagtcagcataatcacaacaaaatcgaacaggtggacttttcgtggaatacttatgcggatggtaaactcgctttttatgatcactatctgatcgaacaaatccagagtggaaaagaacccgaagtccggcagttcttttttctgctggctgtttgccacactgtgatggttgatcgaaccgatggccagctgaactatcaggccgcttcccccgatgaaggagcactcgtcaatgccgcaaggaactttggttttgcatttttagcacgaacacaaaataccatcaccatttcggaactggggaccgaaaggacttacaacgtgctggccatcttggattttaactcagatcggaagcggatgtctatcatcgtcagaacgcctgagggtaacattaaactttattgcaagggagccgatactgtgatctacgagcgactgcaccggatgaatcccacgaagcaggagacacaggatgcactcgacatcttcgccaatgagactcttagaaccctgtgcttgtgttacaaggaaattgaggagaaggagttcacggaatggaacaagaaattcatggccgctagtgtcgcatcgaccaatcgggacgaggcactggacaaagtttacgaggagattgagaaggacctgatcctcctgggcgctacagccatcgaagataaactccaggacggggtgcccgagactataagcaagctggctaaagcagatattaaaatatgggtccttacaggcgataagaaggagactgcagaaaacatcggcttcgcctgcgaattactcacagaagacaccaccatctgctatggcgaggacatcaactctctgctgcacgcccgaatggagaaccagcgcaataggggcggagtgtacgcaaagtttgccccaccagttcaggagtctttctttccacccggcggaaatcgtgccctgataataacagggtcatggctaaatgagattttgctcgagaagaagaccaaaagaaacaaaattctgaagttgaaatttcccagaaccgaggaggaaaggcgcatgcggacacagagcaaacggcgccttgaagccaagaaggagcagcgccaaaaaaacttcgtggatctggcgtgtgagtgctccgcagtcatctgttgccgcgtgacccctaagcagaaggccatggtagtcgacctggtaaagcgctataaaaaagctatcacactcgcaatcggcgacggagccaacgatgtaaatatgattaaaactgcacacataggcgtgggtataagcggccaggagggcatgcaggccgtgatgtctagtgactattctttcgcacaattcagatatttacagcgcctgttgctggtccatggtcggtggagctacatccgcatgtgcaagttcttgcgctatttcttctacaagaattttgcctttaccttggtccacttctggtattcgttcttcaatggctattcggcccaaacggcctatgaagattggtttataactctgtacaatgtgttgtacactagcttgcctgtgctgctgatggggctgttggatcaggacgtatcagacaaactttcgctcaggttccccggcctgtatatagtcggccaacgtgaccttctcttcaattacaaaaggttctttgttagcctcctacacggagtgttgaccagtatgattttgttcttcattccactgggggcgtacctacaaaccgttgggcaagacggagaagctccgtccgattatcagagctttgcggtgacaatcgcatcagccctcgtaattacagttaactttcagatagggttggacacctcctactggacttttgttaacgcttttagcatctttggctccatagccctgtactttgggattatgttcgactttcattctgccggcatccacgtgctgttcccttccgcgtttcaattcacaggcactgcgagcaacgccctgcgacaaccatacatctggctgactataattttggcagtggccgtgtgcctgctgcccgtggtagctattagatttctgagcatgaccatttggcccagtgagtctgataagatacaaaagcatagaaaaagactaaaggccgaagagcagtggcagaggaggcagcaggtcttccggaggggcgtgtccactaggaggtctgcttacgccttttctcatcagagaggctatgccgacctcatctcctccggccgatcaatccgcaaaaaacgatcccctttggatgccatcgtcgccgacggaacagccgagtatcgccggacaggtgacagc

SEQ ID NO: 7394 - DNA, 3753 bp, Artificial Sequence
  Description of Artificial Sequence: Synthetic coding sequence
atgagcaccgaaagggattccgagacaaccttcgacgaagactcccagccaaacgacgaggttgtgccttacagcgatgacgagacagaagatgagctggacgatcagggtagcgcagtcgagccggaacagaatcgcgtgaatcgtgaggccgaggagaaccgcgaacctttcagaaaagagtgcacctggcaggtgaaggctaatgatcgcaagtaccatgaacagccgcacttcatgaataccaaatttttgtgcatcaaagaatcaaaatatgcaaacaatgcaattaaaacctataaatataacgcatttacgttcataccgatgaatctgttcgagcagttcaaacgcgccgcaaacttgtactttttagctctgttgattttgcaggccgtgccgcagatcagcactctggcgtggtatacgactctggtgcctctgctggttgtcctgggtgttacggcaatcaaagaccttgtcgatgacgtcgcccgtcacaagatggacaaggagatcaataatcgcacgtgtgaggttatcaaagatggtcgctttaaagtcgccaaatggaaagagatccaggttggcgatgtcattcggctgaaaaaaaacgattttgtccctgcagacattctgctgctgagcagcagcgagccaaatagcttatgctacgtcgaaacggcggagctagacggcgaaacaaatctaaaatttaagatgagcctggagataacggaccagtatctgcagagggaggataccctggccactttcgatggtttcatcgagtgcgaggaaccaaataaccgtctggacaagttcaccggtacccttttttggcgtaataccagctttccgctggatgcagataagatattgctccgcggatgcgttattagaaatactgatttctgtcacggtctggtgatctttgccggtgcggatacgaagataatgaaaaattctggtaaaaccagattcaagcgaaccaagattgactacttgatgaactacatggtttatacaattttcgtggtgttgatcttactgagcgcgggcttggctatcggtcatgcctactgggaggcacaggtgggcaattcatcttggtacttgtatgacggtgaggacgatacccctagctatcgtggatttctgattttttggggttatatcattgtcctcaataccatggtccctattagcttgtacgttagcgtggaggtgattcgtctgggccagtcccacttcattaattgggatctgcaaatgtactatgctgagaaagataccccggcgaaggcacgcaccactacgcttaatgagcaactaggccagattcactacattttcagcgataaaaccggtacgctgacccaaaatattatgacgtttaaaaagtgctgcataaacggccagatttacggcgaccatagggatgcatctcagcacaatcacaacaagatcgagcaggtcgacttctcgtggaatacctatgcggacggaaaattagccttttatgaccattaccttatcgagcaaatccagtctggtaaagagcctgaggtgcgccaattcttttttctgctcgcagtgtgccacacagttatggtggatcgcaccgacggacaactgaactatcaggctgcttccccagatgaaggcgccctggtcaatgcggccaggaactttgggtttgcgttcctggcacgcacccaaaacaccatcactatctctgagttgggcaccgagcgcacttacaatgtgctggcgatcctggattttaacagcgaccgtaaacgtatgagcatcattgtcagaacgccagagggtaatatcaagctttattgcaagggtgccgacactgtcatctacgagcgcttgcataggatgaatccaactaagcaggagacccaagatgctctggatatctttgctaacgaaaccctcaggaccctgtgtctctgctataaagaaattgaagagaaagagttcactgagtggaacaagaagtttatggctgcaagcgtggctagtacgaatagagatgaggcgctggataaggtctatgaggaaattgaaaaggatctgatcttactgggcgcgaccgctatagaggataaactgcaagatggcgtgccagagaccattagcaagttggccaaagctgacattaagatttgggtgctgaccggtgataaaaaggagactgcggagaacattggcttcgcttgcgaactgctgactgaggacaccacgatctgctatggtgaagatattaattccctcctgcacgcacggatggagaaccagcgaaaccgtggtggtgtgtatgcgaagtttgcgcctcctgtgcaagagtcgtttttcccgccaggaggcaatcgtgccctgattatcaccggcagctggttgaacgaaattctgctcgagaagaaaactaagaggaacaaaatcctgaagcttaaattcccgcgcacggaggaggagcgccgcatgagaactcaatcaaagcgccgtctggaggccaaaaaggagcagaggcagaagaattttgtcgacctggcgtgtgaatgtagcgctgtgatctgctgccgtgtcacgccaaagcaaaaagcgatggtggttgatctggtgaagcgctacaagaaggccattacactggccataggcgatggtgccaacgacgtgaacatgatcaaaactgctcacatcggtgtcggcattagcggacaggagggtatgcaagctgtcatgagcagcgactactccttcgctcagttccgctatctgcaaagactgctgctggttcacggccgctggtcctacatccgcatgtgcaagttcctgcgctacttcttctataaaaacttcgctttcaccctggttcatttctggtactcattctttaacggctactctgcgcaaaccgcgtacgaggactggtttatcactctatataatgtgttatacacatctctgcctgtcctgcttatggggttgctggaccaggacgtctctgataagttgagtcttcgattcccaggtctgtacatcgttggccaacgcgatctcctcttcaattataagcggtttttcgtgagcttgttacacggtgtcctgacctccatgattctgttctttataccactgggtgcctacctgcagaccgtgggtcaggatggcgaagcccctagcgactatcagtcctttgcagtaacgatcgcatctgcgctggttatcaccgtcaattttcagattggactcgatactagctattggacgtttgtgaacgcattttctatttttggctctattgcgctgtactttgggatcatgttcgattttcattctgcaggcattcacgtcctgttccccagcgcatttcagttcaccggcaccgcgtcaaacgcgctccgccaaccgtacatttggctgactatcattctcgcggtcgcggtgtgtttgctgccagtggtcgctatccgctttctgtccatgaccatctggccgagcgaatcggataagatacagaagcatcgcaaacggctgaaggctgaggaacaatggcaacgtcggcaacaagtgttccggcgcggggtgtccactcgccgttcggcatacgctttcagccaccagaggggctatgcagatctgatttcgagcggccggagcattcgcaagaaacggtcacctttggacgcaattgtggctgatggtacggcggagtataggcgcactggcgattct

SEQ ID NO: 7395 - DNA, 3753 bp, Artificial Sequence
  Description of Artificial Sequence: Synthetic coding sequence
atgtcaactgagcgggactccgaaacgacgtttgatgaggacagtcagccaaacgacgaagtggtgccgtactctgatgacgaaaccgaagatgagctggatgaccagggaagcgccgtggagccggagcagaatcgggtcaatcgggaggcggaggagaacagagaaccgttcagaaaggagtgcacctggcaggtgaaggcaaacgaccgcaaataccacgaacagccacactttatgaacactaagttcctgtgcatcaaagagtcgaagtacgcgaacaatgccatcaaaacttacaagtataacgccttcactttcatcccgatgaatctctttgaacagttcaagcgcgcagcgaacttgtactttctcgcgctcctgatactgcaggcggtgccgcagatctcaaccctcgcttggtacaccactctggtgccattgctcgtggtgttgggagtgaccgcaatcaaggacctggtcgacgacgtcgcccgccacaagatggataaggagatcaataaccgcacttgtgaggtcattaaggacggccgtttcaaggtcgccaagtggaaggagatccaggtcggagacgtgatacgcttgaagaagaacgatttcgtccctgcagacatccttctcttgagctcgtcagaaccaaatagtctgtgttacgtggaaaccgcggaactcgatggggaaactaacttgaagtttaagatgagccttgaaattactgatcaatacctgcaacgcgaggacactctcgccacctttgacggattcattgagtgcgaagaacctaataaccgcctcgataagttcacgggaactctgttttggcggaataccagctttccgctcgacgcggataagatccttctgagaggatgtgtgatccgcaatactgacttctgccacggactggtgatctttgccggcgctgatactaagatcatgaagaattcaggaaagaccaggttcaaacgcacgaagatagactacctgatgaactacatggtgtacactatcttcgtggtcctgattctgctttccgctgggctggccatcggccatgcctattgggaggcccaagtcggaaactcgtcctggtacctctacgatggtgaggacgatactccgtcgtatagaggattcctcatcttctggggctacattatcgtgctgaataccatggtcccgatctcgttgtacgtcagcgtcgaagtgatccgcctcggccagtcgcatttcattaactgggacttgcagatgtactacgctgaaaaagacaccccagcgaaggcacggaccactaccctgaacgaacagctcggtcaaatccactacatcttctccgataaaaccggaactcttacccagaatatcatgacgttcaaaaagtgttgtatcaacggacaaatctacggagatcatagggatgccagtcagcataatcacaacaaaatcgagcaggtggatttctcatggaacacctacgctgatggcaagctggccttctacgaccactacttgatagaacagatccaatccggaaaagaaccggaagtgagacaattcttcttcctcctggctgtgtgccataccgtgatggtggatcggaccgacggacagctgaactaccaagccgccagcccggacgagggagcgcttgtgaatgctgccaggaacttcggattcgccttcttggcgaggacccaaaataccatcactatctcggaactcggcaccgaacggacctacaatgttttggccattctcgacttcaattcggaccgcaagcggatgtccatcatcgtgcgcacgcctgaaggtaacatcaagctgtactgcaaaggcgcggataccgtcatctacgaaagacttcacagaatgaatccgactaagcaggaaactcaggatgcgctcgacatcttcgccaatgaaaccctccggaccttgtgcctgtgctacaaggagatcgaagaaaaagaattcaccgagtggaacaaaaagttcatggcagcttcagtggcgagcactaacagagatgaggctctggacaaggtctacgaggaaattgaaaaggacctcatcttgttgggagcaaccgctatcgaggacaagctgcaagacggagtgccggaaactatctctaaacttgccaaggccgacatcaagatctgggtcctgaccggcgataagaaggagactgcagagaatattggatttgcctgcgaactgctcaccgaggacactactatctgctacggtgaggatatcaactcactcctgcatgcccggatggaaaatcaacgcaaccgcggaggcgtgtacgcaaaattcgcacctccggtccaggagtccttcttccccccgggtggaaatcgggcactgatcatcaccggatcctggctgaacgaaatcctcctcgaaaagaaaaccaagagaaacaagattctgaaactgaagtttccacggaccgaagaagagcggagaatgagaactcagtccaagcggagactcgaagcaaagaaggagcagagacagaagaacttcgtggatctggcgtgcgagtgttcggctgtgatctgttgtcgggtcactccgaagcagaaagcaatggtggtggatctcgtgaagcgctacaagaaggctattactcttgcgatcggagatggtgccaacgacgtcaacatgattaagactgcccacataggagtggggatctccggacaagagggtatgcaagcggtgatgtcgagcgattatagcttcgcccaattccggtatctgcaaagactgctcctcgtgcatggacgctggtcgtacatcagaatgtgcaagtttctcaggtacttcttctataagaattttgccttcactttggtgcatttctggtattcattctttaacgggtacagcgctcagaccgcctacgaggactggttcattacgctgtacaacgtgctgtacacgtcactgccggtactgctcatgggtttgctggatcaagacgtgtccgacaagctctccttgcgctttccgggactctacatcgtgggccaaagagatcttctgtttaactacaaacggttcttcgtgtcgctgcttcatggcgtgcttacttcgatgattctgttcttcatcccactgggagcctatctgcaaaccgtggggcaggacggcgaggccccatccgactaccagtcattcgcggtgaccatcgcctccgcgctggtgatcactgtcaattttcagatcggtttggacacgtcgtactggacctttgtgaacgccttctcaattttcggttccattgcgctgtacttcggcatcatgttcgacttccatagcgccggaattcacgtgctgttcccttccgctttccaattcaccggtactgcaagcaacgcgctccgacagccttacatttggcttaccattatcctggccgtcgccgtctgccttctgccggtggtcgctatccgctttttgtcgatgactatctggccaagcgaatccgataagatccagaagcaccggaaacggctcaaggccgaagagcagtggcagaggagacaacaggtttttagaaggggcgtctcgactcgccgctcggcgtacgcgttctcacatcagcgcggatacgccgacctgatctcgtcaggtcggtccatccgcaaaaagcgctcgccgctcgacgccatcgtggcggacggaactgctgagtaccgacgtaccggggactcg

SEQ ID NO: 7396 - DNA, 3753 bp, Artificial Sequence
  Description of Artificial Sequence: Synthetic coding sequence
atgtctacagagcgtgactctgaaacaacttttgatgaagattctcaacctaacgatgaagtggtaccttattctgatgatgaaacagaagatgaattggatgatcaaggaagcgccgttgagcctgaacaaaacagggttaatcgggaggctgaagagaaccgtgaaccatttcgcaaggaatgcacatggcaggtaaaggcgaatgacaggaagtatcatgagcaacctcattttatgaatactaagttcctgtgcattaaggagtcaaagtacgcaaacaacgcaattaaaacctataagtataatgcttttacttttatccctatgaatcttttcgagcaatttaagagggctgccaatctgtacttcctggcactcttaatccttcaggcagttccacagataagcactctcgcttggtacactacactcgttccactcttggttgttcttggcgttaccgccattaaagatctagtggatgatgttgcacgtcataaaatggacaaagagattaacaaccgtacatgtgaagttattaaggatggcagatttaaagtcgcgaaatggaaggagattcaagtaggtgatgtaattcgtctaaaaaaaaacgatttcgtacctgctgatattttgttactgtcatcatccgagccaaactctttatgctatgtcgaaactgctgaactcgatggggagactaaccttaagttcaaaatgtccctagaaattacagaccaatacctgcagagggaagatactctcgcaactttcgacggtttcattgaatgtgaagagccaaacaaccgattagacaagttcaccgggactctgttttggaggaacacttcatttcctttggatgctgataaaattctgctccgaggatgtgttatacgcaatactgacttctgccacggtttggttatttttgcaggtgcggatacaaaaatcatgaaaaatagtggtaaaacaagattcaagaggaccaaaattgattatttgatgaattatatggtctatacaatattcgtggttcttatattgctatcagcaggtcttgctatcggacatgcttactgggaagcacaagttggaaattctagctggtacttgtacgacggtgaagatgacaccccgagctatcgagggtttctcatcttttggggatatataattgtgcttaatacaatggttccgatatcattgtatgtgtctgttgaggttataagacttggccagtctcatttcattaattgggatcttcaaatgtattatgctgagaaggatacaccagctaaagctcgtactacaactcttaacgagcaactgggccaaattcactacatcttctccgataagacaggaactttgacccaaaatattatgactttcaaaaagtgctgtataaatggtcagatatatggtgatcatagagatgcatcacagcacaaccataacaagatcgaacaggttgacttctcttggaacacgtacgcagacggtaaactcgctttctatgatcattacttgattgagcagatccaatcaggtaaggaaccggaggtgcgtcaatttttcttcttgcttgcagtttgtcataccgttatggtcgacaggaccgacggtcaactgaactatcaagccgcatcacctgatgagggagcattggtaaatgctgctaggaattttggattcgcttttcttgcccgaacccaaaatacaattacaatttccgaacttggtactgagagaacttataatgttttagctatcttagattttaacagcgacaggaagaggatgtccatcatcgttcggacgcctgagggaaacattaaactttactgcaaaggagcagatacagtaatctacgagaggcttcaccgtatgaatcccactaaacaggaaacacaggatgctcttgatatcttcgcaaatgagactttacgcactctgtgcctatgctacaaggagatcgaggagaaggaattcacagaatggaataaaaaattcatggcagcaagcgtagcttccaccaatagagatgaagctctggataaagtttacgaagaaatagagaaagatttgattttgctcggcgctactgccatcgaggacaaattgcaagatggtgtacctgagactatttccaaactcgcaaaagcagatatcaaaatttgggtacttactggggataaaaaggaaacagcagagaacatcggattcgcatgtgaattacttacggaggacaccactatttgttacggtgaagatattaacagtttgctgcatgcacgtatggagaatcagaggaatcgtggaggtgtgtatgccaagtttgctccacctgtgcaagagtcattcttccctcctggtggtaatagggcgctaataattactggaagctggcttaacgagatcctgttggagaaaaagacaaagcggaacaagattcttaagctaaagtttcctcgtacagaagaggaacgacgtatgcgtacacaatccaaaaggaggctggaggctaaaaaggagcagcgacagaagaactttgtcgatctcgcttgcgaatgtagcgctgtgatttgttgccgagtgactcctaagcagaaagcgatggtcgtggatttagtcaagaggtacaagaaggctatcacattggcaattggcgatggagctaacgatgtcaatatgataaaaacagcccatatcggtgtcggtatatctggtcaagaaggaatgcaagctgtgatgtcatcagattattcattcgcacagttcagatacttgcagaggttgctgctcgttcatggtcgttggagctacattcgtatgtgtaaattccttcgttactttttctacaagaattttgcattcactctggttcacttttggtactcctttttcaacggctattccgcacaaacagcctatgaagattggtttataacgctttacaacgtcttatacaccagcttaccggttcttcttatgggccttttggatcaggatgtaagtgacaagctttcacttagatttccagggttgtatattgttgggcaaagggatctgctttttaactacaagcgattcttcgtttccctattacacggtgtgcttacttcaatgatcctgttttttattccgctgggagcctatttgcaaacagtaggccaggacggagaagccccctccgattaccagtcattcgctgtaactattgcttcagcattggtgataacagttaactttcagatcgggcttgacacctcctactggactttcgtgaatgctttttccattttcggttccatagctctctattttgggatcatgttcgactttcattcagcagggatacatgtgttgttcccaagtgccttccaatttaccggtactgcctcaaatgcccttagacaaccttatatctggttgacaataattctggcagtggctgtctgtttgcttcctgtggtcgctattcgtttcttgtctatgaccatatggccctctgaatcggacaagatccaaaagcataggaaaagacttaaggccgaggagcagtggcaacgaaggcaacaagtgttccgtaggggggtttcaaccagaagaagcgcatatgcgttttctcaccagcgtggctatgccgatctcatctccagtggtcgttctataaggaaaaagcgttcaccccttgatgctattgtcgccgatggaactgcagagtacagacggacaggagattcc

SEQ ID NO: 7397 - DNA, 3753 bp, Artificial Sequence
  Description of Artificial Sequence: Synthetic coding sequence
atgtcaacagaaagagactctgagaccacatttgatgaggactcacagccaaatgacgaggtagtgccatactcggacgatgaaaccgaggacgaactggacgaccaggggtcggcagtggaaccggagcagaaccgcgtcaatcgggaggctgaagagaatcgcgaaccgttccgtaaagagtgtacctggcaagtgaaggctaatgacagaaagtatcacgaacaaccgcattttatgaacacaaagttcttatgcattaaggagtcgaagtatgcaaacaatgctatcaaaacatacaaatacaatgcatttacattcatccctatgaatttgttcgagcaattcaagcgagcagcgaacctttacttcctggccctccttatcctgcaggcagtccctcaaatctccactttggcttggtacacaaccctcgtgcctctgctggtagttcttggagtgacagctataaaagacctcgtggacgacgtggcccgacacaagatggataaagaaataaataatcgcacctgtgaagttatcaaggacggtaggttcaaagtggcaaagtggaaagagattcaggtgggagatgtgatccggctgaagaaaaatgattttgtgccagccgatatactgctcttgtccagcagtgagcccaactcgctgtgctatgtggagaccgcagaactggatggtgagacgaacctcaagttcaagatgtcattagaaataacagatcaatatttgcagcgagaggacacactggccacgtttgacgggtttatagaatgcgaggagccgaacaaccgactggacaaattcaccggcacgctcttttggcgtaacacttcatttcctcttgatgctgataaaatcctgctcagaggctgcgtgattaggaacacagacttctgtcacggactggtcatctttgcgggggctgatacaaagattatgaagaatagtggcaagactagatttaaacgcacgaaaatcgattacctaatgaactacatggtgtacaccatcttcgttgttttgattctgctttctgccggcctggccataggacatgcatattgggaagcgcaggttggcaactcatcatggtacctgtacgacggggaggacgataccccctcatatagaggattcctgatcttttggggctacattatcgtactgaacacaatggtgcctatctcattgtacgtgtcagtggaagttatcaggctgggccagagtcatttcatcaactgggacctccagatgtattatgccgagaaagatactccagccaaggcccggacgaccaccttgaatgaacagctggggcagattcattacatcttttccgacaaaactggcacgctgacacagaacataatgacattcaaaaagtgctgcatcaacgggcaaatctacggcgaccatcgcgatgcctcacagcataatcataacaaaatcgagcaggtggattttagttggaacacatatgctgatggcaagctggcgttctacgatcactaccttattgaacagatccagagcggtaaagaaccagaggttcggcagttcttttttctgctggcggtttgtcacactgtgatggtggatcgtacggacggccaacttaactaccaggcggcctccccggatgagggagctctggtgaatgcagctcggaacttcggctttgcgtttttggcacgcactcagaatactattacaatcagcgagctcggcactgagcggacttataacgttctggccatcttggattttaattctgatcgcaagagaatgtctataattgtccgtacccccgaggggaatatcaagttgtactgcaagggcgctgataccgtgatctacgaacgcttacacagaatgaaccccacaaaacaggagacacaagacgccttggacatctttgcaaatgaaaccctgagaaccctttgcctctgctacaaagaaatcgaggagaaggaatttaccgaatggaacaagaagttcatggctgcatcagtcgcttccactaatcgggacgaagccctcgacaaggtgtacgaggaaatcgagaaggacctgatactgctgggagcaacagctattgaggataaactgcaggacggggtgcccgaaactatcagtaagttggccaaagccgacatcaagatatgggtactcactggtgacaaaaaagagacagcagagaacatcggatttgcctgtgagctcctgactgaggacactaccatttgttacggagaagatataaactctcttctccatgctcgaatggagaaccaaaggaaccgcggcggagtgtatgcgaagttcgccccccctgttcaggagtccttcttcccccccggagggaaccgtgctctgattataaccgggtcctggttgaacgagatcctgcttgagaagaaaacaaaacgaaataagattcttaagttaaagttccctaggactgaagaggagcggagaatgcgtactcaatctaagcggcgactagaagcaaagaaggaacaacggcagaaaaactttgtcgacctggcgtgtgaatgttctgcggtcatatgctgccgagtgacacccaaacagaaagcgatggtcgtggacctcgtgaaaaggtataaaaaagctatcacattagccatcggcgatggggctaatgacgtaaacatgatcaagactgctcacatcggagtgggcatatccggacaggaggggatgcaggccgtaatgtcttctgactacagcttcgctcagttcagatacctccagcgcctcctgctcgtccacggacggtggtcatacatacggatgtgcaagtttctaagatacttcttctataagaacttcgccttcacgctggttcacttttggtactcctttttcaacgggtatagcgcccagaccgcatacgaagattggtttattacgctttataatgtcttgtacactagcttaccggttctcctgatgggtctgctcgaccaagatgtgagcgataaactgtctttgagattcccgggactgtatatcgtcggacaaagggacctactgttcaattataagcggttctttgtctccctgcttcatggtgtcctgaccagcatgatactgttctttatcccgctgggtgcctatctgcagacagtcgggcaggacggggaggcgcccagcgattatcaaagcttcgccgtcaccattgcttccgccttagtgataacggtgaatttccagattggactggatactagctactggacttttgtgaatgctttttccatctttggatcgatcgcattgtactttggtataatgtttgatttccatagcgccggaatccacgtgctgtttccctctgcctttcagttcaccggaaccgcaagtaatgccctgcgtcagccatatatctggctaactatcattctggcagtagcagtctgtctcttgccagtcgttgctattcggttcttgagcatgacaatatggccgtcagagtccgataagatccagaaacacaggaagcggctaaaagctgaggagcagtggcagcggcgtcaacaggtgtttagaaggggggtcagcacccggcgcagcgcgtacgctttcagccaccagaggggttatgcagatctgatctcgtccggccgctcaatccggaaaaagaggtcccctcttgacgctatcgtggctgacggcactgcggaataccggcgcactggggacagc

SEQ ID NO: 7398 - DNA, 3753 bp, Artificial Sequence
  Description of Artificial Sequence: Synthetic coding sequence
atgtccacggagcgcgatagcgaaactaccttcgatgaagattcgcaacctaacgatgaagtggtcccatactcggacgatgaaaccgaggatgaactggacgaccagggatcggccgtcgagccagaacaaaaccgggtcaatcgggaagctgaagaaaatagggagccgttcagaaaggaatgtacctggcaggtaaaagctaacgacaggaaataccacgagcagccgcatttcatgaacactaagtttctgtgtatcaaggagagcaagtacgcgaacaacgcgataaagacttacaagtacaacgccttcactttcatccctatgaacctcttcgaacaattcaagcgggcagccaacctgtacttcctggcgttgctcatccttcaagcggtgccacaaatcagcacgcttgcctggtacactaccctggtgccgctcttggtcgtgctgggggtgacggcaataaaggatctcgtcgacgatgtggcacggcacaagatggataaagagatcaataacaggacttgcgaagtgatcaaggatggccggtttaaggtcgctaaatggaaggaaatccaggtcggtgatgtgatccggctgaagaaaaatgatttcgttccagcagatatcctgcttctgtcgtcgtccgaacctaattcactgtgctacgtggaaacggcggagcttgacggagagactaacttgaagtttaagatgtcactcgagatcacggaccagtacctgcagcgggaggacactttggctacctttgacggcttcatcgagtgtgaggaacccaataaccggctggacaagttcaccggaaccctcttctggagaaacacctccttccccctggacgcggataagatcctccttcggggatgcgtgatccggaacactgacttctgtcacggacttgtgatcttcgccggtgcagacaccaagatcatgaagaactccggcaaaaccagattcaaaagaactaagatcgactaccttatgaattacatggtatacaccatattcgtcgtccttatcctcctgtctgctggactcgccattgggcatgcgtattgggaggcacaagtgggtaactcgtcttggtatttgtacgacggagaggatgacaccccgtcctaccgtggatttctgatcttctggggctacatcatcgtcctcaacacgatggtgcctattagcctttacgttagcgtggaagtgatccgcctggggcaatcacatttcattaactgggacctgcagatgtattacgcggaaaaggacaccccagccaaggcgagaactactactctgaatgagcaactcggccaaatccactacatattcagtgacaaaactgggacgctgacccagaatatcatgactttcaaaaagtgctgcattaatggacagatctatggtgatcatagggacgctagccaacataaccacaacaaaattgaacaggtggacttctcctggaatacttacgctgatgggaagctggcattctacgaccactacctgatcgagcagatccaatcgggtaaggagccggaagtgcgccagtttttctttctcctggcagtgtgccacaccgtcatggtcgaccgcacggatggtcagctcaactaccaggcggcctcgccggatgaaggagccttggtgaacgctgcccggaacttcgggtttgctttcctcgctcggacccagaacaccatcactatatcggagctcggaactgagaggacctacaatgtgttggcaatcctggatttcaattctgaccgcaagcggatgtcgatcattgttcgcacccccgagggaaacattaagctctactgcaagggagccgacacggtgatttacgagcgcttgcatcgcatgaatcctactaagcaggaaacccaggacgcactggacatttttgctaacgagactctcagaaccctttgcctttgctacaaagagatcgaagaaaaagaattcaccgagtggaacaagaaattcatggcggcctcggtggcatcgaccaacagagacgaagcgcttgacaaagtctacgaggaaatcgaaaaggacctgatcctgctgggggcgactgccatcgaagataaactccaggacggagtgccggaaactatttccaaactggccaaggctgatatcaagatctgggtgcttactggtgacaagaaggagactgcggaaaacatcggattcgcttgtgaactgctgaccgaggataccactatctgctacggagaagatatcaactcgctgttgcacgcccgcatggaaaaccagcggaaccggggaggagtgtacgcgaagttcgcccctccagtgcaagaatctttcttcccaccgggaggaaatcgcgctctcatcatcaccggcagctggctgaatgagatcttgctggagaagaaaaccaaaagaaataagatcctgaagttgaagttccctcgaactgaagaagagcggcggatgaggacccagagcaagcgccgcctggaggcaaagaaggaacagcggcaaaagaacttcgtggatctggcatgtgaatgcagcgccgtgatttgctgcagggtgaccccgaagcagaaagccatggtggtcgatctggtcaaaagatacaaaaaggccatcaccctggctattggcgacggagcaaatgacgtcaacatgatcaagaccgcccatattggtgtgggcatctcaggacaagaagggatgcaggcagtgatgtcctccgactattcgttcgcccagttcaggtacctgcaacgcctcctcctggtgcacgggagatggtcatacattagaatgtgcaagtttctcagatactttttctacaagaacttcgcgttcacgctggtccatttttggtacagcttcttcaatggatactccgcccagaccgcctacgaggactggttcatcaccctttacaacgtgctgtacacttcgttgccagtgctcctgatgggcctcttggatcaggatgtaagcgacaagttgtctctgcgctttccgggtttgtacattgtgggtcagcgggacctgctcttcaattacaagcggttcttcgtgagcctgctgcacggtgtgctgacttcaatgatcctgttcttcattccgctcggagcatacctgcagacggttggccaagacggagaagccccatccgattaccagagcttcgccgttacgatcgcatccgccctggtcatcaccgtcaattttcaaatcggtttggacacttcatactggactttcgtgaacgccttttcaatcttcggaagcattgcactgtactttggaatcatgtttgacttccatagcgctggcatccacgtgctgttcccgtccgcattccagtttactggaaccgcctcaaatgctctgaggcaaccctacatctggctgactataatcttggcagtggccgtctgcttgctgccggtcgtggcaatccgcttcctgtcaatgactatctggccgagcgagagcgacaagatccagaaacacaggaaaagactgaaagccgaagagcaatggcagcgccgtcaacaagtgtttcgcagaggggtgtcaactcgccgcagcgcgtacgccttttcccaccagcgcggttatgccgatctgatctcctccggacggtccatccgcaagaaacggtcccctcttgatgctatcgtggcggatggaaccgcggaatatcgacggaccggagactcc

SEQ ID NO: 7399 - DNA, 4395 bp, Artificial Sequence
  Description of Artificial Sequence: Synthetic coding sequence
atgcctgaacaagaacgacaaattaccgccagagagggcgcgtcacggaagatcctctctaagctttccctcccgacgagggcctgggaaccggccatgaaaaagtccttcgccttcgacaacgtcggctatgaaggagggctcgacggactgggaccctcctcacaagtcgccaccagtaccgtccgtattctcggaatgacatgtcagtcttgtgtcaagagtatcgaggatcggatctcaaacctgaaggggattatctccatgaaagtatccctggaacagggttccgccacagtgaagtatgtgccttcagtggtttgcctacagcaggtatgtcatcagatcggggatatgggctttgaagcatccatcgccgagggcaaggcggcatcgtggccgagccgctcactcccagcccaggaggctgtggtgaaacttcgcgtggaggggatgacctgccaaagctgtgtttcttctatcgagggaaaggtgcgaaagttacagggagtcgtccgtgtgaaggtgtcactgagcaatcaggaggctgtgatcacataccagccctacctcatccagccagaagacctgcgggaccacgttaatgacatggggtttgaggccgccataaagtcaaaggtggcaccactgtcacttggaccaatcgacatcgaacgcctgcaaagtaccaaccctaaacgacctctctcctcggccaatcagaatttcaataattcggagaccctgggacatcaggggagccatgtggtgacactacaactgcggatcgacgggatgcactgcaagagttgtgtactcaatatcgaggaaaacatagggcagctgctgggagtgcagagcatccaagtatctctggaaaacaaaacagcccaggtaaaatatgaccccagttgcacaagccccgtggcgttgcagagggctattgaggcacttcccccgggcaatttcaaggtctccttaccagacggcgccgaaggatcagggactgatcacagatccagtagtagtcatagccctggtagccccccacgcaatcaggtccaaggcacgtgctctacgaccttgatcgctattgccggaatgacctgtgcaagctgtgtacacagtattgaagggatgatctcccagcttgaaggagttcagcaaatctcggtttctcttgccgaaggcactgctacggtgctgtataatcccagcgtgatatctcccgaagagttgcgagccgctatcgaggacatggggttcgaagctagcgttgtcagcgaaagctgtagtactaaccccctgggcaaccacagcgccggaaatagtatggtgcagacgaccgatggtacaccaacctcagtgcaggaagtggctccccacactggtcggctgccggctaatcacgctcctgatattctggccaagtcccctcagagcaccagagccgtggctccccagaagtgtttcctccagatcaaaggcatgacgtgtgcgtcctgcgtctcaaatattgaaagaaatttgcaaaaagaggccggtgtgctgtctgtgctggtggctcttatggctgggaaagctgagattaaatacgatcctgaggtcatccagcctttggagattgctcagtttattcaggacttaggattcgaggcggcagtgatggaagattacgctgggagcgacgggaatatagaacttactattactgggatgacgtgtgcaagctgtgttcacaacattgagagtaagctgacccggaccaacggcatcacctatgcttccgtagccttggccaccagcaaagccctggttaagtttgacccggaaattatcggacccagagatatcatcaaaattatcgaggagatcggattccatgctagcctggctcagcggaacccgaacgcacaccatcttgaccacaagatggaaattaagcagtggaagaaatcatttttatgttcactggttttcgggattccagttatggcactcatgatctacatgttgataccttcaaatgagccccatcaaagtatggtccttgaccacaacatcatacctggtctgagcatcctcaacttgatttttttcattctttgtacctttgtgcagctcttaggcggatggtacttctatgtccaagcctacaaatcactgaggcacagatcagctaacatggatgtcctgattgtcctcgccacgagtatcgcatacgtgtacagcctggtgattcttgttgttgctgtcgcggaaaaggcagagagatcacccgttaccttctttgacacacctccgatgttgttcgtgttcatcgcattgggaagatggttagagcatctggccaagagtaaaacctccgaggccctagctaaactcatgagtctgcaggcgacggaggctactgttgtgaccttgggcgaagataacctgattattcgagaggaacaggtgcccatggagctggtgcagcgaggcgatatcgtgaaagtcgtcccagggggcaaattcccggttgatggaaaagtgttggagggaaacacaatggctgatgagtctctgattaccggcgaggctatgccagttacaaagaaaccgggtagtacggttattgctggatcgatcaacgcgcatggctccgtgctgatcaaggctacacacgttgggaatgacacaacattggcgcagatagtgaaactcgtggaagaagcacagatgagtaaggcacccattcagcagttggccgaccgcttttccggctatttcgtcccctttatcatcatcatgagtactctcaccctagtagtgtggatcgtgattggatttatcgactttggcgtcgtgcagcgatacttcccgaacccgaacaagcacatttcacagactgaagtaatcatcagatttgcttttcagaccagcatcacggtgctgtgcattgcttgcccatgtagtctgggccttgcgacccccactgctgtgatggtcggcaccggtgttgccgcccagaacggtatcttgatcaaaggggggaagcctctcgaaatggctcataaaattaaaaccgtgatgttcgataaaactgggaccataacccatggcgttccccgggtaatgcgggtcctcctgctcggggatgtggccacactgcccctgaggaaagtactggcggtggttgggacagccgaggcctcgagcgagcatcccctcggcgtcgccgtcactaaatactgcaaagaagagctgggtacggagacactgggttactgtaccgattttcaagctgtcccaggctgcgggataggatgtaaggtgagcaacgtggaggggatccttgcgcacagtgagcgcccactgtccgcacccgcctcacatttaaacgaggccggcagtctgcccgcagaaaaagatgcagtgcctcaaacttttagcgtgttgattggtaacagagagtggctgcgccggaatggattaactattagcagcgacgttagtgatgctatgactgaccatgagatgaaaggacagaccgccattttagttgcaatcgatggcgtgctgtgtggcatgatcgcgattgctgacgccgtcaagcaggaggccgcactggccgtgcacaccctgcagtcaatgggggtggatgtggtcctgattactggcgacaacaggaagacggcccgcgccatcgccactcaagttggaatcaataaggtctttgccgaagtgctgccatctcacaaagtggcgaaagtccaggagctgcagaataaaggcaagaaggtggctatggtcggtgacggtgtgaacgacagccctgccctggcccaggcagacatgggcgtcgccattggtacaggaacggatgttgcaatcgaggccgctgatgtagtgctgatacggaatgacttgttggacgtggtggcttctatccacctcagtaagcggacggtgcgccgcatcaggatcaatctggtcctggcgttgatttataatctggttgggatccctatcgccgcaggtgtgtttatgcccataggcatagtcctccagccatggatgggatctgctgcaatggccgccagctcagtgtctgtggttctttcatctctgcagcttaagtgctacaagaagccagacttggagaggtatgaagcacaggcccacggtcatatgaagcctctgactgccagccaggtgagcgtgcatatcggtatggacgaccgctggcgcgatagtcctcgcgcgacaccctgggaccaggttagttatgtcagccaagtcagcctctcttcactgactagcgacaagccttcaagacacagcgccgcagccgacgacgacggcgacaagtggtcactgctattgaacgggcgcgacgaggagcagtacatt

SEQ ID NO: 7400 - DNA, 4395 bp, Artificial Sequence
  Description of Artificial Sequence: Synthetic coding sequence
atgccagaacaggaaaggcagatcaccgcgagagagggggccagccggaagatcctttccaagctgtcgcttccgacccgcgcatgggaaccggcgatgaagaagtcatttgctttcgataacgtggggtacgaaggaggactggacggccttggaccctcttcacaagtcgctacctccactgtgcgcattctcggaatgacgtgtcaatcgtgcgtgaagtcgattgaagatagaatttcaaaccttaaaggcatcatatctatgaaagtgtcgcttgagcagggctcagccactgtgaaatacgttccgtctgtggtgtgcctgcaacaagtgtgccatcaaatcggagacatgggcttcgaggcctccattgcggaagggaaggctgcttcatggccgtcgcgcagcctgcctgcccaagaagctgtggtgaagctgcgcgtggaagggatgacttgtcaatcctgcgtgtcgtctatcgagggaaaggtgaggaagctgcaaggggtcgtgagagtcaaggtgtccctgagcaaccaggaggccgtcatcacttaccaaccttacttgatccagccggaggacctgcgggaccacgtcaatgacatgggattcgaggcggcgatcaaatccaaggtggcaccactctccctgggaccgatcgacatcgagcgccttcagtcgaccaaccctaaacggccgttgtcgtctgctaaccaaaactttaacaatagcgaaacgctgggacaccaaggatcacacgttgtgaccctccagctcagaatcgacggcatgcattgcaagagctgtgtgcttaacattgaagaaaacatcggtcaattgctgggagtccagtccatccaggtcagtctggagaataagacggctcaggtcaagtacgacccatcatgcacctcccctgtcgcgctgcaaagagcaatcgaggctctccccccgggtaatttcaaagtgtccttgccagatggcgctgaaggctccggaaccgatcatcggtcaagctcctcacactcgcccggatcgccgccaagaaaccaagtgcagggaacctgctcgaccaccctgattgctattgcgggaatgacgtgcgcctcatgcgttcactccatcgaagggatgatctcacagctggaaggggtccagcagatcagcgtgtcactggccgagggcactgcgaccgtgctgtataacccgtcggtcatctcacctgaagaacttcgggctgctatcgaggacatgggatttgaagcatcagttgtctcagaatcctgctcaactaacccactgggaaaccattcagcagggaattccatggtccagactacggacggaaccccgacctcagtgcaggaagtggccccgcataccggcagactgcccgctaaccatgcaccggacatcctggcaaagtcaccacagtcaactagagcggtggcgccgcagaagtgttttctccaaatcaaaggcatgacttgcgcaagctgcgtgtccaatatcgagcgcaacctgcagaaggaggcgggagtgctgtcggtgctcgtggccctgatggcgggcaaggccgagatcaaatacgacccggaggtgatccagcccttggaaatcgcgcagttcattcaggaccttgggttcgaagcggctgtgatggaggactacgccggctccgacggaaacatcgaactgactatcacggggatgacctgcgcgtcgtgcgtgcataacattgaatccaagctcaccagaactaacggaatcacctacgcctccgtggcgcttgccacttcaaaggccctggtgaagttcgacccggagatcataggcccccgcgacatcatcaagattatcgaagagattggcttccacgcttctttggcgcagcgcaaccctaacgcgcatcacctggaccataagatggaaatcaagcagtggaagaaatcgttcctctgctcgcttgtgttcggaatcccggtgatggcattgatgatctacatgctgatcccgtctaatgagccgcatcaaagcatggttctcgaccacaatatcatccctgggctctcgatcctgaatctcatcttcttcatcctgtgcacgttcgtgcagcttctgggaggatggtacttctacgtgcaggcttacaaaagcctccggcacagatcggcaaatatggatgtgctgatagtgctggccacttcgattgcctatgtgtattcactggtgatcctggtcgtggcggtggcagagaaggcagagaggagcccggtgacgttcttcgacaccccgccaatgctgtttgttttcatcgctctgggacggtggttggaacatctggccaagtccaagacttccgaagctctggcaaagctcatgtcactccaggccaccgaagcgaccgtggtcactctcggagaagataacctcattatccgagaagaacaagtgcctatggagttggtccagagaggggacattgtgaaggtggtgccgggcgggaagtttccggtggatgggaaggtgctggagggcaacaccatggcggacgaatctctgatcacgggagaagcaatgcctgtgactaagaagccagggtcgaccgtcatcgccggaagcatcaacgcacacggttcggtcctcattaaggcaacccacgtcggaaacgacaccactttggcacagattgtgaagctcgtggaagaagcccagatgtcgaaggccccaatccagcagctggccgatcggttctccggatacttcgtgccgtttatcatcataatgtcaaccctcactctggtcgtgtggatcgtcatcggttttatcgacttcggagtggtgcagcggtacttcccgaatcccaataagcacatctcccagactgaagtgattattcgctttgccttccaaactagcattaccgtcctgtgcatcgcctgcccatgctcgctgggattggctacgccgaccgccgtcatggtgggcactggtgtggccgcccagaacggcatcctcattaaaggaggcaagccactggaaatggcccacaaaatcaagactgtgatgtttgataaaaccgggacgatcacccacggagtcccacgcgtgatgcgcgtgctgctcctcggagatgtggctactctccctctccggaaggtgctcgctgtggtcggcacggcggaagccagcagcgaacatccgctgggagtggctgtcactaaatactgcaaagaagagctggggaccgaaaccctggggtactgcaccgacttccaagcggtgccgggctgcggaatcggatgcaaggtgtccaacgtggaaggaattctggcacattcagaacgcccgctgtcggcccccgcctcgcacctgaatgaggcaggatccctcccggccgagaaggatgccgtgccgcagactttctcagtactcatcggcaacagggaatggctccgccggaatggactcactatctcaagcgacgtgtcggacgcgatgaccgaccatgaaatgaagggtcagaccgcgatcctcgtggctatcgatggagtgttgtgtggcatgatcgcaatcgctgatgccgtgaagcaggaagcggcgttggcggtccacaccctccagtcgatgggagttgatgtggtcctcatcaccggagacaacaggaaaaccgcccgcgccatcgctactcaagtcgggatcaacaaggtgttcgctgaagtcctcccctcacataaagtcgctaaagtccaggagctgcaaaacaagggaaagaaggttgcgatggtgggcgatggagtcaacgactcgccggcgttggcccaagccgatatgggagtggccatcggaaccggaacggatgtggccattgaagccgccgacgtggtgctcattagaaatgatctcctggacgtggtcgcgtcaatccacctctcaaaacgtactgtgcggcggatccgaatcaatctcgtgctcgcactcatctacaacctcgtcggaattccaatcgccgccggagtgttcatgccgatcggaattgtgctgcaaccgtggatggggtcggcggctatggccgcctcaagcgtctcggtcgtcctgtccagcctgcagctgaagtgctacaagaaaccggatctggagagatacgaagcgcaggcccacgggcacatgaagcctctgacggcgtcgcaagtgtccgtccacatcggaatggacgaccgctggcgggattcaccgcgggcaactccgtgggaccaagtttcctacgtgtcacaagtgagcctgtcctccctcacctcggataagccatcacgccatagcgcagccgcggacgatgatggggataagtggtcgctgctgctgaacggacgtgatgaagagcaatacatt

SEQ ID NO: 7401 - DNA, 4395 bp, Artificial Sequence
  Description of Artificial Sequence: Synthetic coding sequence
atgcctgagcaagagcgccagatcaccgcaagagaaggagccagcagaaagatactttcaaaacttagccttcctactcgtgcctgggagcccgcgatgaaaaagagctttgcctttgataatgtgggatacgaaggggggttggacgggctgggtccctccagccaagtggcaacctctaccgtgagaattcttggtatgacctgccaatcctgtgtgaaatcgattgaagatcgaatatccaaccttaagggtatcattagcatgaaggtatcactggaacagggctcagcaactgtgaagtacgtccctagcgtggtgtgtttgcagcaggtatgtcatcagatcggagatatggggttcgaagcatccattgcggagggaaaggcggcttcctggccaagcagatccctcccggcacaagaggccgtggtgaaactgcgggtcgaggggatgacctgccagtcgtgtgtgtcgagcatcgaaggaaaggtcagaaagctccaaggcgtcgtgcgagttaaggtgtcactgtcaaaccaggaagccgtcatcacttaccaaccttacctcatccagccagaagatttgcgggatcacgttaacgatatgggatttgaagctgcaatcaagtctaaagtcgctcccctctccctgggacctattgatatcgaacggcttcaatcaactaaccctaagcgccctctgtcgtcagctaatcagaatttcaataacagcgaaactcttggacatcaggggtcccatgtcgtgactctgcagctgagaatagacggaatgcattgtaagtcatgcgttcttaacatcgaagaaaacattggacagcttctgggtgtccagagcatccaagtgtcacttgagaacaagactgcccaggtgaaatacgatccctcatgtacttcccctgtggcactgcaaagggccattgaagcacttccccccggaaacttcaaggtgtccctgcctgatggagcggaaggctccggaactgatcatcggtcatcgtcgtcccactcgcccggctccccaccacggaatcaagtccaaggtacttgcagcaccactctgattgcaattgcaggtatgacctgtgcgtcgtgcgtgcattccatcgaaggtatgatctcccaacttgagggggtgcagcaaatctccgtttcgcttgccgaaggtaccgctacggtcctgtacaatccaagcgtgatttccccagaagagcttcgggcagcgattgaagatatgggcttcgaagcgtctgtcgtgtcggagtcatgctcgacgaacccactggggaaccacagcgccggaaactcgatggtgcaaactactgacgggacccccacctcagtgcaagaagtcgcccctcataccgggagactcccagcaaaccacgcgcctgacatcctggcaaagtcaccccagtcgacgagggcagtggcgccacaaaagtgtttcttgcaaatcaagggaatgacctgtgccagctgcgtgagcaacatagaaagaaatctgcaaaaggaagcgggggtgctctccgtcctcgtcgcacttatggcagggaaagctgagattaagtatgacccagaagtgattcaaccgcttgaaattgcccaattcattcaagaccttggttttgaagcagcagtcatggaagattacgctggatcagatggcaacatcgagctgaccatcactggaatgacctgcgcatcgtgtgtgcataacattgagtcgaagctgactcgaaccaacggtataacttacgcatcagtggccctggcaacttccaaggcacttgtgaaatttgatccggagattatcggtcctcgggatatcatcaagataatagaagaaattggatttcatgcctcgcttgcgcagcgaaaccctaacgcacatcacctcgaccacaagatggagattaaacagtggaagaagtcattcctttgtagcttggtgtttggaatcccggtgatggctctgatgatttacatgcttattccctccaacgaacctcaccaatccatggtgctggatcataacatcatacccggcctgtcgatcttgaatttgatctttttcatactgtgcactttcgtgcagcttcttggcggctggtacttttacgtgcaggcatacaaaagcctcagacaccggtcagcaaacatggatgtgctgattgtgcttgcaacttccatcgcgtacgtctattcacttgtgatccttgtcgtggcggtggccgagaaggcagaaagatcgccagtgactttctttgatacgccccctatgctttttgtgttcatagcacttggaagatggcttgaacaccttgccaagtccaagacctcggaagccctggcgaaacttatgtcacttcaggccaccgaagcaaccgtggtgactctgggtgaggataatctcattatccgagaagaacaagtgcctatggaactcgtgcagaggggggatatcgtcaaggtggtgccaggaggcaagttcccagtggacggtaaagtgctggaaggaaatactatggcagacgaatccttgattaccggagaagcaatgcccgtcactaagaagcctgggtccacggtgattgcaggttccattaatgcccatggtagcgttttgattaaagcaactcatgtgggaaatgacaccactttggcccaaattgtcaaacttgtggaagaagcgcaaatgtcaaaggcgcctattcagcaactggctgaccgtttttccgggtactttgtgccctttatcatcattatgtccactctcaccttggtggtgtggatcgtcattggctttattgacttcggcgtggtccaacgatactttccaaacccgaataaacatatttcacaaacggaagtgattattcggttcgcattccagaccagcatcactgtcctttgcatcgcatgcccttgttcgcttggcctcgcaaccccgactgcagtgatggtcggaactggagtcgccgcgcagaacggaattctgatcaaagggggtaaacctttggaaatggcacacaaaatcaagactgtcatgttcgataagactggcaccattactcacggcgttccaagagtcatgagggttctgcttcttggtgatgttgcgaccctgcctttgaggaaggtccttgcagtggtgggaacggcagaagcgagttcggagcacccgttgggcgtggccgtgaccaaatactgtaaagaagaactgggaaccgaaactttgggttactgtactgattttcaggcggtcccaggttgtggtatcggttgtaaagtctccaacgtggagggcatcctggcgcatagcgagcgccctcttagcgcacctgcgagccacctcaacgaagcaggctcgcttccagcagagaaggatgcagtcccacaaactttttcagtgcttatcggcaatagagaatggcttcgccgtaacgggcttaccatctcaagtgacgtctcggatgctatgaccgaccatgagatgaagggccaaaccgcaattctcgtcgccatcgacggggtcctttgtggcatgatagcgatcgccgacgcagtgaaacaggaggcagcactggctgttcatacgctccaatcgatgggagtcgatgtggtgctgattaccggggataaccggaaaaccgcacgagcgatagcaactcaagtgggtataaacaaggtattcgcagaggtcctgccaagccacaaggttgcgaaggtccaagaactgcagaacaagggtaagaaagttgcaatggtcggagacggcgtgaacgattcaccagcactcgcacaagcagatatgggagtggcaattggaaccgggactgatgtggccatagaagcagccgatgttgtgctcattcggaacgacctgctcgatgtcgtggccagcattcacctgtcgaaaagaaccgtccgcagaattaggatcaatctcgtgctggccttgatttacaatctcgtgggaattccaattgcagctggtgtattcatgccaatcgggatcgtgcttcagccatggatggggtccgccgccatggcagcgtcctcggtgagcgtggtgctttcgtctctgcaacttaaatgttataagaaaccggatctggaaagatacgaggctcaagcacacggacacatgaaacctcttactgccagccaagtctcggtccatataggcatggatgataggtggcgtgactcacctcgagccactccgtgggatcaagttagctacgtgtcgcaagtctcccttagctcacttacctcagacaagccatccagacatagtgccgcagcagatgatgacggtgataaatggtcgctccttctcaacggaagagatgaggaacagtacatc

SEQ ID NO: 7402 - DNA, 4395 bp, Artificial Sequence
  Description of Artificial Sequence: Synthetic coding sequence
atgccggaacaggaacggcagattaccgcgcgggagggggcctcgcgcaaaatcctgtctaagctgagccttccgacgcgggcgtgggagcctgcaatgaaaaagtcattcgcctttgacaacgtgggctacgaagggggcctggatggtctgggaccgtctagccaagtggcaaccagcaccgtccgcatcttgggcatgacttgtcagtcatgtgtcaagtcaatcgaggatcgaatttcaaacctgaagggaattatctccatgaaggtgtcgctggagcagggtagcgcgaccgtcaagtacgtgccatccgttgtctgcctccagcaggtctgtcatcagatcggagacatgggattcgaagctagcatcgccgaaggcaaggcggcttcctggccgtccagatcgctgcccgcgcaagaggccgtggtgaaacttagagtggaaggcatgacctgtcagagctgcgtgtcatcgatagaaggtaaggtcagaaagctgcaaggagtggtgagagtcaaagtcagcctctcaaaccaggaagctgtgatcacctaccagccgtacctgatccagcctgaggacctgagggaccatgtcaacgatatgggtttcgaagctgctatcaaaagcaaggtggcaccgctgtcactgggacctattgacatcgaaaggctgcaatcgaccaacccaaagcggccgctgtcgtccgcgaaccagaacttcaataactcggagactctgggtcatcagggatcgcacgtggtcactctccagctgcgcatagatggcatgcactgcaagtcgtgtgtgctgaacatcgaagagaatatcggccaactgctgggagtgcaaagcatccaagtgtcactcgaaaacaagactgcgcaggtgaaatacgacccatcgtgcacctcgcccgtggcgcttcaacgggcgatcgaggcgctgccgcccggcaacttcaaggtgtcgctcccagatggagcggaaggttcaggaaccgaccatcgctcgtcctccagccactcaccgggaagcccacctagaaatcaggtgcagggtacttgctccactaccctgattgccatcgccggaatgacgtgcgcgagctgcgtccattccatcgagggcatgatctcgcaactcgagggagttcagcaaatctctgtgtcgcttgctgaagggaccgcgactgtgctgtacaatccgtcagtgatctccccggaagagctgagagccgctatcgaggacatggggtttgaagcatcggtggtgtcggaatcctgctccaccaatccactgggaaaccatagcgcgggcaattcgatggtccagaccactgacggaacgcctacctcggtccaagaagtggctccgcataccggaaggttgccagctaaccacgcccctgacatcctggcgaaatcgcctcagagcacccgggcggtggccccgcagaagtgctttctccaaatcaagggcatgacgtgtgcttcgtgcgtctcgaatatcgaaagaaacttgcagaaggaggctggcgtgctgagcgtcctggtggcgctgatggccggtaaagctgagatcaaatacgaccctgaagtgatccagccactggaaatcgcgcagttcattcaggaccttggctttgaagccgcggtcatggaagattacgcagggtcagacggaaacattgagctgactatcactggaatgacttgtgcctcctgcgtgcataacatcgagagcaagctgacccgaaccaacggaatcacgtacgcctcggtcgcgctggcaacttccaaagctctggtcaaattcgaccccgaaatcatcggtcctcgggacatcataaagatcatcgaggagatcggatttcatgcttccctcgctcagagaaatccgaacgcccaccacctcgaccacaaaatggaaatcaagcagtggaagaagtccttcttgtgctccttggtgtttggcatcccagtgatggctctcatgatctacatgctgattccatcgaacgagccgcaccaatcaatggtgctggatcataacatcatcccaggcttgtcaatcctcaatctcatcttcttcattctgtgcactttcgtgcagttgctgggagggtggtacttttatgtgcaagcctacaagtccttgcggcaccggtccgcaaacatggacgtgcttatcgtcctggcgaccagcattgcgtatgtgtactcgctggtgatcttggtggtggcagtggcggaaaaggccgagagaagcccggtgaccttctttgatactccgccgatgttgttcgtgttcatcgccctgggacggtggctggagcatttggcaaagtccaagacgtctgaggctttggccaaactgatgtcactgcaagctacggaagccacggtcgtcactctgggtgaggacaacctgattatccgcgaagaacaagtgcctatggaactcgtccagagaggagacatcgtgaaggtcgtcccgggaggaaaattcccagtggacggaaaggtgttggaaggtaacactatggcagacgaaagcctcatcactggtgaggcaatgccggtgactaaaaagccgggctcgactgtgattgccggatcgatcaatgctcacggctcagttctgatcaaggcgacccacgtggggaatgatacgacccttgcacaaatcgtgaagctcgtggaagaagcgcagatgtccaaggcaccgatccaacaactggcagatcgcttctcaggatacttcgtgccgttcataatcatcatgtcgactctcaccctggtggtgtggattgttatcggctttatagacttcggagtcgtccagcgctactttccaaatcccaacaagcacatctcgcaaaccgaagtgatcatcagatttgccttccagacttccatcaccgtgctctgcatcgcctgcccgtgttcactcggtcttgcaacgccaacggcggtgatggtgggaacgggagtcgccgcgcaaaacggcatcctcatcaagggcggtaagccgctggagatggcgcacaaaatcaagactgtgatgttcgataagaccggtactatcacccatggcgtgccccgggtgatgagagtgttgctcctcggagatgtcgctactctgccactgcggaaggtcctggcggtcgtcggaacggccgaagcctcgtcagaacacccgcttggcgtcgccgtcactaagtactgtaaggaagaacttggaactgagacgttgggatattgcaccgacttccaggcagtgccagggtgcggaatcggatgcaaagtgtcgaatgttgaaggcatcctggcgcattcggagcggccgctgagcgcacctgcctcccacttgaacgaggcgggaagcctccctgctgaaaaggacgcggtgccacagaccttctcggtgctgatcggaaatcgggagtggctgcgccgcaacggactcaccatctcgtccgacgtgagcgacgccatgaccgatcacgaaatgaagggacaaaccgccattctcgtggccatcgacggcgtcttgtgcggcatgatcgccattgccgatgcggtgaagcaggaggcggctttggccgtgcatactcttcagtccatgggagtggacgtggtccttatcaccggtgacaataggaaaaccgctcgggcgattgctactcaagtgggcattaacaaagtgttcgcagaggtgctgccgagccacaaagtggctaaggtgcaggagctccaaaacaaaggaaagaaggtggcgatggttggggatggagtgaatgattcaccagcattggctcaggcggacatgggagtcgccatcggaaccggtaccgacgtggctatcgaggccgcggatgtggtcctcattcggaacgacctcctggatgtggtcgcttccatccacctgtcgaaaaggactgtgaggaggattagaatcaatctcgtgctggccctcatctacaatctggtgggaatcccaattgctgccggagttttcatgccgatcggtatcgtgctgcagccttggatgggctcggcagccatggccgcgtccagcgtgtcggtggtgctgtccagcctgcaactgaaatgctacaagaaaccggatctggaacgttacgaagcccaagcccatggacatatgaaacctctgaccgcctcacaggtcagcgtccacattgggatggacgatagatggcgcgattcaccacgtgcaaccccatgggaccaagtgagctacgtgtcccaagtctcgctctcatccctgaccagcgataaaccttcgcggcacagcgccgccgccgacgatgacggagacaaatggtcgctcctcctgaatggccgcgacgaagaacaatacatc

SEQ ID NO: 7403 - DNA, 4395 bp, Artificial Sequence
  Description of Artificial Sequence: Synthetic coding sequence
atgcctgaacaagagcgtcagatcactgcaagggaaggagcatccagaaagatactctcgaagttgtctcttccaaccagggcctgggagcctgccatgaagaagtcgtttgcatttgacaacgttggctacgaaggaggactggatggactgggaccttcgtcacaggtggctacttcaaccgtgaggatcctgggaatgacttgtcagtcatgcgtgaaatcgatcgaagataggatctcaaacctgaaagggatcattagcatgaaggtcagccttgaacaaggatccgcaacggtgaaatacgtgccttccgtggtgtgcctccaacaggtctgtcatcagattggtgacatgggtttcgaggcatccattgcagaaggcaaagccgcatcatggccatcgagatcactgccggctcaagaggcagttgtgaagctccgcgtggaaggaatgacctgtcagtcatgtgtgtcctcgatagagggaaaggtgcgtaagctccaaggggttgtgagagtgaaggtgtcactttcgaaccaggaagcagtgataacctaccagccttacctgattcagcctgaagatctccgggatcacgtgaatgatatggggttcgaagcggccattaagtccaaagtggcacctctgagcctgggaccgatagatattgagagactccagtccaccaatcctaagcgcccactttcctccgcgaaccagaatttcaacaacagcgaaacccttggccatcagggatctcatgtggtgactcttcaactcagaattgacggaatgcactgtaagtcatgtgtgctgaatattgaggagaatattggacaacttctgggtgtccaatcgatccaggtgtcactggagaacaagacggcacaagtcaagtatgatccaagctgcacgtcgcctgttgcacttcaaagagccatagaagcactgcctccaggaaactttaaggtgtccctcccggatggggccgaaggaagcggtaccgaccatcggtctagcagctcacattcgcctgggtcaccccctcgcaatcaggtgcaaggaacttgcagcactaccctgattgcaattgcgggaatgacctgcgcatcttgcgtgcattccatcgaaggtatgatctcccagctcgaaggggtccagcagatttcggtttcgctcgccgagggaaccgcgaccgtgctctacaatccgtcggtcatctcccctgaggagctcagggcggcaatcgaggacatgggatttgaggcaagcgtggtatccgaatcgtgtagcactaatccgcttgggaatcactccgcaggaaactccatggtccaaaccactgacgggaccccgaccagcgttcaagaagtggcaccacataccggcagactccctgccaaccatgcccctgacatccttgccaagtcgccacagagcaccagggcagttgccccacagaaatgctttctccagataaagggcatgacttgcgcgtcgtgcgtcagcaatatcgagcgaaacctccagaaagaagccggagtcctgtctgtgcttgtggctctgatggccgggaaggctgagattaagtacgatccagaggtcattcagccccttgagattgcccagtttatccaggatctgggattcgaggccgccgtgatggaagattatgcaggatcggacggaaacatcgagcttacgataactgggatgacgtgtgcgtcatgtgtgcacaatattgagtcgaagctgacgagaactaacgggattacttacgcatcggtggcactggcaactagcaaggccctcgtcaagtttgaccccgagataatagggcctcgggacattatcaagatcattgaggaaatcggatttcatgcatcgctcgcccaaagaaacccgaatgcacaccatcttgaccacaagatggagataaagcagtggaagaaatcgtttctgtgtagcctcgtgtttggaatacctgtgatggcacttatgatttacatgctcatcccttcgaatgaacctcatcagtcgatggtgctggatcataacatcatccctggactttccattcttaacttgattttctttatcctttgcactttcgtgcaactcctggggggttggtacttctacgtgcaggcctacaagtcccttcgtcatcgctcggcaaatatggacgtccttattgtgctggcaacgtccattgcttacgtgtactcgttggtgattcttgtcgttgccgtggctgaaaaggctgagaggtcccctgttacttttttcgacactccaccaatgcttttcgtgttcatagccctgggaagatggcttgaacacctggcaaaaagcaagacctccgaggctctcgcgaagctcatgtccctgcaggcgaccgaagccacggtagtgactcttggtgaagataatctcataattcgtgaggaacaggtgcctatggaactcgtgcaacgtggagatatcgtgaaagtggtccccgggggaaagttcccagtcgacgggaaagtcctcgaaggtaacaccatggcagacgaatccttgataaccggtgaggctatgccagtgactaagaagccaggatccactgtcatcgcgggttctattaacgcacatggcagcgtgctgatcaaggcaactcacgtgggcaatgataccaccctggcacaaatcgtgaaacttgtggaagaggcacagatgtccaaagccccaattcaacaactggcagatcgcttttccggttactttgtcccttttatcatcataatgtccactctgaccttggtggtgtggatcgtcattggtttcattgactttggtgtcgtccaaagatactttcctaaccctaacaagcatatttcacaaactgaggttatcattcgctttgccttccagacgtcaattacggtgttgtgtattgcttgtccctgttcgcttggtcttgccacgcctaccgcagtgatggtgggaacgggcgtggcagctcaaaacggtatcctcataaaagggggcaaaccccttgaaatggcacataagataaagacggttatgtttgataagaccggaactatcacccatggtgtgcccagagtgatgcgcgtcctgcttctgggagacgtggccactctgccactgagaaaagtgctggcagtggtcggcactgccgaggcatcatcagaacacccactcggtgtcgcagtgaccaagtactgcaaagaagagctcggtaccgaaaccttgggatactgtaccgactttcaggcagttccaggttgtggtattggatgtaaggtgagcaacgtcgaaggtattctggcacattcggaacggcccctgtccgcccccgcgtcgcatcttaatgaagcaggttccctgccagcggagaaagacgctgttccacagaccttcagcgtgcttattggcaaccgggaatggcttcgtaggaatgggctgactattagctcagacgtctcggacgcaatgactgatcatgaaatgaagggccaaaccgcaatcctcgtggccattgacggagtcctgtgtggtatgattgcaatcgctgatgccgtcaagcaggaagctgcgcttgcggtgcacaccctccaatccatgggtgtagatgttgtgctcatcactggtgataaccgaaagactgcacgggccattgcaacccaagtgggcatcaataaagttttcgcagaagtgcttcccagccacaaagtcgcaaaggtgcaagaattgcagaacaagggtaagaaggtggcaatggttggagatggcgtcaatgatagcccagcactggcgcaggcggatatgggtgtggcaataggcactggcaccgatgtggcgatagaggcagcagatgtggtgctgattcgaaacgacctcctggatgtagtggcatcgattcatctctccaaaaggaccgtcagaagaatccggattaatctcgtgcttgcgctcatctataacctggtcggtatcccgatcgcagcaggagtctttatgccaatcggcattgtcctgcaaccttggatgggaagcgcggccatggctgcgtccagcgtcagcgttgtcctgagctccctgcaacttaagtgttacaagaagcccgaccttgagagatacgaggcccaggcacatggacatatgaagccgctgactgcaagtcaggtgagcgtgcatatcggaatggatgataggtggagggacagccctcgggcgactccatgggatcaggtgagctacgtgtcccaggtgagcctgtcgtcattgacttccgataaaccttcaaggcactcggcagcggcagatgatgatggcgataagtggtcgctgctgcttaacggacgtgatgaagaacaatacata

SEQ ID NO: 7404 - DNA, 4395 bp, Artificial Sequence
  Description of Artificial Sequence: Synthetic coding sequence
atgcctgaacaggaaaggcagatcactgcaagagaaggcgcctcccggaaaatcctgtccaagctctcgttgccgactcgcgcctgggaaccagccatgaagaagtcattcgcattcgataacgtggggtacgaaggcggactcgatggcttgggtccttcgtcccaagttgccacttccaccgtgcgcatccttgggatgacttgtcaatcgtgtgtcaagtccatcgaagataggatctcaaatctcaaaggaatcatctccatgaaggtgtcactggaacagggctccgctaccgtgaagtacgtgccttctgtggtctgcctgcagcaagtgtgccaccagattggggatatgggatttgaggcatccatcgctgagggtaaagcggcgagctggccatccaggtcgctcccggcgcaggaagcagtggtcaaactccgggtggaagggatgacctgccaatcgtgcgtgtcctcgatcgaaggcaaggtgcgcaagttgcaaggagtcgtgagagtgaaagtatctctgtcgaaccaagaggcggtcattacctaccaaccttacctgatccagcccgaggatctgcgggaccatgtgaacgacatggggttcgaagcagccattaagagcaaggtcgcgccgctgagcctcggtcccatcgatattgagcggctccaaagcaccaaccccaagcgcccactgagctccgctaaccagaatttcaataacagcgagacgcttggtcaccagggtagccatgtcgttacgctgcagctcagaatcgacggaatgcattgtaagtcgtgcgtactgaacattgaagagaatataggtcaactgctcggagtccagtcaattcaagtgtccctggaaaacaagaccgcccaagtcaagtacgacccaagctgcacttcgcctgtcgccctccaaagggccatcgaggcgctcccaccgggcaacttcaaagtctcgctgccagatggagctgaaggctcgggcaccgaccaccgtagctcatcatcccatagcccaggtagccccccgcggaatcaggtgcaaggaacttgctcaaccactctgatcgccattgccggtatgacttgtgcatcgtgtgtgcattcgatcgagggaatgattagccaactcgagggagtgcagcagatctccgtgtccctcgctgaaggtacggccacggtcctttacaacccttctgtcatcagcccggaggaattgagagctgctatcgaggacatgggtttcgaggcttcagtggtttccgaatcgtgcagcaccaatccgctcgggaaccacagcgctgggaactcaatggtccagaccaccgacggaactccgactagcgtccaggaagtggcgccgcacacgggcagattgcctgcgaatcatgctccagatatccttgccaaatcccctcagtccacccgcgcagtggcaccacagaagtgcttcctgcaaatcaaaggaatgacctgcgctagctgcgtttccaacatcgaacggaacctgcaaaaggaggccggagtgctttcagttctcgtggccttgatggcaggaaaggccgagatcaagtacgatccggaggtcattcagccactcgaaatagcgcagttcatccaggatctgggattcgaggcggccgtgatggaggactacgcgggatcggacggaaatatcgaactgaccatcaccggcatgacttgcgcgtcctgcgtgcacaatattgaatcgaagctgactcgaaccaatggaattacttatgcctcggtggcgctggctacctccaaggccctggttaagtttgacccggagatcatcggcccgcgggacatcataaagatcatagaggaaattggatttcacgcatcactggcgcaaagaaacccgaacgcccaccacctcgaccacaaaatggagatcaagcagtggaaaaagagtttcctctgcagtctggtgttcggaatcccggtcatggccctgatgatttacatgctcatcccgtctaacgaaccgcatcaatcgatggtacttgaccataacattatcccgggactctccatcctgaacttgatcttctttatcctttgcaccttcgttcaactcctgggaggttggtatttctacgtccaagcctataagtccctgaggcaccgcagcgccaacatggacgtgctgatcgttctcgccaccagcatcgcgtacgtctactcgcttgtcatcctggtggtggccgtggcagaaaaggcagagcggtccccggtaacgttttttgacactccgccgatgctctttgtgtttattgctttgggacgctggctcgaacacctggcaaagtctaagacctcggaagcgcttgccaaattgatgagtctgcaagccactgaggccactgtcgtgactctgggcgaggacaacttgattatccgggaggaacaggtcccgatggaactggtgcagcgcggagacatcgtgaaagtggtgccgggaggtaagttcccggtggatggaaaagtgctggaaggcaatactatggcggatgaatcacttatcaccggggaagcgatgcctgtgactaagaagcctggatccaccgtaatcgcaggatcaatcaacgctcacggatcagtgttgattaaagccacccacgtcgggaacgatactactttggctcagatcgtgaaattggtcgaggaggcacaaatgtcaaaagcccccatccagcagctggcggatcgcttctctggatactttgtccccttcataatcatcatgagcaccttgaccctcgttgtgtggatcgtgattggattcatagacttcggcgtcgtgcagcgatacttcccaaaccctaacaagcacatttcacagaccgaagtcatcatccggttcgcatttcagacctcgatcaccgtcttgtgtatcgcctgcccctgctcgttggggcttgcgacccctaccgcggtaatggtcggcactggcgtggccgcccaaaatggaatcctcatcaagggagggaagccactggagatggcccacaagatcaaaaccgtgatgttcgacaagactggtaccattactcacggagtcccccgggtcatgagggtgctcctcctgggagatgtggcaacgctgccactgcgtaaggtcttggcagtggtcggaactgccgaagcctcctcagaacaccctctgggcgtggcggtgactaagtactgcaaggaagaactcggcaccgagacgctggggtactgtactgatttccaggccgtcccgggatgcgggatcggctgcaaagtctcgaatgtggaaggtatcttggcccattccgaaagaccgctctcggctccagcaagccatctgaacgaagctgggtcgctgccggcagagaaggatgctgtgccacagactttctccgtcctcattggaaacagagagtggctgaggcgcaatggactgacgatctcttcggacgtgtctgacgcgatgactgaccacgagatgaagggccagaccgctatcctggtggccatcgatggagtgctgtgcggtatgatcgcgatcgcagacgccgtgaagcaagaggcggcccttgcagtgcataccttgcagtcaatgggagtcgacgttgtgctcatcacgggggataatcggaaaactgcacgagcgatcgctactcaggtgggaatcaacaaggtgttcgcggaggtcctgccgtctcataaggtggccaaggtgcaggaacttcagaacaaaggcaaaaaagtcgcaatggtcggggacggcgtgaacgactcaccggcactggctcaggcggacatgggagtggccatcggcaccggtactgatgtcgccatcgaagccgcggacgtcgtgctgatcagaaacgatttgctggatgtggtggcctctatccacctctcaaagcgcaccgtgagaagaatccggatcaatctggtgctggcgctcatctacaatcttgtgggcatcccaatcgcagcaggtgtgttcatgccaatcggaatcgtgctgcagccgtggatgggatccgccgccatggcagcgtcatccgtgtccgtggtgctgagctcactccaactgaaatgttacaagaagccagatctggaacgctacgaggctcaagcgcacggacacatgaagccgctgaccgctagccaggtgtccgtccatatcggaatggacgatcggtggcgggactcgccccgcgcgactccatgggaccaggtgtcgtacgtttcacaggtgtccctctcgtcgcttacctccgacaagcccagtcgccatagcgctgcggccgacgacgacggcgacaagtggagtctgctgctcaatggaagggacgaggagcagtacatc

SEQ ID NO: 7405 - DNA, 4395 bp, Artificial Sequence
  Description of Artificial Sequence: Synthetic coding sequence
atgccagaacaggagcgccaaatcactgcccgcgaaggtgcgtctcgaaagattctgtcgaagttgtctctgcccacgcgcgcctgggaaccagcgatgaagaaatcgttcgccttcgacaatgtgggatacgaaggcggcttggacgggcttggaccgtcgtcccaagtggcgacgtccaccgtcaggattcttggaatgacttgccagtcatgcgtgaagtccatcgaggacagaatatcgaacctcaagggcatcatcagcatgaaagtgagtttggaacaaggctcagctaccgtgaagtatgtcccatccgtcgtgtgcttgcagcaagtgtgtcaccagataggcgacatgggtttcgaggcctccatcgcggaaggaaaggcagcgagctggccgtcgcgctccctgcctgcccaagaagcggtggtgaagttgcgggtggagggaatgacttgtcagtcttgtgtcagcagcatcgaagggaaagtgagaaagctccagggggtggtgagggttaaagtgagcctgagcaatcaggaagcagtcatcacgtaccaaccgtacctgatccagccggaggacctgcgcgaccacgttaacgacatggggttcgaagcggccatcaagagcaaggtggccccgttgtcactggggccgatcgacatcgaacggcttcagtccactaacccaaaacggccgctgagcagcgctaatcagaacttcaacaattctgaaacgctcggccaccaaggatcccatgtggtgaccctgcagctgcggatcgacggcatgcattgcaagagctgtgtcttgaatatcgaagagaacatcggccaactgctcggcgtccagtcgatccaagtgtccctggagaataagaccgcccaggttaagtacgacccctcctgtacctccccagtcgccctccaaagagccattgaagcccttcctccaggaaactttaaggtgagcctgccggacggagcagagggatccggaaccgatcatcgctcctcctcgtcgcattctcctggaagtccgccccggaaccaggtccagggaacgtgctcgactacgctgatcgccatcgccggcatgacgtgcgcgtcctgtgtgcatagcatcgagggcatgattagccaactcgagggtgtgcagcagatctcggtatcgctggcggagggcactgcaacggttctgtacaacccgtctgtgatctcgcctgaggagcttcgcgccgctatcgaagatatgggattcgaagcgtcggtagtctcggaaagctgctcgaccaatccgcttggcaaccattccgcgggtaactcaatggtccagaccaccgatggaaccccaacttcagtgcaggaagtggccccgcatactggcagactgccagccaatcatgcacctgatatcctggcgaagtccccgcaatcgacccgcgcagtggccccccaaaagtgcttcctccaaatcaaaggtatgacgtgtgcatcatgcgtgagcaacattgagcgaaacttgcaaaaggaagctggcgtgctgagcgtgctggtggcactgatggctggcaaagctgagataaagtatgacccagaagtcatccagcctctggaaatcgcccagttcattcaggatctggggttcgaggctgcggtcatggaagattacgccggatcggatggaaatatcgaactgactatcactggtatgacctgcgctagctgcgttcacaatatcgagtccaagttgactcgcactaacggcatcacctacgccagcgtggcacttgcgacctccaaggccctcgtcaagtttgaccctgagatcatcgggccacgggacattatcaagatcattgaagagatcggcttccatgcgtctctggcccaaagaaacccaaacgcccaccacctggaccacaaaatggagattaaacaatggaagaagtcttttctctgttccctcgtgttcggaatccctgtcatggcactcatgatttacatgctgatcccatcgaacgaaccgcatcagagcatggtgctggaccataacatcatcccgggtctgtcaatcctgaacctcatcttcttcatcctgtgcacttttgtccaattgctggggggatggtacttttacgtgcaggcttataagtccctccgccacaggtccgcaaatatggatgtgctgatcgtcctcgcaactagcatcgcctatgtgtactcactggttatcctggtcgttgccgtcgccgagaaagccgaacggtcacctgtgactttctttgataccccacccatgctcttcgtgttcatcgctctggggcgctggctcgagcacctcgctaagtcaaagaccagcgaagcccttgccaaacttatgagcctccaagccacggaagcgaccgtggtgacgttgggagaggacaatctgatcatccgggaagaacaggttcctatggagcttgtgcaaagaggagacatcgtgaaggtggtgccaggtggaaagttcccggtcgacggaaaagtgctggaaggaaacaccatggcggatgagagccttataacgggagaggcgatgccggtgactaagaagcctgggtccactgtgatagctggatccatcaacgcccatggatccgttctcatcaaggccactcacgtcggaaacgacaccaccctcgcacaaatcgtgaagctggtggaggaggcgcagatgtcgaaagcacctatccagcaactcgcagatcgcttctccgggtactttgtgcctttcatcatcatcatgtcaacccttaccctcgtggtgtggatcgtgatcggattcattgacttcggtgttgtgcagagatacttcccgaacccgaacaaacatatctcacagaccgaggtcatcatccggtttgccttccagacttccattaccgtcttgtgcatcgcgtgcccttgctcactcggcctcgcgaccccgacggccgtcatggtgggaactggtgtggccgcccagaatggcatactgatcaagggaggaaaaccactggaaatggcacacaaaatcaagaccgtgatgtttgacaagaccggaactatcacgcacggggtgccccgggttatgagggtgctgctgttgggcgatgtcgccactctgccacttcggaaagtcctcgcggttgtgggaactgcggaggcttcctcggagcacccgctgggagtcgcagtaaccaagtactgcaaagaagaactgggcaccgaaaccttgggatactgcaccgatttccaagcagtcccgggttgcggaatcgggtgcaaggtgagcaatgtcgagggaatcctggcacactccgagcgcccgctgagcgccccggcctcgcacctgaatgaagctggttcgcttcctgcagaaaaggacgccgtcccccaaactttctcggtgctgatcggaaatcgcgagtggcttcggagaaacggactgaccatctcgtccgacgtgtcggatgccatgactgatcacgaaatgaaaggacagaccgcaattctcgtcgcgattgatggagtgctgtgcggaatgattgccattgcggacgcggtgaaacaagaagccgccctggcggtgcacaccttgcagtcgatgggagtggatgtggtcctgatcaccggagacaacaggaaaactgctagggcgatcgccactcaggtgggcatcaataaggtgtttgccgaggtgctgccatcacacaaggtggctaaggtgcaagagctgcagaacaaaggaaaaaaggtcgccatggttggtgatggggtcaacgactccccggcactcgcgcaagccgacatgggcgtggcgatcggcactggaaccgatgttgccattgaggccgccgacgtagtcctgatccgcaatgatcttctggacgtcgtcgcctccatccatctctcgaagcgaactgtgagacggatccgtatcaacctggtgcttgcgctgatctacaacctcgtgggcattccgatcgccgctggagtgttcatgcccatcggcatcgtcttgcaaccatggatgggatcggcagcaatggctgcgagctcagtgtccgtagtactcagctcgctgcagctgaaatgttacaagaagccagatctcgagagatacgaagcacaagcacacggtcacatgaagccgctgactgcttcccaggtgtccgtccacattggtatggatgacagatggcgcgacagcccacgcgcaaccccctgggaccaggtgtcgtacgtgtcgcaagtgagcctgtccagcctgactagcgataagccctccagacattcggcggcagctgatgacgacggggacaagtggtcactgctgctgaatggaagagatgaagaacagtacatc

SEQ ID NO: 7406 - DNA, 4395 bp, Artificial Sequence
  Description of Artificial Sequence: Synthetic coding sequence
atgcccgaacaagagagacagatcaccgcgagagagggagcctcaaggaaaatcctctcgaagcttagtctgcccactagggcctgggaacctgcaatgaagaaaagctttgcctttgacaacgttggctatgagggtggattggatggactggggccaagtagccaggtggctactagtaccgtgcggatcctaggaatgacctgtcagtcctgcgtgaagtcgatagaggatcggatttcgaatctgaaaggaatcatttcaatgaaggtatcacttgaacaaggttcagccactgttaagtatgttcccagcgtggtgtgcctgcaacaggtatgccatcagatcggggatatgggcttcgaggcttccatagctgaggggaaggctgcatcatggccttcacggtccttgcccgcacaggaagctgtcgtgaagctgagggtagagggcatgacatgccagtcttgtgtgagctccatagagggcaaagtgcgaaagttacagggtgttgtgcgagtgaaggtgtcgttgtcaaaccaggaagccgttataacataccaaccttatcttatccaacccgaggatctacgggatcatgtgaatgatatggggttcgaggccgcaattaagtcaaaggtagcacctcttagcttggggcctattgacatcgagcgtctccaatccaccaacccaaaacgcccgctgtcaagcgcaaaccagaactttaataacagtgagacactgggccatcagggctctcacgttgttaccttacagcttcgaatcgacggcatgcactgcaagagttgtgtgctcaacatcgaggaaaatatcggccagctgctgggcgtgcagtcgatccaggtaagtctggagaataaaaccgcacaggtgaaatacgatcctagctgcacatcaccagtcgcccttcagagagctatagaggctctcccgcccgggaatttcaaggtgtccttgcctgacggggcagaggggagtggaacagatcaccgtagctcgagctctcactctcctggctccccacctcggaaccaagttcaggggacttgttcaacaaccctcatcgcaattgctggcatgacttgcgcaagctgcgtgcatagcatagaagggatgatttcccagctcgagggcgtccagcaaatcagtgtttctctcgcagaagggactgctaccgtgctctacaatcccagcgttatatcaccagaagaactgcgggcagcaattgaggatatggggtttgaggcaagcgtagtgagtgaatcatgttcgacgaacccattgggcaaccatagcgctggcaatagtatggtccagacaacagatggaacccctaccagcgtgcaagaggtggcaccacacaccggtcggttgcccgccaaccatgcccccgacatattggccaagtctccccaaagcacaagagccgttgctccccaaaaatgttttctacagatcaagggtatgacctgcgcgtcttgtgtatcaaatatcgaaagaaacctgcagaaggaagccggcgtgctgtctgtgctggtcgctctgatggccggcaaagctgaaataaaatacgaccctgaggttatacagcctcttgaaatcgctcagttcattcaggacctggggttcgaggcagcagtgatggaggattacgccggctcggatggcaatattgagttgactattactgggatgacatgcgcttcttgcgtgcacaacattgagtctaaacttacgagaacaaatggaatcacatacgcttcagtggcgctggctacctccaaggcattggtgaagttcgatcccgaaattataggcccacgggacattatcaagatcattgaagagatcggctttcacgcaagtcttgcgcaaagaaacccaaacgcgcatcatcttgaccacaagatggaaatcaaacagtggaaaaaatccttcctgtgctccctagtcttcggtatacccgttatggcgctgatgatttacatgctcatcccttctaatgagcctcaccagtccatggtgctagatcataatatcattccaggcctgtccatccttaacctcatctttttcattctgtgcactttcgtgcagttgctcggtgggtggtatttttatgtgcaagcctacaagtccttgcggcataggagtgcgaacatggatgtgctgattgtgcttgccacaagtattgcctatgtgtatagtctggtgatcttggtcgttgccgtggccgagaaggctgagagatcccccgttaccttcttcgacacacctcccatgcttttcgtgttcatagccctcggccgatggctagaacacctggccaaaagtaaaacatccgaagccctggctaagctcatgagcctgcaggcaactgaagccaccgtggtgacattaggagaagataaccttatcatccgtgaggaacaggtacctatggagctggtgcagcgcggagatatcgtcaaggtggtgccgggcgggaagtttcccgtcgatggtaaagtcctcgagggtaatactatggcagatgagtctcttattaccggcgaagccatgccagtgacgaaaaaacctggatcaactgttattgctgggagcattaacgctcacggatctgttttgatcaaggcaactcacgtcggcaacgacacaactctagcacaaatcgttaaactggtggaagaggcacagatgtccaaagctccaatacagcagctggccgaccggttcagtgggtactttgttccctttataattatcatgtccacccttacactcgtggtctggattgtgatcgggttcatcgattttggagtggtgcaacgctactttccaaaccccaataagcacatcagccagaccgaggtgatcatcagatttgcattccagacatcgatcactgtcttgtgcatcgcttgtccatgtagtctggggctagccacacccacagctgtgatggtgggcaccggcgttgcagcccaaaatggtatcctgattaagggaggaaaaccgcttgagatggcacacaaaataaagacagtaatgttcgataagaccgggacgatcacccacggagttccgcgagtcatgcgggttcttctcctcggagacgtagccaccttgcccttacgcaaagtgttggccgtggtgggcacagctgaagcctcgagtgagcatcccctcggcgtcgctgtcacaaagtactgcaaggaagaactcggcacagagacgctaggttactgcacagacttccaagctgtccccggatgtgggattgggtgcaaggtcagcaacgtggaaggtatcctcgctcactcagagaggcctctctctgcccccgccagccacctgaatgaggccggctctctgccagccgagaaagacgctgttccacaaacttttagtgtattgattggaaatagagagtggctgcggaggaacgggctcactatcagttcagacgtgtcggacgctatgacggaccatgaaatgaagggccaaactgcaattcttgtggcaattgacggggtcctatgcggaatgatcgccatagcagatgccgtcaagcaggaggcggcgcttgctgtacacacacttcagagcatgggagtggacgttgtgctgataaccggcgacaaccgtaagaccgctagggctatcgctactcaggtgggtatcaataaggttttcgctgaggtactgccgtcccataaggtagctaaggtccaggagctgcagaataaggggaaaaaagtcgcgatggtgggcgacggggtgaacgactcccctgccctggcgcaggctgatatgggcgtggccattggaaccggcactgacgtggccatcgaagccgctgacgtggtcctaatacgaaacgatcttttagacgtggtggcgagtatccatctgtccaagcgaactgtgaggagaattcgcatcaatctggtcctggccctgatctataacctggtgggaatccccatcgctgcaggggttttcatgcctatcggaatagtgttgcagccttggatggggtccgcagccatggcagcgtcctctgtgtccgtcgtcctcagttcactgcagctgaaatgctacaagaagcccgacctagagcgctatgaggctcaagctcacggtcacatgaaaccactgaccgctagccaggtgtctgtccacatcgggatggacgatcggtggagggattcgccccgggccaccccttgggatcaggtttcttacgtctcgcaggtaagtctatcctctctgacttcagacaagccaagcagacactctgcagccgctgacgacgatggtgataagtggtctttgctgctgaacggcagagacgaggagcaatatata

SEQ ID NO: 7407 - DNA, 4395 bp, Artificial Sequence
  Description of Artificial Sequence: Synthetic coding sequence
atgcccgaacaggagaggcaaatcaccgcgcgggaaggcgcaagtcgaaagatcttgagcaaattgagtctgccaacgagggcatgggagcccgcaatgaagaaatccttcgcatttgacaacgtgggttatgagggcggattagacgggttaggcccatctagccaggttgcgacgagcacagtgagaattcttgggatgacatgtcaatcatgtgtgaaatctatagaagacaggatctctaatctgaagggcatcatctccatgaaagtctccttggaacagggttcagccaccgtcaaatatgttccatctgtagtctgcctgcaacaggtgtgccaccagatcggggatatggggtttgaagccagcattgccgagggcaaagcagcctcttggccgtcgagaagtctgcccgcccaggaggccgtggtgaaactgcgcgtcgaaggtatgacttgtcaatcatgcgtaagttccattgaggggaaggtgaggaaactgcagggcgtggtgagagtcaaagtcagcctctctaatcaggaggccgttattacttaccagccatatctgattcagccagaggacctgcgagaccatgtcaacgatatgggctttgaagccgccattaagtcgaaggtggcccctctgagccttggccccatcgatattgagcggttgcagtctactaatcctaagaggcctctgagctcagcaaaccaaaacttcaataattccgaaaccttggggcatcagggttcccatgtggtcactcttcaactgcgaatcgatgggatgcactgtaaatcgtgtgtcctcaatattgaagagaacatcggccaactgctgggtgtgcagtccatccaggtttccctggagaacaaaactgcccaggtgaagtatgatccatcatgcaccagcccagtggcactgcagcgggcaattgaggccctccctcccggtaactttaaggtgtctttacccgacggagcggagggttcgggcactgaccaccgcagtagttcctctcactcacccggttcgccaccccgcaaccaggtccaggggacgtgttcaaccacccttatcgcaatagccggaatgacttgcgcctcttgcgtgcattccatagaaggtatgatctctcaactggagggcgttcaacagatatctgtgtccctcgccgagggcactgcaaccgtcctctataatcccagtgtgatatcacccgaggagctcagagcagccattgaagatatggggtttgaggctagtgtcgtgtctgagagttgtagtactaaccccctgggcaaccactctgcaggcaatagcatggtacagacaactgacggcacacctacaagtgttcaagaggttgccccgcacactggcaggctcccggccaaccacgcacctgatattcttgcaaaaagcccacaaagtacgagggcggtggctccgcagaaatgctttctgcaaatcaaaggaatgacatgtgccagctgtgtgtcgaacattgagaggaacctgcagaaagaagccggtgtactcagcgtgctcgttgccttaatggctgggaaggcagaaattaagtacgaccctgaggtgattcaacccctggagatagcccagtttatccaggatcttgggttcgaggccgccgtgatggaggactatgcagggtcggatggcaacatcgaactcactattactggaatgacttgtgcgagttgcgtgcataatatcgagtcaaagctgacgcgcactaacggcattacctatgcctcagtcgcgcttgccacgtccaaggctcttgtcaaattcgatccagaaatcatcggtccccgtgacattatcaagatcattgaagaaattggtttccatgcgtccctggctcagcgaaatccgaacgcccatcacctggaccataaaatggagataaaacagtggaaaaaaagttttctgtgtagtcttgtgtttggcatccctgtaatggcactgatgatctatatgttaattccgagcaacgaacctcaccaaagtatggtcctggatcacaatataatcccagggctcagcatactgaacttgatcttcttcatcctgtgtacattcgtgcagctgttagggggatggtacttttatgttcaggcttataagtccctaagacaccggtctgctaatatggatgtcctgattgttctggctacctctatcgcttatgtttacagtctggtaatactggtggtcgcagtggcggaaaaggccgaacgtagccctgttactttcttcgataccccccccatgctcttcgtgttcatcgcgttagggcgctggctggaacacttagcaaaaagcaagacttccgaggcattggccaagttaatgtccctgcaggcgacagaagcaaccgtggtgacgctcggtgaagataatttgattatcagggaagagcaggttccgatggagttggttcagcggggagatatcgtcaaagtggtgccgggtggaaaatttcccgtggatggcaaagtactagagggcaatactatggccgatgagtccctcatcaccggagaagcaatgccagtgacaaagaagccaggcagcaccgtgatagctggtagtattaacgcgcatggatccgtgctgatcaaggctacccacgtcggaaatgacacaactctcgctcaaattgttaaacttgtagaagaggcccagatgagcaaagcccctatccagcagcttgctgataggttctctgggtatttcgtaccctttattattatcatgtcgaccttgaccctcgtcgtctggattgtgatcggatttatcgacttcggggtggtgcagcggtatttccccaacccaaataagcacatttcccagactgaagtcattattcggttcgcctttcagacttccatcaccgtgctgtgtatcgcttgcccatgctccctgggtctggcaacccctactgccgtgatggtgggcacaggtgtggctgcccaaaatggaattctgatcaaaggaggaaaaccactagaaatggcacataaaatcaaaacggtaatgttcgataaaactgggactattactcacggagtgccgcgcgttatgagggtccttttgttaggcgatgttgccacgctgcccttgagaaaggtgctggccgttgttggaacagcagaggccagttccgaacatccacttggtgtggccgtgactaagtactgtaaggaagagcttggaaccgagactctggggtactgcacagatttccaggctgtaccggggtgtgggatagggtgcaaagtaagcaacgtagagggcatcctcgctcattccgagaggccactgagcgcccccgctagtcacctgaatgaggccggatccctgccagccgagaaggacgccgtaccccagaccttttccgtgctgattggcaaccgagagtggctcagaaggaacggtctgactattagcagcgatgtatctgacgcaatgacggaccacgaaatgaagggccagacagctatccttgtggccatcgacggagtgctctgtggcatgatcgcgatcgcggatgccgtgaagcaggaggcagctcttgcggtccacactctccagtccatgggtgttgacgtcgtcctgatcactggggacaatagaaaaactgcacgcgccattgccacgcaggttgggataaacaaggtgtttgcggaagtcttgccctctcacaaagttgctaaagtgcaggagcttcagaataaggggaagaaagtggccatggtgggggacggggtcaacgacagccctgcactggcacaggcagacatgggggttgccattggaacaggaaccgacgttgcgatcgaggctgcagacgtggtgttgattaggaatgacctgttggacgtggttgcctcaatccacctgagtaagcgtaccgttagaagaatccgtataaatctggtacttgcactgatctacaacctagtcggtatccccattgctgctggcgtattcatgcccatagggattgttttgcagccatggatgggtagtgccgctatggccgcctcatctgtctctgtggtgcttagcagtcttcaactgaagtgctataagaagcccgatttggaaagatacgaagcacaggctcacggacatatgaagcccttgacagccagtcaggtatccgtgcatatcggtatggacgataggtggagagactccccgagagccacaccgtgggaccaggtgagctacgtgtcacaggtctctctatcttccttgacatctgataaaccgtcacgacatagtgctgcagctgacgatgatggtgataaatggagcttactgctgaatggcagggatgaggaacagtatatc

SEQ ID NO: 7408 - DNA, 4395 bp, Artificial Sequence
  Description of Artificial Sequence: Synthetic coding sequence
atgcccgaacaagaacgccagatcacggcaagggaaggggcaagcagaaagattctcagcaaactgtccctgccaactcgcgcatgggagcccgcgatgaagaaatcctttgcatttgataacgtcggctacgagggtggcctggatggactgggaccttcctcgcaagtggccacctcgacggtgcgaatactgggcatgacctgtcaatcgtgcgtgaaatctattgaagatcggatttctaacttgaagggaatcatatcaatgaaggtgtcacttgagcaggggtcagcgactgtgaagtacgtgccatccgtggtgtgtctgcagcaagtgtgccaccaaattggtgatatgggttttgaggcatccatagccgaaggtaaggcggcctcatggccatcgcgttcgttgccggcgcaagaagccgtggtgaagctgcgtgttgaaggcatgacctgccaatcttgcgttagctccattgagggaaaggttagaaaactgcagggagtggtaagggttaaagtgtcgctttcgaaccaagaagcagtcatcacctaccagccctatctgattcagcctgaagatctccgggaccatgtcaatgatatgggatttgaggcggcaattaagagcaaggtggcccccctgtcacttggtccaatcgatattgagagactccaatcgactaaccctaaacgccctctttcatccgccaatcaaaacttcaataactcagagacgcttggacatcagggaagccacgtggtgactttgcaactccgcattgatggaatgcactgtaagtcatgtgtgcttaacatagaagagaacataggccagctgcttggggtgcaatcaatccaggtcagccttgagaacaagaccgcccaggtcaaatacgacccttcatgtactagcccggtggcacttcaacgcgccatcgaggcgctgccacctggcaactttaaggtgtcccttccagacggcgcagaagggtcgggaacggaccacagatccagcagctcgcattcgcctggttcaccacctagaaaccaagtgcaagggacttgtagcactacgctgatcgccattgcggggatgacttgcgcttcgtgcgtccactcaatcgagggaatgatcagccagctcgaaggtgtccagcaaatcagcgtgtcgcttgctgagggaacggcaaccgtgctttacaacccttcggtcatctccccagaagaactgcgcgccgcaattgaagatatgggctttgaagcctcggtcgtctcggaatcttgttcaaccaacccactgggaaatcactcggcgggcaacagtatggtgcaaaccactgatggaacccctaccagcgtgcaagaagtcgcaccccacactgggagactgccggccaatcatgcgccagacattcttgcgaaatcgcctcaatccacccgagccgtcgcacctcaaaaatgttttctccaaatcaaaggaatgacctgcgcgtcgtgtgttagcaacatagaacgtaaccttcaaaaggaagccggagtgctctccgtgctggttgcacttatggcaggtaaggccgagatcaagtacgaccctgaagtgatacagcccttggagattgcacaattcattcaagaccttggatttgaagcggcggttatggaagattacgcaggttcggatggtaatatcgaactgactatcaccggaatgacttgcgcatcctgtgtgcacaatattgaatccaagctcacgaggaccaacggaatcacctacgcatcggttgcattggcaacctctaaagcactggtgaaattcgatccggagataattggaccacgggacatcattaagatcatagaggagattggatttcatgcatcgcttgcacaacgcaatcccaatgctcatcatctggaccataagatggagattaagcaatggaagaagagctttctgtgtagcctcgtgtttggtataccagtgatggccctgatgatttacatgctcatcccaagcaacgaaccacatcagtcgatggttctcgatcacaacattatccctgggctctccattctcaatctgattttcttcatcctctgtacttttgtccagcttcttggtggatggtacttttacgtgcaagcatacaagtccctccgacatcggtccgcaaacatggacgtgttgattgtgctcgcaacttcaattgcatatgtgtatagcctggttattctcgtcgttgcggtcgcagaaaaagcagaacgttctcccgtcaccttcttcgacaccccacctatgttgtttgtctttattgcactcggcagatggctcgaacatctcgcaaagtccaaaaccagcgaagcacttgcaaagctgatgtccctgcaagcaactgaggctaccgtggtgactcttggagaagataatctgatcattagggaggagcaggtgccgatggaacttgttcagaggggagacatcgtgaaagtagtgcctggaggcaagttccctgtcgatggaaaagttctcgaaggtaatactatggcagacgaatcactgattaccggagaggcaatgccagtaaccaagaagccaggatcgactgtgattgcgggcagcatcaacgcacatggatctgtgctgatcaaagcaacccatgtcggaaatgacactactcttgctcagatcgtgaagctggtggaagaagcccaaatgagcaaggcaccgatccaacagcttgcagatagattttcagggtatttcgtgccctttatcataatcatgtccacgctgactctggtggtctggattgtgataggcttcatcgattttggcgtcgtgcaaaggtactttccgaaccctaataagcatattagccaaactgaagtgatcattcggttcgcattccaaacgtcaatcaccgtgctctgcattgcctgtccctgttcgcttggactcgcaacccctactgccgtcatggtcggaactggtgtcgcagctcagaacggaatactcataaaaggtggcaagccactggagatggcacacaagataaagaccgtcatgtttgataagaccggaaccatcactcatggtgtgcctcgcgtgatgcgcgtcctgctcctcggggacgtggcgacgcttcctcttagaaaggtcctggcagtggtgggcactgcagaagccagctcggaacaccccctcggagtggccgtgaccaagtattgtaaggaagagcttggcaccgaaactctgggatactgcaccgatttccaggctgtcccagggtgtggaattggttgtaaagtgtcgaacgtggagggaattttggcacactccgaacggccgctgagcgcgcccgccagccatctgaacgaagcaggatcgctgcctgctgagaaggatgctgtgcctcagacctttagcgtgctcatcggaaaccgagaatggcttcgccgtaatgggctcactatttccagtgacgtgtcagatgccatgaccgatcatgaaatgaaaggacagaccgcaattctggtcgcaatcgacggagtcctgtgcggtatgattgccattgctgatgccgtgaagcaagaagcggcacttgccgtgcacaccctgcagagcatgggagtcgatgtcgtgctgataactggagacaatcgtaagactgccagagcaattgcgacccaagtggggatcaacaaggtgttcgcagaagtgcttccatcgcataaagttgctaaagtgcaagagcttcagaataagggaaagaaggtcgctatggtgggggatggtgtcaatgactcccctgcccttgcacaggcagacatgggtgtggctattggcaccggaaccgatgttgcaatcgaagcagcggatgtggtgctgattcggaacgatcttcttgatgtggtcgcatccattcatctgtcaaaacggaccgtcagaagaattagaattaacctggtactggcactgatctataacctcgttgggatccctattgctgcgggagtctttatgccaataggtatcgtactgcagccttggatgggatctgcagccatggccgcatccagcgtgagcgtggtcttgagttccctgcagctgaagtgttacaaaaagcccgatcttgaacggtacgaagcccaagcgcatggtcacatgaagccacttacggcaagccaggtgtcggtccatattggtatggacgatagatggcgggattctccaagagcgacgccttgggaccaggtttcatacgtgagtcaagtgtcgctcagctctcttacctccgataaaccaagcagacattccgctgcagcagacgacgatggagataagtggtccctccttttgaacggccgcgacgaagaacagtacatt

SEQ ID NO: 7409 - DNA, 4395 bp, Artificial Sequence
  Description of Artificial Sequence: Synthetic coding sequence
atgccagaacaggagcggcagattactgcgcgggaaggcgcctcccgcaaaatcctttcgaagctgagcctgccgactcgcgcttgggaacctgccatgaagaagtcatttgcgttcgacaatgtcggttatgaaggaggactcgacggtttgggtccgagctcccaggtggctacttccaccgtgcgcatcctgggcatgacttgccagtcctgcgtcaagtcaatcgaagatcgcatctcgaacctcaagggtatcatatccatgaaggtttcactggaacagggctcagcgaccgtgaagtacgtaccttcagtagtgtgcctccagcaggtctgccatcagatcggcgatatgggcttcgaggcttcgatcgccgagggaaaggcggcgtcatggccgtcacggagcttgccggcgcaagaggctgtcgtcaagctgagggtggaaggaatgacgtgccagagctgtgtgagctcaatcgagggcaaggttcgcaaattgcaaggtgtcgtccgtgtaaaggtgtccctgtccaaccaagaagccgtgatcacttaccagccatacctgatccaaccagaggatctcagagatcacgtcaacgacatgggttttgaagcagccatcaagtcgaaggtggcccccctctcgctggggccaatcgatatcgagcggttgcaatcgaccaaccccaagcggcctctgagctctgccaaccaaaatttcaacaactcagaaaccctcggtcaccaggggtcccacgtggtcactctgcaactgcggatcgacggcatgcactgtaagtcctgtgtcctcaacatcgaggagaacattggacaactcctgggagtgcagtcgatccaggtgtcgctcgagaacaagaccgcccaggtgaagtatgacccctcgtgtactagtccggtggccctgcaaagggcaatcgaggccctgccgcccgggaactttaaagtctcgctgccggacggcgcagaagggagcgggacggaccaccggtccagctcatcgcacagccctggatctcccccgagaaaccaggtccagggcacttgttcgacgactttgatcgcgatcgcgggtatgacgtgcgcttcgtgtgtgcactcgattgagggcatgatctcacagctggaaggagtgcagcagatatcagtgagtctggcggaaggaaccgcaaccgtcctctacaaccctagcgttatcagccctgaagaactgcgtgctgctatcgaagatatgggattcgaggcgtcggtggtgtccgagtcgtgtagcaccaatccactgggaaatcattcggcgggaaattccatggtccagactaccgacggcaccccaacttcagtgcaagaggtcgccccacacaccgggagacttcctgcaaaccatgcgcctgatatcttggccaagtccccgcagtccaccagggcagtggctccgcaaaaatgtttcttgcaaattaagggtatgacttgcgccagctgcgtgtccaatattgaacgaaatctgcagaaggaagccggagtgctgtccgtgcttgtggcactcatggcaggtaaagcagaaatcaagtacgatccggaagtgattcagccactcgagatcgctcagttcatccaagatctggggttcgaggccgccgttatggaggattacgcaggatccgacggaaatatagaattgaccatcaccggaatgacctgcgcctcgtgcgtccataatatcgagtcaaaacttactcgcaccaatggaatcacttacgcatcggtcgctcttgctacctcgaaagcgttggtgaagtttgacccagaaatcatcggtccacgcgacattatcaaaatcatcgaagagatcggctttcacgcctcactggcccaacggaatccaaacgcccaccacctcgaccacaaaatggagatcaagcagtggaagaaatccttcctgtgctcgctggtcttcgggatcccggtgatggcactcatgatctacatgctcatcccttccaatgaaccacatcagagcatggtgctcgaccacaacatcatcccgggattgtcgatcctcaacttgatctttttcattctctgcacttttgtgcaacttctgggaggatggtacttttacgtccaagcgtacaaatcacttaggcacagatcagctaacatggacgtcctgatcgtgctcgccacctccattgcctacgtctactcgctcgtgattctggtggtcgctgtagcagaaaaagccgaacgcagcccggtcactttcttcgacacccctccaatgctgtttgtgttcatagcgctcggacggtggctggagcacctggccaagtcgaaaacgagcgaggctctcgctaaactcatgagccttcaggccaccgaggcgactgtggtgacgctcggagaggacaacctgatcatccgcgaggaacaggtgccaatggagctggttcagagaggcgacatcgtaaaagtggtgcccggaggaaagttccctgtggacggaaaggtcctggagggaaacaccatggctgacgagtccctgatcactggggaagctatgccggtgaccaagaagcccgggtctaccgtgatcgcaggctcaatcaacgcccatggcagcgtgctgattaaggccacccacgttggcaatgatacgactctggcgcagattgtcaagctggtagaggaagcccagatgtcaaaggcacccatacaacaacttgcagaccgcttctccggctacttcgtgccgttcattatcatcatgagcaccctgactcttgtggtgtggatcgttatcgggttcatcgatttcggagtggtgcagagatacttcccgaacccgaacaagcacatctcgcaaaccgaagtcatcataagattcgcattccaaacgtcgatcactgtgctgtgcattgcatgcccgtgctcccttggccttgctaccccgactgccgtgatggtcgggactggcgtggcagctcagaatggaatccttatcaaaggaggcaagcccttggagatggctcataagatcaaaaccgtgatgttcgataaaaccggaaccatcactcatggagttccgagggtgatgcgcgtcctccttctcggagacgttgcgactctccccttgagaaaggtgctggcggtcgtcgggaccgcggaggctagctccgaacatccgctgggagtcgcggtgaccaagtactgcaaggaagagctgggaaccgaaaccctgggctactgcactgatttccaggccgtccctggctgcggaatcggatgcaaagtgtcaaatgtcgaaggaatcctggcccatagcgaacgcccactgtccgccccggcctcccatctcaatgaggccggatcactgccggcggaaaaggacgcggtacctcaaactttctctgtgctgattggaaatagagaatggctccgccgaaatggactgactatctccagcgacgtttctgacgccatgaccgaccatgagatgaaggggcagacggcgatcctggtggcaatcgacggagtgctgtgcggaatgatcgcgattgccgacgccgtgaaacaggaggccgcccttgcagtccacacgctgcaatcaatgggtgtggatgtggtgctcatcaccggagacaacagaaagactgcgcgcgccatcgccactcaggtgggaatcaacaaggtgttcgcggaagtgctgccgagccacaaggtggccaaagtgcaggagctccagaacaagggcaagaaagtcgccatggtgggcgatggggtgaacgattcgccggcgcttgcccaggcggacatgggagtggctatcggaactggtaccgacgtggcaatcgaagccgcagacgtggttctcatccgaaacgacctgcttgatgtggtggcctcgattcacctgtctaagcgaaccgtgagacgcatccgcatcaatcttgtcttggctcttatttacaacctcgtgggcattccgatcgccgcgggtgtgtttatgccgatcggaatcgtcctgcaaccgtggatgggatcggcggccatggcagcctcttcggtgagtgtcgtcctctcctctctccagctgaagtgctacaaaaagcccgatctggaaaggtacgaagcccaggcacatggacatatgaagccacttaccgcgagccaagtctccgtgcacatcgggatggacgatcggtggcgggattcacctcgggccacgccgtgggaccaagtcagctacgtgagccaggtgagcttgtcgtccctgacttcggacaagccatcccggcattccgcagcggcggacgacgacggagataagtggtcgctgctgctgaacggacgcgatgaagaacagtatatt

SEQ ID NO: 7410 - DNA, 4395 bp, Artificial Sequence
  Description of Artificial Sequence: Synthetic coding sequence
atgcctgagcaggaaaggcagatcactgccagagagggtgcctcccgtaaaatactcagcaaactgagcctcccaacaagggcatgggagccggcaatgaagaagtcattcgccttcgacaatgtgggctatgaggggggtcttgacgggctcggcccttctagccaggtggccacgagcactgtcaggattttgggtatgacctgccagagttgcgtcaaaagtatagaagatcggatcagcaaccttaaagggattattagcatgaaagtgagtctagaacaggggagtgctaccgtaaagtacgtcccatcagtcgtgtgcttgcagcaagtgtgtcaccagatcggagatatggggtttgaggcttctatcgcagagggcaaagccgcctcctggccatcacgaagtctccccgcccaggaggccgttgtgaagctgagagttgaagggatgacctgccagtcttgcgtgagcagtatagagggaaaagtgcgaaaactccaaggtgtggttagggtgaaggtgtctctcagtaaccaggaagctgtaattacttaccagccgtacctcattcaacccgaagacttaagggatcacgttaacgacatgggatttgaggctgccatcaaatcgaaggttgctccgctgtcactgggcccgatagacatcgagagactgcagtctacaaaccccaaacgacctctttcaagcgcgaatcagaacttcaacaacagcgagacactcggccatcaggggagtcacgtggtgacactgcagctgcgtatcgacgggatgcattgcaaatcatgtgtcctaaacatcgaagaaaacattggtcagctgcttggggttcagtcaatccaggtttccctggaaaacaaaacggcccaggtaaagtacgacccttcgtgcaccagtcctgtggctctccagcgagctatagaggcacttccaccaggcaattttaaagtgagcctgccagacggggccgagggaagtggcaccgaccatcggagctccagctcccattcacccggcagccctccacggaatcaagttcagggtacgtgttctacgacactgatcgcaatcgcgggaatgacatgcgcctcatgtgtacacagcattgaaggcatgatcagccagttggaaggagtgcagcagatctccgtgtctctcgccgagggcacagccacagttctgtataacccatctgtaatctcacctgaggagctgcgcgccgcgatcgaagatatggggttcgaggcatccgtcgtgtcggagtcttgtagcacaaatcccctgggaaatcacagtgctggcaatagcatggtccagaccaccgacggcacccccacaagcgtacaggaggttgccccccacaccggaagactgcctgccaatcatgcacccgacatcctagctaagagtccacaaagtacacgggccgtagctcctcagaaatgctttctacagattaaagggatgacatgcgccagctgtgtctcaaatatagaaagaaaccttcaaaaggaagccggcgtcctgtccgtgctggtggctcttatggcgggaaaggctgagataaagtacgaccctgaagtcattcagcctctggaaatcgcacagttcatccaagacctgggctttgaagccgccgtcatggaggattatgccggaagtgacggcaatattgagcttaccatcacagggatgacttgcgcctcctgtgtgcataacatagaatccaaactgacacggaccaacgggatcacctacgcatccgtggctcttgccacatctaaggccctggttaaatttgacccggaaatcataggcccacgggacatcatcaaaattatcgaggaaataggatttcatgcctctctcgctcagaggaaccccaatgcccatcatctggatcataagatggagatcaagcagtggaaaaagtccttcctgtgcagtctagtttttggaattcccgtgatggcgcttatgatttacatgttgattccatccaatgaaccacatcaaagcatggtcctggatcataatataattcctggccttagcatcctcaacctgatttttttcattttatgtaccttcgtccagctgcttggtgggtggtacttctacgtccaggcctacaagtcactgaggcatcgcagcgcaaacatggacgttttaattgttctggcgacatcaatagcatatgtctacagtctggtcatcctggtagtggctgtcgcagagaaagcagagagaagtcccgtgactttttttgatactccacctatgctcttcgtgtttattgctctcggccgatggctggagcacctggccaagtcaaaaacctcggaagctttagcgaaattaatgtcactgcaggccactgaggctaccgttgttacattaggtgaagataacctgattatacgtgaagaacaggtgccaatggagctggtgcagaggggtgatatagtcaaggtggtgcccgggggaaaatttcccgtggatggcaaggttctagagggaaacacgatggctgacgagtcactcatcaccggagaggcgatgccggtgaccaaaaaacctggcagcacagtaatagctggcagcatcaacgcccatggatccgtgctgattaaggccacacatgtgggaaatgatactactctggcgcaaattgttaagttagtggaagaggcccagatgagtaaagcccccatacagcaacttgcagaccggttctcaggctattttgttccgtttatcattattatgtctacattgaccctggtggtgtggattgtcatcggatttattgatttcggcgtcgttcagcgctacttcccgaatcctaataagcacatctctcaaaccgaggtgattattaggtttgcatttcagacgagtatcacggtcctgtgcatcgcgtgcccctgttctctgggcctggccacccctacagctgtgatggtgggaaccggcgtggcggcacaaaatggaatattgattaaggggggtaagccactagagatggcccacaaaatcaagacagtcatgttcgacaaaacaggaacaataacccacggagtaccccgggtcatgcgcgtgctgctactgggcgacgtcgccacgttaccgctccggaaggtgctggccgtcgtgggcactgccgaggcatcctcagagcacccactgggagtcgcggttaccaaatactgcaaggaggaactcgggaccgagaccctcggatattgtaccgacttccaagccgtcccgggatgtggcatcggctgtaaagtgtcaaatgtggaagggatcctggcccactccgagcgtccccttagcgcccctgcttcgcatttgaatgaagctggctctctgccagcagaaaaggatgcagttcctcaaaccttttcagtgttaattggaaaccgcgagtggctgcgaaggaacggactgaccataagtagtgatgtttctgatgctatgacggatcatgagatgaagggacagaccgctattctagtagccattgacggagttctgtgcggtatgatcgccatcgcggacgcggttaaacaggaggcggcgctagctgtccatacacttcagagtatgggtgtagacgtggtgcttatcaccggggacaacagaaaaacggcgcgcgctatagcaacccaggtgggaataaataaggtgttcgctgaggtgttgccgtcacataaagtggcaaaagtgcaggaactgcagaacaagggcaaaaaggtagccatggtgggggatggggtgaacgattcgcccgcactcgcacaggccgacatgggcgttgcgatcgggacaggaaccgacgttgcgattgaggcagcggatgtagtgctaattcgaaacgatctcctggacgtggtcgccagcatccacctatcaaagcggactgttagacggatccggattaacctcgttctggctctgatatacaaccttgtggggattccgatcgccgcgggcgtgttcatgcccattggaatagttctgcaaccatggatgggcagtgccgcaatggctgcttcgtccgtgtcagttgtgctctcctccctgcaactgaagtgctataagaaacccgacctcgagcgatacgaggcacaggcccacgggcatatgaagcccttgacagcttctcaggtgtctgtgcacatcggcatggacgataggtggagagatagtccccgtgctaccccctgggaccaggtgtcttatgtatcgcaagtgagtctgagctcactgacaagtgataagccaagtcggcacagcgctgcggctgacgacgatggggacaagtggagcttactcctaaacggaagggatgaggagcagtacata

SEQ ID NO: 7411 - DNA, 4395 bp, Artificial Sequence
  Description of Artificial Sequence: Synthetic coding sequence
atgccagaacaagaaagacagatcaccgctagagagggggcttcgcggaagattctctcaaagctgagcctgcctacgcgggcctgggaaccagctatgaaaaagtccttcgcctttgacaatgtgggttacgaaggaggactggacggcttgggaccctcgtcgcaggtggcaacttctactgttagaatcctcggtatgacctgccagagctgcgtgaagagcatcgaagatcgcatctctaatcttaaaggaatcatctccatgaaagtctctttggaacagggatcagccactgtgaaatacgtgccaagcgtggtgtgtctgcagcaagtgtgccatcaaatcggagatatgggcttcgaggcttccattgcggaaggaaaggctgcctcgtggccaagccgctcactgcctgctcaggaagccgtcgtgaagctgagagtggaaggaatgacctgccaatcctgtgtcagctcgatcgaaggcaaggtgagaaagctgcagggggttgtgcgcgtgaaggtgtccctgtccaaccaggaagccgtgatcacttatcagccgtacttgatccaaccggaggatctgcgggatcacgtgaacgacatgggctttgaagccgcgatcaaaagcaaggttgcaccactctccctggggccaatcgacatagaaaggctgcagtcgaccaacccgaaacgcccgctgagctcggccaatcaaaactttaacaactccgagacgttgggacaccagggatctcacgtcgtgaccctgcaactgcgcatcgacggaatgcactgcaagtcgtgtgtgttgaacatcgaggaaaacatcggccagcttctcggtgttcagagcatccaagtctccctggagaacaaaactgcccaagtgaaatacgacccgtcctgcacctcacctgtggccttgcagagggcgatcgaggcactgccccccggtaatttcaaagtgtcactgccggacggcgccgaaggatccggaactgatcatagatcgagctcctcccactctcccggctcgccgccacggaaccaggtgcagggtacttgctcaactactcttatcgccattgctggaatgacgtgtgcgagctgtgtgcacagcattgagggaatgatctcccaactggaaggtgtgcagcaaatctccgtgtcgctggccgagggcaccgccaccgtcctctacaacccatcagtgatttccccggaggagttgagggcagccatcgaggacatgggattcgaagcctccgtcgtgagcgaatcctgctccactaacccactcggtaaccactctgccggtaattccatggtccaaacgactgacggcaccccgacttcggtgcaagaagtggcgccgcacaccggacggctgccggccaatcacgcaccggacatcctggcgaagtccccacagtcgaccagagcggtcgcaccgcaaaagtgctttctccagatcaagggcatgacctgtgcgagctgcgtctcgaatatcgaacggaatttgcagaaagaagctggcgtgctgagcgtcctggtggcgctgatggcggggaaggcggagatcaagtatgaccctgaggtgatccagccactggagatcgcacaattcatccaggaccttggtttcgaagcggcggtaatggaggattacgctggatcagatgggaacatcgaactgacgatcaccggcatgacttgcgcgagctgcgttcacaacatcgaatcaaagttgaccagaaccaatgggatcacttacgcgtcagtcgcgctggccacttcgaaagccctcgtcaaattcgacccagagattattggacctagggacatcatcaagattatcgaagagatcggtttccatgcttcgctggctcagcggaacccgaacgcgcatcatctggatcacaaaatggaaatcaagcagtggaagaagtcgttcctgtgcagcctggttttcggaatcccggtcatggccttgatgatttacatgctcatcccgtcaaacgagccgcatcagtcaatggtcttggaccacaatatcattccaggtttgtcgatcctcaatctgatcttcttcatcctgtgcactttcgtccaactcttgggagggtggtacttctatgtgcaggcctacaaaagcctgcgacaccgctcagcgaatatggacgtgctcattgtgctcgccacttccatcgcctacgtctactcacttgtcatcctggtcgtggccgtggcggagaaagcagagcgcagccctgtgacttttttcgacactccaccaatgctgttcgtgtttatcgctcttggaaggtggctggaacacttggcaaagagcaagacctccgaggcgctcgcgaagctgatgagcctccaggcgacggaagcgaccgtcgtcacgctgggtgaggacaatctgatcatacgcgaggaacaagtgccgatggaactcgtgcagcggggcgacattgtcaaggtggtgccggggggtaagtttccggtcgacggcaaagtgctcgaaggaaacaccatggccgatgaaagcctcatcactggagaggccatgcctgtcactaagaagccaggatcgactgtcatcgccggcagcatcaatgcacatggatcggtgctcattaaggcgactcatgtgggaaacgacactaccctggcccagattgtgaagctggtggaggaagcccaaatgtccaaggctccgatccagcagctggccgaccgtttctcaggatacttcgtgccattcatcatcatcatgagcacgctcacgctggtggtgtggatcgtcattgggtttattgatttcggcgtcgtgcagagatacttcccaaacccaaataagcacatttcgcagactgaagtgatcatccggttcgctttccagacttccatcactgtcctgtgcatagcatgtccctgctccctcggcctcgcaacgccaaccgcggtgatggtgggcactggcgtggctgcgcaaaacggaatcctgattaaagggggcaagccgctggagatggcgcacaagatcaaaaccgttatgttcgacaaaaccggaactattacccacggcgtcccgagagttatgagagtgctgctgcttggagacgtggctaccctcccgctcagaaaggtcctggcagttgtgggcaccgctgaggcgtcctcagaacaccccctgggagtcgcggtcactaagtactgtaaggaagagctcggaaccgaaacgcttggctactgcacggacttccaggcagtgccgggatgcggtatcggttgcaaggtgtcaaacgtcgaaggcatcctcgctcattccgaaagaccgctgagcgcaccggcgtcacatctcaatgaagcggggtcgctccctgccgaaaaagacgcggtgccacagacgttctccgtcctcatcggcaaccgcgagtggctgagacggaacggcctgactatctcatccgacgtgtcagatgccatgacggaccacgagatgaagggacagactgcgattctggtggccatcgacggagtcctctgcggaatgatcgccatcgcggacgcagtgaaacaagaggcggctctcgctgtccatactctgcagagcatgggagtcgatgtggtcctcattactggggacaaccgaaaaactgcgcgggctatcgctacccaggtgggcatcaacaaggtctttgccgaggttctgcctagccacaaagtggcgaaagttcaggagctgcagaataaaggcaagaaggtggccatggtgggagatggagtgaacgatagccctgcgctcgcacaagccgatatgggagtggctatcggaaccggaaccgacgtcgcgatcgaggctgcagatgtcgtgctcatccgcaatgacctgctggatgtggtcgcttcaatccatttgtccaagcggacggtgcgccggattcgaatcaacctggtgctggctcttatctacaaccttgtgggaatcccaatagctgccggtgtctttatgcctattggaatcgttctgcagccatggatgggctcggccgcaatggccgcctccagcgtgtcggtggtcttgtcgtctctgcagcttaaatgctacaagaaaccggaccttgaaagatacgaggcccaggcgcatgggcacatgaaaccccttaccgcgtcgcaggtttccgtccacattgggatggacgatagatggagagatagcccacgggcaactccgtgggatcaggtcagctacgtgagccaggtgagcctgtcctctctgactagcgacaagccctcgcgccattccgccgctgccgacgatgatggagacaagtggtcccttctcctgaatggtcgggacgaagagcaatacatc

SEQ ID NO: 7412 - DNA, 4395 bp, Artificial Sequence
  Description of Artificial Sequence: Synthetic coding sequence
atgcctgaacaggaaaggcagataactgccagggaaggagcatctcgcaaaatcctatctaaactgagtttacctacacgagcatgggaacccgccatgaagaaatcattcgccttcgataacgtcggatatgaaggagggctcgacgggctgggaccttccagtcaggttgccacttccactgtccggatccttgggatgacatgccagtcctgtgtgaaatctatagaagatagaatctctaacttaaaaggaatcatctctatgaaggtgtctttggaacaggggtccgctacagtcaagtacgtgccttccgtggtgtgcctacagcaggtgtgccatcagataggagacatgggattcgaggcaagtatagccgaggggaaagcggcgtcttggccatcgaggagtctccccgcccaggaagcggtggtaaagctgcgggtggaggggatgacttgccaatcttgcgtttcatctatagaaggaaaggtaagaaaattacagggggtggttagagtgaaagtttccctctcaaaccaggaagctgtgatcacttatcagccttacttaatacagcccgaagatctgagggatcacgtaaacgatatggggtttgaagcggcaattaaatctaaagtggcccccttatctctaggacctatcgatatcgaacgcctgcagtctacaaatcctaaaagacccctttctagtgctaaccagaacttcaacaattcagaaacactcgggcatcaggggagtcatgtggtgacactgcaactacggatcgatggaatgcactgcaagagttgtgttctaaacatcgaagagaacatagggcagcttcttggagttcagtctatacaggtgagtctggaaaacaaaactgcccaggttaaatacgatcccagttgtacttctccagtagctctacagcgggcaatcgaagccctcccgcccgggaatttcaaagtgagtctcccagatggggccgaaggatccggaactgatcataggtcaagttcctctcactctcctggaagtcctcctcggaatcaggtccagggaacatgttctactacactaatagccatcgctggaatgacatgtgcatcttgtgtgcactcaattgaagggatgatctcgcagctcgaaggagtacagcagatctctgtgtcgctcgccgaagggacagccactgtgctctacaacccgtccgtgatcagtcctgaagaacttcgagccgcaatagaggacatgggattcgaggcctccgttgtctctgaatcctgctccactaaccccctaggaaaccactctgccggaaattccatggtgcaaactacagacggaacacctacttccgtacaagaagtggccccacacacaggacggttaccagcaaaccacgctcccgatatcttggcaaaatcccctcagtcgacacgtgcagtagcaccacagaaatgctttcttcagatcaaaggaatgacatgcgcttcatgtgtgtccaacatagaacgaaacctccagaaggaagcgggagttttgtctgtgctcgtagccttaatggctggaaaagccgaaataaaatatgatcctgaagtcatccagcctctcgagatagcccagttcatacaggatctcggattcgaagcagccgtaatggaagactacgcgggatccgatggaaacatcgaactcactatcacaggaatgacatgcgcctcctgcgtgcacaacatagaatctaaacttacacggacaaatggaatcacatacgcttccgtggccttagccacaagtaaagctttggtgaagtttgacccagagattatcggacctcgcgatattataaaaataatagaagagatcgggtttcatgcaagtcttgcccagaggaatccaaatgcccaccatctggaccataaaatggaaatcaagcagtggaaaaaatctttcctctgttccttagtgttcggaattcccgttatggctctcatgatttacatgctcataccgtctaatgaaccacatcagagtatggtcctcgaccataatataatacccggattatccatcctcaacctcatattttttatcctgtgtactttcgtgcagcttctcggagggtggtacttttatgtgcaggcatataaatcccttagacaccggtcagcgaacatggacgtcctaattgtgctcgcaacatctatcgcatacgtctattcactcgtgatcttggtggtcgcagtggcagaaaaggcggaaagatcacctgtgacttttttcgatactccacccatgctctttgtgtttattgctctggggaggtggctcgaacatctcgccaaatcaaaaacatctgaagccttagcaaaattgatgtctttacaggccactgaggcaacagtggtaacactgggagaagataaccttataatcagagaagaacaggtaccaatggaactagtccagcgaggagatattgtgaaagtcgtccctggaggaaagtttcctgttgatgggaaagtactggaagggaatactatggcagatgaatcactgatcacaggggaagccatgcctgtaacaaaaaaacctggatctactgtaatcgctgggtccataaatgctcatggaagtgtgctgataaaggccacacacgtaggaaatgacacgactttagcgcagatagtcaagctagttgaagaggcacagatgtcaaaagcaccaatacagcagctggcagatagattttccgggtatttcgtgccctttataatcataatgtctacattgactttagtcgtttggatagtgatcggatttatcgattttggagtggtgcagagatacttccccaatcccaataaacatatttctcagactgaggttataattcgattcgcttttcagactagtatcactgttctctgcattgcctgtccatgctccctcggactcgctactcccacagccgttatggtcgggactggggtagccgcacagaacggaattcttatcaaagggggaaaaccccttgaaatggctcataaaataaaaacagtgatgttcgataaaactgggacgatcacacacggagttcccagagtgatgagagtcctcctactcggagatgtcgctactctccctttgagaaaagtcctcgccgtggtcgggacagccgaagcctcttccgaacaccctctcggggtcgccgtcactaaatattgcaaagaagaactcggaactgaaactctcggatattgcactgatttccaggcagtgcccgggtgcgggataggatgtaaagtatctaatgtagaagggattcttgctcactcagaacggccactttccgctcccgcatcccatctcaatgaagccgggagtctccctgccgaaaaagatgctgtgccccagacttttagtgttctcatagggaacagggaatggctccggaggaatgggctgactataagttccgatgttagtgatgctatgacagatcacgaaatgaaaggacagacagctatcctggtagccattgatggagtgttatgcggaatgattgccatagctgatgctgtaaaacaggaggctgccctcgctgttcacacactacagagtatgggagtcgatgtggtacttataactggagataatcggaaaactgcacgggctatcgctacacaggtcgggattaacaaagtgtttgcagaagtgctgccatcacacaaagtcgccaaggtacaggaacttcagaataagggaaaaaaagtggccatggtcggggatggggtaaatgatagtccagctctcgcacaggccgatatgggggtggctattggaacaggaactgatgtcgccatagaagccgctgatgtggtgctcatccggaacgacttactagatgtcgtcgcctctatacaccttagtaaacgaactgtcagaagaatccggattaatctggtgttagccctgatctacaatctggtaggaatacccatcgcagccggggtctttatgcccatagggatagttctgcagccctggatggggtcagccgccatggctgcaagttctgtttccgttgtgctgtcctcactgcagcttaaatgttataagaagccagacctcgaaaggtatgaagcacaggcgcacgggcacatgaagcccctaactgccagtcaggtttccgtccacatcgggatggacgaccgctggcgagattctccccgagcaacaccatgggatcaggtgagttatgtctcacaagtgtcattaagttctctgacatcagataaaccatcccggcactctgctgccgctgatgacgatggggataagtggagtttactgctaaatgggcgcgatgaagaacagtatatc

SEQ ID NO: 7413 - DNA, 4395 bp, Artificial Sequence
  Description of Artificial Sequence: Synthetic coding sequence
atgcctgagcaggagaggcagattaccgcacgcgaaggggcatccaggaagatcctcagcaaactttctctccccacccgtgcttgggagccggctatgaagaagagcttcgcctttgataacgtagggtacgagggaggactggacggactaggaccaagctctcaggtggccactagcacggtacgcatcctgggcatgacatgtcagtcatgcgttaaatcgatcgaggatcgcatctccaacttgaaagggattatctccatgaaggtatccttggaacaaggttctgcaacagttaagtatgttccttccgtcgtgtgcctacaacaagtttgtcatcagataggagatatgggttttgaagcctctatcgccgaaggcaaggcggcgagctggccctctcggagtctgcctgcacaggaggccgtggtgaagctgcgggtcgaaggcatgacgtgccaatcttgtgtgagtagtatcgaaggtaaagtgaggaaactgcagggtgtggttcgcgtgaaggtttcactttccaatcaggaggcagtgatcacctaccagccttacctgatccaaccggaagatctccgggatcacgttaacgacatgggcttcgaagccgcaatcaagtcaaaagtcgcccccctgtctttaggacccattgacattgagcgtctgcagagtacgaacccgaagcggcccctgtcgtccgctaatcagaattttaataattccgaaacactgggccatcagggcagccatgttgtgacacttcaacttcgaattgacgggatgcattgtaagtcatgcgtgctcaatatagaggagaatatcggtcagctcctgggcgtgcaaagcatccaagtctcactggaaaataagaccgcccaggtgaagtacgatccaagttgtacctcccctgttgcccttcaaagagccatcgaagccctgccacccggtaattttaaggtgagcctacccgatggggccgaggggtctgggacagaccacaggtcctctagctctcattcgcccggttcccccccccgaaatcaggtgcagggaacctgctccactacactgattgctattgctggcatgacttgtgcctcctgcgtccactctatcgaggggatgataagtcagttagagggggtgcagcaaatatcagtgtccctggctgagggaaccgcaacggtgctgtacaacccctccgtaatctcccctgaagagctacgggccgcaatcgaagacatggggtttgaagcctccgtggtttcagaatcctgttccaccaacccgcttggaaaccacagtgctggcaacagtatggtacagacaacagacggcacccccacttcagtgcaggaagtggccccccacactggccgactacccgcaaatcacgctccagacatcctggccaaaagcccccagtctacacgggctgtcgctccgcagaaatgtttcctccaaattaagggtatgacctgcgcctcatgcgtgagtaacatagaacggaatcttcagaaggaggccggagttctgagtgttctggttgccctcatggccggaaaggcagaaatcaagtatgaccctgaagtgatacaaccactcgaaattgcgcagttcattcaggatctgggctttgaagccgccgtgatggaggactacgccggctcagacggcaacatcgaactcaccatcacaggaatgacctgtgcgtcttgcgtgcacaacatcgaatctaaactcactaggactaatggcataacttacgcctccgtggctctggcaaccagtaaggctctcgtaaagtttgaccccgaaatcattgggcctagggatatcattaagatcattgaagagatcggctttcatgctagtttggctcagcgcaatccgaacgcacaccacctcgaccataagatggagatcaagcaatggaagaaatcattcctatgtagtttagtgttcgggattcccgtgatggctctcatgatatatatgctgattccttccaatgagcctcaccagtctatggtcctggaccacaatattattccagggctgtctatattaaacctgatttttttcatcttatgcacttttgtacagctgcttggcggctggtatttttacgtacaggcctacaaaagtctgagacatagatccgctaacatggatgttctgatagtgctggctacttccatcgcttacgtgtattcactggtgatactcgttgtcgccgttgcagagaaagccgaacgatctcccgtgacctttttcgacacccctcctatgctatttgtgtttatcgcccttgggcgctggctggagcaccttgccaagtctaagacgtcagaagccctcgccaagttgatgtccctccaggctacagaagcaactgtcgtgacactaggggaggacaacttgattataagagaagagcaggtaccaatggaactggtccagaggggcgacatcgtaaaggtggtacccgggggcaaattccctgttgatgggaaggtgcttgaaggcaataccatggccgatgagtctttaatcactggggaggcaatgccggttacgaaaaaaccggggtctacggtcatcgctggctcgatcaacgcccacggctccgtgctgattaaggccacccacgtcgggaacgacaccaccctggcccaaatcgtcaaactggtcgaggaggctcagatgtcaaaagcccctatccagcagttggccgacagattcagtggatacttcgttcccttcataattatcatgagcaccctgactttagtcgtctggatagtcatcgggttcattgacttcggtgtggtccagaggtatttccctaaccccaataaacacatatcccagacggaagtaatcatccgttttgcttttcagacgtccattacggtcctctgcattgcctgtccctgctctctgggcttggctacccctactgccgtcatggtaggcactggagtggcagcgcagaacggcatcctgatcaagggggggaagcccctggaaatggctcacaagattaagactgtgatgtttgacaaaacggggactatcactcatggcgtgccgcgcgtgatgcgtgtgctgctccttggtgatgtcgccactctgcctttgcgaaaggtccttgccgtagttggaactgcggaagcttcaagtgaacacccacttggcgtcgctgtgaccaaatactgcaaagaggagcttggcactgagacactcggctactgtacagactttcaagccgtaccaggttgcggaatcggttgtaaggtttcgaatgtggaaggaatactcgcccactctgagaggccattaagcgccccagcctctcacctgaacgaagccggaagtctacccgccgagaaggatgcagtgcctcagaccttttccgtgctaatcgggaaccgggagtggctgcgcaggaatggcttgacaatctcctccgacgtcagcgatgcaatgacagaccacgaaatgaaagggcaaaccgccattcttgtagcgatagatggagtgttgtgtggtatgattgcaattgcagacgctgtgaagcaggaagcggctctagcggtgcacactctgcagtcaatgggtgtcgatgtggtattaattaccggtgacaataggaaaactgcacgggctattgccacacaggttggcataaacaaggtttttgctgaggttctccctagccacaaagttgccaaggtacaggaactccagaacaaaggaaagaaggttgccatggtaggagatggggtaaatgacagtcctgctctggctcaagcggatatgggagtggcaatcgggacaggtacggatgtcgcaatcgaagcggctgacgtggtcttgattcgtaacgacctgctggacgttgtggcctcaattcacctgtcaaagagaactgtgcgtagaattcgcataaatctggtactggctctaatctataacctggttggtatccccattgccgcaggggttttcatgcctattggaattgtgctccagccctggatgggctccgctgctatggctgccagctcagtgtccgttgtgctgtcttctctgcaactgaagtgctacaagaaaccggatctggagaggtacgaggcacaggcgcacggccacatgaagcctctcaccgcttcccaggtaagcgtgcatattggcatggatgatagatggcgcgacagccccagagcaaccccatgggaccaggttagctacgtgtctcaggtttctctcagctctctcactagcgacaaaccatcccggcacagcgccgcagccgatgatgatggcgataagtggagcctgctgctgaatggccgggatgaggaacagtacatc

SEQ ID NO: 7414 - DNA, 4395 bp, Artificial Sequence
  Description of Artificial Sequence: Synthetic coding sequence
atgcctgaacaggagaggcagatcactgctcgcgagggagccagcagaaagatcctttcgaagctgtcactcccaacccgcgcctgggaaccggccatgaagaagtcattcgcatttgacaacgtgggatacgagggtggcctggacggcctcggaccgtcgagtcaggtcgccaccagtaccgtgcgcattctgggtatgacctgtcagtcatgcgtgaagtcgattgaagatcggatcagcaacctgaagggtatcatttccatgaaggtcagtctcgaacagggatcagccaccgtcaagtacgtgccatcggtggtgtgccttcagcaagtgtgccaccaaattggcgacatggggttcgaggctagcatcgctgagggtaaggcggcgagctggccatcgcgctcgctgccagcccaagaggcagtggtgaaactgagagtagagggcatgacttgccaatcctgtgtgagctcgatcgagggaaaggtccggaagctgcaaggtgtcgtccgagtaaaggtgtcactgtccaaccaggaagctgtgatcacttaccagccgtatctgatccaaccggaggacctgcgcgaccatgtcaatgatatgggattcgaagctgcaatcaagtccaaagtggccccactgtctctgggaccgatcgacatcgagcgcctccagtcaactaatccgaaaaggcccctctcctcagcgaaccagaatttcaataactccgagactctgggccaccagggctcacacgtcgtgactcttcagcttcgcatcgacggcatgcattgtaagtcctgcgtcttgaacatcgaggaaaacatcggacaattgctgggagtgcaatcgatccaggtgtccctggagaacaagactgcgcaagtcaagtatgatccatcctgcacctcaccggtcgctctccaacgggcgatcgaagcactgcctccaggcaactttaaggtgtccctgccggacggagccgaaggcagcggaactgaccaccggagcagctcatcgcactccccggggtcgcccccgcggaatcaggtgcaaggaacctgtagtactacgctgatcgcaatcgctggaatgacctgtgctagctgcgtccacagcatcgaaggcatgatttctcaacttgagggggtgcagcagatctcagtgtccttggccgaaggtaccgccacggtgctgtataacccttcagtgatctccccagaagagcttagagccgccatcgaagatatgggatttgaagcctcggtggtgtcggagtcctgttcgacgaatccactcggcaaccactccgcgggaaattccatggtccagaccactgatggcactccgacgtcagtccaggaagttgcccctcataccggacggctgccggctaatcatgctccagacatcctcgccaagagcccgcaatcgactcgcgcggtcgccccccaaaaatgtttccttcagatcaaaggcatgacgtgcgctagctgcgtgtcgaatattgaacggaatctgcagaaggaagcaggggtgctctcggtgctcgtggcactcatggccggaaaagctgaaatcaaatacgatccagaagtaatccaacctctcgaaatagcgcagttcatccaagatctcggcttcgaagcggcagtgatggaggactacgcgggaagcgatgggaacattgagctgaccatcacgggaatgacgtgtgcgtcgtgtgtgcacaacatcgaaagtaagctgacgcggaccaatggcatcacctacgcctcggtcgctctggctacctccaaggcgcttgtgaaatttgatcccgagattatcgggccgagagacatcatcaaaatcatcgaggaaatcggattccacgcatcattggcccagagaaacccaaatgcacaccacctggatcataagatggaaatcaagcaatggaaaaagagctttctttgttccctcgtgttcggaatcccggtgatggcgcttatgatctacatgctgatcccgtcgaacgagccgcaccagtccatggtcctcgaccataacatcatcccaggactgtcgatcctgaacctcatcttcttcatcctgtgcaccttcgtgcagttgctcggcgggtggtacttctacgtgcaggcctacaagagccttcgccacagatcagcgaacatggacgtgctgattgtcttggcgacttccatagcgtacgtctactccctggtgatcctggtggtcgctgtggcggagaaagcggagagatcaccggtgacttttttcgacactcctccaatgctgtttgtgttcatcgccctgggccgctggcttgagcacttggccaagagcaaaacgtccgaggcgctcgcgaagctgatgtcactgcaggcgaccgaagccaccgtggttactcttggggaagataacctgattatccgcgaggagcaggtgccaatggaactcgtgcagcgtggcgacatagtgaaggttgtgccgggaggaaagttcccggtggatggtaaggtgctggagggcaataccatggctgacgaatccctgatcaccggagaagcgatgccagtcactaagaagcccgggtcgaccgtgatcgccggttcgatcaacgctcatggctcggtgctgatcaaggctacccatgtcgggaacgatacgactctcgcgcagatcgtcaagttggtggaagaagcgcagatgtccaaagctccgatccaacagctggctgatcgattctccggttactttgtccctttcatcatcatcatgtcaacccttaccctggtggtttggatcgttattggattcatcgatttcggagtggttcagagatactttccgaacccaaataagcacatcagccagactgaggtcatcatccgcttcgccttccaaacttcaatcacggtgctctgcatcgcatgcccatgctctcttggactggcgaccccgactgcagtcatggtggggactggagtcgccgcccaaaacggaattctcatcaagggaggaaagccgttggaaatggcccacaagatcaaaaccgtgatgtttgacaaaactggcacgatcacgcacggtgtgccgcgcgtgatgagagtcctgctgctgggagatgtggccacgttgcctctccggaaagtcctcgcagtggtcggcaccgcggaggcctcgtcagaacacccgctgggagttgcagtgactaagtactgtaaggaagagctgggcaccgaaactctgggctactgtactgattttcaggcggtgccaggatgcggcatcgggtgtaaggtttcgaatgtcgaaggcattctcgcccatagcgaaagaccgctgtcggccccggcttcgcatctgaacgaagcgggaagcctcccagccgaaaaggacgccgttccgcagacgttctccgtgctgatcggaaatcgggagtggctgcggcggaacggactgaccattagcagcgacgtctcggacgcaatgactgaccacgaaatgaaaggccagaccgcaatcctcgtggcgattgacggggtgctctgcgggatgatcgcgatcgcagatgctgtcaagcaagaggcggccctggccgtgcatactctccagtcaatgggtgtcgacgtggtgcttattaccggtgacaaccgcaaaacggcgcgcgctatcgctacccaagtgggtatcaataaagtgttcgcagaggtcctgccctcgcacaaggtcgcgaaggtgcaagaactgcagaacaaaggaaagaaggtggcgatggtcggagatggagtcaacgattcacctgcattggcacaggcagacatgggtgtggccatcggaactggaaccgatgtcgcgattgaagcagccgacgtcgtgctcatccgcaatgacctgctggacgtggtcgcctcgatccatctctctaaacgcactgtgagaagaattcgcatcaacctggtgctggcgctgatctacaacctggtgggcatcccgatcgctgctggagtgttcatgccaattggaatcgtgttgcagccttggatgggatcggccgcaatggcagcatcttcagtgtccgtggtactttccagcttgcagctcaagtgctacaagaagccagacttggagcgctacgaagcccaggctcacggacacatgaagccgttgaccgcctcacaggttagcgtgcatatcgggatggacgacaggtggcgcgactcgccacgggcaacgccgtgggatcaagtctcctacgtgagccaagtgagcctgtcatcactcacctcggataaaccatcccgccactccgcagccgctgatgacgacggagacaagtggtccctcctgttgaatggccgggacgaggagcaatacatc

SEQ ID NO: 7415 - DNA, 4395 bp, Artificial Sequence
  Description of Artificial Sequence: Synthetic coding sequence
atgcctgaacaagaaaggcaaatcaccgctagagaaggtgcctcgcgcaagatcctgagcaagctctccctgccgacgcgcgcctgggaaccggcaatgaaaaagagcttcgccttcgataacgtgggatacgagggaggattggatggactcggtccgtcatcccaggtcgctacttcaactgtcagaatcctcgggatgacgtgtcaaagctgtgtgaagagcattgaggacaggatctccaacctgaaagggatcatctcgatgaaggtgtcgctggagcaaggctcggccactgtgaaatacgtgccgtcggtcgtgtgcctgcagcaagtatgccaccagatcggagacatgggctttgaagcgtcgatcgcagaaggaaaggccgcttcctggccatcccggtcgctccctgcacaggaggccgtggtcaaattgcgcgtggaaggcatgacctgtcagtcgtgcgttagctccatcgaagggaaggtgcgcaaactccagggtgtggtgcgcgtcaaggtgtccctgtcaaatcaggaagcagtgatcacgtaccaaccttacttgattcaacctgaggacctcagggatcacgtgaacgacatgggatttgaggcggcgataaagtccaaggtggcgccactgtctctgggaccgatcgacatcgaacgcctccagagcactaatccgaaacgcccgctgtcatccgcgaaccagaatttcaacaactccgaaaccctgggtcaccaaggctcccatgtcgtcaccctgcagctgcgaattgacgggatgcattgcaaatcatgtgtgctgaatatcgaggaaaacatcggtcagcttctcggcgttcaatccatccaggtcagccttgagaataagaccgcccaggtgaagtatgatccttcctgtacttccccagtggccttgcaaagagccattgaagctctgccacctgggaactttaaggtgagcctgccggacggcgctgagggttctggaacggaccacaggtctagctcctcacatagccccggttcacccccgcggaaccaggtgcaaggaacctgctcgactaccttgatcgcgatcgcgggaatgacctgcgcgagctgcgtgcattcaatcgaaggaatgatcagccagctcgaaggagtgcagcaaatcagcgtgtccctggcggaaggtaccgccactgtcctctacaacccgtcggtgatctccccggaagagctgagagcagcaatcgaggacatggggtttgaggcatcggtcgtgagcgaatcctgcagcactaatcccctgggtaatcacagcgcgggaaacagtatggtgcagaccaccgacggcactccgacttccgtccaggaggtggctcctcacactggtcgccttcccgcaaatcacgccccagacatcctggcgaagtcgccgcaaagcaccagagcggtcgcgcctcaaaagtgcttccttcaaatcaagggaatgacgtgtgcctcgtgtgtgtcgaacattgagcgcaatctccagaaggaggccggagtgctcagcgtgctggtggccctgatggcgggaaaggctgagatcaaatacgatcccgaggtgatccagcccctggagatcgcccaattcatccaggatctgggtttcgaagccgctgtcatggaagattacgctgggtcggacggcaacatcgagctcacgatcactggcatgacgtgtgcgtcatgcgtccacaacatcgaatccaaactgactcgcactaatgggatcacctacgcatccgtggccctggccacctccaaggccctggtgaagttcgacccggaaatcatcgggccgcgggacatcatcaagatcattgaggaaattggctttcacgcttcgctcgctcagagaaacccaaatgcacatcatctggatcataagatggagatcaaacaatggaagaaatcgttcctctgtagcctggtgttcgggatcccagtcatggccctgatgatctacatgcttatcccgtccaatgaaccgcaccagtcaatggtgctggaccataacatcatcccaggactctcgatcctcaatctcatcttcttcatcctgtgtacgttcgtccagctgctcggcggctggtacttttacgtccaggcgtacaaaagcctccgccatcgcagcgccaacatggatgtgctgatcgtgctggccacttccatcgcctacgtgtacagcctggtgattttggtggtggcggtggcggagaaggccgagcgctctccagtgaccttttttgatactcctccaatgctcttcgtctttattgccctcggaagatggctcgagcatctggcaaagtccaaaacttcggaggcactcgccaaactcatgtccctgcaggcaaccgaggccactgtcgtcacgctgggagaggacaacttgataatcagagaagagcaggtcccgatggaactcgtccagaggggtgacatcgtcaaagtggtgccgggaggcaagttcccggtggatgggaaggtgcttgagggcaatactatggctgatgaatcactgatcaccggagaagcgatgccggtcaccaagaaacctggttcaactgtgatcgcaggtagcattaatgcccacggttccgtcctgatcaaagccacccatgtgggtaacgacactacgctggctcagatcgtcaagctcgtggaggaggcacagatgtcaaaggcgccaatccagcaactggccgataggttctcgggctacttcgtgccgttcatcatcatcatgtcgaccctgactcttgtggtgtggattgtgatcggcttcattgactttggagtggtccaaagatactttccgaaccccaacaagcacatctctcagactgaagtcattattcgcttcgccttccaaacttcaattacggtcctgtgcatcgcctgcccatgttcgctgggattggcgacgccaaccgcagtgatggtgggaaccggagtggccgctcagaatgggattctgatcaagggaggtaagccgctggaaatggcccacaaaatcaagactgtgatgttcgacaagactggaaccatcactcacggcgtgccccgcgtgatgcgggtgctgctgctgggagacgtggccactctgccgctgaggaaagtgttggcggtagtggggactgccgaagcatcgagcgaacacccgctcggggtggcagtgactaagtactgtaaggaagaactgggtactgaaaccctgggctactgcactgattttcaagcggtgccaggctgcggaatcggctgcaaagtctctaacgtggaaggaatcttggcccactccgaaagacctctgtccgccccagcaagccacctgaatgaggcggggtcgctgccagcggagaaagacgcagtcccccaaaccttttcggtgctgatcggaaaccgggagtggctgcgcaggaatggactgactatcagcagcgacgtgtcggatgccatgactgaccatgaaatgaagggccagacggcaatacttgttgccatcgacggggtgctctgcggcatgattgccatcgcggacgccgtcaaacaagaagctgcgctggcggtgcacactctgcagtccatgggagtggatgtcgtcctcatcaccggagacaaccgcaagaccgctagagcaatcgccactcaggtcggcatcaacaaggttttcgccgaagtgctcccgtcccataaggtcgcaaaggtccaggaactgcagaacaaggggaagaaggtggcgatggtgggggacggagtgaacgactcaccggcccttgcacaggccgacatgggagtggcaattggaaccggaaccgatgtcgctattgaggcggccgatgtggtcttgatccgcaacgacctgttggatgtggttgcctcgatccatctgtccaaacggactgtccgcaggattagaatcaacctcgtgctcgccctgatctacaacctcgtcggtatcccgatcgcagcgggcgtgttcatgcctattggaatcgtgttgcagccgtggatgggatcagctgccatggccgccagcagtgtatccgtggtgctgtcaagcctgcagctcaagtgttacaagaagccggacctcgagcgctacgaggcccaggcgcacggacatatgaagccgttgactgcctcccaagtgagcgtgcatatcggcatggacgatcgctggcgggactcgccgcgggcgaccccgtgggaccaggtgtcctacgtgtcacaggtgtcgctgtcctccctgacctcagataagccatcgcgccatagcgccgctgccgacgatgacggtgacaaatggtcgctgctgctgaacggacgcgacgaggagcaatacatc

SEQ ID NO: 7416 - DNA, 4395 bp, Artificial Sequence
  Description of Artificial Sequence: Synthetic coding sequence
atgccagaacaagagcgccagatcactgcacgtgagggagcgtcgaggaagatcctgtcgaagctgagccttcccacccgagcctgggaaccggccatgaagaagtcgtttgcatttgataacgtgggatatgaaggagggcttgacggacttggacctagctcgcaagtggcgacttccactgtccgcatccttggaatgacctgtcagtcgtgtgtgaagtccatcgaagataggatttccaatttgaaaggtattatcagcatgaaagtgtcactggagcagggctcggcaaccgtgaagtacgtgccttccgtggtgtgcctgcaacaggtgtgtcatcagataggtgatatgggatttgaggcctcgattgcagagggtaaggcagcatcgtggccaagtcggtcgctgccagcacaggaagcagtcgtgaagctgcgcgtggaaggcatgacgtgtcaatcctgtgtgagctcgattgaaggcaaggtccgcaaacttcaaggtgttgtgcgagtgaaagtgtcccttagcaatcaagaagcggtcattacctaccaaccatacctgattcagccagaagatcttagagatcatgtgaatgacatggggttcgaagcggcgatcaagtcgaaagtggcacctctgtcgctgggacctattgatattgaacggcttcaaagcactaaccctaagcgtcctctttcatcagcaaatcagaacttcaataactccgaaaccttgggccatcaaggatctcatgtcgtcaccctccaacttagaatcgatggaatgcactgtaaatcctgcgtccttaacatagaggaaaacattgggcaactcctgggcgtgcaatcgatccaggtgtcgctggaaaacaagaccgcacaggttaagtacgacccatcctgcactagccctgtcgcccttcagagggcaattgaagctcttccgccaggaaactttaaggtgtcgctgcccgatggtgctgaggggtccggaacggaccataggtcctccagctcacatagccccggctcgcctcccagaaaccaagtgcaagggacttgctccaccactcttattgccattgccggtatgacttgtgcaagctgtgtgcactctatcgaaggtatgatttcccaactggaaggtgtgcagcaaatctccgtcagcctggcggagggcaccgccactgtgctgtacaatccgtccgtgatttcgcctgaagaactcagagcagcaattgaggacatgggctttgaggcatcagtggttagtgaatcatgttcgaccaacccgcttggaaaccattcggctggaaactctatggtgcaaactactgatggaaccccaacttccgtccaggaggtcgcaccgcataccggaagattgcccgcaaaccatgcacctgacatcctggcaaagtcaccgcaatcaactagagccgtcgcccctcagaagtgttttctccagattaaaggcatgacctgtgcttcatgcgtctcgaacatcgaaagaaatctccaaaaagaagcaggtgtgttgagcgtcctggtcgccttgatggcaggcaaggcagagataaagtacgaccctgaagtgattcaacctcttgaaatcgcacaattcattcaggatcttggttttgaggcagcagtcatggaggactacgccggtagcgatggaaacatcgagctcaccataaccggtatgacctgcgcttcgtgcgttcacaacatcgaatcaaaactgacccggaccaacgggatcacttacgcatcagtggcactggcgacttcaaaagccctggtcaagtttgatcctgagatcatcggtcctagagatatcattaagatcatcgaagaaattggatttcatgcatcgctggcacaacggaatcctaacgcacaccatctcgaccacaaaatggagattaagcagtggaagaaatctttcctgtgttccctcgtgtttgggatcccggtgatggccctgatgatctacatgctgatccctagcaatgaaccccatcagtcaatggtcctcgaccacaatatcatccctggactgtcgatactcaatctcattttctttatcctctgtacctttgtccagctgttgggagggtggtacttctacgtgcaggcatacaaatccctcagacatcggagcgccaacatggacgtgcttatcgtgctcgcaacctccattgcatacgtctattcgcttgtgattcttgtcgtggcagtggcggagaaggcagaacgttcgccagtgaccttcttcgacactcctcccatgcttttcgtgttcatcgccctcggtcggtggcttgaacatctcgcaaagagcaaaaccagcgaagccctcgccaaactgatgtcccttcaagcgacggaggccacggtggtgactcttggcgaagataatctgattatccgcgaagaacaagtccccatggagttggtgcaacgaggtgatattgtgaaggtcgtccctggtgggaagtttccagtggatggcaaagtcttggaaggtaatacgatggcagatgagtccctgattactggtgaagcaatgcccgtgactaagaagcctggttcgaccgtcatcgcaggttccatcaacgcacacggcagcgtgcttatcaaagccacccatgtgggtaacgataccacccttgcccaaattgtgaagctcgtcgaagaggcacagatgtcaaaagccccaatccaacagctggcagataggttctcgggatactttgtgcccttcattatcatcatgtcaactctgactttggtggtgtggattgtcattggctttattgatttcggagtggtgcagagatactttccaaacccgaataaacatatctcacagactgaagtgattattcgatttgcattccaaaccagcattaccgtgctctgtattgcgtgtccttgttccctgggcctggccacccctactgcagttatggtgggaactggcgtggccgcccaaaacggaattctgattaagggtggtaaaccactggaaatggcgcataagataaagactgtgatgtttgataagactggcactatcactcacggggtgccacgcgtgatgagagtgcttcttctgggtgatgtcgcaacgctgcccctgcgtaaggtgctcgccgtggtgggaacggcagaggcctcctcagaacacccactgggcgtggccgtcactaaatactgcaaggaagaacttgggactgaaaccctcggatattgtactgactttcaagccgtaccagggtgcggaattggatgtaaggtgtcaaacgtggagggaatccttgcacattccgagaggcccctgtccgcccctgcatcacatctgaatgaagcgggctctttgcccgcagaaaaagacgcagtgccgcagacctttagcgtcctcattggtaatcgtgaatggctgcgacgcaacggtcttacgatttccagcgacgtgtctgacgcaatgaccgaccatgaaatgaagggacaaaccgctatcctcgtcgccatcgacggtgtgctgtgtgggatgatcgctatagcggacgcagtgaaacaagaggcagcacttgccgtccatactctgcaatctatgggggtggatgtggtgttgatcactggggataaccgtaagaccgccagggcaattgctacccaggtgggtattaacaaggtctttgcagaagtgctgccatcccataaggtcgcaaaggtgcaggaactgcaaaacaaaggaaagaaagtcgcaatggtgggggatggggtgaacgatagcccagccctcgcccaggccgatatgggagtggcaataggaactgggactgacgtggccatcgaagcagcagacgtggtgctgattcgcaacgacttgctggatgtggtggcttcgatccatctctcgaaacgtaccgtcaggaggatccgcatcaacctcgtcttggcactcatctacaacctcgtcggtattccgattgctgcgggtgtctttatgcctattggaatagtcctgcagccgtggatgggaagcgcagctatggctgcaagctcggtgagcgtggtgctctcctccctccaactcaagtgttataagaagcctgatctcgaaagatacgaagcccaagcacatggtcatatgaagcctcttactgcatcccaggtgtcagtgcacattggaatggatgatcgctggagagacagccctcgggcgaccccatgggatcaagtctcatacgtgtcgcaagtctccctcagctcccttacctccgacaagccgtctcgtcattccgcagcagcagacgatgatggggataagtggagccttcttttgaacggtcgggacgaagagcaatacatt

SEQ ID NO: 7417 - DNA, 4395 bp, Artificial Sequence
  Description of Artificial Sequence: Synthetic coding sequence
atgccagagcaggagcggcagatcacagcacgtgagggcgctagtagaaagatcctgagtaaattgtctttaccaaccagggcttgggagcccgccatgaaaaaaagctttgcgtttgataacgttggttacgaaggagggcttgacgggctggggccgtcaagtcaggtggccacctctactgttcgcatcctcggcatgacttgccaatcctgtgtcaaaagcatcgaggatcgcatttccaaccttaagggaatcatctcaatgaaggtttctctggagcagggatcagccaccgttaagtacgtgccgtccgttgtgtgcctgcagcaagtctgccaccagattggcgatatggggtttgaggccagtatcgccgaaggcaaggccgccagctggccatcccggagcttaccagctcaggaagccgtggtgaaactgcgcgtcgagggtatgacatgccagagttgcgtttctagcattgagggcaaggtcaggaaactccaaggagtggtgcgagtaaaagtgagcctgagcaatcaggaggcagtcataacctatcagccttacctgatccagcctgaagatctgcgcgatcacgtgaatgacatgggattcgaggcagcgatcaaatctaaggtcgccccactgagtctgggccctattgacattgaacggctgcagagtaccaatcccaaaagacctctgtcctcagctaaccagaactttaataactccgaaaccttgggccaccaggggtcccacgtcgtgactcttcagctgcggatcgatggaatgcactgcaagtcttgtgtcctcaacattgaggagaacatcggccaactccttggagtgcagagcatccaagtgtcattggaaaacaagaccgcacaagtgaaatatgacccatcttgtacaagtcccgtagcccttcagcgggctatcgaggccttgccacccggaaattttaaggtttccctgccagatggagcggagggcagcggcaccgaccacaggagcagctcctcccactcacccggcagcccacctaggaatcaagtgcaagggacatgctcaactactctgatcgctattgccggtatgacttgcgcgagctgcgtgcacagtattgagggcatgatctctcagctggaaggcgttcagcaaatttcagtgtccttggctgaaggcacagcaaccgtgctgtacaatccgtccgttatctcccctgaggaattgagagccgccatcgaggacatggggtttgaggcgtcagtagtctccgaatcctgttccaccaaccctttggggaatcatagcgccggcaacagtatggttcaaactacagatgggacaccgacctcggtccaggaagtcgctccgcatactggacgattgccagccaaccacgcaccggatatattggctaagtcaccccagtccactcgggcggtggccccccagaagtgtttcctgcaaatcaaggggatgacgtgtgctagctgtgtttccaacatcgagcggaacctgcaaaaggaggccggcgtactgagcgtgttagtagctctgatggctggaaaagctgaaatcaagtacgaccccgaagtcatacagcccctggaaattgctcagttcatccaggatctcgggtttgaggccgcggtgatggaggactatgccggctctgacggcaatatcgaactcaccataacaggtatgacatgtgctagctgcgtgcataacattgagagtaagctgacaagaactaacggcataacatacgccagcgtcgcactggctacctccaaagcactggtcaagttcgatccagagataattggaccacgagatataattaaaattattgaagagattggctttcacgctagcttggcccaacggaacccaaacgcccatcatctcgaccataaaatggagatcaaacagtggaagaagtcctttctttgttctcttgtgtttggcatcccagttatggcgctcatgatctatatgctcattccttccaatgaaccgcatcagtccatggtgctggaccataacataataccaggtctctcaatcctgaacttgatattttttattctgtgtacctttgtgcaactgctgggagggtggtacttctatgtacaggcttataagtccctgcgccataggagcgcgaatatggacgtcctcatcgttctggctaccagcatagcctatgtttattctctggtaatcctcgtcgtggccgtggctgaaaaggcggagaggagccctgtgacattcttcgacaccccaccaatgctcttcgtcttcattgccttgggtcggtggctggagcatctcgccaaaagcaagacatcagaagctctagccaagctcatgtctctacaagcgactgaagccactgtggtcacccttggcgaggacaacctcattattcgagaagagcaggtgccaatggaactggtgcaacgaggtgacatcgtaaaggttgtacctggcgggaaattccccgtggacgggaaggttctcgagggcaacaccatggctgatgagagcctcatcactggagaggcaatgccagttaccaaaaaacccggatccacagtgattgccgggtcaattaacgcccatggcagtgtgctgataaaagcgacccacgtgggtaatgacacaacactcgcccagatcgttaaattggtagaagaagcccagatgagcaaagcacccatccaacagcttgctgatagattcagtgggtattttgtgccgtttatcattattatgagtactttgactcttgtagtttggatcgtgatcggctttattgactttggggttgtgcagcgttatttcccaaacccaaacaaacatattagtcagactgaagttataattaggttcgcttttcagacatcaattacggtcctctgtatcgcatgcccctgtagcctcgggctagccaccccaacagccgtaatggtgggcactggcgtagcggcccagaatggtatcttgatcaaaggcgggaaaccactggagatggctcacaagatcaagaccgtaatgttcgacaaaacaggaactattacccacggggtaccccgggtcatgcgcgtcctcttactgggcgacgttgctaccctgcctctccggaaagtcctcgcagtggtgggcacggcagaagcaagctcagaacatccattaggtgtcgccgtgactaagtattgtaaagaggagttggggacagagaccctcggctactgcacagatttccaggcagtgccagggtgcgggattggatgtaaagtgagcaacgtagagggaatactggcccattcagagcgaccgctatcagcacctgcatcccatctcaacgaggccggcagtctgccagctgaaaaggacgctgtgccacagacgttttctgtgctgattggcaatagagagtggcttcgtagaaacggtctcacaattagtagcgatgtctcagatgctatgaccgaccatgagatgaaggggcagacagctattttggtggccatcgatggcgtgctctgtggaatgatcgctatcgcagacgcagtcaagcaggaagcagcactggcagttcataccctccagtcaatgggggtcgacgttgtcctcatcacaggggacaatcggaagactgccagggcaatcgccacacaggtaggcatcaataaggtctttgccgaggtgctccctagccacaaggtggcaaaagtacaggaactgcaaaataagggaaagaaggttgccatggtgggtgacggggtgaacgacagtccagctttagctcaggctgacatgggagttgcaatcggaacgggtaccgacgtcgcaatcgaggccgcagacgtcgtgctgatccgcaacgatctgttggatgtggtggctagtatacatctctcgaagagaacagtgcgacgcatccggattaacctggttttagctctgatctacaatctggtgggaattccaatagccgccggcgtgttcatgcctatcggcatagtgctccaaccttggatgggaagtgctgcgatggccgcgtctagcgtaagcgtcgtcctgagctctctgcagctaaagtgctacaagaagccggacctggaacgctatgaggctcaagctcacggccatatgaagcctttgactgcttcccaggtttcagtgcatataggcatggatgaccgctggagggacagccctagggctacgccttgggaccaggtgagttatgtgagtcaggtctcactgtcaagcttgacaagcgataaaccctctcggcacagcgccgctgcagacgatgatggcgataagtggtctttgctcctgaacggtcgtgatgaggagcagtacatc

SEQ ID NO: 7418 - DNA, 4395 bp, Artificial Sequence
  Description of Artificial Sequence: Synthetic coding sequence
atgccggaacaagaacggcagattaccgcacgtgaaggggcaagcagaaagattcttagcaaactgtcacttccaaccagagcctgggagcccgccatgaaaaagtccttcgcgtttgacaatgtgggctacgagggaggacttgatggacttggtccttccagccaagtcgcaacttccactgtccgcattcttggaatgacctgccaatcgtgtgtgaagagcattgaagataggatttccaaccttaaaggcattatctcaatgaaagtgtcccttgaacaagggagcgcaaccgtgaagtacgtgccttcagtggtctgtctgcaacaagtgtgtcaccagattggagatatggggtttgaagcatccatcgcagaaggaaaggctgcctcctggccgtcgcggtccctgccagcacaagaggcagtggtgaagctgcgggtggaaggtatgacgtgccagtcgtgtgtgtcatcgattgagggcaaagtgagaaagctgcagggagtggtccgggtgaaggtgtcgcttagcaatcaagaggctgttatcacctaccagccataccttatccaaccagaggacttgagagatcatgtcaatgatatggggttcgaggcagcaatcaagtcgaaggtggccccactgtcgctggggcctatcgacattgaacgccttcaaagcactaaccctaaacggcccctttcctcggcaaaccagaactttaacaactcggaaaccctgggccatcagggctcccatgtggtcactctgcaactgcggattgatggcatgcactgtaagtcctgtgtgctgaacatcgaagagaacattggtcaacttctgggcgtccagagcatccaggtgtccctcgaaaacaagacggcccaggtgaaatacgatcctagctgtacttcacctgtggctctccagcgcgcaatagaagcactgcctccgggcaactttaaagtgtcgctgcctgatggcgccgaaggatccggcactgaccatcgctcctccagctcccatagccctggttctccacctcggaatcaagtgcaagggacttgttcaactactctgattgcaattgcagggatgacgtgtgcatcatgcgtccattcaatcgaaggtatgatcagccaacttgaaggtgtccaacaaatctcagtgtccctggcagagggtactgccaccgtgctgtacaatccgtccgtgatctcacctgaggagctgcgggcagcaattgaagatatgggcttcgaagcatcggtcgtgtccgaaagctgtagcaccaaccctctcgggaaccatagcgcaggaaactccatggtccaaaccaccgatggaactcctacttcggtgcaggaagtcgcaccacataccggacgcttgccagcaaatcatgccccggatatcctggctaagtcaccccagtcgacccgcgccgtggccccacagaagtgcttccttcagattaagggaatgacttgcgcttcatgtgtgtcgaatatagaacgaaaccttcaaaaagaggcgggagtcctctcagtcctcgtcgccctcatggcaggaaaggcagagataaagtacgaccctgaagtcattcaaccgttggagatagcccaattcatccaagatttgggatttgaagccgcagtcatggaggactacgcagggtcggacggaaacattgagcttactataactgggatgacctgtgcctcttgcgtgcataacattgaatcgaaacttaccagaaccaatggaatcacctacgcttctgtggcccttgcgactagcaaggcacttgtcaagtttgatccagagattattggtcccagagacattatcaagattattgaggagatcggatttcatgccagcctggcacaaaggaatcctaacgcacaccacctggatcacaagatggaaatcaagcaatggaagaagtcatttctttgttccctggtgtttggtataccagtgatggccctcatgatttacatgcttattccatccaacgagcctcatcagtcaatggtgctggatcacaacattattcctggcctttccatactgaacctgatcttctttattctgtgtacgtttgtccagctccttggtggttggtacttctacgtccaagcctacaagtccctccgtcatcggtcggcaaacatggatgtgctgatagtgctggcaacttccatcgcatacgtctatagcctcgtcatactggtggtggcagtggctgaaaaggcagaacgatcccccgtcactttctttgatactcctcccatgttgttcgtgttcatcgcgcttggtcgatggttggaacatctcgcgaagtccaagactagcgaggcattggcaaaactcatgtcacttcaagctactgaagccactgtggtgacgctcggagaagataatctgatcataagagaggagcaagtgccaatggaactggtgcagcggggggacatcgtgaaggtggtgccgggtgggaagtttccagtggatgggaaagtgctggaaggaaatacgatggcagatgaaagcctgattactggtgaagcgatgcctgtgaccaagaaacccgggtcaactgtgattgcaggtagcatcaacgcccatggatcggtgttgataaaagcaacccatgtgggaaatgataccaccctggcgcaaattgtgaaactggtcgaggaggcacagatgtcgaaggcaccaatccaacagctggctgatagattcagcgggtactttgtcccatttatcattatcatgtcgaccctgaccctggtggtgtggatagtgattgggttcattgactttggcgtggttcagaggtacttccctaaccccaacaaacacatttcccaaaccgaggtcatcatacgctttgcgtttcagacctccataaccgtcctgtgcattgcatgtccttgctcgctgggactggcaacccctactgccgtgatggtgggaactggagtcgcagcacaaaacggtatcctgattaaaggaggtaagccacttgagatggctcacaaaatcaagaccgtgatgtttgacaaaaccggcactatcacccatggcgtgcctcgcgtgatgagggtcctgttgctgggtgacgtcgctaccctgcctctgcgcaaggtcctggcagtggtcggtaccgcagaagcctcctcagagcatccactgggagtggcagtcactaagtactgtaaggaggaacttggaaccgaaactttgggatattgtaccgatttccaagccgtgcccgggtgtggaattggttgtaaagttagcaatgtggaaggaattctggcccacagcgaacggccactgtcggcgccagcatcgcatcttaacgaagccggcagcctgccggcggagaaagacgcagtgcctcagaccttctcggtgcttattggcaacagagagtggctgaggcgcaacggtctgactatctcatcggatgtctccgatgcaatgactgatcatgagatgaagggacaaacggcaatccttgttgcaattgacggtgtcctttgtggaatgatcgccattgctgacgccgtcaagcaggaagcagcacttgctgtgcatacccttcaatccatgggagtcgatgtcgtcttgattactggagataacagaaaaaccgcccgcgcaatcgcaacgcaagtcggtataaacaaggtgttcgcggaggtgctcccatcccataaagtcgcaaaagtgcaggagcttcaaaacaagggaaaaaaggttgcaatggtgggtgatggtgtgaacgacagcccagcgctggctcaggccgatatgggagtcgccattggaaccggaaccgatgtggcgatcgaagctgcagatgtggtgctgattaggaacgaccttcttgatgtggtggcatcgattcatttgtcaaaaagaaccgtccgtagaatcaggattaatctcgtactcgccctgatttacaacctggtcggtatccccatcgctgctggagtgtttatgcctatcggtattgtgctgcaaccctggatgggctcggcagcaatggccgcaagcagcgttagcgtcgtcctttcgagcctgcaactgaagtgctacaaaaaacctgacctggagagatacgaagcacaagcgcatggtcacatgaaacctttgaccgcatcccaggtgtccgtgcacataggcatggatgaccggtggagagattcgcctcgtgcaactccctgggaccaagtgtcctacgtgtcccaagtgagcttgtcctcacttacttcggataagcccagcagacactccgcggcagcggatgacgacggagacaagtggtcacttcttcttaacgggagagatgaagagcagtatatc

SEQ ID NO: 7419 - DNA, 4395 bp, Artificial Sequence
  Description of Artificial Sequence: Synthetic coding sequence
atgccagagcaggaaaggcagattacagcaagagagggcgcaagtcggaagatactcagcaagctttcactgcccacaagggcgtgggagcctgctatgaagaaaagctttgctttcgataatgtgggctatgaaggaggcctggacggtctcggccccagttctcaggttgcgacgagtacagttcggatcctggggatgacctgccagagctgtgtgaagtctattgaggatagaatcagcaacctaaagggcataatttccatgaaggttagtctggagcaaggatccgccaccgttaaatacgtgccctccgtcgtctgccttcagcaagtgtgtcatcaaattggggacatgggtttcgaagcgagtattgccgaggggaaagccgcctcgtggccgtcgcgcagcctgcctgctcaggaggcggtggttaagctcagggtggagggtatgacttgccagtcttgcgtgtccagtatagaaggaaaggtgcgaaagctgcagggtgtggttagggtgaaggtgtctttgtcaaaccaagaagcggtgataacctaccaaccatacctcatccagcctgaggacctccgggatcatgttaacgatatgggcttcgaggccgcgatcaaatccaaggtggcacctctaagtctgggccccatcgatattgaaagactccaaagtacgaatcctaaacgccctctgtctagtgcgaaccagaacttcaacaatagcgaaaccctgggccaccaaggatcccatgtagttacgttgcaactgcgcattgatggaatgcactgcaaaagctgtgtcctcaacatcgaggagaacatcggccagctcctgggggttcagagtatacaggtgtccctcgagaataagacagcacaggttaagtacgatccctcctgtacttccccagtcgcactccagagagccattgaggccctgcctccggggaactttaaggtgtcccttccagatggagccgagggctccgggacagaccacagatcctcctcatctcattcaccagggtctcctccccggaatcaggtccaggggacatgctctacgactttgatagcgattgccggaatgacctgtgctagttgcgtccacagtatcgagggcatgattagccaattggaaggcgtgcagcagatatctgtgtctttggcagaaggcaccgctaccgtgctttataacccgagcgtgatcagcccggaagaacttcgcgcagccatcgaggatatggggtttgaggcctctgtagtttccgaatcctgttcgacaaacccattggggaaccattcagctgggaactcgatggtccagactacggacggaactcccacctccgttcaggaggttgctccacatacaggcagactccccgctaaccacgcgcctgacattcttgcaaagtcccctcagagtacccgggccgtagcccctcagaagtgctttttacagatcaaaggcatgacttgcgcgtcatgcgtaagcaatatagagcggaatctacagaaggaggccggggtgctgtctgtgctcgtagcactaatggccgggaaagcggagattaagtacgaccccgaagtcattcagcctttggaaatagctcagttcatccaggacctcggatttgaggccgccgtaatggaagactacgccggaagcgacggcaatattgagctcacgatcacagggatgacctgcgcctcatgtgtgcacaacattgaatccaaactgacacgaactaacgggattacatacgcttccgttgccctggcgacatccaaagccctggtcaagtttgaccctgagattattgggccccgcgatatcattaagataatagaagaaattggcttccacgcgagcctggctcagaggaacccaaacgcgcaccatctggaccacaaaatggagatcaagcagtggaaaaaaagtttcctgtgctccttggtgttcggcatccccgtgatggcgcttatgatctacatgttgattcccagcaatgagccccatcaatctatggtgctggaccataatattatccctggattatccattctgaatctaatattttttatcctgtgtaccttcgtccaactgcttggaggttggtatttctacgttcaggcctacaagagcctccgacataggagcgccaatatggacgtgttaattgtcttggccacatccattgcgtatgtctactccctggtcatcctggtggtcgccgtagccgagaaagccgaacgcagtcccgtgacgtttttcgacacacctcccatgctgtttgtgtttattgccctaggtaggtggctcgagcacctcgccaagtccaaaacctccgaagccttagctaaactgatgtccctgcaggccactgaagctacggtggtgaccctgggcgaggataatctcataatccgggaggagcaggtacccatggagctcgttcaacgaggtgatattgtaaaggtggtccctgggggaaagtttcccgtagacgggaaagtgctggaaggtaacacgatggcggatgaaagcttgatcacgggcgaagcaatgccggtgaccaagaaaccaggcagcaccgtaatcgcggggtcaattaatgcacatggtagtgttctgatcaaagctactcacgttggcaacgacacgactcttgcccaaatcgtcaagctcgttgaagaggcccagatgagtaaagctcctatacagcagttggccgatcgattcagcgggtactttgtgcccttcatcattatcatgtcaacgcttacccttgtggtgtggatcgttatcggctttatcgattttggcgttgtccaacgttacttcccaaaccccaacaaacacatcagccagactgaggtgatcatcaggtttgcgttccagacttctatcacggtgctgtgtatcgcctgtccctgtagcctggggctcgcaacacccacagcagtcatggtcggaacgggagtagctgcccagaacggcatccttattaagggcggtaaacccctggagatggcacacaagattaaaaccgttatgtttgataagaccggaacgattactcatggtgtccccagggtgatgcgagtactgctgctgggagatgtagcgacattgcctctgcgcaaggttctcgccgtcgtggggacggcagaggcttctagtgagcacccactcggggtggctgtcaccaagtactgcaaagaagagctgggtaccgaaactctgggatattgtaccgactttcaagccgtgcccggttgcggcatcggctgcaaggtctccaacgtcgaaggaatactggcccactctgagcgtccgctgtcggctccagcatctcatctcaatgaagccggctcattgcctgcagaaaaagatgccgtcccccagaccttctcagtgttaattggcaacagagagtggctgcggcggaatggcctaaccatcagcagcgatgtcagtgacgctatgaccgatcacgagatgaaagggcaaactgctatcctagtagccattgacggggtgctttgcggtatgatcgccatcgctgacgccgtgaaacaagaggccgcgctggcagtgcacaccttacagtcaatgggcgtggacgtcgtgctgattaccggagataatcgcaagactgcgagggcaatagcaacgcaggtggggataaacaaggtttttgccgaagtgctgcctagccacaaagttgccaaggtccaggaactgcagaacaaagggaaaaaggtagccatggtcggtgatggcgtgaacgactctccggctcttgcacaggccgacatgggtgtggccattggcaccgggacagatgtggctattgaagccgctgacgtggtgctcatacgcaatgatctcctggatgtggtggccagcatacatctctctaaacggacagttcggaggatcagaataaatctcgtgctagccttgatctacaacctggtcggcatcccgatcgcagccggagtattcatgccaatcggcatcgtgctacagccatggatgggatcggcagccatggccgcctcttcagtcagtgtggtgttgtcctcactgcagctgaaatgctacaaaaagcccgacctggagagatacgaggcacaagcccacggtcacatgaagcccttgacagcgagccaggtcagtgtccacatcggcatggacgatagatggcgcgactccccccgggccacaccatgggatcaggtgtcttatgtttcacaagtgtccttgtccagcctcacatctgataaaccttcccggcattccgcagctgcggatgacgatggcgacaaatggtcattactgcttaatggaagagacgaggagcagtacatc

SEQ ID NO: 7420 - DNA, 4395 bp, Artificial Sequence
  Description of Artificial Sequence: Synthetic coding sequence
atgcccgaacaggagcggcagatcacggcccgagagggggcttcccgcaaaattcttagtaaattaagccttcctactcgcgcatgggaacccgcaatgaagaagtcattcgccttcgataatgtcggatatgaaggcggtttggatggcctgggtccaagctctcaagtggccacatccacagtgcgcattctcgggatgacatgccaatcctgtgtcaagagcatcgaggacaggatttccaatctcaagggcattatttctatgaaagtgtcccttgagcagggctccgccaccgtgaagtatgtgccttccgtcgtctgcctccagcaagtgtgccaccagatcggcgacatgggtttcgaggcatcaatcgcagaggggaaagcagcgagctggccgagtcgcagtctgccggcacaagaggctgtggtgaaactgagagtggagggcatgacttgccagagttgtgtaagttctatcgaggggaaggttcgaaagttgcagggtgtggtgagggtgaaagtgagcctttcaaatcaggaggcagttatcacctaccaaccatatctgattcagcccgaggacctgagagaccatgttaacgatatggggtttgaagccgcgattaagagcaaggtcgctcccctgtctctggggcctatcgacattgagcgactgcagagtacaaaccccaagcgtccgctgtctagcgcaaatcagaattttaacaacagcgagacgctaggccaccagggaagtcatgtggtgactctgcaattacggatagacgggatgcattgcaaaagctgcgtgctgaatatcgaggaaaacattggccaattgctaggtgtgcagtcaattcaggtgtctctcgagaacaagaccgctcaagtcaagtatgacccgagctgcacctctcctgtggctctccagagagcgattgaagccctgccccccggtaacttcaaagtcagcttgccggatggcgccgaagggagcggaacggatcatcgctctagtagcagccatagcccaggaagcccaccccgaaaccaggtgcagggaacttgctctacaaccttgatcgcaattgctggcatgacctgtgcatcctgtgtacacagtatcgaggggatgatcagtcaattggagggggtacagcagattagcgtgtcactcgcagaagggacagctactgtattatacaacccttctgtcatctcccctgaggaactccgtgctgccatagaggacatggggtttgaagcctcagtggttagcgaatcttgcagcactaatcccctcggaaaccatagcgccggaaactccatggtgcagacaacagatggaacaccgactagtgtgcaggaggtggccccacacacaggaaggctgcccgccaaccacgcaccggacatcttggcaaagtcccctcaatccacgcgtgccgtcgcgccacagaagtgttttttgcagatcaaaggaatgacttgtgcctcctgtgtgtccaatattgaaagaaatcttcagaaagaggcaggggtgctgtccgtcttggttgcactgatggcaggtaaggccgaaattaaatacgaccctgaggtgatacaacccctggagattgcacagtttatacaggacctcggctttgaagccgctgtaatggaggattatgctgggtccgatggaaatatcgagttgactatcacagggatgacatgcgccagttgcgtgcataacatagaaagtaagctaacccgcaccaacggtataacgtatgccagcgtggcccttgccacaagcaaggctttagtcaagttcgatcctgagatcataggcccgagggatataattaagatcattgaggagatcggatttcatgcgtccctggctcagcggaatcccaacgctcaccacctggaccacaagatggaaatcaaacagtggaagaagtcgtttctctgtagcctcgtgttcggaatccccgttatggccttgatgatttatatgttgatcccgagcaatgagccccaccaatccatggtgctcgaccacaatatcatccctgggctgtctatcctgaatctgatcttcttcattttatgcactttcgtgcagctgctgggcggatggtacttttacgtgcaagcctacaagtcccttcggcaccgtagtgccaacatggacgttctcattgtgctggccacatcaattgcgtatgtgtactccctggtgatcttggtggtagctgtcgctgaaaaagccgaacgttccccagtcaccttttttgatacccccccaatgttatttgtatttatcgccctaggccgatggcttgagcatctggccaaatctaaaacatcagaggctctcgcaaaactcatgagcctacaggccacagaggccactgtcgtgaccttaggggaagacaacctgattatccgcgaagagcaggtaccgatggaactggttcaaagaggagacatagtcaaggtggtcccagggggtaagtttcctgttgacggcaaagtgttggagggaaacacgatggccgatgaatccctcattacaggggaggccatgcctgtaaccaagaagccaggctctaccgtgatcgccggaagtataaacgcacacggctcagtgcttatcaaggccactcacgtcggaaatgacactacacttgcccaaattgtcaagctcgtcgaagaagctcagatgtcgaaggcccccatccagcagctggccgatcggttttcaggttattttgtgccatttattatcattatgtctacgctgaccctggtcgtatggatcgttataggcttcattgatttcggagtggtgcagcgatactttcccaaccctaataagcacatctcacaaaccgaagttatcatccggttcgccttccagacctccatcaccgttctgtgcatagcctgcccttgcagtctggggctcgctactcctacggccgtcatggtgggcaccggcgttgctgcacagaatgggatcttgatcaagggaggtaagcctctggagatggcgcataaaataaagaccgtgatgttcgacaaaacaggaaccatcactcatggcgtgcctagagtgatgcgagtactgttgctcggcgacgtggcaacacttcccctccgaaaggtgctggcagtggtgggaaccgccgaggcgagttccgaacatccactcggagtagccgtgaccaagtactgcaaggaggaactgggcacagaaacgctaggctattgcaccgactttcaggccgtgccaggttgtggtatcggctgtaaagtctctaacgttgaaggaatattggcacacagcgagcgaccattgagcgcacccgcgagccatctaaacgaggcgggatctcttccggcagaaaaagatgcagtacctcagactttctcagtcctgattggaaaccgcgagtggctgagaagaaacggactaactatttctagcgacgtcagtgatgccatgacggatcatgaaatgaagggccagactgctattctagtggccatagatggtgttctgtgtgggatgattgcaatagctgatgcagtgaagcaggaagcagccctcgcggttcacacccttcagagcatgggagtcgatgtggtactgattacaggggacaacaggaagaccgcgcgggcgattgctacccaagttggcataaataaggtgtttgccgaagttctgccaagccataaagtggccaaggtgcaggagctgcaaaacaaaggtaagaaggtagctatggtaggagatggtgtgaacgactcaccggcccttgcccaggcagatatgggtgtggctatcggcaccggtaccgatgtcgcgattgaggcggcagacgtagttcttatacggaacgacctgctggatgtcgtcgcttccatccatctctctaaacgaacagtgcgtcgcatcaggattaacttagtactggcactgatctataacctggtgggaattcccattgctgccggagtttttatgcccatcggaattgttttacagccatggatgggttcggcggccatggcagcatcttctgtaagcgttgtactgtcctccttgcagctcaagtgctataagaagccggatctggagcggtatgaagcgcaggcccacggacacatgaagcccttgacggcaagccaggttagtgtgcacatcggcatggatgatcgatggagagatagcccccgcgccacaccatgggatcaggtatcgtatgtgtcacaggtaagcctgtcctctctgacctccgacaagcctagtagacactcagccgccgccgatgatgatggggacaaatggtccctcctcctcaatggacgggacgaggaacagtacatc

SEQ ID NO: 7421 - DNA, 4395 bp, Artificial Sequence
  Description of Artificial Sequence: Synthetic coding sequence
atgccagaacaagagcggcagattacggccagagagggcgcgtcgagaaagatcctgtcgaagctgtcgctgcccactcgagcgtgggaacccgcaatgaagaaatcatttgccttcgacaatgtgggttacgagggcggactggatggactcgggccgtcatcgcaagtggccacctcaactgtccgcatcctcgggatgacttgccagtcctgtgtgaagtctatcgaggacagaatcagcaatctcaaaggcatcatttcaatgaaagtctccctcgagcagggatccgctactgtgaaatacgttccgtcagtcgtttgcctgcaacaggtgtgtcaccagatcggggacatggggtttgaagcgagcatcgcagagggcaaagccgcgtcgtggccttcccgatcgctcccagctcaggaagctgtggtcaagctgcgggtggaaggcatgacgtgccagtcgtgcgtgtcaagcatcgagggaaaggtgaggaaattgcagggagtggtccgggtcaaggtgagcttgtcgaaccaggaggcagtgatcacctaccaaccgtatctgatccagccggaggacctgcgcgatcatgtgaatgacatgggctttgaggcggcgatcaagtcgaaggtcgcaccgttgtcccttggtccaatcgatatcgaacggctgcagtcgaccaacccaaaacggccgctgagctcggcgaatcagaacttcaacaactcggaaactctgggacaccaggggtcccatgtggtgaccctccaactgcgcatcgacggaatgcattgcaaaagctgtgtgctcaacatagaagaaaacatcgggcagctgcttggagttcagagcatccaggtgtcactcgagaacaagactgcccaggtgaagtacgacccgtcctgcacttccccggtcgcgctgcaaagggctatcgaggctctcccgcccggaaactttaaagtcagcttgccggacggagcggaaggatccgggaccgatcacagatccagctcatcccacagccctggctcaccgccgcgtaatcaggtgcagggcacctgttctactaccctcatcgctatcgcgggtatgacgtgcgcttcctgcgtgcattcgatcgaggggatgatttcccaactcgaaggggtgcaacagatctcggtatccctggccgaagggaccgcaactgttctgtacaacccctcagtgatttcgccggaggaactgcgggctgccatcgaagatatgggatttgaagcgtccgtggtttccgaatcatgttcgactaatccattgggaaaccattcagcggggaactcgatggtgcagactactgatggaacccctacttccgtgcaagaggtggccccgcacactggtcggttgccagctaaccatgcaccggacatcctggccaagtcaccgcagtcgacccgcgccgtggcaccccaaaagtgcttcctgcagatcaaaggtatgacctgtgcgtcatgcgtgtcaaacattgaacggaacttgcaaaaggaagcgggagtcctgtcagtgctggtggcactcatggccgggaaggcagaaatcaagtatgatccggaagtcatccagccactggagattgcgcagttcatccaagacctgggattcgaggccgcagttatggaagattacgcaggcagcgatggaaacatcgagctcactatcacgggcatgacttgcgcctcatgcgtccacaacatcgagtccaagctgactcgcaccaatggaatcacctacgcctcagtcgccctcgctacctcaaaggcgttggtgaagttcgaccccgagatcatcggacctcgcgacattatcaaaatcatcgaggaaatcggtttccatgcgagcctggcacagagaaacccgaatgctcaccacctggaccacaaaatggaaatcaagcagtggaagaagtccttcctgtgctcgttggtctttggaatcccagtgatggccctgatgatctacatgcttattccgtcaaacgaaccccatcaatccatggtgcttgatcataacatcattcctggactgtctatcctgaatctcattttctttattctgtgtaccttcgtccaacttcttgggggatggtacttttacgtgcaggcctacaagagcctgagacatcggagcgctaacatggacgtgctgatcgtgctggcgacctctatcgcatacgtgtactcgctggtgatcctggttgtcgccgttgccgagaaggctgagagaagcccagtcaccttcttcgacactcctccgatgctgttcgtgttcatcgccctgggaaggtggctggagcacctggccaagagcaagacctccgaagccctggccaagctgatgtcgctgcaggccactgaggcgaccgttgttactcttggagaggataatcttatcatcagagaagagcaggtgccaatggagctggtccaaaggggtgacattgtgaaagtcgtgccgggaggcaagtttccggtggatggcaaggtcctggaaggaaacaccatggccgacgaatcgctgattactggtgaagccatgcctgtcaccaagaagcctggatccactgttatcgcagggtcgatcaacgcgcacggtagtgtgctcattaaagctacccacgtgggaaatgatactactctcgcccagatcgtgaaactggtggaagaggcccagatgtccaaagcacctatccaacaactcgcggatcggttttccggttactttgtgccatttatcatcattatgtccaccctgactctcgtcgtgtggatcgtgattggattcattgattttggagtggtccagcggtacttccctaacccgaacaagcacatcagccagactgaagtgattatccggttcgctttccaaacttcgatcaccgtcctgtgcatcgcttgcccatgtagcttgggactcgccaccccaacggccgtaatggttggcactggagtggcagcgcaaaacggcatcctcatcaagggaggcaaaccgctcgagatggcacacaagatcaagactgtgatgttcgacaagacgggcaccatcacccacggagtgccgagagtgatgcgggtgctgttgctcggcgacgttgctaccctcccattgcggaaggtgttggccgttgtcggcactgctgaggctagcagtgaacatccgctgggggtcgccgtgaccaagtactgcaaggaagagctgggtaccgagactcttggatactgcaccgacttccaagccgtaccgggttgtgggatcggctgtaaggtatcaaacgtcgaaggaattctggcccactcggagcgtccactgtccgctcctgctagccacctcaatgaggcaggaagtttgccagcagaaaaagacgccgtcccacagaccttctccgtgctgatcggaaacagggagtggctgcgcagaaacggactgaccatctcgtctgacgtctcagacgccatgactgatcacgaaatgaaggggcagactgcaattctggtggcgatcgacggagtcctctgcggaatgatagcgatcgcggatgcggttaaacaggaagccgctctggcggtgcacactctccagagcatgggcgtggatgtggtgttgatcacgggagacaacagaaagaccgctagagcaattgcaacgcaggtcgggatcaataaagtgtttgccgaagtgctgccttcacataaggtggcgaaagtgcaggagctgcaaaacaagggaaagaaggtggcgatggtgggagatggagtgaacgattccccggcgttggcccaggctgacatgggtgtcgccatcggcaccggtacggacgttgcaatcgaagccgccgatgtcgtactgatccggaatgacctgctcgatgtggtcgcatcgatccacctttccaaacgcacggtcaggaggatccgcatcaacctggtcctcgcactgatctataatctcgtgggaatcccgatcgccgccggtgtgttcatgccgattggcatcgttctgcaaccatggatgggatccgcggcgatggcagcgtcctcggtgtccgtggtgctcagctcactccagctgaagtgctacaagaagccggacctggagcggtacgaggcacaagcacacgggcatatgaagccgctgactgcgtcccaggtgtcagtgcatatcggtatggacgacagatggcgggattcaccgcgcgcgactccctgggaccaagtcagctacgtgagccaggtttcgctctcgtcgctcacctcggacaagccgtccagacacagcgcggcggcagatgacgacggggacaagtggagcctgctcctcaacggccgggatgaagaacagtacatc

SEQ ID NO: 7422 - DNA, 4395 bp, Artificial Sequence
  Description of Artificial Sequence: Synthetic coding sequence
atgcctgagcaggagagacaaatcaccgcacgcgaaggggccagccgcaaaatcctgagcaagctctcgctcccgaccagggcatgggagcctgcgatgaaaaagtcctttgccttcgataacgtggggtacgaagggggacttgatggtctgggaccttcaagccaggtggctaccagcactgtgcggatccttggaatgacctgtcagagctgcgtcaagagcattgaagatcgcatttcgaatctgaaggggatcatctccatgaaggtgtcacttgaacagggttccgcaacggtcaaatacgtgccttcggtcgtgtgccttcagcaagtgtgtcatcagataggagacatgggtttcgaagcaagcatcgcagaaggaaaggccgcatcgtggccatcaagatctctccccgcacaagaagcagtcgtcaagttgcgtgtggagggaatgacttgtcaaagctgtgtgagctccatcgaaggtaaggtgagaaagctccagggcgtggtgcgcgtgaaagtgagcctgagcaaccaagaggctgtgatcacctaccaaccttacctgatccaacccgaagatcttagggaccatgtgaatgatatgggttttgaggcagcaattaagagcaaggttgcccccctctccctcggtccgattgatatcgaacggctgcaatccactaatcccaaacgtccattgtcgagcgcaaaccaaaacttcaataacagcgaaaccctgggtcatcagggatcccacgttgtgaccctgcaactcagaattgatggaatgcattgtaagtcgtgcgtgctgaatattgaagagaacattggtcaactcctgggtgtgcaatccattcaggtgtcccttgagaacaaaaccgcgcaggttaagtacgatccttcctgtacgtcgccagtcgctctgcagcgtgccattgaagcacttccaccaggtaacttcaaagtgtcgttgccagatggcgcagaaggttcgggaaccgaccacagatcaagctcatcgcattcgccaggctcacctcccagaaatcaggtgcaagggacttgttccaccacgcttatcgcaattgccggaatgacctgcgcttcgtgtgtgcattcaattgaaggtatgatcagccaacttgaaggtgtccagcaaatttccgtgtccctcgccgagggaactgccactgtgctttacaatccttcagtgatttcccctgaagaactgagagcggcaattgaggacatgggattcgaggcctccgtggtgtccgagtcgtgctccactaatcctctggggaaccattcagccggcaactccatggtccagaccaccgatgggacccctacctccgtccaggaggtggcccctcatactggtcgccttcctgccaatcacgcacctgatattctggcaaagtcgcctcagtcgactagagccgtggcaccgcagaagtgttttcttcagatcaaaggtatgacttgcgcatcgtgcgttagcaacattgaacgcaacctgcaaaaggaagcgggagtgctctccgtgctggtcgctctgatggcaggtaaggcagaaatcaagtacgacccagaagtcatacaacctcttgaaatcgcccagtttatacaggatcttggttttgaagcggcggtgatggaagattacgcaggatccgatggtaacatcgaactcaccatcactggaatgacttgcgccagctgtgtgcataacatcgaatccaaacttacgcgcactaacggtattacttacgcaagcgtcgcactggcaacctcgaaggcactcgtgaagtttgacccagagattatcggtccccgggacatcattaagataattgaggaaattgggttccacgcatcgctggcacaacggaatcctaatgcacaccatctggaccacaaaatggagatcaaacaatggaaaaagtcattcctctgtagcctcgtctttggcataccggtgatggcacttatgatctacatgctgattccttcgaatgagcctcaccagtcaatggtgctggatcataacataattccaggacttagcattctcaatctgattttctttattctttgcaccttcgtgcagctgctgggaggttggtatttctacgtccaagcatacaaaagcctgaggcaccgaagcgcaaatatggatgtgctcatagtcctggctacttcaatcgcatacgtgtatagcctggtgatcctggtggtggccgtcgcagagaaggcagaaaggtcacctgtgactttctttgacactccaccgatgcttttcgttttcattgcacttggtcgctggctggagcaccttgccaagagcaaaacctccgaggcacttgcgaaacttatgtcgcttcaggccactgaagcaactgtggtaacccttggtgaagataatctgattattcgggaggaacaagtgccgatggaacttgtgcagcgcggagacatagttaaggtcgtcccaggtggcaagtttcctgtggatggaaaggtgttggaaggtaacactatggcagatgaatcgcttattaccggagaagccatgcctgtcaccaagaaacccggctcgactgtgattgcgggttcgatcaacgcacacggttccgtcctgattaaggcaacccatgtcggtaacgacaccacccttgctcaaattgtgaagctggtcgaagaagcacaaatgtccaaggcgcccatacaacagctggctgatagattctccgggtacttcgtgccattcatcataatcatgtcgactcttactctggtggtgtggattgtgataggattcatcgactttggcgtcgtgcaaaggtactttcctaacccaaacaaacacattagccaaactgaagtgattatcagatttgcctttcagacctcaatcacggtgctgtgtattgcctgcccttgtagcctgggactcgcaactcctaccgcagtgatggtcggtaccggtgtggcagcacaaaacgggatactcattaaaggtggaaagcctctcgaaatggcacataagattaagaccgtgatgttcgataaaaccggtactataactcatggcgtccctcgggttatgagagtccttctccttggtgacgtggcaacgctgcctctccgcaaggtgctcgccgtcgtgggtacggcagaggcatcatctgagcatcccctcggagtggctgtgaccaagtactgtaaggaggagctgggtaccgaaacccttggatactgtactgatttccaggctgtgcccggatgtggaatcgggtgcaaagtctcgaatgtcgagggaatccttgcacactccgagaggccactgtccgcaccggcctcccacctcaacgaagccggttcacttcccgccgaaaaggacgctgtgccccagaccttctcggtgcttattggaaatagagagtggctcagacgaaacggactcaccatcagcagcgatgtgtcagacgcaatgactgatcatgagatgaaaggacaaactgccattttggtcgctatcgacggtgttctgtgcgggatgatcgctatcgcagacgccgtcaaacaagaagcagcactggcagttcatacccttcaatcgatgggtgtggacgtggtcctgattaccggggataatagaaaaaccgctagagcgatagcaacccaggtcggtattaacaaagtgtttgcagaagtgctcccctcacacaaggtggccaaggtgcaggaactccagaataaaggaaagaaggtggccatggtcggcgatggagtgaacgattcacctgcccttgcccaagccgacatgggagtggcgattggtacgggcaccgacgtggctattgaggcagcagatgtcgtgctgatacggaacgacttgctggacgtggtcgcatcgattcatttgtcgaagagaactgttagacggattcgcatcaatctggtgcttgcgctgatttacaatcttgtgggaattcctatagcagcaggagtgtttatgccgatcggaattgtgctccaaccctggatgggctccgcggcgatggcagcaagctctgtctcagtggtgctctcttcgttgcagctcaagtgctacaagaagcctgatcttgaaaggtacgaggcacaggctcatggtcacatgaaacctcttactgcctcacaagtctcggtccatatcggtatggatgatcgttggcgcgactcgccaagagcaaccccgtgggaccaagtcagctacgtctcgcaagtctcgctgtcctcgctgacctctgacaagccttcgagacactccgctgcggcagatgacgatggagacaagtggagcctgctcttgaacggtcgggacgaggagcagtatatt

SEQ ID NO: 7423 - DNA, 4395 bp, Artificial Sequence
  Description of Artificial Sequence: Synthetic coding sequence
atgccagaacaggagcgccagattaccgccagagagggagccagccgcaaaattctgtctaagctgtcgctgcctacccgggcttgggagccagcaatgaagaaatctttcgcatttgataacgtgggctacgagggcggcctggacggattaggaccaagcagccaagttgctactagcacggttcgcattttgggcatgacttgtcaatcgtgtgtgaaaagcatcgaggaccgtatctccaacctgaagggaattatcagcatgaaggtgagcctggagcaaggctcggcaaccgtgaaatatgttccgtctgttgtgtgtcttcagcaggtctgccatcaaattggcgatatgggcttcgaagcctctatcgccgaaggcaaagccgcatcatggccatcacggagcctcccggcccaggaggccgttgtcaaactgcgcgtagagggaatgacctgtcaaagctgtgtgtcctccatcgaaggtaaagtacgtaaactgcagggtgtggtcagggttaaggtaagcctgtcaaaccaggaggccgtgatcacgtatcagccttatttgatacaacctgaagatctgcgcgatcacgtgaacgatatgggcttcgaagcagccatcaaatctaaggttgcaccactgtcgctcggtccgatcgatattgagcgacttcagtctacgaatcctaagcgacctctgtcgtctgctaatcagaacttcaataattccgaaaccctcggacaccaaggtagccatgtggtcaccctgcagctgcgcatcgatggaatgcattgcaaaagctgtgtgttgaacatcgaagagaatatcggccagctgctgggtgttcaatctatccaggtctcgctggagaataaaaccgcgcaggttaaatatgaccctagctgtaccagcccggtggcgctgcaacgcgccatcgaagccctgcctcctggtaattttaaggtgagcctgcctgacggagcagagggttctggtaccgatcacagatccagcagctcccacagcccgggttctccgccgcgtaaccaggtacaaggtacctgtagcacaaccctgatcgccatcgctggcatgacttgcgcctcatgtgttcattccatcgaaggcatgatctctcagctggagggggtccagcaaattagcgtttctctggcggagggcaccgcgaccgttctgtataatccgagcgtgatcagccccgaggaactgcgcgcagcgatcgaagacatgggctttgaggcctctgtggtgtcggaatcctgcagcactaacccgctgggcaatcactctgcgggtaatagcatggtacagaccacggacggtacccctacgtccgttcaggaggtggcgccgcacacaggtcgcctgccagcaaaccatgccccggatatcctggctaagagccctcaatccacgcgcgccgtcgcgccgcagaagtgctttctgcaaattaaagggatgacttgcgctagttgcgtgtctaacatagagcgaaatctgcagaaggaagcaggcgtgctgtcagtcctggtggctctgatggcgggaaaagctgagattaagtacgatcccgaggtgatccagccgttagagatcgctcagtttatccaagatctgggcttcgaggccgcggtgatggaggactacgcgggttctgacgggaacatcgaacttacgattacggggatgacatgtgcatcctgtgtccataacatcgagtcgaagctgactcgcaccaatggtattacatacgcgagcgtggcactggcgacgagtaaggcgctggttaagtttgatccagaaatcattgggccgcgagatattataaagattatcgaggaaattggttttcacgcttccctggcacaaaggaatcccaacgcgcaccacttggaccataaaatggaaattaaacaatggaagaagtccttcctgtgctccctggtgttcggtatcccggtgatggcactgatgatctatatgctgatccctagcaatgagcctcaccagtcgatggttctggatcataatatcatcccggggttgtcaattctcaacctgatcttttttatcctgtgcaccttcgtccagctgctggggggctggtatttctatgtgcaagcttacaagagtctgcgccaccgctcagcaaatatggacgttctgatcgtactagccactagtattgcgtacgtgtacagcctggtgatcctggttgtcgcggtagccgaaaaagcagaaaggtccccagtaactttcttcgacaccccaccaatgctatttgtcttcattgcactgggacgctggctggagcatctggccaagagcaagacctcagaagcgctggcaaaactgatgtctctgcaggcaaccgaagccaccgtggtgacgctgggtgaggacaacctcattattcgcgaggaacaggtcccaatggagttggttcaaaggggcgacattgtcaaagtcgtcccaggcggcaaattccctgtcgatggtaaagtcctcgaggggaacactatggcagacgagagtctgattaccggcgaagctatgccggtcacaaagaagccgggatccacggtgattgctggcagcattaacgcccacggtagcgtgttgatcaaggccactcacgtgggcaatgatacgaccctggcacaaattgttaagctggtcgaagaagctcagatgagcaaggcgcctattcagcaattggcggaccgtttcagcgggtatttcgtgccgtttatcataattatgagtactctaacattggtcgtgtggatcgttatcggttttatcgatttcggtgtcgtgcagcgttacttccccaacccgaataaacacattagccagaccgaagttattatccgcttcgcgtttcaaaccagcattaccgtgctgtgtatcgcgtgtccttgctcactgggtttggccactccgactgccgttatggtaggcaccggcgtcgcagcgcagaatgggattttgattaagggtggcaagcctctggaaatggcacataaaataaaaacggtcatgttcgacaagacgggtactattacccatggtgtcccacgcgtgatgcgcgtgttgctgttgggcgacgtggccaccctgccactgcgcaaggttctcgctgttgttggcaccgccgaagccagctctgagcatccgctgggtgttgctgtcaccaaatattgcaaggaggagttgggtacggaaactttgggttactgcacagattttcaggcagtcccaggttgtggcatcggctgcaaggtgagcaacgtggagggtattctcgcccacagcgagcgcccattgtcggcgccggcgtcccatctgaatgaagccggcagccttcctgctgagaaggatgccgtgccccagacgtttagcgttctaatcggtaaccgcgagtggctacgccgtaatggactgaccatcagctctgacgtttcggacgccatgactgaccatgagatgaaaggtcaaaccgctatcctcgtggctatagacggagtgctgtgtggcatgattgccattgccgacgctgtgaaacaagaggctgccctagcagttcacacgttgcaatccatgggcgtcgatgtcgtcctgatcacgggcgataaccggaagaccgcacgtgcgattgcaactcaagtgggcataaataaggtctttgcagaagtgctgccatctcacaaagtggctaaggtccaagagctccagaataaaggcaagaaggtggcaatggtgggtgatggcgtgaacgactccccagcgctggcgcaggcggacatgggcgttgccattggtaccgggacggacgtcgcaattgaggcggctgacgttgttctcattcgaaatgacctgctggatgtggtggcaagcatacacctgagcaaaaggacggtacgacgcatccgcatcaacctggtactggctctcatatataatcttgtaggtatcccgatagctgcaggggtcttcatgccaattggcattgtgctgcagccgtggatgggctcggccgcaatggcggcatcatctgtcagcgtagtcctctccagcctgcaattgaaatgctacaaaaagccagacctggagcgctacgaggctcaggcccatggccatatgaagcctctgaccgccagccaggtatccgtacatatcggcatggatgatcgctggcgcgactcgccgcgggcgactccttgggaccaagtgagctacgtgtctcaagtgtctctgagcagtctgactagcgacaagcctagcagacattccgctgccgcagacgatgacggtgataagtggtcccttctgctgaacgggcgtgatgaggaacaatatatt

SEQ ID NO: 7424 - DNA, 4395 bp, Artificial Sequence
  Description of Artificial Sequence: Synthetic coding sequence
atgcctgaacaagagcggcagattactgcccgagagggagcctcacgcaagatcctctctaaactcagcctccccacgagagcatgggagccagctatgaaaaagagctttgccttcgacaacgtggggtacgaaggtggtctggatggtctggggccatctagccaagttgcaaccagtactgtgcgaattttggggatgacatgccagtcttgtgtaaagtctatcgaagatagaatctccaatttgaaaggcattattagtatgaaagtttctcttgagcaagggagtgcaaccgtcaagtacgtgcccagcgtcgtttgcctgcagcaggtgtgtcatcagatcggcgatatgggctttgaggcttctatagcggaaggcaaggctgcatcatggccttctaggagcctccccgcccaagaagccgtcgtgaagttgcgggtggagggtatgacatgtcagagctgcgtgagctctatcgaaggaaaggtccgcaaactgcagggagttgttcgcgtgaaggtgtccctgtccaatcaagaagccgttataacgtaccaaccctatttgatccaacctgaggacttgagagaccacgtgaatgacatgggcttcgaggcagctatcaagtctaaggtggcccctctcagcctgggtcccatcgatatcgagcggctgcaatctaccaatcccaaacgccccctgagctccgcaaatcagaacttcaacaacagtgaaacccttggacaccaaggctcacacgtagtgacgctccaactccggattgacggtatgcattgcaagtcatgcgtgctgaacatcgaggagaatattggtcaactcttgggtgtccagtctatacaggtgtcactggagaacaaaacagcacaggtgaaatatgacccgtcatgcacgtcccctgtcgcccttcagagggctattgaggccttgccacctggtaactttaaggtgtccctcccagacggcgctgaaggttctggaactgatcaccgctcaagctccagtcacagcccaggttcacctccccgaaaccaggtacaggggacgtgttcaacgacactcattgctatagcaggtatgacatgtgctagttgtgtgcactctatcgaaggaatgatctcccagctggagggtgtgcagcagatctccgtgtcactggccgagggaacagcgaccgtgctgtataatccatcagtgatcagcccagaagagctgcgcgcagccattgaagacatgggatttgaggcctctgtcgtctccgaaagctgctctaccaaccctttgggcaaccacagcgccggcaacagcatggtgcagactactgacggaacgccaacatccgtgcaggaggtcgctccgcatacaggtcgactccccgccaatcatgcccctgacatactggcgaagtcccctcagtcaacgagagccgtcgctccccaaaaatgtttcctgcagattaagggcatgacctgtgcatcctgtgtatcaaacatcgaacggaacctgcagaaggaggcaggagttctgtccgtgctcgtggccctgatggccgggaaggcagagatcaagtacgatcctgaagtgattcagccgttggagatcgcacagttcatccaggatctgggatttgaagctgccgtaatggaagactacgccgggtcagacggcaatattgaactgactattactggaatgacctgtgcttcttgtgttcacaacatcgaatctaagctgacgaggactaacggtattacctacgctagcgtggcattggcaacttctaaagccctcgttaagttcgacccagagattatcggcccaagagatatcataaaaatcattgaagagattggttttcatgcgagcctggcccaaaggaatcccaatgcccatcacctggaccataaaatggagatcaagcagtggaagaagtctttcctgtgctcactggtattcgggatcccagtgatggctctgatgatctatatgttgatcccatctaacgagccgcaccaatccatggtacttgatcacaacatcattcccggtttgtctatcctgaatctgatattcttcattctttgcacctttgttcagctccttggcggatggtacttctacgtgcaagcctacaagtcactgaggcacagaagtgcaaatatggacgtgttgattgttctggcgacgtctattgcctacgtttattcactcgtgattctggtggttgctgtggcagagaaagctgagcgcagtcccgtgacgttctttgatacacctcctatgctgttcgtctttatagctctggggagatggctggagcatttggcgaaaagcaaaacctccgaagcgttggctaaacttatgtcactgcaggctacggaggcaactgtcgtgaccttgggcgaggacaaccttattattcgagaagagcaggtgcctatggaattggttcagcgcggagatatagtgaaagtcgtaccgggcggcaagttcccggtggatggtaaagtgctggagggcaatacaatggccgacgagtctctgattactggcgaagctatgcctgtgactaagaagcccgggtctaccgtaatcgctggctctattaacgcccatggttctgtgcttattaaggccacacacgttggaaatgacaccacactggcgcagattgtgaaattggttgaggaggcccagatgtccaaagcccctattcagcagttggccgataggttctccggatactttgtccctttcattattataatgtcaacgctcactctcgtggtttggatcgtaatcgggtttatcgattttggcgtggttcagaggtacttccctaacccaaacaagcatatctctcaaactgaagtcattattcggtttgccttccagacctctataaccgtgctctgtatagcatgtccctgtagcctggggctggccaccccgacggcagtgatggtagggacgggagtggctgcccagaacggcattcttattaaagggggcaaaccacttgagatggctcacaagataaaaacagttatgttcgacaaaacagggaccattacccatggggtgcctcgcgtgatgcgcgtcctcctgttgggggacgtcgctacactgcctctccgaaaggtgctggctgtggtggggaccgcggaggcgtctagcgaacaccctctgggggttgccgtcaccaagtattgtaaagaagagctgggcactgaaaccctcgggtactgtacagatttccaagccgtgccaggatgtggcattgggtgtaaagtgtccaatgtcgaaggcatcctcgcgcacagcgagcgaccgctgtcagctccagcaagtcatctgaacgaggccggctccttgccagccgaaaaagacgccgtgccacagactttctcagttttgattgggaatcgagagtggttgaggcgcaatggcctcacaataagctctgatgtaagtgacgccatgacggatcatgagatgaaaggacagaccgctatccttgtcgcgattgacggggttttgtgcggaatgatagctatagccgatgcagttaaacaggaagccgctctggcagtccacacattgcagagcatgggtgtggacgtggtgcttataacaggggataataggaaaacagccagagccattgccacacaggtgggtatcaacaaagtcttcgcagaggtgctcccttcccacaaggtggctaaggtgcaggagctgcagaataagggaaagaaggtggcaatggtcggcgacggcgtcaatgattcaccagccctggcgcaggccgacatgggggtggccatcggtaccgggacggacgtggccatcgaggccgctgacgtcgttctcatcaggaatgatctgttggacgtcgtggcgtccatccacctgtccaagaggacagtcaggaggatccgcattaatttggtgctggcccttatatacaaccttgttggcatcccaatagccgcaggagtgtttatgccgatcggtatagtattgcagccctggatggggtcagccgcaatggcagcatcatccgtctccgtagtattgtcttccctgcaactgaaatgttacaaaaagcccgatctcgagagatatgaggctcaggcacacggccacatgaagcccctgacagcctcccaggtgagcgtccatatcggaatggatgatcgctggagagatagccctcgagctacgccatgggatcaggtgtcttacgttagccaggtgtcattgtccagcctcaccagcgacaagcccagcaggcatagtgctgccgccgacgatgatggggacaaatggtccctgttgctgaacggaagggatgaagagcagtacatc

SEQ ID NO: 7425 - DNA, 4395 bp, Artificial Sequence
  Description of Artificial Sequence: Synthetic coding sequence
atgccggagcaggagagacagatcactgcacgagaaggcgcgtcacggaaaatcctgtccaagctgtccctgcctactagagcctgggagcctgcgatgaagaagagcttcgccttcgataatgtgggatacgagggagggctcgatgggctgggcccgtcatctcaagtggcgacctcaaccgtgcgcatcctgggcatgacgtgccagtcatgcgtgaagtcgatcgaggacagaatatcgaacctgaaagggattatctcgatgaaggtgtctctcgagcagggcagcgctacggtgaaatacgtcccaagcgtggtctgcttgcagcaggtgtgtcatcagatcggtgatatgggctttgaagcatccatcgccgaaggcaaagcagcctcatggccgtcccgcagcctgcccgcacaagaggctgtggtcaagctgcgggtggaaggcatgacgtgtcaatcatgcgtgtcctccattgaaggaaaggtccggaagctccaaggagtcgtgcgggtgaaggtgtcgctctctaaccaggaggcggttatcacctaccaaccgtacctgattcaaccggaagatctgagggatcacgtgaacgacatggggtttgaagcagctattaagtcaaaagtggctccactctcgctggggccgatcgatatcgaacggctgcagtcgacgaacccgaagcggccactgtcctcggccaaccagaatttcaacaattcggaaactttgggacaccaaggaagccatgtggtgactcttcaactcagaattgatggaatgcattgcaagtcgtgcgtcctcaatatcgaagagaatatcggacaactgctcggagtccagagcattcaggtatctttggagaacaagactgcacaggtcaagtacgatccgtcgtgcacctccccggtcgccctccaacgcgccatcgaagccctgccacctggtaactttaaggtttccctgcctgacggagccgaaggttccggaactgatcacagatcatctagctcgcatagccctggctccccgcctcggaaccaagtccaggggacctgcagcactactctcattgctattgcaggaatgacgtgcgcttcgtgcgtgcactccatcgagggtatgatctcacagctcgaaggagtgcagcagatttctgtgtcccttgcggagggcaccgcgactgtgctctacaacccgtcggttatttcgccggaagagctccgggccgctatcgaagatatgggatttgaagccagcgtggtttcagaatcgtgttcgaccaacccgcttggcaaccattcggcgggaaattcgatggtgcaaacgacggacggtactccgacttcggtgcaggaggtggctcctcacactggtaggctgccggccaaccatgcacctgacatcttggctaagtcgcctcagtcaactcgcgcagtggcgccgcaaaagtgtttcctgcagatcaagggcatgacctgtgcctcctgcgtgtcgaatatcgagcggaacctgcagaaagaggccggagttctgtcggtgctggtggcactcatggcaggaaaagccgaaatcaagtacgacccggaggtcatccagcccctcgagatcgcacaattcatccaagacctcgggttcgaagctgcagtgatggaagattacgctggatccgacggaaacatcgaactcacgattaccggtatgacctgcgcctcatgcgtgcacaacatcgaatcgaagctcacccggactaacggcatcacctacgctagcgtcgccctggcgacttcaaaggccctggtcaagttcgaccctgagatcatcggccctagggatatcattaagatcatcgaagagattggctttcacgcaagcctcgcgcaacggaatccaaatgcccaccatctggaccataagatggaaatcaagcagtggaagaagtcctttctctgctcgcttgtgttcggaatcccggtgatggccttgatgatctacatgcttatcccttcgaatgaaccgcatcagtccatggtgctggaccacaatatcatcccgggtctgtccattctgaacctcatctttttcatcctgtgcaccttcgtgcagctgttgggaggatggtacttctacgtgcaggcgtacaagtcactgcggcacagatctgctaacatggatgtcctgatcgtcctcgcgacttccatcgcttacgtgtactctctcgtgatcttggtggtagcggtcgcggaaaaagcggagcgctcgccagtgactttcttcgacactccgccaatgctcttcgttttcatcgcgctgggacgctggttggaacatctggcgaaaagcaaaacctcggaagcgctggccaaactgatgtcgctgcaagcaactgaagccaccgtcgtgacgctgggagaggataacctcatcatccgcgaagagcaggtgccgatggaactggtccaaagaggagacatcgtgaaagtggtgcccggaggaaagttccccgtggacggcaaggtcttggagggcaacactatggcagacgagtcgctgatcaccggtgaagccatgccggtgaccaagaagccggggtcgacggtgatcgccggctcaatcaacgcacacggatccgttctgatcaaggccactcatgtgggaaacgatacgaccttggcacaaatcgtcaagctcgtcgaggaagcacaaatgtccaaggcaccaatccagcagctcgccgatcgcttcagcggctacttcgtgccgttcatcattatcatgtccactctgactctggtggtgtggatcgtgattggcttcatcgatttcggagtggttcagcgctacttcccgaacccgaataaacacatctcgcagaccgaggtcatcatccggttcgccttccagacctcaatcaccgtgctgtgcatcgcgtgtccctgctcacttggcctcgctacgccgaccgccgtcatggtgggcaccggggtagcagcgcaaaatggcatcctcatcaagggcggaaaaccgttggagatggcgcacaagattaagaccgtcatgtttgacaaaactggcaccatcactcatggagtgcctcgggtgatgagggttctcctgctgggcgatgtcgcgactctccctcttagaaaggttctggccgtggtgggaaccgcagaagcgtccagcgaacatcctttgggagtggctgtgaccaagtactgcaaggaggaactcggaactgaaaccctgggctattgcaccgactttcaggcagtgccgggctgcggaattggttgcaaagtgagcaacgtggaaggaatcctggcgcactcggagcggccactgagtgctccggcatcccacctgaacgaagccggatccctcccggccgagaaggacgccgtgcctcaaactttcagcgtgctcatcggtaacagagagtggctgcgccggaacggccttacgatctcatccgacgtgtcagatgccatgaccgaccacgaaatgaagggccaaaccgcgatcttggtggcgatcgatggtgtgttgtgtgggatgatcgcgatcgccgatgcagtcaaacaagaagcagctctggccgtccatactctgcaatcgatgggcgtcgacgtcgtcctgatcaccggcgacaaccgcaagaccgcccgcgcaattgccacccaggtcggaatcaacaaggtctttgcagaggtgctcccatcgcacaaggtggccaaggtgcaggaacttcagaataaaggcaaaaaggtggccatggtgggagatggagtgaatgactccccggctctcgcccaggcagacatgggagtggccatcggaacggggactgacgtggctatcgaggcggcggacgtggtgctgatccgcaacgatttgctggacgtggtggcctcgatccacctctcgaagagaaccgtgcgcaggatccggatcaatctggttctcgcactcatctacaacttggtgggaatcccaatcgctgcgggcgtgttcatgcctatcggaattgttctgcaaccatggatgggctcggccgcaatggccgcctcgtcagtgtcagtcgtgctgtcaagcctgcaactgaaatgttacaagaagccggatttggagcgctacgaagcgcaggctcacggacatatgaagccactcaccgcttcgcaagtgtctgtgcatatcggcatggacgacaggtggcgggatagcccgagagcgaccccgtgggatcaagtctcctacgtgtcccaagtctccctttcatcccttacttcggacaagccctcgaggcattcggctgcggccgacgacgacggggacaaatggagcctcctgctgaacggacgggatgaagagcaatacatt

SEQ ID NO: 7426 - DNA, 4395 bp, Artificial Sequence
  Description of Artificial Sequence: Synthetic coding sequence
atgccggaacaagagcgccaaatcaccgcccgcgagggcgcatcccgcaagatcctgtcgaagctgtcgctgcctacgcgcgcctgggaacccgccatgaaaaagtcgttcgcctttgacaacgtgggctacgagggcggcctggatggattgggaccgtctagccaagtcgccacttcgactgtcagaatcctcggaatgacctgccagtcgtgcgtgaaatccatagaggatcgaataagcaacttgaagggaatcatctcgatgaaggtgtcattggaacagggatccgcgaccgtgaagtacgtgccgtcagtcgtctgcctgcaacaggtttgccatcagatcggggacatgggctttgaggcgagcatcgcggaaggcaaggccgcctcgtggccaagccgctccctgccggcacaggaagccgtcgtgaagctccgggtcgagggcatgacctgccaatcgtgcgtctcgtcaatcgaagggaaggtgcggaagctccagggagtggtgcgcgtgaaagtgtcactgtcgaaccaagaggcggttatcacttaccaaccctaccttatccagccagaagatctgagggatcacgtcaacgatatgggatttgaggccgcgatcaagagcaaggtcgcccctctctcgcttggaccgatcgacatcgaacggctccagagcaccaacccgaaacgccccctctcctcggccaaccagaactttaacaactcagagactctgggccaccaaggatcccacgtggtcaccctgcaacttagaatcgatggaatgcactgcaagagctgcgtgctcaatatcgaggagaatatcggtcagctccttggagtccaatcgatccaggtttcactggagaacaagaccgcccaggtcaaatatgacccgagctgcacctcaccggtcgctctgcagcgggcgatagaagccctgccaccaggcaactttaaagtgtccctcccggacggggccgagggatcaggaactgaccaccggagctcgtcctcgcactctccgggaagcccaccgcggaaccaggtgcaggggacttgctcgaccaccctgatcgctatcgcagggatgacgtgcgcatcgtgcgtgcactcgattgagggaatgatttcacaactggaaggagtccaacagatcagcgtgtcgctcgcggaggggacggcgaccgttctttacaatccatccgtcatctccccggaggaacttagagctgccatcgaagatatgggattcgaggcgtcggtggtgtcggagtcatgctcaactaatccgctgggcaatcattctgcgggtaactccatggtgcaaaccaccgacggaacccccacctctgtgcaggaggtggccccgcacactggaagattgccggcaaaccacgcccctgacatcctggcgaagtcaccgcagagcacccgcgcagtggcgccgcagaaatgcttccttcagataaaaggcatgacgtgtgccagctgcgtgagcaacatcgagcggaatctccaaaaagaggcaggcgtgctgtctgtcctggtcgcactgatggcggggaaggcggaaatcaagtacgacccggaggttattcagccgttggagatcgctcagtttatccaggatctgggctttgaagcggctgtcatggaagattacgcaggctccgatggcaacatagaactgaccatcactggtatgacttgtgctagttgcgtccacaacattgaatccaaactgactaggactaacggaatcacttacgctagcgtggccctcgccacctccaaggcactggtgaagttcgacccggagattattgggccacgcgacattatcaagatcattgaagaaatcgggttccacgcttcgctggctcagagaaatccaaatgcgcatcacctggaccataagatggaaatcaaacagtggaagaagtccttcctttgctcactcgtgttcggaatccctgtgatggcgctgatgatctacatgttgatcccatcgaacgaaccgcaccagtcgatggtcctggaccacaacattatcccaggattgtccattctgaatctcatcttcttcatcttgtgcactttcgtgcagctgctgggtggttggtacttctacgtgcaggcctacaaatcgctccggcatcggtccgcaaacatggatgtcctgattgtgctggctacctcgatcgcttacgtctactcactggtgatcctggtggtggcggtggccgagaaggccgaaagatcccccgtgacttttttcgatactccgccgatgctcttcgtgttcatcgctctgggacgctggctcgaacatttggctaagagcaaaacctccgaagcgttggcgaagttgatgtccctgcaggctaccgaagccaccgtggtgactctgggcgaggacaacctgatcatccgagaggaacaagtgcctatggaactggtgcagaggggagatatcgtgaaggtcgtgccgggaggcaaattcccggtggatggaaaggtccttgagggaaacactatggctgatgagtcgctgatcactggagaggccatgccagtgactaagaagcctggaagcactgtgatcgccggttccatcaatgcccacggatcggtgctcattaaagctactcacgttggaaatgataccaccctcgcccagatcgtgaagctcgtcgaagaggcgcaaatgtcgaaagcgccgatccagcaactggcagatcgcttctcgggatacttcgtgccgttcatcatcattatgtcaaccctgactttggtggtgtggatcgtgatcggattcattgacttcggcgtggtgcagcggtacttccctaacccgaacaagcacatttcacagaccgaggtcatcattaggttcgcgttccagacctcgatcaccgtgctctgcatcgcctgtccatgttccctggggctggcgactccaactgcggtcatggtaggaaccggcgtggctgcacaaaacggaattctgatcaagggcggaaaaccgctggaaatggcgcacaagatcaaaaccgtcatgttcgataagactggaactatcacgcatggcgtgccccgcgtcatgagggtcttgctgctgggcgacgtggcaactctcccactgcggaaggtcctggccgtggtgggaactgccgaagccagcagcgaacatccgttgggagtggccgtgaccaagtattgtaaggaggaactgggaaccgaaacgctgggctactgcaccgattttcaggcggtcccggggtgtggaatcggatgcaaggtgtcgaacgtcgaaggcattctggctcattccgaacgccctctctcggcgcctgcctcacatctcaacgaagcaggctccttgccggccgagaaggatgcggttccgcagaccttttcggtgctgatcggaaaccgggaatggctgcggagaaatggactgaccatcagctccgacgtctcggacgcgatgaccgatcatgaaatgaagggccagaccgcgattctcgtcgcgatagacggagtgctgtgtggaatgatcgcgattgcggatgcagtgaagcaggaagctgccctggccgtgcatactctccaatccatgggagtcgatgtcgtgctgatcaccggagataataggaaaactgcaagagccatcgcgacgcaggttggaatcaacaaggtctttgcagaggtgctgcccagtcacaaggtggcaaaagtgcaagaactgcaaaacaagggaaagaaggtggcaatggtgggtgacggcgtgaatgactcgcctgccctggcccaagccgacatgggggtggcgatcggcactggaactgatgtggcgatcgaagccgctgatgtggtgctgatcagaaacgacctgctcgatgtggtggcttccatccacctcagcaagcggaccgtccggcgcatcagaatcaatcttgtgctcgccctgatctacaacctggtgggcatcccaatcgcggccggagtgttcatgccgatcggaatcgtgctgcagccgtggatgggttcagcagcaatggctgcttcatcggtgtcagtcgtcctgtcctcactgcagctgaaatgctacaagaagcctgacctggagcggtacgaagcccaggcccatggtcacatgaagccactgaccgcctcccaagtgagcgtgcacattggaatggacgacaggtggcgggattcgccacgggctactccatgggatcaggtcagctacgtgtcgcaggtgtccctgagctccctcacctcagataagccatcccggcactcggcagcggcagatgacgatggagacaagtggagcctcctgctcaacggacgcgacgaagagcagtacatc

SEQ ID NO: 7427 - DNA, 4395 bp, Artificial Sequence
  Description of Artificial Sequence: Synthetic coding sequence
atgcctgagcaagagaggcagatcacggcccgggagggggccagccggaagattctctctaaacttagtctgccgactcgggcgtgggaaccagccatgaagaagtcattcgctttcgacaatgtcggatacgaaggaggcctggatggtctgggaccgtcctctcaggtcgccacctcgacggtgcgcatcctggggatgacctgccaaagctgtgtcaaatccatcgaggatcggatcagcaatttgaagggaatcatcagcatgaaggtgtcacttgagcagggctccgcgaccgtcaagtacgtcccatccgtggtctgcctccaacaggtgtgtcaccagatcggagacatgggattcgaggcctcaattgcggagggcaaggccgccagctggccaagcagatccctcccagcgcaagaagctgttgtgaaactccgcgtggagggcatgacttgccagtcgtgcgtctcctcgatcgaaggaaaggtccggaagctccagggggttgtgcgcgtgaaggtgagcttgtccaaccaagaagccgtcatcacctaccagccatacctcatccagcctgaagatctgagagatcatgtgaacgacatgggctttgaggccgctatcaagtcaaaggtcgccccactgtcgctgggaccaattgatatcgaaagactgcagtcaactaaccccaaacgcccgcttagctccgccaatcaaaacttcaacaactcggaaactctgggccaccaaggctcccacgtcgtgactctgcagctccggatcgatggaatgcattgtaaatcctgcgttctcaacatcgaggagaatatcggtcagctgctcggcgtgcaatcgatccaggtcagccttgagaacaaaaccgcacaagtgaaatacgacccgtcctgcacttcaccagtcgcactgcagcgagcaatcgaggcgctcccgccgggaaacttcaaagtctcactcccagatggggccgaaggatccggtacggaccataggagcagctcgtcgcactccccggggtcgcccccgcggaaccaagtgcaaggaacttgttccactaccctcatcgcgatagccggaatgacctgcgcatcctgcgtccattcaatcgaaggaatgatctcgcaactcgaaggagttcaacagatcagtgtgtcgttggcggagggaaccgctaccgtgctgtacaatccatccgtgatcagcccggaagagctccgggccgccattgaagatatgggattcgaagcctcggttgtgtcagaatcctgcagcaccaaccccctgggaaaccactccgccggcaactccatggtccaaactaccgacggcacccccacctcggtgcaggaagtagccccgcacacggggcgcctgcccgccaatcatgcaccggacatcctggcgaaatcaccgcagtcgacccgcgcggtggcgccgcagaagtgcttcctccagatcaagggaatgacctgtgctagctgcgtgagcaacatcgagcggaatctgcagaaggaggccggagtgctctccgtgctcgtggcattgatggctggaaaggcagaaatcaaatacgaccctgaagtgattcaaccactggaaatcgcgcaattcatccaggacctggggttcgaggctgctgtcatggaggactacgcggggtcggatggaaatatcgaactgaccattaccggaatgacttgcgcttcatgtgttcacaacatcgaaagtaaactgactcggactaacggaatcacctatgctagcgtcgctctcgccacgagcaaggctcttgtgaagttcgacccggagatcatcggaccaagggacatcatcaagattatcgaggaaatcggctttcatgcgtcactggcccaacgcaacccgaacgctcaccacctggaccataagatggagatcaagcaatggaagaagtcgtttctctgtagcctcgtgtttggtatccccgtgatggcactcatgatctacatgcttattccgtcgaatgaaccgcaccagtcaatggtcctcgatcacaatatcatccccggcctgagcatcctgaatctcatcttcttcatcctgtgcacttttgtgcagctcctcggaggttggtatttctacgtgcaggcgtacaagtcgctgagacacaggtctgcgaacatggacgtactgatcgtgcttgccaccagcatcgcatacgtctactcactggtcattctggtggtcgctgtggcggaaaaggccgagagatcgcctgtgactttctttgacactcctcctatgttgtttgtgttcattgctctgggtcgctggctcgagcacctggctaaatcaaagacttcagaagccctggccaaactgatgtcgctgcaggcgactgaggccaccgtcgtcactctgggagaggacaacctgattatacgggaagaacaagtgcctatggaactggtgcaacgaggcgacatcgtgaaggtcgtgcctgggggaaagttcccggtggacggaaaggtcctggaaggaaacaccatggccgacgagtccctgattactggcgaggcaatgccggtgactaagaagccgggatcgactgtcatcgctggatccattaatgctcatgggagcgtcctgatcaaagccactcacgtcggtaatgacactaccctggctcagattgtgaagctcgtggaagaagcacaaatgtcgaaggcgcctatccagcagcttgctgacagattttcaggctacttcgtgccgttcatcatcatcatgtcgaccttgacccttgtagtgtggatcgtgatcggattcatcgacttcggagtcgtccagcgttacttcccgaatccgaacaagcacatcagccagaccgaagtgatcattcggttcgcgttccaaacctcaatcacggtgctgtgcatcgcatgcccgtgctcgctcggccttgcgacccctacggccgtgatggtgggaaccggggtagcggcccagaatgggatactgatcaagggcggtaagccgctggaaatggcccataagataaagaccgtgatgttcgataaaaccggcaccatcactcacggagtgccgcgcgtgatgcgcgtgctgctgcttggagacgtggctaccctcccactgaggaaggtgctggcggtggttgggactgcagaagcatcctccgagcaccccctgggcgtcgccgtgaccaagtactgcaaggaagaactgggaaccgagactctgggatactgcactgatttccaagcagtgccgggctgcggcatcggttgcaaggtgtccaacgtggaaggaatccttgcacactccgaaagacctctgtcagcacctgcctcacatcttaacgaagccggatcactgcccgccgagaaggacgccgtgccacagaccttttccgtgctgatcggcaatcgcgagtggctgcgccgcaatggtcttactatttcgtccgacgtatctgatgccatgactgatcacgagatgaaggggcagaccgccatcctcgttgccatcgatggagtcttgtgcggaatgatcgcgatcgcggatgcagtgaagcaggaagcagcactggccgtgcatacgttgcaaagcatgggagtcgatgtcgtgctgatcaccggagataatcgcaagaccgcccgcgctatcgcgactcaggtgggaatcaacaaggtgtttgccgaggtcttgccatcccacaaggtggcgaaagtgcaggaactccagaacaaggggaaaaaagtggcgatggtgggcgacggcgtcaacgactcgccagccttggcccaggccgacatgggtgtggccattggaactggtactgacgtggccatcgaggctgcggacgtcgtgttgattaggaacgacttgctggatgtagtagcgagtattcatctttcgaaaagaaccgttcggcgcatccggattaacctggtgctggccctcatctacaacctcgtaggaatcccgatcgcagcgggagtgttcatgccaatcggcatcgtcttgcaaccttggatgggttcagcggcaatggcagcctcatctgtctccgtggtgctgtccagccttcagctcaagtgttacaaaaaaccagatctggaacggtatgaagcgcaggcacacggccatatgaaaccgctcaccgcttcgcaagtttcggtgcatatcggcatggacgaccgatggcgcgactcgcctagagcaacgccatgggaccaggtgtcctacgtgtctcaggtgtcgttgtcgagcctcacgagtgataagccgtctcgtcactccgccgcagccgacgatgatggggacaaatggtcactgctgctcaacggtagagatgaggaacagtacatt

SEQ ID NO: 7428 - DNA, 4395 bp, Artificial Sequence
  Description of Artificial Sequence: Synthetic coding sequence
atgcccgagcaggaacggcaaatcaccgccagggaaggggccagtcgtaagatcctaagtaaactaagcttgccaacccgcgcttgggagcctgcgatgaaaaagagctttgccttcgacaacgtgggatatgagggcggcttggacggacttggaccaagcagccaggttgctaccagcaccgttaggatattgggaatgacttgccaatcatgcgttaaaagcatcgaagacaggatttctaatctaaaggggattatctcgatgaaggtctcactggaacaggggtctgctactgtgaaatatgtcccgtctgtggtctgcctgcaacaggtttgtcatcagataggggacatgggcttcgaagcatccatcgcagagggaaaggctgcttcttggccaagtcggtctctgccggctcaagaagcagtcgtgaaactgcgggtggagggcatgacttgtcagagctgcgtgagttctattgaaggcaaggtgcgcaaactgcaaggcgtggtgagggttaaggtgtccctgtctaatcaggaggctgtgatcacctaccagccatatctgattcaacccgaagatctgcgcgatcatgtaaatgatatgggattcgaagccgctatcaaatcgaaggtggcgcctttgtcccttggccctatcgacatcgagcgactacagtccactaacccaaaacggccactcagttctgctaatcagaacttcaataattcagaaacattggggcaccaaggcagccacgtcgtaacgttgcagcttcgcattgacggtatgcattgtaagagctgtgtcttaaatatcgaagagaacatcggccaactcctgggtgtgcagagtattcaggtctccctcgagaacaagacagcccaggttaaatatgacccctcctgcactagccctgtcgcgctacagcgggctatagaggctctccccccagggaactttaaggtttctctgcccgacggcgctgaaggctctgggacggaccatcgctcttcatcttcacatagccctggatctccccctagaaatcaggtccaggggacttgtagtactactttgatcgctatagctggaatgacctgtgcatcttgtgtccactccattgaggggatgatctctcagctggagggcgtgcagcagattagcgtctctctagcagagggaacagcgacggttctgtataaccccagcgtgatcagcccggaggaactgagagcagctatcgaggacatgggctttgaggcttctgtggtgagtgagtcatgttccaccaatccactgggcaaccattccgctgggaatagtatggtccaaacaaccgacggaacaccaacaagcgtgcaggaagtggcccctcatacaggccgacttcctgctaatcacgcaccagatatcctcgcgaagagtccacagtctacacgggcagttgccccccagaagtgttttctgcagataaaagggatgacctgcgcgtcatgcgtgagcaatatcgagcggaacctgcaaaaagaggcaggagtactgagcgtgttagtggcactgatggcaggtaaggcagagatcaagtatgatcccgaagtgatccagcccctcgaaatcgcccagtttattcaagacctcggctttgaagccgcggtaatggaggactacgccgggtccgacggaaatatcgagctgacaatcaccggcatgacttgtgcctcctgtgtgcataacatagaaagtaaactgacacgtactaacgggataacctatgcgtccgtggctctagcaacaagcaaagctctggtgaagtttgatccagaaatcatcggaccgagggatataataaagattattgaggagattggattccacgcaagtttagcacagcggaacccaaacgcacaccacctagatcacaagatggagatcaagcaatggaagaagtccttcctctgttctcttgtcttcggcattcccgtgatggctctcatgatatacatgttgatcccgagcaacgagccccaccaatccatggtccttgaccacaacatcattccgggcctcagcatcctcaacctcatattcttcattctgtgcacctttgtgcagcttctaggtggatggtatttctacgtgcaggcttataaatccctgcgtcaccgctctgcgaatatggatgtgctgatcgtgttggccacctctatagcctatgtctatagtctggttatccttgtcgtggccgttgctgaaaaagcggagcgctcacccgtcactttcttcgatacacctcccatgctgtttgtgttcatagcattgggccgttggctggagcacctagcaaaatccaaaaccagcgaagctttggcaaagctgatgagcctgcaagctacagaagcaaccgttgttactctcggcgaggataacctaatcatcagggaggaacaggtaccaatggagctggttcaaaggggtgatatagttaaggtggttccgggcgggaagtttcccgtggatgggaaagtgctggaaggtaacaccatggccgacgagagtttgatcaccggggaggctatgcccgttacaaagaagccgggaagcacagtcatcgctgggagcatcaacgctcatggtagtgttctgattaaggctactcacgtcggcaatgacaccacgcttgctcagatcgtgaaactcgtcgaggaagcccaaatgtcgaaagccccaatccagcagctggctgacaggtttagcggatacttcgtcccatttatcataatcatgtctacattaacactcgtggtttggatcgtgattggctttatcgacttcggggttgtacaaaggtattttcccaaccctaataagcatatatcccaaaccgaggttatcatcaggtttgctttccaaacttcaatcaccgtcttatgtatcgcctgcccatgttcactcggactagccacaccaacagctgtgatggttgggacgggggttgcagcccaaaatggtatcctgatcaaaggcggcaaaccactcgagatggcacataagatcaaaactgtgatgttcgataaaacaggcacgatcacccacggcgtgcctcgcgtaatgagagtattgctgctgggcgacgtggccactctccctttgaggaaagtgctagccgttgtgggtaccgcggaggcttcatctgaacaccccctcggggtggctgttaccaaatactgcaaagaggagctcggtaccgagaccttaggctactgtacagattttcaggccgttcccggttgcggaatcggctgcaaggttagcaatgtagaggggatcctggcccatagcgagcgtcccttgtctgctccagcctctcatctgaatgaggctggcagtctgccagctgagaaagacgctgtgccccaaacctttagcgtgctcattggcaatcgagagtggctgcgccggaacgggcttactattagctccgacgtgagcgacgcaatgacggaccatgaaatgaagggccagacggcaattctcgttgccattgatggggttctgtgcggcatgattgccatagccgacgctgtgaaacaggaagccgctcttgccgttcacaccttgcagagcatgggggtcgatgtagtgttgatcacaggagacaatcgcaagactgcacgggccattgccacccaggtgggaatcaacaaggtctttgccgaagtcctgccctcacataaggtggccaaggtccaggagctccagaataagggcaagaaggtggccatggtgggcgatggcgtaaatgatagtcctgccttggctcaggctgatatgggtgtagctatcggcacgggcaccgatgtggcaatcgaagcagccgatgtcgttttgatccgaaatgacttactggacgtggttgcaagcatccacctgtctaaacgaacagtaaggagaatccgaataaatctggtacttgccctcatttataatctagtgggtattcctatcgcagcgggcgtttttatgcccattggaatcgtcctgcagccttggatgggctctgctgcaatggctgcatcttccgttagcgtagtgttgtcatccctacagctgaagtgctataagaaacccgacttggaaagatacgaggcacaagcccatgggcatatgaaaccgctcacagcaagccaggtcagtgttcacattgggatggacgataggtggagagactccccaagggcaactccatgggatcaggtctcttacgtttcccaggtaagcctcagctccctgacttcggacaagcccagtcggcacagtgccgcggctgatgatgacggggacaaatggtcgcttctgctcaacgggcgtgacgaagagcagtatatc

SEQ ID NO: 7429 - DNA, 4395 bp, Artificial Sequence
  Description of Artificial Sequence: Synthetic coding sequence
atgccagaacaggaacggcaaattaccgcgagagaaggggcatcgcgcaagattctgagcaaactttcccttcctaccagagcctgggagccagcgatgaaaaagagctttgcattcgacaacgtggggtacgaaggtggacttgatgggctgggcccttcctcccaagtggcgacctccaccgtgcgcattcttggcatgacttgtcaaagctgtgtcaagtcgattgaagatcggatctcaaacctgaagggaattatctcaatgaaagtgagcctcgagcaaggatccgccaccgtgaagtacgtacctagcgtcgtgtgcctgcaacaggtgtgtcatcagattggtgacatgggttttgaggcatcaattgccgaaggtaaggctgcatcgtggccatcccgctctctgcccgcacaggaggcggtggtgaagctccgagtcgagggaatgacgtgtcaatcatgcgtgtcatccattgagggaaaagtgagaaagctccaaggtgtcgtcagggtcaaggtgtcacttagcaatcaggaggccgtgatcacctaccaaccatacctgattcaaccggaagatcttagagatcacgtgaatgacatgggctttgaagcagcaattaagagcaaggtcgcaccgctgagcttgggtcctatcgacatagagcgcctccaatcaacgaatcctaagcggcccctcagctctgcgaaccagaatttcaacaactccgaaacccttggtcaccagggttctcatgtcgtgaccctgcagcttagaatagacggcatgcattgcaagtcgtgtgtactgaacatagaagaaaacattggacagctgctcggagtgcaatcgatccaagtgtcacttgaaaacaagactgcccaagtgaagtacgatccaagctgtacctcccctgtggcgcttcagcgagcaattgaagctctcccccctggtaatttcaaggtcagccttcctgacggcgcagaaggaagcggcactgatcatcgctcgtcctcgtcgcatagcccagggtcgcctcctcgaaaccaagtgcagggaacctgttcgaccacccttatagctatcgcgggaatgacttgtgcttcgtgtgtgcattcgattgaaggcatgatcagccagcttgaaggagtccagcagatctccgtctcacttgcggaggggactgcaactgtcctttacaacccttcagtgatatctcctgaagaacttcgggcagcaatcgaagatatgggattcgaagcgtcggtcgtgtcagaaagctgctccactaatcctttgggtaatcactcggccggaaactcaatggtccaaaccacggatggtaccccaacttcagtccaggaggtggcaccacacaccggtcgtctgcccgcaaaccacgcccctgatatccttgcaaagtccccccaaagcactcgcgccgtggcaccacagaagtgctttctccagattaagggcatgacctgtgccagctgtgtcagcaacatcgaacggaatcttcagaaagaagcgggcgtgctttcggtcctcgtggcgcttatggcagggaaggctgagataaagtacgatcccgaagtaattcaaccccttgaaattgcgcagttcattcaggatctgggtttcgaagcagctgtgatggaagattacgccggatcagatgggaacattgaacttacgataactgggatgacctgtgcgtcatgcgtgcacaatatagagagcaagctgactcgcaccaacggaatcacttacgcatccgtggcccttgccacctccaaggcactcgtgaagttcgatcccgagattatagggcctagagacataatcaagatcatcgaggagatcggttttcatgcatcactggcacaaagaaatcctaatgcccaccatctggaccacaaaatggagataaagcagtggaagaagagttttctgtgctcacttgtttttggtattccggtcatggcattgatgatctacatgctgataccgtccaatgaaccgcatcaatccatggtgctcgaccacaacatcattccaggtctttcgatactgaacctcattttctttatcctgtgcacttttgtccagctgcttggcggctggtacttttacgtccaggcctacaagtctctgcggcatcgttcagccaacatggatgtgcttattgtgttggccacctccattgcatatgtgtactccctcgttatcctcgtcgttgcagtcgcggagaaagcagaaagaagccctgtgacgttttttgataccccgcccatgttgtttgtgtttatcgcactcggcaggtggcttgaacatctggcaaaatccaaaacctctgaagcgctggcaaagctgatgtccctccaagcgaccgaagccaccgtggtcactctgggggaggacaacctcattatccgagaagagcaagtccctatggaacttgtgcagcgcggggatatcgtgaaggtagtgcccggaggaaaattccccgtggacggaaaggtgcttgaaggaaacactatggcagacgaatcgcttattactggtgaggccatgcctgtgactaaaaagcctgggtccaccgtcattgcaggctcaattaacgcccatggatccgtgttgattaaggctacccatgtaggaaacgataccactcttgcacaaattgtgaaacttgtcgaggaggcacaaatgtctaaggctcctatacagcaactcgctgatcgcttttcgggatacttcgtgccttttatcatcattatgagcaccctgaccctcgtagtttggattgtgattgggtttattgatttcggagtcgtgcaacgatactttccaaatccaaacaagcatatctcgcaaaccgaagtgataatcaggtttgcatttcaaacctccattactgtcctttgcattgcatgtccctgttcgttgggtcttgctactccaactgccgtgatggtgggtacgggggttgcggcacaaaacggaatactgattaaaggaggcaagccactcgagatggcacataagattaagacggtgatgtttgataaaaccgggaccataactcacggtgtgcctcgagtgatgagagtgctgctgctgggcgatgtggccaccctccccctccgaaaggtgttggcagtggtgggaactgcggaggcatcatccgaacatcctcttggggtggcagtgacgaagtattgtaaagaagaactgggaactgaaaccttgggatactgcactgattttcaagccgttcctggttgtggaatcggttgtaaggtgtccaacgtggaaggaattctggcgcacagtgaacgtccactgtcggcacctgcatcgcatttgaatgaagcaggctcacttccggcagaaaaggatgctgtgccacaaactttctcggtcctcatcggaaatagggagtggctccggaggaacggcctgactatttcgtccgatgtttcggacgcaatgactgaccacgaaatgaagggtcagactgcaattcttgtcgccatcgacggggtcctttgcggcatgatcgcaattgcagatgcagttaaacaagaagccgcactggcggtccataccctgcagtcgatgggagtggatgttgtgctgataaccggagataatagaaaaactgccagagcgatagccactcaggtgggcattaacaaagtgttcgcagaggtcctcccttcacataaggtggctaaagtgcaagaactgcagaataagggtaagaaggtggcaatggtaggggacggcgtgaacgattcgccggcccttgcacaggcagacatgggagttgccatcgggaccggaacggacgtggccattgaagccgcagacgtggttttgatccggaacgatttgctggatgtggtcgcatccatacacttgtcgaagaggaccgtcagaagaattagaatcaacctggttctcgccctgatctataacctcgtgggcattccaatagcagcaggtgtgttcatgccgatcggtattgtcctccaaccatggatggggtcggcggcgatggcagcttcgagtgtgtctgtggtcctgagctccctccaactcaaatgttacaaaaagccggacctggaacggtacgaggcacaagctcacggtcatatgaaaccactcactgcatcccaagtctctgtgcatattggcatggatgatcgttggcgcgactcgccgcgggctaccccgtgggatcaggtgtcgtacgtgtcgcaggtgtcgctttcttcccttacttccgacaagcctagcaggcatagcgctgcggcagatgacgacggcgataagtggtcactgctgttgaatggtcgtgatgaggaacaatacatt

SEQ ID NO: 7430 - DNA, 4395 bp, Artificial Sequence
  Description of Artificial Sequence: Synthetic coding sequence
atgccggaacaagaacggcaaatcaccgcaagggagggggcctcgaggaagatactgtcaaaactgtcgctgccgactcgcgcatgggaaccagcgatgaaaaagagctttgcattcgataatgtcggatacgagggcggactggatggactgggtccgtcatcacaggttgccactagcacggtcaggatcctcggaatgacttgccaaagctgcgtgaagtcaatcgaggacagaatctcgaacctgaagggcatcatctcgatgaaggtgtcccttgaacagggatctgccaccgtgaagtacgtgccttctgtggtctgcctgcaacaggtgtgccaccagattggagacatgggtttcgaagcgtccatagcagaaggtaaagcagcctcctggccatctcgaagcctcccggcccaagaggccgtggtcaagctgcgcgtagagggaatgacgtgtcaatcatgcgtctcatccatcgagggcaaagtgcgaaaactgcagggcgtcgtgcgcgtcaaagtgagcttgtctaaccaggaggctgtgatcacctaccagccgtacctcatccagccggaagatctgagagatcacgttaatgacatgggattcgaggcggcgatcaaatccaaggtggccccgctgtcactgggccccatcgatatcgaacgcctccagtccactaacccgaagcgcccgctgtcctccgcaaatcagaatttcaataactccgaaaccctcggccaccaaggatcccatgtggtcaccctgcagcttcgcatagatggcatgcactgcaaatcctgcgtcctcaacatcgaagagaatatcgggcagctcctgggagtgcagtcgatccaggtgtctctggaaaacaaaaccgcccaggtcaagtacgacccgtcctgcacctcgcccgtcgctttgcagagagccattgaggcgctcccaccaggaaactttaaagtgtcacttcccgatggagctgaagggtcgggaaccgatcaccgcagcagctcaagccactcccctggctcacccccacggaaccaagtgcaaggaacttgctcaactaccctcatcgcgatcgctgggatgacctgcgcaagctgcgtgcactccatcgagggtatgatcagccagctcgagggagtgcagcagatctcagtgtcactcgcggagggaaccgccactgtcctgtacaatccatcagtcatctcgccggaggagctgcgtgctgcaattgaggacatgggcttcgaggcttccgtggtatccgagtcttgctcgaccaacccgcttggaaaccactctgcgggtaactcgatggtgcagactacggacggaactccgacctcggtccaagaagtggcgccgcacaccgggaggctgccggcgaaccatgccccggacattcttgccaagtccccacagtcaacccgggccgtggccccgcaaaaatgcttcctgcagattaaggggatgacttgcgcgtcgtgtgtctcgaatatcgaaagaaatctgcagaaggaagcaggagtcctctctgtcctcgtcgccctgatggcgggaaaggccgaaatcaagtatgatccagaggtgatccagcccttggaaatcgctcagttcatccaggacctgggatttgaagcggccgtgatggaggactacgcgggatccgatggtaacatcgagctcactatcaccggtatgacctgtgcctcatgcgtgcacaatattgagtcgaaactcactagaaccaacggcatcacttacgcctcagtggccctggcgacctccaaggcactcgtgaagtttgatcccgagatcatcggcccgcgcgacattatcaagattatcgaggagattgggtttcacgcctcgctggcgcagagaaatccgaacgcccaccatctggatcacaagatggaaatcaagcagtggaagaagagcttcttgtgttccctggtgttcggaatcccggtgatggccctgatgatctacatgctcatcccgtccaatgaaccccatcagtcaatggtgctggaccataacattatcccgggcctgagcatcctgaacctgatcttcttcattctgtgcacctttgtgcaacttctcggcggctggtacttctatgtgcaggcttacaagtctctgcgccaccgcagcgcaaacatggacgtgctcattgtgttggcaacctcaatcgcgtacgtgtacagcctcgtgatcctggtggtcgccgtggcagagaaggctgaacgtagccctgtgaccttcttcgacacccctcccatgctcttcgtgtttatcgctttgggacgctggctggagcacctggccaaatcaaagacttcagaggctctggcgaagctcatgtcgctgcaggcgacggaggccactgtggtgaccctcggagaagataaccttatcatccgggaagagcaggtcccaatggaactcgtgcaacggggagatatcgtgaaggtcgtgccgggcggaaagtttcctgtcgatggtaaggtgctcgaaggcaacaccatggctgatgagagcctgatcaccggggaagctatgccagtgaccaagaagcccggtagcaccgtgatcgccgggtcgatcaacgcgcatgggtccgtccttatcaaagcgactcacgtgggaaatgacactactttggcgcagatcgtgaagctcgtcgaagaagcccagatgtctaaggctccgatccaacagttggcagaccggttttccggatacttcgtgcctttcatcattatcatgtcaaccctcaccctcgtggtgtggatcgtgatcggcttcatcgacttcggcgtggtccagcgctacttccctaatccgaacaaacatatttcccagaccgaggtcatcatcaggtttgctttccagacctcgatcactgtgctctgcatcgcgtgtccttgctccctcggactggccaccccgaccgcggtaatggtgggcactggggtcgcggcacagaatggcatcctgatcaagggaggaaagcctcttgaaatggcacacaaaatcaagaccgtgatgttcgataaaaccggaactatcacccacggcgtgccacgggtgatgcgggtgctcctgctgggagacgttgccacgcttccactgcgcaaggtcctggcagttgtgggaactgccgaagcctcgagcgaacacccgctgggagtggctgtgaccaagtattgcaaagaggaactgggaaccgagactctgggctactgcaccgatttccaggctgtgccgggttgcggaatcggatgcaaggtgagcaatgtcgaaggcatcctggctcattccgaacgccccctcagcgccccagcctcacacctgaacgaagccgggtcccttccggctgagaaggacgccgtcccccagacgttcagcgtgctgattggtaaccgagaatggctgcggcgtaatgggctcactatctcgtcggatgtttcagacgccatgactgaccatgaaatgaagggccaaacggcgattctcgtggcaattgacggcgtgctgtgcggcatgatcgcaatcgcggacgccgtgaagcaggaagccgcgctcgcagtgcacaccttgcagtccatgggagtggacgtcgtgctgatcaccggtgacaatcgcaagactgcgcgcgcaatcgcgactcaggtcggaattaacaaagtgtttgcggaggtcctgccatcacacaaagtcgcaaaggtccaagagctgcaaaacaaggggaagaaagttgcaatggtgggagatggcgtgaatgactcgcctgctctggcgcaagcagacatgggagtggcgatcggcactggtaccgacgtggcaatcgaagcggcggatgtcgtgctgattaggaacgacctcttggacgtggtggcctcgatccacctctcgaaacgcactgtccggcgcatcagaatcaatttggtacttgccctcatctacaacctggtgggaatcccaatcgccgctggggtgttcatgcctatcgggatcgtcctccagccgtggatgggctcggcggccatggctgcgagcagcgtctcggtggtgctgagcagcctgcaactgaagtgctataagaagcctgacctggaaagatatgaagcccaagcgcacggacatatgaaaccactgactgccagccaggtgtccgtccacatcggcatggacgaccgctggcgggactccccgcgggctaccccctgggaccaagtgtcctacgtctcccaagtgtcgctgtcgagcttgacctccgacaagccgtcgcggcactcagcggcagcggacgacgacggtgacaagtggtcccttctgctgaacggaagggacgaagaacagtacatc

SEQ ID NO: 7431 - DNA, 4395 bp, Artificial Sequence
  Description of Artificial Sequence: Synthetic coding sequence
atgcctgagcaagagcggcagataacagctcgtgagggagcatctcggaagatcctctctaaattgagcctacccacccgcgcatgggagccagccatgaaaaagagttttgccttcgataacgtgggctacgaagggggactagatgggctgggcccatctagccaggtggccacaagcacagtcaggattcttgggatgacctgtcaatcatgcgtgaaatctatcgaagaccggatcagcaacctcaaagggatcataagtatgaaggtgagcctggagcaagggtccgccactgtgaaatacgtcccctcagtggtctgcctgcagcaagtgtgccaccagatcggggatatgggattcgaggcgtccatcgctgaggggaaagccgcaagctggccttcaaggtctctgccggcccaggaggccgtagttaaactgagggtggaaggaatgacgtgccagtcctgcgtgagcagtatcgaaggcaaagtccgcaaattacagggagttgtccgggtcaaggtatctctctccaatcaggaagccgtgatcacctaccaaccctaccttatacagccggaggacctgcgcgaccacgttaacgatatgggctttgaggcggcgataaagtccaaggtcgcgcccctgagtttaggcccaattgacatagagcggctgcagtcaacgaaccccaaaaggccattatcttcagccaaccagaactttaacaacagcgaaacactgggccatcaggggagtcatgtcgtcacacttcagctccgtattgatggcatgcattgcaaatcctgtgtactgaacatcgaggagaacattgggcagctgctgggcgttcagtcaattcaggtctcccttgagaacaagaccgcacaggtgaagtacgatccgtcctgcacgtctccggtggcactgcagagggccatcgaggcactgccgcccgggaacttcaaggtgagtctacccgacggggctgaaggctccggcacagatcaccgaagtagttcttctcacagtcctgggagtccaccgcgcaaccaggtacagggaacatgttctactactttgattgcgatagcaggcatgacatgcgcctcctgtgtgcactctatcgagggaatgatctcccagttggagggcgtgcagcagatctccgtgtctctcgccgaggggacagcaactgtgctgtacaaccccagcgtgatctctcctgaggagctgcgagccgctatcgaagacatggggttcgaagcttcagtcgtcagtgaaagctgctcaaccaaccctttagggaaccactctgcagggaactctatggtgcagactacagatggtacgcccacgtctgtacaggaggtagcacctcatacagggcgcttgcccgcgaaccacgcccctgatatcctggcaaaatctcctcaatcaactcgggcagtcgccccccagaaatgtttccttcaaatcaaaggaatgacttgcgcctcatgtgtatcaaacatcgaaagaaacttacaaaaagaggctggagttctcagcgtgctggttgccctgatggccggaaaggccgagattaagtacgaccccgaggtcatccagcccctggaaatcgcccaattcattcaagatctcggtttcgaagctgccgtgatggaagactatgcagggtctgacggcaacatcgaactcaccatcaccggcatgacctgcgcttcttgcgtccacaacatcgaaagcaagttgacacggaccaacggcatcacctacgcgtccgtggcgcttgcaactagcaaagccctcgttaaattcgaccctgagataattggcccccgggacatcatcaaaatcatcgaggagataggcttccatgcatctttggcacagagaaatccgaatgctcatcacttggatcacaaaatggaaatcaaacagtggaagaaaagtttcctatgttcactggtgttcgggataccagttatggcactgatgatttatatgctgatcccctccaacgaaccccaccagtccatggtgttggaccataatatcatcccaggactgtccattctgaatctgattttctttattctttgcactttcgtgcagctcctgggcggttggtacttttacgtccaggcctataaaagtttgagacaccgatcggctaacatggatgtcctgatcgttctggcaaccagcatcgcctacgtgtacagtcttgtgattttggtggtcgcagtcgccgagaaggccgaacgtagccctgtgaccttctttgatacacctcccatgctgttcgtgttcatagcgttagggaggtggctcgagcatcttgcgaagagcaaaacctctgaggctctggccaagctcatgtccctgcaggctaccgaggctactgtggtcactttaggagaggacaacctcatcattcgggaagaacaggttcctatggagcttgttcaacgtggagacatcgtgaaggtcgtgcctggtggaaaattccctgtcgacggcaaagtcttggagggtaacacaatggcagatgaatccttgatcacgggggaggccatgcctgtgaccaagaagccagggagcacagttattgcaggtagcatcaatgcccacggaagtgtgctgatcaaggccactcacgttgggaacgataccacactggcacaaatcgtgaaactcgtcgaggaggcccagatgagcaaggcacccattcaacagttggccgatcgattttcgggttacttcgtgcccttcattataatcatgtccactcttacactcgttgtgtggatagtcatcggcttcattgacttcggggtggtgcaaagatatttccctaaccccaataaacatatttcccagaccgaggtgatcatcagattcgcattccagactagcataacagtgctgtgcatagcctgcccttgcagtctaggcctggctaccccaactgccgtgatggtggggaccggagtcgccgcccagaacggtatccttattaaggggggcaagcctctcgagatggctcataagataaagaccgtgatgtttgacaagactggcaccattacacacggggttccaagagtgatgcgggtcctgctgcttggcgatgttgcaaccctgcctctgcggaaagtgcttgccgtagtcggcaccgcagaggcaagcagcgagcacccgctgggagtcgctgttaccaaatactgtaaggaagagctggggactgagacccttggttactgcacagactttcaggccgtgcctggctgcgggattggatgcaaagtgtctaatgtggaagggatcctggcccattccgagcgtcccctgtccgccccagctagccacctgaacgaggccggctctcttccagcagaaaaagatgccgtgccccagacattcagtgtcctaatcggcaatcgagaatggctgcggaggaacgggttaaccatatccagcgacgtctccgatgccatgactgaccacgagatgaagggccagaccgccattcttgtcgcaatcgatggcgtgttatgtggaatgatcgccattgcagacgccgtgaagcaggaggccgccctcgcagtgcataccctgcagtccatgggagttgatgtggtgctgattactggggataaccgcaagacggcccgcgccatcgctacacaggtgggaattaataaagtctttgctgaagtcttgccatctcataaggtagccaaagtccaggagctgcagaacaaagggaagaaagtcgctatggtgggcgacggcgtcaatgatagtccagccctagcccaggctgacatgggggtcgcaattggcacaggtactgacgtggcgatcgaggccgccgatgtcgttttaatccgaaacgacctgctcgacgttgtggccagtatacacctgagcaaacggactgttagacgaatccggatcaacctcgtgttagcgttgatctacaatttggtcggaattcccatcgccgctggtgtgtttatgccaatcggtattgtgctgcagccatggatgggtagcgcggctatggccgccagcagtgtgtccgtcgtcctgagttctttgcagctcaaatgttacaagaagcccgaccttgagcggtacgaggctcaggcccacgggcacatgaaaccgctcaccgcatctcaggtgtcagtccatatcggcatggatgataggtggcgggactcccctagggctaccccttgggatcaggtctcctacgtgtcccaggtctctttgagtagtctgacctcagataaaccatcccgacattcagcggccgccgacgacgacggcgataagtggagcctcctactgaacggcagggatgaggagcagtacatt

SEQ ID NO: 7432 - DNA, 4395 bp, Artificial Sequence
  Description of Artificial Sequence: Synthetic coding sequence
atgccggagcaggaacgccagataacagctcgagagggggcctctcgaaagatcctgtccaagttgagtctgcctacccgggcatgggagcctgccatgaaaaaaagcttcgcattcgataatgtggggtatgagggggggctcgatggactcgggcctagctctcaggtcgcgacttctactgtccgcattctgggaatgacctgccagagttgcgttaagtctattgaggatcggattagcaatctaaaaggcatcataagcatgaaggtcagccttgaacagggttctgcaaccgtaaaatacgttccgtctgtcgtctgcctgcagcaagtatgccaccagataggcgatatggggttcgaggctagtatcgcagaaggcaaagcggcaagttggccgagtagaagcttacccgcccaggaagccgtcgtaaagttgcgcgttgagggtatgacttgtcagtcatgtgtttcgagtatcgaagggaaggtacgaaagttgcagggggtggttcgggtcaaagtcagcctctcgaatcaggaggcagtgatcacataccagccatatctcatccagcctgaagatctacgagaccacgtgaacgatatgggcttcgaagcagccattaaatcaaaggtggctcccctttcactgggtcccattgacattgaacgtctccaaagcacgaatccaaagcgccctctgtcatctgcaaaccaaaatttcaataatagcgaaactcttggccaccagggtagccatgtcgtaacactgcagttgcgcatcgacgggatgcactgcaagagctgcgtattaaacatcgaagaaaacatcggtcagctgctcggggtacagagtattcaggtttctctcgagaataagactgcacaggtgaagtatgatcccagctgtacctctccagtcgccctccagagagcgatagaagctctgcctcccggaaattttaaggtctccctgcccgatggagcagagggttcaggcacagatcacaggtcttcttcgagtcacagccccggatcaccaccacggaaccaagtccagggcacttgcagcaccacactcatcgctattgcagggatgacttgcgcttcatgcgtccactctatcgagggcatgatctcacagctggagggtgtgcaacagatttccgtgtcattggctgagggaactgccactgtcctttataatcctagtgtgatctccccagaagagctgcgcgctgcgatcgaggacatgggattcgaggctagtgtagtctcagaatcgtgttccaccaatcctctcgggaaccatagcgccgggaattccatggtccagacaacagacggaacacctacatctgtgcaggaggtggcacctcacaccgggcgactgcctgccaaccatgcgccggacatcctggccaagtcgcctcagagtactagggctgttgcaccccagaaatgcttcctgcagattaaggggatgacctgcgcctcatgtgtgtccaacattgagaggaacctccaaaaggaggccggcgtactgtccgtgctggtcgccctgatggccggtaaggccgagattaaatacgacccagaagtgatccagccattggaaattgcccagttcatccaggatctagggttcgaagccgctgtaatggaggactatgccgggagcgatgggaatatcgaactgaccataactggcatgacatgcgctagctgcgtacacaatatagagtcaaagctaactcgcaccaacgggattacctacgctagtgttgcattggcaacctccaaggccctcgtgaagttcgatccagaaataatcgggcccagagacatcatcaaaatcattgaagagatcgggtttcatgcatctctggcacagagaaaccccaatgcgcatcatctggatcataagatggaaatcaagcagtggaagaagtccttcctctgctctctcgtttttgggattcctgtgatggcccttatgatctatatgttgataccctcaaatgagccccaccaaagtatggtcttggaccataacatcatccctggattgagcatcctcaacctgatcttctttatactttgtacatttgtgcagctcctaggcgggtggtatttttacgtgcaggcttataaatccctccgtcataggtctgctaacatggacgtcttgatcgtgttagcaaccagtattgcatacgtctattccctagtcatactagtagttgccgtggctgagaaagcagagcgatctcccgttacctttttcgacacacccccaatgctgttcgtgttcattgctctgggaaggtggcttgagcatctcgctaagagtaagactagcgaagcactcgcaaagttaatgagccttcaggccaccgaggcaacagtagtcactcttggggaagataatcttattatacgggaggagcaggtgcccatggagcttgtgcagcgcggagatatcgtgaaagtcgtcccaggcggaaagttccccgtggacggaaaggtgctcgagggaaacaccatggcagatgaatccctcatcaccggggaagcaatgccggtgacaaaaaaacctggctctacagtgattgcagggtctattaatgcacacggctccgttctgatcaaggccacccacgtgggcaatgatactaccctggcccaaatcgtgaagctggtggaggaggctcagatgtcgaaagcacctatccagcagctggcggaccgctttagtggatacttcgttccttttattattatcatgtccaccctgaccttagttgtatggatcgttattgggttcatcgatttcggagtggttcaacgctattttcccaatcctaataagcacatatcccagactgaagtgataatacggttcgcgtttcagaccagtatcacagtcctctgtatcgcgtgcccatgtagcctaggactggccacaccgaccgctgtgatggtcggcactggagtggctgcccagaatggcattctgattaaaggcggcaagcccctggagatggcacataaaattaaaacagtgatgttcgacaagacgggtacaatcacgcatggagttccccgcgtgatgagagtgctgctgcttggcgacgtagcaaccctccctctccgcaaagtcctagccgtggtaggtactgccgaagcctcatcagaacatcctcttggagtggctgtcaccaagtactgcaaggaagagctgggaaccgaaacgttggggtactgcacagacttccaggcagtcccaggctgcggcatcggctgcaaagtgtcaaatgtggagggcatattggcacatagcgagcggccactttcagcgcctgcctcacatctgaacgaagccggcagtcttcccgcggaaaaggatgccgtcccccaaactttcagcgtactcattggtaatcgagagtggcttagaaggaacgggctcacaataagcagcgatgtgtccgatgccatgacggatcatgagatgaagggccagacggccattcttgtggcaatcgacggcgtcctctgtggaatgattgctatagccgatgcagtcaagcaggaggccgcactagccgtgcacacgctgcaatcaatgggtgtggatgtggtgcttataacaggagacaacaggaagacagcccgggcaattgccactcaagtgggcattaataaggtcttcgcagaggtgttgccttcccacaaggtggccaaggttcaagagttgcaaaacaagggcaaaaaggtcgcaatggtgggcgacggggtgaatgatagccctgccctagcccaggccgatatgggggtggctatcggaactgggacagacgtagccatagaggcagcagatgttgtgctgatccgcaacgatttgctggatgttgtggctagtattcacctctccaagcggactgtgaggagaatcagaatcaacctggttttggctctcatctacaacttggtaggtatacccatcgccgctggcgtctttatgcctattggaatagtgttgcagccctggatggggtccgcggcaatggccgcctcatccgtgtctgtggtcctgagctccctacaactaaagtgttacaagaaaccagatcttgaaaggtatgaggcacaggcccatggtcatatgaaacccttgacagcctcacaggtatccgtgcatattggaatggacgatcgatggagggacagccctcgcgcaacaccctgggatcaggtgtcatacgtgagccaagtctccctgtcttccctaacttctgacaagccaagtcggcattcggccgctgctgatgacgacggagataagtggtctctactgcttaatgggcgtgacgaggaacagtatatc

SEQ ID NO: 7433 - DNA, 4395 bp, Artificial Sequence
  Description of Artificial Sequence: Synthetic coding sequence
atgcccgagcaagagagacagatcacagccagagagggggcctctcggaagatccttagcaaactatccctgcctactagggcctgggagcctgccatgaagaagagctttgccttcgataatgttggctacgagggtggcttggacggtctcggcccctccagtcaggtcgccactagtactgtacggatcctgggcatgacctgccaatcttgcgttaagagtatcgaagatcggatttccaacctgaaaggcattatctccatgaaggtgagcctggagcagggctccgctaccgtcaagtatgtaccctctgtggtgtgccttcagcaggtctgtcaccagattggagatatgggcttcgaagcatccattgccgagggcaaggctgcaagttggccatcccgatctctccccgcccaagaggccgtggtgaaattaagagtggaagggatgacttgccagagctgcgtcagttcaatcgaaggcaaagtgcggaaactacagggggtggtccgagtaaaggtgtccctcagcaaccaggaggcagtaatcacctaccagccttatcttattcagcccgaagaccttcgcgaccacgtcaacgatatggggtttgaagccgcaatcaaaagtaaggttgcccccctatctcttggaccaattgacatcgaacgcttgcagtccaccaatcccaaaaggccactctcgtccgctaaccaaaattttaataacagcgagactctgggacaccaggggtctcatgtggtgactttacagctcaggattgatgggatgcattgtaaatcctgcgttctcaatatcgaggaaaatattggccaattgctgggggtgcaatctattcaagtgtcgctggaaaacaagacggcgcaggtaaagtatgacccttcttgtacatcacccgtcgcactacagagagcaatcgaggccctacctccaggaaactttaaagttagtctgccagatggtgcagaaggttcaggtactgatcaccggtcgagctcttctcactcacccggatctcccccgcgcaaccaggtccagggaacctgcagtaccacgctcattgccattgccggaatgacctgcgcctcatgtgtgcatagcatcgagggcatgatttcccagctggagggagtgcagcaaataagtgtgtcccttgccgaaggcacagccaccgtcctgtataatccctccgtgatcagtccagaggagttgcgcgcggccatcgaggacatgggcttcgaagcgtcggtggtgagcgagtcctgtagcaccaaccctctggggaatcattccgctggtaactccatggtgcaaacaactgacggcacccctacaagcgtgcaagaagtggccccccatacaggacgattgccagcaaaccatgctcccgatatactcgcaaagtctccccagagtacccgtgccgtggctccacagaaatgtttcttgcagatcaagggaatgacttgcgcaagttgtgtgagcaatattgagcggaacctccagaaggaagctggggtgctcagtgtgctggtggccttgatggccgggaaagcagagattaagtacgatccagaagtgattcagccattagagattgctcagtttattcaagatctgggcttcgaggcggccgtgatggaggattatgcagggtccgatggcaacatcgagctgacgattactggcatgacatgtgcaagttgcgtccacaatattgagagcaagttgacacgcacgaatggaataacgtatgccagtgtggccctcgctacttctaaagccctggtgaagtttgaccctgagatcatcgggcccagagatatcattaaaataatcgaggagataggttttcatgcttctttggcacagaggaatcccaacgcccaccacctggaccacaagatggagatcaagcagtggaagaaatctttcctatgttccctggtctttggcatcccggtaatggctctgatgatatacatgctgatcccgagtaacgagcctcaccagagcatggttctcgatcacaatatcatcccaggtctgtccattcttaatctgatcttctttatcctttgcacgttcgtgcagcttctggggggctggtatttttatgtgcaggcatataaaagccttcgccaccgtagcgctaatatggacgtgcttatcgtgctggccactagtatcgcttacgtgtacagcttagtgatcctggtcgtggccgtcgcagaaaaagctgaacggagtccagtgacgttctttgatactccacccatgctgttcgtgttcatcgctcttggacggtggctcgagcacttggccaagagcaagacaagcgaggcactggcaaagttgatgagtctgcaagctacggaagccactgtagtgacactgggggaggacaacttgatcattcgcgaggaacaagtgcccatggagctcgtacaaagaggagatattgttaaagtggtccctggtgggaagttccccgttgacggtaaggtgttagaagggaatacgatggcagacgagagcctgataacgggggaggctatgcctgtcacaaagaagcctggttccaccgtaattgccggatctattaacgcccatgggtctgtcttgattaaggcaacccatgtgggaaacgataccacattggctcagattgtgaaactggtggaagaagctcaaatgtccaaggcccctatccagcagctggcggaccgattttccggatattttgtgcccttcatcataatcatgtcaacccttacccttgtagtgtggatcgtaattgggttcattgattttggagtcgtccagcggtatttccccaatcccaataaacacatctcccagactgaagtgataatcaggtttgcatttcagactagtattactgtattgtgtattgcatgcccttgctccctgggattagctaccccgaccgccgttatggtgggaacaggtgttgctgcacagaacggcattctgattaaaggaggcaaacccctcgagatggctcacaagataaagacagtgatgttcgacaagacagggacaatcactcacggagtcccccgggtcatgcgcgtgttgctactgggcgatgtcgctactcttcccctccgaaaggtgctcgcagttgtgggaactgccgaggcttcctctgagcacccactaggagtggctgtgaccaagtattgcaaagaggagctgggcacggaaacattaggttactgcaccgacttccaggctgtgccgggctgtggaatcggttgtaaggtatcaaacgtggagggcatcctcgctcactcagagcgaccgttgagtgcacccgcatcgcacctaaatgaagcaggctccctaccagccgaaaaggacgctgtgccacagacattttctgttctgattggtaaccgcgaatggctgcggcggaatggcctcacaatatcaagcgatgtatcagatgccatgaccgaccatgaaatgaaggggcagactgccattctggtcgcaatcgatggcgtactgtgtggtatgattgccattgccgatgccgtgaaacaagaggccgcccttgccgtgcacaccttgcagtccatgggagttgacgtggtcctgattactggggataatcgtaaaaccgcccgcgcgattgctactcaggtggggataaataaagtgttcgccgaggtgttgcccagccataaggttgcaaaggtgcaggaactgcagaataagggaaaaaaagttgcaatggtgggagacggggtcaacgacagtccggcactggcccaagccgacatgggagtagcgatcggaactggaaccgatgtggccatcgaagccgccgatgtggtcctgatacgaaacgatctgctggatgttgtggcttcaatccacctgtctaagagaacagtgagacgtatcagaataaacctggtcctggctttaatctataatttggtcgggattcccatagctgctggagtgtttatgccaattgggatagtactccagccatggatgggatcagcagccatggcagctagcagcgtcagtgtcgttttgagctctctgcagctgaaatgctataagaagccagacctggaacgttacgaggcgcaggcccatggacacatgaaacctcttactgccagtcaagtgtctgtacacatcggaatggacgacagatggagggactcacccagggcaaccccctgggatcaagtgtcttacgtgtcgcaggtctcactatcttcactgacctcagataagccgagccggcattcagccgctgcagacgatgacggcgacaagtggagcctgcttttgaatggccgcgacgaagagcagtatatt

SEQ ID NO: 7434 - DNA, 4395 bp, Artificial Sequence
  Description of Artificial Sequence: Synthetic coding sequence
atgccagagcaagaaagacaaatcaccgcaagggaaggtgcatccagaaagatactttctaaactgtcccttccaacaagagcctgggagccagccatgaaaaagtcattcgcgttcgacaatgtgggttatgagggtggactggacggactcggaccctcttctcaggtggcaacgtccaccgtcagaatcttgggcatgacttgtcagtcctgtgtcaagagcattgaggacaggattagtaacttgaagggaataatctccatgaaggtcagccttgaacaaggtagcgccaccgtcaagtacgtgcccagtgttgtctgtctgcagcaggtgtgccaccagataggcgacatgggtttcgaggcaagtatcgcagagggaaaagccgcctcctggccttcaaggtcactccccgcacaagaggcggttgtgaaactcagggttgagggtatgacctgccagagctgcgtttcaagcatcgagggcaaagtgagaaaactgcaaggagtggtgagggtaaaggtgagcctgagcaatcaagaagcagtgatcacgtaccaaccctacttgatccaacccgaggacctgagggatcacgtgaacgacatgggttttgaagccgccatcaagtccaaggtagcacctctcagcctgggcccaatcgatatagaaagactgcaatcaaccaacccaaaaaggcctcttagttccgctaaccaaaatttcaacaattccgaaacgctgggtcaccaaggttcccatgtggtcacattgcagctgcgcattgacggcatgcattgtaagagttgcgtgcttaacatcgaggaaaacattggacaactcttgggcgtgcagtcaatccaggtcagtttggagaataaaacagcacaagtcaagtatgatcccagctgcacaagtcctgtcgctcttcagagagccatcgaagctctgcccccgggcaatttcaaggtcagcctgcctgacggcgcggaaggctcaggcacggatcacaggtcctcttccagccatagccccggttcccctcctagaaaccaagtgcagggcacctgtagcaccacactgatcgccatcgcaggtatgacatgcgctagctgtgtccacagtatagaaggtatgattagtcaattggaaggcgttcagcagatttcagtgtccctcgcagaaggtaccgctaccgtactttataatcccagcgtcattagtcctgaggagcttagggctgcgattgaggacatgggtttcgaagcgtcagtggtgagtgaatcctgttctaccaaccccctcggcaatcactccgctggtaactccatggtccagaccacagatggaactcctacaagcgtccaggaggtagctccacacaccggaaggctgccagcaaaccatgctccggacatcctggccaagagcccccaaagcaccagagctgtcgctccccagaagtgctttctccagattaagggcatgacatgtgcctcttgtgttagtaacattgagagaaatttgcaaaaggaggctggcgtcttgtctgtacttgtggccctcatggctggaaaagcggaaatcaagtatgaccctgaagttatccagccccttgaaatcgctcagttcatccaggatctcggctttgaggcagccgtcatggaggattatgcaggttctgacggcaacattgagctcacaatcactggcatgacttgcgcgtcctgtgtgcacaatatcgagagtaaactgacaagaaccaacggaattacttatgcaagcgtcgctctggcaacaagcaaggccctggtcaagttcgatccggagatcattggccctcgcgacatcataaagatcatagaggaaatcggtttccacgcctctttggctcagcgcaatccgaacgcccaccacttggatcacaaaatggaaatcaagcagtggaagaagagctttttgtgtagtctggtttttggcatacccgtcatggcgctcatgatctacatgctgatcccatctaacgaacctcaccagtccatggtgttggaccacaatatcatcccaggattgagcatcctcaacttgatatttttcattttgtgcaccttcgtacagctgctgggaggctggtatttctatgtacaagcctacaaaagcttgcgccatcgctctgctaatatggatgtcctgatagtgctggccacttccattgcgtatgtgtatagcctcgtgatcctggtagttgctgtggcagagaaggccgaacgctcccctgtgacattcttcgacacccctcccatgttgttcgtattcatcgcattgggtaggtggctcgaacaccttgccaaatcaaaaactagtgaagcactggccaagctgatgtcattgcaagccactgaggccacagtcgtcactctgggcgaggacaatttgatcatcagagaggaacaggtccctatggagttggttcagaggggtgacattgtcaaggttgtgccaggcggtaagtttccagtggatggtaaggtcctcgaaggcaacaccatggcagacgagagccttatcacaggtgaagccatgcccgtcacaaagaagcccggtagcaccgttattgcgggttccatcaatgcacacggctctgtgctgataaaggctactcatgtcggaaatgataccacgttggctcaaatcgtcaagctggtggaagaagcgcagatgagcaaagcccctatccagcagctcgcggacagatttagtggatacttcgtgccattcattatcatcatgtccacactgacccttgttgtgtggattgtgatcggtttcatcgacttcggagtcgtccagcgctatttccccaaccccaacaaacacatcagccaaactgaggtcattatcaggttcgcctttcaaacttccatcacggtgctttgcatagcttgcccttgttctctgggcttggcgacacccactgccgtgatggtgggcactggtgtggccgctcagaacggtatcctgattaaaggaggtaaacctcttgagatggcccataagatcaaaacggtcatgttcgacaaaactggaactattacccacggcgtgcccagggtcatgagggtcctgctgctgggcgacgttgctacgttgcccctcaggaaggtcctggccgttgtcggaaccgcggaggcatctagcgaacatcccctgggtgtcgccgtgaccaagtactgcaaagaggagctgggaacagaaactcttggatattgcacagacttccaggcagttccaggttgcggtatcggatgcaaagtatccaatgtcgagggcatcctcgcgcactccgagaggccgctctcagctccagctagtcacctgaatgaagccggatcacttcccgctgagaaagacgcagtcccccagactttcagcgtcctgataggcaacagggaatggctcaggagaaatggcctgaccattagctccgacgtatctgatgccatgacagatcacgaaatgaagggccaaacagctatcctggtcgccattgatggcgtcctttgcggcatgatagccatcgccgatgcagttaaacaagaggctgcactcgcagtccatactttgcagagcatgggcgtggacgttgttctgatcaccggcgataaccgcaaaacggccagagcaatagccacacaggtaggcatcaacaaggtctttgctgaagtgcttccttctcataaggtcgccaaagtacaggagctgcaaaacaaaggtaagaaggttgccatggttggagacggagtaaacgactctcccgctctggcccaggctgatatgggtgttgccattggtactggtacagacgtcgccatcgaagccgcagacgtagtcttgatccgcaatgaccttctggacgtagttgcctcaatccatctgtcaaagcgcaccgtgaggagaattaggattaatctggtgctggcattgatttataacctggtcggtattcccatcgcagcgggagtattcatgcccatcggcattgttctgcaaccttggatgggatccgcggccatggccgcttctagcgtgtctgtggtgctgagctctctgcagctgaaatgttataagaaacctgatctcgaaaggtacgaggctcaggcacacggtcacatgaagcccctgaccgcctcccaggtgagcgtgcacatcggaatggatgatcgctggagggatagtcccagggccacgccatgggaccaagtctcctatgtgtctcaggtgtctctgtcttctttgacctcagacaagccttccaggcattctgctgccgcggacgatgacggcgataagtggtccctccttctgaacggaagggacgaagagcagtacatt

SEQ ID NO: 7435 - DNA, 4395 bp, Artificial Sequence
  Description of Artificial Sequence: Synthetic coding sequence
atgccagaacaggagaggcagatcacggcgcgggagggagctagtaggaagatcttatcgaagttatccctacctacgcgcgcttgggaacctgctatgaagaagtcgttcgctttcgacaacgtcgggtacgagggcggcttggacgggcttggaccaagtagtcaggtcgccacttctactgtgcggattctcgggatgacatgccagtcctgcgtcaaatctatcgaggaccgaatatctaacctgaagggcatcattagcatgaaggtctctcttgagcaggggtcggccactgtgaaatacgtgccaagcgtggtgtgcctgcagcaagtgtgccatcagattggtgacatggggttcgaagcgagcatcgcagagggaaaggccgcctcgtggccctccagatctttgccagcccaggaggcggtcgtgaaactgagggtggagggcatgacctgccagtcttgcgtctctagcatcgagggtaaggtaaggaagcttcaaggggtggtgcgggtgaaggtcagcctgagcaatcaggaggcagtgataacctaccagccttacttgatccagccagaggatctccgcgatcacgtcaacgacatggggtttgaggccgcaattaagtctaaggttgccccgctgtccctggggccaattgatatcgaaagactccagagtactaatccgaagcgtccactatctagcgctaatcagaacttcaacaattccgaaactctcggtcatcaggggtcgcacgtggtcacgctgcagctgagaattgatggaatgcattgtaaatcgtgtgtgctgaatatcgaggaaaacatcggccagctgctgggagtgcaaagcattcaggtttccctcgaaaacaagacagcacaggtgaaatacgacccctcttgcacttccccggtagccctgcagagagcgatcgaggcactgccccctgggaattttaaggtttccttgcccgacggcgcagaggggtccggaacggaccatcggtcctcaagctcccattctccagggagccctcctaggaatcaggtgcagggaacctgctctaccactttgattgcgatcgccggaatgacatgtgcgagctgcgtccactcaattgagggcatgatatcccagcttgagggtgtgcagcagatcagtgtgtctctggccgagggcaccgccaccgtgctctacaaccccagtgtaattagcccggaagagctcagggcagctatcgaagacatgggatttgaagccagtgttgtgtccgagtcatgctccacgaatcccttaggcaaccattctgcaggtaacagcatggtgcagacaaccgacgggacaccgacctccgtacaggaagtcgcccctcataccgggagactgccagcgaatcatgctcctgatattcttgcaaaatcaccccaatccacaagggctgtagcgccacagaaatgtttcctgcagattaaaggaatgacatgtgccagctgtgtgtccaatatcgagagaaatctgcaaaaggaagccggggttctttctgttttggttgccctgatggctggcaaggccgaaatcaagtacgatcctgaggtgattcaaccactcgagatagcccagttcatccaggacctgggttttgaggcggctgttatggaagattacgctggtagtgacgggaacatagagctgaccattaccggaatgacttgcgcctcttgcgtccacaatatcgaatccaagctcacacgaacaaatggaataacatacgcctccgtagccctggcaacttccaaagcactggtcaagttcgatcccgaaatcatcggcccacgggatatcatcaaaattatcgaggaaatcgggttccacgcgtccctggcccaacgaaaccctaacgctcatcatttggaccataaaatggagatcaaacagtggaagaaatcatttctctgcagcctggtgtttggtatacccgtcatggcgcttatgatctatatgctcatcccatcaaatgagcctcaccagtcaatggtcttggaccataatatcatacccggattgtccattctgaatctgatattctttatcctgtgcacttttgtgcagctattggggggctggtacttttatgtccaagcttacaagagtctcagacacaggtccgccaacatggacgtcttgattgtgctggcaacctctatcgcttacgtgtactctctggtcattctcgtggtggccgtggccgaaaaggcggagcggtctcccgtaactttttttgatactccccccatgcttttcgttttcattgcgctcggccgctggctggagcatctagcaaagagcaagacctctgaggctctggccaagctgatgtccctacaagctacagaggcaaccgtggtaaccctcggcgaggataacctcattattagggaggagcaggtccccatggagctcgtgcaacgcggggacatcgttaaggtcgttccaggcggcaaatttccagtggacgggaaagtgcttgagggcaacactatggctgatgagtccctgataactggcgaggcaatgcctgtgactaagaagcctggctcaaccgtgatcgcgggtagcataaacgcgcatgggtcggtactgataaaggcaactcacgtcggaaacgatacaactttagctcaaatagtcaagctggtggaggaggcccagatgagtaaggctccgatccagcagctcgccgatagattttcaggatatttcgtcccctttatcataatcatgtcgaccctcactcttgtggtatggattgtgattggttttattgatttcggtgtggttcagagatactttcccaacccaaataagcacatcagccagaccgaggtgatcatacgcttcgctttccaaaccagtataaccgtgctctgtatcgcttgcccctgctctctgggcttagctactcccactgccgtgatggtgggaacgggagtcgccgcccaaaacggcattctgatcaaaggtggaaaacctctcgagatggcacacaagatcaagactgtgatgtttgataagactggtaccattacccatggtgtgcccagagtgatgcgagtcctgctcctgggggatgtcgcaaccctgcctctacggaaggtcctagccgtcgtaggaactgccgaggccagtagcgagcacccgttaggtgttgccgtgacaaaatactgcaaggaggaattaggtacggagaccctgggatattgtacagactttcaagccgtgcccggttgcggcattggctgtaaagtaagtaacgtcgagggcatcctggcccacagcgaaagacccctcagcgcaccggcttcacatctgaacgaggctggatctctgcctgcagagaaagacgcagttccacaaacattctcagtcttgattggaaacagagagtggctgcgcagaaatggactgacaatatcatcggacgtgtctgacgcaatgactgaccatgaaatgaagggacagactgcaatcttagttgccattgacggcgtgctgtgcggcatgatcgccatcgctgatgccgtgaagcaggaggcagcgctagcggtacacactctgcaatctatgggtgtggacgtggttctgattacaggcgataacaggaagacggcgagggccattgccacacaagtcggtattaataaggtgttcgctgaggtgttaccctcccacaaagtggcaaaagttcaggaactgcaaaacaaaggaaagaaggtagcaatggttggcgacggagtgaacgacagccccgccctggcccaggccgacatgggcgtagccattggaacgggaacagacgtagctatcgaggctgctgatgtggtactgattcgaaatgatcttttggatgtcgtggctagtattcacctaagtaagcgaacggtgcggaggatccgcattaatctcgtgctggctcttatatataatctggtgggtatccctattgcagccggggtcttcatgccaattggtattgtgctgcagccttggatggggagcgccgccatggcagcctcttcggtttcggttgttctgagctccctccagctgaagtgctacaagaagcccgacctggagaggtatgaggctcaggctcatgggcatatgaaaccactgactgcgtcgcaggtctccgttcatattggcatggacgaccggtggagggattccccccgcgctaccccttgggaccaggtgagctacgtgtcccaggtgtcactgtctagcctgaccagcgataagccatcaaggcacagcgccgcagcggacgacgacggtgacaagtggtcgctgctgctcaatgggcgtgacgaggagcagtacata

SEQ ID NO: 7436 - DNA, 4395 bp, Artificial Sequence
  Description of Artificial Sequence: Synthetic coding sequence
atgcctgagcaggagaggcaaatcacagcgagagaaggcgcctctagaaaaattctatccaagctcagcttgccaacacgagcttgggaaccggcgatgaaaaagtcgttcgcgttcgacaacgtaggctacgagggggggttggacgggctgggacctagcagtcaggtggccacctccactgtaaggatccttggcatgacttgtcagtcctgtgtgaagtctatagaggatcgcatttctaacctcaaagggattatctctatgaaggtgtccttagagcagggatccgccacggtgaaatacgttcctagcgttgtgtgtctgcagcaggtctgccaccagattggagacatgggctttgaggcatcaattgccgaaggcaaggcagcctcatggccctctagaagccttccggcacaggaggctgtcgtcaaacttagagtggaaggtatgacatgtcagtcttgtgttagctccatcgaggggaaggtcagaaagctgcagggggtcgtgcgggttaaggtgtccttatcaaatcaggaggccgtgatcacttaccagccttacctgattcagcccgaggacctgcgcgaccacgtgaacgacatgggttttgaggccgccatcaaaagcaaggtggccccgttgagccttggccctatagacatagaacggttgcaatccactaacccgaagcgcccactttcttccgcgaatcagaattttaataacagcgaaaccctcggccaccaaggttctcacgttgtcactcttcaactgcgaatcgatgggatgcattgcaagtcgtgtgtactgaatatcgaggagaacattggccagttgcttggtgtgcagagcattcaggtgagtttggagaacaaaacggcccaggtcaaatatgacccttcttgcacttctccggttgccctgcagagagccatcgaggccctcccccctggcaatttcaaagtaagccttcctgatggtgccgaagggtcaggaacagaccaccgctccagcagcagtcatagtcctgggtctcccccccggaatcaggttcaaggtacatgttcgactactctgattgcaattgccggtatgacatgcgcatcttgtgtgcattccatcgagggaatgatctcccagctggagggcgtgcaacagatctctgtcagcctagccgagggtaccgcgactgtgctgtataatccatccgtaatttctcccgaggaactacgagctgccatcgaagatatgggcttcgaggcttctgtggtgtccgaatcttgttcgacaaatccattgggcaatcactctgcgggcaactcaatggtgcagacgaccgatggaacgccaacatctgtgcaggaggtagccccacatactggcagattacctgcaaaccacgcacctgacatcttggccaaatctccccagtctacccgggctgttgccccacagaagtgtttccttcagataaagggtatgacctgtgcgagttgcgtgtcaaatatagagagaaatctacagaaagaagccggcgtgctttctgtgcttgtggccctgatggcagggaaggccgaaattaagtatgatcccgaagtgatacagcctcttgaaatcgcacagttcatccaggacctcggcttcgaggctgcagtgatggaggattatgccggctccgatgggaatatcgaactgaccataaccggcatgacctgcgcctcctgcgtgcacaacatcgaatcaaagctgacgaggaccaacggcatcacgtacgccagcgtcgcccttgcaacatctaaagcgctcgtgaagttcgaccccgagataatcggccctagagatatcatcaaaatcattgaagaaatcggtttccatgcttccctcgctcagagaaatcctaatgcacaccacctcgaccataagatggagataaagcagtggaagaaatctttcctgtgctcactggtgttcgggatacccgtcatggcgctgatgatctatatgctaatccccagtaatgaacctcaccaatctatggtactggaccacaacatcatccctggtctgagtattctaaatttaatattttttattctatgcacatttgtgcagctgctgggtggctggtacttttatgtgcaagcctataagtccctgagacacaggagtgccaatatggatgttcttatcgtactggccacaagtatcgcgtacgtgtatagcctggtgatccttgttgtggctgtagctgaaaaggccgaacgaagccccgtgaccttcttcgatacgcctccaatgctctttgtgtttattgcacttgggcgatggctggagcacctagccaaatccaaaacgtcggaggcactggcaaaattgatgagcctccaggcaaccgaagctactgtagtgacactcggggaagacaaccttattatacgcgaggagcaggtgccaatggagcttgtgcagaggggcgacatcgtaaaggttgtgccagggggtaagttccccgttgatggtaaagtattggagggaaacacgatggctgatgagtccctgattaccggcgaggccatgcctgtcaccaaaaaaccagggtcaacagtgatcgctggatccatcaatgctcatggcagcgtccttatcaaggcgactcatgtcgggaatgacaccacacttgcacagatcgtgaaactggttgaggaagcacaaatgtccaaagctcccatccagcagctcgctgacaggttctccgggtattttgtgccttttataattataatgtctactctgacactggtggtgtggatcgttatcggatttatcgactttggtgtagtgcaacgctacttccccaatcccaataaacacatttcccagaccgaagtcatcatccggttcgcttttcagacttctataactgtgttgtgcatagcctgcccgtgcagtctgggtctggctacacccactgcagtcatggtcggtaccggggtggccgctcagaatggaattcttatcaagggcgggaaacctctggagatggctcacaaaatcaagacagtaatgtttgacaagaccggcaccatcacacatggcgtgcctcgagtgatgcgagtgctgctcctgggggatgtagctactctgccgctccggaaggtgttggccgttgtgggaaccgcggaagctagctctgagcatcccctgggtgtggctgtgacgaagtactgcaaagaagagctgggtaccgaaacattgggctattgtaccgacttccaggctgtgccaggatgtggcatcggctgcaaggtgtctaatgtggagggaatcctagcccatagtgagagaccactgagtgctcctgccagccacctgaatgaagccggaagtctgccagcagagaaagacgcagtgccacagacattctcagtcctcatcggcaaccgggagtggctgaggaggaacggactgaccatcagttccgacgttagcgacgcaatgacagatcatgagatgaaaggccaaaccgctatcctggtggcgattgacggagtgctatgcggaatgatagcgatcgcggatgctgtgaagcaagaagccgccctggccgtccataccctacagtctatgggagtggatgtggtactgatcactggcgataacagaaagacagctcgggccatagcaacgcaagtaggaatcaacaaagtgttcgccgaagtgctgccaagtcataaggtggctaaggtccaggagttgcaaaataaaggaaaaaaagtggcgatggtgggggatggagttaatgattccccagcccttgcccaggcggatatgggcgtcgccatcggaactggaacagacgtggccatcgaagcagctgatgtggtgctcatccgcaatgacctcctcgatgtcgtggcgtccatccatcttagcaagaggactgttagaaggattagaatcaatttggtcctggccttgatatacaatcttgtgggcatcccaattgcagccggcgtgttcatgcctataggcatcgttctgcaaccatggatgggatctgctgcaatggctgcttcatcagtaagtgtagtgctgtcaagcctacaacttaaatgctataaaaagccagacctggagcgctatgaggcccaggctcacgggcacatgaaaccactgacagcctcacaggtcagtgtgcacataggtatggatgaccggtggagagactccccaagggccacgccctgggaccaggtttcatatgtgtctcaggtcagcttgtcttcactcacaagcgacaagccctcacgccactccgctgctgctgatgatgacggggataaatggagcctcttactgaatggaagagacgaggagcagtacatt

SEQ ID NO: 7437 - DNA, 4395 bp, Artificial Sequence
  Description of Artificial Sequence: Synthetic coding sequence
atgcccgaacaagaacgccagatcacggcccgagaaggcgcatcgcgtaagatattgtcaaaactgagcctgcctacaagagcgtgggaacctgctatgaaaaaatccttcgcttttgataacgtcgggtacgagggcggactggatggactcggcccatcctctcaagtggctacctcaactgtgagaatcctagggatgacctgccaatcttgcgtcaagtccatagaggatcgaatatccaaccttaagggaatcatctctatgaaggtgtccctggagcagggatccgctacagtgaagtacgtaccttcggttgtgtgcctccaacaggtgtgtcaccaaatcggggatatgggtttcgaggcctccattgctgagggaaaggccgcgtcttggcctagcagatcactgccggcgcaagaggccgtcgtgaaactacgagtggagggaatgacgtgtcagtcctgtgtcagttctattgaaggcaaagtgcgaaagctgcaaggagtcgtgcgagtgaaggtttctctgtccaatcaggaagcagttatcacgtaccaaccgtacctgatccagcccgaggatctccgagaccatgtgaatgacatgggttttgaggcagctataaagagtaaagtggccccactgagtttgggtcctattgatatagaacgcctacaaagtactaatccaaaaaggccgctgagcagtgccaaccagaacttcaacaattcagagacacttggccatcaggggtcgcatgtggttaccctgcagctgcgtatcgatgggatgcactgcaagagttgcgtgctcaatatcgaagaaaacatcggccagctcctcggggttcaatcgatccaggtatccttggagaataagacagcacaggtgaagtatgaccctagttgcacttccccggttgctctgcagcgcgcgatcgaagcattgcccccagggaatttcaaagtgagcttgcctgatggcgccgagggctctggaactgatcaccgctcttctagcagccattctccgggtagcccaccccggaaccaggtccaggggacttgctcaacaacactcattgccatcgccggaatgacttgtgcaagctgtgttcactctatcgagggaatgattagccagttagaaggcgtccagcagattagtgtgtctctggccgaaggcacggctacagttctctataaccccagtgtcatcagcccggaggaactacgggccgcaatcgaagatatgggctttgaggcctcggtggtgtccgaaagctgctctaccaaccccctcgggaatcactccgctggaaactctatggttcagaccaccgatggcacccccacttccgtgcaggaagtagcaccacataccgggcgcttgcccgccaatcacgccccagatatcctggccaagtctccccagtccacccgcgcggtggcaccacaaaagtgctttttgcagatcaaaggcatgacctgtgctagctgcgtgtctaacattgagcgtaatctacagaaggaggccggggttttgtcagtgctagtggcactgatggccggtaaggctgaaataaaatatgaccctgaggtgatccagcccttagagattgcacagtttatccaggatcttgggtttgaggccgccgtgatggaggactatgcgggctctgacggcaacatcgagcttactataacgggcatgacgtgcgcttcctgtgtacacaacatagagagcaagctgaccagaaccaatggaataacctacgcctccgtggcactggctactagcaaggcactggtcaaattcgacccagaaatcatcggaccccgagacatcataaagatcatcgaggagattggttttcacgcctctctcgctcaacgaaatccgaatgcccaccacctggaccacaagatggagatcaaacagtggaagaaaagtttcctgtgctccctcgttttcgggatcccagtgatggcactgatgatctacatgttgatcccgagtaacgagcctcaccagagcatggtccttgaccacaatatcataccaggcctctccattctgaacctcatcttttttatactgtgtacctttgtccagttgctgggcggctggtacttttacgttcaagcgtacaaatccttgaggcatcgttccgccaatatggacgtgcttatagtattagcaaccagcattgcttacgtgtattctttggttatactggtcgtggccgtggccgagaaggcggagaggtccccggtgacattttttgacacacctccaatgctcttcgtcttcatcgctctcgggcgatggctagaacatcttgcgaagtcaaaaacctctgaggcgttagccaaactgatgagtttgcaggctacagaagctaccgtggtgacattgggcgaggataatctgatcatcagagaggagcaggttccaatggaactggttcagcgtggtgatattgtcaaggtcgtgccagggggcaaattcccggtggatggcaaagtcctggaggggaatactatggccgacgaatctctgattacaggcgaagctatgccagtgactaagaaacccggttcgacagtgatagcagggagcatcaacgcccacggatcagtgttgattaaggccacccacgtgggtaatgacacaactctggctcagattgtgaagctggtggaggaggcacagatgtccaaggcaccaatccagcagctcgccgaccggttctccggttattttgtgccatttatcatcattatgagtacactgacattggtggtgtggatcgttattgggtttattgattttggggtggtgcagcggtactttccaaaccccaataaacatatcagtcagactgaagttataattcgctttgcatttcagaccagcatcaccgtcctgtgcattgcctgcccctgttctctgggactcgcgacgcctaccgccgtaatggtaggcaccggcgttgccgctcagaacggcatactgataaagggcggtaaaccactcgagatggcccacaaaatcaagaccgtcatgtttgacaagactgggacaatcactcatggtgtacccagggtcatgcgcgtgctcctgttgggtgacgttgccactttgccgctgcgaaaagtgctggctgtagtcggaacggccgaggcctcgtcggagcaccctctgggagtggccgtgactaaatattgtaaagaagaacttggcacagaaacgctaggctattgcaccgattttcaggccgtgccaggatgcggcatcggatgtaaagtgtctaacgtagagggaatcctggcacattcggagagaccactgtccgcccccgcttcccatttaaacgaggctggctccctccctgcagagaaagacgctgtcccgcagacgttttccgtcctgatcgggaatagagagtggctgagaaggaacggtctcacaattagcagcgatgtttccgatgcaatgactgaccatgagatgaaggggcagaccgccatcctcgttgctatagatggggtgctgtgtggcatgattgctattgctgatgccgtgaagcaggaagctgctctggccgtgcatacactccagtcaatgggagtagacgtggtgctgattacaggggataacagaaagactgctagagctatcgctacccaggttgggatcaacaaagtcttcgcagaagtgctaccctcccacaaagtggccaaggtccaggagctgcaaaacaagggaaagaaggtggcaatggttggcgacggagtaaacgattcccccgccctggcacaagcggatatgggtgtcgctattggcaccggcacagacgtggccatagaggctgcggacgtcgttttgatccgaaatgacctgctggacgtggttgcttctatacacctctcgaaaagaacagtacggcggatccgtattaatctggtgcttgccctgatctataatttggtgggcatccccatcgcggccggtgtgttcatgcctatcggaatcgtattgcagccttggatggggtcagccgcgatggctgctagctccgtcagcgtggtcctctcaagcttgcagttaaaatgctacaagaaaccagatctcgaacgttacgaagcacaggcccacggtcacatgaaaccccttaccgcttctcaggtatcagtacacattggtatggatgatcggtggcgggattctccaagggccacgccctgggaccaggtctcatatgtgtcacaagtgtcattaagctcccttacctccgacaagccttcccggcactctgcagctgctgatgacgatggtgacaagtggtcgctgttgctgaacggacgggacgaggagcagtacatt

SEQ ID NO: 7438 - DNA, 4395 bp, Artificial Sequence
  Description of Artificial Sequence: Synthetic coding sequence
atgccagagcaagaaagacaaataactgctcgagagggtgcaagtagaaaaattctttctaaattatctcttcctactagagcttgggaaccagcaatgaaaaaatcttttgcatttgataatgttggatatgaaggaggtttagatggtttgggaccatcttctcaagtcgcaacatctactgttagaattttgggtatgacatgtcaatcatgtgttaaatcaatagaagatagaattagtaacttgaaaggaattatttctatgaaagtgtctttagagcaaggatcagcaacagttaaatatgttccatcagtagtatgtcttcaacaagtatgtcatcaaattggagatatgggattcgaagcatcaattgcagaaggaaaagctgcttcatggccatcaagatcattgccagcacaagaagcagttgttaaattacgtgttgaaggaatgacatgtcaatcttgtgtttcttcaatagaaggaaaggtaagaaagttgcaaggtgttgtaagagttaaagttagtttgagtaatcaagaagcagttattacttatcaaccatatcttattcaaccagaagatttaagagatcatgtaaatgatatgggatttgaagctgcaattaaatcaaaagttgcaccattaagtcttggacctattgatattgaaagattacaaagtacaaatccaaaaagacctttatcatctgccaaccaaaattttaataattctgaaactttgggacatcaaggatctcatgttgttactttacaattaagaattgatggaatgcattgtaaaagttgtgttttaaatattgaagagaacataggacaacttcttggagtacaatctattcaagtaagtcttgaaaacaagacagcacaagtaaaatatgacccatcatgcacatctccagttgcacttcaacgagctattgaggcacttccaccaggtaatttcaaagtaagtttaccagatggagcagaagggtcaggaacagatcatagatctagttcatctcattcaccaggatcaccaccaagaaatcaagttcaaggaacatgttcaacaacattaattgctatcgcaggaatgacttgtgctagttgtgttcattcaattgaaggaatgatttcgcaattagaaggtgttcaacaaattagtgtatcattagcagaaggtactgcaactgttctttataacccatctgttatttcaccagaagaattaagagcagctattgaagacatgggttttgaagcatcagttgtttcagaatcatgttcaactaatccattaggtaatcattctgcaggtaattcaatggttcaaacaactgatggtacaccaacatcagttcaagaagttgcaccacatacaggaagattaccagcaaatcatgctccagatatattggctaaatcaccacaatctacaagagctgtagcaccacaaaaatgttttttacaaattaaaggaatgacttgtgcatcttgtgttagcaacattgaaagaaatttacaaaaagaagctggagttctttctgttcttgttgcattaatggcaggaaaagcagaaattaaatatgatccagaagttattcaaccacttgaaattgctcaattcattcaagatttaggttttgaagctgctgtaatggaagattatgctggatcagatggaaatatagaattaactattacgggtatgacatgtgcatcttgtgttcataatattgaatccaaacttacacgtactaacggaataacttatgcttctgttgcattagctacttcaaaagctttagttaagttcgacccagagattattggaccaagagatattattaaaattattgaagaaataggatttcatgcaagtcttgctcaaagaaatccaaatgcacatcatttagatcataagatggaaattaaacaatggaaaaaatcttttctttgttctttggtttttggaattccagtaatggcacttatgatatatatgttaattccatcaaatgaacctcatcaatcaatggtattggatcataatattattccagggttatcaattttaaatcttattttctttattttatgtacattcgttcaattattaggaggatggtatttttatgttcaagcatataagtcccttagacataggagtgcaaacatggatgttttaattgttcttgcaacaagtattgcatatgtttatagtttagttatattggtggtcgcagtagcagaaaaggcagaacgttcaccagttactttttttgatacaccaccaatgttatttgtgtttattgcattaggtagatggcttgaacatttagcaaaatcaaaaacttcagaggctttagcaaaattaatgtcattacaagctactgaagcaacagttgttacattaggagaagataacttaattattagagaagagcaagttccaatggagcttgttcaaagaggagacatagttaaggtagttccaggaggaaaatttccagttgatggaaaagtcttagaaggtaatactatggctgatgaatcacttattacaggagaagctatgcctgttactaaaaaaccaggatcaactgttattgcaggatcaattaacgcacatggaagtgttttaataaaagctacacatgttgggaatgatacaacattggcccaaatagttaagttagttgaagaagcacaaatgtctaaagctccaatacaacagcttgcagatagattcagtggatattttgttccatttattataataatgagtacattaacccttgtcgtatggattgttattggatttattgattttggagttgtgcaaagatattttccaaatccaaataaacacataagtcaaacggaagttattattagatttgcctttcaaacaagtattacagttttgtgtattgcatgtccttgtagtttaggacttgctacaccaacagcagttatggttggtacaggtgtagctgctcaaaatggtatcttaattaaaggaggtaaaccattagaaatggctcataaaattaaaacagttatgttcgataaaacaggaacgatcactcatggagttccaagagttatgagagttcttttattaggagatgttgcaacattaccacttcgaaaagtattagcagttgttggtacagctgaagcaagttcggaacacccacttggagttgctgttactaaatattgtaaagaagaattaggaactgaaactctaggatattgtacagacttccaagcagttccaggatgtggaataggatgtaaagtttctaatgttgaaggtattttagcacattctgagagaccactttcagctcctgcatcacatcttaatgaagcaggatcattaccagcagaaaaagatgcagttccacaaacattttcagtcttaataggtaatagagaatggttaagaagaaacgggttaaccatttcatcagatgtttcagatgcaatgactgatcatgaaatgaaggggcaaacagctatacttgttgctattgacggtgtattatgtggaatgattgcaattgcagatgcagttaaacaagaagctgctcttgcagttcatactcttcaatctatgggagtcgatgttgttctcattacaggtgataatagaaagactgctagggcaattgcaactcaagttggaattaataaagtatttgcagaagttttaccaagtcataaagttgctaaagtacaagaattacaaaataaaggaaaaaaagttgcaatggttggtgatggtgttaatgattcaccagcacttgctcaagctgatatgggtgttgcaattggaacaggaactgatgttgctatagaggcagctgatgttgtacttataagaaatgatttattagatgttgtagcatcaattcatttatcaaaacgtactgttagaagaattagaattaatcttgttttagctcttatttataatcttgtaggaatccctatagctgctggtgtatttatgccaatcggaattgtattacaaccatggatgggatcagcagctatggctgctagttcagtttcagttgttctttcttcactacaacttaagtgttataaaaaaccagatttagaacgttatgaagctcaagcacatggacatatgaaacctttaacagcttcacaagtttcagttcacataggtatggatgacagatggagagattcaccaagagctacaccatgggatcaagtctcatatgtaagtcaagtttcattatcatcattaacttcagataagccatctagacattctgcagctgctgacgatgacggagataagtggtctttattgttaaatggaagagatgaagaacaatatatt

SEQ ID NO: 7439 - DNA, 4395 bp, Artificial Sequence
  Description of Artificial Sequence: Synthetic coding sequence
atgcctgagcaggagaggcagattactgccagagaaggggcctcacggaagattctaagtaagctgtctctcccaacacgagcatgggaacccgccatgaaaaaaagcttcgcattcgataacgtcggttacgaaggtggtttggacgggctcggaccgtctagccaagtggcgaccagcaccgtgcgaatccttggtatgacgtgtcaaagctgcgtaaagtcgattgaagatcggatttccaatctgaagggcatcatatccatgaaagtctcccttgagcaaggatccgccacagtcaagtatgtaccgtctgtcgtttgccttcaacaggtgtgccaccagattggagacatggggtttgaagcatccatcgccgagggcaaggccgcaagctggcccagccggtcactccctgcacaggaggcagtggtcaagctcagagtcgagggaatgacttgccagtcttgtgtaagcagcatagaaggtaaagttcgcaagttgcagggggtggtcagggtcaaggtcagcctgtccaatcaggaggccgttattacttaccagccatacttaatccagcctgaagatttaagggatcatgtcaacgatatggggtttgaagcggctatcaagagcaaagtggctccactgtcccttgggccaatcgacatagaaagactccaatctacaaaccctaaaagacctctgagcagtgccaatcaaaacttcaataactccgaaaccctgggacaccagggctcacacgtggttaccttacaactccgcatcgatgggatgcattgtaaaagctgcgtactgaatatcgaggaaaacattggccaactgcttggcgttcagtccattcaagtaagtttggagaataaaaccgcccaggtgaagtatgatccctcttgcacttcccccgtggccctccagagagccatagaagctcttccgcccggcaactttaaagtatccctcccggatggcgcggaagggtcaggcaccgaccaccgctctagttcttcacacagtccgggctctccaccacggaaccaagtgcaaggtacgtgctctaccacgctcatagcaattgcgggcatgacgtgtgccagttgcgtacatagcatcgagggaatgattagccagttggaaggggtacagcagattagcgtgagcctcgccgagggcaccgctactgtgctctataatccatccgtgatcagtccagaggaactccgcgcagcaattgaggacatgggctttgaagctagcgtagtgagcgagagctgctccaccaaccccttggggaaccacagcgctggaaattcaatggtacaaacaacagatggtacaccgacatccgtgcaggaggtggcaccccacaccggtcgacttccagccaaccatgcccccgacatcctggccaaatctccacagagtacccgcgcagtcgcccctcagaaatgtttccttcagatcaaaggaatgacctgcgcgtcatgtgtgtccaacatcgaacggaatctccagaaagaagcaggagtcctgtcggtgctcgtcgctctgatggctgggaaagccgagataaagtacgaccccgaggtaattcagcctcttgaaatcgcgcagttcatccaggacctaggctttgaggcagcggtcatggaggattacgccggctctgacggcaatattgagctcactatcactggcatgacgtgtgcctcatgtgtccacaatatcgaatcgaagctaacacggaccaacggcattacctacgcctctgttgcactggctacttcaaaggcactggtgaaatttgatcctgaaatcataggacctagggacatcatcaagatcatcgaagagattgggttccacgcctccctcgctcagagaaatcccaacgctcaccatttagaccacaaaatggagataaagcagtggaagaaatctttcctgtgctctctggtgtttgggatcccagtgatggcgctgatgatttacatgctaatcccatctaacgagccgcaccaatccatggtgctggaccataatataataccgggtttgtctatcctgaacctcattttcttcatcctctgcacgttcgtgcagctgctcggaggatggtatttttatgtgcaggcctacaaatccctgagacaccgcagcgcaaacatggatgttctcatcgtgctggcgacgtcaattgcatatgtctattccctggttatccttgttgtggctgtggcggaaaaggccgagcgctcacccgtaacttttttcgacacgccccccatgcttttcgtgtttattgccctcggtaggtggttggagcacctcgcgaaatcaaaaactagtgaagcacttgccaaattgatgtcgctccaggcgactgaggccaccgtcgtgactctaggcgaagataatcttatcattcgggaggaacaggtcccaatggagcttgtgcagaggggagatatcgtcaaggtggtgccaggcggcaaattccccgtcgacggtaaggtgctggagggcaatacaatggccgacgaaagtctgattacgggcgaagcaatgcccgtgaccaagaaacccgggtccacagtgattgccggaagcatcaatgcccacgggtctgtgctaatcaaggctactcacgtagggaacgacaccacactggcccaaattgttaaattggttgaagaggcccaaatgagcaaggcaccgatccagcagctggctgacaggttcagtggttattttgtcccttttatcattattatgagtactctaactctggtggtctggatagttatcggttttatcgactttggagtcgttcagcgctactttccgaatccaaataaacatatatctcagactgaggtcatcattaggtttgctttccaaacttccataactgtgttgtgtatcgcctgcccatgtagcttggggctggcaacaccgaccgcagtcatggtggggaccggagttgctgctcagaatggcatccttattaagggtggaaaacccctcgaaatggcccacaaaattaaaacggtgatgtttgataagactggaaccataacgcacggcgtaccacgcgtgatgcgggtattactactcggggatgtggccacactgcccctgaggaaggtcctggcagtggtgggtacggccgaagcctccagcgagcatcccctcggggtagccgtcacgaagtactgtaaagaggagctgggaactgagacacttggttattgcactgactttcaggctgttcccggttgtggcattggatgtaaggtaagcaacgtggagggaatactggctcactcagagaggcccttgagcgcacccgccagtcatctgaacgaggctggtagcctgcctgctgaaaaagacgcagttccacagaccttcagcgtattgataggtaatcgggagtggttacgcagaaacggcttaacaatctcttctgacgtttccgacgccatgacggatcacgagatgaaaggccagaccgcaatcctggtcgcaatcgacggcgtgctgtgcgggatgatcgcgatagcggacgcagtgaagcaggaagccgcactggccgtgcacacacttcaaagcatgggagtggatgtggtccttatcacaggcgataatcggaagacagctcgtgcaatcgctacccaggtgggaattaataaagtgtttgccgaagtgctcccaagccataaggtggctaaggtgcaggaattgcagaacaagggaaagaaggtggcaatggtaggggacggagtcaacgatagccccgctctcgcccaggccgatatgggcgtggcaatcggcaccggcactgatgtggcgatagaggccgccgacgtagtcctgatccggaatgacctgctggacgttgttgcttctatccacctgtccaagcggacggtgcgtcgaattcggatcaatttggtgctcgctttgatttacaacttggtcggtattcccattgcagctggggtcttcatgccaattggcattgtactacagccttggatgggctccgcagccatggcagcctcctccgtgagcgtggtcctgagctccctgcagctgaaatgttataagaaacctgacctagagcgttatgaagctcaggcccatggccatatgaaaccattgaccgcatcccaagtcagcgtgcacattgggatggacgaccgctggcgtgattctccgagggccacaccgtgggatcaagtcagttacgtaagtcaggtgagcctgtccagtctcacgtctgacaaaccttcccgccacagcgcggctgctgacgatgacggggataaatggagcctcctgcttaatggcagagacgaggagcagtacatt

SEQ ID NO: 7440 - DNA, 4395 bp, Artificial Sequence
  Description of Artificial Sequence: Synthetic coding sequence
atgcctgagcaggaaaggcagatcacagctcgggaaggggcatcaagaaaaatcctatctaaactgtcactccccactagggcttgggaaccagctatgaagaaaagttttgccttcgataacgtgggatacgaaggagggcttgatggactcgggccttcaagtcaggtggccacatcgacagtgcgcattcttgggatgacatgtcaatcctgcgtgaaaagtatagaggataggatatcaaacctcaaaggaataatctctatgaaggtctccctagagcaggggtctgccacagttaagtacgtgccttccgtggtttgtttgcagcaggtgtgtcatcagataggagatatgggattcgaagcatctatagctgaaggaaaagcggcctcttggccatctaggtcactcccagctcaggaggccgtggtaaaattgcgcgtggaagggatgacatgtcagtcctgtgtctcgtccattgagggaaaggtcaggaaactacagggagttgtgcgagtaaaagtcagtttgtctaatcaggaggcagtcatcacttaccagccttatctcattcagcctgaagatcttagggaccatgttaacgatatgggattcgaggccgctatcaagtcaaaagtcgcacctttatccctcggaccaattgatatcgaaagattacagtctactaaccctaaaaggcccttatcttcggccaaccagaattttaataactcagaaacactgggacaccaggggtcacatgttgtgacacttcagcttagaatagatggaatgcattgtaagtcatgtgtattgaatatagaggaaaacatcggacaactcctcggggtgcagtcgatacaggtcagtctagaaaataagacagcacaggtaaagtatgatcccagttgcacaagtcccgtcgcactccagagggccattgaagcactgccccctggaaacttcaaagtgtctctgccagatggggctgaaggatcaggaactgatcatcgatcctccagtagtcattcccctgggagtcccccccggaatcaggtccaggggacttgttccactacactgatagccatagcagggatgacatgtgctagttgtgttcattccatcgaggggatgatctcacagctggaaggggtccagcagatatctgtatctcttgcggaagggacagctacagtattgtacaaccctagtgtcatctctcctgaagagcttcgggctgcgatagaagatatggggttcgaagcgagtgtggttagtgaatcctgttccactaatccccttgggaatcattccgccggaaacagtatggtgcagactactgatgggacaccaacatccgtccaggaagttgcgccccatactggaaggcttcctgcaaatcatgcgcccgatatactcgcaaagagtccacagtctactcgggctgttgccccacaaaaatgctttctccagattaaaggaatgacatgtgcctcctgtgttagtaacatagaacgaaatctacagaaagaagcaggagtgctgtctgtcctggtagctctcatggctgggaaggccgaaatcaaatatgacccagaagtcatccagccactcgaaatcgcccagtttatccaagatcttgggtttgaggccgccgtaatggaggactacgctgggtccgatggaaatatcgagcttacaattactgggatgacgtgcgcttcttgtgttcataatattgagtctaaactaactaggactaacggaatcacttatgcgtccgtcgccctggccacttcgaaagctctcgtgaaatttgatcccgaaatcatcgggcctagagatattatcaaaatcatcgaagaaataggatttcacgcaagtctcgcccagaggaaccctaatgcacatcatctcgaccacaaaatggaaataaagcagtggaaaaaatcattcctctgttcactagtattcgggattcctgtgatggctctgatgatctacatgctgatcccctccaacgagcctcaccagtccatggtgctggaccacaacatcattccaggactgtccatccttaacctaattttcttcatcctttgcacatttgtgcaactgctagggggatggtatttttatgtgcaggcctacaaatccctccgccacagatcagctaacatggatgtgttaattgtgcttgccacatccatagcctacgtctattctcttgtgatacttgtggttgctgtggcagaaaaagccgaaaggtctcctgtaacattctttgacacaccccccatgctctttgtttttatagccctgggaaggtggctagaacatctcgccaaaagtaaaacatctgaagcactggcaaaattgatgtccctgcaggctactgaagccacagtggtcactctaggggaagataacctaataatccgcgaagaacaggtacccatggaacttgttcagcgcggggatatcgtaaaagtggtgccaggagggaaattccctgtagatggaaaagtcctagaaggaaacactatggctgatgaatctctgataacaggagaggctatgcctgtgacaaaaaaaccaggatcaacggtcatcgccgggtctataaatgcacacggaagtgtcctgatcaaagcaactcacgtcggaaatgatacaactctagctcagatcgtgaaactcgtcgaagaagcccagatgtctaaagcaccaatccagcagctagcggataggttttccggatactttgtacctttcattatcataatgtctacactgacattagtggtctggatcgtgataggatttattgattttggggtggtgcagagatatttcccaaacccaaacaaacacatcagtcagacagaagtcataatcaggtttgctttccagacatctatcactgttctctgtattgcctgcccctgctcactagggttagcgacacccactgctgtaatggtgggaacaggagtcgccgcacagaatgggatacttattaaagggggaaaacccctcgaaatggcccacaaaatcaaaactgtcatgttcgataaaacagggacaataactcatggagtgccccgagtaatgcgagtgctcttgcttggagatgttgctactctcccactccggaaagtgctcgccgtggtggggacagctgaggcctcctccgaacaccccttaggggtggctgtaactaagtattgtaaggaagaactgggaactgaaactctagggtattgcactgattttcaagctgtccctgggtgtggaatagggtgtaaagtatctaacgtggaggggattttggcacattctgaaaggcccctctccgcacccgcttcacacctaaacgaagccggatccttacccgccgaaaaagacgccgtcccacagacattctcggtcctgatagggaatcgagaatggctgcgcaggaacggactgacaatatcatccgatgtatctgatgctatgactgatcatgaaatgaagggacagactgccatcctggtcgctatagacggggtactgtgtgggatgatcgcaatcgccgatgcggtgaaacaggaagctgccctcgcggtgcatactctacagtctatgggagtggatgtcgttttaattactggagataaccgaaaaactgccagggccatcgccacacaggtgggaataaataaagtgttcgccgaagtcttaccttctcataaggtggctaaagtgcaggaactacagaataaaggaaaaaaagttgcaatggtcggggatggagtgaacgatagtcccgccctcgcacaggctgatatgggggtggctattggaacagggactgatgtggccattgaagcagccgatgtcgttctgatccgcaacgatctcctagatgtagtcgcttctatacatctctctaagcgcactgtgaggagaatacgtataaatttagtcctggctttaatttacaaccttgtaggaattcccatagcagcgggggtctttatgccaataggaatcgtgctccagccctggatgggatctgctgctatggcggcgtcatccgtgtccgttgtgttgtccagtctgcagctaaagtgctataagaaacccgacctggaaagatatgaagcccaagcccacgggcatatgaaacccctgactgctagtcaggtgtccgtacatattgggatggatgatcggtggagggattccccacgggcaacaccctgggatcaggtgtcatatgtgtctcaggtcagtctctccagtcttacgagtgacaaaccctctagacattctgccgccgctgacgatgacggggataaatggtcattgttactgaacgggagggatgaagaacaatacatc

SEQ ID NO: 7441 - DNA, 4395 bp, Artificial Sequence
  Description of Artificial Sequence: Synthetic coding sequence
atgcccgaacaggagagacagataaccgccagagagggcgcatctagaaaaatacttagtaaacttagtttacctactagggcttgggagcccgctatgaagaaatcatttgccttcgacaacgtggggtatgaagggggcctggacggattgggccctagctcacaggtggccactagcactgtgcggatcctcggcatgacctgccagtcttgcgtcaaatcaattgaagataggatcagcaatctcaagggcataattagtatgaaagtgagtttagagcagggatctgctactgtcaagtacgtcccgtccgtagtttgtctgcagcaagtatgccatcagattggggatatggggtttgaggcctcaattgctgagggaaaggccgcatcttggcccagtaggtccctgccagcccaggaggctgtagtaaagctgagggttgaaggtatgacttgtcaaagctgcgtgtccagtatcgagggcaaggtgagaaagcttcagggagtagtacgagttaaggtctccttgtccaaccaggaagcggtcatcacatatcaaccctacctgatccagcctgaggatctgagggaccacgtgaatgatatgggctttgaggcagcgatcaaatctaaagtagcacccctgtctctgggtcctatcgatatcgagcgtctacagagcactaatccgaagagacctctttcatctgctaatcagaatttcaacaactctgagaccctcgggcatcagggatcccacgtcgttacactccaacttcgaatagacggcatgcattgcaaatcgtgtgtcctgaatattgaagagaatatcgggcaactcctgggggttcagtctatacaggtgagcttagaaaacaagacggcccaggtaaaatacgatcctagctgcacatccccagtggcccttcaaagggccattgaagccttacccccgggcaacttcaaagtgtctctccctgatggggccgaaggaagcggaaccgaccaccgttcaagttcttcgcacagtccagggtccccgccgagaaatcaagttcagggcacatgttccactactctcattgccattgccggaatgacatgtgcttcttgcgttcattcgatcgaaggcatgatcagtcagctggaaggggtccagcagattagcgtgtcgctagctgagggaaccgctactgtactctacaacccttctgtgatttcacccgaagagcttagagccgctatagaagacatgggatttgaagcctctgtcgtgtcagaatcttgttccacaaacccacttggaaatcacagcgctgggaactctatggtgcagacaaccgatggcacccccacgagcgtgcaggaggtagcacctcacacaggccgactgcctgccaaccacgcccccgacatactggcaaagtcccctcagtcaactagagcagtggctcctcagaaatgttttcttcagatcaagggcatgacctgcgcctcatgcgtgagtaacattgaaaggaacctccaaaaggaagctggcgtcctgagcgtcttggtggccctgatggcaggaaaggctgaaatcaagtacgacccagaggtcatccagccactcgagatcgcccagttcatccaggatctggggttcgaagcggcagtcatggaggactacgccggctccgacggcaatatagagctgacaattacggggatgacatgtgcctcctgcgtccacaacattgaatccaagctaactagaacaaacgggataacgtatgcttctgttgcgctagccacatcaaaagcgctcgtgaagtttgatcctgaaattataggacctcgagatattatcaagatcatcgaagagattggcttccacgcttccctcgcacaaagaaatcctaatgcccaccacctcgaccacaaaatggagattaagcagtggaagaaaagcttcctgtgctccctggtgttcggtatccccgtaatggccctcatgatatacatgctcatcccttctaacgagcctcatcagagcatggtcttagatcacaatatcattcccggactgtccatattaaatcttatcttcttcattttgtgcactttcgtgcagttgttgggcggatggtacttttacgtgcaagcgtacaagagcctgaggcacaggtccgctaatatggacgtgttaattgtactcgcgacaagtatcgcctacgtttacagtctggtgattcttgtggtggcggtcgctgaaaaagcagaaagatccccagtcacgttcttcgatactccaccgatgctctttgtatttatagctttgggtagatggctggaacacctagctaagtccaagacttccgaggcattggcgaaattgatgtctcttcaggcaaccgaagctactgtggttacccttggcgaagacaatctcataataagggaagaacaagtgcccatggaactcgtccagaggggggatatagttaaagtggtgcccggcggcaaatttcccgtggatgggaaggtcctagaaggaaatacgatggctgacgaatctttgattactggcgaagcaatgcctgtaactaaaaaacctggctctactgtgatagctggctctattaacgcacatggctccgtgctgatcaaggcaacccacgtgggaaacgatacgactctcgcccaaatcgtaaagcttgtagaagaggcccagatgtccaaagctcccatccagcagttagctgacagattctcagggtacttcgtgccgtttatcataatcatgtccaccctcactctcgtggtatggatagtgatagggtttattgattttggcgtcgtccagcgctatttcccaaatcctaataagcacatttcacaaaccgaggtgatcatcagatttgcttttcagacttctatcaccgtgctgtgcatcgcgtgcccgtgttctttgggactggcgactccaacagccgtgatggtaggcaccggagtggccgcccagaacggcattcttataaagggaggaaaaccgcttgaaatggcccataagataaagacggtgatgtttgacaagaccggaacgatcacgcacggggtaccccgtgtaatgcgggttctgttgctcggtgatgttgccaccctcccactgcgaaaggtgctcgccgtggtcgggacagctgaggcttcctcagaacaccccctaggggtcgctgtcacaaaatattgtaaggaggagctgggcacagaaacccttggctattgtacagacttccaagcagtaccagggtgcggtatagggtgcaaagttagcaatgtggaagggattcttgcccacagcgagaggccactgagtgctcctgcttcacaccttaatgaagcaggatcactgcctgccgagaaagatgccgtcccccagaccttttccgtgcttatagggaatagagagtggctgagaaggaacgggctgactatctctagcgatgtgtcggacgcaatgaccgaccacgagatgaaagggcagaccgctatactagttgctatagacggcgtgctgtgcggaatgatagcaatcgcggacgccgtcaagcaggaggcagccctagccgtgcatacactacagtctatgggggtggacgtcgtactgatcaccggcgacaaccgcaagaccgcacgagctatcgcaacacaagtaggcatcaataaggtgtttgcggaagtgctacccagtcacaaggtggccaaggtccaggaactgcagaacaaaggcaaaaaggtagcaatggtaggcgatggcgtaaacgactcccccgctcttgctcaggccgatatgggcgtcgccattggcactggaaccgatgtagcaattgaagcagctgatgtcgtacttatccgaaacgacctattggacgtcgttgcaagcatccacctgagcaaaagaacagtgaggagaatccgaattaatcttgttctggccctcatctacaatctcgtcggcatcccaattgctgccggggttttcatgccaattggaattgtactgcagccttggatgggtagtgccgccatggcagctagctcagtctcagtggttctgagctcactgcagctcaagtgttataagaaaccagatctggagagatatgaagcccaggcccacgggcacatgaaacccctgacagcctcacaggtgagcgtccatatcggcatggacgataggtggcgggattccccaagggccaccccctgggaccaggtgagctatgtgtcccaggtgagtttgtcgagcctcacatcggataagccaagtcggcactcagccgcagccgacgatgacggtgacaagtggtcgctgctgctgaatggcagggacgaagagcagtatatt

SEQ ID NO: 7442 - DNA, 4395 bp, Artificial Sequence
  Description of Artificial Sequence: Synthetic coding sequence
atgccggagcaggaacgccaaattaccgccagagaaggggcatccagaaaaatcctttcgaaattgtccttgcccactagggcgtgggaaccagcaatgaaaaagtccttcgcatttgacaacgtcggatatgaggggggtctggatggactgggcccttcgtcccaagtggctacttcgactgtgcgtattctcgggatgacctgtcagtcctgtgtgaagagcatagaggatcgaatctccaatcttaagggaattatcagcatgaaggtgtctctcgaacaaggaagcgcaaccgtgaagtacgtgccttcggtggtgtgccttcaacaagtgtgtcatcaaatcggtgacatgggcttcgaggctagcattgcggaaggtaaggccgcatcgtggccttcacggtccctcccagcacaagaggcagtggtcaagttgcgcgtggagggcatgacttgccagtcatgtgttagctcgatcgagggaaaagtgaggaaacttcaaggggtggtccgtgtcaaggtgtcgctctcgaatcaagaagccgtgattacttaccagccctacctgattcagcctgaagatttgagggaccatgtgaacgatatggggttcgaagcagctattaagtccaaggtcgcgccactgagcctgggtcccattgatatcgaaagattgcaatccactaatcctaagcggcctttgtcgagtgcaaaccagaacttcaacaattcagagactctcggacatcagggatcgcacgtggtgaccctccagcttcggatagatggtatgcattgtaaatcatgtgtccttaacatagaagagaacatcggacagctgttgggcgtgcaatcaatccaagtcagtctggaaaacaagactgcccaagtaaagtacgatccttcctgtaccagccctgtggcactccaacgcgcgattgaggcgctccctcccgggaatttcaaggtttcgcttcctgacggggcagagggatcgggtaccgaccatcggagctcgtctagccattcgcctggatcccctccccgtaaccaagtccaagggacttgctccactacccttattgcaattgctggtatgacttgtgcctcgtgtgtacattcaatagaaggaatgatcagccaacttgagggtgtgcagcaaatttccgtgagcctcgccgagggaaccgcgactgtcctttacaacccctcggttattagcccggaagaacttagagcagcaatcgaagatatgggtttcgaggcctcagtcgtgtcggaatcctgttcgaccaatccacttggtaaccattcggccggaaactcaatggtccaaacgactgatggtacccctaccagcgtccaggaggtggccccccatactggaaggctcccagcgaatcatgcaccagatatactggccaaatcgccccagtccactagagcagtggcacctcaaaaatgttttcttcagataaagggcatgacgtgtgcaagctgcgtatcgaatattgagagaaaccttcagaaagaagccggtgtgttgtcggtcctggtggcactgatggctggaaaggcagagattaagtacgacccggaagtgattcaacccctggagatcgcacagtttattcaggaccttggttttgaggctgcagttatggaggattacgccggcagcgacggcaatatcgagctgaccatcactggaatgacttgcgcctcctgtgtgcacaatatagaatcaaaactgaccagaactaacgggattacgtacgcatccgtcgcccttgcaacctccaaggccctcgtgaaattcgacccggaaatcatcggaccacgagacatcataaagatcattgaagagattggatttcacgcatcactggcacaacgcaacccaaacgcacatcacctggatcacaagatggaaatcaaacaatggaaaaagtcttttctgtgctccctggtctttggaattcctgttatggcattgatgatttacatgctcattccatccaatgaaccccaccaatccatggtcctcgatcacaatatcattcctggtctttccatcctgaacttgattttcttcatcctgtgcaccttcgttcagcttctgggcggttggtacttttatgtgcaggcatacaagtcactccggcataggagcgctaacatggatgtactgatcgtgctggcgacgtctatcgcgtacgtgtattccctcgtgatcttggtcgtggcggtggcggaaaaggcagaacgatcgccggtgacgttctttgataccccaccaatgctctttgtgtttatcgcgcttggaaggtggctcgaacatctggccaagtcgaaaactagcgaggctctggccaagctgatgtcccttcaggcaaccgaagcgacggtcgtgactcttggtgaggacaacctgattattcgtgaggaacaagtccctatggaattggtgcagcggggagatatcgtgaaagtggtgccaggaggcaagtttcctgtggatgggaaagtactcgaaggtaatactatggcagatgaatcactgatcaccggtgaagcaatgcctgtgactaaaaagccaggctctactgtgattgccggctccattaacgcccacggttcagtcttgataaaggcaacccatgtgggtaacgacactaccctggcacagattgtgaagctggtggaagaggcgcaaatgtcaaaggcaccaattcaacagcttgcggaccgattttccggttactttgtgccctttatcatcatcatgtcgacgcttactctggtcgtctggatcgtgatcggctttatagactttggtgtcgtgcagcggtacttcccaaatcccaacaaacatatttcacaaaccgaggtcattatacgttttgcgtttcagacgtcaattaccgtgttgtgcattgcatgtccgtgtagcctgggtcttgccacccctaccgcagttatggtgggaactggagtcgccgctcaaaacgggattctgattaagggaggcaaaccactcgaaatggcccataagatcaagaccgtgatgtttgataagacgggaaccattacccatggggtgcctcgcgtaatgcgcgtgctgctccttggagatgtggctactctgcctctcagaaaggtccttgcagtcgtcggtacggccgaagcaagctcggaacaccctctgggcgtggcggtgaccaaatactgcaaggaagaactgggtaccgagactttgggatactgcaccgattttcaggcagtgccggggtgtgggatcggatgtaaggtgtcgaacgtggaagggattcttgcgcactcagagaggccccttagcgctccagcatcgcatctgaatgaagccggctccctgcctgcagaaaaggatgcagtgccacagaccttttcggtcctgatcggcaatcgagaatggcttagaagaaacggacttaccatttcatcggacgtgtcggacgcaatgaccgatcacgaaatgaaggggcagactgcgatcctcgtggccatagatggcgttctttgtggtatgatcgcaattgctgatgccgtcaagcaggaagcagccctggcagtccacaccctgcaatcaatgggtgtcgatgtggtgcttattaccggagataacagaaagacggcaagagctattgcaactcaagtgggcattaacaaggtgttcgcagaagttcttccctctcataaggtggccaaggtccaagaacttcagaacaagggaaaaaaggtagctatggtcggagatggagtgaacgattcccccgcactcgcacaggcagacatgggagtggcaatagggaccggcactgatgtggcaattgaggcggcagacgttgtgctcatccgaaatgaccttctggacgtcgtggcaagtattcaccttagcaagcgcaccgtcagacggatacggatcaacctggttctggctctgatttacaatctcgtaggaatccctattgcagcgggagtattcatgccaataggaattgtgctgcaaccatggatgggctccgccgccatggcagcctcgtcagtctcggtggtgctgagcagccttcaacttaagtgctacaagaagcctgatttggaacgctacgaagcacaggcacatggacacatgaagccgctgactgcaagccaagtgtcagtgcatatcgggatggacgaccgctggcgggatagccctagagccaccccatgggatcaggtgtcatacgtgagccaagtgtccctctcctcacttactagcgataagccatcccgacattcagcagctgcagatgacgatggagataaatggtcccttctgcttaacggcagagacgaagaacagtacatt

SEQ ID NO: 7443 - DNA, 4395 bp, Artificial Sequence
  Description of Artificial Sequence: Synthetic coding sequence
atgccggagcaagaacgccagatcactgcccgcgaaggtgcctcacgcaagatcctctcgaaactgtcactgccgacccgcgcgtgggaaccagcgatgaagaaatcatttgccttcgacaacgtgggatacgaaggaggtctggatgggctgggaccaagctcccaagtggcaacctccaccgttcggatcctgggtatgacgtgccagtcttgcgtgaagtcgattgaggatagaatatcaaacctcaaaggtatcatctccatgaaggtgtcactggaacagggctccgctactgtcaaatacgtcccgtcggtggtgtgcctgcaacaggtgtgccatcaaatcggagacatgggctttgaagcctcgattgctgaaggaaaggctgcaagctggccatccagatccctccctgctcaagaggcagtcgtcaagctccgcgtggaaggaatgacctgtcagtcctgcgtgagctccattgagggtaaggtgaggaaattgcagggcgttgtgcgggtgaaagtctcgctgtcgaaccaggaagccgtgatcacctaccagccctacctcatccagccagaggacctccgcgaccacgtgaacgatatggggttcgaagccgctatcaagagcaaggtggcgccgctttcgctggggccaatagacatcgagcggctgcagtcgactaatccgaagcgcccactctcatcggccaatcaaaacttcaacaacagcgaaactttgggccaccaaggttcacatgtcgtgaccttgcaactgcggatcgatggaatgcactgcaagtcctgtgtcctgaacatcgaggagaacatcgggcagctccttggtgtgcagtcgatccaagtttccctcgagaataagactgcccaggtcaaatacgacccatcctgcacttcacctgtcgcgctgcagcgggcaatcgaggccctcccaccgggaaacttcaaagtctcgttgcccgacggagcggagggaagcggcaccgaccatagatcaagctcatcgcactcgcccggatcaccgccgcgcaaccaagtgcaagggacttgctccaccactctgatcgctatcgcgggcatgacgtgtgcaagctgtgtccatagcatcgaaggtatgatctcccaactggaaggggtgcaacagatctccgtgtcgctggcagaaggaaccgcgaccgtgctgtacaatccgtccgtgatctcaccggaagagctgcgagccgccatcgaggacatgggcttcgaagcatcagtcgtgtccgaatcatgttccaccaaccctctgggaaaccattccgcgggaaatagcatggtccaaaccactgacgggacccccacttcggtgcaagaagtggcgcctcacaccggccgactgccggccaatcacgctcctgacatcttggccaaatcgccacaatccaccagggcagtggccccgcagaagtgctttctgcagattaagggaatgacctgcgcctcatgcgtctccaacatcgaacggaatctgcaaaaggaggcgggagtgctctctgtgctcgtggcgctgatggcgggaaaagctgagatcaagtacgacccggaggtgattcagccccttgaaatcgcccagttcatccaggacctgggatttgaagccgccgtcatggaggattatgctggaagcgacggcaatatcgaactgactatcaccggaatgacttgcgcgtcctgtgtgcacaacatcgaatccaaactcactcgcactaacggaatcacctatgcgtccgtcgccctcgccacctccaaggctctggtgaaattcgacccagagatcattggaccgagagacatcatcaaaatcattgaagaaatcggttttcacgcgtccctggcgcagagaaatccgaacgcccatcatctggaccacaagatggaaatcaagcagtggaagaaatcctttctctgctccctggtgttcggcatccctgtcatggccctcatgatctacatgctgattccatctaacgagccccaccaaagcatggtgctggaccacaatatcattcccggactgtcgatcctgaacttgatcttcttcatcctgtgcaccttcgtgcagctcctcggcgggtggtacttttacgttcaagcgtacaagtccctgagacacagatccgctaacatggacgtgttgatcgtgctggctacctccatagcctacgtctacagcctggtgatccttgtcgtggccgtggcagagaaggcagaacgctctccagtgaccttcttcgatacgcctccgatgttgttcgtgttcatcgccctcggacgatggcttgagcatctggctaagtcaaagacctccgaggctctcgctaaacttatgagcctccaagccaccgaggccaccgtggtcactctgggggaggataacctgatcatcagggaggaacaggtgccgatggaattggttcaacgcggtgatattgtgaaggtcgtcccgggcggaaagttcccagtggacggaaaggtgctggaaggaaacactatggccgacgagtcattgatcacgggagaggccatgccggtcaccaagaaaccgggatccaccgtgatcgccgggtccatcaacgcacatgggtcagttttgatcaaggccacgcatgtcggaaatgacaccaccctggcccagatcgtgaaacttgtggaagaggcgcagatgtccaaggcaccaatccagcagcttgcagacagattctctggctactttgtgcctttcatcataatcatgagcactttgacgcttgtggtgtggatcgtgattggattcatcgactttggagtggtccagagatacttcccgaatcccaataagcacatctcccagacggaagtcatcatcagattcgcgttccagactagcatcactgtgctgtgtatcgcctgcccttgttcactcggccttgccaccccgaccgcagtgatggtgggaactggcgtggctgcccaaaacggaatcctcatcaagggagggaaaccgctggagatggcccacaagatcaagactgtcatgttcgacaaaaccgggactatcacgcatggtgtgccgcgggtgatgcgcgtcctgctcctgggtgatgtggccaccctcccgctgcgcaaggtgctcgccgtggtcggaaccgcagaagcaagctccgagcatccgcttggagtcgccgtcaccaaatactgtaaagaggagcttggcaccgaaaccctgggatactgcaccgatttccaagcagttcccggatgcggaattggctgtaaggtgtcgaacgtcgaaggtatcctggcacactcggaaagaccgctgtcagccccggcctcccacctcaacgaggccggatcgctgccagcagaaaaggatgctgtccctcagaccttctcggtgctgatcggaaatagggaatggctccgccggaacggtctgactattagctcggatgtgtcagacgctatgaccgatcacgagatgaaagggcagacggccatcctggtggccattgacggagtcctctgcggtatgatcgcaatcgctgacgccgtcaagcaggaagccgcgttggccgtgcacaccctgcagtctatgggtgtggacgtggtgcttattaccggagataatcgcaaaactgcccgtgccatcgccacgcaggtcggaatcaataaggtctttgccgaggtgctgccaagccacaaagtggctaaggtgcaagaactgcagaataagggaaaaaaggttgcgatggtcggggatggagtgaacgatagcccggctctggcccaggccgacatgggagtggccattgggactgggactgatgtggccatcgaagctgccgacgtcgtgcttatccgcaatgacctgctggacgtggtggcttccattcacttgagcaaaaggaccgtgaggcggattcgcatcaacctcgtgctggcactgatctataacctggtgggtatcccaatcgctgcgggcgtgttcatgccgatcggaatagtgctgcagccctggatgggaagcgccgcaatggccgcgtcgtcagtcagcgtggtcttgtcgtcgctgcagctcaagtgctacaagaagccggacttggaacgctacgaagcacaggcacatgggcatatgaagccgctgacggcatcccaggtgtcagtgcatattggcatggacgatcggtggcgtgattccccgcgtgcgactccgtgggatcaggtgtcatacgtgagccaagtgtctttgtcgagcctgacttcagacaagccgtcaagacattccgctgccgcagatgacgatggggacaagtggtcgctcctcctcaatggccgggatgaggagcagtacatc

SEQ ID NO: 7444 - DNA, 4395 bp, Artificial Sequence
  Description of Artificial Sequence: Synthetic coding sequence
atgccagaacaggagaggcaaattactgcaagagaaggagcgagcagaaagatactgagcaaactttcccttccaacgcgcgcgtgggagccagcaatgaagaagtccttcgcgtttgataatgtgggttacgaggggggtctggacggtcttggacctagctcccaggtggcgacctcgaccgtgagaattcttggtatgacgtgtcaatcgtgtgtgaagtccattgaagatagaattagcaacttgaaggggatcatttcgatgaaggtgagcctggaacaaggttcagcaactgtcaagtacgtcccgagtgtggtgtgtctgcagcaggtctgccaccaaattggggacatggggtttgaagcctcaattgccgagggaaaggcggcatcctggccatcgagatcgcttccggcgcaggaagcagtggtgaagctgcgcgtggaggggatgacctgtcagtcgtgcgtctcctccatcgagggaaaagtccggaagctgcaaggagtcgtgcgggtcaaggtttcgctgagcaaccaagaggccgtgatcacgtatcagccctaccttattcagcctgaagatctgcgggaccacgttaacgatatgggctttgaggcagcaatcaaatcaaaggtggcacctctgtccctgggcccgattgacattgaacgtttgcagtcgactaatcccaagcgtccactgagctcagcgaaccaaaactttaacaatagcgaaacccttgggcatcaaggttcacatgtggtgacgcttcagctcagaattgatgggatgcactgcaagtcatgtgtgcttaacattgaagaaaacatagggcaacttcttggcgtgcaatcaattcaggtgtcactggagaacaagactgcacaggtaaagtatgatccttcctgtaccagccccgtggctttgcagagagcaattgaggccctgccacctggtaacttcaaggtttccctcccagatggagcagaaggctcgggcactgaccatcgaagctcgtctagccactcccctggatcgcccccaagaaaccaagttcaggggacttgctccactaccctcatcgcaatcgcggggatgacttgtgctagctgtgtgcattcgatcgaggggatgatttcgcaactggaaggagtgcagcaaataagtgtgtccctggcggaaggtactgccaccgtcctgtataatcccagcgtcatcagcccggaagaactccgagcagcaatcgaagatatgggatttgaggcgtcagtggtgtctgagtcgtgttccactaatccccttggaaaccattcggcgggaaactcgatggtgcaaaccaccgatggaactccaaccagcgtgcaagaagtcgccccacacaccggacgcctcccagcaaatcatgcacccgatatcctcgcaaagtcgccacagtccacccgagcagtggctcctcagaaatgtttcctccagatcaaaggaatgacctgtgcttcctgcgtgtcaaacatagagagaaacctgcaaaaggaggcgggtgtcctctccgtgcttgtggctctgatggccggtaaagcagaaatcaagtacgatcctgaagtcattcaacctcttgaaatagcgcagtttattcaggatctgggttttgaggccgcagtgatggaagattacgccggcagcgatggcaatattgaactgactataactggtatgacttgcgcatcgtgcgtgcataacattgaaagcaagctgaccagaaccaacggcatcacttacgccagcgtggcactggcaacttcgaaggcactcgtcaagtttgatcctgagatcattggtcctcgggatatcatcaagatcattgaggagattggatttcatgcaagccttgcacaaaggaaccctaatgcgcatcaccttgatcacaaaatggaaatcaagcagtggaagaagtcatttctgtgctcattggtgtttggaattccggtcatggccctgatgatatacatgttgataccatcgaatgaacctcatcaatccatggtcctggatcataacattattcccggcttgtcgatcctgaacctgatattcttcattctctgtacttttgtgcaactcctcggaggctggtacttttacgtgcaggcatacaaatcccttagacatcgatcagccaatatggatgtgcttattgtgttggcaacctcgatcgcatacgtgtactcccttgtgattctcgtcgtggccgtcgcggaaaaagcggaacgtagccctgtgactttctttgacactccaccaatgcttttcgtgttcatcgccctgggtcgatggcttgaacatttggccaagtcaaagacttccgaggcacttgcaaagctcatgagcctgcaggcaacggaggcaaccgttgtgactctcggagaagataatctgattattcgggaagaacaagtccctatggaacttgtgcagcggggagatattgtgaaggtggtgcccggaggaaagtttccagtcgatggtaaggtgctggaaggtaacaccatggcagatgaatcgctcatcacgggagaagccatgcccgtaacgaaaaaaccgggttcgactgtgatcgccggttcaattaacgcacacggatcggtattgatcaaagccactcatgtgggtaacgacactacccttgcacaaattgtgaagctggtggaggaagcccaaatgtcaaaggcccctatccaacaattggccgataggttctcaggctactttgtgccgtttatcatcatcatgtcgacccttaccctggtggtgtggatagtcattggattcatcgattttggagtggtgcagcgctacttcccaaatcccaacaaacacatttcgcaaaccgaggtgattatacggtttgcgtttcaaacttcgatcaccgtgctgtgtatagcgtgtccgtgtagcttgggtttggcaacgcctacggcggtcatggtgggtaccggggtggctgcccagaatggaatcttgattaaaggtggcaagcctcttgaaatggctcacaagataaagactgttatgttcgataagaccggcaccattacccatggtgtgcccagagtgatgcgcgtcctcctcctgggagatgtggccactcttcctctgcggaaggtccttgccgtggtgggaaccgcagaagcaagctcagaacatccactgggtgtcgcagtgactaagtactgcaaagaagaacttgggaccgaaacgctcgggtactgtaccgactttcaggccgtgcctggttgcggtattggttgtaaggtgagcaacgtcgaaggaattcttgcccattctgagcggcctctgtcggcacctgcaagccacctgaacgaagcagggtccctcccagcagaaaaagatgcagtccctcaaaccttttctgtcctcatcgggaatcgcgaatggcttagacggaatgggctgaccatatcgagcgatgtcagcgatgcgatgaccgaccacgaaatgaagggtcaaaccgctatactggtggcgatagatggagtcctgtgcggtatgatagcaatagcagacgcagtgaagcaggaagcagcgctggcagtgcacactctgcaatcgatgggagtggatgtggtccttataaccggagataatcgtaagacggctcgtgcaattgcgacgcaggtggggataaacaaagtgttcgcagaggtgctgcctagtcataaagtggcaaaggttcaggagctccaaaacaagggcaagaaggttgctatggtcggggatggtgtgaacgacagccctgcacttgcccaagccgacatgggtgtcgccattggaacgggaactgacgtggcgattgaagcagctgatgtggtgctcatccggaatgatcttcttgacgtggtggccagcatacatctttcaaaacgtactgtgagaagaataagaatcaatttggtgcttgcactgatctacaatctggtgggaatccccatagcggcaggcgtgttcatgccaatcggaatcgtcctgcaaccttggatgggatcggcggcaatggcagcatcgtcagtgtccgtggtgttgagctcacttcagcttaagtgttacaaaaagccggatttggagaggtacgaagctcaagcacatgggcatatgaagccactcaccgcgagccaagtgagcgttcatatcgggatggacgatcgatggcgtgatagcccacgggcaaccccttgggaccaggtgtcctacgttagccaagtctccctgagctccctcacctcggataagccttcgagacatagcgcggccgcagatgacgacggtgataaatggtcccttcttctgaacggtagggacgaagagcaatacatc

SEQ ID NO: 7445 - DNA, 4395 bp, Artificial Sequence
  Description of Artificial Sequence: Synthetic coding sequence
atgccagagcaggagagacaaattactgccagagagggcgcatctcgtaaaatcctgtcgaaactttcccttcctactcgcgcctgggaaccagcgatgaagaagagcttcgcatttgataacgtgggatacgaaggaggtttggatggcctgggtccatcctcccaggtggctacctccacggtccgtattcttgggatgacctgtcagtcgtgtgtgaagtccattgaagatcggatatccaaccttaaggggatcatctcgatgaaggtgtctttggagcaaggaagcgcaactgtcaagtacgtcccttcagtggtgtgccttcaacaagtctgtcatcaaattggagacatgggttttgaagcatccattgcagaaggaaaggcggcctcctggccatcccgaagcctgcccgcacaggaagcagtggtcaagttgcgcgtggagggcatgacgtgccagagctgcgtgtcatcaatcgaaggaaaagtacgcaagctgcagggggtggtgagagttaaggtgagcctgtcaaatcaagaggcagtcatcacctaccagccttacctgatccaaccagaggaccttcgcgatcatgtgaatgacatgggctttgaggcagcgataaagtcgaaggtggcacctctgagccttggacctattgacattgaacgactgcaatcgactaacccaaagcgcccactctcgtcggcaaatcaaaacttcaataactcagagactctcggtcaccaagggtcccatgtggtcactcttcaacttcgtatcgacggaatgcattgcaagtcatgcgtgttgaatattgaagagaacatcggtcaattgcttggggtccaatcgattcaagtgagccttgagaacaagactgcacaggtcaagtacgatccttcctgtactagccctgtggccctgcaaagagccatcgaggcactgccccccggtaactttaaagtgtcgttgcctgatggtgcagagggctcgggtactgatcacagatcatcgtcgtcccattcgcctggttccccacctagaaaccaagtgcaaggaacttgttccactactcttatcgctattgcgggaatgacgtgcgcctcctgcgtgcactcgatcgaaggcatgatctcacagctggagggcgtccagcaaatctccgtaagtctggcagagggtacggcaacggtgctgtacaatccaagcgtcattagcccagaagaactccgggccgctattgaagatatgggattcgaagcgtcggtggtgagtgaatcgtgttccaccaatcccctcggtaatcattcggcgggcaactcaatggtgcaaactactgatggaacccccacctccgtgcaagaggtcgctccccatacggggagactgccagcaaaccatgcaccagacattcttgccaagtccccccaaagcactcgtgcggttgccccccaaaagtgttttctccagataaaggggatgacctgcgcaagctgtgtcagcaacattgagcggaatcttcagaaggaagcaggagtcctgagcgtgctcgtggcgcttatggccggtaaagcagaaatcaaatacgacccggaagtgattcaacctctggaaattgcacagtttatccaagatctgggtttcgaagctgcggtgatggaagattacgcaggatcggacggtaacattgagctcaccataaccggaatgacttgtgcttcatgtgtgcacaacattgagtcaaagctgacgagaactaatggcattacgtacgcatcggttgcacttgcgacctcaaaagcgctcgtgaagtttgatcctgaaatcataggaccacgcgacattatcaaaatcatcgaggaaattgggtttcatgcctcgcttgcacaacggaatcctaatgcacatcatcttgaccacaagatggagataaaacaatggaaaaagtcgtttttgtgcagcctggtgtttggtatcccagttatggctcttatgatctacatgctgatcccatcaaacgaaccacatcagtcaatggtcctggatcacaacatcatccccggacttagcattctgaacctgatattctttatactctgtacctttgtgcaactcctgggtggatggtacttctacgtccaagcgtacaaatcgttgcgacatcggtcggcaaatatggatgtgctgattgtgctcgccacctcgatcgcatatgtgtactcccttgtcatcctcgtcgtggcagtcgcagaaaaagcggaaagatccccggtgaccttttttgatacccctccaatgctttttgtgtttatagcactgggtcgctggctcgaacacctggcaaaatccaagacttcagaagcacttgcaaagttgatgagcctccaagcaactgaggcaactgtggttactctcggagaagataaccttatcattcgtgaggaacaggtgcctatggaactggtccagcgaggggatattgtgaaggtggtgccgggaggcaaatttccagtggacggaaaggtgttggagggtaacaccatggcggacgaatcccttattaccggtgaggcaatgcccgtgaccaagaaacccggttcaactgtgatcgcaggttcgataaatgcacatggttccgtgctgattaaagcaactcacgtgggtaatgataccactctggcacagattgtgaagttggtggaggaagcacaaatgagtaaagctcctatccagcagcttgccgataggtttagcggctactttgtgccattcatcattatcatgtccacgctgactctcgtggtttggatagtgatcggcttcattgatttcggggtggtgcaaagatacttccccaaccctaacaaacatatttcgcagaccgaggtgattatcagatttgcattccaaacctcgatcaccgtgctgtgtattgcgtgtccgtgttcgcttgggcttgcaacccctactgcagtgatggtgggaactggtgtggctgcacagaacgggattctgattaaaggcgggaaacctcttgaaatggcacataagatcaaaaccgtgatgtttgacaaaactggcaccatcacccacggggtccctagagtcatgcgagtgctgcttcttggggacgtggcaactctccctctgcgcaaggtgctggcagtcgtgggcaccgcggaggcgtcgtccgaacaccctctgggagtggcggtgactaagtactgtaaggaagaactgggcaccgagactctcggatactgtaccgacttccaagctgtgccaggttgcgggattggatgtaaggtgtcaaacgtggaagggatcctggcacattcggagcggcctcttagcgcgcccgccagccaccttaacgaggccggaagcctgccagcagaaaaagacgcagtgccccagactttctcagtgctgattggtaaccgggagtggctcaggcggaacggactgaccatttccagcgatgtctccgatgcaatgaccgaccatgagatgaaaggtcagactgcaatcctcgtagccattgatggagttctctgcggaatgattgcgattgctgatgccgtgaaacaggaggcagcgcttgctgtgcataccctgcagtcgatgggcgtcgatgtcgtgctgatcaccggagacaaccgcaagactgcacgcgccatcgcaacgcaagtgggcatcaacaaagtctttgcagaggtgctccccagccacaaggtggccaaagttcaagagcttcagaacaagggaaagaaagtggcgatggtcggggatggtgtgaacgactcgccggccctggcacaagctgatatgggcgtcgcgatcgggaccggtactgacgtggcgatcgaagcagcagatgtcgttcttattagaaacgacctccttgacgtcgtggcatcgatacacctgtccaaaagaaccgtgaggcgaatacggatcaaccttgtattggcgcttatctacaacctcgtcggaatacctatcgccgcaggtgtctttatgccaataggcattgtgctgcagccttggatgggaagcgcagcgatggcagcttcgtcggtgtctgtggtgctgagctcactgcagctgaagtgttacaaaaagcctgatctggaacggtacgaggcccaggcccatgggcacatgaaaccactgactgccagccaagtctccgtgcatatcggaatggatgacaggtggagggactcgccgcgggccaccccatgggatcaagtctcctacgtgtcgcaggtttccctttcatcccttacgtccgacaagccgtcgcggcactcggcagcagcagatgatgatggggacaaatggtcgcttcttcttaacgggcgggacgaagaacagtacatt

SEQ ID NO: 7446 - DNA, 4395 bp, Artificial Sequence
  Description of Artificial Sequence: Synthetic coding sequence
atgcccgagcaggaacgacagattacagctagagaaggtgccagtagaaaaatcctgtctaagctgtcactacccacgagagcctgggagccagcgatgaaaaaatctttcgccttcgacaatgtcggatacgaaggcggattagatggcctaggcccctcctctcaggtcgcgacctctaccgtgaggatcctcgggatgacatgtcagtcgtgcgtgaagagtattgaggatcgtatctcaaatctgaaaggcataatcagcatgaaagtgtccttggaacagggtagcgcaaccgtgaagtacgtacctagcgtggtttgtctacaacaggtctgccatcaaataggtgatatggggtttgaggcatccattgcagaggggaaggctgcaagctggccatcacgatctctgcccgcccaagaggctgtggttaaactccgcgtggaggggatgacctgccagagttgcgtctcaagcatagaggggaaagtccgaaagctgcagggcgtggtgcgtgttaaggtttctctttcaaaccaggaggccgtcattacgtatcaaccttatctcatacagcctgaggacttgcgggatcacgttaatgacatgggtttcgaggctgcaatcaagagtaaggtcgccccactaagtctgggcccaatcgacattgagcgcttgcagtctaccaaccccaagaggcccctgagtagcgcgaaccaaaactttaacaattcagagacccttggacatcagggatctcatgtcgtgacactgcagctgagaatcgatggtatgcactgcaagagttgtgtgctcaacatcgaagaaaacatcggccagctgctaggggttcaatctattcaggtatcgctggaaaacaagacagctcaggtgaagtacgatccatcctgcaccagccccgtggccctccagcgggctatagaggctctccctcccgggaactttaaggtgagccttccagacggcgccgaaggctcagggactgatcaccgatcttccagctcccacagcccaggttcccctccacgtaaccaggtgcagggtacctgctctacgactttgatcgccatagctggaatgacctgcgcaagctgcgtgcatagtatcgagggaatgatttcccaactagagggcgtccagcagattagcgtatctctggcagagggcactgccaccgtgctgtataacccatctgtgatcagtcccgaagagctcagagccgctatcgaggacatgggctttgaagcgagcgtggtcagtgaaagctgttcgacgaatcctctaggtaaccacagcgctggtaactccatggtccagaccaccgatggcacccctacctcggtgcaagaagtggccccccatacgggccgcctccctgcaaaccacgcgccggacattttggcgaagagcccacaatctacccgggctgtcgcaccccaaaagtgtttcctgcaaataaaaggtatgacctgcgcctcgtgcgtatcaaacatcgagcggaacctgcaaaaagaagcaggcgtcctcagcgtactcgtggcattaatggcgggaaaggctgaaattaaatatgaccctgaagtcatccagccattggagattgcccagttcattcaggacttgggatttgaggcggctgtgatggaggactacgcaggatccgatggaaacatcgagttgactatcaccggcatgacttgcgccagttgtgttcacaacatcgagagcaagctcaccagaactaacgggataacatacgctagcgtcgctcttgccactagcaaggctttggtgaaattcgaccctgagataataggaccgagggacatcataaaaatcattgaagagatcggattccatgctagtctagcacagcggaatccaaatgctcatcatttggatcacaaaatggagataaaacaatggaaaaagagctttctctgtagcttggtgtttggtatcccagtgatggccctgatgatttacatgttgataccttctaatgaaccgcaccagtctatggtgctcgatcacaatataatccccgggttatcgatcctgaatctgattttttttatcctctgcacgttcgtgcagcttctggggggatggtacttctacgtacaggcctataagtccctgaggcatcgcagtgctaatatggacgttttgatcgtcctggcaacatccatcgcctatgtgtacagcctggtgattctcgtggtggcagtggccgaaaaggccgaacgctccccagtgaccttctttgatacacctcccatgctttttgtgttcatagctctgggccgctggctggaacacctcgccaaatccaagacaagcgaggctctggccaaactgatgagcctccaggccaccgaggctacagtggtgacactgggcgaggataacctcatcatccgcgaggagcaggttccgatggagttagtgcaaaggggcgacatcgtgaaagtggtgcctggcggtaagttccccgtcgacgggaaagttcttgagggaaatactatggcagatgaaagtctcattactggggaagccatgccagtcaccaagaaaccagggagcacagtgatcgcaggaagcattaatgctcacggctcagttctgatcaaagctactcatgttgggaacgacaccaccttggcgcagatcgtgaaactagtggaggaggctcagatgtcgaaagctcccattcaacagctcgccgacaggttcagtggttacttcgtacccttcatcatcattatgtccaccttaacactggtcgtttggattgtcattgggtttatagattttggggtggtgcagcgatactttccgaatcccaacaaacatatttctcaaaccgaagttatcatcaggtttgcttttcagacttccattacggtgctctgcattgcttgtccttgctcactgggattggcgacccccacggcagtgatggtgggcaccggggtggcagcccaaaatggaatcttaataaaggggggcaaaccactggaaatggcacataagatcaagacggtgatgtttgataagactggcacgattactcacggtgtgccgagggtgatgcgggtgctcctgctcggggacgtcgcaacactcccgttgagaaaagtgttagcagtggtaggcaccgccgaggcatcttcagaacatcctctgggagtggcagttacgaagtactgcaaggaggagctggggacggaaaccctcggttattgtaccgactttcaggctgttcctggctgtgggatcgggtgtaaagtatctaacgtggaggggatcctggctcactcggaacgccctctgtcagcaccagcctcacacttgaatgaggcaggctcgctgccagcagagaaggacgcagtccctcagacattcagtgtacttatcggtaatcgcgaatggttaagacgcaacggattgactatatccagtgacgtgagcgacgcaatgacagatcacgagatgaagggtcaaactgccatcctcgtcgcaatcgacggagtactttgtgggatgatagctatcgccgacgctgtgaagcaggaggctgcactggcagtacacaccctccagagcatgggggtggatgtggttctgatcacaggggataaccggaagactgcgagagcgatcgcgacccaggtgggcatcaacaaagtgtttgcagaggttctgccaagccacaaggttgctaaagtgcaagagcttcaaaataaaggtaaaaaggtggccatggtaggggatggtgtcaatgatagcccagcacttgcccaggccgacatgggtgttgccataggtacagggactgatgtggccatcgaggctgctgacgtggtcctgatccgcaatgatctcctagacgttgtggctagtatccacctgtctaagaggactgtcaggcgcatcaggattaacctcgtgctggctctcatatacaacttagtaggcatcccgatcgcagcaggcgtgttcatgccaatcggcatcgtgctccagccctggatggggagcgctgctatggccgctagttccgtgtcagtggtgctgagttctctgcagttaaagtgttacaagaagcctgatctggagaggtacgaggctcaggcccacggacatatgaaacctctgaccgcctcacaggtttccgttcatatcgggatggatgacagatggagagactctccacgtgccaccccatgggatcaggtgtcgtacgtttcgcaggtctccctgtcttctctgacaagtgacaaaccgtccaggcactcagccgccgccgatgacgatggagacaagtggtctctcctgcttaacgggcgggatgaagaacagtacatc

SEQ ID NO: 7447 - DNA, 4395 bp, Artificial Sequence
  Description of Artificial Sequence: Synthetic coding sequence
atgccagaacaggagaggcagatcaccgcacgcgaaggcgcatccaggaagatcctttctaaactttccttgccaaccagggcttgggaacccgccatgaagaagagctttgctttcgacaacgttgggtatgaaggcggacttgatggcctcggcccttccagccaggtggccaccagcactgtaagaatcctgggcatgacttgtcaaagctgcgtgaaatccatcgaagacaggatttctaacctgaagggaattatctcaatgaaagtgtcactggagcagggaagtgctactgtcaagtacgtgccttctgtggtctgcctgcagcaggtgtgtcaccaaattggggacatgggctttgaagcaagtatcgccgagggaaaggcagcgagttggccttcaaggtccctgcccgcacaggaagccgttgtcaaactcagggtggagggcatgacttgccaaagctgcgtgagttcaatcgaagggaaggtgcgtaagttacagggcgtggtgcgcgtgaaggtctccctgtccaaccaggaggcagtgatcacctatcaaccctaccttatccagcccgaagatctcagagatcacgtgaacgacatgggatttgaagcagccatcaaatctaaagtggcacctctgagcttggggcctatcgacatcgagagattgcagagcacgaacccaaagcgcccactcagctccgccaaccagaactttaacaatagcgaaacactgggacaccagggtagtcacgtcgtaacactgcaactccgtatagacggcatgcattgtaagagctgcgtgctgaacatagaagaaaacatcggacagcttctcggagtccagtccattcaagtctcgttggagaacaaaaccgcccaggtgaagtatgatcccagttgtacatccccagtggcattacagcgcgccatagaggctcttcctccaggcaatttcaaggtgagccttcccgatggtgctgaaggatccgggactgatcaccgtagttctagctctcacagcccgggatctccccccaggaaccaggtgcaaggcacatgctctacaacactgatcgcgatagctggaatgacctgtgcaagctgcgttcacagcatcgaagggatgatctctcagttagagggtgtccaacaaatctcggtcagccttgctgaggggacagcaactgtgctttacaaccctagcgtgatttcacccgaggagctgcgcgccgcaatcgaggatatgggatttgaagcaagcgtagtgagcgaaagctgttccaccaaccctctcggaaatcacagcgctggtaactcgatggtccagaccacagacggcactcctacaagcgtgcaagaggtcgccccacacactggtcggctgcccgctaatcatgcacccgacattctggccaagagtccccaatctaccagggctgtggctccgcagaagtgctttctgcagataaaagggatgacctgcgctagctgcgttagcaacattgagagaaatctgcaaaaggaggctggcgtcctgtccgtgctggtcgccctcatggccggcaaagcggagattaagtacgaccccgaagttatccagccactggaaatcgctcagtttatccaagacctgggattcgaggctgccgtgatggaagactatgccggcagcgacggtaacattgaacttacaatcaccggaatgacctgtgcctcatgtgtgcacaacatcgagtctaaactgacccgcactaatggcattacctacgccagcgtcgcacttgcaacatccaaggccttggtgaagttcgatcccgaaattatcggccccagggatattatcaaaataatagaggagattggctttcacgcttctctggcccagagaaaccctaatgcccaccacttggaccacaaaatggagattaaacagtggaagaagagcttcttatgctctttagtgtttggaatacctgttatggcactcatgatctatatgctgataccgtctaacgagcctcaccagtctatggtcctggaccataacataatccctggcttgtctatactgaatttgatctttttcatcttatgcacattcgtgcaactccttgggggatggtacttctatgttcaggcctacaagagtctaagacacaggtcagccaacatggacgtgctgatcgttcttgcaacttcaatcgcatacgtctattctctggtgatcctcgttgtggccgtcgctgagaaagctgaaaggagtcccgtcacattctttgatacaccaccaatgttgttcgtttttattgcacttggacgctggctggaacacctggccaagtccaagacgtccgaggcgcttgccaaattgatgagcttgcaggcaaccgaagctactgtcgtgaccttaggagaagataatctaattatcagggaggaacaagtgcctatggagctggtccagcggggcgacatagtgaaagtggtgcccggaggaaagtttccagtggacggaaaggtcctggaggggaatactatggcggacgagagcctgattacaggagaagctatgccagtgaccaaaaaacctggatccactgtaattgctggaagcattaatgctcacgggtccgttttaattaaagcaacacatgtgggaaacgacacaacacttgctcagattgtcaagctcgttgaggaagcccagatgtccaaagctcccatccaacagcttgccgatcggttctctggatacttcgtcccattcatcattattatgtccacacttaccctcgtggtatggatcgtcattggcttcatcgactttggtgtggttcaaaggtacttcccgaaccctaataaacatatcagccaaactgaagtaatcatcaggtttgcatttcagaccagcattacagtcctttgtattgcatgtccttgttcactggggctggctacccccactgctgttatggtgggcaccggcgtggctgcccagaacggtatcctgattaaaggcggcaagcccctggaaatggcgcacaagatcaagacagtcatgttcgacaaaactggcactattacccatggtgtccccagggttatgcgcgtgctgctattgggggacgtggcgaccctgcctcttagaaaagttctggcagtggttggcaccgctgaggccagtagcgagcatcctctgggagttgcagtgaccaaatattgtaaggaagagctgggcactgaaaccctcggatattgcaccgactttcaggcagtgccgggctgcgggatcggctgtaaagtgagtaatgtggaaggcattctcgctcacagtgagcgccctctcagcgcccccgccagtcatttgaacgaggcaggcagccttccagcagagaaggacgctgttcctcagacatttagcgtgctcattgggaatcgggagtggctgaggaggaacgggctgaccatctctagcgacgtctccgatgctatgaccgatcacgaaatgaaggggcaaacagcgatccttgtcgccatcgacggagtcctatgcggcatgatcgcaatcgcagacgcagtgaagcaggaggccgctcttgcagtgcatacactgcagagcatgggagttgatgtcgtactaatcaccggggataacagaaagaccgcaagggccattgctacacaagtgggtatcaacaaggtgtttgccgaagtactacctagccacaaggttgcgaaggtgcaagaattacagaacaaagggaagaaggtggccatggtgggagatggggtgaacgattcccccgcgctggctcaggcagacatgggagtcgctatcggtaccggcactgatgtggcgattgaggcggctgacgtggtattgatcaggaacgatttattagatgtggtggcttctatccacctgagtaaaagaacagtaagaaggattaggatcaaccttgttctggcactgatctacaatcttgtcggcatccccatcgcggcaggggtttttatgccaatcggcatcgtactacagccgtggatgggaagcgcagcaatggcagccagcagcgtgtctgtggttctgagctctctgcaactcaagtgctataagaaacccgacctggagcgttacgaagctcaagcccatggtcacatgaaaccacttaccgccagccaggtctccgtgcatataggaatggatgaccgctggcgcgactccccgagggcaaccccctgggaccaggtctcttacgtttcccaggtgtctctgagctcattgacatccgataaaccatcgaggcatagcgccgctgctgatgatgatggggacaagtggtcactcctgctgaacggacgggacgaggagcagtacatt

SEQ ID NO: 7448 - DNA, 4395 bp, Artificial Sequence
  Description of Artificial Sequence: Synthetic coding sequence
atgccagaacaagaacgtcaaatcacggcacgcgaaggtgcgtcccgtaagatcctctcgaagttgtcgcttcctactcgggcatgggagcctgcaatgaagaagtccttcgcattcgacaatgtcggttacgagggcggacttgatggcctggggccctcatcgcaagtggccacctcaaccgtcagaatacttgggatgacctgtcaatcttgcgtgaagagcattgaggacagaatttccaatcttaagggaattatctcaatgaaggtttcactggaacaagggtccgcaactgtgaagtacgtcccttcggtggtctgcctgcaacaagtgtgccaccagattggagatatgggattcgaagcatccattgctgaaggaaaggcagcaagctggccatcgaggtcccttccggctcaagaagctgtggtgaagctgcgcgtggaggggatgacttgtcaaagctgcgtctcatccatagaaggcaaagtgcggaagctgcagggtgtcgtccgggtgaaggtgtcactgagcaatcaggaggcagtcatcacttaccagccatatctgatacaaccagaagatcttagggatcatgtgaatgatatgggatttgaagcggcgatcaaatcgaaggtggcacctctctcactgggccccatcgacattgaaagactccaatccaccaatcctaaaagaccactgtcctcggcaaaccagaactttaacaattcagagactcttgggcatcaagggtcgcatgtcgtgacccttcagctgcgaatcgacggcatgcattgtaaaagctgtgtgttgaatattgaggaaaacattggacaacttctcggcgtccagtcgatccaagtctcgctggaaaacaagaccgcacaagtgaagtacgaccctagctgtacgtcccccgtggctttgcaacgtgcaatcgaagcactgccacctgggaactttaaggtttcactcccagatggagcagaaggatccggaaccgatcacagatcgagctcaagccactcccctggatcaccaccgaggaaccaagtccaaggcacctgcagcactactcttatcgccatagcgggaatgacctgtgcaagttgtgtgcattccatcgaggggatgatttcacaactcgagggagtgcagcagatctccgtgtctcttgctgaaggtactgcaaccgtgctttacaaccctagcgttatttcgcccgaagagcttcgggccgcaattgaggacatgggtttcgaagcatcggtcgtgtcggaatcctgttccaccaacccccttggcaatcacagcgccggcaattcaatggtgcaaaccactgatggaactcctacctccgtccaagaagtggcacctcacaccggtagactgcccgcaaaccacgcccctgacattcttgccaaatcgccgcaatcaacccgtgctgtggcaccccaaaaatgttttctgcagataaaaggtatgacttgtgcatcctgtgtgtcaaacatagaaaggaacctccagaaagaggccggagtgctctccgtccttgtggccctgatggcaggtaaggccgagatcaaatatgatcccgaggtgattcaaccgctggaaattgcacaattcatccaggatctcggttttgaggcagccgtcatggaggactacgcagggtcagatggaaatatcgaacttaccatcaccgggatgacgtgcgcatcgtgcgttcataacattgaatcaaaactgacccgcactaacggaatcacctacgcaagcgtggcactcgcaacgagcaaggcactcgtgaagtttgatccagagattattggacccagggatatcatcaagattattgaagagattgggttccatgcctcgctggcccaacgtaaccccaatgcacatcacctggatcataagatggagataaaacaatggaaaaagtcgttcctgtgttcgttggtattcggtattccagtcatggctcttatgatttacatgcttattccttccaacgaaccacatcaatccatggtgcttgatcacaacataattccaggcctgtcgatcctgaatctcatcttctttatcctttgtacctttgtgcagcttcttggaggttggtacttttacgtgcaagcgtacaagagcctcagacaccgcagcgccaacatggatgtgctgattgtcctggcaacttccatcgcttacgtctacagcctggtgatacttgtggtggcggtggcggaaaaggcagagagatcacctgtcacttttttcgacactcctcccatgcttttcgtgttcatcgcacttggaaggtggctcgagcatctggcgaagtccaagacctcggaagcgcttgcgaaacttatgtccctccaagctaccgaagcgacggtggtgaccctcggagaagataacttgatcataagggaagaacaagtgccaatggagctcgtccaaaggggtgatatcgtgaaggtggtcccaggaggtaagtttcctgtcgatggaaaggtgcttgaaggtaacaccatggcggatgaatcactcattaccggagaggccatgccagtgactaagaagccaggttcaactgtgattgcaggcagcattaacgctcatggcagcgtgctgataaaagcaacccatgtgggaaacgacaccactctggcacaaatcgtgaaactggtggaagaggcacagatgagcaaggcacctatccagcagctggcagacaggttttcgggatactttgtccctttcatcattatcatgtcaacgctcactctcgtggtgtggattgtgatcgggtttattgattttggtgtcgtccaacgctattttccgaaccctaataagcacatatctcagaccgaagtgattattcgcttcgcgtttcagacctcaataaccgtgctttgtattgcttgcccatgctcgctcggacttgccactccaactgcagtcatggtggggactggggttgcagctcaaaacggtattttgattaagggcggaaagccccttgaaatggcacacaaaatcaagacggtcatgttcgacaaaaccggtaccattactcatggcgtgccaagagtgatgcgcgtgcttctcctcggggatgtggcaaccctgcctctccggaaggtgctggcagtcgtgggtactgccgaagcatcgtcagaacacccactgggagttgcagttaccaaatactgcaaggaggaactgggtaccgaaactctgggatactgtaccgattttcaagcagtccctggctgcggtattggctgcaaagtctcgaacgtggagggaattctggcacactccgagaggccactcagcgcaccagcatcccatttgaacgaagcgggatcgctgccggcagaaaaggatgccgtgccacagacgttttcggtcctgatcggtaacagagagtggcttcgccgtaatgggctcactatttcgtctgacgtcagcgacgcaatgaccgatcacgagatgaagggacagacggcaatactcgtcgccatcgatggtgtgctgtgtggaatgatcgctattgcagatgcagtgaaacaagaggcagctcttgcagtgcacactttgcaatcaatgggagtggatgtagtcctgataaccggagacaaccgcaaaacggcccgtgcaatcgcaacccaagtgggtattaacaaggtgtttgctgaagtgctgccatcgcataaagtcgcaaaggtgcaagaactgcagaataaaggaaagaaggtggccatggttggtgacggagtgaacgattcgccagccctggcgcaggcagatatgggagtcgcgatcggaaccggtactgatgtggcgatcgaagcggctgatgttgtcctgatccgtaacgatctgttggatgtcgtggcctcaatccatttgagcaaacggactgtcagacggattcgtatcaatcttgtgcttgccctgatttacaatctcgtcggtattcccattgccgcaggtgtgtttatgccaattggaatcgtgctccaaccttggatgggctcggcagcgatggcggcaagcagcgtgtcggtggtgctttcctcccttcaactcaaatgttacaagaagcccgacctggagagatacgaagcacaagcacatggccatatgaagccacttacggcatcacaagtgtccgtgcatataggaatggacgataggtggagagattcccctagagcgactccatgggaccaggtttcatacgtctcccaggtgtcactgtcgtcccttacctcggataagccatcgcgccattcggccgcggcagacgatgatggagataagtggtccttgcttcttaacgggcgagacgaagagcaatacatt

SEQ ID NO: 7449 - DNA, 4395 bp, Artificial Sequence
  Description of Artificial Sequence: Synthetic coding sequence
atgcccgaacaggagcgacagattaccgcaagagaaggggcctcgaggaagatactgtcgaagctgtctctgcccactcgggcttgggaacctgcaatgaagaaaagtttcgcttttgacaatgtggggtacgagggaggactggacggcctgggtccttcctcccaggtggcgacttccactgtgaggattctcggtatgacctgccaatcatgcgtcaagagcatagaagatcgcatctccaatctgaagggcattatctcgatgaaagtctcgcttgaacaggggtccgcgactgtcaagtacgtcccctcagtcgtgtgtctgcaacaagtttgtcaccaaattggtgatatgggatttgaagcaagcattgcagagggtaaggccgccagctggccgtccagatccctcccggcacaggaagccgtggtgaagctgagagttgaaggaatgacttgtcaatcgtgtgtgtccagcatagaaggaaaagtcagaaagttgcaaggggtggttcgggtgaaggtgtccctgtccaatcaagaagcagtgataacctaccagccatacctgattcaaccagaagatttgagagatcatgtgaacgacatgggtttcgaggcagctatcaaatctaaggttgcacctctttcgttggggcctatcgatattgagcggctccagtcgacgaaccctaaaaggcctctctcaagcgcaaatcaaaactttaacaacagcgaaactcttggtcaccagggatcccatgtcgtgactctgcagctcagaattgatgggatgcattgtaaatcgtgtgtccttaacattgaagagaatatcggacaacttcttggtgttcagagcatacaagtctctcttgaaaacaagactgcacaagtgaagtacgatccatcgtgtactagcccagtcgccttgcaaagagccatcgaagcactgccacccggcaatttcaaggtgagcctgcccgatggagcagagggatccggcaccgaccatagatcaagctcctcccattcgcctggaagccctccacgaaaccaggtgcagggcacctgcagcaccaccctgattgccatcgcaggtatgacctgtgcgtcttgcgtgcactcaattgagggaatgattagccaactggagggcgttcaacaaatctccgtgtcacttgccgagggaactgcgactgttttgtacaacccgtccgtcatttccccggaagaactccgggcagccattgaagatatgggcttcgaagcatcagttgtgtcggaatcttgttcgaccaacccactgggaaaccatagcgcaggtaattccatggtgcagacgacggacggcactccgacctcggtgcaggaggtggcacctcacacggggcgcctgcccgcaaatcatgcaccagatattctggcaaagtcacctcagagcactcgggcagtggcaccgcaaaaatgttttctccagatcaaggggatgacgtgcgcatcatgtgtgtcaaacatagaacgcaaccttcagaaggaagccggagtgttgtcggtgctcgtggctcttatggcagggaaggcagagatcaagtacgaccccgaagtgattcaaccactggaaattgcgcagttcatacaagatctgggattcgaggcggcagtgatggaagattacgcagggagcgatggaaacatcgagcttacgattacgggcatgacttgcgcctcatgtgtgcataacattgaatccaagctgactcggaccaacggtataacttatgcctcggtcgcccttgcgacctcgaaggcactcgtcaaattcgatcccgagattattggaccccgcgatatcataaagattatcgaggagattggattccacgcaagcctggcgcagagaaatccaaatgcccatcatctggatcacaaaatggagattaagcagtggaagaagtcgtttctgtgctcgctggtgtttggcattcctgtgatggcacttatgatttacatgctgattccttccaatgagcctcatcaaagcatggttctggatcataacataatccctggcctgtcgatcctgaacctgatctttttcattctttgtacctttgtgcaactgctcggaggttggtacttttacgtgcaagcgtacaagtcacttagacacagatccgcaaacatggatgtgctgattgtgcttgcgactagcatcgcatacgtgtactccttggtcattcttgtggtggctgtcgcagaaaaggcggagagatcacctgtgaccttctttgatactccacccatgctgtttgtgtttatagctcttggacgctggttggaacatcttgcaaagtcgaaaacctcggaagcattggcaaagttgatgtcgcttcaggcaaccgaagcaaccgtggtcactcttggagaagataacttgataattcgcgaagaacaagtgccaatggagctggtgcaacgtggtgacatcgtcaaggtcgtgcctggtgggaagtttccagtggacgggaaagttcttgagggcaataccatggcagacgaatccctgataaccggtgaagcaatgcctgtgaccaaaaagcctggaagcactgtgatcgcaggatctattaacgcccacggttccgtgctcattaaagccacccatgtcggcaacgatacgactcttgcacaaatcgtcaaacttgtcgaagaagcacaaatgagcaaagcaccgattcagcaactggcagatcgtttttcaggttacttcgtgccattcattatcattatgtcaactcttactctggtcgtctggattgtgattggctttattgacttcggagttgtgcaaagatactttcctaaccctaacaagcatatctcgcagaccgaagtcattattcggtttgcttttcaaactagcatcaccgtgctgtgtattgcgtgtccatgttccctgggtctggcaacccctaccgctgtcatggtcggaactggggtggctgcccagaatggtattctcattaaaggaggcaagcctcttgaaatggctcataagatcaaaactgtcatgttcgataagactggaactattactcatggcgtgcctcgagttatgcgcgtcttgcttctgggcgatgtggctactctgccactgcggaaggtcctggcagtggtcggtactgcagaagcatcatccgaacatcccctgggtgtggcagtcaccaagtactgtaaagaagagcttggaaccgaaactctgggctactgcactgatttccaagcagtgccaggctgcggaattggatgcaaggtgagcaacgtcgaagggattctggcccattccgaaaggccacttagcgcacctgcgtcgcatctgaatgaagcaggttcacttcccgccgaaaaggatgcagtgcctcagacgttctcagtactgatcggtaacagggaatggttgcgaagaaacggccttactatctcctcggacgtgtcagatgcaatgaccgaccacgagatgaaaggtcaaaccgcaatacttgtggcgatcgatggtgtgctgtgtggaatgatcgcaatcgcggatgcagtcaaacaagaagccgccctggccgtgcataccctgcagagcatgggagtggatgtggtccttatcacgggggataaccgcaagaccgcaagagcaatagccacccaggtgggcatcaataaagttttcgcagaagtcctgccctcccataaggtggcaaaagtgcaagaactccagaataaggggaagaaagtggcaatggtcggagatggagtgaacgattctccagcccttgcgcaagccgacatgggggtcgcaatcgggaccggaaccgacgtggcaatcgaggcggccgacgtcgttttgatccgcaatgatcttctggatgtggtggcaagtatccatctgtcgaagagaaccgtgagacgcattagaatcaacttggtgctggcactgatctataatctggtgggaattccaatcgcggccggtgtgttcatgcctatcggtatcgtgcttcaaccctggatggggtctgctgcaatggccgcatcatccgtgtcggtggtgctgtcctccctccaactgaaatgttacaaaaagcctgatctggaacgctacgaagcacaggcacacggccatatgaagccattgaccgcgtcccaagtgtcggtgcatattggaatggatgatcgttggcgggacagccctcgtgcgacgccatgggaccaggtgtcctacgtgtcgcaagtgtccttgagctcgctgacttcagataaaccctcgcgccatagcgcagcagcggacgacgatggtgataaatggtcattgctgcttaatgggcgcgatgaagaacagtacatc

SEQ ID NO: 7450 - DNA, 4395 bp, Artificial Sequence
  Description of Artificial Sequence: Synthetic coding sequence
atgcctgagcaagaacgccagatcactgcccgagagggcgcctcccggaagatcctcagtaagttgtcccttccgacccgcgcctgggaaccggcgatgaaaaaatccttcgccttcgataacgtgggttatgaaggcggtctggatggcctcggaccgtcctcacaggtcgcaacctcgactgtccgcatcctggggatgacctgccaaagctgtgtgaaaagcatcgaggaccggatctcgaacctcaaaggaatcatttccatgaaagtgagcttggagcaaggtagcgccaccgtcaaatacgttccatcagtggtgtgcctgcagcaggtgtgtcaccagatcggagacatgggtttcgaagcaagcattgccgaaggaaaggcagcttcgtggccttctcgcagcctgccggcccaagaagcagtggtgaaactgcgcgttgagggaatgacttgccaatcctgtgtgtcctccattgagggtaaggtgcggaagctccagggagtggtgagggtcaaagtgtcgctcagcaaccaggaggccgtgattacctaccaaccgtacctgattcagcctgaggaccttcgggaccacgtgaacgacatgggattcgaggctgcaatcaagtcaaaggtggcaccgctctccctgggaccgatcgacatcgagcgcctgcaatccactaaccctaaacgaccgctgtcatcggccaatcagaatttcaacaattcggaaacgctgggacaccagggaagccatgtggtcactctgcaactccgcatcgacggtatgcactgcaaatcctgcgtgctgaacatcgaagagaatatcggacaactgctgggcgtgcagtccatccaggtgtcccttgagaataagacggcccaagtgaaatacgatccgtcgtgtactagcccagtcgctctccaaagagctatcgaggccttgccacctggaaatttcaaggtgtcgcttccggatggcgccgaaggctcgggaactgaccaccgctcgtcgtcaagccactccccgggatcgccaccgcggaatcaggtccagggaacctgtagcaccaccctgatcgcgatagccggcatgacctgcgctagctgcgtccattccatcgaagggatgatcagccagctggaaggcgtccagcaaatctcagtctccctggcagaaggcacggcgacggtgctctataacccttcagtcatcagcccggaagaactcagggcagccatcgaagatatgggatttgaggcgtcggtcgtctccgagtcgtgctcgactaacccgctcggaaaccactcggcgggcaactcgatggtccagactactgacggtaccccaacgtcagtgcaagaggtggctccgcacaccggtcggcttccggccaaccatgcccccgatatcttggccaaaagcccacagtcgactcgtgcagtcgctcctcagaaatgcttcctccagatcaagggcatgacgtgcgcatcttgtgtgtctaatatcgaacgcaatctgcaaaaggaagcaggcgtgctgagcgtgctggtggctctcatggccggcaaggccgagattaagtacgacccggaagtgatccagcctctggagatcgcacagtttatccaagacctcggattcgaagccgccgtgatggaggattacgccgggtccgacggaaacatcgagctgactatcacggggatgacttgcgcttcgtgtgtgcataacattgaatcgaagctgacccggactaacggaatcacctacgcgagcgtcgcacttgctacttccaaggcgctggtgaagttcgatcccgagatcatcggaccccgggacatcatcaagatcattgaggagatcggcttccacgcgagcctggctcaaagaaaccctaatgctcatcacctggaccacaagatggagatcaagcagtggaagaagtcgttcctgtgctccttggtttttggcatcccggtcatggctctgatgatttacatgctgattccgtcaaatgaaccacaccaatcaatggttctggatcataatatcatcccgggcctctcaatcttgaacctgatcttcttcatcctttgcacctttgtgcaactgctcggcggatggtatttctacgtgcaggcatacaagtccctgaggcatagatccgccaacatggatgtcctcattgtgctcgcaacgtccatcgcgtacgtgtactcgctggtgatcctggtggtggcggtggcggagaaagccgagagatcaccagtgactttcttcgacaccccgccgatgctcttcgtgtttatcgcgctcggacggtggctggaacatctcgccaaaagcaaaacctcggaggcactcgcaaaattgatgagcttgcaggcgaccgaggccaccgtggtgaccctgggggaggacaacctgattatcagagaagaacaagtgccgatggaactggtccagagaggtgacatcgtgaaggtggttccagggggaaagtttccagtggatggaaaggtgctcgagggcaacactatggctgatgaatccctgatcactggcgaagcgatgccggtcactaagaagccggggtcaactgttattgctggatcaatcaatgcgcacggaagcgttctgattaaggcgacccacgtagggaacgacaccaccctcgcccagatcgtgaaactggtggaagaggcgcagatgtcaaaggcccctatccaacaacttgcggaccgatttagtggatacttcgtgccgtttatcatcatcatgtcaaccttgactctcgtggtctggatcgtgatcggatttatcgacttcggcgtcgttcagcggtacttccccaatcctaacaagcacatctcacagaccgaggtgataattcgcttcgcgttccagactagtattactgtgctgtgcattgcctgcccttgttcgctcggactcgccactcccactgctgtcatggtcggcacgggagtggccgcgcagaacggaatcctgatcaagggaggaaaaccacttgaaatggcccacaagatcaaaaccgtgatgttcgacaagaccggaaccatcactcacggagtccccagagtgatgcgggtcctgcttctgggagacgtggcgacgctgccactgcgcaaggttctcgccgtggtcggtaccgccgaagcctcttcagaacaccctctgggagtcgctgtgaccaagtactgcaaggaagaacttgggactgaaaccctggggtactgcactgacttccaggctgtgcccggttgcggcatcgggtgcaaggtgtcaaacgtggaaggaatcctggcacactcggagcgcccgttgtcggcgccagcttcccatcttaacgaggccggctcccttccagccgaaaaggatgcagtcccacagaccttctcggtgctgatcggcaacagagaatggctccggagaaacggactcaccatctcgtcagacgtgtcggacgccatgactgaccacgaaatgaagggtcagaccgctatcctcgtggcgatcgatggggtgctgtgcggcatgatcgcaattgccgatgccgtgaagcaggaagcagcgctggctgtccatactctccagtcgatgggagtggatgtcgtcctgatcaccggagacaatcggaaaaccgcccgcgccatcgccacccaagtcggtattaataaggtattcgcagaagtgctgccatcccataaggtggccaaggtgcaggaactccagaacaagggaaagaaggtcgcgatggtgggggatggagtcaatgactcccccgcgctggctcaggcggatatgggggtcgccatcgggaccgggaccgacgtggccattgaggcggcagatgtggtcctcattcgcaacgatctgttggacgtggtggcatcaatccacctgtcgaagaggactgtgcgcaggattcggatcaacctggtcctcgcactgatctacaacctcgtcggaatccccatcgctgcaggcgtctttatgcctatcggaatcgtcttgcagccgtggatgggttccgcggctatggccgccagcagcgtgagcgttgtgctgtcctccttgcagctgaagtgctacaagaaaccagacctggaacgctacgaagcccaggcgcacggacatatgaaacccttgactgcctcgcaagtctctgtgcatatcggaatggatgaccggtggcgcgactcgccaagagccactccgtgggatcaagtgtcgtacgtgtcacaagtgtcactgtcgagcctgaccagcgataagccgagcaggcattccgccgcggcagacgacgacggagataagtggtccctccttctgaatggaagagacgaggaacagtacatc

SEQ ID NO: 7451 - DNA, 4395 bp, Artificial Sequence
  Description of Artificial Sequence: Synthetic coding sequence
atgcctgaacaggaaagacagatcaccgctagagagggagccagtcgcaagatactaagcaaactctctctccccacccgggcttgggagcctgccatgaagaaaagttttgccttcgacaatgtgggctacgaaggcggcctggatggacttggccctagttcacaggtcgcgacgtccacggttcgcattttagggatgacatgccagagctgcgtgaagagtatcgaagatcgaatcagcaatttaaagggaatcatcagcatgaaggtgagcctggagcagggctccgccactgttaagtatgtgccaagcgtagtgtgtcttcaacaagtctgtcaccaaatcggcgacatgggttttgaggcttcaattgctgaagggaaagccgcatcatggcctagtcgcagcctacccgcccaggaggctgtagtgaagcttcgagtagagggaatgacttgtcagtcctgcgttagttccattgaaggaaaagtccgaaaactgcaaggggtcgtccgagtgaaagtctccctaagtaatcaggaggccgtcatcacataccagccctacttgatccaacccgaggacttgagggaccacgtcaacgatatgggattcgaggccgctatcaaatctaaggtcgcccccctgagcctgggccccattgatatcgagaggctacagagcaccaaccccaaaagacccttatcctcggctaaccagaatttcaataattccgaaacgctcgggcatcagggaagccacgtggtgaccttacagctgcgcatagacggtatgcattgcaagagctgcgtgctgaatattgaagagaacatcggccagctgttgggagtgcagtcaatccaagtgagcctggaaaacaagaccgctcaggttaaatatgatcctagctgcactagccctgtggcactacagagagctattgaagcactgccacccggcaatttcaaagtctctctgccagacggagcagagggctccggaaccgatcacagatctagctccagtcactccccaggaagcccgcctcggaaccaggtccaggggacatgtagcaccacactgatcgcaatcgcagggatgacatgtgctagttgtgtgcattctatcgaaggaatgatatcccaactggaaggggtgcagcagatctctgtgtcccttgcggaaggcactgccacagtcctctacaaccccagcgtcatctcaccggaagagttgagggccgccatcgaagacatgggctttgaggctagcgtcgtgtctgaatcttgcagtaccaatcctctcggcaatcattctgcagggaattctatggtgcagacgaccgacggcacgccaacatctgtgcaagaggtggctccgcacacggggcgactacctgctaatcacgccccagatatactggccaaatccccccagtccaccagggccgtggctccccagaaatgtttcttacagatcaaaggaatgacctgtgcctcatgcgtttctaatattgagagaaatcttcagaaagaggcgggcgttctgagcgtcctggtcgccctgatggcaggaaaggccgagattaagtatgaccctgaagtgatccagccactggaaatcgcccagtttatacaggatctcgggtttgaagctgcggtgatggaagactatgccggctcagacggtaacatcgaactcacgataacaggcatgacctgtgcttcctgcgtgcataatatcgagagcaagttaaccaggacaaatggaattacgtacgctagtgtggcactggcaaccagtaaagcattggttaaatttgatccggaaattatcggacccagggatattataaaaatcattgaagaaatcggattccacgcaagccttgcccagcggaatccaaacgcacatcatctagatcacaaaatggaaatcaagcagtggaaaaaaagcttcctctgttcattagtgttcgggattcccgtgatggcgctcatgatatacatgctgatccccagcaacgaaccacatcagagcatggtgctggaccacaatataatccctggactgtcaatcctgaacctcatattctttatcctgtgcacattcgttcagctgctggggggatggtatttttatgtgcaggcctacaagagtcttcgccataggtctgccaatatggatgtgctcatcgtgcttgcaaccagcatcgcgtacgtgtacagcctggttatcctcgtagtagctgtggccgagaaagctgagagatcaccagtcacgttttttgacaccccacctatgttattcgttttcatagctctcggcagatggctcgagcacttagctaaatctaagactagcgaggctctcgccaaactcatgagtctgcaagccacggaggccacagtagtcactctgggcgaggacaatctgatcatcagagaagagcaagtcccaatggagctggtgcagcgcggcgatatcgtgaaagttgtaccaggagggaagtttccggtggacggaaaggtcctggaaggaaatactatggcggatgaaagccttataacaggagaagccatgccggtgacaaagaagccaggatcaacagtcatagctggttctatcaacgcccatgggtctgtgctgatcaaggccacacacgtcgggaacgatacaaccctggctcagattgtgaaactggtcgaggaggctcagatgtccaaggcccccatccagcagcttgcggataggttctccggttatttcgttccatttattatcattatgagcacccttaccctggtggtatggatcgtcatcggcttcatcgactttggggttgtccagagatactttccgaatcctaataagcatatttcacagactgaagttatcataaggttcgcattccagactagcattactgttttatgtattgcctgtccttgctctctcggactcgccaccccaacagctgtgatggtagggactggcgtcgccgcacagaacggtatactcatcaagggcggtaaaccccttgagatggcacataaaattaaaaccgtgatgtttgacaaaactggcaccataacacatggtgtgcccagagtcatgcgcgttttactcctgggagatgtggccaccctcccgttgagaaaagtgctggctgtagttggcaccgcggaagccagcagtgaacaccctctcggcgtcgccgttacaaagtattgcaaagaggagctcgggacagagaccctgggatactgcaccgacttccaggcagtgccaggttgcgggattggttgcaaggttagcaatgtggaagggatcctggctcattctgaaagacctctgagtgcgccagcttctcacctgaacgaggcagggtccctccccgctgagaaggacgccgttccacagactttttcagtcttgatcggtaacagggaatggctgcggagaaatggactgacaatctcctccgatgtttcagatgcgatgaccgatcacgagatgaaggggcagacagctatcctagtggccatcgatggggtgctctgtgggatgatcgcaatcgcggatgcggtgaaacaggaggccgcactcgctgtacacacactccagtcaatgggagtggatgtggtattgatcacaggggacaatcgaaaaaccgctcgagccatagccacacaagtcggtattaataaggtatttgcggaagtgttaccatcacataaggttgctaaagtgcaagagttgcaaaacaagggtaagaaggtggctatggtaggggacggtgtaaacgacagcccggcactggcccaggccgacatgggtgtggcaattggtacgggaacagacgttgcgattgaagcagctgatgtggtgctgatccgtaatgatcttttggatgtcgtggccagcatacatctgtctaagcggaccgtccgacgaatccgaatcaaccttgtactggcgctcatttacaacctggtaggaatcccaatcgccgcaggtgtgtttatgccgatagggatcgtgctgcagccctggatggggtccgccgcgatggcggcctcttccgtatccgtcgtcctgagctcccttcagctaaagtgctacaagaaacccgatcttgagagatacgaagctcaggcgcacggtcatatgaaacctcttactgcctcacaggttagcgtacatattgggatggacgacagatggcgggactctccaagagccactccctgggaccaggtctcctatgtcagccaagtttcgttatccagcctgacctctgacaaaccctccaggcattcggcagcagccgacgatgacggcgacaagtggagcctgctcctgaacggccgagacgaggagcagtatatt

SEQ ID NO: 7452 - DNA, 4395 bp, Artificial Sequence
  Description of Artificial Sequence: Synthetic coding sequence
atgcctgaacaggagcgacagatcaccgcccgggagggtgcttccagaaagatcctctccaagctctctcttcccacccgcgcctgggagccagccatgaaaaagtccttcgcctttgacaacgtgggatacgaaggcggattagacggtttgggtccttcctctcaggtcgccacatccaccgtccgcatcttgggcatgacatgtcagagctgcgtgaaatctattgaggacagaatctccaacctgaaaggtatcatcagcatgaaagttagcctggagcaaggctcggccacggtcaagtacgtgcccagcgtggtttgtctgcagcaggtctgtcatcagatcggcgacatgggcttcgaggcctccatcgccgaagggaaggcggcatcctggcctagcaggtccttgccagcacaggaggcagttgtcaagctccgcgtcgagggaatgacctgccagtcgtgcgtctcgtctatcgaaggaaaggtgcgtaagctgcaaggcgtggtccgcgtgaaggttagcctgagcaatcaagaggctgtcatcacctaccaaccgtacttgatccagcccgaggacctccgtgatcatgttaatgacatgggcttcgaagccgctattaagtccaaggttgctcccctctcgttgggtccgattgacatcgagcgcctgcaatccacgaaccccaaacgtcccctgagcagtgcaaaccagaacttcaataactctgaaaccttgggccatcagggcagtcacgtggtcacattgcagttacgcatcgacggaatgcattgcaagtcctgcgtcctcaacatcgaggagaacatcggccagttgcttggcgtgcagtctatacaggtttctctagagaacaagactgcccaggtaaagtacgacccttcctgcacaagcccggtagctctgcagcgcgcgatcgaggcccttcccccaggcaacttcaaggtctctctgcctgatggcgcagagggtagcggcaccgaccaccgctccagctcctctcactcgcccggaagtcctccccgtaaccaggtccaggggacgtgcagcacaactcttattgcgattgctggcatgacttgcgcgtcctgcgtgcactcgattgaaggtatgatttcgcagctggagggcgtccagcagatcagcgtctccctcgctgagggcacggccactgtgctgtacaacccgtctgttatctcccccgaagagctgcgtgcggcgatcgaagatatgggtttcgaagcctcggtcgtgtcggagtcctgctccacgaaccccctggggaaccactccgccggaaactccatggtgcagactacggacggaactcctacctccgtgcaggaagtcgcaccacataccggccgtttaccggcaaaccacgctccggacatcctcgctaagtctccccaatccacccgcgcagtcgcccctcaaaagtgcttcttgcagatcaagggcatgacctgtgctagttgcgtttcaaacatagagcgtaaccttcagaaggaggccggtgttctgtcggtgctggttgcgctcatggccggcaaggctgagatcaagtatgacccagaagttatccaacccctagaaatcgcacagtttattcaggatctgggattcgaggccgcagttatggaggactacgctggctctgacggaaacatcgaactcacaattacgggaatgacgtgcgcatcgtgcgttcacaacatcgagtccaagcttacccgcaccaatggcatcacctatgccagcgtcgcgttggccacttctaaggctctcgtcaagtttgaccccgagattatcggcccacgtgatattatcaagatcatcgaagagatcggcttccacgcttcgctcgcgcagaggaaccccaatgctcaccaccttgaccataaaatggagattaaacagtggaaaaagagcttcttgtgctccctggtcttcggtattcccgttatggcgctgatgatctacatgttgattccgtctaacgaacctcatcagtccatggtcctcgatcacaacatcattcccggcctctcgattctcaacttgattttcttcattctctgtaccttcgttcagcttttgggcggctggtatttctacgtccaggcctacaagtccttgcggcaccgttcagcaaacatggacgtcctcattgtcctggcaacctccatcgcttacgtctactctctcgtcatccttgtggttgcggtcgcagagaaggctgagcgctcccccgttacattcttcgataccccccccatgctgttcgtgttcatcgctctcgggcgttggttggagcatctggccaaatccaaaactagcgaagctctagcgaagttgatgagcctgcaggccaccgaggctactgtggttacgctgggagaagataacctgattattcgcgaggaacaggtcccgatggagctcgtccaacgcggagacatcgtcaaggtcgtccccggtggcaaattccctgtggatggcaaagtgttggaaggaaacacaatggccgatgagtccctcatcacgggggaggcgatgcccgttactaagaagcccggctctacagttatcgctggcagtatcaatgcgcacgggtcggtcctgatcaaggccacacatgtcggtaacgacaccaccctcgcccagatcgtaaagctggttgaagaggcccagatgtcaaaggcccccatccaacagttggctgatagattttccggctactttgtcccatttatcattatcatgagtaccctgacactagttgtttggattgtgatcgggttcatcgatttcggagttgttcagcgttattttcccaaccccaacaagcatatctcgcaaaccgaagtgattatccgtttcgctttccagacttcaattacggtcctgtgtatcgcctgtccctgttccctaggcctcgccactcctacagccgtcatggtcggcaccggtgtggccgcccagaacggtatactcatcaagggcggtaagccgctggagatggcccacaagatcaagacggtgatgttcgataagaccgggaccattacccacggtgttccgcgagttatgcgtgtgctgttgctgggtgacgtcgcgaccctccctctccgcaaggtgttagcagtcgtgggtacagccgaagcctcctccgagcatcccctaggcgtcgccgttaccaagtactgtaaggaggaattgggaaccgagactttgggctactgcacagacttccaagctgtaccaggctgtggcatcgggtgcaaggtatcgaacgtcgaaggcatcttggctcatagtgaacggcccctaagcgcccctgcatcgcacctaaacgaggccggcagcctccccgctgagaaggacgccgtccctcagacattttcggttctcatcggaaacagagaatggctccggaggaacggcttgacaatatctagtgacgtctccgacgcgatgaccgatcatgaaatgaagggccagactgcaattctcgttgcgattgatggggtcctttgcggcatgattgccatcgctgacgctgtgaagcaggaggcagctctggcggtccataccctgcagtccatgggcgtcgatgtcgtgttgatcacgggtgataaccgcaagaccgcccgagctattgctactcaggttggtatcaataaggtcttcgccgaggttcttccgtcgcacaaggttgccaaagtccaggagttgcagaacaagggcaagaaggtcgccatggttggcgatggcgtgaacgattctccggcgctagcacaggctgatatgggtgttgccattggtaccggaactgacgtggctattgaggccgctgacgtcgttttgatccgtaacgacctgctagatgtcgtagccagtattcacctgagcaaacgaaccgtccggcgtatccgtatcaacttggtgcttgccctgatctacaacctggtcgggattcccatcgccgcgggagtgtttatgccaataggaatcgtgttgcagccgtggatgggatccgcagcgatggctgcctcatctgtgtccgtggtgctgtccagcctgcagctcaagtgctacaagaagcctgatctcgagagatacgaggcccaggcccacggccatatgaagccccttacggcctcccaggtcagtgtccacattggtatggacgaccgctggagggattctccgcgggcaaccccctgggatcaggtctcgtacgtctctcaggtctccctctcctcgttgacaagtgataagccctcccggcattcggcggccgctgatgacgatggtgacaagtggagtctcctcctcaacggtcgagatgaggagcagtacatt

SEQ ID NO: 7453 - DNA, 4395 bp, Artificial Sequence
  Description of Artificial Sequence: Synthetic coding sequence
atgcccgaacaggagcgtcaaatcacggcgagagagggggcgtccaggaaaatcctgtcaaaactctcccttccaacccgcgcatgggaaccggcgatgaagaagtcatttgcctttgataatgtcggctacgaaggtggcctggacggacttgggccctcatcgcaggtcgcgacgtcaaccgtgaggattctcggtatgacgtgccaatcttgcgtcaagagcattgaggaccggatctcgaacctcaagggaatcattagcatgaaagtttcgcttgaacagggttccgccactgtgaagtacgtgcctagcgttgtgtgcctgcagcaggtgtgtcaccaaattggagatatgggttttgaagcctccatagcggaaggaaaggccgcctcgtggcctagccgatcactcccagcacaagaagctgtggttaagctgagagtggaggggatgacgtgtcaatcgtgtgtcagctcgattgagggcaaagttagaaagctccaaggggtggtgagagtcaaggtgtccctgtctaaccaggaggctgttatcacttatcaaccttacctgatacaaccggaggatctgcgtgatcatgtcaacgacatggggttcgaagcggcaattaagagcaaggtggcaccgttgtctttggggccaattgacatcgaaagactgcagtcaactaaccccaagcgaccactctccagcgcaaatcaaaactttaacaattccgagactcttggccatcaagggtcccacgtggtgacccttcagcttagaattgacggaatgcattgcaaatcgtgtgttctcaacattgaggagaatataggacaactccttggtgtgcagtcgattcaagtgtctctggaaaacaagaccgcgcaagtgaagtatgatccatcctgtacgtccccagtcgcacttcaaagagcgatcgaagcacttcctcccggcaactttaaggtgtccttgcctgatggagccgaagggtccggaactgatcatcgaagctcaagctcgcatagcccgggatcccctcctcgcaatcaggtccagggtacttgttcgactaccctgatcgcaatcgccggtatgacctgtgcgtcctgtgtgcactcgatcgaaggaatgattagccagctggaaggcgtgcagcagatttcagtgtcccttgccgaaggtactgcgactgtcttgtacaacccatcggtgatttcgcccgaggagcttagagcagcgatcgaagatatgggcttcgaagcgagcgtggtgtcggaaagctgctcaaccaatcctctgggaaaccactcggccggaaattcaatggtgcaaaccactgatggaactcctacctcagtccaagaagtggcaccgcacaccggacggctgcccgcaaaccacgcccctgatattcttgcgaaatcgccacaatcgactagagctgtcgccccacagaagtgctttctgcagataaaaggcatgacctgcgctagctgcgtgtccaacattgaaaggaacttgcaaaaagaagcgggggtgctgtcagtccttgtggcgctgatggcgggaaaagccgaaatcaagtacgatcctgaggttattcaaccccttgaaatcgcccagttcatacaggatctgggatttgaggcagcagtgatggaggattacgccggatcggacggaaacatcgagcttaccatcaccgggatgacttgcgcaagctgtgtgcacaatatcgaatctaaactcactcggaccaatgggataacgtatgcatccgtcgcactcgcaacctccaaagcattggtgaagtttgatcctgagataattggacccagagatatcattaagattattgaagagataggatttcatgcatcgctcgcacagcgtaatcccaacgcccatcaccttgatcataagatggaaatcaaacaatggaaaaagtcgtttctgtgttcgcttgtctttggcattccggtcatggctctcatgatttacatgctcataccttccaacgaaccgcaccaatcgatggtcctggaccataacattatccctggactgtcgattcttaacttgatcttcttcatcctttgcacttttgtgcaactgctcggtggatggtacttctacgtgcaagcatacaagtccctgcgccaccggagcgcaaatatggacgtcctcattgtgctcgccacctccattgcatacgtctactccctggtgattctggttgtcgctgtggctgaaaaagcagagcgcagcccagtgactttcttcgataccccacctatgctgtttgtgttcatagcccttgggaggtggcttgaacatctggcaaagagcaagaccagcgaagcacttgccaagttgatgtcacttcaggcaaccgaggcaactgtggttactcttggagaggacaaccttatcattagagaggaacaagtgccaatggaacttgtgcagcgcggtgacattgtcaaggtggtccctggtgggaagtttcctgttgatggcaaggttctggagggaaatactatggctgatgaatcactgattaccggcgaagctatgcctgtcactaagaaaccaggttccaccgtgattgcaggttcaatcaacgctcatggaagcgtgctcattaaagcaacccacgtcgggaacgacactacccttgcacaaatagtgaaacttgtggaggaggctcaaatgtcaaaagcacccattcaacagctcgccgatcggttttcgggttactttgtgcccttcatcataatcatgtctacgctgactctggtggtgtggattgtgatcggctttatagatttcggagtggtgcagagatacttccctaatcctaataagcacatctcgcagaccgaggtcattatcaggtttgcattccaaacctcgattactgtgctttgcatagcgtgtccgtgtagcctcggactcgcaacgccgactgcggtcatggtgggtacgggcgtcgcagcccaaaacggaattctgattaagggtgggaagccactcgaaatggcacataagataaagactgtgatgtttgacaagactggaacgattacgcatggggtgcctagggtcatgagggtcctgctcttgggagacgtcgccactctgccacttcggaaagtgctggccgtggtcggaaccgcggaagcatcgagcgaacatccattgggtgtggctgtgaccaaatactgtaaagaagaactcgggactgaaactcttggatactgtaccgattttcaagccgtcccaggctgtgggatcggttgtaaggtgtccaatgtggaaggtatcctcgcacattcggagcggcccctttcggcacccgcatcacaccttaacgaagccgggagcttgcctgctgaaaaggacgcagtgccacagactttttcggtcttgataggtaaccgagaatggcttcgccgtaatggtctgaccattagctccgatgtgtcggatgcaatgaccgaccatgagatgaagggccaaaccgccattctcgttgcgattgacggagtgctgtgtggcatgattgcgattgcagacgcagtcaaacaggaggcagcgcttgccgtccatactctgcaatctatgggagtggatgtggtgcttatcaccggagacaacagaaagactgcacgagcaatcgcaactcaggtggggatcaataaggtctttgcagaggtgctgccatcacacaaggtggctaaggtgcaggagcttcaaaacaagggtaagaaggtggcaatggtgggtgatggagtgaatgacagcccggcactggcccaagcggatatgggggtggcgattgggacgggtaccgatgtcgctattgaagctgcggatgtcgtgctgatcagaaatgatcttcttgatgtcgtggcatcgatccacctgagcaagcgaactgtgaggagaattcgcattaaccttgtccttgcactgatctacaacctggtcggcatcccaatcgctgccggcgtgtttatgcctattggcatcgttcttcagccctggatgggatcggcagcaatggctgcatcatccgtctcggtggttttgtcaagcctgcaactcaaatgttacaagaaaccggatctggaacgttacgaagcgcaggcccacggtcacatgaagcctcttactgcgtcacaggtttccgtgcatatcggtatggatgaccggtggagggacagcccacgggcgactccgtgggaccaggtgagctacgtgtcgcaggtgtccctctcgtcactgacgtccgataagcctagccgccattcagcggcagcagatgatgacggagataaatggagcctgctgcttaacggaagagacgaagaacaatacatt

SEQ ID NO: 7454 - DNA, 4395 bp, Artificial Sequence
  Description of Artificial Sequence: Synthetic coding sequence
atgccagagcaagagcggcagatcactgcccgcgaaggggccagccgcaagatcctgagcaagctctcgttgcctacccgggcctgggaaccagctatgaagaaatcgttcgcgtttgacaatgtgggatatgagggaggccttgacggcttgggcccatcgtcccaagtggccacgtcgactgtgagaatcctgggaatgacctgccagagctgtgtgaaatcgatcgaagatcggatttcaaacctcaagggaatcatctccatgaaagtctcgctcgaacaaggatcagccacggtgaagtacgttccgtcggtggtgtgtctgcagcaagtttgccatcagatcggcgacatgggatttgaggcaagcatcgcggaaggaaaggccgcttcgtggccatccaggtcgctgccggcgcaagaagcggtggtcaagctgcgcgtcgaaggcatgacctgtcagtcatgcgtcagctcaatcgagggaaaggtgcggaagctgcaaggagtggttcgcgtgaaggtgtcgctgagcaatcaagaggccgttattacttaccaaccttacctgatccagccagaggacctccgcgatcacgtgaacgatatgggatttgaagccgcgatcaaatccaaggtggccccgctttccctcggcccgatcgacatcgagaggcttcagagcacgaacccgaaacggccgttgtcgtcagcgaaccagaacttcaacaattcggagactctgggccatcagggatcccatgtcgttaccttgcaactcaggattgacggaatgcattgtaaatcctgcgttctgaacatcgaggagaacatcggccagctcctcggggtgcagagcatccaagtctccctggaaaacaagactgctcaggtcaagtacgaccccagctgcactagccctgtggcgctccagcgcgccatcgaagcgttgcctcctggaaatttcaaggtgtccctgccggatggagcggaaggaagcggaactgatcatcggagttcgagcagccattcgccaggctccccgccaagaaaccaggtgcaggggacttgctcaaccaccctgatcgcgatcgcagggatgacttgcgcgagctgtgtgcatagcatcgaaggaatgatctcgcaactggaaggtgtgcagcaaatttcggtgtcgctggcggagggcaccgcgactgtactgtacaacccaagcgtaatcagcccggaggaactgcgcgcggccatcgaagatatgggcttcgaagctagcgtggtgtcggaatcgtgctccaccaatccgctgggaaaccacagcgccggcaactccatggtccagaccaccgatgggactccaaccagcgtgcaggaagtggccccgcacaccggccgcctgccagccaatcacgctccggatattcttgccaagtcgccgcagtcgacccgggcagtggcgcctcaaaagtgcttcctgcagattaaggggatgacctgcgcatcctgcgtgagcaatatcgaacggaacctgcagaaagaggccggcgtgctgtcagtgctcgtggcgctgatggcaggcaaggcagaaatcaagtacgatcccgaagtgattcagccgctggaaatcgcgcagttcatccaggatctggggtttgaagctgctgtgatggaagattacgccgggtccgatggaaatatcgaactgactatcactggaatgacgtgcgcctcatgcgtgcacaacatcgaatccaagctgactagaaccaatggaatcacctacgcctcggtcgcccttgccacttccaaggctctggtcaagttcgatccagaaatcatcggaccaagggacattatcaagatcatcgaagagatcggattccatgctagcctggcgcaacggaacccgaacgcccaccacctggaccacaaaatggaaatcaaacaatggaagaagtccttcctgtgtagcctggtctttggtatcccggtgatggccctgatgatttacatgctcatcccttcgaacgagccgcatcaaagcatggtcctcgaccataacatcatccctggccttagcatcctgaatctgatcttcttcatcttgtgcaccttcgtacagcttctcgggggctggtacttctacgtgcaggcgtacaaatccctcagacaccggtccgcgaacatggacgtgctgatcgtgctcgcgacctcaatcgcttacgtttattcattggtcatcctggtcgtcgcggttgccgaaaaagccgagagatcaccagtgacgttctttgatacccctcccatgctcttcgtgttcatcgcactgggacgctggctggaacatcttgccaagagcaagacttccgaggcactggccaagctgatgtccctgcaggcaacggaagcgactgtcgtgactctcggggaagataatctgatcatccgcgaggaacaggtccctatggagttggtgcagcggggagacatcgttaaggttgtgcccggagggaagttcccagtggatggcaaggtcttggagggaaacactatggcagacgagtccctgattactggagaggcgatgccagtgactaagaagccaggctcaacggtgatcgccgggagcatcaatgcacacggcagcgtgctgattaaggccacccacgtgggaaacgatacgactctggcgcagatcgtcaagctggtcgaagaggcccagatgagcaaggcgccgattcagcagctcgctgaccgattttcaggatactttgtgcctttcatcatcataatgtctaccctgaccctcgtcgtgtggattgtgatcggattcatcgattttggagtggtccagagatacttccccaatcctaataagcatatcagccagactgaggtcatcatccggttcgctttccaaacttccatcacggtgctttgcatcgcgtgcccgtgctcactgggattggcgacccccactgccgtgatggtgggaaccggagttgccgcgcagaacggcatcctgatcaaagggggaaagcctctggaaatggctcacaagattaagactgtcatgttcgataaaactgggaccattactcatggtgtcccacgcgtcatgcgagtgcttctccttggagacgtcgctactctgcccctgcgcaaggtgctggcagttgtgggcaccgcggaggcctcgtctgaacacccgctcggagtggcagtcactaagtactgcaaggaggagcttggtactgaaaccctgggatactgcaccgatttccaggctgtgcccggctgtggaattggttgtaaagtctccaacgttgaagggattctggcacactcggagcggcctctcagcgctccagcatcacacctgaatgaagcaggatcactgccggctgagaaggacgccgtgccgcaaactttctccgtcctgatcggcaaccgagagtggctgcggcggaacgggttgaccatctcatccgatgtctcagatgccatgactgaccatgaaatgaaggggcagaccgccattttggtggccattgatggcgtcctttgcggcatgatcgctattgccgacgcggtcaagcaggaggctgctctggctgtgcacacgcttcagtccatgggagtggatgtggtgttgatcaccggagacaaccgcaagaccgccagagccatcgcgacccaggtgggaatcaacaaagtgttcgcggaagtcctgccgtcacataaggtggcgaaggtgcaggaattgcaaaacaagggtaagaaggtcgccatggtcggagatggagtcaatgacagccccgccctggcacaagctgacatgggcgtggccatcgggactggaactgacgtggcgattgaggccgccgatgtcgtgctgatccggaacgatctcctggacgtggtggcgtcgatccacttgtcgaagcgcactgtgcgccgcatccggatcaatttggtgcttgctctgatctacaatcttgtgggcatccctatcgccgcgggagtgttcatgccaatcggaatcgtcctccagccatggatgggatcggccgctatggctgcatccagcgtctcagttgtgcttagcagcctgcaactgaaatgctacaagaaaccggacctggagcgctacgaagcccaggcccatggacatatgaagccgttgactgcaagccaggtgtcggtgcacataggtatggacgatcgttggcgcgactcaccgcgggccaccccctgggatcaggtgtcgtacgtgtcgcaggtgtcgctgtcatccctcacttccgacaagccttcacggcattcagcagcggccgatgatgatggtgacaagtggtcgctgctcctgaacggacgggacgaggagcaatacatc

SEQ ID NO: 7455 - DNA, 4395 bp, Artificial Sequence
  Description of Artificial Sequence: Synthetic coding sequence
atgccagagcaagaacgccaaatcactgcgcgggaaggcgcctcgcggaaaatcctgtccaagctctcgctgccgacgcgcgcttgggagccggccatgaagaagtccttcgctttcgacaacgtgggctatgaagggggactggacggactgggcccgtcaagccaggtcgccacctcgactgtgcgaatccttggaatgacctgtcaaagctgcgtgaagtcgatcgaggatcgcatctccaacctcaagggaattatcagcatgaaagtgtcgcttgaacagggttccgccacggtcaaatacgtgccgagcgtcgtttgcctccagcaagtgtgccaccagattggtgacatgggctttgaggccagcatcgcggagggcaaggctgcctcctggccatcgcggtcactccctgcgcaggaagcggtggtcaaactgcgcgtcgagggcatgacctgtcagtcatgcgtgtcgtcgatcgaaggaaaggtccgcaaacttcagggggtggtgcgtgtgaaagtctcgctgagcaaccaagaggcggtgattacgtatcaaccttacctgatccagccggaagatttgcgcgaccacgtgaacgatatgggattcgaagcggccattaagtccaaggtggccccgctgtcgctcggaccaatcgacatcgagcgactgcagtcaaccaatcctaagcgccctcttagctctgccaatcagaatttcaacaatagtgaaaccctggggcaccaaggttcccatgtcgtcaccctccagcttcggatcgacggaatgcactgcaagtcgtgcgtgctgaacatcgaggagaatataggtcaacttctgggggtccagagtatccaggtgtccctggagaacaagaccgcccaggtgaagtacgacccgtcctgcacctcaccggttgccctgcagcgcgcaatcgaggcccttccaccgggaaatttcaaggttagcctgccggacggggcagaagggtccggtaccgatcaccggtcgagtagctcgcactccccgggctcgccgcctaggaaccaggtccaaggcacttgctctactacgctgatcgctattgcaggaatgacgtgcgccagctgtgtccactccatcgaaggcatgatcagccagctggaaggggtccaacagatctcagtatccctggcagaagggaccgccactgtgctctacaacccatcagtgatcagcccagaggaactgcgcgctgctatagaggacatgggtttcgaggcctcagtggtgtcggagtcatgcagcaccaatcctctcggtaaccactcagccggaaattccatggtgcaaactacggatggaactccgacctcagtgcaggaagttgccccacacactggacgcctgccagcaaaccacgccccagatatcctcgcaaagtctccgcagagcacccgggctgtggcaccacagaagtgtttccttcagatcaaaggcatgacctgcgcatcatgcgtgagcaacatcgaaaggaacctccagaaagaagcaggcgtgctgtccgtgctcgtcgcgctcatggccggaaaagccgagatcaagtacgatccggaggtgatccaaccactggagattgcccaattcatccaggatctcggtttcgaagctgccgtcatggaggactacgcaggtagtgacggcaacatcgaactgacgatcactggcatgacgtgcgcttcatgtgtgcacaatatcgaatccaagctgaccagaactaacgggatcacttacgcatccgtggctttggccacgagcaaggccctggtgaagttcgaccccgagatcatcggaccacgggacattatcaagatcatcgaagagattggcttccatgcaagcctggcgcagagaaatccgaacgcacaccatctggaccacaagatggagatcaaacaatggaagaaatcgtttctctgctcccttgtgtttggaatcccggtgatggcactcatgatctatatgctcataccgagtaatgaaccccaccaatcaatggtgctcgatcacaacatcatcccgggcctgtcgatcctcaatctgatcttcttcatcctttgcactttcgtgcaactgctgggtggttggtacttttacgtgcaggcctacaagtccctgcggcataggagcgccaacatggatgtgttgatcgtgctcgctacctccatcgcttatgtctactcgctggtgatcctcgtcgtggccgtcgcggagaaagctgaacgatccccagtcacttttttcgacactccacccatgctttttgtgtttatcgcactcggacgctggctggaacacctggcgaagtccaagacctcagaggccctcgctaagctcatgtccctgcaggcaactgaggcgactgtggtaactctgggagaggacaacctgatcatccgcgaagagcaagtccccatggagctggtgcagagaggggacattgtgaaggtggtcccgggaggaaagtttcctgtggatggaaaagtgctggagggcaacaccatggctgacgagtcgcttatcaccggagaggccatgccggtgactaagaaacctggttcgaccgttattgcgggatccatcaacgcccacgggtccgtcctcattaaggcgactcatgtaggaaatgatacgaccttggcacaaatcgtcaagctggtggaagaggcgcaaatgtcgaaggcgcccattcagcagttggcagaccggttttcgggctacttcgtcccgttcatcatcatcatgtccaccctcactcttgtggtgtggattgtcatcggattcatcgacttcggagtcgtacaaaggtacttcccaaacccaaacaagcatatctcacaaaccgaagtgattattcggttcgcattccaaacttctattacggttctgtgtatcgcttgcccctgttcgctgggactcgccactcctaccgctgtcatggtggggactggagtggctgctcaaaatggaatcctgatcaagggaggaaagccgttggaaatggctcataagatcaagactgtcatgttcgataaaaccggaaccattacccacggagtgcctcgggtcatgcgggtcctgctgttgggcgatgtggccactcttccgcttaggaaggtccttgccgtggtggggaccgctgaagcctcatcggagcacccccttggagtggcagtcaccaaatactgcaaagaagagctgggaaccgagactctgggatactgcaccgactttcaggccgtgcctggctgcggcattggatgtaaggtgagcaacgtcgaaggaatcctcgctcattcagaacgccctctctctgcgcccgcctcgcatttgaacgaagccggatcgctgccggccgaaaaggatgctgtgccacagaccttcagcgtgctgatcggcaaccgcgaatggctgcggagaaatggcctgactattagctccgatgtttcagatgctatgaccgaccacgagatgaagggccaaactgcgatactggtggctatcgacggtgtgctgtgcggaatgattgccatcgcggacgcggtgaagcaggaagcggcgctcgccgtccacaccctgcagtccatgggtgtggatgttgtcctgatcactggcgataataggaaaaccgcccgagccattgcaactcaggtcggaatcaataaggtgttcgctgaagtgctgccgtcacataaagtggccaaggtgcaggaattgcagaacaagggtaagaaggtggcaatggttggagacggggtgaacgactctcccgcgctcgcacaggcggacatgggagttgccatcgggaccggaactgacgttgccattgaagcggctgatgtggtgttgatcagaaatgaccttctggacgtggtggcaagtatccatctgtccaaacgtactgtgcgccgcatccggatcaacctggtcctcgccctgatctacaatctcgtgggaatcccaatcgcggcgggggtgttcatgccgatcgggatcgtgctgcagccatggatgggctcagcggccatggcggcgagctccgttagcgttgtgctttcgtcgctccagctgaagtgctacaagaagcccgatttggaaagatacgaagcccaggcccatggacatatgaaacctctgaccgctagccaagtctcagtccatatcggaatggatgaccggtggcgcgactcccctagagccaccccgtgggaccaggtgtcctacgtgtcgcaagtctccttgtcatcccttacctcggacaaaccgtcgcgtcacagtgctgccgctgacgatgatggagataaatggagcttgctgctcaacggacgcgacgaagaacagtacatc

SEQ ID NO: 7456 - DNA, 4395 bp, Artificial Sequence
  Description of Artificial Sequence: Synthetic coding sequence
atgcctgagcaggaacgtcagatcaccgccagggagggcgcttcacgcaaaatactgtctaaactgagcctccccactagggcttgggaaccagccatgaagaagagtttcgcatttgacaacgtcggttacgagggggggctggatggactaggacccagttctcaggtagccacaagcactgtacgaattttaggcatgacatgccaaagttgtgtgaaaagtattgaagacagaatcagtaacttgaaagggattattagcatgaaagttagtctcgaacaaggatcagccaccgtcaaatacgtgcctagtgtggtatgcctacagcaggtatgtcaccagatcggtgatatgggctttgaggcaagtatagctgagggtaaagccgcttcatggccctcaaggtcattgcctgctcaggaagctgtggtgaagttacgcgtcgagggaatgacttgccagagctgtgtcagttccatcgaaggaaaagtccggaaactccagggagtggtgcgcgtgaaggtgtccttatctaatcaagaagcagtcatcacctaccagccctatctgatccaaccagaggatctgcgtgatcatgtgaacgacatgggcttcgaggcagccatcaagtcaaaggtggccccactcagtcttggccctatagatatcgagcgactccagagtaccaacccaaagaggcccctgtcctccgcaaaccaaaactttaataactcagagacgttgggccaccaggggagccacgtcgtcacgttgcagcttaggatcgatgggatgcactgtaagtcgtgcgtgctgaatattgaagagaacattggacagcttctaggggttcagagcatccaagtgagtctggaaaacaaaacagcacaggtgaagtatgatccttcctgtacatcccccgtggcgctgcagagggctatagaggcccttcccccgggcaatttcaaggtcagcctgccagatggagccgaaggatctggaaccgatcacagaagttctagtagtcactctcccggatccccaccccgcaaccaggtccaaggaacttgctccaccactctgattgctattgctggtatgacctgcgcctcttgtgtgcacagcatcgagggtatgatttcacagctggaaggagtccagcagatatcagtgtccctggccgaagggaccgctaccgtattgtacaaccccagcgttatttcccctgaggagctccgagccgctattgaggatatgggcttcgaggctagcgtcgtgtcggagtcctgcagcacaaaccccttaggaaatcatagtgccggcaattctatggtgcaaacaaccgatggaacaccaacctccgtgcaagaagtcgcacctcacaccggccgcctccccgcaaaccacgctcctgatatcctggctaagtcgcctcagtctacacgtgcagtcgcaccacagaaatgctttctgcagatcaaggggatgacatgtgcgtcttgcgtcagcaacatcgagcgtaacctgcagaaagaggccggagtactcagtgtgttggtcgcactcatggcaggaaaggctgagatcaagtatgaccctgaggttattcaaccgttggaaatagctcagtttatccaggatttgggtttcgaagccgctgtaatggaggactatgctggaagtgacggtaacattgaactgacaatcacagggatgacctgtgcaagctgcgttcacaatatcgaaagcaaattgactcggaccaacggtataacctatgcttccgtcgctcttgccactagtaaagcactagttaagtttgaccctgagataatcggtccccgcgacatcataaagataatcgaggaaattggttttcacgcatctctggcccagagaaaccctaatgcccatcatttagaccataagatggagataaagcagtggaagaaatcgtttctatgctcactggtgttcggcatccctgtgatggccctgatgatttacatgctcatcccctctaacgagccacatcagtcaatggttctggatcacaatatcataccggggctgtctattctgaacttaatcttcttcattctgtgtacgtttgttcagctcctgggcggctggtacttttacgtgcaagcttacaaatctctcaggcaccgcagtgccaacatggacgtgctgatcgtgctggccaccagtatagcttacgtgtacagtttggtgattctggtagtggcagtggctgagaaggcggaaaggagtcctgtaaccttctttgatacacctcccatgttgttcgtctttatagctctgggccggtggttagaacacctggctaaaagcaagacctctgaggccctggcaaagctcatgagtctccaggctacagaagctaccgtcgttaccctcggagaggacaatctgatcatacgtgaagagcaagtgcccatggaactggtgcagaggggtgacatcgtgaaggtggtccctggcgggaagttcccggtggatggtaaggtcttagagggcaacacgatggcagatgagagcttgatcaccggggaggcgatgcctgtgactaagaaacctgggtccacggtgattgcaggtagcattaacgcccacggcagcgtcctgattaaggcaactcacgtaggcaacgataccacgctggcgcagatagtcaaactcgtggaggaggcccagatgagtaaagctcccatccagcagctggctgatcgcttctctggctacttcgtccctttcataatcatcatgtcaactctcaccctggtcgtgtggattgtcattggtttcattgactttggcgtcgtgcagagatatttccccaaccccaataaacatataagtcaaacagaggtgatcatacgtttcgcctttcagacaagcatcaccgtactatgcatcgcttgtccatgcagcctcggtctggcaacaccaaccgcagtgatggtcgggacaggagtggcagcccagaacggcattcttatcaagggcggtaaaccactcgaaatggcccacaaaattaagactgtgatgttcgacaaaacaggtaccattacacacggagtcccaagagttatgcgcgtgctgctgttaggcgatgtcgccacattgcctttacggaaagtacttgccgtggtgggcaccgcggaggctagtagtgagcatcctctaggagtggccgtgacgaaatactgtaaggaggaactcgggactgaaaccctgggttattgcacagacttccaggctgtgccggggtgcggcattggctgcaaggtgagtaacgtggagggaatactagctcactctgagagacctctcagtgctccagcctcacatcttaatgaggcgggcagcctgccagccgagaaggatgctgtgccacagacattcagtgtactcattggcaatcgggaatggctgagaaggaatggtttgactatctcctctgacgtgagtgatgcaatgaccgatcatgagatgaagggccagaccgctattctggtggcaatcgatggagtactgtgcggcatgatagcaatagctgatgccgtgaagcaggaagcggcactggccgttcataccctgcagagcatgggagtggacgtcgtgcttattaccggtgataataggaagacagctcgtgccatagccactcaagtaggcatcaataaagtgtttgcggaggttctcccctcccacaaggttgcgaaggttcaggaactgcaaaataagggaaagaaggtggccatggtcggagatggagtcaacgactcgccagccctggcccaggcagatatgggcgtagctatcggaaccgggactgatgtcgccattgaggccgccgacgtggtcctaatacggaatgacctgcttgatgtggtggcgtcaatccacctatcaaagcgcaccgtgcgcagaattcgaattaatttggtgttagcgctcatttacaacttagttggcatacccatagctgctggggtgttcatgcctatcggaatcgtgctgcagccatggatgggatctgcagccatggctgcctcgtctgtatctgtcgttctgtcaagcctccagctgaagtgttataagaagcctgacctagaaaggtacgaggctcaggctcatgggcacatgaagccgcttacagcctctcaggtctccgtccatattggaatggatgacagatggcgagacagtccccgagccaccccctgggatcaggtatcatacgtctcacaggtcagcctctcctctcttacctccgataagccgtctagacattcggccgcggccgacgatgatggagataagtggagcctgctactcaatggaagggatgaggagcaatatatc

SEQ ID NO: 7457 - DNA, 4395 bp, Artificial Sequence
  Description of Artificial Sequence: Synthetic coding sequence
atgccggagcaggaacggcaaattactgcccgcgagggcgcctcgaggaagatactgtccaaattgtccctacccacgagggcatgggaaccggccatgaaaaagagcttcgcatttgataatgtggggtacgagggagggttagatgggctcggaccctcttcccaggtagctacgagcaccgttaggatcctgggcatgacctgtcaatcctgtgtgaagagtattgaagacaggatcagtaatctgaaggggatcattagcatgaaagtgtctttggaacagggctccgcaaccgtgaagtacgtcccctcggtggtatgcctgcagcaggtgtgtcaccagattggtgacatggggttcgaagcctcaatcgctgaaggaaaggcagcatcatggccgtctaggtcccttccggcccaggaagccgttgtgaaactgcgggtcgagggtatgacttgtcagagctgcgtctcttccattgaaggtaaagtcagaaaattacagggcgtggtgcgcgtgaaagtatcgctctccaaccaggaggccgtcatcacctaccaaccatacctgatccagccagaggatctgcgggaccatgtgaatgacatgggtttcgaggccgccatcaaatctaaggtcgcccccttaagtctcggccctattgacattgaaagacttcagtctaccaacccgaagcgcccgctgagcagcgccaaccagaacttcaataactcagaaacactagggcatcagggctcacatgtcgtgaccttgcagctaaggattgatgggatgcattgcaaatcgtgtgtgcttaacattgaggagaacattgggcaactcttgggtgtgcagagcatacaagtgtcccttgaaaacaaaacagcccaggtgaaatacgatccaagctgcacaagtccggttgctcttcaacgggccattgaagctcttcctcctggtaactttaaagtgtcactgcctgatggcgccgaggggtctggcacagatcataggagtagtagctcacacagcccggggtctccgcctcggaaccaagtacaaggcacctgctccactaccctcatcgcaattgctggcatgacctgcgcttcatgcgtgcactctatagagggaatgatatcacagttggaaggcgtgcagcagatcagcgtatcactggcagaaggtactgcaactgtgttgtataatccctcagtgatctccccagaagagctccgggctgccatcgaagacatgggctttgaggcctcagtggtttctgaaagctgtagtactaacccactgggtaaccacagcgccggaaactcaatggtgcaaacgaccgacgggacgccaacctctgtgcaggaagtagcacctcatacggggcgcctcccggcgaaccacgctcccgacatcttagctaaatcaccccagtccacacgtgctgtagcaccccagaaatgtttccttcaaatcaagggtatgacctgtgccagctgtgtttctaacattgagagaaatctgcagaaggaggcgggtgtgctgtctgtcctagtggcgctcatggctggcaaggctgagataaaatatgaccccgaagtgatccagccgctcgagatcgctcagttcattcaggatctggggtttgaagctgccgtaatggaagattatgcaggcagcgacggcaatatcgaattgacaataaccggaatgacctgcgcaagctgcgtacataacattgaatccaaactgacccgaaccaatggcatcacatacgccagtgttgcgctggctacgtcaaaggcgttggttaagtttgatccagagataattggcccgagggacattattaagattatcgaggagattggatttcatgccagcctcgctcagagaaacccaaacgcacatcatctggatcacaaaatggagatcaagcagtggaaaaaaagtttcctctgttctctcgtgttcggaataccggtgatggctttaatgatctatatgttgatccctagcaatgaaccacatcaatccatggtgctggaccacaacatcatccccgggctcagcatcctaaacctcatattttttattttatgcacctttgtgcagctcctgggcggctggtatttttatgtgcaggcttataaatcacttaggcacaggtccgcaaatatggacgtcctcatcgtcctggcgacttccatcgcctatgtatacagcttagttatcctggttgttgctgtggctgagaaggctgagaggagcccggtgaccttcttcgacacaccaccaatgttgttcgtctttatcgctttaggccgctggctggagcatttagctaagtcaaagacctccgaggcccttgcgaaactcatgtccctccaggccacagaagccacggtggtgaccctgggggaggacaacttgatcatccgcgaggagcaggtgcccatggagctggtccagcggggcgacatagttaaagtggtgccaggaggtaaattccccgtggatgggaaagtgttagaagggaacactatggccgatgagagcttgatcactggtgaagccatgcctgtgacgaaaaaacccggcagcactgttatcgcggggagtataaatgcccacggtagcgttttaattaaagctacgcacgttggaaacgatactaccctggcccaaattgtgaaactcgtggaggaagctcaaatgagcaaagccccaatccaacaactggccgatcgattctcagggtacttcgtgccctttataataattatgtcgaccctgaccctggttgtttggatagttatcggttttattgatttcggcgtggttcagcgctacttccctaatcccaataagcatatctcacagaccgaggttatcatccgctttgcctttcagacatcaattactgttctgtgcattgcctgtccttgttctctgggccttgccactcccacagccgtaatggtcggaactggagtcgcagctcaaaatggaattttgataaagggcggtaaacctttagaaatggctcataagatcaagaccgtaatgtttgataagacaggcaccataactcatggagtccctcgcgtcatgcgggtgctgcttctgggcgacgtggcaaccttacccttgaggaaggtcctggccgtcgtcggcactgccgaggcctcatctgaacatcccttgggtgttgccgtcactaagtactgcaaagaggaacttggcaccgagaccctgggctactgtacagacttccaggccgtccctggctgtggtattggctgcaaagtctcaaatgtggaaggaatcctggcgcactctgaacgcccactctcagcgccagcgagccacctgaacgaagccggcagcctgcctgcagaaaaggacgcggtgccacagactttctccgttctcattggtaatcgagagtggctgcgcagaaacggtctgaccatatcgtctgacgtaagcgacgccatgaccgatcacgaaatgaaaggccaaactgcgattctggtcgcaattgatggagtattatgcggaatgatcgctattgctgatgcagtgaagcaggaggccgcgctggcagttcacacgttacagagcatgggcgtcgatgtggtcctgattaccggcgacaaccgtaagaccgctagagcgatagccactcaagttggcattaacaaggtttttgctgaggtgctgccctcgcacaaggtcgccaaggtacaggaactgcaaaacaagggcaaaaaagtcgccatggtgggggacggcgtgaacgacagccctgcactggcccaggctgacatgggagtggccattgggaccgggactgacgtcgctatcgaggccgccgatgtggtgctcatacgaaatgatcttcttgatgttgtggcctctatccatttaagcaaaagaaccgtgcgaaggattaggataaatctagtgcttgccctgatctataacttggtcggaattccgatcgccgctggggtattcatgccaattgggattgtactccagccatggatgggctccgcagccatggctgcttccagtgtgtctgtcgtgcttagttcgttacagctgaaatgctataaaaagcccgatctcgaacgttatgaggcccaagcacatggccatatgaagcccctcacggcaagtcaagtttctgtgcatatcggcatggacgatagatggcgggattcgcctcgcgccacgccatgggaccaggtgagctatgtgagccaggtgagcctaagtagtttgacgtctgacaagccctcacgtcactccgccgccgccgacgatgatggagacaagtggagtcttctcctcaacggacgggacgaggaacagtatatt

SEQ ID NO: 7458 - DNA, 4395 bp, Artificial Sequence
  Description of Artificial Sequence: Synthetic coding sequence
atgccggaacaggaacgtcaaattaccgcaagggagggagcgtctcgtaaaatcttaagtaaactttccttacctacaagagcgtgggaaccggccatgaagaaatcctttgcatttgacaatgttggatatgagggcgggctggatggtttgggcccttcatcgcaagtggcgacctcgaccgtacgaatcttgggtatgacttgccaatcctgcgtcaaatctattgaagacagaatttcaaatctcaaaggaattatttcaatgaaagtgagcctagagcaaggatctgcaacggtaaaatatgtcccgtcagtggtctgcttgcagcaagtgtgccaccaaatcggagatatgggattcgaggcttctatcgccgaaggaaaggctgcaagttggccctctaggtcacttccggcccaggaagcggtagtgaaactgcgtgttgaaggaatgacttgtcaatcatgcgtgtcaagcatcgaaggcaaagttaggaaacttcaaggtgttgtccgggttaaggttagtttgtccaaccaggaagctgttattacatatcaaccttatttgattcagccagaagatcttcgcgatcacgtgaacgacatgggatttgaagcggcgattaaatcaaaggtggctccacttagtttaggcccgatcgatattgaaagattacaatcaaccaaccccaaaagaccactgtcaagcgcgaatcaaaattttaataacagtgagaccctcggacatcagggtagtcacgtcgtaacgttgcaactgagaatcgatggcatgcattgcaaatcttgcgtgctgaacattgaggagaatatcggacagctcttaggagtacaaagtattcaagtctccttggagaacaaaaccgcacaagttaagtatgatccttcttgcacgtcaccggtcgccctgcaacgggcgattgaagccttacctccgggtaatttcaaagtctctttgcctgatggcgccgaaggtagtggcacggaccaccgaagctcaagttcacattctcccggctctcctccgcgcaaccaggttcagggcacgtgtagtactacccttattgccattgcaggaatgacctgtgcttcttgcgtacattcaatcgaagggatgatcagccagttagaaggggtacagcaaattagtgtctctctggccgaaggtacagcgacagttctttataacccctcggtaatttcaccggaagagctgcgggctgcaatagaagatatgggatttgaggcgtcggttgtgagcgaatcctgtagcaccaacccattgggtaaccactctgcgggcaattctatggtgcagacaacagatggcacgcccacgagcgtccaagaggtcgccccgcacacaggaagattaccggcaaatcacgccccagatattcttgcaaagtcgccgcaatcaacgcgtgcagttgccccgcagaaatgttttctccaaattaaaggaatgacttgtgcatcttgcgtttcaaacattgaacgtaacctgcaaaaagaagcaggtgtactgagtgtcttagttgcactgatggcgggcaaggccgaaattaagtacgaccctgaagtgattcagccgttagaaatcgctcagttcattcaagatcttggatttgaggctgcggtgatggaagattatgcaggttcagatggaaacatcgaattaacaatcacaggtatgacctgcgccagctgcgtacataatattgaatctaaactcacacggacgaacggcattacttatgcgagtgtagcattagcgacgtcgaaagcattggttaaattcgatcctgagatcattgggccacgagatataattaagattatcgaagaaatcgggtttcatgcgtccctcgctcagagaaacccgaacgctcaccaccttgaccataagatggaaattaaacaatggaaaaaaagttttctttgcagcctcgtgtttggcattccagtcatggcattgatgatttacatgctgatcccgtcaaatgaaccgcatcaatctatggtgctggatcataacataatcccgggtctgtcaattttgaaccttattttttttatattatgcacgttcgtccaacttcttggtgggtggtatttttacgtccaagcatataaatcacttaggcatcgctcggcgaacatggatgtattgatagtgctcgcaacgagcattgcatatgtatattcattagttattttggttgtagccgtcgcagagaaggctgaacgaagcccggttacgttcttcgatactcctccaatgttatttgtattcatcgccctgggacggtggttggaacacttagctaagagcaaaacgtcggaagcacttgcaaagttaatgagcctgcaagccacggaagcaacggtcgtgacacttggagaagataatctcattatacgtgaggagcaggttccgatggagcttgtacaacgtggggatattgtaaaagtagtgccgggcgggaaatttccggtcgatggaaaggtgcttgaaggtaatacgatggcagatgaatctcttatcactggcgaggcgatgcctgtaaccaagaaaccggggtcgactgtcattgcgggctccatcaacgcacatgggtcagttttgataaaggcgactcatgtcggtaatgacaccacattggctcaaattgtcaaacttgtggaagaagcccagatgtccaaagcaccgattcaacagctcgcagaccgtttttcgggttattttgtcccatttattatcattatgtctaccctgactctggtagtctggattgtaattggctttatcgattttggtgttgttcaacgttattttccgaatccgaataaacacatttcacaaacagaggttattattcgttttgcattccagactagcattactgtgctttgtattgcgtgcccctgttcacttggattagccacgccaacggcagttatggtaggcacaggagttgctgctcaaaacggtattctgataaaaggaggcaagccgcttgaaatggcccataaaattaaaacagtcatgtttgataaaacaggcacaattacacacggtgtgcctcgcgttatgagagttttgctgttaggagatgtggcgaccctgccgctgagaaaagtcttagcagttgttggaacagctgaagcttctagtgaacacccacttggagtcgcagttacgaaatattgcaaagaagaactgggaacggaaacgcttggatattgtaccgatttccaagcagtgccgggttgcggaattggctgcaaagtctcgaatgtcgaaggaatattggcgcatagtgaaagaccattatctgctccggcgtcacacctgaacgaagcaggtagtctgccggcagaaaaggacgcggtaccgcaaacattttctgttcttatcgggaatcgcgaatggttacgccgtaatggtttaacaataagcagtgatgtctccgatgcgatgacagatcatgagatgaaaggccaaacagccatcttagtagcgattgacggcgtactctgtggcatgattgcgatagctgatgctgtgaaacaagaggccgcattagcggttcatacattacaatccatgggagtggatgtggtcctgattacgggtgataatcgcaagaccgctcgggccattgcgacccaggtcggaattaacaaagtgtttgcagaagttctgccgtcacacaaagtggcgaaagtccaagaattacaaaataagggaaaaaaagtagccatggtcggcgacggggttaacgattctccggcgctcgctcaagctgatatgggtgtagcaattggaactggcaccgacgtagctattgaagcagccgatgtcgtacttatccgcaacgaccttctggatgttgtggcctcaatacatttgtcaaaaagaacagtccgcagaatacgaatcaatttggttctcgctctgatctataacctcgtgggcataccgatcgccgctggcgtttttatgccgatcggaatcgttttacagccttggatggggtccgcagcaatggctgcgtccagtgtgtcggttgttttatcaagtcttcaactgaaatgttataagaaacctgacttagagagatatgaggcgcaggcccatgggcatatgaaaccgctgacagcaagccaagtgtcggtccatattggcatggatgatcgttggcgcgattctccgagagctaccccctgggatcaggtaagttatgtatcacaggtctctctatctagcctgaccagcgataaacctagccgccattccgccgcggcagatgacgacggtgataagtggtcattactccttaatggcagagatgaggagcaatatatt

SEQ ID NO: 7459 - DNA, 4395 bp, Artificial Sequence
  Description of Artificial Sequence: Synthetic coding sequence
atgccagagcaagaaagacagatcaccgcccgtgagggagcttcacgaaaaatcttatcaaaattaagcctaccaacgcgcgcttgggagccagctatgaaaaaatcattcgcgttcgataatgttggatatgaaggaggtcttgacggtctcggaccctcctcccaggtggcaacctcgactgtgagaatcttaggaatgacttgtcaatcatgcgtaaaatccattgaagatcgtatatcgaatttaaaaggaattatcagcatgaaagtatctcttgagcaaggttcagcaacagtcaagtatgtcccatcagtcgtttgtctccaacaggtttgtcaccaaattggagatatggggttcgaggcctcaattgctgaaggaaaagcagcttcatggcccagtagatctctacccgcacaggaagctgtcgttaagcttcgcgtagaaggtatgacgtgccagtcctgcgtttcttcgatcgagggaaaggttcgcaagttacaaggtgtggtgcgagtgaaggtgtcactatcgaatcaggaagcagttatcacttatcaaccgtacctcatacaaccagaagacctacgtgaccatgtcaacgacatgggctttgaagctgctattaaatcaaaggtcgcgccgttgtcattgggcccaattgatatagaaagattgcagagtacaaatccaaaacgcccattgagtagtgcgaatcaaaatttcaacaactcagaaacattaggtcatcaaggctctcatgttgttactttacaactacgtatcgacggaatgcattgtaaatcgtgcgtgctgaacattgaggagaacatcgggcaattgctcggggtccagagtatccaagtcagtttggaaaacaaaacagcccaggtcaaatatgatccaagttgtacgtcacctgttgctctgcaaagagctattgaagcactgccaccaggaaatttcaaagttagccttcctgatggagctgaaggatcaggaacagaccatagatcttcgtcatcccactctccgggatcgccacctcgaaaccaagttcagggaacatgttctactactttgattgcgattgccgggatgacgtgcgcatcttgtgttcattcaattgagggtatgattagtcagctcgaaggagttcagcagattagtgtgtcgttggcagaaggaactgctactgtcttatacaatccatccgttatctccccagaggaattaagagccgctatagaagatatgggatttgaagccagtgttgtttcagaatcctgctcaacaaatccacttggaaatcacagcgctggtaattcaatggttcagacaactgatggaactccaacttccgtgcaagaagttgcgcctcatacaggacgtttacctgcgaatcatgctcctgacattttggctaaaagtcctcagtctactcgagctgtcgctcctcagaagtgcttcttgcagattaagggaatgacctgcgcatcatgcgtgtccaacattgagagaaatctgcaaaaggaagctggcgtgctttcggtgctggtggcgctgatggcgggtaaagcagagattaaatatgatcctgaagtcatccaaccactagaaattgctcaatttatacaagatcttgggtttgaggctgcggtgatggaggactatgctggatctgatggaaacatcgagcttacgatcacaggaatgacatgcgctagttgcgtacataacatcgaatcaaagctcacaagaactaatggtatcacatatgcttctgtggctctcgctacgtctaaagctcttgttaagttcgatccagagatcattggcccacgagatattatcaagatcattgaagaaattggctttcatgcatctctcgctcagagaaatccgaacgcacaccatctggatcataagatggagattaaacaatggaaaaagtcattcctttgtagtttggtattcggcattcccgtgatggctctcatgatttatatgctcattccaagcaacgaaccacatcagtctatggttctggatcataatataatcccaggactgtccatccttaatctgatctttttcattctatgtacgtttgttcaactactgggaggttggtacttttacgtgcaagcatataaatctttgcggcaccgttcagcgaatatggatgttcttatcgtgcttgcaacttcaatcgcttatgtttactcgttagttattttggtagtcgcagtagcggagaaggctgaacgcagcccagtaacttttttcgacaccccgccaatgctttttgtttttattgcgttgggacggtggcttgagcacttggctaagagtaaaacatccgaagcacttgccaaattgatgagtcttcaagcaacagaagccacagtggtgactctcggtgaagataatctaattattagagaggagcaagtgcctatggaattggttcagagaggagacatcgtgaaggtagtcccaggaggaaagttcccagttgacggcaaggtgctcgagggaaacacaatggccgatgagtcgcttatcacgggagaggctatgcccgttacgaaaaaaccgggctccacagttattgcgggatcaataaatgcccatggaagcgtattgattaaagcaactcatgtggggaatgacactacgcttgctcaaattgtaaaattagttgaagaagctcagatgtcaaaagctcccattcagcagctcgccgaccgattcagcggctatttcgtcccttttatcatcataatgagcactttgacacttgtagtatggatagtgattggcttcatagatttcggcgtggtgcaacgatatttcccaaatcccaataaacatatttcacagacagaggtaatcattagattcgctttccaaacgtccattacagttctctgcatagcctgcccatgcagcttaggactcgcaactccaacagctgtcatggtgggaactggagtcgctgcacaaaatggaattttgattaagggaggaaagccactggaaatggcacacaagataaaaacggtgatgtttgataaaactggaaccattactcatggagttccacgagtgatgcgtgtactattgctgggagatgtcgcgactttgccacttcgaaaggtgttagcagtagttggaacagctgaagcctcatctgaacatcctcttggagttgctgttactaaatattgtaaggaggagttggggacagagacgctgggatattgtactgattttcaagctgtcccaggttgcggaattggatgtaaggttagcaatgtagaaggaattttggctcattctgaacggccactctcagctcctgcaagccaccttaatgaagccggatcactaccggctgaaaaagatgcagtacctcagacgttcagtgttctcataggtaacagggaatggctgcgacggaatggtttgaccatttcaagtgacgtctcagatgcaatgactgatcacgagatgaaaggtcaaacagctattctcgttgccatcgacggagtgttgtgtggtatgattgcaatcgctgatgccgttaagcaagaagctgcccttgctgttcacactcttcaaagcatgggagttgacgtagtgttgattactggagataatcgtaagactgctcgagcaatcgcaacacaagttggaattaataaggtcttcgctgaagttctaccctctcataaagtggcaaaagttcaagaattgcagaacaaaggaaaaaaagttgcaatggttggagatggagtgaatgattcaccggctctagctcaagccgacatgggagttgcaattgggacaggcaccgatgtagcgatcgaagccgcagatgttgtgttaatacgtaacgatctgctcgacgtcgtggcatcaattcatctctcaaagagaacagttcggcgcattcggatcaacttggtcctagctcttatttataacctggtaggaattccgatcgccgcgggagtttttatgcctataggcattgttctgcaaccttggatggggtcagccgctatggcagcatctagtgtgtctgtggtgttatcatcacttcaactgaaatgctacaagaagccagatctcgaacgttatgaagctcaggcacacggacatatgaaaccattgacagcttctcaagtgtcagttcatattggaatggatgatcgatggagggattcaccccgagccactccatgggaccaagtatcctatgtctcacaagttagtttgtcttcattgacatccgataaaccgtcgcgacactcggctgcagctgatgatgacggtgacaagtggtctctactactaaatggcagagatgaggagcaatacata

SEQ ID NO: 7460 - DNA, 4395 bp, Artificial Sequence
  Description of Artificial Sequence: Synthetic coding sequence
atgccggagcaagagcggcaaattaccgccagagaaggcgcatcgcgcaaaattctgtctaaactatctctcccaactagggcatgggaaccagctatgaagaagagcttcgctttcgataacgtgggatatgagggcgggctagacggtctagggccctcatcccaggtggccacgagcacggttcgaattcttggcatgacatgtcaaagttgtgtcaagtcgattgaagatcggatcagcaacctgaaggggataataagtatgaaagtgagccttgagcaaggctctgccacggtgaagtatgtaccttccgtagtgtgtttgcagcaagtgtgtcatcagatcggtgatatgggatttgaggcttctatcgccgagggtaaggccgctagctggccgtctaggtccttacctgcacaggaggccgtcgtcaagcttcgggtcgaaggaatgacctgtcagagttgcgtcagtagtatcgaggggaaggtgcgaaaactccaaggagtcgtgcgggttaaggtttctttaagcaatcaggaggctgtaatcacctaccaaccctatttaatccagcccgaagacctcagggatcacgtaaatgacatgggattcgaagccgccattaaaagtaaagtggcccccctctccctggggcctatagacattgagcgcctccagagcaccaaccctaaacgtcctctgagcagcgcaaaccaaaatttcaacaactcagagaccctaggccaccagggtagtcacgtggtaactctgcagctcagaattgacggcatgcattgcaagtcttgcgttttgaacatcgaggagaacattgggcagttgttaggcgtgcagtccatccaggtgtctttagaaaacaaaacagcacaggtgaaatacgatccaagctgcacttcccctgtggccctccagcgggctattgaagcactcccacccgggaatttcaaggtttcactgcccgatggagcagagggcagtggcactgatcacaggtctagctccagccactcccctggctctccaccacgaaatcaggtccagggcacatgctctaccactctgatcgcaatcgctggaatgacttgtgccagctgcgtgcattcaatcgagggaatgatcagtcagcttgagggcgtccaacagatatctgtctcgctggccgaagggaccgcaacggtactgtacaacccgtcagtcatcagccccgaagaattaagggctgctatagaagatatgggattcgaagcctcagtggtgtccgaaagttgcagcaccaaccctttaggaaaccactcagcggggaacagcatggtgcagacaactgatggcacacctacatccgtccaggaggtcgctccacacacaggtcggcttcccgctaaccatgcaccggacattcttgctaaatcacctcagtctactcgcgctgtggccccgcagaagtgctttttgcagatcaagggcatgacctgtgcgtcctgtgtttcaaatatagagagaaacctacagaaggaggccggcgtcttgtctgtgctggtggccctgatggcgggaaaagctgagatcaaatatgatcctgaggtaatacagcccctagaaattgcccaattcatccaggatctgggatttgaggcggccgttatggaggattacgcaggaagtgatgggaatatcgaattaactatcacgggaatgacctgtgctagctgcgtgcataatattgaatccaagctgacgcggaccaacggcatcacttacgctagtgttgcgctggctacgtcaaaagcactcgtgaagttcgaccctgagatcataggccctagggacattattaagatcatagaggaaattggtttccatgccagcttggcccagaggaatcccaatgcccaccacctagatcataaaatggagataaagcagtggaagaagagctttctgtgtagtctggtgttcgggatacccgtgatggcgctaatgatttatatgttgattcctagcaatgaaccacatcagtcaatggtgttggaccataacatcatcccagggctcagtattctgaacctgatattcttcattctctgtacatttgtgcagctgctgggaggatggtacttctatgttcaggcatataaatccttgcggcacagaagcgcaaacatggacgtcctgatcgtgttggccacgtcaattgcgtatgtatacagcctagtgattttggttgtggccgtagcagagaaggccgaacgatctccggtgaccttcttcgatacccctcccatgctgtttgtttttatagcactcgggcgatggttggagcacttggccaaaagcaaaaccagcgaggctttagccaaattaatgagtttacaggccaccgaagcgactgtggttactctgggggaggataacctgattattagggaggagcaggtcccaatggagctggtgcagaggggtgacattgttaaagtggtcccaggaggcaaattccctgtggatgggaaagttctggagggtaatacgatggccgacgagtctctcatcacgggggaggctatgcctgttacaaaaaagccaggaagcacggtcatcgcaggttccattaacgcacacgggagcgtcctgatcaaagccacacacgtgggaaatgatactacccttgctcagatcgtcaagctagtggaagaagcacagatgagtaaggccccgatccagcagctggccgaccgattcagtggttacttcgtcccatttatcattatcatgagcacacttactctggttgtttggattgttatcggatttattgactttggcgtagtccagaggtacttccccaatcctaataagcacataagccaaactgaggtgatcattcgtttcgccttccagacatccatcacagtcctctgtattgcttgcccatgtagtttgggccttgccacacctaccgcggttatggtgggaaccggagtggcagcccaaaatggcatcctaattaagggtggcaaacccctcgagatggctcacaagattaaaacagtaatgtttgacaaaaccggaaccattacacatggggttcctcgcgtgatgcgcgtcctgctcctgggtgatgtagcaactctgccccttcggaaagtgctggctgtggtgggaaccgctgaagcaagctcagagcacccactgggtgttgccgtgactaaatattgtaaggaagagttggggacggagacactgggctactgcaccgattttcaggcggtgccggggtgtggtatcggctgcaaagtgagtaatgtcgaggggattttagcccactctgagcggcccctcagcgctccagcgtcccacttgaatgaagctggatcattgccggcagaaaaggatgccgtgccgcagacatttagcgtacttatcggcaatcgcgaatggttgcgcagaaatggcctcactatctcttctgacgtatcggatgccatgacggatcatgaaatgaaaggtcagaccgctatcctagttgccatcgacggcgttctctgcgggatgattgcgattgccgatgctgtgaaacaggaggccgcccttgctgtacacacactccagtccatgggtgtggatgtcgtgctgattaccggtgataataggaaaaccgcccgcgctattgctacccaggtgggaatcaacaaagtgttcgcagaagtgcttccctctcacaaggtggccaaagtccaggaactgcagaacaagggtaaaaaggtcgccatggtgggtgatggcgtaaacgattcccccgccctagcacaggctgacatgggtgtcgctataggcaccggaaccgacgtggccatagaagctgctgatgtggtcttgatccggaacgatctcctggatgtggtcgcgtcgatccacctctccaaaaggactgttaggcggataaggatcaacctagtcctcgcgctaatctataacttggtcgggatcccaatcgcagccggcgtgttcatgccaataggcatcgttctccagccctggatgggcagtgcagctatggctgcaagttcagtgtcagtagtgctgagctccctacagctgaagtgctataaaaagcccgatctcgagaggtacgaagctcaagcccacggacatatgaaacccctcactgcctcacaagtctccgttcatattggcatggacgatcgttggagagacagtcctagagcaaccccctgggaccaggtctcgtacgtgtcgcaggtgagcctgtcatcacttacatcagataaaccctcgagacattcagctgcagctgacgacgatggagataagtggtccctgctcctgaatggtagagatgaagagcaatatatt

SEQ ID NO: 7461 - DNA, 4395 bp, Artificial Sequence
  Description of Artificial Sequence: Synthetic coding sequence
atgcccgagcaagagagacagatcactgcacgggagggagcatcccgcaaaatcttgtctaagctgtctctgccaacgagagcctgggagccagcaatgaagaagtcatttgccttcgacaacgttggttacgagggtggcctggatggcctcgggccctcctcccaagtggccactagcaccgtacggatcttgggtatgacctgccaatcatgcgtgaagagtatcgaggataggattagtaaccttaaaggtatcataagtatgaaggtcagcttggaacagggctccgctaccgtgaagtatgtacccagcgttgtttgtctgcagcaggtgtgccatcagattggtgatatgggtttcgaggcctccattgccgaggggaaggctgcatcttggccctcgagaagtttgcctgcccaagaagctgtcgtgaagctgagggtggagggaatgacgtgccagtcatgcgtcagcagcatcgaaggaaaggtacgaaagcttcagggcgtggtaagagtgaaggtaagcctgagtaatcaggaggccgtaataacctatcagccctacttaattcagccggaggacctgagggatcacgtaaacgatatgggctttgaagcagccatcaaatcgaaagtggctccattgtccctcgggccgattgacatcgaaagactgcagagcactaatcccaaacggccactcagctctgccaaccagaattttaacaattccgagactttaggccatcaagggtcccacgtcgtcacactgcagctcagaatagacggaatgcactgtaaatcttgcgtgttaaatattgaggagaatatcgggcaactcttgggagttcagagtatccaggtctctcttgagaacaagaccgcccaggtcaaatatgatccgtcttgtaccagccccgttgctctccagcgcgcaattgaggctttgccgcctggcaactttaaggtctcactccccgatggcgctgaggggtctggtactgaccacagaagtagtagctcccactccccgggaagccctccgcgcaaccaagtgcagggcacctgcagtactaccctgatcgctatcgcaggcatgacatgcgcgtcttgtgtgcactctatcgaaggaatgatctcacagctggaaggtgttcagcagatctcagtctctctggctgagggcactgccaccgtactctataatccaagcgtaatatctccagaggagctcagagccgcgatcgaggacatggggttcgaggccagcgtggtaagtgaatcctgttcaacaaacccgctcggaaatcactccgctggcaacagtatggtgcaaacaaccgatggtactcctacatctgttcaggaggtcgcgccacacaccggtagattgccagctaatcacgccccagatatcctcgcgaagtctccccaaagcactcgggctgttgcgcctcagaaatgttttctgcagatcaagggcatgacttgtgcctcttgcgtgagtaacattgaaaggaaccttcagaaggaggctggggtgttgagcgtcctggtcgctctgatggcgggaaaggctgaaatcaaatacgatccggaagtaatccagcccctggaaatagcgcagtttatccaagacctgggttttgaagcggcagttatggaggactacgccggcagcgatggcaatatcgagctgacaatcacgggaatgacatgcgcatcctgcgtccataacatcgaatcaaagctcacaagaaccaacggcataacatatgcgagcgttgcattggccacctccaaagctctggtgaagtttgaccccgagatcatcgggcctagagatataatcaaaattattgaggaaataggatttcatgcttccttggcccagcggaatcctaacgctcatcacctggaccacaagatggagattaaacagtggaagaaatcatttctctgcagtctggtgtttggcatccccgtgatggcactgatgatatatatgctaataccatccaatgaaccacatcagtccatggtactcgaccataacatcataccaggactctccatcttgaatctcatcttcttcattctctgtacttttgtgcaactacttggtgggtggtacttctacgtccaagcatataaatctcttcggcacagaagtgcgaacatggacgtgctgatcgtattagctacctcaattgcctacgtatactccctcgtcattctcgtggtcgccgtggcggaaaaagccgaaaggtccccagtaacctttttcgatacgccccctatgctgttcgtgttcattgctctcgggaggtggttagagcatctggctaaatctaagaccagcgaggccctggccaaactcatgtctctccaggctacggaggccactgtagtgacgctgggggaggacaatctgattattagggaggaacaggtgcctatggagctggtccaaaggggcgatatcgtgaaggtagtgcccggaggaaaattcccggttgatggtaaggtgctcgaagggaatactatggctgacgagagccttattaccggggaagccatgcctgttacaaagaagccaggtagcaccgtcatcgccggctcgattaacgcccacggctccgttctgataaaggcgacccacgtcggtaacgacaccacactggcacaaattgttaaacttgtggaagaggcccaaatgagtaaggcgcccatccagcagctggccgaccgctttagtggctacttcgtgccttttatcataattatgagtacactcacactggtggtgtggatcgtgatcggattcatcgattttggagtggtccaaagatacttcccgaacccaaacaaacacattagccagaccgaagtcattatacgatttgcgttccagactagtatcactgtgctctgcatagcgtgtccctgttcccttggactggctactcccaccgctgtgatggtgggaacaggggtggctgcccagaacggaatcctaatcaaggggggcaagcccttggaaatggcccacaaaataaagaccgtaatgtttgataaaactgggactataacccacggagtgccgcgggtcatgcgagtcctgttactgggggatgtcgccacactacccttgcgaaaggtgctggctgtggtgggcacagctgaggcaagcagcgagcaccctctgggggtggctgtaaccaaatactgtaaggaagaattgggaacggagaccctgggatattgcaccgattttcaagccgttccaggttgcggaatcggatgcaaggtgtccaatgttgagggcattctagctcattcagagcgacccctttcagctcccgcttctcatctaaacgaggccgggagcctcccggctgaaaaggatgcagtgcctcagaccttctcagtccttattggcaaccgcgaatggctcagacggaacggtcttacgatctcctcagatgtttctgatgcgatgacagaccacgagatgaaaggacagaccgcaatcttagtggccattgacggtgtgttatgcggcatgattgcgatcgccgacgccgtgaaacaggaagctgccttagctgtgcacacattgcagtctatgggagtggacgttgttctcataaccggggacaaccgcaagacagctcgcgcgatagctactcaggtcggcataaacaaagtgttcgcagaggttctccccagtcataaggtggctaaggttcaggagttgcaaaataagggcaagaaggtagctatggttggcgacggggttaatgactctccagctctggctcaggctgatatgggggtagcgatcggcacggggaccgacgtggcaattgaagccgctgacgttgtgcttatccgtaatgacctgctggacgtcgtcgcctcaatccatctgtcgaaaagaaccgtgcggaggattaggatcaatctggtgttagcgcttatctacaacctggtgggcatccccattgcagccggggtattcatgcctataggcatcgtgcttcagccctggatggggtccgctgccatggcagcgtcaagcgtctccgtggttctctcatctctgcagctcaagtgctacaagaagccagaccttgagcgctacgaagctcaagcccacggtcacatgaagcctttgaccgcaagccaagtgtccgtgcacattggcatggatgatcggtggcgggactcccctcgggccaccccttgggatcaggtgtcttatgtgagtcaggtttccctcagctccttaactagcgataagccttctagacacagtgcagctgctgacgacgacggggacaagtggagtctgctcctaaatggccgggacgaagagcaatatatt

SEQ ID NO: 7462 - DNA, 4395 bp, Artificial Sequence
  Description of Artificial Sequence: Synthetic coding sequence
atgcccgaacaagaacgccagattacggcgcgcgaaggagcatctcggaagattctttccaagctgagccttccaaccagggcatgggagccggctatgaagaagagcttcgccttcgataacgtgggctacgaaggtggtcttgatggactgggacccagctcgcaagtggcaacctccactgtgaggatactgggaatgacctgccagtcctgcgtgaagagcatagaggatagaatttcgaaccttaagggaatcatctcgatgaaggtgtcgctggaacagggatcagcaaccgtcaaatacgtgccctccgtcgtgtgcctgcaacaggtctgtcatcaaattggtgatatgggattcgaggcctcaatcgcagaaggaaaggccgcatcctggccgtcgcgttccctcccagcacaggaagcggtcgtgaaacttcgcgtggaaggtatgacgtgtcaatcctgcgtctcatccatcgaaggaaaggtgagaaaactgcagggagtggtgcgcgtgaaagtctcacttagcaatcaagaggccgtgattacctaccagccatatctgatccagcccgaagatttgagagatcatgtgaatgacatgggattcgaagcagccatcaaatccaaggtggcgccactcagcctcggtcctatcgacatcgaaagactgcaatcgaccaatccaaaaagaccactgtcatcggcaaaccagaactttaacaattcggaaaccttggggcaccaaggaagccacgtggtgacgttgcaacttcggatcgacggcatgcactgtaagtcatgcgttctgaacattgaggaaaacatcggacaattgcttggagtgcaatcgattcaggttagcttggagaataagactgcccaggtgaaatacgatccttcgtgtacctcccccgtggcactgcaacgtgcgattgaagcactgcctccgggaaactttaaagtctcgctgcctgacggggccgagggttccggcaccgatcataggtcctcctcctcacattcaccgggatcaccacctaggaaccaagtgcagggaacttgttcaacgacccttatagccatcgcaggaatgacttgcgcctcgtgtgtgcactctattgaaggtatgatttcgcaactggaaggggtgcagcagatctccgtgtccctcgccgagggcaccgctaccgtgctgtacaacccctcagttatctcgccagaagaactcagggccgcaattgaagatatgggatttgaagcaagcgtcgtctcagaatcgtgtagcactaatcctttgggcaaccactcggctggaaattcgatggtccaaactacggacggcactcctacttccgtgcaagaggtcgcaccgcatactggcagacttccagcaaaccatgcaccagatatcctcgcaaagagccctcagtctacccgtgcagtcgcacctcagaagtgttttctccaaatcaagggcatgacttgtgcatcctgcgtgtcaaatatcgaacgaaaccttcaaaaagaggcaggtgtcctgtcggtccttgtcgcacttatggctggtaaggctgagattaagtacgatccagaggttattcaacctttggagatagctcagtttatccaagaccttggattcgaagctgccgtgatggaagattatgcgggctcggacgggaatatagaacttactattactggtatgacttgtgcgagctgtgtccacaatattgaatctaaattgacgcggacgaacggtattacttatgcttcggtggctctggctaccagcaaagcgcttgtgaagttcgaccctgagatcatcggccctcgagacattatcaagatcatcgaagaaataggattccatgccagcctggcgcaaagaaatcccaacgcacaccatcttgaccataagatggagattaagcagtggaagaaatcgtttctttgtagcttggtgttcggaatcccagtgatggcacttatgatttacatgctgatcccttccaacgaacctcatcagtctatggtgttggatcacaacattattcctgggctgagcattctcaaccttatcttctttatcctctgcacctttgtgcagctcctcggaggttggtacttttacgtgcaagcctacaagtcattgcgtcatagatccgcaaatatggacgtgctgatagtgctggcgacctcgatcgcatacgtctactcgctggtcatactggtggtcgcggtggcagagaaggccgaaagaagcccagtcacttttttcgatactcccccaatgctctttgtgtttatcgccctcggaagatggcttgaacatctggcaaagtctaaaacctcagaagctcttgcaaagctgatgtcgcttcaggccactgaagcgactgtggtgacccttggggaggataacttgattattcgcgaagaacaagtgcctatggagcttgtgcaacgaggggatatcgtgaaagtcgtgccagggggcaagttccccgtggacggcaaggtccttgagggtaacacgatggcggatgagtcgcttattaccggcgaagcgatgccggtgactaaaaagccaggctccaccgtgattgctggttccataaatgcccacggatcagtcctcattaaagcgacccatgtcggaaatgacacgaccttggcacagattgtgaagctcgtggaagaggcccagatgtctaaagcgcccattcaacaacttgcggacagatttagcgggtactttgttccttttatcatcatcatgtccactctgacgctggttgtctggatagtgattggcttcatcgattttggtgtggtgcaacgatactttcctaaccccaacaaacatatctcgcaaaccgaggtgattattcggttcgcatttcagacctccatcaccgtcctgtgcattgcttgtccttgttcgctgggacttgctacgcctaccgccgtcatggtcggcaccggagtggcagcgcagaatggaatcctgattaagggagggaaaccgcttgaaatggcccataagattaagaccgtgatgttcgataagaccggaaccatcacccacggggtgcctagagttatgagggtgcttcttcttggagacgtggcaactcttccactgagaaaggttttggcagtggtgggtactgcagaagcgtcctccgaacatccacttggtgtggcagtgaccaaatactgtaaggaagaactgggtactgaaactctgggatactgtaccgacttccaagcggttccaggttgtggtattggatgcaaggtttctaacgttgaaggcattcttgcccattctgagcgaccgctgtcagccccagcctcacacctgaacgaagctggtagcctgccagcagagaaggatgcggtgcctcagacctttagcgtgctcatcggaaatcgggaatggcttaggagaaacggattgacgatttcgtccgatgtctccgatgcaatgaccgaccacgagatgaaagggcaaactgcaattctcgtggcaattgatggtgtgctgtgtggtatgattgcaatagcggacgccgtcaagcaggaggcagctctcgccgtccataccctgcaatcgatgggcgtggatgtggtgcttattactggggataacagaaaaaccgccagagcaattgctacgcaggtgggaatcaacaaggtgtttgcagaggttcttccatcccataaggtcgcaaaagtgcaagaactgcagaataagggaaaaaaggtggcaatggttggtgacggcgtgaacgattcacctgcactcgcacaagcggacatgggagttgcaataggaactggaaccgatgtcgcaattgaagcggcagacgtggttcttatcaggaatgatctccttgatgtggtcgcgtccattcatctttcgaagagaaccgtgcggcggattcgaatcaacctggtgctcgccttgatttacaacctcgtcggaattccaattgcagcaggagtctttatgccgataggaattgtgcttcagccctggatgggctcggcagcgatggcagctagctctgtgagcgtcgtcctttcctcactccagctcaagtgctacaagaagccagacttggagcgctacgaggcacaagcccacggtcacatgaagcctctgaccgcgtcccaggtgagcgtgcatatcgggatggacgatcggtggcgagattcccctagagcaactccctgggatcaagtcagctacgtgtcacaagtgagccttagcagccttacctcggataagccatcgcggcattccgcagcagcggatgatgatggtgacaaatggagcctgctcctgaacgggcgcgatgaggagcagtacatt

SEQ ID NO: 7463 - DNA, 4395 bp, Artificial Sequence
  Description of Artificial Sequence: Synthetic coding sequence
atgcctgagcaggaacggcagatcactgctagggaaggtgctagccggaagattctctccaaactgtcactcccaactagggcatgggagcctgcaatgaaaaagtcgtttgcttttgataacgtgggctacgaaggaggtcttgatggacttggtccttcatcacaagtggcgacttctaccgtgcgcattcttggtatgacttgccagtcctgtgtcaagtccatagaagatcggatttccaacctgaagggaatcatatcaatgaaggtatccctggagcagggatcggcaactgtgaagtacgtcccaagcgtggtgtgtttgcaacaggtgtgtcatcaaattggtgacatgggcttcgaggcatcaattgcagaggggaaggcagcttcatggcctagccgttcgctgccagcacaagaagcggtcgtgaagctgagggtggagggtatgacctgtcagtcgtgcgtctcctccattgaaggcaaggtgaggaagttgcaaggagtggtacgggtcaaggtgtcactttccaaccaagaagcagtgataacctaccaaccttacctgattcaacctgaagatttgcgcgatcatgtgaacgatatgggttttgaggcagcgatcaaatcaaaggttgctcctctgagcttggggcctatcgacatcgaacgccttcagtcaactaaccctaagcgccccctgtcctcagcaaaccagaatttcaacaattccgaaactcttggccatcaaggtagccatgtcgtgactctccagctgaggattgacggtatgcactgtaagtcctgtgtgctgaatattgaggaaaacatcggtcagttgttgggcgtgcaatcgattcaggtgtccctggagaataagacggcccaggtgaaatatgatcctagctgtactagcccggttgcacttcaaagggccattgaggcactcccgccaggaaactttaaagtgtcgctgcccgatggcgccgagggatcggggaccgatcatcgctcatcctcctcccacagcccagggtccccgccacgaaaccaggtgcagggaacctgtagcaccaccctcatcgctatcgcaggaatgacttgtgcatcgtgtgtgcactcgattgaagggatgatcagccagctggagggcgtccagcaaatttcagtgagccttgccgaaggtacggcaaccgtcctgtacaatccttcggtgatctccccagaagagttgcgcgcggcaattgaagatatggggttcgaggccagcgtggtgtccgaaagctgctccactaacccactcggcaaccattcagcaggaaactcgatggttcagacgactgatgggacccctacctcggtgcaagaagtggctcctcataccggtcggcttccggcaaatcacgctccagatatccttgcaaagtcccctcaaagcactagagcagtcgcgccccaaaagtgttttctgcagatcaaaggaatgacctgtgcatcgtgcgtgtcaaacattgagcggaacctgcaaaaggaggcaggtgtcctgtccgtgcttgtggccctgatggcaggaaaggcagagattaagtatgatccagaggtgattcagccgcttgaaatagcacaattcatccaggacctgggctttgaagcagcggtgatggaggattacgccggctccgatggaaacattgaactgactatcaccggaatgacgtgtgcatcctgtgtccataacatcgagtccaagctcactagaaccaatggaattacgtacgcatcggtggcccttgctacttcgaaggcacttgtaaagtttgatccggagattattggacctagagacatcattaagattattgaagaaataggatttcatgcaagccttgcacaacgtaatccaaacgcgcaccaccttgatcataagatggagattaagcagtggaagaaaagttttttgtgctccctggtctttggaattcctgtgatggcactgatgatctacatgcttattccttcaaacgaaccacaccaaagcatggtcctcgaccacaacataatacctggtctgtccattcttaacctgatcttctttattctctgtacctttgtgcaactgctgggaggatggtacttctacgtgcaggcgtacaaatccctgaggcatagatcagcaaatatggatgtccttattgtgctggcaacttcgattgcatacgtctactcgcttgtgatcctcgtggtggcagtggccgagaaggccgagagatccccagtcaccttttttgataccccgccgatgctgttcgtctttattgcactgggcagatggctggagcatctggcaaagagcaagacttcagaggcacttgcaaagctgatgtccctgcaagcgactgaggcgactgtggtcacgctcggagaggacaacttgattatacgcgaagagcaagtgccaatggaactggtgcagagaggcgacatcgttaaggttgtgccaggagggaagtttccagtggatggaaaggtgctcgaaggcaacactatggccgacgaatcgcttattactggagaagcaatgccagtgactaagaagcccggctcgaccgtcatcgcaggctcgattaacgcacatggatccgtgctgatcaaagcaactcatgtgggtaacgatactactctggcacaaatagtgaagctcgtggaagaagctcagatgtcaaaagcacctattcaacaacttgccgacagattctcgggttactttgtgccttttatcatcattatgtccaccctgacgctcgtggtctggatcgtcattggattcatcgatttcggcgtcgtgcagcgctactttcccaaccctaacaaacatatctcccaaactgaagtgatcattagatttgcctttcaaacctccattactgtcctgtgcatcgcgtgtccttgcagccttggactcgccactcctaccgcagtcatggtgggaaccggagtcgcagctcaaaacggtatccttatcaagggagggaagccactcgaaatggcacacaaaatcaagactgtgatgtttgataagactggcaccattactcatggggtgccccgcgtgatgcgggtgcttctccttggagatgtggctacccttcctctgcgcaaagtgcttgcagtggtcggaactgcggaggccagctccgagcacccactcggcgtggcagtgaccaagtactgtaaagaagagctcggtaccgaaaccctggggtactgtactgatttccaggcagtcccagggtgcggcattggatgcaaggtgtctaacgtggagggcatccttgcacactcagaacgccctctgtcagcaccagcttcccatctcaacgaagcaggctcacttcctgcagagaaggacgccgtgccgcaaaccttcagtgtccttatcggaaatagagaatggctgagacgcaacggacttaccatatcgtctgacgtgtccgacgcgatgacggaccatgagatgaaggggcagaccgcaatcctggtggcaattgatggcgtcctttgtggaatgattgcaatcgccgacgccgtcaaacaagaggcagcgcttgcagtgcacactctccagtccatgggagtggacgtcgtgttgattaccggcgacaaccggaaaacggctcgagcaattgcgactcaagtcggtattaacaaagtgttcgctgaagtcctcccatcacacaaggtggccaaggtgcaggagctgcagaataagggaaagaaggtcgccatggtgggagacggagtgaacgattcgcccgcactggcacaggcagacatgggagtcgcaataggtaccggaaccgacgttgctattgaagcagccgatgtggtcctcatccggaatgaccttctggatgtggtggcatctatccacctgtctaaacgcacggtcagaaggatcagaatcaaccttgtgctcgccttgatttacaacctcgtgggaatccctattgctgcaggtgtgttcatgcctattgggatcgttctgcagccatggatgggctcagcggcaatggcagccagtagcgtgtcagtggtgctttcgtcccttcaacttaagtgctacaaaaaacctgatctggaaagatacgaagcacaggcccatggtcatatgaaacctctcaccgcgtcgcaggtgtccgtccacattggcatggacgatcggtggagagattcaccacgagcgacgccttgggaccaagtctcatacgtgtcgcaagtctctctgagctcgttgacttcagacaagccttcacgtcactcggcagcagccgatgatgatggggataagtggtcgttgcttcttaacggaagagacgaagaacagtacatc

SEQ ID NO: 7464 - DNA, 4395 bp, Artificial Sequence
  Description of Artificial Sequence: Synthetic coding sequence
atgcctgagcaggagaggcagatcacggctcgcgagggtgcatcccgtaaaatcctatcaaagctgagcctgccgacacgcgcgtgggagcctgccatgaagaagagtttcgctttcgataatgtcggctacgagggtggccttgacggcctggggcctagctcacaggtggctacaagcaccgtaagaatcttaggtatgacgtgtcagagttgtgtgaagagcattgaggaccgcattagcaacctcaaggggatcatcagcatgaaggtgtccctggaacaggggtcagcaaccgtgaaatacgtccccagcgtggtgtgtttgcaacaggtgtgtcaccagataggcgacatgggcttcgaggcgtcgattgcagagggaaaagctgcgtcttggccaagtcggagcttgcccgctcaggaggctgtagtgaaactcagagtggaaggcatgacatgtcaatcttgcgtcagctccattgaaggaaaagttcggaagctgcagggggtggtgagagtcaaagtctccctttccaatcaggaggctgtcattacctaccagccttacctgattcagccagaagatctcagagaccatgtcaacgacatggggttcgaagccgccatcaagtcaaaggtcgcccctctcagtctaggacctatcgacatagaacgcctgcagtccacaaaccccaagaggcccctttcttccgcaaatcaaaacttcaataatagtgagaccttgggtcaccagggctcccatgtggtgactctgcaactccggatcgatggtatgcattgcaagtcatgtgtgcttaacattgaagaaaatataggacagctccttggggtgcagagcatccaggttagtttggaaaacaaaacagcccaggttaagtacgatccaagctgcacaagtccagtggcccttcagcgtgccattgaggctttgcccccagggaactttaaggtgtccctgcccgacggggctgagggctctgggacagaccataggtctagttcttcccacagccccggctctccccccaggaatcaggtccagggcacgtgtagcacgaccctcatcgctatcgccggaatgacctgtgcctcttgcgtccactcaatcgaaggcatgatcagccagcttgagggcgtgcaacagatcagcgtaagcctcgcagaagggaccgcaaccgtgctgtacaatccttcagttataagtcccgaggaactgagggccgcgattgaggatatgggttttgaggcttcagtggtgagcgagagctgctctactaaccccctgggcaaccattcagcaggcaattccatggtccaaactaccgatggtacccccacctctgttcaggaagtggccccgcacaccgggcgcctgccagccaaccatgcgccagacatccttgcaaagtcccctcagtcaacgcgcgccgtggcgccacagaaatgctttctgcagatcaaggggatgacttgcgcgtcctgtgtgtctaacattgaaagaaaccttcagaaagaggccggggttttaagcgtgctggtggcactgatggcaggcaaggccgaaattaagtatgaccccgaggtcatccagcctcttgagattgctcaattcatccaggacctgggcttcgaggcagccgttatggaggattatgctgggtctgatggcaacatcgaactgacaatcacaggtatgacttgtgcttcctgtgtgcataatatcgaaagtaaactgaccaggaccaatggtatcacctacgccagcgtggctctggcaacttccaaggctcttgtgaaatttgatccagagataatcggcccgcgcgacataatcaagatcatagaagagatcgggtttcacgcatctttagcacaaagaaatcccaacgcccaccacctggaccataagatggagatcaagcagtggaagaagtcctttctgtgcagtctggtcttcggcattcccgtcatggctctgatgatttacatgctgatcccttctaacgagcctcatcagagcatggtgctggatcataatatcataccagggctgtccatcctgaatcttatctttttcatcctgtgtacctttgttcagcttctgggaggatggtatttttatgtgcaagcttacaagagtctgaggcaccgatccgcaaatatggatgtcttgatcgtgctagctacgtctatcgcttacgtctattctctcgtaatcctggtagttgctgtggccgaaaaggcggaacgctcacccgtgaccttcttcgacacacccccaatgctttttgttttcatcgcactgggccgctggctcgagcacctggccaagtccaagacctctgaggctttggcgaagctcatgtctctgcaggccaccgaggccacagtcgttaccctgggtgaggacaatttgatcatccgagaggaacaagtccccatggagctcgtgcaaaggggcgacatcgtcaaagtggtgcctggtggtaaattcccagtggacggaaaggtgctggaaggaaacaccatggctgatgagagcctcattactggtgaagctatgcccgtgacaaagaagcctggctcaacggttatcgccggatccattaatgcccacggaagcgtcctgatcaaggctacccatgttggtaatgacaccacactggcccaaatcgtgaaactggtcgaagaagcacagatgtctaaggcacctatccagcaactggccgatcggttctccgggtatttcgtgcctttcataatcatcatgtctacgcttaccctagtcgtatggatcgtcatcggcttcatcgatttcggcgtagttcagcggtactttcctaacccaaataagcacatctcccaaacagaagtaataatcagattcgcatttcaaacctccattaccgttctgtgcatcgcttgcccatgttctttgggtctggcgacacctactgccgtgatggtcggaaccggcgtggcagctcagaacggcatcctgattaagggggggaagcccctggagatggcccataagataaaaacggtgatgtttgataaaacaggaaccatcacgcacggtgtcccacgtgtgatgcgcgtcctgctacttggtgacgtggccacacttccactccgaaaggttctggccgtggtagggaccgcggaagcttcaagcgaacaccctctcggtgtggccgtgacgaagtattgtaaggaggagctcggcactgagaccctggggtactgtactgacttccaggccgtgcctgggtgtggcataggatgcaaggtttccaatgtggaaggtatcttagcccacagtgaaagacctctctcagccccggcatcccatctgaacgaagcagggagtctcccagctgagaaggacgccgtgccacagacttttagtgtcttgatcggcaatcgtgaatggctcaggcggaacggcctgactatctcatccgacgtgagcgacgccatgactgaccacgaaatgaagggacagacggcgatcctggtcgctatcgatggcgtcctgtgcgggatgatcgccatagccgacgcggtgaaacaggaagctgctctagcggttcatacactgcagtcaatgggcgttgatgtagtactgatcacgggagataatcgcaagactgctcgagccatagccactcaggtcggcatcaacaaggtattcgcagaagtcttacccagccacaaggtggcgaaggtgcaggagcttcagaacaagggaaagaaagtggccatggttggagacggagtgaacgacagtcctgccctcgcccaggcagatatgggcgtcgccattggcaccgggacagacgtggccatcgaagctgcagacgtcgtcctgatcaggaatgatcttctggacgtggtggcatcaatccacctgtccaagcgtacggtccgacggattcgaatcaacttggttttggccctcatatataatttggtgggtatccctattgcagctggcgtgttcatgcccatcggtatcgtgctgcagccatggatgggatcagctgctatggccgcaagcagtgtgtcagtcgtcctgtcctctctgcaacttaaatgctacaagaagcccgatctggaaaggtatgaagcgcaggcacatggtcatatgaagcccttaaccgcgagtcaggttagtgtgcatatcggaatggacgatagatggcgggactctccccgtgcaaccccctgggaccaggtgtcatacgtgagccaggtgagcttgtctagcctgacctcagacaagcctagcaggcacagcgccgcagctgacgacgatggagacaaatggtctttgctcttgaacgggcgagacgaggagcagtacatc

SEQ ID NO: 7465 - DNA, 4395 bp, Artificial Sequence
  Description of Artificial Sequence: Synthetic coding sequence
atgcccgaacaggaacggcagattacagcaagagaaggagcctcaaggaagatactgtccaagctctccctgccaactagagcttgggagcctgccatgaagaagagctttgctttcgataacgttgggtacgaaggaggactggatggtctcggtccttctagtcaggtggcaacgagcactgtgcggatcctggggatgacgtgtcagagttgcgtaaagtcaatcgaggacaggatatccaacttgaaaggtattatctctatgaaggtctcacttgagcaagggtcagctaccgtcaagtatgtcccatccgttgtctgccttcagcaggtttgccaccagatcggagatatgggtttcgaggcatccattgctgaaggtaaggctgccagttggccctccagatccctcccagcacaagaggcagtggtcaagctgagagtggaggggatgacatgccaatcctgtgtctctagtattgaggggaaagtccggaagctccagggagttgtcagggtgaaggtgtccctgtctaaccaggaagcagtcatcacatatcagccttatctgatacagcctgaagatttgcgggatcatgtgaacgatatgggttttgaggccgcaattaagtctaaggtagctcccctgtcacttggccctatagatatcgaacgcctgcaatctaccaaccctaaacgacccctgtcctcagctaatcagaacttcaataacagtgagaccttgggtcaccagggttcccacgtggtgaccctgcagctgcgaatcgacggtatgcactgcaagagttgtgtgctgaacatcgaagagaatatcggccaactcctgggggtgcaatctatacaagttagcctcgagaacaagactgctcaggtcaagtatgacccgtcctgcacttcccccgtggctcttcagagagcaattgaagctctgccgcccggaaacttcaaagtttctctgcctgacggagcggaggggtccggtacagaccatcgcagttcatcttctcacagtccaggatcacccccgcgaaaccaggtgcaaggcacatgttccactaccttgattgctattgccgggatgacgtgtgcaagctgtgttcactctatcgagggcatgatctctcagttggagggtgtgcagcagatctccgtatccctggctgagggcacagccacggtgttgtacaatccctccgtgattagtccagaagaactgcgcgctgcgattgaggatatgggattcgaggcgagtgtggtgagcgaatcatgtagtacgaatcccctgggtaaccactctgcggggaattctatggtgcagaccaccgatggaacccctactagcgtccaggaggtggcacctcacacaggcagactgccggcgaatcacgcacccgatattctggctaagagtccgcagtctacaagagctgtagccccccagaaatgctttctgcaaatcaaaggaatgacttgtgccagctgcgtttccaatattgaacggaatttgcagaaggaagccggagttctctcagtgctggtcgcattgatggctggcaaggctgagatcaagtatgaccccgaggtgatccagccactcgaaatcgctcaatttatacaggaccttggatttgaggcggcagttatggaggactacgctggctcagacgggaacatcgagctgacaattacaggcatgacttgtgcctcctgtgtgcacaacatcgagagcaaacttactcgcactaatggaattacctatgcgagcgtggcacttgcaaccagtaaggccctggttaagttcgatcccgaaataatcgggcctcgggatattatcaaaatcattgaagagatcgggtttcatgcctcactggcacagaggaatcccaacgcccaccatctggaccacaagatggaaatcaaacaatggaaaaaatccttcttgtgctcacttgtgttcgggatccctgtgatggcattgatgatctatatgctgattccctccaatgagccccaccagtctatggtccttgaccacaacattattccgggtttgtctatcctcaatctgatcttcttcatcctctgcaccttcgtccaactgttgggaggatggtatttttatgtgcaggcttacaagagtctcagacacagatccgccaatatggacgtcttgatagtgttggccacaagtatagcctatgtgtactcactcgtcattctggttgtggcagtagcagagaaggccgagaggtccccagtcacgtttttcgatactcccccgatgctgtttgtgttcatagccttgggtagatggctggagcatttggctaagagcaagacgagcgaagccctggccaagctgatgagtctccaggctaccgaggcaactgttgtgactcttggagaagataatctgattattagggaagagcaggtgccaatggagttggtacagcgaggcgatatcgtcaaggtcgtacccggaggcaagttccccgtggacggtaaagtgctggaggggaatactatggccgacgagtctctgatcacgggggaagctatgcccgttacgaagaagccgggaagcactgtgatcgcaggctctattaacgcccatggttcagttctgattaaagccacacacgttgggaacgacaccacgcttgcccagatcgtcaaactcgtggaggaggcccagatgtcaaaagcccccattcagcagctggccgacaggttctccggatactttgtaccattcataatcataatgtctaccctgaccctggtcgtctggattgtcataggctttattgactttggcgtggtacagcgctactttcccaaccccaacaaacatatttcacagaccgaagtcataataaggtttgcattccagacatctatcaccgtgctgtgcattgcttgtccttgctcactgggcctggctaccccaactgcggtgatggtcggaacaggagtcgcggcacaaaacgggatcctgatcaagggaggcaaacccttggagatggcccataagatcaaaaccgttatgtttgataaaaccggtactattacccacggcgtaccacgggttatgagagttctgctgcttggggacgtggccaccctgcctcttcggaaggtgctggccgtcgtgggaaccgcggaagcttcctctgagcaccccctgggcgtcgccgtgacaaaatactgcaaagaagaactcggaacagagacactgggttattgcaccgacttccaggccgtgccgggctgcggaatcggctgtaaggtgtctaacgtggagggtattctcgcccatagtgagcggcctctctctgcgccagcgagtcatctgaatgaagctggtagccttccagccgaaaaagatgccgtgcctcagactttttcagtcctcatcggtaaccgagagtggctgaggagaaatggattgacgatctccagtgatgtttccgacgcaatgaccgaccacgagatgaagggacagaccgctatccttgtggcaatagatggtgtcctgtgcggaatgatagcaatcgcggatgccgtgaagcaggaggccgctctggccgtccacacgctgcagagcatgggagtagatgtagtgcttattaccggcgacaaccggaagaccgcacgcgcaatcgccacccaggtgggaattaataaggtgttcgcagaagtcctgccttctcacaaagtggcaaaggtacaggaacttcagaacaagggtaaaaaggtagcaatggtcggcgacggagtgaacgattcccctgctctggcacaggctgacatgggggtggcgatcggcactgggaccgacgtagcgatcgaggccgctgacgtcgtgttgatcagaaacgatcttctggatgtggtggcttccattcacctttctaagcggacagttcgccgcattcgaattaaccttgtgctcgccctgatctataacctggtcggaattccaattgccgctggtgtattcatgcctattggtatcgtactgcagccctggatgggatcagctgctatggccgctagttccgttagcgtggtcctgagcagcctccaattgaaatgctacaagaagccagacctggagcgatatgaagcacaggcccacggacatatgaagccacttacagcgtcacaggtgtccgtgcatatcggcatggacgacaggtggagagactcacctagagctacaccttgggatcaagtcagctatgtgtcccaggtcagtcttagcagccttacttctgacaaacccagtagacacagtgccgccgctgacgacgatggagacaaatggagtctgctcctcaatgggcgagacgaggagcagtacatt

SEQ ID NO: 7466 - DNA, 4395 bp, Artificial Sequence
  Description of Artificial Sequence: Synthetic coding sequence
atgccagagcaggagaggcagatcacagccagggagggcgcctcacggaaaattctcagcaagctctctctcccgacacgggcttgggagcctgcaatgaagaagagctttgcattcgataacgtgggatacgagggtggacttgatggcctagggcctagcagccaggtggccacatctaccgtgaggatcctggggatgacctgccagtcgtgtgtaaaatcaatagaggatcgaattagtaatctcaaagggattatatctatgaaagtgtccttggagcagggaagtgccacagttaagtatgtgccgtcagtggtgtgtttgcaacaggtgtgccatcaaattggtgacatgggcttcgaggcctcgattgccgaaggaaaggctgcctcctggccatccaggagcctgcctgctcaggaagccgtggtcaagctgcgtgtggagggcatgacatgccagtcctgtgtatcttctattgaaggcaaggtgaggaagctgcagggagtcgtaagggtaaaagtcagtttgtccaaccaggaggcagtgatcacttaccaaccgtacttgatccaacccgaggatctacgggatcacgtgaacgacatggggttcgaagccgccatcaagtctaaggtcgcacctctatccctcggacctatagacatcgaaagactgcagagtacgaaccccaagaggcctctgtctagtgcaaatcaaaattttaataactccgagacgctgggccatcagggatctcacgtggtaaccttgcagctacgaatagacggtatgcactgcaagtcctgcgtactgaatatcgaggagaacattgggcaattgctcggcgtccagtctattcaggtttccctcgagaacaagacggcccaagtgaaatacgatccctcatgtactagccctgttgccctacagcgggccatcgaggcgcttcctcccggcaacttcaaggtcagcctgccagatggtgcagaaggtagtgggacggatcatcggtcatcctcctctcactccccaggctcaccacctcgaaatcaggtacaggggacgtgtagcacgacacttatagccatagccgggatgacttgtgcttcatgcgtgcattccatcgaggggatgatcagtcaactggaaggcgtgcaacaaatctccgtctccctagctgaaggcacggcgacagtactgtataatcccagtgtaatctcaccagaagaactcagggctgctattgaagatatgggttttgaagcaagtgtggtgagcgaatcttgttctacaaacccgctcgggaatcatagcgctggcaatagtatggtccaaaccactgatggaacgccaaccagtgtgcaagaggtagccccgcacactggccgcctgcctgccaaccacgccccggatatattggcgaagagtccacagtccacgagggctgtggctccacagaaatgcttcttgcaaatcaagggaatgacctgtgcctcttgtgtgtctaatatcgaacggaacctccagaaagaagccggggtcctctccgtgcttgtagcactcatggccgggaaggcggaaataaagtacgaccccgaggtgatccagcccttggagatcgcacagttcatccaggatttaggatttgaagccgcagttatggaggattatgctggaagtgatggcaacattgaactcacaatcactgggatgacttgtgcctcatgcgtgcacaatattgaatccaaactgacgaggacaaacgggatcacctacgctagtgttgccttagcaacatctaaagcactcgttaaatttgacccagagataatcgggcctagggatataatcaagatcatcgaagagatcggcttccatgcgtctctagcccagcgcaatccaaatgctcaccatttagatcacaaaatggagatcaagcagtggaagaaaagcttcctgtgcagtcttgtatttggaatccccgtgatggccctcatgatatatatgctgatccctagcaatgagccacatcagagcatggtacttgatcacaatatcatccctggcctgtcaattctgaacttgatattttttatcttgtgcacatttgtgcagctactgggaggttggtacttttacgtgcaggcctataagtccctgcggcaccggagtgctaacatggacgttctgattgtactcgcgaccagtatcgcctacgtgtactcccttgtcattctggtggttgcggtagcagaaaaggcggaacgtagccctgtgacattcttcgatacccccccaatgctttttgtgttcatcgcactagggaggtggttggaacacctggcgaaaagtaagacaagtgaggcacttgccaaactcatgtctttgcaggcaactgaagccaccgtggtaactctcggggaggacaacctgatcatcagggaggagcaggtaccaatggaactggttcagagaggggatattgtcaaggtcgtgcctggagggaagttccccgtggacggcaaagtgctggaaggaaatacaatggccgatgagagtctgatcactggagaggctatgccagtgacaaagaaacctggttccacagtcatcgccgggtccatcaacgcccatggctcagtgctgataaaggccactcatgtcggaaacgatactactctcgctcaaattgtcaagctcgtggaggaggctcagatgagcaaggctcccatccaacagttggcagatcgattctccgggtactttgttccttttatcattataatgtcaactctgactcttgtggtatggatcgtgatcggtttcattgacttcggagttgtacagagatacttccccaacccaaacaagcacatctctcagactgaggtgattattcggtttgcatttcaaacaagcatcaccgtgctttgcatcgcctgcccctgcagcctgggtcttgcaactccaaccgccgtgatggtgggcaccggagtggccgcacagaatggcattctcattaaaggcgggaagccactggaaatggctcataagatcaagacagtcatgttcgacaaaacaggcacaatcacgcatggagtcccgcgagttatgcgtgtgctgctcttgggggacgtcgccacattgcctctgaggaaagtgctggcggtcgtgggcactgcagaggcttcatccgaacatcccttaggagtggctgtgaccaagtattgcaaagaggagcttgggactgagacattggggtattgcacagacttccaggcagtcccgggatgcggaataggttgcaaggtgtccaacgtggaaggaattctggcgcatagcgagaggcctttgagtgcgccagcctctcacttgaatgaggccggaagcctgcctgctgagaaggacgctgtcccccagacctttagtgtgctcataggtaacagggagtggctccggcgcaatggtttgactatatcttctgacgtgtccgatgccatgaccgaccacgagatgaagggccagactgctattttagttgcgattgacggagtcctatgcggaatgattgccatcgctgatgccgtgaagcaggaggccgcgctggccgtgcacactttacagagcatgggggtcgatgtcgtgctgatcacaggggataacagaaaaacagcgcgggccatagcaacccaggtgggaattaataaggtcttcgcagaagtattgcccagtcataaggttgctaaagtgcaggaattgcagaacaaaggcaagaaggttgccatggtcggggacggcgttaacgatagtcctgcgctggcgcaggctgacatgggggtggccattggcaccgggaccgacgtggccatcgaagcggcagacgtggtgttaatacggaatgatttgctggacgtcgtcgcgtccattcacttgtccaagcgtacagtgaggcgaatcagaattaatctggtcttggccttgatttacaatcttgtggggattcctatagctgcgggtgtcttcatgcccatcgggattgtcttgcagccgtggatggggtccgcagcaatggcagcatctagcgtgtctgtggtgctgagctctctgcaactaaaatgctacaaaaaacccgatctggagagatacgaggcacaagctcacggtcacatgaagccactgactgcttcacaggtgtccgtccatattggcatggacgaccgctggcgcgattcaccacgcgcaacgccctgggaccaggtgtcttacgtgagccaagtttccctatcttcactgacatctgataagccttccaggcatagcgcagctgcagacgacgatggggacaaatggtccctgctgcttaacggccgcgatgaagagcagtacata

SEQ ID NO: 7467 - DNA, 4395 bp, Artificial Sequence
  Description of Artificial Sequence: Synthetic coding sequence
atgccagagcaggagagacagatcaccgcccgcgaaggagcctctcggaagatcctctcgaagctgagcctccccactagggcgtgggagcccgctatgaagaagagcttcgccttcgataatgtcggctatgagggcggactggacggcctcggaccaagtagccaggtggctaccagcaccgtcagaatacttggaatgacttgccagtcatgcgtgaagtccatcgaggatcggatcagtaacctgaaggggattattagcatgaaagtctcactagagcaggggtcagcaaccgtgaaatatgtccccagtgtcgtgtgtctgcagcaagtgtgtcatcagatcggagatatgggattcgaggctagcatcgcagagggcaaagccgcaagctggccctctagaagtttgcccgcgcaggaggcagttgtcaaattgcgcgtcgagggcatgacgtgccagtcatgcgtctcctctatagaaggcaaggtcagaaaacttcagggggtggtgcgggttaaggtaagtttgagcaaccaggaagcagtaatcacataccagccttatctgatacagccagaggatctgcgcgatcacgtgaatgatatgggattcgaggccgcaatcaaatccaaagtggccccgctgtcactgggacctatagatatagagagactccaatccactaaccctaaacggcctttgtccagcgcaaatcagaacttcaacaattcagagaccctgggccaccaggggagccacgtggtcaccctacagctcagaatcgacggcatgcactgtaaaagctgtgtgctaaacattgaggagaacatcgggcaacttctgggggttcaaagcatacaggtgtctctggaaaataaaacagctcaggtgaaatacgaccccagttgtacctctcctgtcgccttacagcgtgctatcgaagctctccccccaggcaacttcaaggtgtctctccccgacggggctgagggctcaggcactgaccatcgcagttcgtcctctcatagtcccggctcacctccacgcaaccaagtgcagggaacctgttctaccacgctgattgctatcgctggcatgacctgcgccagttgtgtccactcgatcgaaggcatgatctctcaattggagggggtgcaacagatatcagtgagccttgcagagggtactgcaacagtgctgtacaatccgtccgtgattagtcccgaggagctgagggccgctattgaagacatggggttcgaggcaagcgttgtgtccgagtcctgttccaccaatccgctgggcaaccactccgctggcaacagtatggtgcagactaccgacgggactcctaccagcgtgcaggaggtggctcctcacaccggccgcctgccagctaatcacgctccggacatcctcgcaaaatcaccccagagtacccgagccgtggcgccacaaaagtgcttcttacagatcaaagggatgacctgtgcctcttgcgtctctaatatcgaacgaaacttacagaaggaggctggagtgctctcagtactggtggccctgatggctggcaaggcggaaattaaatatgatcctgaggtaattcagcccctggagattgctcaattcattcaggacttggggtttgaggcggctgtaatggaagactatgccggctctgacggaaacattgagttgactataacgggaatgacatgcgcctcatgtgtccacaacatcgagtccaagctgacacggacaaacggcataacatatgctagcgtggctttggctacatctaaggccctcgtgaaatttgatcccgaaattataggcccaagagatattatcaagatcatcgaggagatcggtttccatgcaagcctggctcagagaaatcctaacgcccatcacctggaccacaagatggagattaagcagtggaagaagtcgttcctgtgcagcttggtgtttggcattccagtcatggccctgatgatttacatgctgatcccctcgaatgagccccaccaaagcatggtcctggaccacaatattatcccaggtctatctatattgaacctgatcttttttattttatgtacctttgtgcagcttctcggcgggtggtatttctatgttcaagcctataagtctttacggcacaggtctgctaatatggacgttctgatcgtactggctacctctattgcatacgtttatagcctggtgattttggttgtggccgtggccgaaaaggcagaacgatcccctgtgacattttttgacacaccacccatgttgttcgtgttcattgctctgggcagatggctggaacacttagcaaagagtaaaacctctgaagctcttgcaaagttgatgagtctgcaggctacagaggccaccgtcgttacactgggtgaagacaacttgattatccgcgaggaacaggtgcccatggagttggtccagagaggcgatattgtcaaagtggtgcccggagggaagtttcctgtagatggcaaagtgttggagggcaacacaatggccgatgagtctttaatcactggagaggctatgcccgtgactaaaaagccggggtctaccgtgatagcaggaagtatcaacgcccacggaagtgttctcataaaggcgactcacgtcgggaatgatacgacattagcccagatagtcaagttggtagaagaggctcaaatgtctaaggcacctatccaacagctggccgatcgcttttctgggtatttcgtgccattcatcatcatcatgtccactctgacactggtggtgtggattgtgattggctttatagactttggagtggttcagcggtactttcccaatccaaataaacatatctcgcagaccgaggtgatcattaggttcgcctttcagacctccatcaccgttctctgcattgcctgtccgtgctcgctcggactggcaacgcccacggccgtgatggtgggaactggcgtcgctgcccagaacggcatcctgatcaagggtggaaagcctcttgaaatggcgcacaaaattaagacggtgatgttcgacaagacaggtacgattacacatggggtgccaagagtgatgcgggtgctgctactcggagacgtggccactcttcctctgcggaaagtactggcggttgtcgggaccgctgaggctagttcagaacatcccctgggcgtggccgtgaccaaatactgtaaagaagagttgggcacagaaacattgggctactgcacggacttccaggcagtgcccggatgtgggattgggtgtaaggtaagcaacgtggaaggtatactagcccacagcgagagacctttaagcgctccagcatcacatcttaatgaagccggctcactcccagccgaaaaggacgctgtcccccagacctttagtgtgctcatcggcaacagggaatggctgcggcggaacggcttgacaatctcctctgatgtcagcgatgcgatgactgaccacgaaatgaagggacagaccgcaatactggtcgccatcgatggcgttttgtgtggcatgatcgctatcgccgatgccgtgaaacaggaagccgctctggcagtgcatactttacaatccatgggggtggatgtcgtgctcatcacgggcgacaacaggaagactgccagagccatcgcaactcaggtaggaatcaataaggtcttcgccgaagttctaccttcccataaagtggccaaggttcaggagctccagaataaaggcaagaaggtggctatggtaggagacggggtgaatgattctcccgccctcgctcaggcagacatgggcgtggcgattggaaccggaaccgatgttgctattgaagctgctgacgtggtgctgatcaggaatgatctgctcgatgtggttgcctcaattcatttgagtaagcggacagttaggcgtatccgcatcaacttggttttggccttgatctacaacttagtaggcatcccgatcgcggcaggagtttttatgcctatagggatcgtgctccagccttggatgggctcagccgcaatggccgcctccagcgtttctgttgtgctcagtagcctacagctgaagtgctacaaaaagcctgatctggaaagatacgaagcacaagcccatggccatatgaagcctcttacagcatcgcaggtctctgtacatattggaatggatgacagatggcgtgattcgcccagggccaccccgtgggaccaggtctcgtatgtgagtcaggtaagtctgagcagtctgacctccgacaaaccttcaagacactctgccgctgccgatgacgacggggataaatggtctctccttctgaacggcagggatgaagagcagtacatc

SEQ ID NO: 7468 - DNA, 4395 bp, Artificial Sequence
  Description of Artificial Sequence: Synthetic coding sequence
atgcctgagcaagagcgccaaatcaccgccagggagggggcttcccggaagatcttgtctaaattgtccttgcccacccgggcttgggaacccgctatgaagaagagctttgccttcgacaacgtgggctatgagggtggcctggatggactaggtcccagttcccaagtggccacttccactgtccgaatcttgggcatgacctgccagtcttgtgtaaaatccattgaagatcggatcagtaacttaaaaggaatcatttccatgaaggtgtctttggagcagggcagtgccaccgtgaagtacgttcccagcgtggtctgcctgcagcaggtgtgccatcagatcggggatatggggtttgaggcttcaattgccgagggcaaggcagcatcatggccaagcagaagcctgccagcacaggaggcggtggtcaaactccgtgtcgaaggcatgacatgccagagctgcgtttctagcatcgagggcaaggtacggaaactgcagggcgtggtcagagtgaaagttagccttagtaaccaggaagctgtgattacctaccagccttatctcatacagcccgaggacttgagggaccacgttaatgatatgggttttgaggccgctattaagagcaaggtggccccactgagccttggccccatcgacatcgagcgcctgcagagcaccaaccctaaaaggcccctgtcttcagcgaaccagaatttcaataacagcgagaccctggggcatcagggctctcacgttgtcacactccaattgaggatcgatgggatgcactgtaagtcctgtgttcttaatattgaagagaatattgggcagctcctaggggtgcagtcaattcaagtgtctctggaaaacaagaccgcccaagtcaagtacgatccgtcctgtactagccccgtggccttgcaacgcgcaatcgaggcactgcctccaggaaattttaaagtctccctacccgacggagcagaggggtccggaaccgaccataggagctccagttctcattctcccggctcacccccacgaaatcaggtgcaggggacctgctctacgacactgattgccattgccggtatgacctgtgcctcgtgtgttcacagcatcgaagggatgatctcccaattggagggggtccaacagataagcgtgtctttggccgagggcacagctaccgtcctttacaaccccagtgtgataagcccagaagagctgcgagccgccatcgaagatatgggatttgaggccagcgtagtgtccgaaagctgtagcacaaaccctcttgggaatcacagcgccgggaatagcatggtccagacaacagacggcacccctacttccgtgcaggaggtagcccctcacaccggcagattgccagcaaaccacgcccctgacatacttgctaagtctccgcagtctacccgggccgtggccccccaaaaatgctttctgcagatcaaaggcatgacatgcgcttcctgcgtctctaatatagagagaaacctacagaaggaggccggtgttttgagtgtattggtggctttgatggccgggaaagctgaaattaaatatgacccggaggtgatccagccacttgagatagcccaatttattcaggacctgggcttcgaagccgccgtgatggaagattacgctggcagtgacggcaatattgaactcacaatcacagggatgacatgtgcaagctgtgtccataacatcgaatcaaaactgacaaggaccaacggcattacctatgcctctgtcgcactagccacctccaaggcgctagtaaagttcgacccagaaattattggccccagagatattataaaaattatcgaagagatcggttttcacgcctccttagcccagcgcaacccgaacgcccaccacctagaccacaaaatggaaatcaagcagtggaagaaatcatttctgtgtagcctcgtgtttggcatcccggtaatggctctcatgatttacatgttaatcccttctaacgaaccccaccagagcatggtgctcgaccacaatattattcctggcctcagcattttgaacttgatttttttcatcctgtgtacctttgttcagctgctggggggatggtatttctatgtccaagcatacaagagtctgcgtcaccggtcagccaatatggacgtgctaatagtcctggccaccagtatagcttacgtgtacagcctcgtgatcctggtggtcgcagtcgcagagaaggccgaaaggagtcctgtgacattcttcgataccccccccatgctctttgtgttcattgcactggggaggtggcttgaacacctggccaagtctaaaactagcgaggccctggcaaaactgatgtctctacaggctaccgaggctaccgtagtcacgttaggggaagacaacctcataatccgggaagaacaggtacctatggaactggttcagcggggtgacattgtcaaagtcgtacccggcggaaaattccctgtggacggcaaagtgcttgaggggaatacaatggctgacgaaagcttgataaccggcgaggcgatgccagttacgaagaaacccgggagcacggtgattgcagggagcatcaacgcccacggtagcgtcctgattaaggctacacacgtgggcaacgataccacactcgctcagattgttaagttagttgaagaggcccagatgtcaaaggcgcctattcagcagctggcagatcgcttcagcggatatttcgtcccttttatcattatcatgagtacgctcaccctggtggtttggattgtcatcggttttattgacttcggtgtagtgcagcgttatttccccaacccgaataagcacatctctcagacagaagtgatcatcagattcgctttccagaccagtatcaccgtcctttgcatcgcctgcccatgtagtttgggcctggccacccccactgccgtgatggtcggtactggagttgctgcccagaatggcattctgatcaagggcgggaagccgctcgaaatggcacataaaattaagaccgtgatgttcgacaagaccggcacaataactcatggggtcccacgtgtgatgagggttctactgttgggcgacgtagctaccttgccactgcgcaaagtgctggcagttgttggcacagcagaggcatcttccgagcacccgttgggggttgcggtgactaagtattgcaaggaggagctgggaacggaaacactaggatactgcacggacttccaggctgtgccaggctgtggcatcggctgcaaggtgtcaaatgtggaggggattcttgcgcactccgaacgccctctgagtgccccagcgagccacctgaacgaagctgggtctcttccagccgaaaaagacgccgtgccacagacctttagtgtcctgatcggcaaccgggagtggttacggcgaaatggtctcaccatcagtagtgatgtgtccgatgccatgacagatcacgagatgaaaggccagaccgctatactcgtcgctatagacggcgtcctatgcggcatgatcgctatcgctgacgcggtgaaacaagaggcagccctcgccgtgcatactctacagtctatgggcgtggacgtggtgctgatcacaggcgataacaggaagactgctagagcaatcgctactcaggtgggcatcaataaggtatttgcggaagtactgccatctcataaggtggcaaaggtgcaggaactccagaataaaggcaaaaaggtcgccatggttggagacggagtgaatgacagccccgcactggctcaagccgacatgggagtggccatagggactgggacggacgtagccattgaggccgccgacgtggttctgattaggaacgatctgctcgacgtggtggcgtcaatccatctatcaaagagaaccgtgaggcgtattcggatcaacctggtgttagccctgatctataacctcgtaggcatacccattgccgccggtgtgtttatgccaatagggatagtacttcagccttggatgggaagtgctgcgatggcagccagctccgtgtctgtggtgctgtcatccctccagctgaaatgttataaaaagcctgatcttgagcggtatgaagcgcaggcacatggacatatgaagccactgaccgcttcacaggtctcggtgcacatcggcatggacgaccggtggagagatagcccacgggcgacaccatgggatcaggtgtcttatgtgtcgcaggtctccttatcgagtttaactagtgataagccgtctcgccactctgccgccgccgatgatgacggtgataagtggtctcttctgttaaatggtagagatgaagaacaatacatt

SEQ ID NO: 7469 - DNA, 4395 bp, Artificial Sequence
  Description of Artificial Sequence: Synthetic coding sequence
atgcccgagcaagagaggcagatcactgctcgtgagggcgcttctcggaagatactcagcaagctgtctttgccaacccgcgcctgggaaccagccatgaaaaaaagctttgcatttgacaacgtgggatatgaggggggactcgatggactcggcccatctagccaggtggccacctcaacagttaggatcttaggcatgacctgccaatcctgtgtaaaatctatagaagatcggatatccaacctcaaaggcatcatcagcatgaaggtgtccttagagcagggcagcgctaccgtgaagtacgttccatctgtcgtgtgtctccagcaggtgtgtcaccagattggagacatggggtttgaggcttctatagctgaaggcaaagctgcaagctggccaagcaggtcactgccagctcaggaggctgttgtgaaactcagagttgaggggatgacttgtcaaagttgcgtcagctccatagaaggcaaggtgcgaaagctgcagggagtggtgagagtaaaggtctccctcagcaaccaagaagcagtgatcacctaccaaccatatctgatccagcccgaagacttacgggaccatgtgaatgatatgggatttgaggcagcaatcaagagtaaagtggcccctctcagcctcgggccaatcgatatcgaacggttgcagtccaccaaccccaagaggcccctcagcagcgccaaccagaactttaacaacagtgagactctagggcaccagggctcacatgtggtgaccctgcagttacgaatcgacgggatgcactgtaagtcttgtgtgttgaacattgaagagaacattggtcaactgcttggcgtgcaatctatccaggtgagtctagagaacaagacagcccaggttaagtatgatccatcatgcacatccccagtcgccctgcagcgggccattgaggcacttcccccaggtaactttaaggtcagcctgccggatggcgctgaaggctctggcaccgaccatcggagtagctcctcccacagtccaggatctcctcctagaaaccaggtgcagggcacctgcagcaccacccttatagctatcgcaggcatgacctgcgcctcctgcgtgcactccatagaggggatgatttcccagttggagggcgttcagcaaatatctgtgagtttagctgaaggaaccgccacagttctgtataacccctccgtgatctcccctgaggaacttcgtgctgcaattgaagatatgggctttgaagcctctgtcgtgtcagaatcttgttctaccaatccactggggaaccacagtgccggaaacagcatggttcaaacaaccgacggtactcctacatccgtgcaagaggttgcaccacatactgggcgcctgcctgccaaccacgctcccgatatcttagccaagtcccctcagtcaactcgagccgtcgctccacagaagtgtttcctgcagatcaaagggatgacctgtgccagctgcgtgtctaacatagagagaaacctccagaaagaagctggcgtcctatctgtcctggttgctttgatggccggcaaggctgaaattaaatacgaccccgaggtgattcaacctctagaaattgctcagttcatccaggacctcggctttgaggctgctgtgatggaggattatgctggttctgacggtaatatagaattaaccataactggcatgacctgtgcatcttgcgtgcacaacatagagtccaagctcacccggaccaatgggattacttatgctagcgtggctctcgccacatccaaagctcttgttaaattcgatcctgagataattggccccagagatatcataaaaatcattgaggagatcgggttccacgcatcattagcacagcgcaaccccaacgcccatcacctggaccataaaatggaaatcaaacagtggaagaagtcctttctgtgctccctggttttcggaataccagtgatggctctgatgatctatatgctgataccttccaacgaaccccatcagagcatggtgctggaccacaatattataccaggcctgtcaatactgaatctaatattcttcatcctgtgcacatttgttcaacttctgggcgggtggtatttttacgttcaggcctacaaatcattaaggcatagatccgctaacatggacgtcctgattgttctcgctacatctatagcttacgtctatagtctggttatcctagttgttgctgtggcagaaaaggccgagcgctcccccgtcaccttctttgatacccctcctatgctattcgttttcatagcactgggcaggtggctcgagcatctcgccaaaagcaagaccagtgaagccctcgccaaactgatgtctctgcaggccaccgaggccacagtggtgaccttaggtgaagataatctgattatcagagaagagcaggtgcctatggagctggtgcaacggggtgacatcgttaaggtagtgccaggtggtaaatttcccgtggacggcaaagtgctggagggcaacactatggccgatgaatcactcataaccggcgaagctatgcccgtgactaagaaacctggctctaccgtaattgccggcagcattaacgcacacggctctgtcctcataaaggcaacccacgtgggtaatgataccaccctcgcccagatcgttaagctagtcgaagaagcccaaatgtccaaggcccccatacaacagctggctgatcgcttcagcggctactttgtgccatttatcattattatgagcaccctgacactggtggtgtggattgttataggttttatcgattttggtgttgtgcagcggtacttcccaaatcctaacaaacacatctcccagactgaggtaattattcgctttgcattccagacctccatcacagttctgtgcatagcttgtccttgtagcctggggctggccacccctaccgcagtcatggtgggcactggggttgccgcacagaacggtattctgatcaagggtggcaaaccactcgagatggcccataagattaagacagttatgtttgacaaaactggaacaataactcatggagtccctagggtgatgcgcgtgctcctcctgggggacgtggctacccttccccttaggaaggtgttagctgtggtgggtaccgccgaagccagctctgaacatcccctcggcgtggccgtgaccaaatattgcaaagaggaactggggaccgagacactggggtattgtaccgacttccaggcagttccaggctgcggcatcgggtgcaaagtgtctaatgtggaaggcattctggcacactctgaacggcctttaagtgctcctgccagccacttaaacgaggctggatcactgccagccgaaaaagacgccgttccccagacttttagcgtcctgattggaaaccgcgagtggctgcgccggaatggcctgactataagctctgatgtgagcgacgctatgaccgatcacgaaatgaagggccaaaccgctatcctggtggcaattgacggagtgctgtgcgggatgatcgctattgctgatgccgtgaagcaggaagccgccctcgctgttcatactctgcagtctatgggtgtggacgtggtgttaatcacaggcgataacagaaagaccgcacgggcaattgctacccaggtgggaatcaataaagtatttgccgaagtcttacctagccacaaggtcgcaaaggttcaagaactgcagaataaggggaaaaaggtggctatggtgggcgatggcgtgaatgactctcccgcactcgcacaagccgacatgggtgtggcaatcgggaccggcaccgacgtggctattgaggctgcagatgtggtattaattcggaacgacctactggatgtggtggccagcatccaccttagcaagagaaccgtacgtaggatccggatcaacctggtgcttgcactgatctataacctagtcggtattccaattgctgccggagtctttatgccaatcggtatagtgttgcagccatggatgggtagtgcagccatggccgcctcttcagtgagtgtggtgttgtcctccctgcagctgaaatgttacaaaaaacctgatttggagcgttatgaggcccaggcacacggccatatgaagcctctcacagccagccaggtgagcgttcatattggaatggacgacaggtggagagactcaccacgggcaactccttgggaccaagtcagctacgtttcacaggtgagcctgagcagcctgacctctgataaaccatctagacatagcgccgccgcagatgacgacggcgacaagtggtccctgctgctgaacggtagagatgaggagcagtacatt

SEQ ID NO: 7470 - DNA, 4395 bp, Artificial Sequence
  Description of Artificial Sequence: Synthetic coding sequence
atgccggaacaagaacgtcaaataacggcgcgagaaggtgcgtcgcgtaaaatattatcgaaattatcgttaccgacgcgagcgtgggaaccggcgatgaaaaaatcgtttgcgtttgataatgtaggttatgaaggtggtttagatggtctaggtccgtcgtcgcaagttgcgacgtcgacggttcgtatattaggtatgacgtgtcaatcgtgtgttaaatcgatagaagatcgtatatcgaatttaaaaggtataatatcgatgaaagtatcgctagaacaaggttcggcgacggttaaatatgtaccgtcggtagtttgtttacaacaagtatgtcatcaaataggtgatatgggttttgaagcgtcgatagcggaaggtaaagcggcgtcgtggccgtcgcgatcgctaccggcgcaagaagcggttgtaaaactacgtgttgaaggtatgacgtgtcaatcgtgtgtatcgtcgatagaaggtaaagtacgtaaactacaaggtgttgtacgagtaaaagtatcgctatcgaatcaagaagcggtaataacgtatcaaccgtatctaatacaaccggaagatttacgtgatcatgtaaatgatatgggttttgaagcggcgataaaatcgaaagtagcgccgctatcgttaggtccgatagatatagaacgtttacaatcgacgaatccgaaacgaccgttatcgtcggcgaatcaaaattttaataattcggaaacgctaggtcatcaaggttcgcatgtagtaacgttacaattacgaatagatggtatgcattgtaaatcgtgtgtactaaatatagaagaaaatataggtcaactattaggtgtacaatcgatacaagtatcgctagaaaataaaacggcgcaagtaaaatatgatccgtcgtgtacgtcgccggtagcgctacaacgagcgatagaagcgttaccgccgggtaattttaaagtatcgttaccggatggtgcggaaggttcgggtacggatcatcgttcgtcgtcgtcgcattcgccgggttcgccgccgcgaaatcaagtacaaggtacgtgttcgacgacgttaatagcgatagcgggtatgacgtgtgcgtcgtgtgtacattcgatagaaggtatgatatcgcaactagaaggtgtacaacaaatatcggtttcgttagcggaaggtacggcgacggtactatataatccgtcggtaatatcgccggaagaattacgtgcggcgatagaagatatgggttttgaagcgtcggttgtttcggaatcgtgttcgacgaatccgctaggtaatcattcggcgggtaattcgatggtacaaacgacggatggtacgccgacgtcggttcaagaagttgcgccgcatacgggtcgtttaccggcgaatcatgcgccggatatattagcgaaatcgccgcaatcgacgcgtgcggttgcgccgcaaaaatgttttttacaaataaaaggtatgacgtgtgcgtcgtgtgtatcgaatatagaacgaaatttacaaaaagaagcgggtgttttatcggttctagttgcgctaatggcgggtaaagcggaaataaaatatgatccggaagtaatacaaccgctagaaatagcgcaatttatacaagatttaggttttgaagcggcggtaatggaagattatgcgggttcggatggtaatatagaactaacgataacgggtatgacgtgtgcgtcgtgtgttcataatatagaatcgaaattaacgcgaacgaatggtataacgtatgcgtcggtagcgttagcgacgtcgaaagcgctagtaaaatttgatccggaaataataggtccgcgagatataataaaaataatagaagaaataggttttcatgcgtcgctagcgcaacgtaatccgaatgcgcatcatttagatcataaaatggaaataaaacaatggaaaaaatcgtttttatgttcgttagtatttggtataccggttatggcgctaatgatatatatgttaataccgtcgaatgaaccgcatcaatcgatggtattagatcataatataataccgggtctatcgatattaaatctaatattttttatactatgtacgtttgtacaattactaggtggttggtatttttatgtacaagcgtataaatcgctacgacatcgttcggcgaatatggatgtattaatagtattagcgacgtcgatagcgtatgtatattcgttagtaatattagttgtagcggtagcggaaaaagcggaacgatcgccggtaacgttttttgatacgccgccgatgttatttgtatttatagcgctaggtcgatggttagaacatttagcgaaatcgaaaacgtcggaagcgttagcgaaattaatgtcgctacaagcgacggaagcgacggttgtaacgttaggtgaagataatttaataatacgtgaagaacaagtaccgatggaattagtacaacgaggtgatatagtaaaagtagtaccgggtggtaaatttccggtagatggtaaagtattagaaggtaatacgatggcggatgaatcgttaataacgggtgaagcgatgccggtaacgaaaaaaccgggttcgacggttatagcgggttcgataaatgcgcatggttcggtattaataaaagcgacgcatgttggtaatgatacgacgttagcgcaaatagtaaaattagttgaagaagcgcaaatgtcgaaagcgccgatacaacaattagcggatcgattttcgggttattttgtaccgtttataataataatgtcgacgctaacgttagtagtatggatagtaataggttttatagattttggtgttgtacaacgatattttccgaatccgaataaacatatatcgcaaacggaagtaataatacgttttgcgtttcaaacgtcgataacggttctatgtatagcgtgtccgtgttcgttaggtttagcgacgccgacggcggtaatggttggtacgggtgttgcggcgcaaaatggtatattaataaaaggtggtaaaccgttagaaatggcgcataaaataaaaacggtaatgtttgataaaacgggtacgataacgcatggtgttccgcgtgttatgcgtgtattactattaggtgatgttgcgacgctaccgctacgtaaagttttagcggttgtaggtacggcggaagcgtcgtcggaacatccgctaggtgttgcggttacgaaatattgtaaagaagaactaggtacggaaacgctaggttattgtacggattttcaagcggtaccgggttgtggtataggttgtaaagtatcgaatgttgaaggtatactagcgcattcggaacgtccgctatcggcgccggcgtcgcatctaaatgaagcgggttcgctaccggcggaaaaagatgcggtaccgcaaacgttttcggttttaataggtaatcgagaatggttacgtcgaaatggtctaacgatatcgtcggatgtatcggatgcgatgacggatcatgaaatgaaaggtcaaacggcgatactagtagcgatagatggtgtactatgtggtatgatagcgatagcggatgcggtaaaacaagaagcggcgctagcggttcatacgctacaatcgatgggtgtagatgttgtattaataacgggtgataatcgaaaaacggcgcgtgcgatagcgacgcaagtaggtataaataaagtttttgcggaagttctaccgtcgcataaagttgcgaaagttcaagaattacaaaataaaggtaaaaaagttgcgatggttggtgatggtgttaatgattcgccggcgttagcgcaagcggatatgggtgtagcgataggtacgggtacggatgtagcgatagaagcggcggatgtagttttaatacgtaatgatttattagatgtagtagcgtcgatacatctatcgaaacgaacggtacgtcgtatacgtataaatttagttttagcgttaatatataatctagtaggtataccgatagcggcgggtgtttttatgccgataggtatagtactacaaccgtggatgggttcggcggcgatggcggcgtcgtcggtatcggtagtactatcgtcgttacaactaaaatgttataaaaaaccggatttagaacgttatgaagcgcaagcgcatggtcatatgaaaccgttaacggcgtcgcaagtatcggtacatataggtatggatgatcgatggcgtgattcgccgcgtgcgacgccgtgggatcaagtatcgtatgtatcgcaagtttcgttatcgtcgttaacgtcggataaaccgtcgcgacattcggcggcggcggatgatgatggtgataaatggtcgttattattaaatggtcgtgatgaagaacaatatata

SEQ ID NO: 7471 - DNA, 4395 bp, Artificial Sequence
  Description of Artificial Sequence: Synthetic coding sequence
atgccagaacaggagcgacaaattaccgctcgcgaaggagcttcccgtaagattctttcaaagttatcactacctactagggcatgggaaccagctatgaaaaagagtttcgcattcgataacgttggttatgaaggtggactggacggattgggtccatcatctcaagtagccacttcaaccgtgagaattctcggcatgacctgccaaagctgtgttaagtcgattgaggatcgtatttctaatttaaagggaattatatctatgaaggtcagcctggaacaggggtcagcaaccgtgaagtatgttccaagtgttgtttgtttgcagcaggtgtgtcatcaaatcggagacatggggttcgaagctagtattgcagagggtaaggctgcttcttggccatccaggtcattacccgctcaagaagctgtggttaaactccgggttgaggggatgacctgtcagtcttgtgttagctctattgaaggtaaagtcaggaaacttcagggggtcgttcgtgtaaaagtcagcttgtctaatcaggaggcggtcattacttatcagccgtacctcattcaacctgaagacctcagggatcatgttaatgatatgggatttgaggccgcaattaaatcgaaggtcgcacccctaagccttgggcctattgatatcgagagacttcaatctaccaatcctaagcgccctctgtcctcagccaaccagaattttaacaactctgagacacttggacatcaggggagtcatgtcgtgaccttacaattgcgtattgacggaatgcattgtaagagttgtgtattgaacattgaggaaaatattggtcagctcttgggggtgcagtcaatccaggtgtcgttagagaacaaaactgcacaagtcaaatatgatccatcgtgtacatcacctgttgctcttcaaagagcaatcgaggcactcccacctggtaacttcaaggtcagccttcctgacggcgctgaaggttcgggcaccgatcatcgatcatcttcgtcacacagccctggtagccctcctagaaatcaagttcaaggaacatgtagtactacattgatagctattgccggaatgacatgcgcatcttgtgttcacagcattgagggaatgatctcccaactcgaaggagttcagcagatttctgtgtcgcttgccgagggtacagcaactgtgttgtacaatcctagtgttatttctcctgaagaacttagggcagctatagaagatatgggtttcgaggcttccgtagtctcagagagctgtagcacaaatccactgggtaaccacagcgcaggaaattctatggttcagacaacagacggtactcctacttcagtacaggaagtcgcaccacataccggtcgacttcctgctaaccatgctccagacatactcgctaaatctccgcagtcgacacgagccgtagcgccacaaaagtgctttctgcagataaaggggatgacgtgtgcttcctgcgtctcaaatattgaaagaaacctgcagaaggaggcgggggtgctatctgtcctagttgcccttatggccggtaaggctgagatcaaatatgatcctgaagtcattcaaccactcgagatcgcccagtttattcaagaccttgggtttgaagcagctgtcatggaggattatgcgggatctgatggaaatattgagttaaccattaccggcatgacatgcgcatcctgtgttcataacatcgagagcaagctgactcgtacgaatggtataacgtatgcaagtgttgctctagccacttccaaggcccttgtaaagttcgacccggagattatcggtccaagggatataattaagataatagaagaaattggtttccatgcttctttagctcaaagaaatcctaatgctcaccacctcgaccataagatggaaatcaagcagtggaaaaaaagcttcttatgttcccttgtgttcggcatacctgttatggctctcatgatttatatgcttattccttccaacgaaccgcaccagtcgatggttctcgatcacaacataatacctgggctttcaatacttaatcttatcttttttatcctctgcacctttgtacagttacttggaggttggtatttctacgtccaagcttacaagagtttgaggcaccgtagcgctaacatggatgtgttgatcgtacttgccacgtcaattgcttatgtttattcactggtaattctagtagtcgcggttgcagagaaagcagaaaggtctcctgtcacattctttgatacacctcccatgctgttcgtgtttattgcccttggtaggtggttagaacatctggctaagtctaaaacgagtgaggcactggctaagctcatgtctttgcaggcaacggaggccacggtggtcacccttggtgaggataaccttataataagagaagagcaggtgccaatggaacttgtgcagcgcggtgatattgttaaagttgtgcctgggggtaagttcccggtggatggaaaagtgcttgaagggaatacaatggcagacgagtccctaataaccggtgaagcaatgccggttacaaaaaagccgggatccactgtgatcgctggatccataaacgcccacggtagcgtccttattaaggctacccatgtgggtaatgatactacgcttgcccagattgtgaagctcgtggaagaagcacagatgtccaaagcgcctattcaacaattggctgatcggtttagtggatattttgttccatttataattattatgagcaccctgacgcttgtggtctggatagtgattgggttcattgacttcggtgttgtacagagatatttccctaatccaaataagcacatttctcaaactgaagttattattaggttcgcttttcaaacatccataacagtgttatgtatagcttgcccttgttcgctgggtcttgctacaccaacagcagtaatggtaggaaccggtgtcgcagctcagaatgggatccttattaagggtggtaaacctcttgagatggcacataaaattaagactgtgatgttcgataagacaggtaccataactcatggtgtgccaagagtaatgcgggtacttcttcttggtgacgtcgccaccctgccgctccgtaaagttcttgctgtggttgggacagcagaagcgtccagcgagcaccccttgggtgttgcagtcaccaaatattgcaaagaggaacttgggactgagactctcggctactgcactgattttcaagcggtgcctggttgtggtatcggttgcaaggtgagcaacgtcgaaggtattcttgctcattcggagaggcctctctcagctccagcttcacatcttaatgaggctgggagcttacctgctgaaaaggatgccgtaccacaaactttttctgtgctcataggtaatcgcgagtggcttagacgaaatggattgacaatttcgagtgatgtaagtgacgccatgacggaccatgaaatgaaaggccaaactgccatattagttgcgatagatggagttttgtgtggtatgattgccatcgctgatgcagtcaaacaagaagcggcccttgctgtccacacgcttcagtcaatgggagtcgatgtcgttcttattactggtgacaacaggaagaccgctcgtgctatcgctactcaggtcgggattaataaggtttttgcggaggtcttgccctcacataaggttgctaaagtccaagaactccagaataagggaaagaaggttgctatggttggggatggcgtgaacgactccccagcattggctcaagccgatatgggagtggctataggaactggtacggacgtggctatagaggctgctgacgttgttctcatcaggaatgatttgctagatgttgttgcttctattcatctcagcaagcgaaccgtacggcggatcagaatcaacctcgtccttgcgctgatttacaatttggtcggtattccaatagctgccggtgtttttatgccgatagggatagttctccaaccatggatgggatcagccgctatggccgcttcctccgtgtctgttgttttgtcatcactgcagctgaagtgttacaagaagcctgatttggagaggtacgaagctcaagctcacggacatatgaagcccttgacagcctctcaggtttctgttcacatcggcatggacgataggtggcgggacagcccgagagcaaccccttgggaccaagtgtcctatgtctctcaagtgtcacttagttccttaaccagtgataaacccagcaggcattcagcagctgctgatgacgatggagacaaatggtcgcttctcctcaatgggcgtgatgaggagcaatacatt

SEQ ID NO: 7472 - DNA, 4395 bp, Artificial Sequence
  Description of Artificial Sequence: Synthetic coding sequence
atgcctgagcaggaacgacagatcacagcccgcgaaggggcatccagaaagatcttgtccaagttgagtttgcccacgcgagcttgggagcccgccatgaagaagtcctttgcgtttgataacgtcgggtacgaggggggactggatggcctcggacccagcagccaagtggctacaagcaccgttagaatcctcggcatgacctgccagtcttgtgtgaagagtatcgaggaccgcataagcaatctgaagggaatcattagcatgaaagtgtcattggagcaaggttcagccaccgtgaagtacgtcccttccgtcgtctgccttcagcaagtatgtcaccagataggggatatggggttcgaggccagtatcgccgagggaaaggctgcctcttggcctagccggtccctcccagcacaggaggccgtcgtgaagctccgcgtcgagggcatgacatgccagagttgcgtgagcagtatagaagggaaggtccgcaagctgcagggggttgtgcgagtgaaagtgagtctgagcaaccaggaggcggtgatcacttaccagccgtacctgattcagcccgaggatctgagagatcatgtgaatgacatgggatttgaagccgctatcaaatctaaagtggctccgctctccctcgggccgattgacatagaaaggctgcagtccaccaaccccaagagaccattgtccagcgcgaaccagaacttcaataattctgagacactcgggcaccaggggtcccatgtggtaaccctgcagttgcgcatcgacggcatgcactgtaaatcatgcgttcttaacatcgaggagaacatagggcagctgctgggcgtccagagcatccaggtgagtcttgagaataaaacagcccaggtgaagtatgatccaagttgcacctctcctgtcgccctgcaacgagcgatcgaggctcttcctcctggaaacttcaaggtctctttgcctgacggcgccgagggcagcggaacggaccacaggagtagctctagccacagcccagggagtccacctcgcaatcaggtccagggcacctgtagtacgacacttatagctattgcggggatgacctgcgccagttgtgttcactcaattgaagggatgatatctcaacttgagggggtgcagcagatatctgttagcctggcagaaggtacggccacagtcctgtacaaccccagcgtgattagccccgaggaattgagagctgctatcgaggacatgggattcgaagctagcgtggtgtctgaaagctgttccacaaatcccctcgggaaccatagcgccgggaactccatggtccagacgactgatggtactccaactagcgtgcaggaggtggcaccccacacaggccggttgccagctaaccatgccccagatattctggctaagagcccccaaagcactagggcagttgccccccagaagtgctttttgcaaatcaaggggatgacctgcgcttcttgtgtttcaaacatagagcggaaccttcaaaaagaggctggtgtcctgagcgtgctggtcgccttgatggccggtaaagcagaaatcaagtacgaccctgaagttatccaacccctggaaattgcccagtttattcaggacctgggatttgaggcagcagtcatggaggactacgctggaagcgatggcaatattgaattgactatcaccggcatgacgtgtgccagttgcgtacacaacatcgaatccaagctgaccagaactaatgggatcacctacgccagcgttgccctggccacttcaaaggcgctggttaaatttgatccagagatcatcggtcctcgcgacatcattaaaatcatcgaggaaatcggctttcatgcttccctggctcagcgaaaccccaatgcccatcatctcgatcacaaaatggagatcaaacagtggaaaaagagcttcctttgtagtctggtctttggcataccagttatggccctgatgatttacatgctgatcccctcaaacgaacctcaccagagtatggtgctggaccacaacatcatccccggcctgagtatcctgaatctgatattctttatcctttgcaccttcgtgcagctgctcggtggctggtacttctatgttcaagcctataagtcccttagacatagatctgcaaatatggatgtgctgatcgtgttggctacaagcatagcatacgtgtacagtctggtgatcctggtagtggctgtcgctgaaaaggctgaacggtcccccgtgacctttttcgacacgccccctatgctgtttgtctttattgcgctcggcagatggctcgagcacttggcaaaatctaaaacctctgaggctctggctaaactgatgagcctgcaggccacagaggccaccgtcgtgaccttgggggaggacaatctgatcataagggaagaacaggttccaatggagctggtgcagcgcggggatattgtgaaagtggttccaggtggaaagttcccggtagacggcaaggtgctggaaggcaataccatggccgacgagtccctgatcacaggggaggccatgcctgttacaaagaaacccggcagtacagtgattgcaggttctatcaatgctcatggctctgtgctcatcaaggccacccatgtcggtaatgacactacattggctcaaatcgtgaagctggtggaagaggcacagatgtccaaggctcctatccagcaactggccgatagatttagcggatacttcgtaccctttattattatcatgtccacactgaccctggtcgtttggatcgtgattggatttatagattttggcgtggtgcaacggtacttcccaaatcccaacaagcacataagccaaaccgaggtgatcattcggtttgcgtttcagaccagcatcactgtgttgtgcatcgcctgcccctgttctctcgggctggccacacctaccgcggtcatggtcggtacaggagtagccgcccagaatgggattctcatcaaaggagggaagcccttggagatggcgcataaaattaagaccgtcatgtttgataaaactgggactataacccacggcgtccctcgggtgatgcgagttttgcttctcggcgacgtggcaacccttcccttgcggaaggtgctggccgtggtgggaaccgccgaggcttcctccgagcatcctcttggcgtggccgtgaccaaatactgcaaggaggagcttggtaccgaaactctgggatattgcacagattttcaggccgtacctgggtgtggcatagggtgcaaggtgtctaacgtcgagggcatactggctcacagcgaacgacctctgtccgccccggcctcccatctgaacgaggcgggttcactgcctgccgagaaggatgcggtccctcaaactttctcagtcctgatcgggaatagggaatggctccgcaggaacgggctgaccatctccagcgatgtgagtgacgcaatgacggatcatgaaatgaaggggcagactgccatcctggttgctatcgatggggtgctgtgtggaatgatcgcaattgccgatgcagtgaaacaggaagctgccttggccgtgcacactttgcagtcaatgggagtggacgtggttctgattactggcgataatagaaaaaccgctcgcgccattgctacccaggtaggcatcaacaaagtcttcgcagaagtcttgccttcccacaaggtggccaaagtgcaggaactccaaaataaaggaaagaaagtagctatggtgggagatggggttaatgactcccctgcactggcccaggctgacatgggcgttgcgatcggcacaggaactgacgtagccatcgaggctgccgacgttgtcctgattaggaacgatctcctcgatgtggttgcgtccatccacctctccaagcgaaccgtcagacggatcagaatcaacctggtgctcgctctcatctacaacctcgtgggcattcctatagcagccggagtttttatgcccattggaattgttttgcagccctggatgggatccgcagcaatggctgcgagcagcgtgagtgtggtattgagttctctccagcttaagtgctacaaaaaacccgatctggagcggtacgaggcacaggctcacggacacatgaaacccctgacagcaagtcaggtgagcgttcacatcgggatggatgatcgctggagggacagccccagggctacgccatgggaccaggtgtcttacgtgtcccaggtttccctttcctccctcacatccgacaagccatcccggcacagcgcggcagccgatgacgatggtgataaatggagcctgctgctcaatggccgggatgaagagcagtatatt

SEQ ID NO: 7473 - DNA, 4395 bp, Artificial Sequence
  Description of Artificial Sequence: Synthetic coding sequence
atgccggaacaagaacggcaaattaccgccagagagggagcatcaagaaagatcctgtcgaagctgtcgcttccaactagggcatgggaaccggccatgaagaaatcattcgcatttgataacgtggggtacgagggaggtcttgacgggctcggaccctcttcacaagtcgcgactagcaccgtcagaattttgggaatgacttgtcagtcgtgtgtcaaatcaatcgaagatcgtatctcaaacctcaaaggtatcatttccatgaaagtctcacttgagcagggctcggccactgtgaagtacgtgccatccgtcgtgtgtctccaacaagtgtgccaccagatcggtgacatgggtttcgaagcatcaatcgctgaaggtaaagcagcatcctggccttcgagatccctccctgcccaggaagcggtcgtgaagctccgtgtggaaggcatgacttgtcaatcctgtgtgagctctattgaaggaaaggtgagaaagctgcagggggtggtgcgcgtcaaagtctcccttagcaatcaagaagcagtgattacgtaccagccatacctcattcaaccagaagatcttagagatcatgtgaatgacatgggattcgaagcagcaataaagtcgaaagtagcacctctctcgcttggcccgatcgatattgaacgccttcagtccactaaccccaaacgcccactgagcagcgctaaccagaacttcaacaactcggagactcttggtcatcaaggatcccatgtggtgacgcttcagctgcgcattgatggcatgcattgcaaatcgtgcgtccttaacattgaagaaaacattggtcaactccttggagtgcaatcgattcaagtctcactcgaaaacaaaactgcacaagtgaaatacgatccatcctgtacctcacctgtcgcattgcaacgggcaatcgaagcccttcctcctggcaactttaaggtttcccttccagatggcgcagagggtagcggtaccgaccatagatcctcgtcctcccactcgccaggctccccgcctcgtaaccaggtgcagggaacctgtagcaccacccttattgcaattgccgggatgacctgtgcttcgtgtgtgcactcgattgaaggtatgatctcccaactggaaggggtgcaacagatttctgtctcgctcgcagagggtactgccaccgtgctttacaacccatctgtcatatccccggaagaacttagagctgcaattgaggatatgggattcgaggcaagcgtggtgagcgagtcgtgctctactaacccacttggcaatcattccgccggaaattccatggtgcagaccactgatggtactcccacctcggtgcaagaggtcgcacctcacactggtcgcctgcccgcaaaccatgctcctgatatccttgcgaaatcgcctcagtcgactcgggcagtcgcaccgcaaaaatgtttcctccaaatcaaagggatgacgtgtgcatcctgcgtctccaacatcgagcgtaacttgcagaaggaagccggagtgctttccgtccttgtggctctgatggctggaaaggcagagattaagtacgatccagaagtgattcagcctttggagattgctcagtttattcaggatcttggctttgaggcagctgtgatggaagattacgccggaagcgatggaaacattgaactgactataaccggtatgacctgcgcgtcgtgcgtgcataacatcgagagcaaactgactcggaccaacggcattacttacgccagcgttgcactcgcaacctcgaaagcacttgtgaagttcgacccagaaatcattggaccgcgcgacatcattaagattattgaagaaattggcttccatgcctcgcttgcccaacgtaatccaaatgcgcaccatctggaccacaaaatggaaatcaagcagtggaagaagtcgttcctttgttcgctcgtgtttggcatacccgtgatggccctgatgatttacatgcttattcctagcaacgagccacaccagtcaatggtcctggaccacaatatcatccctggactctcaatacttaatctgatctttttcatcctttgtacttttgtccaactgctgggtggatggtacttctacgtgcaggcgtacaagtcgctgcgccataggtccgcaaatatggatgtccttatcgtcctggcaacgagcatagcatacgtgtactccctggtgattctggtggtcgccgtggcagaaaaagcagaacgcagccccgtgacgttttttgataccccacctatgctctttgtgtttattgcactggggagatggctcgaacatctggcaaaaagcaagaccagcgaggcacttgcaaaattgatgtctcttcaagcaaccgaagccactgtggtgactctgggggaggacaacctcatcatacgagaggaacaggtgccaatggaactcgtccagagaggagatattgtgaaggtggtgcctggaggaaagtttcccgtggacggcaaggtgcttgaaggaaataccatggctgatgagtcactcattacgggcgaagcgatgcctgtgactaagaagccaggatcgaccgtgatagcaggctccattaatgcgcacggaagcgtgctgatcaaggcaacccatgtgggtaatgatactaccctggcacagattgtgaagctcgtggaggaagctcaaatgtccaaggcacctattcagcaactggcggacagatttagcggctacttcgtgccatttatcataatcatgtctactctgactctggtggtgtggatcgtgatcggctttatcgattttggcgttgtccagcgatacttccctaatcctaacaagcacatctcccagaccgaggtgattatccgattcgcgtttcagacctccatcactgtgctgtgtatcgcgtgtccgtgttcgcttggccttgcaactcctactgcagtcatggtcggaaccggcgtggcagcacagaatggaatcctcattaagggcggtaagccactggaaatggcacataagatcaaaactgtgatgtttgataagactggcaccattacccatggtgtcccacgcgttatgcgggtcctcctgcttggagacgtggcaactcttcctcttcgcaaggttctggcggtggtaggaactgcagaggcatcatcagagcatcctcttggagtggcagtgaccaagtactgtaaggaggagctgggtaccgagacgctcggatactgtactgattttcaggcggtgccaggttgcggtatcggatgtaaagtgtcgaacgtggaaggaattctggcgcattcagagcgacccctgtccgcaccagcatcgcatctcaacgaggcaggttcgctgcctgccgaaaaagatgctgtgccacaaactttttcggtgcttattggaaacagagagtggctcaggagaaatggactcaccatctcttccgatgtcagcgacgcaatgaccgaccatgaaatgaagggtcaaactgccatccttgtggcaattgatggagtgctgtgtggtatgatcgcaattgcagatgcagtcaaacaggaagcagcgcttgcagtgcataccttgcaatcaatgggggtcgacgtggtcctcattaccggggacaacaggaaaaccgcccgggcgattgcaactcaggttggaatcaataaagtctttgcagaggtccttccatcacacaaggtggcgaaggtgcaagagctgcagaacaagggaaaaaaggtggcaatggtgggggacggggtgaacgacagcccagcactcgcacaagcggatatgggtgtggcaattggaaccggaaccgacgtcgcaattgaagccgctgacgtggttcttattcgcaacgatcttctggacgtggtggcatccattcatctctccaagagaaccgtgcgtcgcattcggattaatcttgtcttggcgctgatctacaaccttgtcggaatccctatagcagcgggtgtgttcatgcctattggcatagtgcttcagccctggatggggtcggccgctatggcagcgagctccgtgtcagtggtcctttcgtccttgcaactgaaatgttacaagaagccagacctggaacgttacgaagcacaagcgcacggacacatgaagcctttgaccgcatcccaagtgtcagtgcacattggtatggatgatagatggagggactcccccagagccaccccatgggatcaagtgtcctacgtctcgcaagtgtcgctgtcatcgctgactagcgacaaaccctcccgacattcagccgccgcagatgatgacggcgacaagtggtccctcctgcttaacggtagagacgaagagcaatacatt

SEQ ID NO: 7474 - DNA, 4395 bp, Artificial Sequence
  Description of Artificial Sequence: Synthetic coding sequence
atgccggaacaggagcggcagatcaccgcgcgcgaaggcgcctcccgcaaaatcctgtcgaagctgtccctccccaccagagcgtgggaacccgctatgaagaagtcgttcgccttcgataacgtgggctacgagggtggactggacggattgggcccctcatcccaggtggctacctcgaccgtgcggatcctcggaatgacctgtcagagctgcgtcaaatcgatcgaggacagaatctcgaatctgaagggaatcatttccatgaaagtcagcctcgagcaaggctccgccacggtcaaatacgtgccgtcagtggtgtgtctgcaacaagtgtgccaccagatcggcgatatggggttcgaagcctcaatcgcggagggcaaagccgcatcgtggccctcaagatcgctgccagcccaggaggctgtggtcaaactgagggtggagggtatgacttgtcagtcatgcgtgagctcgattgaaggaaaggtgcgaaagctccagggagttgtgcgagtgaaagtgtcactgagcaaccaagaggcagttatcacctaccaaccatacctgattcagccagaggacctgcgcgatcacgtgaatgacatgggattcgaggccgctatcaagtcaaaagtcgcgccgctgtcgctcgggcctatcgacatcgaaaggctgcaatccaccaacccgaaacggccactgtcatcagccaaccagaatttcaacaattcagagactctgggtcaccaaggaagccacgtcgtcaccctgcagctgcggatcgacggaatgcattgcaagagctgcgtgttgaatatcgaagagaacattggccagctcctcggcgttcaaagcattcaggtgtcactggaaaacaaaaccgcacaggtcaaatacgacccttcgtgcacgtcgcctgtggcgctccagcgcgctatagaggctctcccgccaggaaatttcaaggtgtcccttccggacggggcggagggctccggaaccgatcatcgctctagctcctcccattcgccgggctcgccgccacgcaaccaagtgcagggcacctgctccactactttgattgcaatcgcagggatgacctgcgcctcatgcgtgcattctatcgagggcatgatctcacagctcgagggagtgcaacagatcagcgtgtcgcttgccgaaggcaccgcaactgtgctgtacaacccctcggtgatctcgccggaagagctgcgggccgccatcgaagatatgggatttgaagcctcggtggtttcggagtcgtgctcaaccaacccgctgggcaaccactcggcaggcaattctatggtgcaaaccacggacgggactcctaccagcgtgcaggaggtcgccccacatactgggcgccttcccgcgaatcatgctccggatatcctcgccaagagcccgcagtccaccagagctgttgcaccacagaagtgcttccttcaaatcaagggaatgacttgcgcatcatgcgtctcgaatatcgagaggaatctgcaaaaggaagcaggagttctctccgtgttggtcgctttgatggcaggaaaagcggagataaagtatgatcctgaggtcattcagccacttgaaatcgcacaattcatccaggaccttggattcgaagcagcggtgatggaagattacgccggatcagacggaaacatcgaactcactataacgggcatgacctgtgcctcctgtgtgcataacatcgaatccaaattgacccggactaacggaatcacttatgcttcggtggcactggcgacttcaaaggccctggtgaagttcgatcccgagatcatcggaccgcgggacatcattaagatcatagaggagattggatttcatgcctcacttgcacagcgaaaccctaacgctcaccatctggaccataagatggaaatcaagcaatggaagaagtcattcttgtgcagcttggtgttcggcatcccagtgatggcgctcatgatctacatgctgattcccagcaatgagccgcaccagtcaatggtgctggatcataacattattccgggactgtcgatcctcaacctgatcttctttatcttgtgtacttttgtccaactgctgggtggctggtacttctacgtgcaggcatacaagagcctgagacaccggtccgcgaatatggatgttctcatcgtgttggccacgagcatcgcgtatgtttatagcctcgtcatcctggtcgtggccgtcgcagaaaaggcagaacgctccccggttacctttttcgatactccaccgatgctttttgtgttcatcgccctgggtcggtggctggaacatctggcgaagtctaagactagcgaagcactggcaaagctcatgtccttgcaagcgactgaagcgactgttgtgactctcggggaggacaatctgattatccgtgaagaacaggttccaatggagcttgtccagcgcggagacatcgtcaaggtggtgccaggaggaaagttccccgtggacgggaaggtgctggaaggcaatacgatggctgacgaatcgctcatcaccggagaggctatgccggtcaccaagaaacccgggtcaaccgtgatcgccggaagcatcaacgcacacggctcagtgctgatcaaggctacccacgtcggtaacgatactacgttggcccaaatcgtcaaacttgtcgaagaggctcagatgtcaaaggccccgatccagcagctggctgaccgcttctcgggatacttcgtgccatttatcatcatcatgtcgaccctgaccctggtcgtgtggatcgtgatcggcttcatagattttggcgtggtccaacgttacttcccgaaccctaacaagcatatctctcaaacggaagtgatcatcagatttgcatttcaaactagcatcactgtgctgtgcatcgcctgcccttgcagcctggggctcgcgactccaacggcggttatggtgggaaccggagtggcagctcagaatggaatcctgatcaaaggtggcaaaccgctggaaatggctcacaagatcaagacggtgatgttcgacaaaacgggtaccatcactcatggcgtccctcgcgtgatgcgcgtgctgcttctcggggacgtggccaccctcccgctcaggaaagtgcttgccgtggtggggactgccgaagcgtcgtccgaacatccactgggagtggccgtgaccaagtactgtaaagaggaactgggaaccgaaactctgggatactgcaccgatttccaagccgtccctggatgcggcattggctgcaaggtcagcaacgtggaggggattcttgcccactccgaaaggccactcagcgccccggcgtcgcatctgaacgaagcaggttcactcccagccgagaaagatgccgtccctcagacgttcagcgtgctcatcggcaatagggaatggctgaggcgaaacggactgaccatctcctccgacgtgtcggatgccatgaccgaccatgagatgaagggacaaaccgccattctcgtcgctatcgacggcgtgctgtgtggcatgatcgcgattgcagatgcagtcaagcaggaggcagcattggcggtgcatactctgcagagcatgggcgtcgacgtggtcttgatcactggcgataacagaaaaaccgccagagcgatcgccacgcaggtcggaatcaataaggtgttcgccgaggtgctcccatcgcacaaggtggcaaaggtccaggaacttcagaacaagggtaagaaggtggcgatggtgggggacggggtgaatgactcgccggcgctggcccaagcggacatgggggtggctatcggcactggaaccgatgtggcgatcgaggcagccgatgtcgtcctgatccggaacgacctgctggacgtggtcgcttcaattcatctctccaagcgcaccgtgcgccggatccggatcaacctggtgctcgccctgatctataacctggttggaattccgatcgccgcgggagtgttcatgccgataggaattgtgctccaaccttggatgggttcggcagctatggccgcctcctcggtcagcgtggtcctgtcatccctccaactgaagtgctacaagaagcctgatctcgagcgctatgaggcccaggcccacggacacatgaagcctctgactgcctcccaagtctccgtgcacattggaatggatgacagatggcgcgattcgcctcgggcgactccctgggaccaggtcagctacgtgtcgcaagtctccctgagctcgctgacttcagacaaaccgagcagacattccgccgcagccgatgacgacggggacaagtggagcctgttgctgaatggtcgcgacgaggaacagtacatc

SEQ ID NO: 7475 - DNA, 4395 bp, Artificial Sequence
  Description of Artificial Sequence: Synthetic coding sequence
atgccagagcaggaacggcagattaccgctcgcgagggggcttcccgcaaaatactcagtaagttgtccctgccaactcgtgcctgggagcctgctatgaaaaaatcatttgctttcgacaacgtcggatatgaaggagggctggacgggctggggccgtcgtctcaggtggcgaccagtaccgtgcggattctgggaatgacctgtcagtcatgcgtgaaaagtatcgaggacaggatctccaatttgaaagggattatcagtatgaaggtatcactcgagcaggggtcagccaccgtcaagtacgtgccatcagtggtgtgtttgcagcaggtgtgtcaccagataggagacatggggttcgaggcctccatcgccgaggggaaggctgcaagttggccctctagatctctgccagctcaggaggcagtggtaaagctcagagtcgagggtatgacatgtcagagctgtgttagttccatcgagggcaaggttagaaagctccaaggtgtagtgcgcgtcaaagtgtcattatccaatcaggaagcggtgatcacataccagccctacctcatacagccggaggatctgagggaccatgtgaatgacatgggcttcgaggctgcgattaagtccaaggttgcccccctttctcttggccccatcgacattgagcgacttcaatccactaacccaaagcgacctttatcttctgctaaccagaatttcaataatagtgagaccttgggccatcagggctctcacgtagtgactctacagctgcgcattgatggcatgcattgcaagtcatgcgtccttaatattgaagaaaacattggccaattactgggcgtgcagagcattcaggtgtccctggaaaacaagacagcccaggtcaaatatgaccctagctgtacttctccagtggctctccagcgtgccatagaggccctgccgccaggaaactttaaggtgtctcttcccgacggcgcagaagggtctgggactgaccaccgatcttcgtcaagccactcaccaggctccccaccaaggaatcaggtgcaggggacatgtagcaccactttaattgccatcgccggtatgacatgcgcatcttgtgtccacagtatagaaggaatgatatctcagctggagggtgtgcaacaaattagcgtttcccttgctgagggcacggccaccgtgttatacaatccctcagtgatttccccggaagaactacgcgcagctatagaggacatgggttttgaagcttcagtggtgagcgagagctgttcgaccaaccccttgggcaatcattccgctggaaattcaatggtgcagactaccgacggtacacccacgtcagtgcaggaagtggccccacacaccggacggctgcccgccaaccacgctcccgatatcttggctaagagcccacagtcgacaagagccgttgccccccagaaatgtttcttgcaaataaagggcatgacatgtgcgtcctgtgtatcaaatattgaacgcaatctccagaaagaggctggagtcctgtccgtgctggttgcgctgatggctggaaaagcagaaattaagtatgatcctgaggtgatccagcctctagagattgcccagtttattcaggacctcgggtttgaagcagccgtgatggaggattacgctggcagtgacgggaatatagaactaacaatcacaggtatgacatgtgctagttgcgtgcacaacattgaatcaaagctgacccggacgaatggcattacatacgcaagcgtggcgctggctacaagcaaagctcttgtcaagttcgacccggagatcattggcccccgagacattataaagatcatagaggagataggtttccacgcgtccctggcgcagaggaatccaaacgcccaccatttggaccacaagatggaaattaaacaatggaaaaagtcttttctctgcagcctggtctttggcattcccgtgatggcgttgatgatttatatgctcattccctccaacgagccgcaccagagtatggtactggaccacaatattatccccggcttgtcgatccttaacctgatcttctttattttatgcacatttgtccaactgctgggggggtggtacttttacgtgcaagcctacaagtccctgcggcaccggtcagcaaatatggacgtgctgatcgttctggcaacctctattgcttatgtctattctcttgtaattttggtcgtagccgttgcagagaaagctgagcgttcacccgtgacatttttcgacacgcctccgatgctgtttgtctttatagccctcggtcgctggctcgagcaccttgcgaaatcaaaaacgtccgaagctctggccaaactgatgtccctgcaggccactgaggctacagtggttactttgggagaggataatcttatcatcagagaagaacaggtccccatggagcttgtccagcgcggtgatatcgttaaggtagttcctggaggaaaattcccagtcgatggtaaggtgttggagggtaacactatggccgacgagtctctgatcactggggaggctatgccggttaccaaaaagcctggatcaactgttatcgccggaagcattaatgcccacgggagcgtcctgattaaagctactcatgtgggtaatgacacaaccctcgcgcaaattgtcaagctggtcgaagaagcccagatgagcaaagcgcctattcaacaacttgccgacagattctcaggctacttcgtgccgttcatcattataatgagcaccctgactctcgtggtttggatcgtgattggcttcatcgatttcggcgtggtgcagagatatttccccaatcccaacaagcacatcagccagacggaggtgatcattcgcttcgcatttcagacatcaatcactgtgctgtgcatagcttgcccctgcagtctgggtctcgctacacctaccgctgtgatggtgggcaccggggtggctgcccagaatgggatcttgattaaaggcgggaagcccctggaaatggctcataagatcaagaccgttatgtttgataagacagggaccatcacgcacggcgtaccaagagtcatgcgagtgctgctgctgggcgatgtcgccacgctgcccttgcgaaaagtgctggcagttgtgggcaccgccgaggccagttctgaacaccctctaggggtggccgtcaccaagtactgcaaagaagaacttggcacagaaacactgggttactgtaccgactttcaggcagtacctggatgtggtattgggtgtaaggtctccaatgtagaggggattctggcccactccgagcgccctctgtccgctccagcttcccacctgaatgaggcaggctctctgcccgcagagaaggacgcagtccctcagaccttctcggtgttgattgggaaccgagagtggctacgtcggaacggtctgactatcagctccgatgtgagcgacgcgatgactgaccacgagatgaagggccagaccgccattttggttgccatagacggggtgttatgtggaatgattgctatcgctgacgccgtgaaacaagaggccgcactggctgttcacactttgcagtccatgggagtggacgtcgttctgatcaccggcgataacaggaaaaccgcacgggctattgcaactcaagttggtatcaacaaggtgttcgctgaggtgctgcctagccacaaagtggcaaaagttcaggaacttcaaaataaggggaagaaggtggccatggtgggagatggtgtcaacgattcgcctgctctggctcaagccgatatgggcgtcgcgatagggactggtacggatgttgccatcgaggccgctgacgtcgtgttgatccgcaatgacttgctggacgtggtggcctccatccacctgtctaagcgcactgtgcgtagaatacgaataaatctggttttagcactgatctataatcttgttggaattcccatagccgctggtgtctttatgcccattggaattgtacttcagccatggatgggtagtgccgccatggcagcctcttccgtctcagtagtcctctcaagcctccagcttaaatgctacaagaaaccagacttagagcgctatgaagcacaagctcacggacacatgaaacccttaacggctagtcaggtctcagtccatattggaatggatgatagatggagagattctccccgggcaactccctgggaccaagtctcttacgtgagccaggtttccttaagctcactcacatctgataaacctagcaggcacagcgcggccgccgacgacgacggagacaaatggtctctgttgttaaacggtagagacgaggaacaatatatc

SEQ ID NO: 7476 - DNA, 4395 bp, Artificial Sequence; identical to SEQ ID NO: 7467
  Description of Artificial Sequence: Synthetic coding sequence

SEQ ID NO: 7477 - DNA, 4395 bp, Artificial Sequence
  Description of Artificial Sequence: Synthetic coding sequence
atgccggaacaagaacgccaaattaccgctagagagggcgcctccagaaagatcctgtccaaactgtccttgcctacccgcgcctgggaaccggcgatgaagaagtccttcgcattcgataatgtgggatacgagggtggacttgatggactgggaccttcgagccaagtggcaacctcaactgtgaggatcctgggcatgacgtgtcagtcctgcgtcaaatccatcgaagatcgcattagcaatctgaaaggaatcatctcgatgaaggtatcccttgaacaagggtcagccactgtgaaatacgtgccgagcgtggtctgcctgcagcaggtgtgccaccagatcggggatatggggtttgaagcgtcgatcgcagaaggcaaggccgcctcttggccgagccggtccctgccagcgcaagaagcggtggtgaagctgagggtggaaggaatgacctgccagagctgcgtgtcctcgatcgaaggaaaggtcagaaagctgcaaggcgtggtccgcgtgaaagttagcctgtcgaatcaggaagctgtgatcacctaccaaccgtacctgatccagccggaggatctgagagatcacgttaatgacatgggctttgaagcggccatcaagtcgaaggtcgcaccattgtcactgggaccgatcgacattgaacgcctgcaatcaaccaatccaaagaggccgctcagtagcgcaaaccagaactttaacaactcagagactctcggccatcaagggagccacgttgtcacgctccagctgagaatcgatgggatgcactgtaaatcgtgcgtcctgaacatcgaggagaatattggccaactcctcggcgtgcagtcgatccaggttagtctcgagaataagaccgctcaggtgaaatacgatcctagctgtaccagcccggtggccctgcaaagagctatcgaagcgctcccgccaggaaacttcaaagtcagcttgccagatggtgcagaaggatctggaacggatcatcggtcatcatcctcccacagccctggaagccctccccgcaatcaggtccaggggacctgcagcaccaccctcatcgctatcgctggtatgacctgcgcttcgtgtgtgcactcaatcgaaggaatgattagccagttggagggagtgcagcaaatctccgtgagcctggcagagggcactgccactgtgctttacaacccgtcagtgatctcaccggaggaactgcgagccgctatcgaggacatgggattcgaagcctcggtggtgtcggagtcatgctcgacgaacccgctcggaaaccactcggcaggaaactcgatggttcaaaccactgacggcactccgaccagcgtgcaggaggtggctcctcacactggaagattgccggccaaccatgccccagacatccttgcgaagtccccgcagtcgacccgggccgtggctcctcaaaagtgcttcctccagatcaaaggcatgacttgtgcctcctgcgtgtcgaatatcgagcgcaacctgcagaaggaagccggagtgctgagcgtgctggtggcactcatggcaggaaaggccgaaatcaagtacgatccggaagtgatccagccgctggagatcgctcaattcattcaagacctgggcttcgaggccgcagtcatggaagattacgcgggctcggatggaaacattgagctgaccatcactggaatgacctgtgcgagctgtgtgcataacatcgagtcaaagctgactcggactaacggaatcacctacgcctcagtcgcgctggccacctccaaagccctggtcaagttcgaccccgaaatcattggacctcgcgatatcattaagattatcgaggaaatcggatttcacgcttcactggcacaacgcaatccgaatgcgcaccacctcgatcataagatggaaatcaagcaatggaagaaatccttcctttgcagccttgtgttcgggatcccggtcatggcgttgatgatctacatgctcatcccgagcaacgaaccgcatcaatcaatggtgctggaccacaacatcatccccggcctgtcgattctcaaccttatcttctttatcctgtgcaccttcgtccagttgctcgggggatggtacttctacgtgcaagcctacaagtcgctgcgccaccgcagcgccaatatggacgtgctcatcgtcctggccacgtcgatcgcctatgtgtatagcctcgtcatcctggtggtcgcagtggccgaaaaagccgagcgaagcccggtcactttcttcgacaccccgcccatgctgttcgtctttatcgctctggggcgttggctggaacacctggcaaagtccaagacgtcggaggctctggcgaaacttatgtcgctccaggcgactgaggccactgtcgtgactcttggcgaggacaacctgattatccgcgaggagcaggtcccgatggagctcgtccaaaggggcgacatcgtcaaagttgtgccgggcggcaagttcccagtggacggtaaggttctggagggtaataccatggcagatgagagcctgataactggagaagccatgcctgtgaccaaaaaacctggatccactgtgatcgccggctcaatcaacgctcacggaagtgtcctgatcaaagcgactcatgtggggaacgatactactcttgctcagatcgtgaaactcgtggaagaagcgcagatgtccaaggccccaatccaacaactcgccgatagattttcaggatacttcgtcccgtttatcatcatcatgtccactctgactctcgtggtgtggattgtcattgggtttatcgatttcggagtggtacagcggtacttcccgaacccgaacaagcatatttcgcaaactgaggtgatcatccgctttgcctttcaaacgtcgatcaccgtcctctgcatcgcatgcccgtgctctctgggactggctactccgacggccgtcatggtggggaccggcgtggccgcgcagaacggaatcctgattaaaggagggaagccactggaaatggctcataagatcaagacggtgatgtttgacaaaacgggaacgatcactcacggagtcccacgcgtgatgagagtgctgctgctgggagacgtggccactctgccgctcagaaaggtcttggcagtggtcggaaccgcagaggccagctcggaacaccctctcggagtggccgtgaccaagtactgcaaagaagagctgggcaccgaaaccctgggctactgcactgactttcaagccgtgccgggatgcggtattggatgcaaggtgtccaacgtggaagggatcctggcgcatagcgaacgcccgctgtcggcgcccgcatcgcacctcaatgaggccggtagtctgccggccgaaaaagacgcagtcccgcagactttttctgtcctgatcggtaacagagagtggctccggcgcaacgggctgaccatctcgagcgacgtctcggatgcgatgaccgaccacgagatgaagggacagactgcaatcctcgtggccatcgacggagtgctgtgcggcatgatcgcgatcgccgacgctgtcaagcaggaagctgctcttgctgtgcatactctgcaatctatgggagtcgacgtggtgttgatcaccggcgataaccgcaagaccgctcgggcaatcgcaacccaggtggggataaacaaggtgttcgcagaagtgctcccttcgcacaaggtcgctaaggtccaggaactccagaataagggcaagaaggttgccatggtgggggacggtgtcaatgacagcccagcgctggctcaagccgacatgggagtggcaatcggtacgggcaccgacgtcgccatcgaagcggccgacgtggtgctgatcagaaacgatctgctggacgtcgtcgctagtatccatctctccaagagaactgtgcgccggatccgcataaatctggtgctggctcttatctacaatctggtggggattcccatcgccgcaggagtgtttatgccaatcggaatcgtgctgcagccttggatgggatccgcggccatggcggcctcatccgtctcagtggtgttgtcatcactccaactgaaatgctacaagaaacccgacctggagcggtacgaggcgcaagcacatggacacatgaagccgctcacggcctcgcaagtgagtgtgcatatagggatggatgatcgctggcgggactccccgcgcgcaaccccatgggatcaagtgtcctacgtgtcgcaagtctcgctttcatcccttacttcagataagccctccaggcacagcgcagcggccgacgatgacggagacaagtggtccctgctcctcaacggacgcgacgaagaacagtacatt

SEQ ID NO: 7478 - DNA, 4395 bp, Artificial Sequence
  Description of Artificial Sequence: Synthetic coding sequence
atgcctgagcaggaacgccagattaccgcacgggagggagcaagccggaagatcctttctaagctcagcctgccgacacgggcatgggagcctgccatgaagaagagcttcgccttcgacaacgttggatacgagggcgggctggacggcctgggaccatcctctcaggtcgctaccagcacagtcagaatcctcggcatgacttgccaatcctgcgtgaaaagcatcgaggatagaataagtaacctgaaaggcataatcagcatgaaggtgagtttggagcagggaagcgcaacagttaaatacgtcccttctgttgtgtgtctgcaacaggtctgccatcagattggggacatggggtttgaagcctcaatcgcagagggaaaggctgcttcttggccctctagatctctcccagcacaggaggctgtggtgaagttacgggtcgaaggaatgacatgtcagagctgcgtcagcagtattgaaggcaaagtccgcaagctgcagggtgttgtaagagtgaaagtgtcattgagtaatcaggaagccgtgatcacatatcagccctacctgattcaacctgaggatttacgcgatcacgtgaatgacatgggctttgaggctgcaataaaatctaaagtggctccactgagcctcggaccaatcgacatcgagcggcttcagtctacgaacccaaaaaggcctctcagctccgctaatcaaaattttaacaactctgagaccctgggtcaccaaggcagccatgtggtgacactccagctgcggatcgacgggatgcactgcaaatcatgcgtgctcaacattgaggaaaatataggccaacttctcggcgtccagtcaattcaagttagcttggaaaacaaaaccgcccaggtgaagtatgacccaagctgtacctctcccgtcgccctccaacgggctattgaggccctgcctccaggcaatttcaaagttagtctgcctgatggagctgagggcagcgggacagatcaccggtcaagctccagccatagtccaggatctccgccaaggaaccaagtccaaggaacctgttctacaaccctcatcgctatcgcaggcatgacctgcgcctcatgtgtacactctatcgagggcatgatatctcagcttgagggagtccagcaaataagcgttagccttgcagaaggcaccgccacagtcctctataatccaagcgtgatatctcccgaggaattacgcgctgctattgaagatatgggatttgaagccagcgtggtgtcagagagctgtagcacaaacccgctcgggaatcatagtgccggtaactctatggtccagaccacagatggaacccctaccagcgttcaggaggtggctccacatactgggaggcttccagccaaccatgcgcctgatatcctcgccaagtcaccccagagcactcgtgcagtggccccacaaaagtgcttcctgcagatcaaaggcatgacttgcgctagttgcgtgagcaacatagagcgcaaccttcaaaaagaagccggagttttatccgtgctcgtcgctttaatggccggcaaagctgagataaagtatgatcctgaggtcatccagccactggagattgcacagtttatccaagacctgggattcgaagccgccgtcatggaagactatgctgggtcggacggcaatatcgagcttaccatcacagggatgacctgtgctagctgtgtgcataacatcgaaagtaagcttacaagaactaacggaatcacatacgcgtcggtcgccctcgctacatcaaaagccttggtaaaatttgacccagagattatcggccctagagatatcataaaaatcattgaagagatcggattccacgccagcctggcacaacgtaaccctaacgctcaccatctggatcataagatggagatcaagcagtggaagaaaagcttcctgtgtagcttggtgtttggaattccagtgatggccttgatgatctacatgcttatcccctcaaatgagcctcaccaatctatggtgctcgaccataatattatacctggactcagcattttaaaccttatcttttttatcctctgtaccttcgtccagctgctgggaggatggtatttctatgtacaagcctacaagagcctgagacaccgctctgcaaacatggacgtgcttattgtgttagctacatcaatcgcttatgtctattctctggttatcctggtcgtggccgttgctgaaaaggctgagcggagtccagttacatttttcgatacaccgcctatgctctttgtgttcattgccctgggccgctggctggaacatttggccaaaagcaagacaagcgaggccctcgccaagctcatgagcctgcaggctactgaagcaaccgttgtgaccctgggtgaagataacctgattatccgcgaagaacaggtccccatggaacttgtacagcggggggacattgtaaaggtggtgccaggaggtaaattcccggtggatggcaaggtgctggagggtaacaccatggccgacgagagccttatcacaggcgaggctatgccagtgactaaaaagcccgggtccactgttatcgctggttctatcaacgcccatgggagcgtcctcataaaagcgacccatgttggcaatgataccactctggctcagatagtaaagttagtggaagaggcccaaatgagcaaggcacccatccagcagcttgctgatcgtttttccgggtactttgtcccattcatcatcatcatgagcaccctgacactggtcgtctggatcgttattggtttcatagattttggcgtggtccagagatacttccctaatccgaacaaacacatcagccaaaccgaggtcatcattaggtttgctttccagaccagcattaccgtgttgtgcattgcttgcccttgttcccttgggctggctacacctacagcagttatggtcggcactggcgtcgctgcccaaaacggcattctgatcaagggtgggaaaccactcgaaatggctcataaaattaagactgtgatgttcgataaaacaggtacaattacacacggcgtccctcgagtgatgcgcgttctactgttaggcgacgtcgctacactgccattacggaaggttttggcagtggtgggcactgccgaagccagtagcgaacacccactcggcgtcgctgttacaaaatattgcaaagaggaactgggaactgagacgctggggtactgcacagacttccaggctgtgccaggatgtggaatcggctgcaaggtttccaacgtcgaaggcatcttggcacactcagaaagaccgttgtcagctcctgcttcccatctgaacgaggctggaagcctgccagctgagaaggacgcagtccctcaaaccttcagcgtgctgatcgggaaccgggagtggctccgcaggaatggacttaccatatcaagtgacgtcagcgatgcgatgacggaccacgagatgaaaggacaaaccgctatccttgtagccatcgacggagtgctatgcgggatgattgcaattgccgatgctgtgaaacaggaggccgcattagcagtgcataccctgcagagtatgggcgtggacgttgtgctgatcacaggggacaacaggaagactgcccgggccattgctacccaggttggaatcaacaaggtgttcgcggaagtgctgccaagtcacaaagtcgctaaagtgcaggagctccaaaataaggggaagaaggttgccatggtaggggacggagtcaacgacagcccggctctggctcaggccgacatgggcgttgctatcgggacaggaaccgatgtggctattgaagcagcagacgtcgtgctgatcaggaacgatcttttagatgtcgtagcatcaatccacctttccaagaggactgtgcgcaggatccgcatcaaccttgtactggctctgatctataatcttgtcggaatccctatcgccgcaggagttttcatgcctatagggattgtgctgcagccatggatggggagcgcagccatggcggcttcatccgtttctgtggtgctgtcctccctccagctgaaatgctacaagaagccggacctggagaggtacgaggcacaggcacacggccacatgaaacctctgactgcctctcaggtttcggtccacattggcatggatgatagatggagggactcccccagggctactccatgggaccaagttagttacgttagccaggttagtctatcttctctgacaagtgataagccgtcaagacattccgctgctgccgatgacgacggcgataaatggagcctgctgctcaacggccgcgatgaagagcaatacatt

SEQ ID NO: 7479 - DNA, 4395 bp, Artificial Sequence
  Description of Artificial Sequence: Synthetic coding sequence
atgccagaacaggagagacagatcactgcacgcgagggagcgtcgcggaagattctttcgaagctctcattgccaaccagggcttgggaacccgcaatgaagaagtccttcgcattcgataatgtgggttacgagggaggacttgatggcctggggccatcgtcccaagtggcaacctcgacggtcaggatcctcgggatgacgtgccaatcatgtgtcaaatcgatcgaagatcggatttccaatctgaaggggataatctccatgaaggtgtcgctggaacaagggtccgccaccgtgaagtatgtgccctcggtggtgtgcctgcaacaagtgtgtcaccaaatcggtgatatgggatttgaagcatccatcgcagaagggaaggcagcaagctggccaagccgatccctgccagcacaggaggccgttgtgaagttgcgagtcgaggggatgacttgtcaatcgtgtgtgtcctccatagaggggaaggtgcgtaaactgcaaggagtcgtgagagtgaaagtgtcgctttccaaccaagaagccgtgatcacgtaccagccttacctgattcaacccgaagatctgcgggatcatgtgaacgacatgggttttgaagccgctattaagtccaaggttgcacctctgtcgttgggacccatagatatagaacgcctgcaatcaactaaccccaaacgacctttgagctcggcgaaccaaaactttaacaactcagaaaccctggggcatcagggaagtcacgtggtgacgctccagcttcgtatcgacggaatgcattgcaagagctgtgtgcttaacatcgaggagaatataggacaactgctgggcgtccaaagcatccaagtgtctctggaaaacaagaccgcgcaggttaagtatgatccttcgtgtacgtcgcctgtcgccttgcagcgagctattgaggcacttccgcctggtaacttcaaagtgtcattgccagacggagcagaaggatcggggaccgatcaccgcagttcatcctcgcattccccaggttcacccccacgtaatcaggtgcagggtacgtgttccacgactcttattgcgattgcgggcatgacttgtgccagctgtgtccattccatcgaaggtatgattagccaacttgagggagtgcagcagatctcagtgagccttgcagaaggaactgctaccgtcctctacaacccaagcgtgatcagcccagaggaacttcgcgcagccattgaggacatgggtttcgaggcctcggtggtaagcgagagctgttccactaacccacttggcaaccactccgcgggaaactccatggtgcagaccaccgacggaacccccaccagcgtgcaagaagtggcaccacataccggacgccttccagcaaaccatgctcccgatattcttgcaaagagcccccaatcgactcgggccgtcgcaccacaaaagtgctttctccagattaaaggaatgacttgcgccagctgtgtgagcaatattgagcgtaacctccaaaaagaagcaggagtgctgtcagtgctcgtggcactgatggccggcaaggcagaaatcaagtacgatccggaggtgatacaacctcttgaaatagctcagtttattcaggacctgggattcgaagcagcagtgatggaggactacgcaggctccgacggtaacattgaactgaccattactggtatgacctgtgcctcctgcgtccataacattgaatctaagctcaccagaaccaatggtatcacctacgcgtccgtggcgcttgcaacttcaaaagcgctggtgaagtttgatccggagattattggtcccagagatatcattaagattatcgaggaaataggtttccacgcgtcgcttgcacagcgaaaccctaatgctcatcatctcgatcataagatggagatcaagcagtggaagaagtcgtttctgtgctccttggtgttcggaatccctgtgatggctctgatgatatacatgcttatcccttccaacgaaccacaccaatcaatggtcctggatcacaacattatccctggattgagcattcttaacctgatcttcttcatcctgtgtaccttcgtgcagctgcttgggggctggtacttttacgtgcaagcatacaagagtctgcgccaccggtctgcaaatatggatgtcttgattgtgcttgcaactagcatcgcatacgtgtactcccttgtgattttggtggtggcggtggctgaaaaggcagaacggtcgccagtcaccttttttgatactccacccatgctgtttgtgtttatcgcactggggaggtggctggaacatctggccaagtccaagacgtccgaagcccttgcaaagctgatgagcctgcaagcaaccgaagcaaccgtggtgacccttggggaagataacctcattatcagagaagaacaggtgcctatggagctggtgcagagaggtgatatagtgaaagtcgttcccggtggtaagtttccagtggacggcaaagtgctggagggcaacactatggcggatgaaagcctgataactggcgaagccatgcccgtgactaagaagccgggatcaactgtcattgccggttcaatcaatgcgcatgggtcagtcttgattaaagcgactcacgtgggtaatgacaccaccctcgcacaaattgtgaaacttgtggaggaagcccaaatgtcgaaagccccaattcaacagctggccgatagattctccggctacttcgtgcctttcattatcatcatgtctactcttacccttgtggtttggattgtgataggctttattgacttcggcgtggtgcagaggtattttcctaatcccaacaagcacatttcccaaactgaggtgattatacgttttgcatttcagacctcaattactgtcctctgcatcgcatgtccctgtagtctgggtcttgcgaccccaacggccgtgatggtggggacgggagtggctgcacagaatggcattctgatcaaaggtggaaagcctcttgaaatggctcataagattaagaccgtcatgtttgacaaaaccggaactattacccacggagtcccgcgggtcatgcgtgtcctgcttttgggcgatgtggcaactcttcccttgcgcaaagtgcttgcagtcgtgggaactgccgaagcgtcgtcagagcatccactgggggtggcagtcaccaagtattgcaaggaagaactcggaactgaaactctgggatactgtaccgactttcaagcagtgccaggatgtggaattgggtgcaaagtgtcgaacgtggaaggaattctggcccatagcgagcggccactctcagcgcccgcatcacatctgaacgaagcaggttccctgcctgccgaaaaggatgcagtcccgcaaaccttttcagtgctgataggaaatagagagtggttgcgccgaaacggccttaccattagctcagatgtctccgatgccatgaccgaccacgagatgaagggacaaaccgccatccttgtggcaatcgacggtgtcctctgcggaatgattgcgattgccgacgccgtgaaacaagaggcggcactggccgtgcacacccttcaaagcatgggggtggatgtcgtcctgattaccggtgataaccgcaagaccgctcgtgccatcgcaacccaagtgggcataaacaaggtctttgcggaggtgctcccctcgcacaaggtggcaaaggtgcaggagctccaaaacaaaggtaaaaaggtggccatggtaggtgacggagtgaacgacagccctgctctggcccaggcagatatgggagtggcaattgggactggtacggacgttgcaattgaagcagcagacgtggtgcttatacgtaacgatctgcttgacgtggtagcctctattcatcttagcaaaagaactgtgcgccgcatccggattaatctggtgcttgcgcttatctataatctggtgggtattccgattgctgcgggagtctttatgccaatcggcattgtgttgcaaccgtggatgggctcagcagcgatggcggcttcgtcagtgtccgtggtgctttcgtcccttcaactcaagtgctacaaaaagcctgatcttgaacgctacgaggcacaagcacatggccacatgaaaccgcttaccgcatcgcaggtgtccgtccatatcgggatggatgacagatggagggactcacctagagccaccccctgggatcaggtgtcgtacgtgtcacaagtctccctgagctcgcttacttcggacaagccttcccgccactcggcagcagcggatgacgatggcgataagtggtcgctgctgctgaacggacgagatgaggagcagtacatt

SEQ ID NO: 7480 - DNA, 4395 bp, Artificial Sequence
  Description of Artificial Sequence: Synthetic coding sequence
atgcccgagcaggaacggcaaatcacagccagagaaggagctagccgaaaaatcctgagtaagctttccctgccaactagagcgtgggagcctgccatgaagaagtccttcgctttcgataacgtgggttacgaaggaggcttggacgggctcggaccctccagccaagtggcaacctccacagtgcggatccttggaatgacttgtcaatcatgtgtgaagagcattgaggatcggatctctaacttaaagggcattatctccatgaaagtcagcctcgaacaaggcagcgccactgttaaatatgttccctccgtggtatgcctgcaacaagtctgccaccagatcggagacatggggttcgaggcatcaattgcagaaggtaaagccgctagttggccaagtagatccctgcccgcacaggaagcagtcgtgaaactgagagtggagggaatgacctgccaaagctgtgtatcctcaatcgagggaaaagttcgcaaattgcagggcgtagtgagagtaaaagtgtccctctctaatcaggaggccgtgatcacataccagccttacctgattcagccagaggacctcagggatcacgtgaatgacatgggattcgaagccgcaattaagtccaaagtagcacccttgtccttaggtcctatcgacattgaacggctccagtctactaatcctaagcggccactgagctccgcaaaccaaaatttcaataatagcgagactctggggcatcagggctcacatgtagtcaccctacagcttcgcatcgacgggatgcactgtaagagctgtgtactcaacatcgaagagaacataggacagctcctgggagttcagtctatccaagttagtttggaaaacaagacagcacaagtgaaatacgatccttcatgcacctccccggtggctctgcaacgggccatcgaggccctccctcccggaaacttcaaagtcagcctgccagatggtgccgagggatccggtaccgaccacaggtcatcctcctcgcactctcccgggtctcccccaagaaatcaggtgcagggcacgtgctctacaaccttaatcgcaattgcaggtatgacatgtgcatcttgcgtccattcgatcgaagggatgatctcccagttagagggagtgcagcagatctccgtgtccctggcagaagggaccgctacggtgctatacaacccctccgttatctcacctgaagagttgagagcagcaatcgaggacatggggtttgaagcaagtgtcgttagtgagagttgctccacaaacccgttaggaaaccattccgcagggaactccatggttcagaccactgacggcacacccacctccgtgcaggaggtcgccccccatacaggacggctgcccgccaatcacgcccctgatatactggcaaagagcccccaatctacacgagccgttgctcctcaaaaatgcttcctccaaattaaaggtatgacctgcgcgtcatgtgtaagcaacatcgagcgtaatctacagaaggaggctggcgttttgtcagtattagttgccctgatggcaggcaaggcagagatcaagtatgaccccgaagttatccaacccctggaaattgcacagtttatccaagatctggggttcgaagcggcagtgatggaggactatgctggatcggacgggaatatcgagctgacgatcacaggcatgacttgtgctagttgtgttcacaacatcgagagcaagctgacgcgcacgaacggtatcacttacgcttccgttgctctggctacgtctaaggcgcttgtcaaattcgatccggaaatcattggtccccgggatatcatcaaaattattgaggaaattgggtttcacgcctcccttgcacagcgcaaccccaacgctcatcatcttgaccataaaatggaaattaagcagtggaagaaaagctttctgtgcagcttggtctttggtatcccagtgatggctctgatgatctacatgttaatcccatccaacgaaccccaccagagcatggtactggaccacaacattatccctgggttaagtatcctaaatctcatcttctttatcctctgtacgtttgttcagctgctgggtggctggtatttctatgtgcaggcttacaaaagtctacgccatcggtccgcaaacatggatgtgctcatcgtgctggccacatcaattgcctacgtttacagtctggtcatcttagtggtggccgtggcagagaaggcggaacgctcgccggtcaccttcttcgatacacctcccatgctatttgtgtttattgcacttgggcggtggttggagcacttggctaaatcgaagacatctgaggcgctggccaaactcatgtcactccaggctaccgaagctactgtcgtcacgctgggcgaagataacttgattatacgggaggaacaggtgcctatggagctggttcagcgcggcgacattgtcaaagtcgtgccgggggggaagttccccgtagatggaaaggtgttggaaggcaacaccatggccgacgaatcccttattacgggagaggccatgccggtgacaaaaaagccggggagtaccgtgatagcgggaagcataaacgcccatggctccgtactcatcaaggcaactcatgtaggcaatgatactacattggctcagatcgtcaaattagtggaggaggcccagatgtccaaagcacctatacaacagttagcagatcgattcagtgggtactttgtgccattcatcatcatcatgagcaccttgacactggtggtttggatcgtgatcgggttcattgactttggagtggtgcaacgctatttccccaatccaaataaacatataagccagacagaggtcataatcagatttgcatttcagacatcgatcacagtcctctgtattgcttgtccttgttcactcggtctagcaactcccacggcggtgatggtcggaaccggagtcgctgcccaaaacggaatactgataaaagggggaaaacccctggaaatggcccacaagatcaagaccgttatgtttgataagaccgggactatcactcacggcgtgccccgagtgatgagagtgcttctgctgggagatgtggccactctacctctgaggaaggtactagccgtggtgggcactgccgaggcgtcttcagagcaccctctgggcgtcgcggtcaccaaatactgtaaagaggaacttggcacagaaacactaggctattgtaccgattttcaagctgtccctggatgcggtattggctgtaaagtgagcaacgtcgagggcatcctggcccactccgagcgcccgttatctgctcccgcatcacaccttaatgaggcaggatctctgccggccgagaaagatgccgtgccccagacattcagtgtgcttattggaaatcgcgagtggttgaggagaaacggcctgaccattagcagtgatgtaagcgatgcgatgaccgatcacgaaatgaaaggacaaacagctatccttgtcgccatcgatggcgtgctctgcggcatgatagcgatcgccgatgccgttaagcaggaggcagccctggctgtccacacactccagagtatgggcgtcgacgttgtgctcataacaggtgataatagaaagaccgctcgcgccatcgccactcaggtgggtatcaataaggtttttgccgaagtgctaccatcccacaaggttgccaaagtgcaggaattacagaacaagggaaaaaaagtcgccatggtgggtgacggagtgaacgattctcccgcgctggctcaggccgatatgggcgtagctatcggcacaggaactgacgttgccatcgaagccgctgatgtcgtcctcattcggaatgaccttctcgacgtcgttgcatccattcacttgagtaagcgaactgtgcggcgaatcagaattaatctggtcctggccttaatctataacttggtcgggatccctattgccgctggcgtgttcatgcccattgggatcgtcctgcagccttggatggggtctgccgccatggccgcgtcctccgtcagcgttgttctgtccagtcttcagctcaagtgctataaaaagccagacctcgaaaggtatgaggcacaggcccacgggcacatgaagcctctgaccgccagtcaggtatctgtgcatatcggaatggacgaccggtggcgggactcaccaagagccactccctgggaccaggtgagttatgtgagccaggtgtccctgtcaagcctcactagtgataaacctagccgtcattcagccgccgccgacgatgatggcgataagtggagcctcctactaaacgggcgggacgaggagcagtacata

SEQ ID NO: 7481 - DNA, 4395 bp, Artificial Sequence
  Description of Artificial Sequence: Synthetic coding sequence
atgccggaacaggagagacagatcacagccagggagggggcctccagaaaaattctttccaagctctcacttcctacccgggcttgggagccagcaatgaagaagtcatttgcttttgataatgtgggttacgagggtggccttgacggtctgggtccaagttcccaggtcgcaacgtcaacagtgagaatcttagggatgacttgccagtcgtgtgtcaagtcgatagaggaccgcatctccaatctgaaggggattatcagcatgaaagtgtcactcgaacaggggtcggccacagtgaagtacgtgccgtcagtggtgtgtctgcagcaggtgtgtcaccagatcggggatatgggcttcgaggccagcatcgctgaagggaaggctgcctcttggccatcccgctctctgcccgcacaggaagccgttgttaagttgcgcgtggaaggcatgacatgtcagtcatgtgtctctagcatcgaaggtaaagtacgaaaactacagggtgtggtgcgggtcaaggtatctctctcaaatcaggaggcagtaatcacctatcagccttatttaattcagccagaagacctgagggaccatgtaaacgatatgggcttcgaagccgccattaaatccaaagtcgcccctctgagcctagggcccatcgacatagagaggctccagtccactaaccctaaaagaccgcttagctcagccaatcagaacttcaacaactccgaaaccttggggcaccagggctcacatgtggtcactcttcaactgcgcatagatggcatgcactgcaagtcctgcgtgctgaacattgaggagaatataggccagttgctcggcgttcagtccatccaggtgagcttggaaaataagacggctcaggtgaaatatgaccccagctgcaccagtccggtggccctgcagagggccattgaagcccttccacctggtaatttcaaggtttctctgccggatggcgccgagggctcaggcacggaccatcggtcatcatcctcccatagccctggatctccccccagaaatcaagtgcagggcacatgtagcacgactctaatcgctatagcaggcatgacatgtgccagctgtgtacattccatcgaaggcatgatcagtcaactggaaggcgtgcagcagatcagtgtgagcctggcggagggaaccgccactgttctgtacaacccttctgtgatctccccagaggagctgagagccgccatcgaagatatgggattcgaggcctctgttgtgagtgagagttgttccacaaaccctctgggcaaccattcagccggcaattctatggtccagacaacagatggtactcctacttctgtgcaagaagtggccccacataccggacgccttcctgccaatcacgctcccgacatcctcgccaagtctccacagagtaccagagccgttgccccacagaagtgcttccttcagatcaagggcatgacatgtgcaagctgcgtttcaaatatcgagcggaatctccagaaagaggctggggtgctctcggttctggtggccctgatggctgggaaggccgaaataaaatatgaccctgaagtgattcaacctctcgagattgcccagtttatccaggatctcggatttgaggcggccgtgatggaggactacgcgggatctgatggcaacattgaactgaccattactggaatgacgtgcgcttcatgtgtgcataatatcgaatcaaaactgacccggaccaacggcatcacttacgccagcgtggcactggctacatctaaggcgctggtcaagtttgatcctgaaattattggaccgcgagatattatcaagatcattgaagagatcggcttccatgcaagtttagctcagaggaacccgaacgcacatcatctagatcataaaatggaaattaagcagtggaagaaaagttttctctgtagtctcgtattcggaattcctgtcatggccctgatgatttacatgctaatcccaagtaatgaaccccatcagagtatggtgctcgaccataatatcatccccggtctttctatactcaatctaatcttctttatactgtgtaccttcgtacagcttctggggggatggtatttttatgttcaggcatacaagtcactgaggcatcggtccgctaacatggatgtactgatcgtgttagccacgagtattgcctatgtttacagtctcgtaatccttgtggtggccgtggcggagaaggccgaaaggtctcctgtcactttctttgacaccccgccaatgttatttgtattcatcgcactgggaaggtggttggagcacctcgccaagtctaaaacatctgaggccctcgctaagctaatgagcctgcaggccactgaagcaaccgtcgttacactgggagaggacaatctcatcattcgagaggaacaagtcccaatggaactggttcaaagaggcgacatagttaaggtcgtgccgggcggaaagtttcctgtggacgggaaagtgctcgagggaaacacaatggctgatgaaagtctgattactggcgaagccatgccggtgaccaagaaacctgggagtaccgtcattgccggctccataaatgctcatggttccgttttaatcaaagccactcatgtcggcaatgatacaaccctagcccagatagtaaagctagtagaggaagcccagatgagcaaggcccctatacagcagctggctgaccggtttagcggctacttcgtgccttttataattataatgtccactttaaccctcgttgtctggatagtgatcggcttcattgattttggcgtggtccaaaggtacttccccaatccaaacaaacacattagccaaaccgaagtcatcattcggttcgcctttcagacatcaatcacggtgctgtgcattgcttgcccctgtagtctgggcctggcaacccctaccgctgttatggttgggactggagtggccgcccagaatggaatactaatcaaaggcggaaaacccctggagatggcccataaaattaaaaccgtcatgtttgacaaaaccggtacgattacccacggcgttccgagggttatgcgagtacttctactcggtgacgtggccacccttccgctgcgcaaggtgttagcagtggttgggaccgcagaggcgtcgtctgagcatcccctgggtgtagccgtgaccaagtactgtaaagaagagctgggcaccgaaaccctcggctattgcactgatttccaggctgtgccgggttgcgggattggatgtaaagtctcaaacgtagaaggcattcttgcacactcagagcgccccttaagcgcccccgcctcccacttgaatgaagcgggaagcttacccgccgaaaaggacgcagttccgcagactttctcagtgctgattgggaaccgcgaatggttgcggcggaatggcctaactatttcaagcgatgtcagtgatgccatgaccgatcatgagatgaagggacagaccgcaattctggtcgcaatcgatggggtgctatgcggtatgatcgccattgcagacgcggtgaagcaagaggccgcactcgccgtgcacaccttgcagtcaatgggcgtagacgtcgtgctcattaccggggacaaccgtaaaaccgcgcgcgcaatagccacacaggtaggcataaataaagtttttgccgaagtgctgccatcacataaggtcgcaaaggttcaagagctccaaaataaagggaagaaggtcgccatggtgggagatggcgtcaacgattctcccgccctggcgcaagccgacatgggagtagctatcggtactgggaccgatgtggccattgaagcagcagacgttgtgctcatccgcaacgatttactggatgtggttgcaagtattcatctgtccaagagaacggtccgccggatccggatcaacctcgtgcttgccttgatctacaacctggttgggatcccaatcgccgctggcgtgtttatgcctatcggcatagtgctccagccttggatgggctccgctgctatggccgcttccagtgtgtccgtcgttttatccagtctgcagctgaagtgctacaagaaaccggatctggaacgctacgaggcacaggcccacggccacatgaagcctttaaccgcctcccaagttagcgtgcatattggcatggatgaccggtggcgtgattctccaagagccacaccctgggaccaggtgtcctacgtgtcgcaggtctcgttgagctcattgaccagcgataaaccaagcaggcattcggctgcagcagacgacgacggcgataagtggtctctgctcctcaatggcagggacgaggagcagtatatc

SEQ ID NO: 7482 - DNA, 4395 bp, Artificial Sequence
  Description of Artificial Sequence: Synthetic coding sequence
atgcctgagcaggaacgtcagattaccgcaagagagggtgcctcacgcaagatcctttcaaagctgtctcttcctaccagagcatgggaacctgccatgaaaaagtcttttgcttttgacaacgtcggctacgagggtggtttggatggactgggtccttcctcacaagtggctaccagcaccgtgcgtattctgggcatgacttgccagtcctgtgttaaaagtatagaagaccgcatcagtaacttgaagggtatcatctccatgaaagtctccctggagcagggatctgccactgtcaaatacgtaccttccgtagtctgcctgcagcaggtgtgtcaccagattggagatatgggtttcgaggcatcaatcgcagagggtaaggctgcctcttggccctcaagatcactgcctgcccaagaggccgtggtcaaactccgtgtggagggaatgacttgccaaagctgcgtgagttctatcgaaggcaaggtgcgtaagcttcagggtgtcgtcagagtgaaagtctcacttagcaaccaagaagcagtcatcacctatcagccctaccttattcaacccgaagacctgcgcgatcatgtcaatgacatgggattcgaggctgcaataaagtccaaggtggcaccattgtctctgggtcctatcgatatcgaacgtctgcaatccactaatccaaaacgtccactcagttcagctaaccaaaacttcaataatagcgagactctcggtcatcaaggctctcatgtggtgactctgcaactgcgcatcgatggaatgcactgtaagagctgtgtcctgaacatcgaagaaaacatcggacagctcctgggcgtgcagagcatccaagtgagcttggaaaataagactgctcaggtcaagtacgatccctcttgcacatctcctgtggctctgcaacgtgccattgaggccctgccacctggaaacttcaaggtgagcctgcctgacggcgctgagggatctggaaccgaccaccgctcctcaagtagtcatagccctggctctcctcccagaaatcaggtgcaaggcacatgctctactaccctcatcgcaattgccggtatgacctgcgctagttgcgtacattctatagaaggaatgatctctcagttggaaggcgtgcagcagattagtgtgagcctggctgagggaactgccaccgtcctgtataacccatctgttatcagccctgaagagcttcgtgccgcaatcgaagacatgggcttcgaagcatccgtggtttctgaaagttgcagcaccaatccactgggcaaccattccgctggaaacagcatggtgcaaacaaccgacggtacccctacatctgttcaggaagtcgcaccacacactggccgcctccccgctaatcacgctcccgatatcttggctaagagtccacagagtactagggcagttgctccccagaagtgtttcctccaaatcaagggtatgacatgtgcctcctgcgtatctaacatcgagagaaatttgcaaaaggaggcaggtgttttgtccgttctggtggcccttatggcaggaaaggccgagataaaatacgatccagaggtcatacagccactcgaaatagcccaatttattcaagacctgggttttgaagctgccgtgatggaagattacgccggtagcgacggcaatattgaactgaccatcaccggtatgacttgcgccagttgcgtgcacaacattgaatctaaacttacacgcacaaacggtatcacctacgcctccgtagctctcgctacctccaaagctctggtgaagttcgacccagagatcatcggtccaagggacatcatcaagattattgaggagatcggatttcatgcaagtctcgcacaaaggaaccccaacgctcaccacctcgatcacaagatggaaataaaacaatggaagaaatccttcctgtgctcattggtgttcggtatccccgtgatggctctgatgatttatatgctgattccctctaacgagccacatcaaagtatggtgctggaccacaacataattccaggactgtccattctcaacctgatattcttcatcctgtgcactttcgtccagttgctgggaggctggtatttctacgtacaggcttacaagtcactgcgccatagatcagctaacatggatgtgcttatcgtactcgctacttccatcgcctacgtatattctctggtgatattggtggtggccgtggctgaaaaggctgaacgtagtcccgtgacttttttcgatactccccctatgctgttcgtatttattgccctcggccgttggctggagcacctcgctaagtctaagacttctgaagcactggctaaactgatgagcttgcaggcaacagaagctactgtcgtgactcttggcgaagataatctgattatccgcgaagagcaggtgccaatggaactcgtgcagaggggcgacatcgtaaaggtggtgcccggcggaaaattccctgtggacggcaaggtcctggaaggaaatactatggctgacgagtcactgattactggtgaagccatgcctgttacaaaaaaacccggtagtaccgttatcgctggatccattaatgctcatggctcagtccttattaaggctacccacgtgggcaatgacactaccctcgcccagatagtgaagctggtcgaggaggcacagatgagcaaggctcctatccagcagctggccgataggtttagcggttactttgtcccattcatcatcatcatgagcaccctgactttggttgtctggatcgtcatcggtttcattgatttcggcgttgtgcagcgttacttccctaatcctaacaagcatatatcccagactgaagttatcatcaggtttgctttccagaccagcatcacagttctgtgtatcgcttgcccttgcagtttgggccttgctacacctactgcagtgatggttggcaccggcgtcgcagcccaaaacggcatcctgatcaagggcggtaagcccctcgaaatggctcacaagatcaagaccgtgatgttcgataaaacaggtaccatcacccatggtgtgccacgtgtaatgcgcgtcctcctcctgggtgatgtggccaccctgcccctccgcaaagtgttggcagtagtaggaactgcagaggcttcttccgaacacccactcggcgtggctgtaacaaaatactgcaaagaggagcttggaactgagacacttggctactgtactgactttcaagccgtgcctggctgcggaatcggatgcaaggtaagtaacgtagagggaattctggcacactcagaacgtcccttgtcagcccctgcttctcacctcaacgaggccggttcacttcccgctgagaaggatgccgtgccacagacattttcagtcctgattggcaacagagaatggcttagaagaaacggcttgaccatatccagcgatgtgagtgatgctatgaccgaccacgaaatgaagggtcaaacagctatcctggtggctatcgacggcgtactctgcggaatgatcgccatagcagatgccgtgaagcaggaggcagcacttgccgtgcacactctgcagagcatgggtgttgacgtggtgctcataactggagataataggaagaccgctcgcgcaatcgctacccaggtcggcatcaataaggttttcgccgaggtactcccttcacacaaggtagccaaggtgcaggagttgcagaacaagggtaaaaaagtggccatggtgggcgacggagtaaacgattcccctgcccttgcccaggccgatatgggcgtggcaattggtaccggtactgatgtagcaatcgaggccgctgacgtggtgcttatcagaaatgatctgctggacgtggttgcttccatccacctgtctaaacgtacagtaagacgtattcgtattaaccttgtgctggccctgatttacaatctcgtcggcatccctatagctgccggcgtcttcatgcctattggaatcgtgctccagccttggatgggatctgctgctatggctgcttcctccgtttccgtcgtcctgagttctctgcagctgaaatgttacaaaaagcctgatcttgagaggtatgaggcccaagcacatggacatatgaaaccactcacagccagccaggtctccgtccacatcggcatggatgatcgctggcgtgatagcccaagagccaccccttgggatcaggtctcatatgtcagccaggtttctctttcatcactgacttctgacaagccctcaaggcattctgccgctgcagacgacgacggagataaatggtccctccttcttaacggcagggacgaagaacaatatatc

SEQ ID NO: 7483 - DNA, 4395 bp, Artificial Sequence
  Description of Artificial Sequence: Synthetic coding sequence
atgcccgagcaagagcggcaaatcaccgcaagagagggcgcatcccgaaaaatattgtctaagctgtcactacctactagagcgtgggaaccagccatgaagaagagctttgcgttcgacaacgtgggttacgaggggggtctggacgggcttgggccttcctcccaggtggccacgtcgaccgtgcggatcctagggatgacctgccaatcatgcgtcaagagtatcgaggaccgaatcagcaatttgaaaggcattatatctatgaaagtttcgttagagcagggttctgcgaccgttaagtatgtccctagcgttgtttgcctgcagcaggtttgccaccagattggagatatgggttttgaggcctctattgccgagggcaaggcggccagctggccgtcacgatcacttccggcccaggaggcagtcgttaagctaagagttgaagggatgacctgccaatcttgtgttagttcaattgagggtaaggttcggaaattacagggcgtggtgcgggtgaaagtcagtctttcgaaccaagaggcggtcataacatatcagccctacctcatacaaccagaggatctgcgggaccacgtcaacgatatgggcttcgaagctgcgatcaagtctaaggttgcaccactgtctcttggcccgatcgatatcgagcgtttacaaagcacaaatcccaagcgtcccctgtcctcagctaatcagaacttcaacaacagcgagacactcggccaccaaggaagtcatgtggtaacgcttcaactgaggatcgacggtatgcattgcaaaagctgtgtcctgaacatcgaggagaacatcggtcagcttctgggggtccagtccattcaggtgtctctcgaaaacaaaactgcccaagttaaatatgacccatcctgcacctcaccagtagcgttgcagagagcaattgaagccttgccacccggcaacttcaaggtcagccttcctgacggcgcagaaggttcgggaacggatcacagatccagcagttcccacagccctggtagcccaccgcgcaaccaagtgcaggggacctgctcgacaaccttgatcgcaatcgcagggatgacttgtgcttcctgcgtccacagtatagagggtatgatatctcagctcgaaggtgtccaacaaatcagcgtctctttagccgaagggactgcaacagtgctttacaacccttcggtgatttcaccggaagagcttcgagctgctattgaggatatgggctttgaagcatccgtggtcagtgagtcatgctctaccaacccgcttggtaatcactctgctggtaattcgatggtgcaaacgaccgatgggaccccgacttccgtccaggaagttgcccctcacacaggacgactcccggcgaatcacgctcccgacatcctcgcgaaatcccctcagagcactcgagctgttgcccctcagaaatgtttcctccagattaagggcatgacttgcgcctcctgcgtctcaaatatcgagcgaaacctccagaaggaggcgggcgtgctttccgttctcgtggcactcatggctggaaaggctgagattaagtatgacccggaagtcattcaacccctggagattgcacaattcatacaggaccttggctttgaagccgctgttatggaagattacgctggatctgatggcaacattgaactgactatcactggaatgacttgcgcgtcctgcgttcacaatattgagagtaaactgacaagaactaacggaatcacgtacgcctccgtggcgctcgccacatcaaaagcccttgtgaaattcgatccagaaatcataggtccgcgcgacattatcaagataatcgaggagattggcttccatgctagcctggctcagcgtaaccccaacgcccaccacctcgatcataagatggaaattaagcagtggaagaagtcctttctgtgcagccttgtatttggaatccctgtgatggcgctgatgatttatatgctcatcccatccaatgaacctcatcagtcgatggtcttggatcataatataataccaggtctgtcgattcttaaccttatcttttttatcctctgcacttttgtgcaattactgggtggatggtacttttatgtccaggcatacaagtcccttcgtcatcggtcagcgaatatggatgttttgatcgtgctagcaacgagcatcgcttatgtctatagtctcgtcattcttgtggttgcggtggcggagaaagcagagcgatctcctgtaacgtttttcgacacacctccaatgctgttcgtttttatcgcgttaggtcgttggttggagcatctagcaaagtccaagacgtcagaggctcttgccaagctgatgtctctgcaagcgacggaagctacggttgtaaccttgggagaggacaacctcataattcgggaagagcaagtccccatggagctcgtacaaagaggggatattgtgaaggttgtgcctggagggaagtttcctgttgatggtaaggtgctggagggtaatacgatggctgacgagagcctcatcactggagaggcaatgcctgtcacaaagaaacccggctccactgtcatcgccggatcgatcaacgctcacggctcagtgctgatcaaggctacacacgttggaaacgatacaacgcttgcacaaatcgtgaagttagtcgaggaagctcagatgtccaaggcgccaatacagcagcttgctgatcgattttctggctattttgttcccttcatcatcatcatgtctaccttgacccttgtcgtttggattgtgattggattcatagattttggcgttgtccagcgctatttccccaacccaaataagcacatctcgcagacggaggtgatcatacggttcgccttccagacttccattaccgtgttgtgtattgcgtgtccttgttcgctgggcctggcaacccctacagctgtaatggtcggcaccggcgtggccgcacaaaacggcattctcatcaaaggcggcaaacctctagagatggctcacaagatcaagactgtaatgttcgataagaccggtacaattactcacggtgttccccgagttatgcgagttctattgcttggcgatgtcgccaccctcccgttgcgaaaggttctggcggtggttgggacagcagaggcgtcttctgagcatcctttgggtgtagcagtcaccaagtattgtaaagaggaattaggaacggagacgcttggttactgtaccgacttccaagctgtaccggggtgtggaattggatgtaaggttagtaatgttgaagggatcctggcacactctgagcggcccctatctgctcccgcttcccatttgaacgaggcaggcagcctgcctgcagaaaaggatgcggtgcctcagactttctcagtgctgatcggtaatcgcgagtggctccgtcgcaacgggctgaccatcagttcggacgtctcagacgctatgacagatcatgaaatgaagggtcaaaccgccatcctggtggcaatagacggtgtgctgtgtgggatgatagcaatcgccgatgctgtgaagcaggaagcagcgcttgccgtccacacgctacagtccatgggtgtcgatgtcgtactcataaccggtgacaaccggaagaccgcccgtgccatcgctacgcaagtaggtatcaacaaagtgttcgccgaggtcctaccctcacacaaagtcgcgaaagtacaagaactgcagaacaagggtaagaaggttgccatggtcggagatggagttaacgactcacccgcccttgcccaggcggacatgggcgtcgcgatcggcaccggtacggacgttgccatcgaggcggcggacgtcgtgttgatccgtaacgacctgctggatgtggtggcctcgattcatctttcgaaacgaactgtgagacggattaggataaacctggtccttgcgttgatctacaaccttgtaggtatccctattgctgctggcgtttttatgccgattggtatcgttctccagccatggatgggttcggccgccatggcagcgtcatcggtctcagtcgttctttcctcacttcagctcaagtgttataagaagcccgatttagaaaggtatgaggctcaggcgcacggtcatatgaagccgctaacggcctcacaggtttcggttcatataggtatggatgacaggtggcgggattcacctcgggccactccttgggaccaggtctcttacgtcagccaagtctctctgagctcacttacgtccgataagccctcgcgacattccgcagccgcggacgatgacggcgacaagtggtcccttctgcttaacggacgtgatgaagaacaatacatc

SEQ ID NO: 7484 - DNA, 4395 bp, Artificial Sequence
  Description of Artificial Sequence: Synthetic coding sequence
atgccggagcaggaaagacaaatcactgcccgcgaaggcgccagtcgcaaaatattgtcgaagctgtcgttgccgacccgtgcctgggaacctgccatgaagaagagttttgcgttcgacaacgtaggatacgaggggggcctggacggactagggccatcgagtcaggtggcgacaagtactgtgcgcattctaggcatgacctgccagagctgcgtgaagtcgatagaggaccgcatcagcaatctgaagggtattattagtatgaaggtttctttggagcagggttcagccaccgtaaagtacgttccctcagtggtttgcttgcaacaggtctgtcatcaaattggtgatatgggcttcgaagccagcatagcagagggcaaagccgcctcctggccgagtcggagcttgccagcccaggaagccgtggtcaaactgcgggtggagggtatgacctgccagagctgtgtgtcctctattgaagggaaggtgcgcaaactacagggagtcgtcagggtcaaggtgtctctgagcaaccaagaagccgtgattacctaccagccatacctgattcaaccggaggatcttcgtgatcatgtgaacgacatgggctttgaagccgcgattaagtccaaagtcgcccccctgtcactgggtcccatcgatatcgaacggctgcaatcgactaatccgaagcgcccgctgtcatccgccaatcagaatttcaataattccgagaccctcggacaccagggaagccatgttgtaaccctgcagctgcgcattgatggcatgcattgcaagtcgtgcgtgctaaacatagaggaaaacatcggccaactactcggtgtccagagcatacaggtgtccctagaaaataagacagcccaggtcaaatacgatccgagctgtacatcaccggtggccttgcaacgggccatcgaggcgctgcccccaggaaactttaaggtgtcgctccccgacggtgcggagggaagcggcacagatcacaggagctccagctcccactcgccaggtagcccaccgcgcaaccaggtccagggaacttgttctacgacgctgatcgccattgcaggcatgacctgcgctagctgcgtacactctattgaaggaatgatcagccagctggagggtgtgcagcaaatctctgtttctttggcggagggcacagcgactgtactgtataatccatccgtgatctctcccgaagagttgcgtgccgctatcgaggacatgggcttcgaggcctctgttgtatctgagtcctgttcgaccaacccactcggtaaccattcggctggaaacagtatggtgcagacgacagacggcacgccgacgtccgtccaggaggtggccccgcatactggccgtctgccagctaatcacgctccagacatcctggccaagtccccacagtccacccgcgccgttgccccccagaagtgctttttgcagatcaagggaatgacgtgcgcgagttgtgtgtctaatattgagcgcaatctgcagaaggaagccggcgtcttgtccgtgctggtggcgttaatggcgggaaaagcggagatcaagtacgaccccgaggttatacaaccactcgagatagcccagttcattcaggatctgggcttcgaagcagctgtgatggaagactacgccggctcggatggaaatattgagctgaccattacaggtatgacctgcgccagctgtgtgcacaacatcgagtcaaagttgacccgtacgaatggcattacttacgccagcgtcgcgcttgccacctccaaggctttggtgaagttcgatccggaaataataggaccacgggacattataaagatcatagaggagataggattccacgcttcgctggcacaacgcaatccgaacgcgcaccaccttgatcacaagatggaaataaagcagtggaagaagagcttcttgtgcagccttgtgtttggtatccctgtgatggcgctaatgatctacatgctcatcccatccaacgagccccaccaaagcatggtcctcgatcacaatataatcccaggtctatccattttgaatctgatcttttttattctgtgcacctttgtccagttgctcggaggctggtacttttacgttcaagcttacaagagcctacgccatcgcagcgccaacatggacgttctaatcgttctcgccacaagcattgcttacgtgtattcactggtgattttggttgtggccgtagcggagaaggcagagagatccccggtgaccttcttcgacacgccccccatgctcttcgttttcatagcgctcgggcgttggttggagcatctggccaagtccaaaacctctgaggccttggccaaactcatgagcctccaggccacggaagccacagtggttaccctcggtgaggacaacttaattatcagggaggagcaagtcccgatggagctggtgcaaaggggcgacattgtgaaggtcgtccccggcggcaaattcccggtcgatggtaaagtgctagaaggcaatacgatggccgacgagagtctaataaccggtgaggcgatgcctgtgaccaagaaacccggatcaacagtgatcgctggcagtattaatgcgcatggaagcgtgttgattaaggctactcacgtcggtaatgataccaccttagctcagattgtgaagctcgtggaggaagcccagatgagtaaagcgcccattcaacagctagccgatcggttctccggatacttcgttccgttcataatcatcatgtcgacactgactctagtcgtgtggatcgtgatcggttttattgattttggcgtggtgcagcggtatttccccaatccgaacaaacatatctcacagaccgaggttatcattcgctttgcgtttcagactagcattacggtgctgtgtatagcctgcccctgcagcttgggactggcaacacctaccgccgtgatggtgggtacgggcgtcgccgcccaaaatggtatccttattaagggtggtaagcccttagaaatggcccacaagataaaaaccgtcatgttcgataagactggcactattacccatggggtgccgcgtgtgatgcgggtcctcttgctgggcgatgtcgcaacgctgccactccgaaaggtattggcagtcgttggaacagccgaggccagcagtgagcaccccctgggagtggcggtgaccaagtattgcaaggaggaactcggaacggagactctgggatattgcactgatttccaagccgtgccgggctgcggaattggctgcaaggtttcgaacgtagaggggattctggcgcactcggagcgtcccctgtccgctcctgcttcacacctcaacgaagctggaagtttgccggcggagaaggatgccgtaccccagaccttcagcgtgctgatcggcaatcgtgagtggctccgccgcaacgggctgaccatctccagcgacgtcagcgatgccatgactgatcacgagatgaagggccagacggcgatccttgtggcgatcgatggtgtcctgtgtggtatgatcgcgattgcagatgccgttaaacaagaggcggccctcgccgtgcacacgttacagagcatgggtgtcgatgtggtgttaatcaccggggataatcgaaagacggccagggccattgcgacgcaagtgggcataaataaggtcttcgcagaggtcctaccgtcccataaggtcgcaaaggtacaggaactccaaaacaagggcaagaaagttgcgatggttggagatggcgtgaatgattcgccggcgctggcccaagcggatatgggagtggcgatcggaaccggaaccgatgtggccatcgaagcggctgacgtggtgctgattagaaatgacctgctggatgttgtagctagtatacacctaagtaagcgtaccgtgcgacgcatccgtataaatttggtgctcgcgttgatttacaacctggtgggaattccaatcgcggccggcgttttcatgcctatcggcattgtgttacaaccatggatgggcagtgcggcgatggctgcgtcctcggtctccgtggtcctgtcctcccttcagttgaaatgctataaaaaaccggaccttgaacgctacgaagctcaggcccacggccacatgaagcccctcacggcctcgcaagtgtcggttcatattggcatggacgatcgctggagggattccccgcgcgctacaccgtgggaccaggtgtcgtatgtcagccaggtgtctttgagctcgttgaccagcgataagcccagtcgccattcagcagccgcggatgacgatggggacaagtggtcacttctgctgaacggccgtgatgaagagcagtacatc

SEQ ID NO: 7485 - DNA, 4395 bp, Artificial Sequence
  Description of Artificial Sequence: Synthetic coding sequence
atgccagagcaggagcggcagattaccgcccgagaaggcgcatcccgtaagatcttatccaagctgtctctcccaacccgggcttgggaacctgctatgaaaaagtctttcgcattcgacaatgtaggttacgagggggggttagatggcctgggcccatcatcacaggtggccaccagtaccgtccggattctggggatgacatgtcaatcatgtgtgaaatccatcgaggatagaatttcaaacctaaaggggatcatttctatgaaggtgtccctggaacagggaagtgctactgtaaaatacgtgcctagtgtcgtttgtctgcagcaggtttgccatcaaattggcgatatgggatttgaagcttctattgccgaggggaaagctgcttcctggcctagcaggagcctgccagcacaggaagctgttgtgaaactgagagtggaaggcatgacctgtcagtcatgcgtttcctccattgaaggaaaggtccgcaaactccagggagtggtgagggtgaaagtgtcactctccaatcaagaagctgtgatcacctatcagccctatctgatccagcctgaagacctccgcgaccacgtaaacgacatgggtttcgaggctgccatcaaatcaaaggtggctcccctcagtttaggccctattgacatcgagaggttacagtccaccaatcccaagcgacctctatcatccgcgaaccagaatttcaataatagcgagactctgggacaccagggctcacacgtggtcaccctgcaactgagaatagatggaatgcactgcaaatcttgtgtgctaaacatcgaagagaacattggacagctgctgggagtccagagtattcaagtctctttggagaataaaactgcgcaggttaagtatgacccgtcttgtacctcacctgtcgcactgcaaagagcgatcgaggcgttgcctccaggtaacttcaaggttagtctcccggacggcgccgaggggagcggaaccgatcaccggagtagctcatcccactcccccggtagtccgcccagaaaccaggttcagggcacctgcagcaccacacttatcgccatcgcaggcatgacgtgcgcatcttgtgtgcactctatcgagggaatgatctctcagctcgagggagtgcaacaaatctcagtgtccttggccgagggaaccgcgaccgtgttatacaatccaagcgttatatctcccgaggagctgcgcgcggccattgaggacatgggctttgaagcctctgtggtgagtgagtcatgttctactaatcctctaggcaatcactctgcgggtaactctatggtgcaaaccaccgatggtacccctacctccgtgcaagaggtggcgccacacactgggcgtttgccggccaaccatgcccccgacatactcgctaaaagcccccagagtactagggccgtggccccgcagaagtgtttcctgcaaatcaaggggatgacctgtgcttcgtgcgtcagcaacatagaacgcaacctgcagaaggaggccggagttctaagcgttcttgtcgctctgatggctggcaaagccgaaattaaatacgaccccgaggtgattcaaccactggagatcgcgcaattcatccaggacttggggtttgaagccgcagtcatggaagactatgctggctctgatggaaatatcgagttaacaattaccgggatgacttgtgcgtcttgcgttcacaatattgaatcaaagctgacccgcaccaacgggattacgtatgcttctgtggctttagccacgtccaaagctctagtaaagttcgacccagaaatcattggcccccgggacatcattaagattatcgaagagatcggatttcacgcctcgttggcgcagagaaatccaaatgcccaccacttggaccataaaatggagataaagcagtggaagaagtcattcctttgcagcctagtcttcggcatccccgtaatggcgctcatgatatacatgctgattcctagcaacgaacctcaccaatccatggttttggaccacaatattatccccggcctgagtattctgaacctgatcttcttcattctctgtacatttgtgcagctacttggaggttggtacttttacgtacaggcttacaagtctctcaggcataggtccgccaatatggatgtgttgatcgtacttgcaacatccatcgcctatgtgtattccctggtcattctggttgtagctgtggccgagaaagccgagagaagtcctgtgaccttcttcgacaccccccctatgttgttcgttttcatagcgctgggccgctggctggagcatctggctaaatccaaaacatcagaagcactggctaaactaatgtcacttcaggctaccgaggcgactgttgttactctgggagaagacaacctgatcattcgagaggagcaagttccgatggagctggttcagaggggagatatagtgaaagttgtgcccggaggcaaattcccggtcgacgggaaggttttggaaggcaatacaatggccgacgagagtctgatcaccggcgaggccatgccagtaacgaagaagcccggttctaccgtgattgcggggtctataaacgctcacggctcggtattaattaaggccacccatgtgggtaacgacaccacactggcacagatagtgaagttggtggaagaggcacaaatgagtaaggcccccatccagcaattggcagacagattttcgggatattttgtgccattcataataattatgtccaccctgactcttgtggtctggatagtgatcggcttcatcgacttcggggtggtgcagcgatactttccgaaccccaacaagcatattagtcaaacagaggtgataattcgcttcgcattccaaacatccatcacagttctgtgcatagcttgtccatgctcactcggcctggccactcctaccgctgtcatggtcggaaccggggttgcagctcagaacggtatcctcatcaaaggggggaagcccctggagatggctcacaagatcaagacagtgatgttcgacaaaacaggcaccatcactcacggggtacctagagtgatgcgggtgctactgctcggggacgtggccactctgccactgcgcaaagtgttggccgtcgtgggtacagctgaggctagtagtgagcaccctctgggagtagctgttacaaaatattgcaaggaagagcttggaaccgagacgctgggctactgtactgacttccaggcagtaccgggatgtggcattggttgcaaagtgtcaaacgtggaaggtattcttgcccactcggaacggcctctcagcgctccagcctctcacctcaacgaagcgggcagcctgccagcagagaaggatgctgttccacagacgttctccgttttgatcggcaaccgagagtggctacgtagaaacggcctgactatctcttctgatgtgtccgatgccatgaccgaccatgagatgaagggccagacagcaatcttggtggccatagacggcgtcctgtgtgggatgatcgcaatcgcagacgccgtgaagcaggaggccgcactggccgtgcatacactgcagagtatgggagtggatgtggtgctgatcacaggagataatagaaagaccgctcgtgccatcgctacacaggtgggcatcaacaaggtttttgccgaagtcctgcctagccataaagtggccaaagtgcaggagctccaaaacaagggaaagaaggttgccatggtgggcgacggcgtgaatgactcccctgccctggctcaagctgacatgggagtcgctattggaacaggcactgacgtggctattgaagcagctgatgtggtgctcatccggaacgatttgctcgacgttgtggcgtcgattcatcttagcaaacgcacggttcgcaggattagaattaacctcgtgctagctctgatatataatcttgtaggtatacccatcgccgctggcgttttcatgcccatcggaatcgtcctccaaccatggatgggttccgctgccatggccgcaagtagcgtcagcgtggtgctgtccagcctccagctcaaatgctacaagaaaccagatttggagaggtacgaggctcaggcgcatgggcatatgaagcccctcaccgccagtcaagtgagtgtgcacatcggcatggacgatcgctggcgggactcccccagggcaaccccatgggatcaggtttcgtacgttagccaggtcagcttatcttcacttacaagcgataagccgtctagacactcagccgccgctgatgacgacggggataaatggagcctccttctaaacgggcgtgacgaagagcagtacatc

SEQ ID NO: 7486 - DNA, 3858 bp, Artificial Sequence
  Description of Artificial Sequence: Synthetic coding sequence
atggatttggaggccgctaagaacggaaccgcctggcgccctacttcagcggaaggagactttgagctgggcatctctagtaaacagaaaagaaagaaaaccaagaccgtcaagatgatcggtgtgctcactctgttcagatactcagactggcaggacaagttgttcatgtcgctgggcaccatcatggcgatcgcccacggatcaggactgccgctgatgatgatcgtctttggtgaaatgactgacaagtttgtggacactgccggcaatttctcgtttccggtgaacttctcgctgagcctgctgaatccgggaaaaatcctggaagaggaaatgaccagatacgcgtattactactccggactgggggcaggcgtgcttgtcgccgcctacatccaagtttcgttctggacgcttgcagctggtaggcaaattcggaagatccggcagaagttcttccacgccatcctccggcaagaaatcggatggttcgatatcaacgatactaccgagctgaacacccgccttaccgacgatatctccaaaatcagtgaggggatcggagataaggtgggcatgtttttccaggccgtcgccacctttttcgctggcttcattgtgggctttattcgggggtggaaactgacccttgtgatcatggcaatcagcccaatcctgggactgtccgccgcagtgtgggccaagatactctcggcttttagtgacaaagaattggccgcctacgctaaggcaggtgctgtggccgaggaagccctgggagccatcagaactgtgattgccttcgggggccagaacaaggaactggagcgataccaaaagcatctggaaaatgccaaggaaatcggaatcaagaaggcgatctcggccaacattagcatgggaattgcctttcttttgatttacgcctcctacgccctggcgttttggtacggcagcacgctcgtgatctccaaagaatacactatcggaaatgcaatgactgtgtttttctcaatactgatcggcgccttctccgtggggcaagcagcaccatgcattgacgcgttcgcaaacgcgcgcggagctgcctacgtcatttttgacatcattgataacaatcctaaaatcgactcgttctcagagcggggacacaagccggactcaatcaagggtaacctggagttcaatgacgtgcatttctcgtacccgagcagggccaacgttaagatccttaaggggctgaacctgaaggtgcagtcagggcagactgtggcactggtcggctcgagcggctgtggaaaatccactacggtccagctcattcagagactctatgacccggacgaaggaaccattaacatcgatggacaggacatccgcaatttcaatgtgaactacctgcgggagattataggcgtcgtgtcccaggaaccggtgctcttctcaaccaccattgccgagaacatatgctacggtcggggcaacgtcaccatggatgagatcaagaaagccgtcaaggaggcgaacgcttacgagtttatcatgaaactgccgcagaagtttgatactctggttggagaacggggtgcacaactctctggaggacagaaacaacgtatcgccatcgcacgcgcgctggtccggaatccgaagattctcctcctggacgaagcgacctccgctctcgataccgagtcagaagcggaggtccaagccgcgctggacaaggctagagaggggcgcactacgatcgtcatcgctcatcgtctctcgaccgtgcggaatgcagacgtgatcgccggattcgaggatggagtgatcgtcgaacagggatcgcactcggagctgatgaagaaagagggagtgtacttcaagttggtcaatatgcagacttcaggttcccaaattcagagcgaagaatttgaactgaatgatgaaaaggcggccacccgcatggcgcccaacgggtggaaatcacgactgttcaggcactcgacccagaaaaacctgaagaacagccagatgtgtcagaaatcgttggacgtggaaacggacgggctggaggcaaatgttccaccggtatccttcctgaaggtgctgaagctgaacaagactgaatggccttactttgtcgtcgggacggtgtgcgctatcgctaacggagggctgcagccagcgttcagcgtgatcttctccgaaatcatcgcgatcttcggccctggcgatgacgcggtgaagcaacaaaagtgcaacattttcagcctgatcttcctgttcttgggaatcatctcttttttcactttcttcctgcagggtttcaccttcggcaaggcgggagaaattctcacccgtcgccttaggtcgatggcgttcaaagctatgttgcggcaagacatgagttggttcgacgaccacaagaattccaccggcgccctgtccactcgcctggccacggatgctgcacaagtgcaaggcgccaccgggactcgcctcgcccttatcgcacagaacatcgccaatcttggaactggaatcatcatctccttcatatacggatggcaactgaccctcctccttctcgcagtggtccctatcatcgcagtgtctggaatcgtcgaaatgaaactgttggcgggaaacgctaagagagacaagaaagagctggaagccgctggcaagattgccaccgaagccatagagaatattcggaccgtggtgtcgctcacccaagagcgcaagttcgagtcgatgtacgtggaaaagctctacggaccctatcggaactccgtgcagaaagcccacatctacggaatcaccttctcaatctcgcaagccttcatgtacttttcttacgctggttgcttccgcttcggcgcctacttgatcgtgaacggtcatatgagatttcgagatgttatcctcgtgttttcggcgatcgtgttcggagccgttgcattgggccacgcgtcatcctttgccccagattacgccaaagcgaagctgtcggctgcgcatctgttcatgttgtttgagcgccaaccactcatcgacagctactccgaggaaggtctgaagccggacaagttcgaagggaacatcactttcaacgaagtggtgttcaactatcccactcgcgctaacgtgccggtgctgcaaggtctgtcacttgaggtcaaaaagggacaaacccttgccctcgtaggaagctcaggttgcgggaagagcaccgtagtgcagttgctcgagcgattctacgacccactcgcaggtacggtctttgtggacttcgggttccagctccttgatggccaagaagcaaaaaagctcaatgtccagtggctgcgcgcccagctcggaattgtttcccaggaaccaatcctcttcgactgctcgattgcggagaatatcgcctacggagataatagcagagtggtttcccaggatgagatcgtgagcgcagctaaggccgctaacatccacccattcatcgagactctgccccacaagtacgaaactcgggtcggggacaagggaacccagctgtcagggggacagaagcagcggattgcgatcgctagagcgctgatcaggcagccccagatcctgttgctcgatgaggcaacgtccgcgttggacactgaaagcgagaaggtggtccaggaagcgctcgacaaagcccgcgaaggacgtacttgtatcgtgatcgcgcacagactgtcaactatccaaaacgctgatcttatcgtcgtgttccaaaatggccgcgtcaaggaacatggaacccatcagcagcttctcgcacagaagggcatctacttctccatggtcagcgtgcaagccggtactcagaacctg

SEQ ID NO: 7487 - DNA, 3858 bp, Artificial Sequence
  Description of Artificial Sequence: Synthetic coding sequence
atggacctggaagcagcaaagaacggaaccgcatggcgccctacctcagccgaaggcgacttcgaactgggcatctctagcaaacagaaaaggaaaaagactaagactgtcaagatgatcggtgtgctgacgctcttccgatacagcgattggcaggacaaactgttcatgagcctcggtacgatcatggcgatcgcacacggctcaggactccctttgatgatgatcgtgttcggagaaatgactgataagttcgtggacacggcggggaacttttcattcccagtcaacttctcactgtccttgctgaatccgggaaagatcctggaagaagagatgacccgctacgcgtactactactccggattgggagcaggagtgttggttgctgcctacatccaagtctcgttctggaccctcgcagccggacgccagatccgcaagatccgccaaaagtttttccacgccattcttcggcaggagatcggatggttcgatatcaatgatactaccgaactgaatacccgcctgaccgatgacatctcgaagatctccgagggtattggggacaaagtgggcatgtttttccaagccgtggccacttttttcgccggctttattgtgggattcatccgcggttggaagctcacgctggtgatcatggccatctcgccgatcctggggctttcagcggctgtctgggcgaaaatccttagcgcgttctccgataaggaactggccgcctacgcaaaagcgggcgccgtcgcggaagaagcactcggcgccatcagaactgtgatcgccttcggaggacagaataaggagcttgaacgctaccagaaacacctcgaaaacgcaaaggaaatcggcatcaagaaggcgatcagtgcgaacatcagcatggggatcgcgtttcttctcatctacgctagctacgctttggccttttggtacggctccactttggtgatttcaaaggagtatactatcgggaatgctatgaccgtctttttctccatcttgattggggcgttctccgtgggccaggctgccccctgcatcgacgctttcgcgaacgcccggggcgctgcgtatgtgatttttgatatcatcgacaataatcccaagatcgactcgttttcagaacgggggcacaaaccagattcgattaagggcaacctggaattcaatgacgtccatttttcgtatccttcgcgcgccaacgtgaagatccttaagggccttaacctcaaggtccagtcaggccagaccgtggcgcttgtgggatcctcaggttgcggcaagtcgactaccgtgcaacttattcaacggctgtacgatccggatgagggtacgatcaacatcgatggccaggatattagaaactttaacgttaactacttgcgggagatcattggcgtggtgtcccaggaaccggtcttgttcagcaccactattgcagagaacatctgctacgggcggggaaacgtgaccatggacgagattaagaaggccgtgaaagaggccaatgcatacgaattcatcatgaagctccctcagaagttcgacaccctcgtcggggaaagaggagcccagctgtctggcggacaaaagcaacgcatcgccatcgcacgcgccctggtgcggaacccaaaaatcctgctcctggacgaagccacgagcgcgctggacaccgagagcgaagcagaggtgcaggctgcgctggacaaggcgcgggagggaagaacgactattgtgatcgctcacaggctgtcaactgtgcgcaacgccgacgtgattgctggcttcgaagatggtgtgatagttgaacaaggctctcattcagaactgatgaagaaggaaggagtttactttaaactcgtgaacatgcagacctcgggctcacagatccagtccgaggaattcgaactgaacgacgaaaaagcggcgacccggatggccccgaacggttggaagtcgagactgtttcggcactcaacccagaagaatctgaagaacagccaaatgtgccaaaagagcctcgacgtagaaaccgacggactggaagcaaatgtccctccggtgtccttcctgaaggttctgaaacttaacaagactgagtggccatactttgtggtgggtacggtgtgcgcgatcgccaacggcggactccagcctgccttcagcgttatcttttccgagattatcgccatctttggaccgggtgacgatgccgtcaaacagcaaaagtgcaacatcttctccctcattttcctgtttctgggtatcatcagcttcttcacttttttcctgcaaggattcacttttggaaaggccggggagatcctcacccggcggcttaggtccatggctttcaaagcaatgcttagacaggatatgtcatggttcgatgaccacaagaattccactggcgcgctgtccactagactggccaccgatgccgcacaagtgcaaggcgccaccggaactcggttggccctgatcgcccagaatatcgctaatctgggaactggcattatcatctcgttcatctacggatggcaactgaccctgctgctgctggcggttgtcccgatcatcgcggtcagcggcatcgtcgagatgaagctgcttgctgggaacgctaagcgggacaaaaaggaactggaggcggcaggcaagattgctaccgaagctattgaaaacatccgaactgtggtttccctgacccaggaacgtaagttcgagtccatgtacgtggagaagctctacggcccataccgcaactcagtccaaaaggcccatatctatggaattaccttcagcatcagccaggccttcatgtactttagctacgccggttgcttccggttcggagcctacttgattgtcaacggacacatgagattccgggatgtgatcctggtctttagcgctatcgtgttcggcgccgtggccctcggacatgcctcatcatttgcaccagactacgccaaagccaagctctcggctgcccacctgttcatgctgttcgaacggcagccgctcatcgatagctactcagaagaaggcctgaaaccggataagttcgagggaaacatcaccttcaacgaagtggtgttcaattacccgactcgggccaacgtgccggtgctccagggactttccctcgaagtgaagaagggacagaccctcgccctggtcggcagcagcggatgcggaaagtcgaccgtcgtgcaactccttgagagattctacgacccgctggcaggaactgtgtttgtggactttggattccagctcctggacggccaggaagcgaagaagctgaatgtgcagtggctgcgcgcacagcttgggatcgtgtcccaagaaccgatcctgttcgattgctccatcgcggagaacatcgcctacggcgataattcccgggtggtgtcgcaagatgagatcgtgtctgcagctaaggccgcgaacatccacccgttcatcgaaactctgccgcataagtatgaaactagggtgggcgacaaggggacccagctgtcagggggccagaagcagcggattgctatcgcacgggccctcatccgacaaccgcaaattcttctgctcgacgaagcgacttccgccctggataccgagtcggaaaaggtggtgcaggaggcgctggataaagcgagagagggtagaacctgcatcgtcatcgcccataggttgtcgactattcaaaatgcggatctcatcgtggttttccagaacggcagggtgaaggaacacggaactcaccagcagctcttggcgcaaaaaggcatctacttctcaatggtatctgtgcaggcaggaactcagaacctg

SEQ ID NO: 7488 - DNA, 3858 bp, Artificial Sequence
  Description of Artificial Sequence: Synthetic coding sequence
atggaccttgaggcagccaaaaatggaaccgcgtggcgtcccacctccgcagagggagacttcgaactgggaatttcctccaagcagaagcgcaagaaaaccaagacggtcaaaatgattggagtgctcaccctgtttagatacagcgattggcaagataaactgttcatgagcctcggcactatcatggcaattgcgcatggctcggggcttcctctgatgatgatcgtattcggcgaaatgactgataagttcgtggatactgcgggaaacttttcatttcccgtcaacttttccctctcccttctcaacccagggaaaattctggaagaagaaatgacgcgttacgcctactactacagcggactgggcgcgggcgtcctggtcgcagcatacattcaagtctcattttggactctcgccgcaggaaggcagattaggaaaatccggcagaagtttttccatgccatacttagacaagaaattggatggtttgatatcaatgacactactgagttgaatactcgcctgaccgacgacatttcaaagatctccgaaggtataggagataaagtcggaatgttcttccaagcagtggcgacgttttttgcaggcttcatcgtggggttcattcggggatggaaactgacccttgtcattatggcaatttcgcccattcttggactctcggccgccgtctgggcaaagattttgtccgcattttccgataaggaactggcagcctacgcaaaggccggagccgttgccgaagaagccctcggtgcgatccggaccgtcatcgcgtttggaggacaaaacaaggagctggagcgttaccagaaacacctggagaacgcaaaagaaattgggatcaaaaaagcaatatcggcaaatatcagcatggggatcgcctttcttctgatctatgcctcctacgcactggcattctggtacggttccaccctggtgatttccaaagagtacaccattggaaatgcaatgactgtgtttttcagtatcctcattggagcattttccgtgggacaagcagccccatgcatcgacgcgtttgcgaacgctagaggggcagcatacgtgatctttgacatcatcgacaacaatcccaaaattgattcctttagcgaacgggggcataagcccgacagcattaaggggaatttggaattcaacgatgtgcatttttcttacccaagcagggcgaacgtgaaaattctgaagggtctgaatctcaaggtgcagtcaggtcaaactgtggctctcgttggctcgtctggctgcggtaaatcgactactgtgcaactgatccaaagactctacgatcctgatgaaggaactataaacatcgacggtcaagatattagaaactttaatgtcaattaccttagggagattatcggagtggtgtctcaggagccagtgctgttttccaccactatagctgaaaacatttgctacggtcgtggcaacgtgactatggatgagatcaagaaagcagtgaaggaggcaaacgcgtacgaattcatcatgaaacttccacagaagttcgacactcttgtgggagagcggggagcccaactttcggggggacaaaagcagcggattgccatcgcaagggcacttgtcaggaatccaaagattcttcttcttgacgaagcaactagcgcgcttgataccgaatcggaagcagaggttcaagcagcacttgataaggcacgagagggacggaccaccattgtcatcgcccacagactttccactgtccgcaatgccgacgtgattgcagggtttgaagatggggtcatagtggagcaggggagccatagcgaactgatgaagaaggaaggtgtgtactttaaactcgtcaacatgcagaccagcgggagccagattcaaagcgaagaatttgaactgaacgatgagaaggccgcaaccaggatggcccctaatggatggaaatcgagacttttcagacattccacccaaaagaatcttaagaactcgcagatgtgccaaaaatctctggacgtcgaaactgacggcctcgaagcaaatgtccctccagtctcgttccttaaggtgcttaaactgaacaagaccgaatggccatacttcgtggtcgggaccgtgtgcgcaatcgctaatgggggcctgcaacctgcattctcagtgattttctcagagattatagcaatcttcggtccaggcgatgatgccgtcaagcagcaaaaatgtaacatctttagcctgatctttcttttcctgggcatcattagctttttcaccttttttctccaaggatttacttttggcaaggcgggagagatacttacccgccgccttcggtccatggcctttaaagccatgctgagacaggatatgtcgtggtttgatgatcataagaactcgacgggtgcactctcgactagactcgcaacggatgcagcccaagtgcagggcgccactggaactcggttggcccttatagcgcaaaacattgcgaacctgggaactggaattatcatttcgttcatatacggatggcagcttactctgctgctgcttgcagtcgtgcccattatcgcagtctcgggcattgtggagatgaaacttctggcgggcaacgcgaagcgagataagaaggaacttgaggcagctgggaagatcgcaaccgaagcaatagaaaacattcggactgtggtcagtctgacccaggaacgcaagtttgagtccatgtacgtcgaaaagttgtacggaccctacagaaactccgtccaaaaggcccatatctacggaataaccttttccatttcacaggcgtttatgtacttttcctacgcaggatgttttagatttggagcatacctgattgtcaacggtcatatgagatttagggatgttattctggtgttttcagccatcgtctttggcgccgtggccctcggccatgcctcatcattcgcccctgattacgctaaggcaaaactttcagctgcacatctgttcatgctgttcgaacggcaacccctgatagactcctactccgaggaaggtttgaagcccgataagtttgagggtaatatcacttttaacgaggtcgtattcaactacccaacccgcgcaaacgttccagtgctgcagggtcttagccttgaagtgaaaaagggacagacccttgcactggtcggatcttctggttgtggcaaatcgactgtggtgcaactccttgaaagattctacgaccctcttgcaggaactgtgttcgtggattttgggtttcagctgctggatggccaggaagccaagaagctgaatgtgcaatggctgcgtgcgcagctgggcatcgtgtcccaagaacctattcttttcgattgcagcatagcagagaatatcgcatacggtgataactcgagagtggtgagccaagatgaaatagtgtccgccgctaaggcagccaatattcatcctttcattgaaactttgcctcataagtacgagactcgcgtgggtgataagggtactcagctgtccggtggccaaaagcaacgcatcgcgatagccagagcacttattagacagccccagattctgctgctggatgaggcaacctcagcattggacacggaatcagagaaggtcgtccaggaggcattggacaaggcgcgcgagggaaggacctgtatcgtgattgcacatcgactcagcactattcaaaacgcagatctcattgtggtctttcagaacggtagggtgaaagaacacggcacccaccaacagcttctcgcacaaaagggaatctactttagcatggtgtcggtgcaagcaggtacccaaaacctt

SEQ ID NO: 7489 - DNA, 3858 bp, Artificial Sequence
  Description of Artificial Sequence: Synthetic coding sequence
atggacctggaagcagccaagaatggcactgcatggaggcccacgtcggcagagggagattttgaactgggaatttcctcaaagcagaaaagaaaaaagaccaagaccgtgaagatgattggagtgcttacccttttccgctactcagattggcaggacaagctgttcatgtcgttgggaaccattatggctattgcacatggtagcggattgccacttatgatgatcgtgtttggcgaaatgaccgacaaattcgtcgatactgcagggaacttttccttcccagtcaatttctccctgagccttcttaacccaggcaagattttggaagaagagatgactagatacgcttactactactcggggcttggagctggagtccttgtggcagcatacatacaggtgtccttttggaccctggccgcaggtagacagataagaaagattagacaaaagttctttcatgccattttgagacaggagattggttggttcgatatcaatgacaccactgaattgaacacgcggcttaccgatgacatttcaaagattagcgaaggaattggtgataaggtcggaatgttctttcaggcagtggccaccttctttgccggttttatcgtcggcttcattcgaggatggaagctgacccttgtgatcatggcaatttcgcccattctggggcttagcgccgcagtctgggcaaaaatcctgtcagcctttagcgataaagagctcgccgcgtacgctaaggcaggagccgtcgcagaagaggcacttggagccattagaacggtgatcgctttcggcggacaaaacaaagaactggagagataccaaaagcaccttgaaaacgcaaaggaaattggaatcaaaaaggcaatttccgcaaatatctcgatggggattgcatttcttctgatttacgcatcatacgcacttgcattctggtacggatcaacgctggttatatccaaggagtacacgattggcaatgcaatgaccgtctttttcagcattcttatcggggcattcagcgtcggacaagctgcaccatgtatcgatgcattcgcgaacgcccggggcgcagcttacgtgatctttgacattattgataacaacccaaagattgactcgttttccgaacgtggacataagcccgattcgatcaaaggcaacctggagtttaatgatgtgcatttctcgtatccatcgcgggcaaacgtgaagatcctcaagggactgaacctgaaggtgcaatcgggtcaaaccgtggcactggtgggaagctcaggatgtggtaaatccaccactgtgcagctgatccagcgactttacgatccagatgagggaaccattaacattgatggtcaagacattagaaactttaatgttaactacttgcgggaaatcattggagtggtgtcacaggaaccagtcctcttttcaaccaccattgccgaaaacatttgctacggtcgcggtaacgtgactatggatgagattaagaaggcagttaaggaagcaaacgcatacgagttcataatgaagttgccacagaagttcgacaccctcgtaggggaacgcggggcacaactgtccggtggacaaaagcagaggattgccattgcgcgcgccctggtccgaaaccccaagattctgctgctggatgaggcaacgagcgcacttgataccgagtcagaagcagaagtgcaagcggcccttgacaaggcacgtgagggtcgcactactattgtcattgcgcataggcttagcactgtgcgcaacgccgatgtgattgcgggattcgaggacggagtgattgtggagcaggggtcgcactcggaactcatgaaaaaagaaggagtctactttaaacttgtgaatatgcaaaccagcggatcccagatacagagcgaagagtttgagcttaatgatgagaaggctgcaactcgtatggccccaaatggatggaagtcacgtctttttaggcactcgactcagaagaacctgaagaattcacaaatgtgtcaaaaatccctggacgtggaaaccgacggccttgaggcgaacgtgccgccagtgagctttcttaaggtgctcaaacttaacaaaacggagtggccttactttgtcgtgggtaccgtgtgcgcaattgcaaatgggggcctccaaccagccttctcagtgatcttctccgaaatcatagcaattttcgggcctggagacgacgccgtcaaacaacaaaagtgtaatatcttctccctcatttttcttttcctgggtataatctccttcttcaccttttttctccagggattcacttttggtaaagcaggcgagattttgaccaggcgacttcgctccatggcatttaaggctatgctgagacaagatatgagctggtttgatgaccacaaaaacagcactggagccctcagcacccgtctggcaactgatgccgcacaagtgcagggtgcaaccgggactagacttgcactcatcgcgcagaacattgcaaatctcggtaccggaattatcatctcgtttatctacggttggcaactgacccttctcctgctggcagtggtgcctatcattgccgtgtcaggaattgtggagatgaagttgcttgcaggaaatgctaagcgagataagaaggaactggaagcggcaggcaagatcgccaccgaagcgatagaaaacatccgtaccgtcgtgtccctcacccaagaacggaagtttgaatcgatgtacgtggaaaagctgtacggtccttacagaaactccgtgcagaaggcacacatatatgggatcactttttcaatctcgcaggccttcatgtacttttcgtacgcaggctgtttccgttttggagcgtacctgattgtgaatgggcacatgcggttcagggatgtcattcttgtgttctccgccattgtctttggtgcagtggcactgggtcacgcatcctcatttgcccccgactacgcaaaagcgaaattgagcgctgcacacctctttatgctctttgaacggcagcctctgattgattcctattcagaggagggactgaagcctgacaagtttgagggcaacattacttttaacgaggtggtgttcaactacccaacccgcgcaaatgtgcccgttctgcaaggcctttcgctcgaagtgaagaaagggcagacgctggcactcgtgggatccagcggatgtggaaaatctactgtggtgcaactgcttgaaagattctacgacccgcttgctggaaccgtgtttgtggactttggctttcaactcctggacgggcaagaagcaaagaaactgaacgtgcaatggctccgagcccaactgggtatagtgtcccaagaacctatcctgtttgactgttcgattgcagagaacatagcatacggagataactcaagggtggtgtcccaggatgaaattgtctccgcagccaaagcagcaaacattcatccgttcattgaaaccctcccacataagtatgagactagggtgggcgataaagggactcaattgtcggggggtcaaaaacagcgtattgccattgctcgggcacttatcagacaaccccagatcttgctcttggacgaggccacctcggcgctggatactgaatcggagaaggtcgtgcaagaagcattggacaaggctcgcgaaggacgcacgtgcatagtcatcgcccataggctctccaccatccagaacgcggatctcatcgtcgtgtttcaaaacggaagagtcaaggaacatgggactcatcagcaactgttggcccagaagggaatttacttctcgatggtgtctgtgcaggcaggtacgcagaatctc

SEQ ID NO: 7490 - DNA, 3858 bp, Artificial Sequence
  Description of Artificial Sequence: Synthetic coding sequence
atggacctggaagcagccaagaacggaaccgcatggcggccaacttctgcagagggagacttcgagctgggaatttcgtcgaagcagaagcggaagaaaactaagactgtcaagatgatcggagtgctcaccctgttccgctacagcgactggcaagacaagctcttcatgtccctgggtactatcatggctatcgcccacggaagcggtttgccgctcatgatgatcgtgtttggggaaatgaccgacaagttcgtggataccgccggaaacttctcgttcccggtgaacttctcgctctcgctcctgaatcctggaaagattctggaagaagagatgaccaggtacgcatactactactcgggtctgggcgcaggggtgctggtggccgcatatatccaggtttccttctggaccctcgccgcaggccgacagatcaggaagatccggcagaaattctttcacgcaatccttcggcaagaaatcggatggttcgacattaatgacacgactgaactgaacacccgcctgaccgacgacatcagcaagattagcgagggcatcggggataaggtgggtatgtttttccaagcggtggccacgtttttcgccggattcatcgtggggtttatccgaggctggaaacttactctggtgatcatggccatttcaccaattttgggactgagcgccgccgtgtgggctaagattctgtcagcattcagtgacaaagagcttgctgcgtacgccaaggccggagctgtggctgaagaagctctgggtgcaatcaggactgtcatcgccttcggaggacagaacaaggaattggaacgctaccagaagcacctcgagaacgccaaggaaattggcatcaagaaggccatcagcgctaacatcagcatgggaatcgctttcctgttgatctatgcctcctacgctctggctttctggtacggaagcacgctggtcatcagcaaggaatacactatcggaaacgcaatgaccgtgttcttcagcattttgatcggcgccttcagcgtgggccaggccgccccatgcatagatgcatttgccaacgcgcggggggcagcatacgtcatcttcgatatcattgacaataatccgaagattgactcattttcggaacggggccacaagcccgactcgatcaaggggaatctggagttcaatgacgtgcacttctcatatccatcgagggccaatgtgaagattctgaagggactgaatctcaaggtccagtcgggacagaccgtcgccctggtcggatcgtctgggtgcggaaaatcaactaccgtccaactgatccaacgcctgtacgaccctgatgaaggcactatcaatatcgatggtcaagatatccgcaatttcaatgtcaattacctgcgggagatcatcggggtggtgtcccaggaacccgtgctcttcagtaccactatcgcggaaaacatctgctacggacgcggcaacgtcaccatggacgagatcaagaaggcagtgaaagaagcgaacgcctacgaattcatcatgaaactgccgcagaagtttgacacgctggtcggggagcggggagcgcagctgtcgggcggacaaaagcagaggatcgcgattgctcgggctctcgtgcgcaaccccaaaatcttgcttctcgacgaggcgacttcggcgttggacactgaatccgaggcggaagtccaggccgcgctcgacaaggctagggaaggacggaccaccatcgtcatcgcccacagactctccactgtgcgcaacgcggatgtgatcgccggcttcgaagatggcgtcatcgtggagcaggggtcccacagcgagctgatgaagaaggagggagtctactttaagctggtcaacatgcagacctcgggcagccaaattcagagcgaagaattcgagctcaatgacgaaaaagcggccaccagaatggccccgaacggttggaagagccgcttgttcagacactctacgcagaagaatctgaaaaactcgcagatgtgccaaaagtcgctggacgtcgaaaccgacggactcgaggcgaatgtcccgccagtgtcctttctcaaggtcctgaaactgaacaagaccgaatggccttacttcgttgtggggactgtctgcgccattgccaacggcggcctgcagccagctttttccgtgatcttctctgaaatcatcgcgatctttggcccaggagatgacgccgtcaagcagcaaaaatgcaacatctttagcctcatctttctgttcctgggaattatctcctttttcacctttttcctccagggattcactttcggcaaggcaggcgagatccttacccggcggctgcgcagcatggccttcaaagcaatgctccggcaagatatgagctggttcgacgaccataagaacagtacgggtgcactcagcactcgcctggccaccgatgcggcccaggtgcaaggcgccaccggaactcgcctggcgctgatcgcccagaacatcgcgaacctgggtaccggtatcatcatcagtttcatctacgggtggcaactcaccctgctgctgctggctgtagtgccgatcatcgcggtgtcgggcatcgtcgaaatgaagctgctggcgggaaatgcgaagagagataagaaggaactggaagctgcgggcaaaatcgctaccgaggcaattgagaatatccgcaccgtggtgtccctgactcaagaacgcaagttcgagagcatgtacgttgaaaagttgtacggaccatacaggaattcggtgcaaaaggcccacatctacgggatcaccttctccatcagccaggcattcatgtacttctcatacgccggatgcttccggttcggggcgtatcttatcgtgaacggccatatgcgctttcgggacgtgatcctggtgttctcggcgatcgtgttcggagcagtcgcccttggacacgcgtcgtccttcgcgccggattacgctaaagcgaagctctccgccgcccatctcttcatgctgttcgagagacagccactgatcgactcgtactccgaggaagggcttaagccggacaagtttgagggaaacatcacgttcaacgaagtggtgttcaattacccaaccagagcgaacgtgccagtcctgcaagggttgtcccttgaagtgaagaagggacaaaccctggccctcgtgggatcgtcaggatgcgggaaatcgaccgtggtccagctgttggaacggttctacgatcctctggctggcaccgtgtttgtggattttggatttcaacttttggacggacaagaagccaagaaactgaacgtgcagtggcttcgggcgcagctcggaatcgtcagccaggaaccgatcttgtttgattgctcgatcgcggagaatatcgcatacggagacaactcgcgcgtcgtgtcccaggatgaaatcgtgtcggccgcgaaggccgccaatatacacccctttatcgagactctgccgcacaagtacgaaactcgcgtgggcgacaaggggacccagctttccgggggacagaagcagcgcatcgccatcgcccgcgccttgatccgacaaccgcagatcctgctcttggatgaagccacctcagcactggatactgaatcagaaaaggtggtccaagaagcgctggacaaggccagagagggacggacttgcattgtgatcgctcatagattgtcaactatccagaacgcggacttgattgttgtgttccagaatgggcgggtcaaagagcacgggacccaccagcagctcctggcgcagaagggaatctatttctctatggtgtccgtccaagcagggactcagaacctc

SEQ ID NO: 7491 - DNA, 3858 bp, Artificial Sequence
  Description of Artificial Sequence: Synthetic coding sequence
atggacctggaagccgctaaaaatgggacagcatggagacccaccagtgctgagggagacttcgaacttgggattagtagcaagcagaagaggaagaagaccaagacggtgaagatgattggcgttctaacactgttcaggtatagcgactggcaagataagttgttcatgagccttgggacaatcatggctattgcccacggcagcggactcccactgatgatgattgttttcggggaaatgaccgacaaattcgtggacaccgccggcaattttagctttccagtgaacttctctctctctctgctaaacccgggtaaaatccttgaggaggagatgacccgctatgcctactattacagcgggcttggggctggagttttagtggccgcatacatccaagtatcgttctggacactggccgccggcaggcagattcgcaaaattaggcagaagttctttcatgccatcttgcgccaagaaattggctggttcgatatcaacgacaccactgaactcaatacgcgtctcacagatgacatcagcaaaatctccgagggaattggcgataaggtcggaatgttctttcaggccgtcgcaactttcttcgccggattcatagttggattcattagaggctggaagctaaccctggttataatggctatatctcctatcctgggactttccgccgcggtatgggcaaagattctgtccgcgttctccgacaaggagcttgcagcgtatgctaaagcaggggccgtggctgaggaagccctgggtgcaatccgcacggttatagccttcggcggtcaaaacaaggaattggagcggtaccaaaagcacctggaaaacgccaaggaaatcggaataaagaaggccattagcgctaatatctcaatgggtatcgctttcctactgatctatgccagttacgctctcgccttctggtatggcagcaccctggtgatctctaaggagtacacaatagggaatgccatgactgtgttcttttcaatcctgattggagcgtttagcgtgggccaggccgccccttgcatcgatgcatttgccaatgccagaggagcagcctatgtcatcttcgacatcattgacaacaatcccaaaatagactccttttccgaaagggggcacaagccggattcgatcaagggcaatctggagttcaatgacgttcatttttcatacccctcaagagcaaacgtaaaaatcctcaagggtctcaatcttaaggtacagtcgggccagacagttgccctggtaggttcttcaggctgtggcaagagtacgacagtgcagctcatccagcggctctacgatccagatgaaggtactatcaatatagacgggcaggacatccggaatttcaatgttaattacctgcgcgaaattatcggagttgtgtcacaggagcccgtactgtttagtacaactatcgccgagaatatctgctacggccgcggaaatgttacgatggacgagatcaagaaggcagtcaaggaagctaatgcctacgaattcataatgaagctgccacagaaatttgacactctcgtgggtgagaggggggcccagctgtcagggggacagaaacagaggatcgcaatcgcacgtgcgttagtccggaaccctaaaatccttcttctggatgaggcaacctctgctctagacacagaatctgaggcggaagttcaagcagccttggacaaagcccgtgaggggcgtactacgattgtgatagcccataggctgtctacagtacgtaatgctgatgtcattgccggatttgaagatggcgtgatcgtcgaacagggatcgcactctgagttgatgaagaaagaaggcgtatatttcaagttagtgaatatgcagacaagcggaagccagatccaaagcgaagagttcgagctcaatgatgaaaaagccgctacacgcatggctcccaatggatggaaatcccggctcttcaggcactccacacaaaagaatctgaagaatagccaaatgtgccagaagtctctcgatgtggagactgatggtctcgaggcgaatgtccctcccgtatcctttctgaaagttctaaaactgaataagactgagtggccctacttcgtggtgggaaccgtatgtgcgatcgccaatggcggactgcagccagctttctctgtcatcttcagcgagatcatcgcgatcttcggacccggtgacgacgccgtgaagcaacagaagtgcaacatcttctctctgatatttctgttcctaggtattattagttttttcacattctttcttcaggggtttacctttgggaaggccggcgagattttgactagacgcctccgctccatggcgttcaaagctatgctgcgacaagacatgagctggttcgacgaccataagaatagtaccggcgccctgagcacccgccttgccacggatgcagctcaggtgcaaggcgccacgggcacacggctggctctgatcgcccaaaatatcgccaacttgggaactggtataatcatttcctttatttacggatggcagctaacattacttctccttgctgtggtcccaataattgctgtgtccgggatcgtggagatgaagcttctagctggcaacgctaagcgcgacaagaaggagttggaggccgcggggaaaatcgcgactgaagctattgagaatatcagaacagttgtatcactgacccaggagcggaaattcgaatcaatgtatgtcgaaaaactgtacggcccctaccgaaactctgtgcaaaaagcccacatctacggaatcactttctcaatctctcaggcctttatgtatttttcctacgccggatgcttcaggttcggcgcgtatctaatagtcaacgggcatatgcgattcagagacgtgatattagtcttctcggccattgtctttggcgcggtggcactaggacatgctagcagcttcgcccctgactacgctaaggccaaactcagcgccgcacacctttttatgttgtttgagagacaaccactaattgattcatacagcgaagaaggtctgaaaccagacaagttcgaggggaacatcacctttaatgaagtggtgtttaactatccaaccagggccaatgtgcctgtgctgcagggtctgtcactagaggtgaaaaaaggccagactctcgccctcgtgggcagcagcggatgcggaaagtccacagtggtgcaactgctcgagaggttttatgatcccttggcaggtactgtcttcgtcgacttcggattccaattactcgatggacaggaggctaagaaactcaatgttcagtggctccgggcccaacttggtatcgtgtcccaggaaccgatcctgtttgactgcagcatcgctgaaaacattgcctacggggacaactcgagggtagtgtcacaagacgagattgtgagtgccgcgaaagccgccaacatacacccttttatagagacgctaccgcacaaatatgaaactcgcgtgggcgacaagggaacccagctgtctgggggccagaaacagaggattgccatagctcgcgccctcataaggcagcctcagatcctgctgttagacgaggccacctccgccctggatacagaatcagaaaaggtagtgcaggaagccctagacaaagcacgagaagggcggacctgcattgtgatagcccacaggctgagtaccatccagaacgctgacctgatagttgtcttccaaaatggaagagttaaagaacacggtacccaccagcagctgctcgctcaaaaaggcatctactttagcatggtgtctgtgcaggctggcactcagaacctt

SEQ ID NO: 7492 - DNA, 3858 bp, Artificial Sequence
  Description of Artificial Sequence: Synthetic coding sequence
atggacctcgaggctgccaagaatggcactgcctggcggcccacgtcagcggaaggcgatttcgagctgggtatttcatctaaacagaagcgcaaaaagacaaagacagtgaagatgattggcgtgctgaccctttttcggtattcggactggcaagataaactgttcatgtcactagggactataatggctatagcgcatggctccggtctccctcttatgatgatagtcttcggggaaatgaccgataagttcgtcgatacagcggggaatttttcgttccccgttaatttctcactgagtctccttaatcctgggaagattctcgaagaagagatgacccgctacgcgtattattattccggtctgggggcgggagtacttgtggcagcctatatacaggtcagcttttggaccttggcagccggtcggcagatccggaagatacgccagaagttcttccacgccatacttagacaggaaatcgggtggtttgatattaacgacacgaccgagctcaacaccagattgacggatgatatctctaagatctctgagggcattggcgataaggtgggaatgttcttccaagccgtggcaactttttttgccggcttcatcgtgggttttattcgcggatggaaactgacgctcgttataatggcgataagcccaatcctgggactctcggcagccgtgtgggctaaaattctcagtgccttttccgataaggagctggcggcatatgccaaagccggggctgtagcggaggaggcactgggagccattaggacggttatcgctttcggcggccaaaacaaagagctggaaagataccaaaaacacctggaaaatgccaaggaaatcggaatcaaaaaagccatttccgctaacatctcaatgggcatcgctttcttactgatttatgccagttacgctttggccttttggtacggcagcacactagtaatctctaaggaatacacaatcggcaatgcaatgactgtcttttttagcattctcataggagccttcagcgtcggacaggccgctccttgcattgatgccttcgcgaacgcccggggggcggcctatgtcatcttcgacataatcgataataaccctaagatcgacagcttctccgaacggggacacaagcctgattccatcaaggggaacctggaatttaacgacgtgcatttctcatacccaagccgagcaaacgtgaaaatcctgaaaggcctgaacctgaaggtgcagtcaggacagaccgtcgctctcgtgggttctagtggctgtggtaaatccactactgtgcagctcattcagcgcctttacgatcccgacgaaggaactataaacattgacggccaggacatacgcaactttaatgtgaattatttgcgggagattatcggagtcgtatcgcaggaacccgtgctcttttctactactatagcggagaacatctgctacggacgaggcaacgtcacaatggatgagataaagaaggctgtaaaagaagcaaacgcttacgagttcatcatgaagttgcctcagaaatttgacactctggttggcgagaggggtgcccagttgagcggcgggcaaaaacagcgaattgcgatcgctcgagccctcgttcgcaatcccaagattttactgctcgacgaggccacaagcgcccttgatacagagagcgaagccgaggtgcaggccgctctggataaggctcgggagggtcggaccactatagtaatcgctcacaggcttagtaccgtgcgtaacgctgatgtcattgctggctttgaggatggggtgattgtggagcaaggctcacatagtgagttgatgaaaaaggagggagtatattttaaactggtgaatatgcaaacttccggatctcagattcagagtgaagagttcgagttgaatgatgagaaagcagccaccaggatggctccaaatgggtggaaatctaggctctttcgccacagcacccaaaagaacctgaaaaacagtcaaatgtgccagaaatcactggatgtcgagaccgacggactagaggccaatgtcccccccgtttctttcctgaaggtcctgaaattaaacaaaactgaatggccatacttcgttgtgggaaccgtttgtgccattgcaaatggaggcttgcagcccgcctttagtgtgattttttccgagattatcgccatattcgggcccggcgacgatgctgtcaagcaacaaaagtgcaatattttcagtcttatcttcttgttcctggggatcataagtttcttcactttcttcctccaggggtttactttcggtaaggccggcgaaatcttgactaggagactgcggtcaatggcattcaaggccatgctgagacaggacatgtcctggtttgacgatcacaaaaactcaacgggagccctgtcaacaagattggccactgacgccgctcaagtccagggtgctaccggcacccgacttgcgctcatcgcccagaatatcgccaacctgggcacgggcatcattatcagctttatatacggatggcagctcacacttctgctcctggcggtggtccctatcatagcggtttcgggtattgtggagatgaaactgttagcagggaacgctaaaagggataaaaaagagctggaggccgccggaaagatagcaaccgaggcaatcgagaacattaggacagtggttagcctcactcaagagcggaaattcgagagcatgtatgtggaaaaactgtatgggccttacagaaactcagtgcagaaagcccacatatacggcataacattctcaattagtcaagcattcatgtacttcagctatgcaggttgctttaggtttggagcctatctgatagttaatgggcatatgcggttccgggacgtgatattggtgttctccgccatcgtgtttggtgccgtggctctcgggcatgcttctagtttcgcgcccgactatgccaaggctaagctctctgccgctcatttgttcatgctttttgagaggcagcccttgatcgattcctattctgaggagggtctgaaacctgataagtttgaggggaatatcaccttcaatgaagtcgttttcaactaccctacacgagctaatgttcctgtactgcaggggctgtccttggaggtgaaaaagggtcaaaccctggcattagtcggctcaagcggttgcggtaagtccaccgtcgtgcagcttctggaaaggttctatgacccccttgccgggacagttttcgtggacttcggttttcagctcctcgacggacaggaggcaaagaagttgaatgtgcagtggctgcgagcacagctggggatcgtgagtcaggaacctattctcttcgactgctctatcgcagagaacattgcttatggcgataactctagggtcgtctcacaggatgagatcgtgtcagccgcaaaggctgcgaacatacacccttttatcgaaacattacctcacaaatacgagaccagagtgggtgacaagggcacccagctcagcgggggccagaaacagaggatcgctatcgcacgggccctcatccggcagcctcagattctcctgctggacgaggcaactagtgccctggataccgagtctgagaaggtggtccaggaggccctggacaaagcacgagagggacgaacctgcatcgttattgctcataggctgagtaccattcagaatgctgatttgatagtggtttttcagaacggcagggtaaaagaacacggtacacaccagcagctgctcgcacagaagggtatttactttagcatggtgtctgtgcaggcaggcacccagaacttg

SEQ ID NO: 7493 - DNA, 3858 bp, Artificial Sequence
  Description of Artificial Sequence: Synthetic coding sequence
atggatcttgaagccgctaaaaacgggactgcatggaggccgacctcggctgaaggagacttcgaactgggaatctcctccaaacagaagcggaaaaaaactaaaaccgtgaaaatgatcggggttctcacactgtttagatattccgattggcaggataagttgttcatgagcctagggacgattatggcaatcgcccacggttccggccttccacttatgatgatcgtgtttggagagatgactgataaatttgtggatacagccggcaatttctcctttcccgtgaactttagcttgtccctcctgaatcctggcaagatcctggaggaggagatgacgcgatatgcctactactactccggtctgggcgcgggggtactcgtggcagcctatatccaagtttccttctggacgctggcggccgggcgacagattcgcaaaatcagacagaaattttttcacgccattctgcgtcaagagatcgggtggtttgacattaacgataccaccgaattgaacacgaggttaacggacgacatcagcaaaatcagcgaggggatcggagacaaggtggggatgttcttccaggcagtggcgaccttcttcgctgggtttatcgtgggctttattcgaggctggaaactcacattggtgatcatggccattagtcccatcttgggcctcagtgcagcagtatgggctaaaattctgtccgctttttcagacaaggaactcgccgcctatgcgaaggccggggctgtagcggaagaggctctaggcgccatccgcaccgtgatcgcttttggcggtcaaaataaggagctagagcgctaccagaagcatctggagaacgcaaaagaaattggaattaagaaggccatctccgccaacatctccatgggtatagcctttttactgatctatgcgagttacgcattagccttttggtacggcagcaccctggtgattagtaaggaatacactatcggcaacgctatgactgtttttttcagtattctgataggcgccttcagcgtgggccaggcagccccatgcatagatgcgttcgccaatgccagaggggccgcatatgtaatcttcgatattatagacaataatcctaaaatcgatagcttctccgaaagagggcacaaaccggacagcatcaagggcaatctggaatttaatgacgtgcatttcagctatcccagcagggctaatgtcaagattctgaaagggctcaaccttaaggttcagagtgggcagaccgtcgcactggtcggcagcagcggttgtggcaaaagcaccacagtccagctcattcagcggctgtatgaccccgacgaaggcaccatcaacatcgatggacaggatattagaaacttcaacgtgaattacctgcgggaaatcattggtgtggtgagccaggaacccgtgctcttttccacaaccattgctgaaaatatttgttatggacggggcaatgtgaccatggacgagatcaaaaaggcagtgaaggaggcaaacgcttacgagttcatcatgaagctaccacagaaattcgataccctggtgggcgagagaggggctcagctcagtggaggacagaagcagaggatcgctatagcgcgcgcattggttagaaatccaaagattttattgttggatgaggctacatcagctttggacacggaaagtgaagccgaagtccaggccgcgctcgacaaggcgagagagggccggaccactatagtcatcgcccatcgattgagcaccgtcaggaacgccgatgttatcgccggatttgaggacggcgtcatcgttgaacaggggagccattcagaactcatgaaaaaagagggcgtttacttcaaactggttaacatgcagacgtccggcagccaaatacagtctgaggagtttgaactcaacgacgagaaggccgccaccaggatggcaccgaatggttggaaatcaaggctgttccgccactcaactcagaagaatctgaagaatagccagatgtgtcagaagtcacttgatgtggaaaccgacggactcgaggccaatgtgcctcctgtctcctttttgaaggtgctcaagctgaataagaccgagtggccttatttcgtggtgggtacagtctgtgccattgctaacggaggtcttcagcccgctttttcagtgatcttctctgaaatcatcgctattttcggcccgggtgatgacgccgtgaagcagcagaagtgtaacattttttccctgatcttcttgtttctagggattattagttttttcacctttttcctgcagggttttactttcggcaaggcgggtgagatcctgactagaagactgcgctccatggcctttaaggcaatgctgagacaggacatgtcttggttcgatgaccataagaactccaccggggccttatcaactcgactggccaccgacgccgcccaggtgcagggagctaccggtacacggttagccttgatagcccaaaatatcgccaacctgggtacgggcatcattataagtttcatatacgggtggcagctgactctgctgctgttggccgtcgttcccatcattgcagtaagcgggatcgtggagatgaaactgttggcaggtaacgctaagcgcgacaagaaggaattggaggccgcgggcaagatagccacagaagcaatcgaaaacataaggaccgttgtatccctgacacaggagcgtaagtttgaatctatgtatgtcgaaaaactttatggcccataccgcaattcagtccagaaagcacacatttacgggatcaccttctccatcagccaggccttcatgtatttttcctatgccggctgcttccgcttcggagcctacctaatcgtcaacggccatatgagattccgagacgttatcctagtattttcagcaattgtctttggggccgttgctcttgggcacgcttcatccttcgctccggactacgcaaaagccaagttgagcgcggcccatctgtttatgttgttcgaaaggcagcctttaatcgattcctactccgaggagggactaaagccggacaagttcgagggcaacattacatttaatgaggtggtgttcaattacccgactcgggccaacgtgcccgtgcttcaagggctgagtctggaagtgaagaaaggacaaacattggctctcgtagggtccagcggttgtgggaagagcacagtggtacagttactcgagcgattctacgaccccctggccggaacagtgttcgtcgattttgggtttcagcttcttgacgggcaggaggccaaaaagctaaacgtgcagtggttaagggctcagctgggcatagtgtcacaggagcccatcctgttcgactgttctatagccgagaacattgcgtatggcgacaactcacgggtggtcagccaggatgaaatcgtcagcgcagcgaaagcagcgaacattcatccatttatagaaactctaccccacaaatacgagactcgcgtcggtgataagggcacacagttatctgggggtcaaaaacaacgcatcgcaatcgctcgtgcattaattcgtcagcctcagattctcctcttagatgaagctacttctgccctggatacagaaagtgaaaaagtagtccaagaggccctggacaaggcaagagaggggcggacctgcatcgttattgcacaccgactaagcacaattcagaatgctgatctgatcgtggtgtttcagaatggtagagttaaggagcacggcacccaccagcagctgttggcccagaaagggatttacttctctatggtctctgtgcaggccgggacacaaaacctg

SEQ ID NO: 7494 - DNA, 3858 bp, Artificial Sequence
  Description of Artificial Sequence: Synthetic coding sequence
atggacctggaagcggccaaaaacgggactgcatggcgccctacctcagcagagggagacttcgagctggggattagctcgaagcagaagcggaaaaagactaagaccgtcaagatgattggtgtgctgaccctgttcagatactcggattggcaggacaagctcttcatgtcactcggaactattatggccatcgcacacggctccggactccctctcatgatgattgtgtttggtgaaatgactgataagttcgtcgacacggccggcaatttctcatttccggtgaacttctccctcagcctgctcaaccccggaaagatcctcgaagaagagatgacccgatacgcgtactactactcgggactgggagccggtgtcctggtggccgcatacatccaggtgtcgttctggactctcgctgcaggtcggcagatcagaaagatacgccagaagtttttccacgcaatcctgaggcaggaaatcggatggtttgacataaatgatactaccgaactgaatacccgcctgaccgacgacatctcgaagatctcggagggcatcggcgacaaggtggggatgttctttcaggccgtcgccacttttttcgccggattcatcgtgggctttatcaggggatggaagctgaccctggtgatcatggcaatttccccaatcttggggctctccgctgccgtgtgggcaaagatcctgtccgcattctctgacaaagagcttgcagcatacgctaaggcaggagcagtggcagaggaagccttgggagccatcagaaccgtcatcgctttcggaggacagaacaaggagttggagcgctatcagaagcaccttgagaacgcgaaggaaatcggcatcaaaaaagctatctcagcgaacatttcaatgggcattgcattcctgctgatctacgcttcgtacgcgttggctttttggtacggcagcaccctggtgatttcgaaagagtacaccatcgggaatgcgatgactgtctttttctctatcctcatcggagccttttcagtgggccaggcggctccatgcatcgatgcgttcgcgaatgcaagaggcgcggcctacgtgatcttcgacatcatcgataacaacccaaagattgactcattctcggagcggggacacaagcccgattcgatcaagggaaatctggagttcaacgacgtgcatttcagctacccgtcgcgcgcgaatgtgaagatcctcaaggggctgaatcttaaggttcagagcgggcagaccgtggccctggtggggagctcgggatgtggaaaatcaactaccgtccagctcatccagcgcctctacgaccctgatgaggggaccatcaatatcgatggacaggacattcgcaacttcaatgtgaactacctgcgcgaaatcatcggcgtggttagccaggaacccgtgctgtttagcactaccatcgcagagaatatctgctatggaagaggaaacgtcaccatggatgaaatcaagaaagcagtgaaggaagcgaacgcatatgagttcatcatgaagctcccccagaaattcgataccctggtcggcgagagaggagcacagctctcgggaggacagaagcaacggatcgccatcgcgagggcgctggtccggaacccaaagatcctgctcctcgacgaggccaccagcgcacttgataccgaatcggaagcggaagtacaggccgcactggataaagcgagagaaggacgtacgacgatcgtgatcgcccacagactgtcaaccgtgcggaatgccgatgtgattgcaggctttgaagatggggtgatcgtggagcagggctctcattcagaactgatgaagaaagaaggggtgtactttaaactcgttaacatgcaaacgagcggctcgcagatccagtcggaggaatttgagctgaatgatgagaaagcggccacccggatggccccaaacggatggaaatcacgcctgttccgtcattcaacgcagaagaacctgaagaatagccaaatgtgccagaagtcactggatgtggaaactgacggcctggaagcgaatgtacctcccgtgtccttcctgaaggtactgaaactcaacaagaccgaatggccgtactttgtggtgggaaccgtctgcgccatcgccaacggtggattgcaacctgctttcagcgtgatcttttcagagatcatcgccatctttggaccaggtgatgacgcggtgaagcagcaaaagtgcaacatcttttcgctgattttcctctttctcggcatcatttcgttctttaccttcttcctccagggcttcacgttcggaaaagccggagagattctcacgaggcggctgaggtctatggcgtttaaagcgatgctgcgacaagatatgagctggttcgacgaccacaagaactccaccggagccttgtcgactcggctggcgaccgatgctgcgcaagtccaaggggccactggaactagactggcgctgatcgcccaaaacatagccaatcttgggaccggaatcatcatctcgtttatctacgggtggcagctgactctcctgctgcttgcagtcgtgccgatcattgcagtgtcgggaatcgtggagatgaagctgctggctggaaacgccaaaagagacaagaaggaactcgaagccgccggaaaaatcgcaaccgaggcaatcgaaaacatacggaccgtggtttcattgacgcaagaacggaagttcgaatcgatgtacgtggaaaagctctacggaccgtaccgaaactcggtccaaaaagcgcatatctacggtataactttctccatctctcaggccttcatgtacttctcctacgctggttgcttccggtttggcgcctaccttattgtcaacggccacatgcggttcagagacgtgatccttgtgttctctgcgatcgtgttcggcgccgtcgccctgggacatgcctcctcattcgccccggactacgccaaggccaagctgtccgctgcccatctgttcatgctctttgaacggcagcccctgatcgattcctattctgaagagggactgaaaccagacaaattcgaaggaaacatcaccttcaacgaagtcgtctttaactacccgactagagctaatgtgccagtgctgcaaggtttgtcactggaagtcaagaagggtcagaccctcgccttggtgggatcctccggatgcggaaagagcactgtcgtgcagttgcttgagcgcttttacgatccgctggccggcactgtctttgtggattttggtttccagctgctcgacggccaagaagcgaagaagctcaatgtgcaatggctgagagctcagcttggaattgtgtcccaggaaccaatcctgttcgattgttcaattgctgagaatattgcctacggagacaacagccgcgtggtgtcccaggatgaaattgtctccgccgcaaaggcggccaacatccacccattcatcgaaaccctgcctcacaagtacgagactcgcgtaggcgacaaaggaacccagctctccggtggtcaaaagcaaagaatagccatagctagagcgctgattcgccaaccacaaatcctgctgctcgacgaggcaactagcgccctggatactgagagcgagaaagtcgtgcaggaggcccttgacaaagctcgcgaaggcaggacttgtatcgtgattgcacatcgcctgtcgactatccagaatgctgacctgatcgtcgtgttccagaatgggcgggtgaaggaacacggaactcatcagcaactgctggcgcagaagggaatttacttctcaatggtgtccgttcaggccgggactcagaatctg

SEQ ID NO: 7495 - DNA, 3858 bp, Artificial Sequence
  Description of Artificial Sequence: Synthetic coding sequence
atggacctcgaagctgctaagaacggcaccgcctggaggcccacctcggccgagggcgatttcgaactggggatatccagtaaacagaagcgcaagaaaaccaaaaccgtgaagatgatcggggttctaactttattcaggtatagtgactggcaggataaactcttcatgagcctcggaacaatcatggcaatagcacatggaagcggattacccctgatgatgatcgtgtttggggaaatgaccgataaatttgtcgatacagcaggaaacttcagctttcctgttaacttttctctgagcctcttgaatccaggcaagatcctggaagaggagatgacccggtatgcctactactattccggtctgggagcaggggtcttggtggccgcttatatccaggtgtcgttctggactttggcagccggaagacaaataaggaagattaggcagaaattcttccacgcaatcctcagacaggagatcggatggttcgatattaatgatactactgagctgaatacccgcctaaccgacgacatctctaaaattagtgaaggcatcggagacaaggtaggaatgttctttcaagcagtggcaaccttcttcgccggcttcatcgtggggttcattcgggggtggaaactgacactggttattatggccatcagccccatcctcggtttatcagccgcggtgtgggccaagatactgtctgccttctcagacaaggagctggcagcgtatgctaaggcaggcgctgtcgcggaggaggccttgggggccattcggactgtaattgcgttcggcggacagaataaggagctggagcggtaccagaagcatctggagaacgctaaggagatagggatcaagaaggccatcagtgcaaacatatcaatgggcatcgcatttctcctcatctatgcgtcatacgctttggctttctggtatgggtccacactcgtcattagcaaggaatataccatcggaaacgcgatgacggtgtttttcagcatcctgatcggagctttcagtgtggggcaggcagccccctgcatcgatgcctttgcaaatgcccggggggccgcatatgtaattttcgacatcatagacaataacccaaaaatagatagcttttcagagcggggtcataagccggactctattaaggggaatttggagtttaacgacgtgcacttctcctacccaagcagggcaaacgtgaagatcttgaaagggctcaacctcaaagtgcagtcaggccagacagtagcccttgttggatcgagcggctgcgggaaatcaaccaccgttcagttaatacagagactttacgaccccgacgagggaaccattaatattgacggccaggacattcgcaactttaacgtgaactatctacgggaaataatcggcgtggtgagccaagaacccgtgctttttagcaccaccatagccgaaaacatctgttatggccgtggcaatgtcaccatggatgaaattaaaaaggcagtgaaggaagcgaacgcctacgagttcattatgaagctgccccagaaatttgataccctcgttggtgagcgcggagctcagctcagtggtggccaaaaacagcgaatcgcaatcgcgcgcgcattagtcaggaatcccaagattttgctccttgacgaagccacatcagcgctggacaccgaaagcgaggccgaagtgcaggccgccctcgacaaggctagggaaggaaggacgaccattgtgatcgctcataggcttagcacggtgaggaacgctgatgtgatcgctgggttcgaggacggcgtcattgtagagcagggatctcacagtgaactcatgaagaaggaaggcgtgtattttaaattggtgaacatgcaaacttccggatctcagattcagtctgaagagttcgagctgaatgacgaaaaagctgccacacggatggctcctaatgggtggaagtctcgactttttcgccacagtacccagaagaacctgaagaattcccagatgtgccagaagagtctcgatgttgaaactgatgggcttgaggccaatgtgcctcctgtttcatttttgaaggttttaaagctaaataagacagagtggccttattttgtagtcggtactgtctgcgcgatagccaatggcggtttgcagcctgcattttccgtgatattttctgagattatagccatttttgggccaggcgacgacgcggtgaaacagcaaaaatgcaacatcttcagcctcatctttttatttttgggcataatttcattctttacctttttcctccaaggctttacctttggcaaggcaggagaaattttaacacggaggctgagatcgatggcctttaaagctatgcttcgacaagacatgtcgtggtttgatgaccacaaaaattctaccggcgcgctttcaacaagactggccacggacgctgcccaggtgcaaggcgcaacaggtacacggttggcacttatcgctcaaaatattgcaaacttaggcactgggattataatctctttcatttatggatggcaactgacgcttcttttgctggccgtggtgccgataatcgcagtgagtggcatagtggaaatgaagttactggccggaaacgctaaacgggacaaaaaagagctggaggcagctggcaagatcgcaacggaagctatagaaaacatccgaacagtcgtctcgttaactcaggagcggaagttcgagagtatgtatgtagaaaaactctatggcccgtatcgtaattcagtgcagaaggcgcatatttatggcatcacattttctattagccaggccttcatgtacttctcctatgctgggtgtttcagattcggcgcctacttgatcgtgaatggccacatgcgatttcgggatgttattctggtgttctccgcgatcgtattcggtgcagtcgccttagggcacgctagttcttttgccccagactacgccaaggcgaaactcagtgccgcacacctgttcatgctttttgagaggcagcccctgatcgacagctacagcgaggaaggacttaaacccgacaagtttgaaggaaacattacttttaacgaagtggtttttaattatccgactagggccaacgtccctgttctgcagggtttatctctggaggtgaagaagggccaaaccctggctctggttggatctagcggctgcggcaaatctactgtagtgcagctgttggagagattctacgatcccttagccgggacagtcttcgtagacttcggctttcagcttcttgacggacaggaagccaaaaagcttaacgtgcagtggctcagagcccaactgggcattgtctcccaggaacccatcctctttgactgttctattgccgagaatatcgcctacggcgataattctagggtggtgtctcaggatgagattgttagtgcagcaaaggccgcaaacattcacccgtttatcgagactctcccacacaagtacgaaacccgcgtgggcgacaaaggaactcagctgagtggaggccaaaaacagaggatcgcaattgctcgagcgctgatcaggcagccacagatactcttattggacgaggctacctctgcactagatacagagtctgagaaggtggtccaggaggcactggataaggcacgtgaggggcggacgtgcatcgtcatagcccataggttgagtaccatacaaaatgctgacctgatcgtggtgttccaaaatggcagggtaaaggagcacggcacccatcagcaacttctcgcccagaaaggaatttatttctccatggtgagcgttcaggctgggactcagaatttg

SEQ ID NO: 7496 - DNA, 3858 bp, Artificial Sequence
  Description of Artificial Sequence: Synthetic coding sequence
atggacctggaggctgccaaaaacggcactgcatggaggccaacctccgcagagggcgactttgagctcggtatctcaagtaagcaaaagcggaaaaaaacgaagaccgtgaaaatgattggtgttctcacactgttcaggtatagcgattggcaagataagctctttatgagcctgggaacaatcatggcaattgcccatggttctggattgcccttaatgatgattgtgttcggggagatgaccgacaagtttgttgatactgccggaaacttttctttccctgtaaacttcagcctgtcactgctcaaccctggcaagatcctcgaagaggaaatgaccagatacgcttactattacagtggactcggcgcaggggtgttggtcgccgcttacattcaggtcagcttttggactttggccgctggtagacaaattaggaaaatccggcagaaatttttccatgctatactccgccaggagatcggctggtttgacattaatgataccacagaactgaatactcggctaactgacgatatatctaagatcagtgagggcatcggagataaagtgggcatgttctttcaggcagtggccacttttttcgcaggctttattgtgggattcattcgaggttggaagctgaccctggtgatcatggctatcagccctattctcggactctctgctgcagtgtgggccaagattctctcagcctttagtgacaaggaactggcggcttacgccaaagccggtgctgtagctgaagaagcattgggcgccatcagaaccgtcatcgctttcggcggccaaaacaaggaattggagcgctatcagaagcacctggaaaacgcaaaagagatcggaatcaagaaggctatcagcgctaacatctcgatgggcatagccttccttctgatttatgcttcctacgctttggctttttggtacgggtcgacactcgtaatcagtaaggagtacactataggaaacgccatgacggtgttcttttccattcttatcggagctttttccgtcggtcaggccgcaccatgcatcgatgcctttgccaacgctcgcggcgcagcatacgtgatttttgacattatcgataataaccctaaaattgattcattctctgaacgtggtcacaaacccgattctatcaaaggcaacctcgagttcaacgacgtccatttttcatacccaagtcgcgcgaacgttaagatcttgaaggggcttaacctgaaggtacagtccggacagaccgtggctttggtgggcagttcaggctgtggcaagagcaccacagtgcagctaatccaaagattgtatgacccagacgaaggaaccattaatatagatggccaggacatccgcaacttcaacgttaactatctccgcgagataataggggtggtgagccaggaaccagtgctcttcagcactaccatcgctgagaacatctgctacggcaggggcaacgtcacaatggatgagatcaaaaaagcggtgaaagaggcaaatgcctatgagttcataatgaaactgccacaaaagttcgatactctggtcggcgagaggggagcacaactttcaggcggacagaaacagcggattgccatagctagagcgcttgtgagaaaccctaagatcctcctgctggatgaagccacatctgcgctggatacagagagcgaagctgaagtccaggccgctctggacaaagccagggaagggaggactaccattgtgattgctcatagactcagcaccgtgaggaacgctgacgtgatcgccggtttcgaagacggagtgatcgtagagcaaggaagccattccgaacttatgaaaaaggaaggggtgtacttcaaattagttaacatgcaaacatcaggcagccagatccagagtgaagagttcgagctgaacgatgaaaaagcagccacaaggatggcccccaacggctggaaatctagactctttcgccatagtacccagaagaatctgaagaacagtcagatgtgccagaaatccttggacgtagaaacagacggattagaggcaaacgtgccaccagtatcatttctgaaagtcctgaaactgaacaagactgagtggccttattttgttgtcggcacagtgtgcgcaatcgctaacggtggtttgcagccagcattttctgtcatttttagcgagatcatcgccatcttcggtccaggcgatgatgctgttaagcaacagaagtgcaacattttcagtttgatatttctgttccttgggatcataagcttttttacattctttttgcaaggatttacatttggaaaagctggcgagatactgactcggcgtctgagaagcatggctttcaaggctatgctccgccaagacatgtcctggtttgacgaccataagaacagcaccggtgcattgtctacaaggctggccaccgatgccgcccaagtccagggggccaccgggaccaggttggctttgatcgctcaaaacatagccaacttaggcacaggaattattatctcgttcatctacggctggcagttgaccctcctgctgctagcagtcgttcctattatcgccgtcagtggaattgtcgaaatgaagcttctggcgggcaacgcgaagagagataagaaagagctggaagcagcgggtaaaattgcaacagaagccatcgagaacatccggactgtcgtcagcctgacccaagaaagaaagttcgagagcatgtacgttgagaaactgtacggaccatacagaaatagcgtgcaaaaagctcatatttacggcattactttttctatcagccaagcgttcatgtattttagctacgccggatgctttaggttcggggcttacctgatagttaatggtcatatgaggttcagggacgttatactcgtctttagtgctattgtctttggagcagtcgccctcgggcatgcttcttctttcgctcctgactacgccaaagcaaaattgagtgcagcacatctgtttatgctcttcgagcgccaacccctaatcgattcctacagcgaagaggggttaaaaccggacaaatttgagggaaatatcacatttaatgaagtagtgtttaactaccctacaagagccaacgttcccgttctgcagggactttcactggaagtcaagaagggccagacacttgctttggtgggttcctcgggctgtggaaaatcgaccgtggtgcagctgctggagaggttttacgaccctttagcagggactgtgttcgtggacttcggatttcagctgctggatggccaagaagctaaaaagctgaacgtgcaatggctgcgagctcagctcggcatcgtcagccaggaacccattctgtttgactgctcgatagcagagaacatagcttacggagacaattcgagggttgtaagccaagatgaaatagtgagcgctgccaaggctgcaaatatccatcctttcatcgagacactcccccacaaatacgagacccgggtgggagacaaaggaacacagctgagcggtggacagaagcagagaatcgctatcgcgcgtgctttgattaggcagccacagatacttctcctcgacgaagctacatccgctctggatacagagtccgaaaaagtcgtccaggaggctctcgataaagcaagagagggccgcacctgtatagtgattgcacatagactgagcaccattcagaacgctgacctgatcgtcgttttccagaacggaagagtgaaagagcatggtacccaccagcagctgctggcgcagaagggcatctacttctcaatggtcagtgtccaggctggcactcaaaacctc

SEQ ID NO: 7497 - DNA, 3858 bp, Artificial Sequence
  Description of Artificial Sequence: Synthetic coding sequence
atggatttggaggccgccaagaatgggaccgcctggcgccccacgtcagcagagggcgacttcgagctcggcatctcctcgaaacagaagcgaaaaaagaccaagaccgtgaaaatgatcggagtgctcactctcttccgctactcggattggcaggacaagctgttcatgagtctggggactatcatggcgatcgcccacggatctgggcttccgctgatgatgattgtgttcggcgaaatgaccgataagtttgttgacactgctggaaatttctcatttccggtgaacttctccctgagcttgctgaaccctgggaagatcttggaggaggagatgaccaggtacgcgtactactactcgggcctgggagccggagtgcttgtggcagcgtatatccaagtctcattctggaccctggcagcgggtagacagatccgtaagattcggcagaagttcttccacgcgatcctccgccaagaaatcggctggttcgatatcaacgacaccactgaactgaatacccgcttgaccgacgatatatcgaagatcagcgagggaataggtgataaggtgggcatgttcttccaggcggtggcgactttcttcgctggattcattgttggctttatcagaggttggaaattgactctggtgatcatggcaatcagcccgatcctcgggttgtccgccgccgtgtgggcgaaaatcttgtcagcattttccgacaaagaacttgccgcgtacgctaaggccggcgcggtggcagaggaagccctcggtgccatccggacggtgatcgcgtttgggggacagaataaagagctcgaaaggtaccagaagcatctggaaaatgcaaaagagatcggaatcaaaaaagctatctccgctaacatcagcatgggcatcgccttcctcctcatctacgcctcctacgcattggccttctggtacggctccactttggtgatcagcaaagaatacactatcggaaatgccatgactgtgttcttctcgatccttattggcgcattcagcgtcggacaagctgccccatgcatcgatgccttcgctaatgcccggggggcggcatatgtgatcttcgacatcatcgacaacaatcccaagatcgattcattcagtgaacggggacacaagccggacagcatcaaagggaacctcgagtttaatgacgtgcatttctcgtacccatcccgggccaatgtcaagatcctgaagggactgaacctgaaggtccagagcggacaaactgtggcactcgtcggtagttccggatgcgggaagtcaaccaccgtccaactcatccagcgtctctatgacccagacgaaggcaccatcaatatcgatggccaggacatccgtaacttcaacgtcaattacctgcgcgagattatcggagttgtgtcccaggagccggtgctcttctcaactaccatcgcagaaaacatctgctacggacggggcaacgtgactatggatgagatcaagaaagcggtgaaagaagcaaatgcgtacgaattcattatgaaactgccccagaaattcgatacccttgtgggtgaaagaggggcacagctgtcgggcggccagaagcaacggatagcgatcgcgcgagctttggtccggaacccaaagatcttgctgctggatgaagcgacttcagccctcgataccgaatcggaggctgaagtccaagcggcgctcgataaggcacgggaagggagaaccaccattgtgatcgctcaccgcctgtctaccgtccgcaacgccgacgtcattgcgggtttcgaagatggagtcatcgtcgaacaggggtcccatagcgagcttatgaagaaggagggcgtgtactttaagctcgtcaacatgcaaacgtccggatcgcagatccagtctgaagaattcgagctgaacgacgaaaaggcagctacccgcatggccccgaatggatggaagagccgactgtttcgacactcaacccagaaaaacctcaaaaactcgcaaatgtgccaaaagtctctggacgtggagactgacggactggaagccaacgtgcctccggtgagctttcttaaggtcctgaaactgaataagaccgaatggccgtactttgtcgtgggaaccgtgtgtgccatcgcaaacggaggattgcagccagccttctcggtcatcttctccgagataatcgcaattttcggacccggcgacgacgccgtgaaacaacaaaagtgcaacatctttagtctgatattcctgttcctgggaatcatttccttcttcaccttcttcctccaaggctttacctttggcaaggctggtgagatcctgacgaggcgcctcaggagcatggccttcaaagctatgttgagacaggatatgtcgtggtttgatgaccacaagaattccaccggcgcgctttcgactagattggcgactgacgccgcccaggtgcagggagcgactggaactagactggccctgattgcccagaacatcgcaaatctgggcactggcatcatcatttcgtttatctacggctggcagcttaccctgctgctcctggccgtggtccctatcatcgcggtgtccggtatcgtcgaaatgaagctccttgcaggaaacgccaaaagagataagaaggaactggaggctgctggaaaaatcgcgactgaggccatcgaaaacattcggaccgtggtgagcctcactcaggaacgcaagttcgagtctatgtacgtggaaaagctgtacggtccttaccggaacagcgttcagaaggcacatatctacggaatcactttctcgatctcacaggccttcatgtacttttcatacgctggctgctttcgattcggagcctacttgatcgtcaatggacacatgcggtttcgcgatgtgatcctcgtgttctccgcgattgtgtttggagccgtggcccttggacacgcgagctccttcgcgccggactacgcgaaggccaaactcagcgctgcccacctcttcatgctgtttgaacggcaacccctgattgattcgtactccgaggaaggtcttaagccggacaagttcgaaggaaacattacgttcaacgaggtggtgtttaactacccgactagagccaacgtcccagtccttcaggggctgtcgctggaggttaagaagggtcaaactctggcactcgtgggctcctctggatgtggaaagtcgactgtggtccaactcctggagcgcttctacgacccactggccggtaccgtctttgtggacttcgggttccagctgttggacggacaggaagcgaaaaagctgaatgtgcagtggctgcgggcacaactcgggattgtctcccaagagcctatcctcttcgactgttcaatcgccgaaaacatcgcgtacggcgacaactctcgcgtggtttcacaggacgaaatcgtgagcgctgctaaggcggcgaatatccatccttttatcgagacgctgccacataagtatgagacgcgggtgggagataagggaactcaactctcgggaggacagaagcaacgcatcgctattgcccgtgctctgattaggcaaccgcagatcctcctcctggacgaggccacttctgccctggacacggaatcggagaaggtggtccaggaagcgctggacaaggcccgcgagggaaggacgtgcatcgtaattgctcatcgcctgagcaccatccagaacgcagacctgatagtggtgttccaaaacggtcgcgtgaaggaacacggtacccaccaacagctgctggcccagaaaggtatctatttctctatggtgtccgtccaagcaggaacccagaacctg

SEQ ID NO: 7498 - DNA, 3858 bp, Artificial Sequence
  Description of Artificial Sequence: Synthetic coding sequence
atggacttggaggccgcaaagaatggcaccgcctggcggcctacctcagctgagggggacttcgaactcggcatcagtagcaagcagaaaaggaaaaaaaccaagactgtcaaaatgattggagtcctgacactgtttcgctattcagattggcaagataagctctttatgtctctcgggacaatcatggctatagcccatggaagcggattgccgttaatgatgattgtgttcggggagatgactgacaagtttgttgacacggccggtaacttctcctttcccgtgaacttttctctgagcctcttaaatccgggtaagatacttgaagaggagatgacccgttacgcatactactacagcggacttggggcaggagtgctagtggcggcctacattcaggtgagcttttggaccctggcagcgggtcggcagatcagaaagatcaggcagaagtttttccacgcaatcttgcgccaggagatcggctggtttgacatcaatgatactacagaattgaatacaaggctgaccgacgacatatccaagatttccgaaggtatcggagacaaagtggggatgttcttccaggcggtcgctacattctttgctggatttatcgtaggcttcatcagaggctggaagctgaccctggtgatcatggctataagccctattctgggactgtcagctgcagtctgggccaagattttgtcagctttttccgacaaagagctggctgcctatgctaaggcaggagcagtagctgaagaggcactgggagccatcagaaccgtaatagccttcggaggtcagaataaagagctggagaggtatcagaagcacctggaaaatgccaaggagatcggcatcaagaaagccattagtgccaatatcagtatggggattgcttttcttttgatttacgcaagttatgccctcgccttctggtacgggtctaccctggtcatatctaaagaatatacaatcggtaatgccatgaccgtgtttttttccatcttgattggtgcattctcagttggccaggctgccccttgtatcgacgcctttgctaacgcgaggggcgccgcatacgtgatcttcgacattatcgataataaccctaagatcgactccttctcagaacgcggccataaacccgactctatcaaggggaatctcgaatttaatgatgtacacttttcttacccctcacgggcgaacgtgaagatcctgaaagggctaaacctgaaagtgcaatccggccagacagttgcactggttgggtcatcaggttgcgggaaatcaaccactgtgcaactcatccagcggctttacgatcccgacgaaggaacaatcaacatagatggacaagatatacgaaattttaacgtgaactacttacgggagatcatcggggtagtttcccaggagccagtgctgttttccaccaccattgccgaaaacatttgttacgggaggggaaatgttactatggatgagatcaagaaagccgtaaaggaggcaaatgcctatgagttcataatgaaactcccccagaaattcgataccttggtcggcgaacgtggggcgcagctgtctggcgggcagaaacagcgtatagcaatcgcccgggcactcgtgaggaatcctaagatcctgttacttgacgaggcgacaagtgcactcgacactgagagcgaggccgaggtgcaggcagccctggataaggccagggagggcagaaccacaatcgtgatcgcgcaccgtttatccacggtccggaatgcagatgtgatcgctggcttcgaagatggggttatagtagagcaaggcagccatagcgagctgatgaagaaggagggggtctactttaagctggtcaacatgcagacatcgggcagccagattcagtctgaggagtttgagcttaatgatgaaaaagctgccacaagaatggcccccaatggctggaagagccgactctttcggcactctactcagaagaacctgaagaactcgcagatgtgccaaaaaagcttggacgtcgagacagatggtctggaggcgaacgtaccacctgtcagtttccttaaagtgctcaaattgaacaagactgagtggccttatttcgtcgtgggaactgtgtgtgccatagccaacggtggcctgcagcccgcattctccgtgatattctcagagatcatcgccatttttgggcctggagacgacgccgtgaagcagcaaaaatgcaatattttcagcctgatcttcctgtttctgggaatcattagctttttcacattctttttgcaaggatttacgtttggcaaagctggcgaaatcttgacgaggcggctgcgttcgatggcttttaaggccatgttgaggcaggacatgagctggttcgatgaccacaaaaactcaacgggtgctctgtccacccgccttgccacagatgccgcacaggtgcagggagccaccggaaccagactggctttaattgcgcaaaatattgcaaacttgggcaccggtattattattagcttcatctatgggtggcagctcacattgctcttgctcgccgtggtgccaatcattgccgtgtctggaatcgtggagatgaagttgctggccggcaacgcaaagcgagacaagaaggaactggaggccgctggtaagatcgcaacagaagctatagagaatattcggaccgtggtcagtctgacccaagaacggaaatttgaaagcatgtacgtagagaaactttacgggccttatcgcaattccgtgcagaaagcacatatctacggtattacgttttctattagtcaggccttcatgtacttcagttacgccggttgctttcgcttcggtgcctacctgatcgtgaatgggcacatgaggttcagagatgttatacttgtgttctcggccattgtgttcggggccgtcgcactgggccacgcatcgtctttcgcccccgattatgctaaggcaaagctctcggcggcgcacctctttatgcttttcgaacgtcagcccctcatcgattcctactccgaagagggactgaaacccgacaaatttgaagggaacattacgtttaacgaggtggtgtttaattatcccacgagagcaaatgtgcccgtgttacagggcctgtcacttgaagtcaagaaggggcagacactggctctggtgggctcttccggttgtgggaagagtaccgtggtgcagctgttggagcggttttacgaccctctggcagggacagtgtttgtcgacttcggattccagctgttggacggccaggaagccaagaaactcaatgtccagtggcttagggcccagctcggaattgtttcacaggaacctatcctgttcgactgctccatcgccgagaatatcgcgtatggtgacaactcaagggtggtttcccaagatgaaatagtatccgctgcaaaagctgcaaacatccacccttttatcgagaccttaccgcataaatatgagacccgtgttggcgataagggcacccagctgagtgggggccagaagcaacgaatcgccattgcgcgcgctctgattcggcagccacagattttattgttggacgaggccacttctgccctggatactgaaagcgagaaagtcgtacaggaagccctcgacaaggcccgcgaaggacggacgtgcattgtcatcgctcatcgccttagtacaatccaaaatgctgaccttattgtggtgttccagaacggaagagtcaaggagcatgggactcatcagcagttgttggcacagaagggaatttatttcagcatggtgtccgtgcaggccggcacccagaacctg

SEQ ID NO: 7499 - DNA, 3858 bp, Artificial Sequence
  Description of Artificial Sequence: Synthetic coding sequence
atggatttggaagccgcaaagaacggaacggcgtggcgcccgacttccgcagaaggagacttcgagctgggcatatcatcgaagcaaaaacgaaagaaaactaagactgtgaagatgatcggtgtccttacccttttcagatacagcgattggcaagataaactgtttatgtcacttggcactattatggccatcgctcatggatcagggcttccactgatgatgattgtctttggtgaaatgaccgataagtttgtggatactgcaggaaacttctcttttcctgtcaacttctccctgagccttctgaaccctggaaagattcttgaagaagagatgaccagatacgcatactactactcaggacttggggccggagtgctggtggcagcatacattcaagtatccttctggaccttggcggcgggtaggcagattcgaaagatccgtcagaagttttttcacgcaattttgcggcaagaaatcggctggtttgacataaacgatactaccgagctcaacactcgtctgacggatgatattagcaagatatcggagggaattggagacaaggtcggaatgttttttcaagccgtggcgacctttttcgccgggtttatcgttggttttatcagaggttggaagctgacccttgtcattatggcaatcagccctattctgggacttagcgcagcagtttgggcaaagattctgtccgcattctccgataaggagctggctgcatacgcgaaggcaggcgcagtggcagaagaggcacttggcgccatacgtactgtgattgcgtttggtggacagaacaaagaactggaacgctaccagaaacatctcgagaacgcaaaagaaatcgggatcaagaaggcaatcagcgccaacatctccatgggtatcgcgtttctgcttatctacgcatcctacgcacttgcattttggtatggttcgaccctcgttattagcaaggaatatacgataggtaacgctatgaccgtctttttctccatcctgattggcgcattttcagtggggcaggcagccccttgcattgacgcctttgccaacgcacggggtgccgcatacgtcatctttgacattattgacaataaccctaaaatcgacagcttttcggagcggggacacaagcctgattcgatcaagggcaacctcgagtttaacgatgtgcatttttcctacccatcgagggcaaatgtgaagattcttaagggcttgaatctcaaggtgcaaagcggccagactgtagcacttgtcggatccagcgggtgtggtaaaagcactaccgtccaactgatacaacggttgtacgacccagacgaaggcaccatcaatattgacggtcaagatatccgaaatttcaacgtgaattaccttcgggagattatcggtgtggtgtcgcaggagcctgtgctgttttccactactattgcagaaaacatctgttacggtaggggaaacgtgactatggacgaaatcaaaaaggcggtgaaggaagcaaacgcatacgagttcattatgaagctccctcaaaagtttgatactctggtgggagagcgcggggctcaactttcgggaggacagaaacaacggatcgcaatcgcaagagcactggtgcgaaatcccaagattctgctgctggacgaagccacttcggccctcgataccgaatcggaagcagaggtccaagcggcacttgataaggcacgtgagggtaggactactatcgtgattgcacatcggctttcgaccgtccgaaatgctgatgttattgcaggattcgaagatggagtcatagtggaacaaggtagtcattccgagttgatgaagaaggaaggtgtgtactttaaacttgtcaatatgcaaacctctggaagccagattcaatccgaagagtttgaactgaacgacgagaaagcagcaacgaggatggcccctaacggatggaagtcaagattgtttaggcattcaactcagaaaaaccttaagaattcgcagatgtgtcaaaaatcgctcgacgtggaaaccgatggactggaagcaaatgtgccaccagtcagctttctcaaggtcctgaaacttaacaagacggaatggccatactttgtcgtgggtaccgtctgcgcaatcgcaaatggaggactgcaacctgcgttttcggtgatattctctgagataattgcaattttcggaccaggcgatgacgcagtgaagcaacaaaagtgtaacattttctctctgattttccttttcctgggtattatctccttctttactttctttctgcaaggctttactttcggtaaagcaggtgaaatcttgaccagaaggcttcggtccatggcctttaaagcaatgctgcgacaagatatgtcgtggtttgacgaccataagaactccaccggcgcgctgtcgaccaggcttgcaactgatgcggcacaagtccaaggagcaaccggtacccgcttggcgcttattgcccagaacattgcaaacctgggcaccggtattatcattagcttcatttacgggtggcagctcaccctgctcctcctcgcagtggtgccgataattgcagtgtccgggattgtcgaaatgaagttgctcgcagggaacgccaaaagagacaaaaaagaactcgaagcagcggggaagatagcaactgaagcaatcgagaacattcggactgttgtctcactgactcaagaacgaaagttcgaatcgatgtacgtggaaaaactgtacggtccatatcgcaatagcgttcagaaggcacacatctacgggattactttctcgatcagccaggccttcatgtactttagctacgcaggttgctttcggtttggagcataccttatcgtcaatggccacatgagatttcgcgatgtgattttggtgtttagtgcaatcgtttttggtgcagtggcactgggacatgcatccagttttgcacctgattacgcaaaagcaaaactgtcagcggcccatttgttcatgttgtttgaacgccagcccctcattgattcatactccgaggaggggctgaagcctgataagtttgaaggcaacataacttttaacgaggtcgtgtttaactacccaacgagagcaaatgtccctgtgcttcagggactttcccttgaggtgaagaagggacagactcttgcactggtaggaagctcaggatgtgggaagagcaccgtggtgcaattgcttgaaaggttctacgacccgcttgcaggcactgtgtttgtcgacttcgggttccaactgctcgatggacaggaagcgaagaagttgaacgtgcagtggctgagggcccaacttggcattgtgtcgcaagaacccatattgttcgactgcagcatagcagaaaacattgcgtacggagacaattcccgggtcgtgtcccaggacgaaatcgtctcggcggcgaaagcagccaacatccacccctttattgaaacccttccgcataagtacgaaacccgcgtgggtgataagggtacccagttgagcggagggcagaagcagagaattgccattgcccgagcccttatcagacagcctcagatcctgctgctggatgaagccacttctgcgcttgataccgagtcagaaaaggtggtgcaggaggccctggataaagcacgggagggacgcacctgtattgtcatcgcacaccggctctcaaccattcaaaacgccgatcttatcgtcgtctttcaaaacgggagggtgaaggaacacggcacccatcagcagctgctcgcgcaaaagggtatttacttttccatggtgtcagtgcaagcaggcacccagaacctt

SEQ ID NO: 7500 - DNA, 3858 bp, Artificial Sequence
  Description of Artificial Sequence: Synthetic coding sequence
atggacttggaggctgctaagaatggcacagcatggcgccctacgtccgctgaaggggacttcgagctgggcatctcctctaaacagaagagaaagaaaactaagacagtgaaaatgatcggagtgctgacattattccggtattcagactggcaggataagctcttcatgtccctcgggacgatcatggcgatagcacatggctccgggcttcctttgatgatgattgtcttcggggagatgaccgataaattcgtagacactgccggaaacttctctttcccggtgaatttctcactcagtttgctgaatcccggaaagatcttggaagaagagatgacacgatacgcatattattatagtggcctcggtgcaggagtcctggttgctgcctatatacaagtgtctttttggacactggccgctggccggcagatcagaaagattcgccagaagttttttcatgccattctgaggcaggagatcggctggtttgacattaatgataccactgagctaaacacaaggttgaccgatgatattagcaagatttccgaggggatcggggacaaggtaggcatgttttttcaggctgtggcaactttttttgcaggtttcattgtcggatttattcggggctggaagttgactctggtaattatggctatttcccccatactgggactgagtgccgccgtgtgggccaaaattctgtctgccttctctgataaagaactggccgcttatgcaaaggccggcgccgttgctgaagaggcgcttggagctatccgcacagtaattgccttcggggggcagaataaagaactcgagaggtaccaaaagcatctcgagaacgcaaaggaaatcggtatcaagaaggctatctccgccaacatcagcatgggcattgccttccttctcatttatgcgtcctatgccttagcattttggtatgggtctacgctggtcatttctaaagagtatacaatagggaacgctatgaccgtattcttctccatccttatcggagcattttcagtaggtcaggctgccccttgcatagacgctttcgctaacgcgcgtggtgctgcctatgtaattttcgacataatcgataacaatccgaaaatcgacagctttagcgaacggggtcacaaacccgatagcataaaaggcaatctggagttcaatgacgttcatttttcctatccttcaagagctaatgtgaagattctgaagggcctgaacctaaaggtgcagagcggccagaccgttgctctcgtcggaagcagcggttgcggcaagtctactaccgtccagctgattcagcgcctgtacgatccggatgaagggaccatcaacatagatggacaggatatacggaactttaatgtgaactatctgcgggagatcataggggttgtgtcgcaagagcccgtgctctttagcacgacaatcgccgagaacatctgttatgggcgtgggaatgtcactatggacgaaattaaaaaggccgtcaaagaagcaaatgcctacgaattcatcatgaaactgccgcagaagtttgatacccttgtgggagagcggggcgcccagctgtctggaggtcaaaaacagagaatagccatcgctagggcccttgttagaaatcccaagatcctgttgctggacgaagcgacaagtgctcttgatactgagtccgaagcagaggtgcaggcagctcttgataaagcacgggaggggagaacaaccattgtgattgcacacaggctttccaccgtgcggaacgcagacgtaatcgctggctttgaggatggcgtaattgttgagcaggggtcacattcagagctcatgaagaaagagggtgtgtatttcaagctcgtcaatatgcagactagtgggagccaaatccagagcgaggagtttgagctcaatgatgagaaagctgccacccggatggctcccaatggttggaaatcgaggctgttccgccattcgacacagaagaacctgaagaactctcagatgtgccagaagagtctggacgtggagactgacggtctagaggccaatgtacctccagtttcgtttttgaaggtactcaaactgaataaaacagaatggccctattttgtggtgggcactgtatgcgcaatcgcaaacgggggtctgcaacccgccttttcagtgatattctcagagattattgcaattttcggccccggggatgatgccgtgaagcaacagaaatgcaacattttttctctgatttttttgttcctggggattatctcattcttcactttttttcttcaggggtttacattcgggaaggccggggaaattttgaccaggaggctccggtctatggcctttaaggccatgcttcgtcaggatatgagttggtttgatgaccataaaaactcaaccggcgctctttccactagactggccacggacgccgcgcaggtccagggggctaccggcactagattggctcttatcgcccaaaatatcgccaatctaggtaccggaatcattatttccttcatttatggatggcagctgactctgctactcttggcagtcgtgcctatcattgccgtgagtggaatagttgaaatgaaattgctcgccggcaatgcaaagcgagataagaaggaactagaagcagccggaaagatcgcgacggaagccatagaaaacatacggactgtggtctccctgacacaggagagaaaatttgagagtatgtatgttgagaagctgtacggcccctatcggaatagcgtacagaaagcgcacatatacggcattacttttagcattagtcaggccttcatgtatttctcctatgctgggtgcttccgctttggcgcctacctgatagtgaacggccatatgcgttttcgggatgttattttggtgttttccgctatcgtattcggagccgttgctcttgggcacgccagtagctttgcaccagactatgccaaggccaagctgtctgccgctcatttattcatgctgttcgagaggcagccgctcattgacagctatagtgaggaaggcctgaaacctgacaagttcgagggaaatatcaccttcaacgaggtggtgtttaattaccccactagagccaatgtacccgtcctgcaggggctcagcctagaggtgaaaaaaggacagactctcgcgctggtcggatcctctgggtgcgggaaatcaacagtcgtccagctgctcgagaggttctacgatccgctggcagggacagtattcgtcgattttggtttccaactgttggatgggcaggaggccaagaaactgaatgtgcagtggttacgggctcagttgggtattgtgtctcaagaacccatcctgtttgattgctccatcgctgaaaacattgcgtatggggataactctcgggtggtctcccaggatgagattgtatcagcggctaaggccgctaatatccacccttttatcgagactctacctcataagtacgagaccagggtcggcgacaaaggcacacaactctctggcggacagaaacagcgaatagcaatcgcgcgtgccttaattaggcaacctcagatattattactggacgaagctacttcagctctggacaccgagtcagagaaggtagtccaagaggccctggataaagctcgcgagggtagaacatgcattgtgatcgcacaccggctatccactattcagaacgccgatctgatcgtggtgttccagaatggtagggtgaaggagcacggaacacaccagcagctgttagcacaaaagggcatctacttctctatggtctcagtacaggcaggcactcagaatctt

SEQ ID NO: 7501 - DNA, 3858 bp, Artificial Sequence
  Description of Artificial Sequence: Synthetic coding sequence
atggacttagaagcagccaaaaatggaactgcttggcgccctacctctgcagaaggcgactttgagctgggtatctccagtaagcagaagcgtaagaaaacaaagactgtaaagatgatcggcgtccttacattgttccgttactcggattggcaggacaaactgttcatgagtttaggaactattatggctatagctcatggtagcggtcttcccctcatgatgatcgtatttggggagatgaccgacaagtttgtggataccgcgggaaacttcagcttccccgtgaacttttccctgtccctactgaaccccgggaagattctggaagaagagatgactcggtatgcatactattactccggtctgggcgccggtgtgctcgtcgccgcttatatacaggtctcgttttggacactcgcagcggggaggcaaattcgtaagatacggcaaaagtttttccatgccattctgagacaggaaattggctggtttgacattaacgatacgaccgagcttaacacccggctgaccgatgacatcagcaaaatcagtgaaggcattggtgacaaggtggggatgttctttcaagcggtggctactttcttcgccggttttatcgtgggattcatacgcggatggaaactcaccctggtgatcatggccatttctccaatccttgggctgtctgccgctgtatgggccaagatactgtccgcattttctgacaaggaactagcagcatacgcaaaggcaggggccgtggccgaggaagcacttggtgctatccgtacagtgatagccttcggagggcagaacaaggagttggagagatatcaaaaacacctcgaaaatgcgaaggaaattggcatcaagaaggctattagcgctaatatatctatggggatcgccttcttgctgatctacgcctcttatgctctggcattttggtatggtagcaccctggttattagcaaagagtacactattggcaatgctatgaccgtgttcttctctattttgatcggcgcattttctgtgggacaagccgcgccgtgtatagacgcgtttgccaatgcgaggggagctgcctacgtcatctttgacattattgataacaacccgaaaattgactccttttctgaacgcggccataagcccgactctattaagggcaacctagagttcaacgacgtgcacttctcatatcctagtagggccaatgtcaagatactgaaaggtctcaatctcaaggtacaatctggtcagacggtggcactggtcggatcttccggatgtgggaaaagcaccaccgtgcaactgatccagcggctttatgacccagacgaggggacaatcaatattgacggccaggacatcagaaacttcaacgttaactatctgcgggagattatcggcgtcgtgtcgcaggagcccgtgctattctcaactacgatcgccgaaaatatctgctatggaaggggtaacgttacaatggacgaaattaaaaaagctgtgaaggaggcaaatgcttacgagtttatcatgaaactaccccagaagtttgacaccctggtcggggagcgcggggcccagctgtccggcggccagaagcagcggatcgcaatagcgcgggctctcgtccgcaatcccaagattttgttgctggacgaggctactagcgctctagatactgagtccgaggccgaggtgcaggcagcgctcgataaagcacgggagggccgtaccaccatcgtcatcgctcatagactttccacagtgcggaacgctgacgtgattgccgggttcgaagacggggtgatcgttgagcaggggagtcattctgaactaatgaaaaaagaaggcgtctattttaagctggtcaacatgcagaccagcgggtctcagatccagtcggaggagttcgaactcaacgacgagaaggcagccactcggatggccccaaacggatggaagtccagacttttcagacacagcacccagaagaacctgaaaaactcccagatgtgccagaagtcactggatgtggagaccgatggattagaggcaaacgtgccacctgtgagtttcctgaaggtcctgaagctgaacaaaacagaatggccgtattttgtcgtgggaacagtgtgcgctatcgctaatggcggcttgcagcccgcattctcagtgatcttctctgagatcatcgccatctttgggcccggagacgacgcagtgaagcagcagaagtgtaacattttcagcctgattttcctgttcctgggaatcatcagtttctttacctttttcctccaaggttttacctttggcaaggcaggagaaatcctgactagaaggctacgcagcatggcctttaaagccatgctgcggcaggatatgagttggttcgatgatcacaagaatagcacaggggccttaagcacacggctggccaccgacgcggctcaggttcagggagccacgggcaccagactggcgctcatcgcacagaacattgccaatctggggactgggataatcatatcctttatctatggatggcagctgacactgctgctgttggctgtggtgcccattatcgctgtttcaggcattgtggagatgaaacttctggcagggaatgcaaaacgagataaaaaagaattagaggccgccggaaaaattgccaccgaggctatcgagaatatccgaactgtggtctctttaacacaggagcgaaaatttgagtcgatgtatgtagagaaactctacggtccatacaggaactccgtacagaaagcacacatttatggcataacgttttctattagtcaggcttttatgtatttttcttatgccggctgttttcggttcggcgcatatctgattgttaacggacatatgcggttccgggatgtcattcttgtcttctcagcaatcgtttttggggcagtcgcgctaggccatgccagttccttcgctccagattacgccaaagctaagctgagcgccgcccacttgttcatgctatttgaaaggcagcctttgatcgactcctattctgaagaggggcttaagcctgacaagtttgagggtaacatcactttcaatgaagttgtattcaactacccaactcgcgctaacgtaccagtgctgcaaggcctctctcttgaggtgaaaaaaggtcagaccctcgccttagtgggatctagcggatgcgggaagtcaacagtggttcagctgctggagagattctatgacccactggccggtacagtttttgtcgacttcggctttcaacttctggatggtcaggaggccaagaaactcaacgtacagtggctcagggcacagctcggcatcgtctctcaggaacccattcttttcgattgtagcattgctgagaatatagcatacggggacaattcgcgggtcgttagccaagatgagatcgtgagtgccgccaaggctgctaacatccatccctttattgaaaccctaccccacaaatacgagacacgcgtgggcgataaaggtactcagctgagcggagggcagaaacagaggatagccattgctagggccctaatcaggcagccacaaattttactgttagatgaggccactagcgcactcgacaccgaatccgagaaggtcgtgcaggaggcactcgacaaagctcgggaaggacgcacatgtattgtcatcgctcaccggttgtccaccatccaaaacgccgacctcattgtcgtgtttcagaacgggagagttaaagagcatggcacccatcaacagttgttagcgcagaaggggatatacttcagcatggtgagtgtacaagccgggacccagaatttg

SEQ ID NO: 7502 - DNA, 3858 bp, Artificial Sequence
  Description of Artificial Sequence: Synthetic coding sequence
atggacctggaggcagccaagaacggaaccgcctggcggcctacatctgccgaaggcgattttgaactcggaatctcttcaaagcagaagcgaaagaagaccaagacagtgaagatgatcggagtccttactctctttcggtacagcgattggcaggataagctcttcatgtctctcggcacaataatggctatcgctcacggttcaggcctgcctcttatgatgattgtgttcggagaaatgaccgataagtttgttgacactgcagggaacttttcttttcccgtcaatttcagtttgtccttacttaaccccggcaagattctggaagaggagatgacccggtacgcctactattactccgggctgggagccggtgtgcttgtagccgcttatatccaggtctcgttctggactcttgccgccggccgccagattcgcaaaatccgccaaaaatttttccacgccatcttgcggcaagagatcggctggttcgacatcaatgatacgacggagctgaacacccggcttacagatgatatctcaaaaatttcagaaggcatcggagacaaagtgggaatgttttttcaggcagtggccactttttttgccgggtttatcgtcggctttatcaggggctggaagctgacccttgtgattatggccatttcccccattctcggcctgagcgcagcggtgtgggcaaaaattctttcagcctttagtgataaggagctcgctgcttatgccaaagcaggcgctgttgccgaagaggccttgggagcaattcgaacagtgatcgctttcggagggcaaaataaggagctggagcgatatcaaaaacacctggaaaacgccaaagagatcgggatcaagaaagctatctctgccaacatcagcatgggaatcgcttttctattgatttacgcctcttatgcccttgctttctggtatggctcaacactggtaatcagtaaagagtacactatagggaacgcgatgaccgtcttctttagtattctgatcggtgcatttagcgtaggacaggctgccccttgcatcgatgccttcgctaatgcccgtggcgctgcctatgtcatcttcgacatcattgacaacaatccaaaaatagattccttcagtgagagggggcataaaccagatagcattaagggcaatttagagttcaatgatgtccatttcagttatccttcgcgcgctaacgttaaaattctgaaaggactaaacctgaaggttcagtctggccagaccgttgcccttgtcggcagcagcggttgtggcaagtccactactgtccagcttatacagagattatatgatcccgacgagggcaccatcaacatcgacggccaggatatccggaactttaacgtaaattacctgcgagaaatcataggagtggtttctcaagagccagtgctgttctctacgaccatcgccgaaaacatctgttatgggcggggcaacgtgaccatggacgagattaagaaggctgtcaaagaggccaatgcatatgagtttattatgaagttgcctcagaaatttgacacactagtaggggagcgaggagcacagctgagcgggggtcagaaacagcgcattgccatcgcccgcgccctggtgagaaaccctaaaattcttctgctagacgaagccacctcagcgttagacacagaaagcgaagcagaggtgcaggccgcgttagacaaggcacgcgagggtcgcacaacaatcgtgattgctcaccgcctgagcactgtgagaaatgccgacgtgatcgcaggatttgaagacggcgtgatagtggaacaagggagccattccgagcttatgaagaaagagggagtctatttcaaattggttaacatgcagacctccggctcccaaattcagtcggaagagttcgagcttaatgatgaaaaggccgctacccggatggcccccaacggttggaagagccgcctctttcggcactctactcagaaaaacctcaagaactctcagatgtgccaaaagtcattagacgtcgaaaccgatgggttggaggcaaatgtccccccggtaagctttttaaaagtcctgaaactcaataaaaccgagtggccttactttgtcgtgggcacagtgtgcgcaatcgcgaacggaggcttacaacccgctttctccgtgatcttctctgaaatcatcgctatcttcggccccggtgatgatgccgtcaagcagcagaaatgcaacatcttttccctcatcttcctgtttctgggcatcatcagcttctttaccttcttccttcaggggtttacttttgggaaggccggcgaaatcctcacaaggagactgagaagtatggccttcaaggcaatgctgcgccaggatatgagctggtttgatgaccacaagaatagtaccggggctttgtccacccggcttgccacagatgccgctcaagtgcagggcgccaccggcacgcgcctggccctgattgcacaaaatatcgccaacctggggaccggaataataatatcctttatctacggatggcagcttaccctgctcttacttgctgttgtacctataatcgctgtctccggcatagtggaaatgaagttgctggccgggaatgctaaaagagacaagaaagagctggaagcggccggcaaaattgcaacggaggcgatcgaaaacatacgaacagttgtgtctttgactcaggagaggaagtttgagtcaatgtatgtggagaagctgtatggtccgtacagaaactcggtacaaaaagctcatatatacggtattaccttttccatcagccaggcctttatgtacttcagttatgctggctgttttaggttcggcgcgtatctgatcgtcaacggccacatgcgctttcgggacgtcatccttgtgttcagcgctatcgtgtttggtgccgtggccctggggcatgcctctagctttgctcccgattacgctaaggccaagctaagcgcagcacatttattcatgttattcgagcgtcagccccttatcgactcatattccgaggagggcctgaagccagataagttcgaaggcaatattacgtttaatgaagtggtcttcaactaccctacaagggccaatgtgccggtgctgcagggtctctctctggaagttaagaagggtcagacactggcactggttggcagttcgggctgcggtaagagtaccgtcgttcaactgctcgagcggttctatgatcccctggcaggaacagtctttgtggattttggatttcagctgctggatggacaggaagctaaaaagctgaatgttcagtggttgcgggcgcagttgggcatcgtgtcacaagagcccatcctgttcgattgctcaatcgctgaaaacatcgcatacggcgataattcccgggtagtgtcccaggacgaaattgtttcagcggccaaggccgctaatatacacccatttatcgagacgcttcctcataagtatgaaacccgagttggcgacaagggtacccagttatcaggaggacagaagcagaggatcgccatagccagggccctcattcggcagcctcaaatcctcttgctggatgaagctacatccgctctggacacagagagtgagaaggtggtccaggaggctctggataaggcccgggaagggcggacttgcattgtgatcgcccaccgattatcaacaatacaaaacgcggacttgattgttgtgttccagaatggacgcgtgaaggagcacggcacacatcagcagctgctcgcgcagaagggtatctatttctcaatggtttcggttcaggcagggacacaaaactta

SEQ ID NO: 7503 - DNA, 3858 bp, Artificial Sequence
  Description of Artificial Sequence: Synthetic coding sequence
atggacttggaggcagcgaaaaatggtactgcatggcgccctacatctgccgaaggtgacttcgaattgggcatttcatcaaagcagaagcggaagaagactaaaacagtcaaaatgattggagtcctgactctcttcagatatagcgattggcaggacaaattgttcatgtctcttggcactataatggcaatcgcccatggtagtggactacctttgatgatgatcgtgttcggagaaatgacagacaagttcgtggatacagccggcaatttctccttccctgtgaacttctctctttcactgctaaacccggggaaaatcctcgaggaagaaatgacgagatatgcgtactactacagtggtctgggagcgggtgtgctggtggcggcctacatccaggtgtccttctggactttagccgctggacggcagattagaaagatccggcagaagttttttcacgctattctcagacaggagattggctggtttgacattaacgacacgactgaactgaatactcgcttgaccgacgacatttccaaaatatccgaggggattggagataaggtgggaatgttcttccaggctgttgctactttctttgccggcttcatagttggtttcattagagggtggaagctgaccctggtgattatggccatctctcccatcctagggctgtccgcagccgtatgggccaaaatactgtccgctttcagcgacaaagaactggctgcatatgccaaggcgggagccgtggctgaagaggcattaggtgccattcgaaccgtgatagccttcggcggccagaacaaggaacttgagcggtaccagaagcacttggagaatgctaaagaaattggtataaagaaagccatctccgccaatatctccatgggcatcgcatttctcctcatttatgcctcttacgctcttgctttctggtacggaagcacactggttatctccaaagagtataccattggaaatgccatgacagtgtttttctctatcttgataggggcttttagtgtcgggcaggccgccccatgtatcgacgccttcgctaacgccaggggtgcagcctatgtgatatttgatatcattgacaataacccgaagatcgactcattcagcgaacgcggccataagccagacagcatcaagggcaatctcgaattcaatgatgtccatttctcataccctagccgggccaacgttaagatccttaaaggactgaacctaaaggtgcagtcgggccaaaccgttgcactggttgggagtagcgggtgcggtaaatccactaccgtgcagctcatccagagactgtatgaccctgacgagggcacaatcaacatcgacgggcaggacatccggaacttcaacgtgaattacctgcgcgaaataattggagttgtatcacaagagcccgtcctgttcagtacaaccatcgccgaaaacatttgctacggcagaggcaacgtaaccatggatgagattaaaaaggccgtcaaagaagccaacgcttatgagtttatcatgaagttgccacagaagttcgataccctggtgggcgagcggggagcccagttgagcggggggcaaaaacagaggattgcgatcgcccgcgctctagtccgcaatccaaagatcttacttctggatgaggccactagtgctcttgatacagaatccgaagccgaggtgcaggccgccctggataaggcccgggaaggacgcactaccatcgtgatcgcacatcgcctgtctacagtgaggaatgcggatgtgatagctggcttcgaagatggcgtgattgtggaacaggggagccacagtgagttgatgaagaaggaaggggtgtacttcaaactggtgaatatgcagaccagcggcagtcagatccagagcgaagaattcgagctcaacgatgaaaaagccgccacacgcatggcacctaacggctggaagtctcgtctctttcgccactctacccagaaaaacctcaagaattcacagatgtgtcagaagagccttgacgtggaaacggatggactcgaagctaacgttccccctgtctcatttcttaaggtactgaaactgaacaagactgagtggccgtacttcgtggtcggtacagtctgcgcaatcgccaatggcggcttacaacctgccttttcggtgattttcagcgaaatcatcgcaatctttggccctggcgacgatgcggtgaaacaacaaaaatgtaacatattcagcctgatcttcctattccttggcattataagtttcttcactttttttctgcaagggtttacctttggcaaagccggggagattctgaccaggcggctgaggtcaatggctttcaaagctatgctccggcaagatatgtcttggtttgatgaccacaagaacagcacgggcgcactgtctacaaggttggcgacggacgcagctcaggtgcaaggagctactggtactcgtttggctttgattgctcagaatatcgcaaacttgggcacaggaatcatcatttcctttatatacggctggcagctgacactcctcttacttgccgtggtgccgattatcgcggtgagtggaatagtggagatgaagttacttgcaggaaatgccaagcgcgacaagaaggaacttgaagctgcaggcaagatcgctacggaagccatcgagaatattagaacagtagtctctcttacccaggagagaaagttcgagtcaatgtacgtcgagaaattatatgggccctacaggaattccgtgcagaaggcccatatttacggcataacgtttagcatctcacaggctttcatgtatttcagttatgccggttgcttccgatttggtgcctacttgatcgttaatggacacatgcgcttccgtgacgtgatcctggtgttttccgccattgtgttcggcgccgtggccttgggccacgcttctagttttgcacctgactatgccaaggccaaactctcagcagcccatctgtttatgttgtttgaaaggcagcccctgatcgactcatatagcgaggaggggctaaaaccagacaagttcgaaggaaacatcaccttcaacgaggtcgtgttcaactaccccactcgcgccaacgtccccgttctccaggggttgagtctggaagtcaagaagggccaaaccttggcccttgtgggctcatctggatgtggaaaatccacagtggtacagctgctcgaaaggttttatgacccactcgctggcacggtgtttgtcgatttcggcttccaactgcttgacggtcaggaggccaaaaagttaaacgtccaatggctgcgcgcccaactgggaatcgtgagccaggaaccgatccttttcgattgttccatcgctgaaaatatcgcttacggagataactcccgcgtggtctctcaggatgaaattgtttccgcggcaaaagctgcgaacatccatccattcatagaaacgctgccccataagtacgagacccgggtcggtgacaagggaacacagctgagcggggggcaaaagcaacgcatcgccattgcgagagccctgatcaggcagcctcagatcctcctgctggacgaggcaaccagcgccctggatacagagagcgaaaaagttgttcaagaggccctggataaggctcgagaaggacggacttgcatcgtcattgcacaccggctgagcactatacagaatgctgatctgattgtcgtgttccagaacggccgggtgaaggaacacggaacccatcagcagctgctggcacagaagggtatttacttcagtatggtgtcagtgcaggctggcacccaaaatctt

SEQ ID NO: 7504 - DNA, 3858 bp, Artificial Sequence
  Description of Artificial Sequence: Synthetic coding sequence
atggatctggaggctgccaagaacggaacggcctggcgccccaccagtgccgaaggagatttcgagcttggcatatccagcaaacagaaacgcaaaaaaaccaagaccgtgaaaatgataggggtgcttacccttttccgctactctgattggcaggacaaacttttcatgagcttgggtacaatcatggccatcgctcatggcagcggtcttccactgatgatgatagtgttcggggagatgacggacaagtttgtcgacacagcagggaatttctcatttcctgtgaatttttccctcagtctcctcaatccggggaaaattctggaagaggagatgaccagatatgcttactactattcaggcctgggagctggtgtgttggtggccgcatacattcaggtttcattttggacgctggctgctggtaggcagattaggaagattagacaaaagtttttccacgccatcctgaggcaagagatcggttggtttgatatcaacgataccacagagttgaacaccagactgacagatgacatcagtaaaatttccgagggtataggcgacaaggtcggcatgttctttcaggcggtggctacgttcttcgccggctttatcgttggattcatcagagggtggaaactgacactggtgattatggccattagcccaatcctggggctgagtgccgccgtttgggctaagatcctctccgccttcagcgacaaggagctcgccgcgtatgctaaggccggggcggtggctgaagaggctcttggcgcaatccggacagtgatcgccttcggaggccagaacaaagagttggagaggtatcagaagcaccttgaaaacgccaaagagattggaattaagaaggcgatcagtgccaatatctccatgggaatcgcgtttctcctgatttacgcctcatatgctctggctttctggtatggatctactctggtgatttctaaagagtacacgatcgggaatgccatgaccgtcttcttctccattctcatcggtgcgttcagtgtcggacaagcggctccctgcattgatgctttcgccaatgcccgcggggcagcatatgtgatcttcgacataattgataacaacccaaagatagattctttcagtgagcgcggccacaaaccagatagtatcaaagggaatcttgaatttaacgatgtgcacttttcctacccatctcgcgccaacgtgaagattctcaagggcctgaaccttaaggtacagtcaggtcagaccgttgcattggtcggcagttccggctgcggcaagtccactactgtgcaactgattcagcgcctgtacgaccccgatgaaggtaccatcaacattgatggacaagacatccgcaattttaatgtcaactatctgagggagataatcggggttgtgtcccaggaacccgtcctgttttctactaccatcgccgaaaatatctgctacggccgaggcaacgttacaatggatgagatcaaaaaggccgttaaagaggccaacgcctacgaattcatcatgaagttgccacagaagttcgatacacttgtgggcgagcggggggcccagctctctggcggccagaaacagaggattgccattgcccgggccctggtgaggaacccgaaaatcctgttgttggatgaagcgacatctgcccttgataccgagtccgaagccgaggtgcaagcagctctggataaggctcgagagggcagaactacaatagtgatcgcgcatagactcagcacagttcgaaatgccgacgtcatcgctggttttgaagatggagtgattgtggaacaaggtagtcattctgaactcatgaagaaggagggagtctactttaagctcgtcaatatgcagacatctgggtcacaaattcagtccgaggaatttgaactgaacgatgagaaggctgccacacggatggccccgaatggctggaagagccggctgtttcggcacagcacacaaaagaacctgaaaaactcccagatgtgtcaaaaaagtcttgatgtggaaacagacggcctggaagccaatgtcccgcctgtctccttccttaaagtcctcaagctgaataagacagagtggccctatttcgtggtcgggacggtttgtgccattgcaaatggtggactgcagccggccttctctgtcatattttcagagattatcgcaatatttggaccaggcgacgacgccgtaaagcagcagaagtgcaatatctttagtctcattttcctgttcctcggaatcatctccttctttacattcttcttgcaaggatttacttttggcaaggctggggagattctcactcggagactgagaagtatggcctttaaagcgatgcttcgacaagacatgagctggtttgatgaccataagaattcaaccggcgcgctgagcacccgactggccacagacgcggcccaagtccagggggctactggtactaggctcgctcttatcgctcagaatatagccaatctgggaacgggaatcataatcagcttcatttacgggtggcaactgacactgttgctcctggccgtagtgccaatcatagccgtgtctggcatcgtggagatgaaacttctcgcaggaaacgccaagcgggacaagaaggagctggaagcagccggcaaaatagctaccgaggccatagaaaacattcgaactgtggtcagccttacccaggagcgaaaatttgagtccatgtacgtggagaagctgtacgggccctaccgcaatagcgtccagaaagcccacatctacggcatcacattctctatttcccaggcgttcatgtatttctcatacgctggatgctttcggttcggcgcctacctgatagtgaatggacatatgcgctttagagacgtgatccttgtattttctgccatcgtgttcggcgcagtcgccctggggcatgcctcaagttttgctccggactacgccaaagccaagctttccgcggcacacctgttcatgctgtttgagcgacagcctctcatcgattcatactctgaggaaggactgaaacccgacaagtttgagggcaatattacctttaacgaagtagtattcaattacccaacaagggccaacgtgcctgtgttgcagggcctcagcctggaggtaaaaaaaggccagacgctcgccctggtgggtagctctggatgcggcaaaagtactgtagtccagctcttggagcgcttctacgacccattggccggaacagtatttgtggacttcggctttcagttgctggacgggcaagaggcgaaaaagctgaatgtgcaatggctgcgagcacagctgggcatcgtttcccaggaaccaatcctctttgattgctcaatcgccgagaacattgcatatggtgacaactctcgggtcgtctcccaggacgaaatcgtgagtgccgcgaaggccgcaaatatccacccgtttatagagactctgccgcataagtacgagacaagggtgggtgacaaggggactcaactctccggcggacaaaaacagcggattgctatcgcgcgggccttgattagacagccacagatcctcctgctggatgaagctacctctgcactcgataccgaaagcgagaaagtcgtgcaggaggcactggacaaggcaagagaggggcggacctgcatagtgatcgcccacaggctgagcaccatccagaatgcggacctgatagtggtctttcaaaatggccgcgtaaaggagcatggaactcatcaacagctgctggcacagaaaggtatatacttcagcatggtatccgtgcaagccgggacccagaatctg

SEQ ID NO: 7505 - DNA, 3858 bp, Artificial Sequence
  Description of Artificial Sequence: Synthetic coding sequence
atggacctagaggctgcaaagaatggcacggcttggagaccaacgagcgccgaaggtgactttgagttagggattagctccaagcaaaagaggaagaaaactaagactgtgaaaatgatcggcgtcctcacgttgtttcgctattcggactggcaagataaactttttatgtcccttggtaccataatggcaatagcacacgggagcgggcttccacttatgatgattgtttttggagaaatgaccgacaagtttgtggacactgccggaaactttagctttcccgtcaacttttccctttcgctcctgaacccaggaaaaatcctggaagaggaaatgacacgatacgcttattactacagtggtctcggcgccggagttctggtagcagcttatatccaggtgtctttctggacgttggcagctggccgccagatcaggaagattcgacagaaattcttccacgcgatcctcagacaggagatcggttggttcgatatcaacgacaccactgagttgaacacccgtcttaccgacgatatttccaaaatctccgagggtatcggggataaggttggtatgttcttccaagccgttgcaactttctttgccggttttattgtcggtttcattagagggtggaaattaacactcgtcataatggcaatctcgcccatcttaggcctatcggcggcagtgtgggcaaagatcctgtccgcttttagtgataaggaactcgctgcgtacgccaaggcaggggcagttgctgaggaagccctgggtgcgatccggactgttatcgcgtttggcggccagaacaaggaactcgagcggtatcagaagcacctagaaaatgccaaggagattggaattaaaaaagctattagtgctaacatctctatgggtatcgcctttttgctgatctacgcttcctacgctctcgcgttctggtatggctctactttggtgatttccaaggagtatactataggcaacgctatgaccgtcttttttagtatcctcattggcgcgttcagcgtgggccaagcggctccttgcattgacgcatttgctaacgctaggggtgctgcatatgtcatctttgacatcattgataacaaccctaaaatcgactccttttccgagaggggtcacaagcccgatagtattaagggaaacctggaattcaacgatgtccactttagttatccatcaagagcaaacgtgaagattctaaagggcttgaatctgaaagttcagtccggtcagacagtggcattggtgggcagttctggctgcggaaagagcactacggtacagcttattcaacgtctatatgatccggacgaaggaacgattaacattgatggccaggatatccggaattttaacgtcaattacctccgcgaaataataggagtggtttcacaggagcctgtcctgttttccacgactatcgcagaaaacatctgctacggccgaggtaacgtgaccatggatgaaattaagaaagcagtaaaggaggccaacgcatatgaattcatcatgaagttgccgcaaaaattcgatactttggtaggagaaaggggcgcccagctatcaggaggtcaaaagcagcgtattgctatcgcccgggcactcgttcgaaacccaaagatcctactgttagatgaggctactagtgctcttgacacggagtcagaagcggaggttcaggccgccctggataaagctcgcgagggacgtacaaccatcgttatcgctcaccggctctctacagttcgcaatgcagatgtgattgcaggatttgaggatggagtaattgtcgaacaaggtagccattctgaactgatgaagaaggagggagtctactttaagctggttaacatgcaaacttctggatcccaaatccaaagcgaggaatttgagctgaacgatgagaaggcggcgacacggatggcacctaacggatggaagtctagacttttccggcatagcacccagaagaatttgaaaaatagccaaatgtgtcaaaagtcgttggatgtcgaaaccgacggattggaagctaacgtcccacctgtttccttcctcaaggttttgaagctcaacaaaacggaatggccgtacttcgtcgtcggaaccgtctgtgctattgccaacggcggtttgcagccggcattttcggtaatttttagtgaaatcatagcaatcttcggccctggggacgatgccgtcaagcaacagaaatgtaatatcttttcgcttatcttcttgttcctcggcattatcagctttttcacctttttcctacagggattcaccttcggaaaggcaggtgagattcttacccgacgccttcggtctatggcattcaaagcaatgctgaggcaggacatgagctggttcgacgaccacaagaattctacgggtgccctttccactcgcctcgcaacagacgctgctcaagtgcaaggggcgacaggtaccaggctcgcgcttattgctcaaaatatcgcaaatctcgggacaggcatcatcatcagctttatatacgggtggcagttgaccctcctcctgctcgccgtcgtcccaatcattgcggtttcaggaattgtagagatgaagctactggcaggtaacgcaaagcgagataagaaagaattggaagctgcgggtaaaatcgccacggaggctatcgagaatatccgcactgtggtcagtctcacacaggagcgtaagtttgagtcaatgtacgtggagaagttgtacggaccgtaccgaaatagtgtgcaaaaagctcatatttacggcattacatttagtatctcacaggcattcatgtacttttcgtatgcgggctgcttccggttcggtgcctacttgatcgtcaatgggcatatgcggttccgagatgtgatcctcgtcttcagtgccatcgtgttcggcgccgtggcccttgggcacgcgtcttcgttcgctcctgactatgctaaggctaagctgtccgcagcgcacctgttcatgctatttgagcggcagccacttattgacagctatagcgaggaaggtctcaaacctgataaatttgaaggcaacataaccttcaatgaggttgtgttcaattacccaactcgagcaaacgtaccagtcctccagggcttaagcctcgaggtcaagaagggccaaacacttgctctagttggttcgtcaggatgcggtaagtccactgtggtgcaactccttgaacgcttttacgatcctctagctggcaccgttttcgtagacttcggatttcagttgctagatggccaggaagcaaaaaaactgaatgtccaatggcttcgggcccagctgggcattgtgtcccaagagcccattctcttcgactgctctatcgcggaaaatatcgcgtatggcgacaattccagggtcgtttcgcaagatgagatcgtctccgcggccaaagcggcgaacattcacccattcattgagactttaccgcataaatacgagacccgggtgggcgacaagggaacgcagctttccggaggtcagaagcaacgcatcgctatcgcaagagcactcatccgacaacctcagatattgttacttgatgaagctacgagcgccctggatacagagtctgaaaaggtggtgcaggaagcgctggacaaggcgcgagaagggcggacctgtatcgttattgcgcacaggcttagtaccattcaaaatgccgatctgattgttgtgttccaaaatggtcgcgtcaaggagcatgggacacatcagcagttgttagcacagaaaggtatctatttctcaatggtgtccgttcaagctggaactcagaacctg

SEQ ID NO: 7506 - DNA, 3858 bp, Artificial Sequence
  Description of Artificial Sequence: Synthetic coding sequence
atggatctcgaagcagccaaaaacgggactgcctggcggcccacatccgccgagggggatttcgaattaggaatttcctctaaacaaaaaagaaaaaaaactaaaacagtcaagatgatcggagttctaactctgttcagatatagtgattggcaggacaaactatttatgtcccttggaactataatggctatagcccacgggtcaggattgcctctgatgatgattgtcttcggagaaatgacagataaattcgtggatacagccgggaacttttccttccccgtgaattttagtctctctctccttaatcccggaaaaattcttgaagaagaaatgacgcggtacgcctactactattcaggactaggggccggagtgctagtggctgcctatatccaggtcagtttctggactctcgctgccgggaggcagatacggaaaattagacagaaattctttcatgctatacttcggcaggaaatagggtggtttgatatcaacgacacaactgaactcaacactcggctcacagatgatatctcaaaaatatccgaagggataggagataaagtcggaatgtttttccaggctgtggccacattttttgccgggtttatagttggattcatccgggggtggaaactcactcttgtgattatggcaattagtcctatccttggactgagtgctgcagtgtgggctaagatcctctcggccttctccgacaaagaactagccgcttatgccaaagccggggcagtagccgaggaagcccttggggccatcaggacggtgatcgcctttggagggcagaacaaagaattagagagataccagaagcaccttgaaaatgccaaagaaataggaatcaagaaggcaatatctgccaatatctccatggggatagcattcttacttatctatgcatcttacgccctcgctttctggtatgggtctactttagtgatatcaaaagaatatacaatcggaaacgctatgactgtctttttttctatccttattggagccttttccgtcggacaagctgccccctgtatcgatgcttttgccaacgctagaggagctgcatatgtcatcttcgacattatagataataatcccaaaatagactcattcagtgaacgagggcacaagccagattcaattaaagggaatttggaattcaatgacgtacacttctcctacccttctcgggcaaacgtgaaaatcttgaaagggctcaacctgaaggtgcaatctgggcagacagtggccctagttgggtcttctggatgtgggaaatctacaactgtccagctcatacagcggctctacgatcccgatgaagggactatcaacatcgatgggcaggacatcagaaacttcaatgtgaactatcttagggagattataggagtggtgtcccaggagcctgttctattctcaactacaattgctgaaaacatatgttatggacggggaaatgtaactatggatgaaataaaaaaagccgtaaaagaagccaacgcctatgaattcatcatgaaattgccccagaaatttgatacactggtcggagaaagaggagcacagctcagtggaggacagaaacagcgcatcgcaattgcacgggccttagtgaggaatccaaaaatcctactcctcgatgaagcgacaagtgctctcgatacagaatccgaagccgaagtgcaggcagcattagataaagccagagaagggagaactactatcgttatcgctcacagactgagtacagttcgcaatgcagacgtgattgcagggttcgaagatggagtgatagtggaacagggatcacattctgaactcatgaaaaaggaaggagtatattttaaacttgtcaatatgcagacatctgggtcacagatccagagtgaagaattcgaacttaacgatgaaaaggctgccacaaggatggcaccaaacggatggaagtccaggctctttaggcattctacacagaagaatctgaagaactctcagatgtgtcagaaatctcttgacgttgaaacagatgggctcgaagcaaatgttccacctgtgagttttttgaaagtgctgaaactaaataaaacggaatggccatatttcgttgttgggacagtctgcgctatcgccaatggaggactgcagccagcgttctcagtgatcttttccgaaataatcgccattttcggaccaggggacgatgcagtgaagcagcagaaatgcaatatattttccttaatattcctgttcctgggaataatttctttttttactttttttctacaggggtttactttcgggaaagccggagaaatactgacaaggcgattgagaagtatggcttttaaagccatgcttcggcaggatatgtcatggttcgacgatcataaaaattccacaggagccctatcaactaggcttgccactgatgctgcacaggtccagggggccactggaacacggttggcactcatagctcagaatattgcaaaccttgggacaggaataataatctcttttatctatgggtggcagctcacacttctcctgctggcagtagtgcccataattgcggtttccgggatcgtggaaatgaaacttctggctgggaatgcaaagagagataaaaaagaactcgaggcagccggaaaaatagccacagaagccatagaaaatattaggactgtggtttccttgacacaggaacggaaattcgaatctatgtacgttgaaaagctctatggaccatacagaaattctgtgcagaaagcccacatatatgggatcactttttctatctcccaggcttttatgtatttctcatacgctggatgtttccggttcggagcgtacctcatagtaaatggacacatgcgatttagggatgtcattctggtcttttcagccatagtcttcggggctgttgcacttggacatgcatcatctttcgcccctgattatgcgaaggctaagctctctgctgcgcacctgttcatgcttttcgaacgacagccactaatagattcctatagtgaagaaggactcaaaccagataaatttgagggaaatatcacttttaacgaagtcgtgttcaactacccaactcgggctaacgtgcccgtactccagggactctccctggaagtaaaaaaggggcagactctggcactcgtcggatcctctggatgtggaaaatccacggttgtgcagcttctagaacgcttctatgaccctctcgcaggaacagtgtttgtcgattttgggttccagctattggatggacaggaagcaaaaaaacttaacgtccagtggctccgggctcaattaggaattgtttctcaagaacctatactgttcgactgttcaatagccgagaacattgcgtacggggataattccagggtggtctcgcaggatgaaattgtgtccgccgccaaagctgccaatatccatcccttcatcgaaacactacctcacaaatatgaaactcgggtaggagataaagggactcagctgtccggaggacagaaacagagaatcgcaatagctagggcactcatacggcagccccagatcctgctccttgatgaagccacatctgccctagatacagaaagtgaaaaagtggtccaggaagccttagataaagcacgcgagggacgcacatgtatcgtcatcgcccatcggttgagtacaatccagaatgcggacttaatcgtcgtgtttcagaatgggcgcgtgaaagaacatggaacacaccagcagttgctggcacagaagggaatctatttttctatggtctctgtccaggccgggacacagaacctt

SEQ ID NO: 7507 - DNA, 3858 bp, Artificial Sequence
  Description of Artificial Sequence: Synthetic coding sequence
atggacctggaggcggccaagaatggcaccgcatggcgaccaaccagcgctgaaggagatttcgagctgggaatctcatcgaagcaaaagcgaaagaaaaccaaaaccgtgaagatgataggcgtcctgacgctcttcagatactccgactggcaagacaagctgttcatgtcactgggcactattatggctatcgcacatggatccggtctgcctttgatgatgattgtgtttggcgaaatgactgacaagttcgtggacactgctgggaacttctcgtttccggttaacttctccctgagccttctgaacccagggaaaatcctggaagaagagatgactcgctacgcctactactactctggattgggagcgggcgtccttgttgctgcgtacattcaggtgagcttttggaccctcgctgcggggcggcaaatcaggaagataagacagaagttctttcacgctatcctccgccaggagattggctggttcgacatcaatgatactaccgagttgaatacgcggttgaccgatgatatttcaaaaatcagcgagggtatcggagataaagtggggatgttctttcaagcggtcgcaacgtttttcgctggatttatcgttgggttcatcaggggctggaagctgacccttgtgatcatggcaatctcacctatcctgggactgtcggctgccgtgtgggcgaagattttgagcgccttttcagataaggagctggccgcgtacgccaaggccggcgccgtggctgaagaagccctcggcgcgattcggacggtgatcgctttcggaggccagaataaggagctcgaaaggtaccaaaagcacctggagaacgcgaaagagattggaattaagaaggcaatatccgcgaacatctcgatgggtatcgcgttcctgctgatctacgctagctacgccctcgccttctggtacggaagcactctcgtaatcagcaaagagtacaccatcgggaatgcgatgaccgtgtttttcagcatcctcatcggtgctttttcggtgggtcaggccgcgccctgtatcgacgctttcgccaatgctcggggagcagcctacgtgatcttcgacattatcgataacaacccaaagattgactccttctcagaacgaggccacaaacccgacagcattaaaggaaacctcgagttcaatgatgtgcactttagttacccgtcccgggcgaacgttaagatcctgaagggacttaatctgaaggtccagtcggggcagaccgtggcactggtggggtcctcgggttgcggtaagagcactaccgttcaactcatccaacgcttgtacgacccagacgaggggaccatcaacatcgatggtcaagatatcagaaacttcaacgtgaattacctccgcgagatcatcggagtggtgtcccaagagccggtcctgttttcgacgactatcgctgagaacatctgctatgggagaggaaacgttaccatggatgaaatcaaaaaggcggtgaaagaagcgaatgcctatgagttcattatgaagctgccgcagaagttcgacaccctcgtgggtgaaagaggagcccagctctcgggtgggcagaagcaacggatcgccatcgcacgtgctctggtcaggaatccgaagatcctcctcctggatgaagccacctcagcgcttgacaccgaatccgaagccgaagtgcaggcagcgctcgacaaggcccgtgaaggacgcactactatcgtcatcgcacatcgactgtcaaccgtgcgaaacgccgatgtgatcgccggatttgaagatggagtgatcgtggagcaaggatcacactcggagctcatgaagaaggagggtgtgtacttcaagttggtaaacatgcagacctctgggtcacagattcaatctgaagagttcgaacttaatgacgagaaggccgcgactcgcatggccccgaacgggtggaagtccagactcttccgccatagcacccagaagaacctgaaaaacagccagatgtgccagaaatctctcgacgtcgaaaccgacggccttgaagccaacgtgcccccagtgtcctttctgaaggtgttgaaactgaacaagaccgagtggccatacttcgtggtgggtactgtctgcgcaatcgccaacggtgggctgcagccggctttctcagtgatcttttcggagatcattgccatctttggcccgggcgacgatgccgtgaagcaacaaaaatgtaacatcttttcgctgatcttcttgttcctggggatcattagcttcttcaccttcttcctgcaaggcttcacgttcggaaaggccggggaaatccttacgcggcgtctgaggtcgatggcatttaaggctatgctgaggcaggatatgtcatggttcgacgaccacaaaaactccactggggccctgtccaccagattggcaacggacgccgcccaagtccagggagccactgggacgagactcgcgttgattgcgcagaacatcgccaacctcggtaccggtattatcattagttttatctacggatggcagctgactctcttgctgctcgccgtcgtgccaatcatagccgtctcgggaatcgtcgagatgaagctgctggctgggaatgccaaacgcgacaagaaagaactcgaagctgctggtaaaatcgcgactgaagcgatcgagaacatccggactgtggtcagccttacccaagaacggaagtttgaatcgatgtatgtggagaagctgtacggaccctacagaaattcggtgcagaaggctcacatctacggaatcactttctccattagccaagcgttcatgtacttcagctacgccggatgtttccgcttcggagcctatctgatcgtcaacggccatatgcgcttccgggacgtgatcttggtgttcagcgccattgtctttggcgcagtcgctttgggacacgcgtcctccttcgctcctgactacgcaaaagctaaactgagcgcagcgcacctcttcatgctctttgagagacagccactgattgactcatactcggaggagggcctgaagcctgataagttcgagggcaacatcacctttaacgaggttgtgttcaactacccaaccagagcgaacgtgcctgtgttgcaggggctgtcactcgaagtcaagaagggacagactctcgccctggtgggcagctcgggctgtggcaagtcgaccgtggtccagctgctcgaacgcttttacgatccgctggccggaactgtgttcgtcgatttcggatttcaactcctggacggccaggaggcgaaaaagctcaatgtgcagtggctgagggcccagctgggaatcgtgtcgcaggaaccgattcttttcgactgttccatcgccgagaacatcgcctacggcgacaatagccgcgtcgtgtcacaagatgaaatcgtgtccgcagccaaggctgccaacatccatccgttcattgaaactctccctcacaaatacgaaactagggtcggtgataagggcactcaactctccggtggacagaaacaacgaatcgctatcgctagagcgctgatccgccaacctcagatcctgttgctcgatgaagcgacttccgccctggatactgagtcagagaaggtggtgcaggaggccctggacaaagcccgcgaagggcggacctgcatcgtgatcgcgcaccgcttgtccaccatccagaatgcggatctgattgtcgtgtttcagaacggacgggtgaaggagcatggaacccatcagcagctccttgcccagaagggaatttacttctccatggtgtccgtgcaggccggaacgcagaacctc

SEQ ID NO: 7508 - DNA, 3858 bp, Artificial Sequence
  Description of Artificial Sequence: Synthetic coding sequence
atggacctggaagctgcaaaaaacggaactgcctggaggcctacctcggcagagggtgacttcgaactgggcatctcctctaaacagaagcgaaagaagaccaagacggtcaagatgatcggggtcctaactctgtttcggtacagtgactggcaggacaaattatttatgtccctcggcactataatggccatcgcccatggatcgggcttgcctttgatgatgattgtctttggcgagatgacggataagttcgtagatacagctggcaattttagtttccccgtcaacttctctttgtcattgctcaaccccgggaagatattggaggaagaaatgacccgctatgcgtattattatagtggccttggcgcaggagtgctggttgcagcctacattcaggtcagtttctggaccttggccgccggccgccagatacggaagattagacaaaagttctttcatgctattctgcggcaggagattggctggtttgacattaatgataccactgagctcaacacccgtctgactgacgacatcagcaagatctcagaggggataggggataaagtaggcatgtttttccaggccgtggccacattttttgctgggttcatcgtggggtttatcagaggatggaaactgaccctagttatcatggcgatttcacctatattggggctttctgcagcagtctgggctaagatactgtccgccttcagtgataaggagcttgcagcttatgcgaaggcaggggccgtcgccgaagaggccctgggggctatacggacagtgatcgccttcggcggacagaacaaagaattagaaagatatcagaaacacctggagaatgctaaggaaattggaattaagaaggctatctctgccaacatctcgatgggcatcgcattcttgctgatatatgctagctatgccctggccttctggtacggcagcacccttgttatctctaaagagtacacaatcgggaatgctatgaccgtcttttttagtatattaattggtgctttttcggtcggtcaggctgctccatgtattgacgcatttgccaatgctcggggggcggcttacgtcattttcgatatcattgacaataaccccaaaattgacagctttagcgaaagggggcataagccagatagcattaaaggcaacctggaattcaacgatgtgcacttctcttatccttctagggcaaatgtgaagatactcaaaggcctgaacctgaaggtccaatccggccagaccgtagctctagttggaagctccgggtgcggaaaatctacaaccgtccagctcatccaacgtctttacgacccagacgagggaaccataaacatcgatggccaggacattagaaactttaatgttaattatctgcgggagatcataggggtggtgtcccaggagccggttctttttagcaccaccatagcagagaacatctgttatggaagagggaacgtgacaatggatgagattaagaaggccgtgaaggaagccaatgcatatgagttcatcatgaagttacctcagaaattcgacaccctggttggcgagcggggcgcacagttaagcggagggcagaagcagaggatcgccattgctcgtgctctggtgcgtaacccaaagatactgctcctggatgaggctacaagcgcactagacacggagtccgaagcggaggtgcaggcagctttggataaggcgcgcgaagggcggacaacaatcgtaattgctcatcgactttcaactgtcagaaacgcagacgtcatcgctggctttgaggatggcgtaatcgtggagcaaggcagccattctgaactcatgaaaaaagagggggtgtattttaagctggttaatatgcagacctcagggtcccagattcaaagcgaggaattcgagttgaacgatgagaaggcggcaaccaggatggcccccaatgggtggaagtctaggctcttccgacactctacccagaagaatctgaagaactcacagatgtgtcagaaatcgttggatgttgaaactgacgggctggaagctaatgtcccaccagtgagttttttaaaggtactgaagctgaacaaaactgaatggccctactttgtcgtgggcacagtgtgcgcaattgctaatggaggcctgcagcctgcctttagcgttattttcagtgaaattatagcaatttttggacctggcgatgacgcagtgaaacaacagaagtgcaacatcttttctctcatctttttgttcctgggcattataagcttttttaccttcttccttcagggcttcacatttggaaaggcaggtgagatcctgaccagaagactgcggtctatggccttcaaggctatgctcaggcaggacatgtcgtggttcgacgatcacaagaattccacaggtgctctctccaccagactcgccactgacgcggcccaagtgcagggcgcaacaggtaccaggctggccttgatagcccagaatattgccaatctgggaaccggaatcatcatctcctttatttacggctggcagttaaccctgctgctgctagctgtggtgcccatcattgcggtgtcaggaatagtcgagatgaagttgctcgctggtaacgcaaagcgcgataagaaggagctcgaggcagccgggaagatcgccactgaagccatcgaaaatatacgcactgtagtctccctgacccaggaaagaaagttcgagagcatgtacgtggagaagctctacggtccctaccggaattcagtccagaaagctcacatctatggtattacattctctatttcccaagctttcatgtatttttcttatgctggatgtttcagattcggcgcctaccttatcgtcaatggacacatgagattcagggacgtgattctggtgttttcggcgatagtgtttggagctgtagctctcgggcacgcgtcatccttcgccccggattatgctaaagccaaactgagcgcagcccacctttttatgctctttgagcgacagcctctgattgattcttactctgaagaaggactaaagcctgataaattcgagggaaacattacattcaacgaggtcgtatttaattaccccacacgcgccaatgtgccagtgctacaaggtctatctctggaagtgaagaagggccagactctggccctggtaggctcgtctgggtgtggtaaatctaccgttgtccagctgctggagaggttttacgatccgctcgcaggcaccgtgttcgttgatttcgggttccagctccttgatggtcaggaggctaaaaagcttaacgtgcagtggctaagggcccaactcggaattgtgtcccaggagccaatcttgttcgattgctctatagccgaaaacatagcctatggagacaatagtcgcgtagtatctcaagatgagattgtcagcgccgccaaggccgctaatatacacccatttatcgagacccttccccacaaatacgagacccgggtgggggacaaggggactcaactgtccggggggcaaaagcagcgtatcgcaattgcccgcgctttgataagacagccccagatcctcctgctcgacgaggctacatctgccctggataccgagtccgagaaagttgtccaggaagccctggacaaagccagggagggcagaacttgtatcgttatcgcccatagattgagcaccatacagaatgctgacctgattgtggtgtttcaaaatgggagagtgaaggagcacgggacgcaccagcagctgctagcccagaagggaatttattttagtatggtatcggtccaggctggaacacagaatctg

SEQ ID NO: 7509 - DNA, 3858 bp, Artificial Sequence
  Description of Artificial Sequence: Synthetic coding sequence
atggacctcgaagcagccaagaatggaaccgcatggcggcccactagcgcggaaggtgacttcgaactgggtatctccagcaagcaaaagagaaaaaagaccaaaactgtgaagatgatcggagtgcttactctttttaggtactcggattggcaagataaacttttcatgtcacttggcaccattatggcgatcgcccacggctcagggctgcccctcatgatgatagtttttggagaaatgaccgataagtttgtcgataccgcaggaaacttttcatttcctgttaacttttccctgagcctcttgaacccgggcaagatactggaggaagagatgacccgatacgcgtactactactctggacttggcgcaggagtgcttgtggcggcctacattcaagtgtcgttttggacgttggctgcaggacgacagatcagaaaaatcaggcagaagttctttcatgcgatcctgagacaggaaattggatggtttgacattaacgatactactgagcttaacacccgactcaccgatgatatctcgaagatctcggaaggaattggagataaggtgggaatgtttttccaagcagtcgccacctttttcgcaggctttattgtgggctttatacgcggctggaagctgactctggtgattatggcaatttcgcctatcctgggccttagcgccgccgtctgggcgaagattcttagcgcgttcagcgataaagaactggcagcatacgctaaggcaggagccgtcgcagaagaggccctcggtgcaattaggactgtgattgcatttggagggcaaaacaaggaacttgaaagataccagaagcatctcgaaaacgccaaggaaatcggtatcaaaaaggcaatctcagcaaacatttccatggggatagcttttctgctgatatacgcatcctacgcgctggcgttttggtacggttcaacccttgtgatctcgaaagaatacacgattggcaatgcgatgactgtgtttttctcgattcttattggagcattcagcgtcggtcaggccgcaccttgtatcgatgcatttgccaacgcgcggggagctgcctacgtcatttttgacatcattgacaacaatccgaagattgattcgttttcggaacgtggacataagccggatagcatcaagggtaatctcgaattcaatgatgtccattttagctacccttccagagcaaacgtcaagatccttaaaggcctgaatctgaaagtgcagtcgggacagaccgtggccctggtcggttcgagcggatgcggtaaaagcactactgtgcagctcatccaacggctctacgatcctgatgagggaaccataaacattgatggccaagatatcagaaacttcaacgtgaattaccttagggaaatcattggagtggtgtctcaggagcccgtgctcttctccactactatcgcggagaacatttgttacggaagaggaaatgtgacgatggacgagattaagaaagccgtcaaagaagccaatgcatacgagttcattatgaaacttcctcagaaatttgatactcttgtgggggagagaggggcccagctttcggggggacagaaacagcgcattgccatcgcccgggcacttgttcgaaatccaaagattcttctgcttgatgaagcgaccagcgcattggacactgaatcagaagctgaagtgcaggctgcactcgataaggcacgtgagggaagaaccactatcgtaatcgcccatcggcttagcactgtccgcaacgctgatgtgattgcgggatttgaggatggtgtcattgtcgaacaaggttcacattccgagttgatgaagaaggaaggggtgtatttcaagttggtcaacatgcaaacgtcaggctcacaaattcaatccgaagagtttgaactcaacgatgagaaggcagcgacgcggatggccccaaatggatggaaatcgagactgtttaggcattccactcagaagaaccttaagaacagccaaatgtgtcagaagtcccttgacgtcgagactgatgggctggaagcaaacgtcccccctgtgtctttccttaaggtgctgaaactgaacaagaccgaatggccctactttgtggtggggaccgtgtgtgcaattgcaaacggagggctccaacctgccttttcggtgatattctcagaaatcatagccatctttgggcctggggatgatgcggtcaaacagcagaagtgcaacatattctcgctgattttcctttttcttggtataatctcgttctttacgttttttctgcagggatttacctttggcaaagcaggagaaatactgactaggcgactgcgttccatggcattcaaggccatgctccgacaagatatgtcctggtttgacgaccataagaacagcactggcgctctttcgaccaggctggccactgatgcagcacaggtgcaaggagcaactggtactcgcctcgcccttattgctcagaacatcgccaatctcggcactgggattatcatatccttcatttacggttggcaacttacgcttctgctgcttgcggtggtgccaattatcgccgtctccggaatcgtcgagatgaaacttctggcaggtaatgcaaagcgggataagaaggagcttgaggcagcaggaaaaatcgccactgaagcaatcgagaacatccggaccgtggtgagccttacccaggagcgaaagtttgagtcaatgtacgtggagaagttgtacgggccgtacaggaatagcgtgcagaaggctcatatctacggcattaccttttccatcagccaggcctttatgtacttttcgtacgcaggatgtttccgtttcggagcatatctgattgtaaacggacatatgcgtttcagggatgtgatccttgtcttttccgcaatagtgtttggtgcagtcgcccttgggcacgcaagctcatttgcacctgattacgcaaaggcaaagctgtccgcagcacacctgtttatgctgttcgaaagacaaccgctgatagatagctacagcgaggaaggacttaaacctgataagttcgaaggtaatatcacctttaacgaggtcgtgtttaactaccctacccgagcgaacgtgcctgtcctgcagggtttgagtctcgaagtcaagaaaggtcaaactctcgcattggtcgggtcctccggatgcggcaaaagcaccgtcgtgcagctgctggaaagattttacgatcctctcgctggaaccgtgtttgtggatttcggatttcagctgcttgacggtcaagaggctaaaaagctgaatgtccaatggctgcgggcacaactgggaattgtctcgcaggaaccaatactcttcgactgttcaattgcagaaaacattgcttacggagataattcccgcgtggtgtcccaggacgaaatcgtgtcagcagcaaaggccgcgaacattcatccgtttatcgaaacccttccccataagtacgagactcgagtcggggacaagggaacgcaactttccggtgggcaaaagcaacgcatcgcaattgcaagggcactgattcgacaacctcaaattcttcttcttgacgaggcaacgtcagcactggataccgaatcggaaaaggtcgtgcaggaggcactggacaaagcgcgcgaaggtcgaacttgtatagtgattgctcataggcttagcacgattcagaatgcagatctgattgtggtgttccagaatggacgggtgaaggagcatgggactcatcaacaattgctcgcccaaaagggaatttacttctcgatggtgagcgtgcaagccggaactcaaaatctc

SEQ ID NO: 7510 - DNA, 3858 bp, Artificial Sequence
  Description of Artificial Sequence: Synthetic coding sequence
atggatctcgaggcagctaaaaacggtacggcatggaggcctacctcagcagagggagattttgagcttgggatttcttcgaagcagaagcgcaagaaaaccaagactgtgaagatgattggtgtactgacactgtttaggtattcagattggcaggataaactgtttatgtctctgggcactatcatggctatcgcacatggatctggtttgcccttgatgatgatagtgtttggtgagatgaccgataagttcgtggacactgccggcaattttagttttccagtgaatttcagcctttccctgcttaatccagggaagatattagaggaggagatgacaaggtatgcgtattactactccggcctgggcgcaggcgtgctggtggctgcatacatacaggtgagcttctggaccctagcagccggtcgtcagattcgcaagattcggcagaagttcttccatgccattctgcggcaggagatcgggtggttcgatattaatgacactactgagctgaatacacgcctgaccgacgatatcagcaagatttcagaggggattggagataaggtcgggatgttcttccaggcagtggccaccttcttcgccgggttcatcgttgggtttatccgcgggtggaaactgacccttgtcattatggccatctcacccattctgggactgagtgcggccgtgtgggccaagatcctgtccgcattttctgacaaagagctggcagcttacgcgaaggccggcgcggtagcggaagaggcgttaggggctatacggacggttatcgctttcggggggcaaaataaggaactggagagataccagaagcacctggaaaatgccaaggagattgggatcaagaaggccatctccgccaacatcagcatgggaatcgctttcctgttgatctatgcaagctacgctctcgctttctggtatggctctactttggtaatctcaaaagagtatacgattgggaacgccatgaccgtgttttttagcattctgataggggctttttccgtcgggcaggctgccccatgtatcgacgccttcgctaacgctcggggcgctgcatacgtgatattcgatatcatcgacaataacccaaagattgattctttcagcgagagggggcacaagcctgactccattaaagggaatctcgagttcaacgatgttcacttcagttacccatctcgggcgaatgtgaagatcctcaagggcttaaacctgaaggttcagtcgggccaaaccgtggcgcttgtaggatcttccggctgtggcaaatctactaccgttcagttgatccagaggctgtacgacccagatgaggggacgattaatatcgacggacaggacatcagaaattttaatgtgaactatttgagagaaattatcggtgtcgtgagccaggagcctgtgctgttctctactacaatcgctgaaaatatttgttacggcaggggcaatgtgacaatggacgagattaagaaagccgtgaaggaggcgaatgcgtatgagtttattatgaagttaccccagaaattcgacacgctcgtaggggaaagaggcgcgcagctaagtggggggcagaagcaaaggatagccatagcgagagctctagtcaggaaccctaagatcctgttgctggacgaggctacttcagccctcgatactgaatctgaggccgaggtgcaagcagcgctcgataaagcgcgggagggaaggacaacgattgttatagcccaccggctgtcaacagtccgcaacgctgacgttatcgctggatttgaagacggggtcattgtcgagcagggcagccacagtgagctgatgaagaaggagggcgtctactttaaactggttaatatgcagacctccggcagccagatacagtctgaagaattcgaacttaatgatgagaaggcagctactagaatggcgccaaatggttggaaatctcgactgttcagacactcgacacagaaaaatctgaagaactcgcagatgtgtcagaagtcgctggatgtggaaactgacgggctcgaggccaacgtgccacccgttagcttcctgaaggtgctgaagttgaataagactgagtggccatactttgtggttggtaccgtgtgtgctatcgccaatggtggcctgcagcccgccttttcggttattttcagtgagattatcgcaatttttggcccaggcgatgacgctgtcaaacagcagaagtgtaacatctttagcctgatattcttgttcctggggatcatctctttcttcactttctttctccaagggttcacattcggaaaagccggggaaatactcacaagaagattgcgatcaatggcatttaaggctatgcttcgtcaggacatgtcttggttcgacgatcacaagaactccaccggggctcttagtactcggctcgcgaccgatgcagctcaggttcagggagcaaccggaactaggctggcccttattgctcaaaacatcgccaatctgggtacggggattatcatttcctttatctatgggtggcagctgacgctgctcctgctcgccgtggttccaatcatcgccgtcagtgggatagtagagatgaagctactggctggcaacgccaagagagataaaaaggagttggaagcagcaggcaaaatcgccactgaggctattgagaatatccggactgtcgtctcattaacacaggagagaaagttcgagagcatgtatgtggagaagctgtatggtccgtatcgcaactccgtccagaaagcgcatatctatggcataacatttagcatcagccaagctttcatgtacttcagctacgccggatgcttccggttcggagcttatctcatcgtcaacgggcacatgcgcttcagggacgtgattctggtgttttcagccattgtgttcggggcagtggccctgggtcatgccagctctttcgcaccagattacgctaaggccaagctctcagcagctcacctgttcatgctatttgagcggcagcccctcattgactcatatagtgaggaagggctgaaaccggacaagtttgagggcaacatcacattcaatgaggtggttttcaattaccccactcgtgcaaacgtcccggtactgcaaggccttagccttgaggtgaagaaaggacagactcttgcgctggtgggttcctctggttgcggcaagtccaccgtcgtgcagctcctggagcgattctacgaccctctagcagggactgtgtttgtggacttcggatttcagctgcttgacggtcaggaggcaaagaagttgaatgtccagtggttgagggcccagcttggcattgtctcgcaagaacccatcttatttgattgcagtattgctgaaaacattgcctatggtgacaactcccgtgttgtaagtcaggatgagatcgtgagtgccgccaaggcggctaacatacatcctttcatcgagactctgccgcataagtatgaaacacgcgtgggagataaaggcacccagctatccggggggcagaagcagaggatcgccatagcgcgtgcattgatccgccagccacagattctgcttctggacgaggcaacctctgcgctcgatactgaatccgagaaagtcgtccaggaggccctggacaaggctagagaaggtcgaacatgcattgtgatcgcgcaccggctcagcacaatccagaatgctgatctcatcgtggtcttccagaacggcagggtgaaagaacatggaacccatcagcaactcctagcccaaaagggaatatatttttcaatggtgagcgtacaagcaggaacacagaatctg

SEQ ID NO: 7511 - DNA, 3858 bp, Artificial Sequence
  Description of Artificial Sequence: Synthetic coding sequence
atggaccttgaagccgcaaagaacggtaccgcttggcgtccgacgtcggccgaaggcgattttgaactgggaatttcatccaagcaaaaacgcaagaaaaccaagaccgtcaagatgatcggagtgctcaccctttttagatactcagattggcaagacaagctcttcatgtccctgggaaccatcatggccatcgcacatggtagcggtctgccactgatgatgatcgtgtttggagagatgaccgataagttcgtggataccgccggtaacttttcctttccggtgaatttctccctgtcgttgcttaatccgggaaagatcctggaagaggagatgacgaggtacgcctactactactcaggcctcggtgcaggcgtcctggtggcagcttatatccaagtgtccttctggactctggccgcgggaaggcaaatccggaagatccgacagaagtttttccatgccatcctgcggcaggagatcggttggttcgatatcaacgacactaccgaactgaatacccggctcaccgacgatatctcgaagatctcagagggtattggggacaaagttggaatgttcttccaggccgtcgccactttcttcgctggatttatcgtgggattcatacgcggatggaagctgaccctcgtgatcatggcgattagcccgatcctgggactgagcgccgcggtgtgggccaaaatcctgagcgcgttctcggataaggaactggccgcctacgcgaaagcaggagctgttgcggaggaggccctgggcgctatcaggacggtcatcgcctttggaggccagaataaagagctggagcgataccagaagcatctggaaaatgccaaggaaatcggaatcaagaaagccatttcggccaacatttctatggggattgccttcctgctgatctacgcgtcgtacgccttggccttttggtacggttccacccttgtcatctctaaggaatacaccattggaaatgcaatgaccgtgtttttctccattctgatcggtgctttcagcgtgggacaggccgcaccgtgtatcgatgccttcgcgaacgcccgcggagcagcctacgtcatcttcgatatcatcgacaacaatcccaagatcgactcgttctccgagcgcggccacaagcccgactcaattaaggggaacctggagttcaatgatgtgcacttctcctacccaagccgggccaatgtgaaaatcttgaagggtctgaaccttaaggtccaatcaggacagaccgtggctctggtggggtcgtcgggttgcggtaagtctacgactgtccaactgattcagcggctctatgaccctgatgaaggcaccatcaacatcgacggacaagatattcggaacttcaacgttaactaccttcgggaaatcataggcgtggtgtcccaagagccggtcttgttctccactactatagctgaaaacatttgctacggccgggggaatgtcaccatggatgaaatcaaaaaggctgtgaaggaggccaatgcctacgaattcatcatgaagctgcctcaaaagtttgacactctggtcggagaaagaggagctcagctcagcggtggacaaaagcagaggattgcgatcgccagagccctggtgcgtaacccaaaaatcctgctcctggacgaagcaacctccgctctggacaccgagtcggaagccgaggtccaagccgctctcgacaaagcccgagaaggtcgcactacgattgtgatcgcccataggcttagcaccgtgagaaatgctgacgttatagccggatttgaagatggcgtcatcgtggaacagggatcccactcggagctcatgaagaaagaaggcgtctactttaaactcgtgaacatgcagacttcaggcagccagattcagtccgaagagttcgaactgaatgacgaaaaagctgctacccggatggcgcctaacgggtggaaatcgcggcttttcagacactccactcaaaagaacctcaagaatagccaaatgtgccagaagtccctggacgtcgagactgatggtttggaggcaaacgtgccgccggtgtccttcttgaaggtcctcaagctgaataagactgaatggccgtatttcgtggtaggaactgtgtgtgcgatcgccaacggaggactgcagcctgccttctcagtgatcttctcagaaatcatcgccatcttcggcccgggcgacgacgcagtgaagcagcagaaatgcaacatcttctcgctgatcttcctcttcctcggaatcatttccttcttcactttctttctgcagggattcactttcggaaaggccggggaaatcctgacccggcgcctccgctcgatggccttcaaggccatgttgcgacaggacatgagctggttcgatgaccacaagaactccaccggagcactgagcacccgcttggctactgacgctgcccaggtccagggggctactggaaccagacttgcacttatcgcacaaaacatcgctaatcttggtactggaatcatcatctcgttcatctacggatggcagctgaccttgctcctgctggcggtcgtgccgatcatcgccgtgagcggcattgtggagatgaagctgctggcaggaaatgccaagcgggataagaaagagctggaagcggcaggcaagatcgctaccgaagcgatcgagaacatccgcaccgtggtgtcacttactcaggagaggaaattcgagagcatgtacgtggagaaactctacggaccataccggaactcggtgcaaaaggcgcacatctacggcataaccttctccatcagccaagccttcatgtacttctcctacgccgggtgctttcgctttggggcgtacctgattgtcaacggccacatgaggttccgggacgtgatcctcgtcttttcggcgattgtttttggtgccgtggcgctcggccacgccagctcatttgcaccggactacgccaaggccaaattgagcgcggcacatctgttcatgctgttcgaacggcagcctctgatcgatagctactccgaagaaggactgaagccggacaagttcgagggaaacatcaccttcaacgaggtcgtgtttaactatcccaccagagctaacgtgccggtgctgcagggactctcgctggaagtgaagaaaggacagactctggcgctcgtggggtcctcgggttgcggaaagtctactgtggtgcagctgctggagcgcttctacgaccctctggcggggactgtgttcgtcgatttcggcttccagctcctggatggccaggaggctaagaagctgaacgtccaatggctgcgcgcacagctcggaatcgtgtcacaggagccgatcctgttcgactgttccatcgccgagaatatcgcgtatggggacaacagccgcgttgtctcacaagacgaaatcgtctcggccgccaaggcagctaatatccacccattcattgagactttgccgcacaaatatgagacgagagtgggagacaagggaacgcagctgtcagggggacagaagcagcggatcgccatcgctagagctctgatccggcagccacaaatactgctgctcgacgaagcaacttccgccctggatactgaatcagagaaggtggtgcaggaagctctggataaggcgcgcgaaggacgcacttgtatcgtcatcgcgcacaggttgtcgaccatccagaatgctgacctcatcgtggtattccagaacggaagagtgaaggaacacggcactcaccaacagcttctcgcgcaaaagggaatctacttctcaatggtatcagtgcaggctggaacccagaatctc

SEQ ID NO: 7512 - DNA, 3858 bp, Artificial Sequence
  Description of Artificial Sequence: Synthetic coding sequence
atggaccttgaagcagctaaaaatggaaccgcttggagacctacttctgctgaaggagattttgaattaggtattagttcaaaacaaaaaagaaagaaaacaaagactgttaaaatgatcggagtacttacattatttcgttattcggattggcaagataagttattcatgtcattagggacaataatggctattgcacatggaagtggattaccattgatgatgattgtttttggagaaatgactgataaatttgtagatacagctggaaatttctctttcccagtaaatttctctttatcattattaaatccaggaaaaattttagaagaagaaatgacaagatatgcttactattactcagggttaggtgctggggtcctagttgctgcttacatacaagttagtttctggactcttgctgctggaagacaaattagaaaaatcagacaaaaattttttcatgctatacttcgacaagaaattggatggtttgacattaatgatactactgaacttaatacaagattaacagatgatattagtaaaatttcagaagggattggtgataaagtaggtatgttttttcaagcagtagctacattttttgctggatttattgttggatttataagaggatggaaacttacacttgttatcatggcaatttctcctattcttggactttcggctgctgtttgggcaaagatcttatctgcatttagtgataaggagttagctgcttatgctaaagcaggagcagtcgcagaagaggctcttggagctattcgtacagttattgcttttggaggacaaaataaggaattagaaagataccaaaaacacttagaaaatgcaaaagaaattggaattaaaaaagcaatttctgctaatatatcaatgggaattgcttttttattaatttatgcatcatatgctcttgctttctggtatggatctacactagtaatttcaaaagaatatactataggaaatgcaatgactgtattttttagtattttaattggagcattttcagttggacaagctgcaccatgtattgatgcttttgcaaatgctagaggagctgcatacgtgatttttgatattattgacaataatccaaaaattgattctttttcagagagaggtcataagccagatagtattaaaggaaatttggaattcaatgatgttcatttttcatatccaagtcgagcaaatgtaaagattttaaaaggattaaatttaaaggtccaatctggacaaacagtagctttagttggaagttctggatgtgggaaatccacgacagtccaacttattcaaaggttatacgatccagacgaaggtacaataaatattgacggacaagatattcgtaatttcaatgttaattatttaagagaaattattggagttgtatctcaagaaccagttcttttttcaacaacaattgctgaaaatatttgttatggaagaggaaatgtgacaatggatgaaattaaaaaagcagtcaaagaagctaatgcttatgaattcattatgaaacttcctcaaaaattcgacactcttgttggagaaagaggagcacaactttctggtggtcaaaaacaaagaattgctattgctcgtgcacttgttagaaatccaaagattcttttgttggatgaagcaacttcagcacttgatactgaatcagaagctgaagtacaagcagcattagataaagcaagagaaggtcgtacaacaattgttattgcacatcgactttcaacagttagaaatgcagacgttattgcaggtttcgaagatggagtgattgttgaacaaggatctcattcagaattaatgaagaaagaaggtgtttattttaaacttgttaatatgcaaacttcaggatcacaaattcaatcagaagaatttgaattgaacgatgaaaaagctgcaaccagaatggctccaaatgggtggaagtcaaggctttttagacattcaactcaaaaaaatcttaaaaacagtcaaatgtgtcagaaatctttagatgttgaaactgatggtttagaggctaatgttccaccagtttcatttttgaaagtacttaaattaaataaaacagaatggccatactttgttgttggtactgtttgcgctatagctaatggaggactccaaccagcattcagtgtcattttttcagaaataatcgcaatatttggtcctggtgatgatgctgttaaacaacaaaaatgtaatattttcagtcttatttttttatttttgggaataatttcattttttactttttttttacagggattcacatttggaaaagcaggagaaattcttacaagaagacttcgttcaatggcttttaaagcaatgttaaggcaagatatgagttggttcgatgatcataaaaatagtacaggagctcttagtactagacttgcaacagatgcagctcaagtacaaggtgcaacgggaacaagacttgctttaattgctcaaaatatagctaatcttggtacaggaattattatttcttttatatatggatggcaattaactttattactattggctgttgttccaatcatagctgtttctggaattgttgaaatgaaattactagctggaaatgcaaaaagagataaaaaagaattagaagcagcaggtaaaattgcaactgaagcaattgagaatattagaactgttgtttcacttactcaagaaagaaaatttgaatctatgtatgtagaaaaactttatggaccatatcgtaatagtgtccaaaaggcacatatctatgggattacattttcaattagtcaagcttttatgtatttttcatatgcaggatgttttaggtttggagcttatctaattgttaatggacatatgagatttagagatgtaattcttgttttttcagccattgtttttggagctgttgcattaggacatgcatcatcatttgcaccagattatgctaaagcaaaattatctgctgctcatttatttatgttatttgaaagacaacctttaattgatagttatagtgaagaaggattaaaaccagataaatttgaagggaatattactttcaatgaagtagtatttaattatcctactagagctaatgtgccagttttacaaggacttagtcttgaagtaaaaaaaggtcaaacattagcacttgtaggatcaagtggttgtggaaaaagtactgttgttcaattacttgaaagattttatgatccattagctggaaccgtatttgtagattttggatttcaactcttagatggacaggaagcaaaaaaattaaacgtacaatggttaagagctcaattaggtattgtaagtcaagaaccaatattattcgattgttcgattgcagaaaacatagcatatggagataatagtagggttgtttctcaagatgaaattgtttcagcagcaaaggcagctaatattcatccatttatagaaactttaccacataaatatgaaacaagagttggagacaaaggaactcagctatcaggaggtcaaaagcaacgaatagcaattgctagagcattaattagacaacctcaaattcttttattagacgaagctacaagtgcacttgatactgaatctgaaaaagtagtacaagaagcattagataaagctagagaaggaagaacttgtatagttatcgctcataggctttctacaatacaaaatgcagatcttattgttgtttttcaaaatggtagagtaaaagaacatggaactcatcagcaattacttgcacaaaaaggaatttattttagtatggtttctgttcaagctggaactcaaaattta

SEQ ID NO: 7513 - DNA, 3858 bp, Artificial Sequence
  Description of Artificial Sequence: Synthetic coding sequence
atggacctggaagccgctaagaatggaacagcgtggcgacccacgtccgctgagggcgattttgaactggggatatcatccaagcagaaacgtaagaaaaccaaaactgtcaagatgattggcgtgctgactttattccgctactccgattggcaggacaaactcttcatgtctctaggtaccatcatggcaatcgcccacgggtcaggacttccactgatgatgatcgtgtttggtgaaatgaccgacaagtttgtggataccgccgggaacttctcttttcctgtgaatttctcactctcacttctgaatcctgggaaaatactagaagaggaaatgacacgctacgcatattattactccggactcggagcaggagtgctggtggcagcttatattcaggtatctttctggacattggcagctggtcgacagattaggaagattcggcaaaagttctttcatgccatcctgagacaagagatcggttggtttgacattaacgacactactgaacttaacacaagacttactgacgatatttcgaagatcagtgagggcatcggtgataaagttgggatgttctttcaggcagtggcgacgttcttcgccggatttatagttggatttatccgagggtggaaattaactcttgttataatggccatatcaccgatacttggactgagcgccgcagtttgggccaagatccttagcgcctttagtgacaaggaactggcggcctacgctaaagccggggcggttgcggaagaagctttgggcgccatcagaactgtcattgcattcgggggccaaaataaagaactggaaaggtatcagaaacacttggaaaatgccaaagagataggcatcaaaaaggccatctctgctaacatctccatgggcatcgcatttctcctgatttatgcatcatatgccctggccttttggtacggttcaacgttagtgatctccaaggaatatacaattggaaacgcaatgaccgttttctttagtatcctcatcggagccttttcagtgggccaggcagcaccctgtatagacgccttcgccaatgctagaggggcagcatacgtgatcttcgacatcatagataacaatccgaagatcgattcattctctgagcgcggccataagccagatagtatcaagggcaacttagagttcaacgatgtgcattttagttatcctagccgggctaacgtaaaaatattaaaaggcctgaacctgaaagtgcagtccgggcagacagtggctcttgtaggcagctcagggtgcggaaagtcgacaaccgtgcaactcatccagcggttatatgacccagacgaaggcaccataaacatcgacggtcaggatattaggaatttcaacgtgaactatttgagagaaattatcggggtggttagccaggagcctgtgcttttcagcactacgatcgctgagaacatttgctacggtcgaggcaatgttaccatggatgaaatcaagaaggctgttaaagaagccaacgcctatgaattcatcatgaaactgccacagaaatttgacactttggtcggggagcgcggtgcgcagctgagcgggggacagaagcagagaatcgccattgcgcgggctctggtgagaaatcccaagatccttttactggatgaggccactagtgcccttgataccgaaagtgaagctgaagtgcaagccgcgttggacaaggcacgggaggggcggaccactatcgttattgctcacaggcttagcaccgtgcgtaatgcagatgtgatagcgggatttgaagacggcgtcatcgttgagcaaggaagtcattccgaattaatgaaaaaagaaggggtgtactttaaactggtgaatatgcagacatccgggtcacaaattcagtccgaggaatttgagctgaacgacgagaaagctgctactagaatggcaccaaatgggtggaagagccgcttgttccgccactctactcagaaaaacttgaaaaactcccagatgtgtcagaagagcttggacgtcgagacagatggcctcgaggcaaacgtgcctccggtctcctttcttaaagttctgaagctgaacaagaccgagtggccctattttgtggtgggaactgtgtgcgcgatagccaacgggggtttgcagccagcctttagcgtaatcttctccgaaatcatcgctatattcggccctggtgacgacgcagtgaagcagcaaaagtgcaacatcttctcccttatttttctgttcttgggcattattagtttcttcacgtttttcctgcaggggtttacattcggcaaggccggcgagattctgacgcggagactgcgctccatggcgttcaaggctatgctgagacaggacatgtcctggtttgatgaccacaagaattctacaggcgcattgagcaccagacttgccactgacgctgcacaggtgcagggcgctactggaacccgcctcgcactaatcgctcagaacatcgctaaccttgggaccgggataatcatttcattcatttatggctggcagttgaccctcctgctcttggccgtcgtgcctatcatcgccgtctctggaatagtcgagatgaagctgttagctggcaacgcaaaacgagataaaaaggagctggaggccgccggtaagattgctaccgaagcgatcgagaatattaggaccgtcgtgtctctgacgcaagaaaggaaattcgaaagcatgtacgtagagaaattgtatggtccctatcgcaactcagtccagaaggctcatatttatggtattaccttcagcatatcacaggcgttcatgtatttcagctacgctggatgctttagatttggagcctatctgatcgtgaacgggcatatgcgattccgagatgtgatcctggtttttagcgcaattgtctttggggcagtggccctgggacacgctagctccttcgcacctgattacgcaaaggctaagctgagcgcggcccatctctttatgttgttcgaacgtcagccgctcattgacagctacagcgaggaggggctcaagccggacaaatttgaggggaatataacctttaacgaggtcgtgtttaattaccccacaagggcgaatgtgcccgtgctgcaaggcttgtctctggaggtgaagaaggggcagacactggctctagtgggaagtagtggctgtggcaagagcacagtggttcagctattagagcggttttatgatcctctggccggcaccgtgtttgtggatttcgggtttcaactgctcgatggacaggaagccaagaagcttaatgtgcagtggctccgggcgcagctaggaattgtttctcaggagccaatactgttcgattgttctatagccgagaacatcgcttacggcgataattctagggtggtgtcccaggacgagatcgtttccgcagccaaagctgccaacatccatcctttcatcgagaccttgccccataaatatgagacacgcgtcggcgacaaagggacacagctgtcaggggggcagaaacaacgaattgctattgcccgggccctgatccggcaacctcagatcctgttgctagacgaggccacatcagctctcgatacggagtctgagaaagtggtacaggaggccctggacaaagctcgcgagggccggacctgtatagtcatagcccataggttgtctaccatccaaaacgcagatttgattgtcgtgttccaaaatggccgggttaaagagcacggcacacaccagcagctgcttgcccagaaaggaatctatttttccatggtttccgtacaggcaggaactcagaacctt

SEQ ID NO: 7514 - DNA, 3858 bp, Artificial Sequence
  Description of Artificial Sequence: Synthetic coding sequence
atggatcttgaggctgccaagaacggaaccgcttggcgcccgactagcgctgagggagacttcgagcttggaatctctagcaagcagaagcggaagaaaactaagactgttaagatgattggcgtcctcactctctttcgctatagtgactggcaggacaagctgttcatgtcgctggggacaataatggccattgcccatggttctggtctgcccctcatgatgattgtcttcggagagatgaccgataagtttgtggacactgccggcaactttagtttccccgtgaatttcagcctttctcttctgaatccaggaaaaatcttagaagaggagatgaccaggtatgcctactattattccgggctgggcgccggtgtcttagtagccgcttatatccaggtgagtttttggactttagccgccggcaggcagatcaggaaaatccggcaaaagttcttccacgccatactgagacaagagattggatggtttgatataaacgatacaactgagctcaatacacgcctgaccgatgatatcagcaaaatatccgaaggaattggggacaaggtaggtatgtttttccaggctgtggctaccttttttgccgggttcatagtgggcttcatcaggggctggaagttgacacttgtcatcatggccatcagtcccattctgggcctctcagcggcggtgtgggccaagatcctatcagccttcagcgacaaggagcttgctgcatatgccaaggctggcgcagtagcagaggaagcgctcggggcaattagaaccgttatcgcattcggcggacagaataaagaactcgaacgataccagaaacacctggaaaatgctaaagaaatcggcatcaaaaaggcaataagtgcaaacattagcatggggatcgcctttttgttaatttatgccagctacgccctggccttctggtacggctcaaccctggtcattagcaaagagtacacgatcggcaacgctatgacagtgttctttagcatcttaatcggtgcgttttccgtcggtcaagcggccccttgcattgacgctttcgccaatgcacgtggagcagcatacgttatcttcgatatcatagacaacaaccctaagattgattccttttctgagaggggacacaaacctgattccatcaagggcaatctcgagtttaatgacgtgcacttctcctaccctagcagggccaatgtgaagattctgaagggattaaacctgaaggtgcagagtgggcagacagtggcccttgtaggctcaagtggttgtggtaaatcgaccacagtccagctgattcaacgtctgtacgacccggatgaagggacaattaacattgacggccaggatattaggaacttcaacgtgaactacctccgtgaaatcattggcgttgtgtctcaggagcctgtcctgttcagtacaaccatcgcagaaaacatttgctacggcagaggcaacgtcactatggacgaaattaagaaagccgtgaaagaggcaaatgcatacgaattcattatgaagctgccacagaaattcgacacactggtgggtgagaggggcgcccagctgtccgggggccaaaaacagcgcattgcgatcgcgagggcactcgtccggaatcctaaaatcttattgttagacgaagcgacatcagccctggacactgaatcagaggccgaggtccaggcagcgctcgataaggcaagagagggccgcaccacgattgtgatagctcaccgcttaagtaccgtccgaaacgctgatgtgatcgcgggctttgaggacggggttatcgtggaacagggaagccattctgaactgatgaaaaaagagggggtctattttaaactagtgaatatgcaaactagtggatcgcagatacagtcggaggagttcgaactgaacgacgagaaagccgctacacgcatggcgcctaatgggtggaagtcacgcctgttccgtcactcaacccaaaagaacttgaagaatagccagatgtgccaaaaaagcttggatgtggagaccgatgggttggaggcaaatgtccctccggtgtctttcctgaaggtgctgaaacttaacaaaacagagtggccctacttcgtggtaggcaccgtatgcgccatcgcaaatggagggctccagcctgcgttctccgtgatcttttcagaaattatcgcaatctttggacccggggatgacgcagttaagcagcagaagtgcaacatattcagcctcatcttcctcttcctcggcatcatttcattcttcaccttcttcttgcaggggtttacttttggcaaggcaggagagattctgacccgacgcttacgcagcatggcgttcaaggccatgctgagacaagatatgtcgtggttcgacgaccataaaaacagtactggtgctctctcaactcgacttgccaccgacgctgcacaggtgcaaggtgccaccggaacgagactagccttgattgcacagaacattgcaaacctcgggactggtatcatcatcagctttatttatggatggcagttaacactgctgttgctagcagtggtgcccatcattgccgtgtccggaatcgtcgagatgaagcttctggccgggaacgctaagagggacaagaaagagcttgaggcggcaggaaagatagccacagaggcaattgagaacattaggaccgtagtttccctgacccaggaacgcaagttcgagagtatgtatgtggaaaaattgtatggcccttatcgcaattccgttcagaaagctcacatttatggcatcactttctctatttcccaggccttcatgtattttagctacgctggatgctttcgattcggcgcttacctaatcgttaacggccacatgaggttccgcgatgtgatcctggttttcagcgccatcgtgtttggagctgtcgctcttggccatgcgagttctttcgctcccgactacgctaaggctaagttgtccgccgcgcacctgtttatgctttttgaaaggcagccgctcatcgactcttattcagaagagggtctgaagccggataaatttgaaggcaacattacctttaatgaagtagtctttaactacccgacgcgagcaaatgttcccgtgctgcaaggactatctctcgaggtaaaaaagggccaaaccctggctctcgtaggtagctcagggtgcggcaagtccaccgtggttcagctccttgaacggttctatgacccgctggctggtacagtgtttgtggattttggttttcaactcctggatggccaggaggctaagaagctgaacgtgcaatggctccgcgctcagctcggcattgtgagccaagagcccatattatttgattgcagtattgcagagaatatagcctacggcgataatagcagggtggtgtcgcaggatgagatcgtgagcgctgctaaggctgcaaacatacaccccttcatcgagacactcccccacaagtatgagaccagggtaggcgataagggaacccaactgagtgggggtcagaaacagagaatcgctattgctcgggccctgatcagacagccacagattctgcttctggatgaggcgacaagtgccctggacacagagtcagagaaggtggtccaagaagcactggataaggcccgtgaggggcgaacctgtatcgtgatcgcacaccgtctttctaccatccagaacgctgatctgattgtggtatttcaaaacggccgtgttaaagaacatggcacccatcaacagttgctggcacagaagggaatttacttctctatggtgtccgttcaggcgggcacacagaacctc

SEQ ID NO: 7515 - DNA, 3858 bp, Artificial Sequence
  Description of Artificial Sequence: Synthetic coding sequence
atggaccttgaagcagccaagaacgggactgcatggcgaccgacttcggcagagggagattttgagcttggaatctcctccaagcagaagcgcaagaaaacgaaaactgtgaagatgatcggcgtgcttactctttttcgttacagcgattggcaggacaaattgtttatgtccctgggtactatcatggcaatcgcccatggttccgggctccctctgatgatgatagtgttcggggaaatgaccgacaaattcgtggatactgccggcaactttagctttcctgtgaatttctcgctcagcctgctgaacccagggaagatcctggaagaagaaatgacccgctacgcatactactactccggactcggagcaggagtgttggtcgcagcatacatccaggtgtccttctggaccctggcggcgggccgccagatcagaaagattagacagaaattctttcacgccattcttcggcaagaaattggctggtttgacataaatgatacgactgaactgaacactcgtctcaccgatgacatttcaaagatttcggaaggaatcggggacaaggtaggcatgttcttccaggccgtggcaacctttttcgctggcttcatcgtgggcttcattagaggatggaaacttaccctggtgataatggcgatttcacctattctcggcttgtcagccgcagtttgggcaaagattctttcagctttctcggataaagaactcgcagcctacgcaaaagctggggcggtggcggaggaagcacttggcgcgattagaaccgtgattgcatttggaggccagaataaggaacttgaacggtaccaaaagcatcttgaaaacgccaaggagatcggtatcaaaaaggccattagcgcaaacatctcaatgggtatcgcatttcttctgatatacgcatcatacgcccttgcattctggtacggatcaactcttgtcatttcaaaggagtacactattgggaatgcaatgaccgtgttcttttctattctgatcggtgcattttccgtgggtcaagccgcgccttgtattgatgcgtttgccaacgcacgcggtgcggcgtacgtgatctttgacattatcgataacaatcccaagattgatagcttttcagaaaggggacataagccagactcgataaagggaaacttggagtttaatgatgtgcatttctcatatccaagccgggcgaacgtgaagatactgaaaggattgaacctgaaggttcaaagtggacagacggtcgcactggtgggaagctcaggatgtggtaagtccaccaccgttcaactcatccagcgactgtacgatccggatgaagggactattaacatcgacggtcaggacatccgcaactttaatgtgaactacctgagagagataatcggagtagtgtcccaggagcccgttctctttagcaccaccatcgctgagaacatttgctacggacgaggcaacgtcactatggacgagatcaagaaggcagtgaaggaagcaaacgcatacgagttcattatgaagctcccccagaagtttgatacccttgtgggagagcggggcgctcaactttcggggggtcaaaagcaaagaattgcgattgcacgagcactcgtcagaaatcctaaaatcttgcttttggacgaagcaacttcggcacttgatactgaatcggaagccgaagttcaggccgccctggataaggcaagagaaggtcgaactaccatcgtcatcgcacacagactttcaaccgtgcgtaacgccgacgtgatcgcgggttttgaagatggagtgattgtggaacaggggtcccactcggaactcatgaagaaggagggtgtgtactttaagctggtgaatatgcaaacgtcagggtcacagattcagtcagaagaattcgaactgaacgatgagaaagcggctacgcgcatggcgccgaacggctggaagtcacgcctgtttcgtcactccacccaaaagaacctgaagaattcccagatgtgtcagaagtcgctcgatgtggaaactgatggccttgaagctaatgtgccgcccgtgtccttcctgaaagtgctcaagctcaataagactgaatggccttacttcgtggtcggcacggtctgcgcaatagccaacgggggtctgcagccagcattttcagtgatctttagcgaaatcatagccatattcgggccaggtgatgacgccgtgaagcaacaaaagtgtaacatctttagccttatctttctcttccttggcattatctccttctttactttctttcttcagggattcactttcggtaaggcaggagagattctgactaggagactcaggtcgatggcctttaaggcaatgctgcgccaagatatgtcctggtttgatgaccataagaactcgaccggggctctgagcactcggctggccaccgatgcagcgcaagtgcaaggagctactggtactcgcctggcccttattgctcagaacattgcaaacctcggaaccggaatcattatctcttttatctacggatggcagctcaccttgcttctgctggcggtcgtgccgataattgccgtgtcgggaatagtcgaaatgaaacttctcgcagggaacgcaaagagagataagaaggagctggaggcagctggaaagattgcaactgaagcaatagaaaacatccgtaccgtggtgagccttacgcaggaaagaaagtttgaatcgatgtatgttgaaaaactttatggcccttaccggaattcggtgcaaaaagctcacatctacgggatcaccttttcgatctcacaggcatttatgtactttagctacgcggggtgctttcgattcggggcctatctgatagtcaacggccatatgcgatttcgcgatgtgattctcgtgttcagcgcaatcgttttcggagcagtggcacttggacatgctagcagctttgcccctgattacgctaaggcaaagctctccgcagcacatctgtttatgctttttgaacgacaacctctgatagattcgtactcggaggaaggattgaagcctgacaaatttgaaggcaacattacttttaacgaagtggtgttcaattaccctaccagagcaaatgtgcctgttcttcagggactgtcactcgaagtgaaaaagggtcaaacgcttgctctggtgggatcttccggttgcggaaagagcacggtggtccaactcctggaaagattttacgatcctcttgctggtacggtgtttgtggacttcggatttcagcttctcgatggtcaagaagcaaagaagctgaacgtgcagtggctccgggcgcagctgggaattgtgtcacaggagcctatcctgttcgattgttcaattgcagaaaacattgcatatggtgataattcccgcgtggtgtcccaagatgagattgtgtcggcggcaaaggcagcaaacatccatccattcattgagactctgcctcataagtacgaaacgagagtcggagacaaaggtactcagcttagtggaggtcaaaaacagagaattgctattgcaagagcactcattaggcaacctcaaattcttctgctggacgaagccacctccgcgcttgatacggaatctgagaaggtggtgcaggaggcgcttgacaaagccagggagggacggacctgcatagtcattgcccatcgcctttcgaccattcaaaacgcggatcttattgtggtgttccagaatggacgcgtgaaggaacatgggacccatcaacaacttctggcacaaaagggaatttacttcagcatggtcagcgtgcaggcaggcacccaaaatctt

SEQ ID NO: 7516 - DNA, 3858 bp, Artificial Sequence
  Description of Artificial Sequence: Synthetic coding sequence
atggatctcgaggccgcaaagaatggaactgcatggaggcctacctcggctgaaggggattttgaactgggaatcagctccaagcagaagcgaaagaaaactaagaccgtgaagatgattggagtccttactctttttagatactcggattggcaggataagctctttatgtcacttggtaccattatggcaattgcccatggttcgggacttccccttatgatgatcgtgtttggtgagatgaccgataagtttgtggataccgctggcaatttctcctttccagtgaacttttcgctgtcactcctcaaccctggaaagatcctggaagaggaaatgaccagatacgcatactactactcagggcttggagccggagtgcttgtggcagcctatattcaggtgtcgttttggactctggcagcggggcgacaaatcaggaagattcggcaaaagttctttcatgcaatacttcgccaagagataggctggtttgacattaatgataccaccgaacttaacacccggcttactgatgacatttcaaagatatcagaaggtattggtgataaggtgggtatgttttttcaggcggtggcaactttctttgccggctttatcgtcgggtttattcgcggttggaaactcacgctggtgataatggctatatcgccaatccttggcctgagtgcagcggtgtgggccaagattctttcagcattttcagacaaggaactcgcagcgtacgccaaagcaggtgcggtggcagaagaggctctgggagcaatacgcaccgtgattgcatttgggggacagaacaaagagctcgaacgttaccagaagcacctggagaatgcaaaagagattggaattaagaaagcaatcagcgccaacatttccatgggaatagcgttcctgctcatttacgcttcgtacgcgcttgcattttggtacgggagcacgttggtgatttccaaggagtacactatcggtaacgccatgaccgttttcttttcaattctgatcggggcatttagcgtcgggcaggccgcaccgtgcatagatgcattcgcaaacgccaggggagcggcctacgtgatttttgacattatcgataacaatcccaagattgactccttctcggagaggggacataaaccagactccattaagggaaacttggagttcaatgacgttcatttctcgtaccctagccgcgcaaacgtgaagattcttaagggcctcaacctcaaggtgcagtccggacaaaccgtggcactggtgggatcctccggctgcggaaagagcaccactgtgcaactgatccaaagactctacgatcctgacgaaggcaccataaacatagacggacaggacatcagaaactttaatgtgaactacctccgagagataattggagtggtgtcgcaagagcctgtgcttttttcgaccactatcgcagaaaacatttgttatgggcggggaaatgtgaccatggatgaaatcaagaaagcagtgaaggaagcaaacgcctacgaattcataatgaagttgcctcagaagttcgacactctggtgggtgaacggggtgcacaattgagcgggggacaaaaacaacgcattgccatcgctagagcactcgtgagaaaccccaagatcctgttgcttgatgaagcaacttcggcactcgatactgaaagcgaggccgaggtgcaggcagcactggataaggcaagagagggacgcaccaccatcgtgatcgctcaccggcttagcaccgtgcgaaatgccgatgtgatagcaggttttgaggatggagtgattgtcgagcaaggatctcattccgagcttatgaagaaggaaggagtgtacttcaaactcgtcaacatgcaaacctcaggttctcagatccaatcagaagaattcgaacttaatgatgagaaggcggccaccagaatggcgcctaatggatggaaaagccggctctttagacactcaactcagaagaaccttaagaactcgcaaatgtgtcagaaatcgcttgatgtggaaaccgatgggttggaagcaaacgtccctcctgtttcgtttctgaaggtgctgaaactgaataagaccgagtggccatacttcgtggtgggaaccgtgtgtgcaattgcaaacgggggcttgcagcctgccttttcggtaatcttttctgaaatcattgcgatatttggccccggcgacgatgctgtgaagcagcagaaatgcaacattttctctcttatcttcctctttcttgggatcatttcatttttcactttctttcttcagggctttaccttcgggaaggcaggggaaattctcacccgtagactgcgatcaatggcattcaaagccatgcttagacaagatatgtcctggtttgacgatcacaaaaacagcaccggggcactttccacccggctcgcaaccgacgcagcacaagtccaaggggccactggaacgaggctggcactgattgcacagaatattgcaaatcttggtaccgggataatcatatcgttcatttatggatggcaactcacccttttgctcctggccgtggtgccgataattgcagtgtcaggtattgtagaaatgaaactgctggcgggtaacgccaagcgcgataagaaggagttggaggcagctggcaagatcgccactgaagctattgaaaacatccgtaccgtcgtgtccctgactcaggaacgaaagtttgaaagcatgtacgtggaaaaactttacggaccgtaccgaaattcagtgcagaaagcccacatctatggaattactttttccatttcgcaagcctttatgtacttttcgtacgctggctgctttagatttggcgcatacctcatcgttaacggccacatgcggttccgcgacgtgattcttgtgtttagcgcaatcgtctttggagccgtcgcgctgggccacgcatcctcctttgcgcccgattacgcgaaggccaaactttccgcagctcacctctttatgcttttcgaacgccaacctctgatagattcctactccgaagaaggacttaagcctgataagtttgaaggcaacattacctttaacgaggtggttttcaactaccccactagagctaatgtgcctgtcctccaaggcctgtccctggaagtgaagaagggccagactctggccctggtggggtcctcaggctgtggaaagtcgacggtcgtgcaactcctggagcgattctacgacccactcgccggtaccgtgttcgtggattttggatttcaactgcttgatggccaagaagcaaagaagctgaatgtgcaatggcttagggcacaacttggtattgtgtcccaagagccaattctgttcgattgttcgatcgcagagaacattgcctacggtgataattcgagagtcgtgtcccaggacgaaatagtgagcgcagctaaggcagcaaacattcatccattcattgaaacgctccctcataagtacgaaaccagagtgggggataagggcacccaactgagcggtggtcaaaagcagagaatagcaattgcacgcgctctgatccgccaaccacagatcctgctgctggacgaagcgaccagcgcactcgacactgaatccgaaaaggtggtgcaagaagctctcgacaaggctagagaggggagaacctgtattgtgattgcccatagactctcgactatccagaacgcggacctcattgtggtgttccaaaacggacgggtgaaggaacatggtacccaccagcagcttctcgcccagaagggtatttacttctcgatggtgtcagtccaggctggtacccagaatctc

SEQ ID NO: 7517 - DNA, 3858 bp, Artificial Sequence
  Description of Artificial Sequence: Synthetic coding sequence
atggatctcgaggcggcgaagaatgggaccgcctggcgaccaacatccgctgaaggggatttcgaactcggtatctcaagtaagcagaagagaaagaagactaaaaccgtgaaaatgatcggggtgttgacactttttagatactctgattggcaagacaagctattcatgtctctggggacaataatggctattgcccacggctcaggcttgcctttaatgatgatcgtgttcggcgagatgacagacaaatttgtagacactgccggaaactttagctttccagtgaatttctccttgtccctcttgaatcccggcaaaatcttggaagaggagatgactcgctacgcctactactattccggtcttggagcaggggtgctcgtggcagcgtacattcaggtgtctttctggaccctcgcagccggaagacagattcggaaaatccgacagaaattttttcatgcgatcctgcgtcaggagattggatggtttgacatcaacgatactactgagcttaatactcgactgacagacgacattagtaaaattagcgaagggatcggcgataaggtaggtatgttttttcaagccgtggcaaccttctttgcagggtttatagtgggatttatacgtgggtggaagctgacgctggtcatcatggccatttcccccatccttggtctgtcggcggccgtgtgggccaagattttatccgccttttccgataaagagttggccgcctatgcaaaagccggcgccgtggcagaagaagcactcggagctatacgaaccgtaattgctttcggtggacaaaacaaggaactagagcgatatcagaagcatctggaaaacgctaaggagatcggaatcaagaaggccataagcgcaaatataagcatgggcatcgcctttctgctgatttacgcctcctatgccttggctttctggtatggaagtacgctggtcatctcaaaagagtatactattggaaatgccatgaccgtcttctttagtatcctgatcggcgcatttagcgtagggcaggctgcgccctgtatcgacgccttcgcgaatgctaggggggctgcctacgttatctttgacatcattgacaataaccccaagatcgattcattcagcgaacgaggccataagccagattccataaagggaaatttggaattcaatgatgttcatttctcatacccttcacgagctaacgtgaaaatccttaagggccttaatctgaaagtgcaaagcggtcagactgtggccctggtaggttccagcgggtgcggcaaaagcaccactgtgcagctgatccagagactttatgatccggatgagggcacaatcaatatcgacggacaggatattagaaattttaatgtgaattacctgagagaaattattggcgtggtgagccaggaaccggtgctcttcagtaccaccattgctgaaaatatctgttatgggagggggaatgtcacgatggatgagatcaagaaagcagttaaagaagccaatgcatatgaattcatcatgaagctgcctcagaagttcgatacattggtgggggaaaggggggcgcagctgtctgggggccaaaagcaacgaatagccattgctagggcccttgtgagaaatccgaaaattcttttactagatgaagccacctccgcactagacactgagagtgaggcggaggtgcaggcggcactggacaaagcaagagaagggcgaacaacaatcgttatcgcacacaggctgtcaacggtgaggaatgccgatgtaatcgctgggttcgaagacggtgtgatagtggagcaaggatcgcactcggaacttatgaaaaaagaaggggtatacttcaagctcgtcaatatgcagacctctggctcccagattcagtccgaagagttcgagctcaacgatgagaaggctgctactagaatggcccccaatgggtggaaatcgagattatttagacacagcacccagaagaacctcaagaacagtcagatgtgccagaagtccctggacgtcgaaacagacggactcgaagccaacgtgcctccagtttcatttctgaaggtacttaagttgaacaagacagagtggccttactttgttgttgggaccgtgtgtgcaatcgcaaacggtgggctgcaacccgcgttctccgtcatttttagcgaaataattgctatatttggccctggagatgatgcggtcaaacagcaaaagtgcaatatttttagcctcatcttcctttttcttggaatcatatctttcttcactttctttctgcagggcttcacctttggtaaagccggcgaaatattgacgcgaaggctgagatccatggcatttaaagctatgctacggcaggacatgtcctggtttgatgatcacaagaactcaaccggagcgttgtcaacacgtctggcgactgatgcagcccaggttcagggagccaccggcaccagactggcattgatagctcagaacatcgcaaacctgggcacagggattataatttcatttatctatggctggcagttgacattgctcttgctcgctgtggtccctatcatcgcagtttcaggtatcgttgaaatgaaattactggctggcaatgctaaaagggataaaaaggagttggaggcggccgggaaaatagccacagaagctatcgaaaatatcaggaccgtggttagcttgacccaggaacgaaaattcgagtcgatgtatgtcgaaaagttatacgggccctaccgaaactcagttcagaaggcgcacatctacggtataacgttcagtattagccaggcattcatgtatttcagttatgctggctgctttaggttcggcgcctatctgatcgtcaacgggcacatgcgatttcgtgacgtgatactggtgttcagcgccattgtgttcggcgctgtagctctaggccacgcatcatccttcgcgcccgattacgctaaagcgaaactgtccgcagctcacctttttatgctcttcgagaggcaacccctcattgacagttatagcgaggagggcctcaagccagataaattcgagggtaatataacctttaatgaagtggtattcaactatccaacacgcgccaacgtgcctgttttgcagggcctgtccctcgaggtgaagaagggacagacactcgctctggtgggctcctctggatgcgggaagtctactgtagtgcaactgctggagcgcttttacgatcccctggccggaaccgtgttcgttgacttcggatttcagcttctggatgggcaagaagcaaaaaaactaaatgtccaatggcttcgggcccagcttggtatcgttagccaggaacccatcctgttcgattgcagtatcgccgagaatattgcctatggtgataactctagagtggtctcccaggacgagatcgtgagcgctgccaaggccgccaatattcacccgttcatagagaccctgcctcataagtacgaaacaagggttggagacaaaggtacacaactgtccggcggtcaaaagcagcgcatagctatcgcccgcgccctgatcagacagcctcagatcctgctactagatgaagcaaccagtgcccttgacaccgaaagcgaaaaagtggttcaggaagcactcgataaagcgcgcgagggacggacctgtattgttatcgcccatcgtctgagcaccatccagaatgcagacctcatagttgtgttccagaacggtcgggtgaaggagcacggaactcatcagcaattgctcgctcagaaaggcatctacttctccatggtgagcgtgcaggcaggaacccagaatttg

SEQ ID NO: 7518 - DNA, 3858 bp, Artificial Sequence
  Description of Artificial Sequence: Synthetic coding sequence
atggacctcgaagcagctaagaatgggactgcctggcgcccgacctccgcagagggggatttcgaactgggcatcagctcgaaacaaaagagaaaaaagactaaaacggtaaagatgatcggcgtcctgaccctgttccgctactcagactggcaagataaactgttcatgtctttgggaacgattatggcgatcgcccacggctccgggctgcccctcatgatgatcgtattcggtgagatgaccgacaaattcgttgacaccgcgggaaatttctcgttccccgtgaacttctccctgagcctgcttaatccgggaaagatcctggaagaagaaatgacccggtatgcctattactactcggggctcggagctggggtcctggtggctgcatatatccaagtcagcttctggaccctggcggctggcagacagatcagaaagatccgccagaagtttttccacgcgatcctgcgacaagagatcggctggttcgacatcaacgatacgaccgagctcaacactcggctcactgatgacatttccaagatctcggagggtatcggagataaggtcggaatgttcttccaggcagtggccacttttttcgcgggctttatagtgggatttatcaggggctggaagctgactctggtgatcatggctatctccccaatcctggggttgtcggcggccgtgtgggcaaaaatcctgagcgcgtttagtgacaaggagcttgccgcctacgcaaaggcaggagctgtggccgaagaagctctcggtgccattcggaccgtgatcgccttcggtggacagaataaggaactcgaacggtaccaaaagcacctcgaaaacgctaaagagatcggaatcaagaaagcgatctcagcgaacattagcatgggaatcgcattcctcctgatctacgcttcatacgctctggccttctggtacggatcgaccctggtgatctcaaaggaatacaccataggaaacgccatgacggtgttctttagcatcctcatcggtgccttctcagtgggacaggcggccccgtgtattgacgcattcgccaatgccaggggagcagcttacgtgatattcgacatcattgacaacaacccgaaaatcgactcattcagcgaacgggggcacaagccagatagcattaaaggaaatttggagttcaacgatgtgcacttttcctacccgagccgggcaaatgtgaagatcctgaagggcttgaatttgaaagtgcagtcggggcagaccgtcgctctggtggggagctccggctgcggtaaatcaactactgtgcagctgattcagagactctacgatcctgatgagggaactatcaacatcgatggtcaggacatccggaatttcaacgttaactacctccgagaaatcatcggagttgtgagccaggaaccagtgctgttctcaaccactatcgcagagaacatttgctacggaagagggaacgtcaccatggacgagatcaagaaagccgtgaaagaggccaatgcctacgaattcatcatgaagctgcctcaaaagtttgacaccctcgtgggcgaacgcggagctcagctgtccggtgggcaaaagcagcgcatcgccatcgctcgcgcacttgtcaggaacccgaagatcctgctgctcgacgaggcgacttccgccctcgacaccgaatcggaagccgaggtgcaggctgccctcgataaggcccgggaaggacgcactacgatagtgatcgcgcaccggttgtcgactgtcagaaatgccgacgtcattgcaggcttcgaggacggagtcatcgtggagcagggatcgcactcggagctgatgaagaaggaaggcgtctacttcaaactcgtgaacatgcaaacgagcgggagccagatccagtccgaagagttcgagctgaacgacgaaaaggctgccaccagaatggctcccaacggatggaagtcccggctgtttcgccattccacccagaaaaatctgaagaactcccaaatgtgccaaaaaagcctggacgtggaaaccgacggactcgaggccaacgtcccgcccgtgtccttcctcaaggtgctcaagctgaacaaaaccgaatggccatacttcgtcgtcggcactgtgtgtgctatcgcgaacgggggacttcagccggccttttcggtgatcttctccgagatcatcgcaatctttggcccgggagacgacgcggtaaaacagcagaagtgcaacatcttctccctgattttcctgttccttggaatcatatcattcttcactttctttctgcaaggatttaccttcggaaaggcaggagaaatcttgactcggcggcttaggtccatggctttcaaggctatgctcagacaggatatgtcctggttcgatgatcacaagaactcaactggagcgctgtccactcgcctggccactgacgccgcccaagtgcagggcgccaccggaactcgactcgcgcttatcgcccagaacatcgcgaatctgggaaccggaatcatcatctcgttcatttatggctggcagcttactctgcttttgctcgctgtggtgccgatcattgcagttagcggcatcgttgagatgaagttgttggctggaaatgcgaaacgcgacaagaaggagctggaggctgcggggaagatcgccactgaggccatcgagaatattcgtactgtggtgtccttgacccaagaacgcaaatttgagtccatgtacgtggaaaagctctacggaccgtaccgtaattcagtccaaaaagcacatatctacgggattacgttctcaatctcgcaagcgtttatgtacttttcatacgcaggatgctttcgcttcggcgcgtacctgatcgtgaacggccatatgagattccgagacgtcatcctggtgttctcggccatcgtgttcggtgctgtggccctcggacatgcgtcctcgtttgccccggattacgccaaggccaagctgtccgcagcccatctcttcatgctgtttgagcgccaacctctgattgattcgtacagcgaggaagggctgaaaccagataagttcgaagggaacatcaccttcaacgaagtcgtgttcaattaccccacccgggccaatgtgccagtcctgcagggcctgtcgctggaggtgaaaaagggtcagacccttgcattggtgggctcatccggctgcggcaagagtaccgtagtccagctcctggaacgcttctacgacccactcgccggaactgtctttgtcgacttcggattccagctgctcgacggccaggaagcgaagaaactgaacgtgcagtggctgcgcgctcagctcggaatagtttcgcaggaacctatcctctttgactgttcaatcgcagaaaacatcgcctacggcgataactcgagagtcgtctcacaagacgagatcgtcagcgccgcgaaggcagccaatatccatcctttcatcgaaactcttcctcacaagtacgaaaccagggtgggagataagggtactcagttgtcaggaggacagaagcaacgaatagcaatcgctcgagccctcatccgccagccccaaattctcctgctggatgaggcgacgtctgcgcttgacaccgagtcggaaaaagtggtgcaggaggccctcgacaaggcccgcgaaggccggacctgtatcgtgatcgcacatcggctttcgacgattcaaaacgccgatctgatcgtggtgttccaaaatggacgcgtcaaggaacacggaacccaccaacaactgttggcccagaagggtatctacttcagtatggtgtcggtgcaagctggcacccagaacctg

SEQ ID NO: 7519 - DNA, 3858 bp, Artificial Sequence
  Description of Artificial Sequence: Synthetic coding sequence
atggacctggaagccgccaaaaacggtacggcttggcggccaacatcagccgagggtgattttgaactcgggatctccagcaagcagaagcgaaaaaagaccaagaccgtcaagatgatcggggtgctcacactattcagatacagtgattggcaggacaagctctttatgagtttgggcaccattatggccatagcgcacggaagcggcctaccactcatgatgatcgttttcggggagatgacagacaaattcgtggacacagcggggaacttctccttcccggtgaatttcagcctctctttgctgaacccaggcaaaattctcgaggaggaaatgactcggtatgcctactactattctgggctgggtgccggagtacttgtggcggcatacatacaggtaagtttctggacactcgcagcagggcgccagatccgcaagattaggcagaagttctttcacgctatcttgcggcaggaaattggttggttcgatatcaatgacactaccgagcttaacactcgcctgaccgatgacatatccaagatatcagagggcatcggagataaagtggggatgtttttccaagccgtcgccactttttttgccggcttcatagtcggattcatccgcggttggaaactgactttggtgatcatggctatcagccctatcctgggcttatccgctgcggtgtgggctaagatcctcagcgccttctcagataaagagttggccgcctatgcaaaagcgggagcggtggccgaggaagcgctgggtgcaatcagaactgttatagctttcggcggccagaataaggagttggagaggtatcagaaacatttagagaatgccaaggaaatcggcataaagaaggcaattagcgcgaacatcagcatggggatcgccttcctactgatctatgcatcgtatgccctggcattctggtatggctctacgctcgtcatttcgaaagaatatacgatcggaaatgccatgactgtgttcttctctatcctgataggcgcgttttccgtggggcaggctgctccatgtattgatgcattcgcaaacgcacgaggcgccgcttatgtgatctttgacattatcgacaacaacccaaaaatcgactcctttagcgaaagggggcataagccagattcgatcaaggggaacctcgagttcaacgacgtgcacttctcctacccgtcccgagctaatgtgaagatcctcaagggactcaatctgaaggttcagtctggtcagaccgtggcgctggttgggtcctctgggtgcggaaagagcacaacagtacagttaatccaaagattatatgacccagatgagggtacaattaatatagatggtcaagacattaggaactttaatgtaaactatttgcgagagataattggggtggtgagtcaggaaccagtgcttttttctacgaccatcgccgagaacatctgttatggtcggggtaacgtgactatggatgaaatcaaaaaggccgtgaaagaagccaacgcctacgaattcatcatgaagcttccgcagaaattcgacaccctggtgggcgaaagaggtgcacagctgagtgggggccagaagcagcgtattgcgattgcccgagccttggttcggaatccaaagatcctattgcttgatgaggctacaagtgctctggatactgaaagcgaagcagaggtccaggccgccctcgacaaggctcgcgaggggcggaccacaatcgttattgcacaccgactgagcacggtgagaaacgctgatgtgattgccggattcgaggatggtgtgatcgtcgagcaagggagccatagcgaactcatgaagaaagagggcgtctatttcaagctcgtgaatatgcagacatctggttcacaaatccagagcgaagaatttgagttgaatgatgagaaagctgccaccagaatggcccccaatggctggaaaagtcggctcttcaggcatagcacccagaaaaacttaaagaattcccagatgtgtcagaagagcttagatgtcgagaccgatggcctggaggctaacgtccctcctgtgtctttcctgaaagtcttgaaattgaacaagactgaatggccctactttgtggtggggaccgtgtgcgctattgctaacggcggtctacaaccggcattttctgtcatattttctgagattatcgcaatctttggacccggtgatgacgccgtgaagcagcagaagtgcaacatattcagccttatctttctgtttctgggaattatcagcttttttacctttttcttacagggcttcacttttggcaaggcgggtgaaatcctcacacgccgtctgaggagcatggcgtttaaggccatgctgcgtcaggacatgagctggtttgacgaccacaagaatagcaccggagcattgagcacgaggctggctaccgacgcagctcaggttcagggtgctactggcacccggctggcactgatcgctcagaatatcgccaacctggggaccgggataatcatatcttttatctacggttggcagctgactctgctgctcctggctgtggttcccattatcgctgtgtctggaattgtagagatgaaactactcgccgggaatgcaaaaagagacaagaaggagctagaagctgccggaaagattgcaactgaagcgatcgagaacattcggaccgtggtatcccttacacaggagcggaagttcgaaagcatgtatgtggaaaaattgtatggtccctatcgcaatagtgtgcagaaagctcacatctatggtatcacttttagcatatcgcaggccttcatgtacttctcatacgctgggtgctttagatttggcgcctacttgatcgtcaatggccacatgaggttcagagacgtgatacttgtctttagcgctatcgtattcggcgcagtcgcactgggccatgcgtcctcctttgcgcccgactacgccaaggctaaactgtccgccgcccatcttttcatgcttttcgaaagacagcccctcatagattcatattcggaggagggactcaaaccggataagtttgaagggaatatcacctttaatgaagtggtgtttaattatccaactagagcaaacgtgccagtacttcaaggacttagtctggaggtcaagaaggggcaaacattagcccttgtggggtcttccggctgcggcaagagtacagtcgtccagctactggaaagattttacgatcctctcgctgggaccgtgttcgtggactttggctttcaacttctggacggccaggaggccaaaaagttgaatgtccaatggctcagagcccagttaggaattgtgagtcaagaacctatcctcttcgactgttcgattgccgaaaatatcgcatacggggacaattcaagggtagtctcacaagacgaaatcgtctcagccgcgaaggccgccaatattcatccgttcatcgagactctgccacataaatacgaaacaagggtcggagacaagggtactcaactcagtggtggacagaagcagcgcatcgccattgcccgcgctctgattcgacagccccagatcttgctgctggacgaggccacctccgctctcgacacagaatccgaaaaggtcgtgcaggaggctttggacaaggccagggaagggagaacgtgcatcgtgatagctcatcggctcagcactattcagaatgccgatctcatagtcgtgttccagaatggcagagttaaggagcacgggacccaccagcagctgttggctcagaaaggaatttacttctccatggtgtcggtacaagctgggactcagaacctt

SEQ ID NO: 7520 - DNA, 3858 bp, Artificial Sequence
  Description of Artificial Sequence: Synthetic coding sequence
atggacctggaagctgctaagaacggaactgcctggcgccctacgtctgccgagggagacttcgaattgggaatcagctccaaacagaagcgcaaaaagaccaaaaccgtgaagatgatcggagtgctgaccttgtttcggtactcggactggcaagacaaacttttcatgtcgctgggaactatcatggcaattgcgcacggatctggtctgcctctgatgatgattgtttttggggaaatgaccgacaaattcgtggataccgctggaaacttcagcttcccggtgaacttttccctgagcttgcttaacccaggtaagatcctggaggaggaaatgaccaggtacgcgtattactactcaggcctgggagcaggtgtgctggtcgcggcatacatccaagttagcttctggaccctcgcggcggggcgccagatcagaaagatccgccagaagttttttcatgcgatcttgcgccaggaaatcggatggttcgacatcaacgacaccactgagctgaacaccagactcactgacgacatctcgaagatctcggaaggaatcggcgataaggtcggaatgttctttcaggcagtcgcgaccttctttgctggattcatcgtgggcttcatccgcggctggaagttgaccttggtgataatggccatcagcccgatcctcggcctgtcggcggccgtctgggcgaagatcctctccgccttctcagataaggagctggccgcatacgcgaaagcgggagccgtcgcggaagaggccctgggcgccatccggactgtgatcgcgttcggaggacagaataaagaactcgagcgctaccagaagcacctcgagaatgctaaggaaatcggaatcaagaaggcaatttcggccaacatcagcatgggcattgccttcctgctgatctacgcatcctacgcgctcgccttttggtacggatcgactctcgtgatttcgaaggaatacactatcgggaacgccatgactgtgtttttctcgatcctgatcggtgcgttctcagtgggccaggctgctccatgcatcgatgcctttgccaacgcgcgcggcgccgcctatgtcatcttcgacataatcgacaacaacccaaagatcgatagcttctcagaacgcggacacaagccggactcgatcaaaggtaatcttgaattcaacgatgtgcatttttcatacccttcaagggcgaacgtgaagatcctcaaggggctgaacctcaaggtgcaaagcggacaaaccgtcgcgctggtgggctcatctggctgcggcaagtcgaccactgtgcagctgatccagcgcttgtacgacccggacgagggcaccatcaacatcgacggacaggacattcggaatttcaatgtgaactacctgcgcgagatcataggagtggtgtcccaggaacccgtgctgttctccaccacgatcgccgagaacatttgttacggccggggaaatgtgaccatggatgagatcaaaaaagccgtcaaagaggcgaacgcttacgagttcatcatgaaactgccacagaagttcgacaccctggtcggagaacgcggtgcacagctgtccggaggccaaaaacagcgcatcgcgatcgcaagggcgctggtccggaaccctaagatcttgctcctcgatgaagcgacgagcgcgcttgacaccgagagcgaagcggaagtgcaggcagcactcgataaggccagagagggccggacgacgatcgtgattgctcacaggctgtccaccgtccgcaatgcagatgtgatcgcaggatttgaagatggcgtgatcgtggagcaaggatcacacagcgaattgatgaaaaaagaaggggtgtactttaaacttgtgaatatgcagacttccggatcacaaatccagtccgaggaattcgagctcaacgacgaaaaagccgccacccgaatggcaccgaacggatggaagagtcggctgtttcgtcattcaacccagaaaaacctgaaaaacagccagatgtgccagaagagcctggacgtggaaaccgacgggcttgaggccaacgtgccaccagtttccttcctcaaggtgctcaaactcaacaagaccgaatggccctactttgtggtcggtaccgtgtgcgccatcgccaacggtggactgcaaccggctttctctgtgatcttcagcgaaatcatcgcgatctttggaccgggagatgatgcggtcaagcagcagaagtgcaacattttctctctgattttcctgttcttgggaattatctcattcttcacttttttcctgcaaggttttacgttcggtaaagccggtgaaatcctgactagacggctcagatctatggccttcaaggcaatgcttagacaggatatgagctggttcgacgaccacaagaatagcaccggagcgctgtcaacccgcctggccactgatgccgcccaagtccaaggagccactggaactcggctggcgctgatcgcacagaacatcgcaaatctggggaccgggatcattatctccttcatctacggatggcagctgactctgctgctgttggccgtggtcccgataattgctgtgtccggcatcgtcgagatgaagctgctggcgggtaacgccaagagggataagaaggaactcgaggcagcggggaaaatcgctactgaggctatcgagaatatccggactgtcgtgtccctcacgcaagaaaggaagtttgaatcaatgtacgtggagaagctgtacggaccgtaccggaattcggtgcagaaggctcacatctatggaatcactttttcaatctcccaggcattcatgtacttcagctacgcgggatgcttccggttcggtgcatacctgatcgttaatggacacatgagattccgcgatgtgatcctggtgttctcagcaatcgtgtttggagcagtggccctgggccatgcgtcctccttcgcgccggactacgcgaaggccaagctgtccgccgcccacctgttcatgctcttcgagcgccaaccattgatcgactcgtactcggaggaaggcttgaaacctgataagttcgaagggaacatcacgtttaacgaggtggtctttaactaccctaccagagcgaatgtccccgtgctgcaagggctctcgctggaagtgaagaagggacaaactctggctctcgtgggctcttcgggatgcggaaaatcgaccgtggtgcaactgctcgagcggttctacgacccactggcaggaaccgttttcgtggacttcggcttccaactgctggacggacaggaggcaaagaagctcaacgtgcagtggctccgggcacagctcgggatcgtctcacaagaaccgatcctcttcgattgctcaatcgccgaaaacatcgcctatggcgacaactccagagtggtcagtcaggatgaaatcgtctcggcggccaaggccgccaatatccacccctttatcgaaactctgccgcacaagtacgaaactcgggtgggggacaaggggactcaattgtcggggggacagaagcagcggatcgctatcgcgcgcgcattgataagacaaccgcaaatcctccttcttgacgaggctacgtctgccctggacaccgaatcagagaaagttgtgcaggaggcgctggataaggcccgcgaaggtcggacgtgcatcgtcatcgctcaccgcttgtcgactatccagaatgccgacctcatcgtggtctttcagaacggacgcgtgaaagaacacggaactcaccagcagctgctcgcccagaagggcatctatttctctatggtgtctgtccaagctggaacccagaatctc

SEQ ID NO: 7521 - DNA, 3858 bp, Artificial Sequence
  Description of Artificial Sequence: Synthetic coding sequence
atggatctagaagcggcgaaaaatggtacggcgtggcgtccgacgtcggcggaaggtgattttgaattaggtatatcgtcgaaacaaaaacgtaaaaaaacgaaaacggttaaaatgataggtgtattaacgctatttcgatattcggattggcaagataaactatttatgtcgttaggtacgataatggcgatagcgcatggttcgggtttaccgctaatgatgatagtatttggtgaaatgacggataaatttgtagatacggcgggtaatttttcgtttccggtaaatttttcgttatcgttattaaatccgggtaaaatattagaagaagaaatgacgcgttatgcgtattattattcgggtctaggtgcgggtgtattagttgcggcgtatatacaagtatcgttttggacgttagcggcgggtcgacaaatacgtaaaatacgtcaaaaattttttcatgcgatattacgacaagaaataggttggtttgatataaatgatacgacggaactaaatacgcgtctaacggatgatatatcgaaaatatcggaaggtataggtgataaagtaggtatgttttttcaagcggttgcgacgttttttgcgggttttatagttggttttatacgtggttggaaattaacgctagtaataatggcgatatcgccgatactaggtttatcggcggcggtatgggcgaaaatactatcggcgttttcggataaagaattagcggcgtatgcgaaagcgggtgcggtagcggaagaagcgttaggtgcgatacgaacggtaatagcgtttggtggtcaaaataaagaattagaacgatatcaaaaacatttagaaaatgcgaaagaaataggtataaaaaaagcgatatcggcgaatatatcgatgggtatagcgtttttactaatatatgcgtcgtatgcgctagcgttttggtatggttcgacgctagtaatatcgaaagaatatacgataggtaatgcgatgacggtttttttttcgatactaataggtgcgttttcggtaggtcaagcggcgccgtgtatagatgcgtttgcgaatgcgcgtggtgcggcgtatgtaatatttgatataatagataataatccgaaaatagattcgttttcggaacgaggtcataaaccggattcgataaaaggtaatctagaatttaatgatgtacatttttcgtatccgtcgcgtgcgaatgtaaaaatattaaaaggtttaaatctaaaagtacaatcgggtcaaacggttgcgttagtaggttcgtcgggttgtggtaaatcgacgacggtacaactaatacaacgtttatatgatccggatgaaggtacgataaatatagatggtcaagatatacgtaattttaatgtaaattatctacgtgaaataataggtgtagtttcgcaagaaccggtattattttcgacgacgatagcggaaaatatatgttatggtcgtggtaatgttacgatggatgaaataaaaaaagcggttaaagaagcgaatgcgtatgaatttataatgaaattaccgcaaaaatttgatacgttagtaggtgaacgaggtgcgcaattatcgggtggtcaaaaacaacgtatagcgatagcgcgtgcgctagtacgtaatccgaaaatactactactagatgaagcgacgtcggcgctagatacggaatcggaagcggaagttcaagcggcgttagataaagcgcgagaaggtcgtacgacgatagtaatagcgcatcgtttatcgacggtacgtaatgcggatgtaatagcgggttttgaagatggtgttatagtagaacaaggttcgcattcggaattaatgaaaaaagaaggtgtttattttaaattagttaatatgcaaacgtcgggttcgcaaatacaatcggaagaatttgaactaaatgatgaaaaagcggcgacgcgaatggcgccgaatggttggaaatcgcgactatttcgacattcgacgcaaaaaaatttaaaaaattcgcaaatgtgtcaaaaatcgttagatgttgaaacggatggtctagaagcgaatgttccgccggtttcgtttctaaaagttctaaaactaaataaaacggaatggccgtattttgtagtaggtacggtatgtgcgatagcgaatggtggtctacaaccggcgttttcggttatattttcggaaataatagcgatatttggtccgggtgatgatgcggtaaaacaacaaaaatgtaatatattttcgttaatatttttatttttaggtataatatcgttttttacgttttttttacaaggttttacgtttggtaaagcgggtgaaatactaacgcgtcgattacgatcgatggcgtttaaagcgatgttacgacaagatatgtcgtggtttgatgatcataaaaattcgacgggtgcgctatcgacgcgtttagcgacggatgcggcgcaagtacaaggtgcgacgggtacgcgtttagcgttaatagcgcaaaatatagcgaatctaggtacgggtataataatatcgtttatatatggttggcaattaacgctactattattagcggttgttccgataatagcggtatcgggtatagtagaaatgaaattactagcgggtaatgcgaaacgtgataaaaaagaattagaagcggcgggtaaaatagcgacggaagcgatagaaaatatacgaacggtagtttcgctaacgcaagaacgtaaatttgaatcgatgtatgttgaaaaattatatggtccgtatcgaaattcggttcaaaaagcgcatatatatggtataacgttttcgatatcgcaagcgtttatgtatttttcgtatgcgggttgttttcgatttggtgcgtatttaatagttaatggtcatatgcgatttcgagatgtaatattagtattttcggcgatagtatttggtgcggtagcgctaggtcatgcgtcgtcgtttgcgccggattatgcgaaagcgaaattatcggcggcgcatctatttatgctatttgaacgacaaccgttaatagattcgtattcggaagaaggtctaaaaccggataaatttgaaggtaatataacgtttaatgaagtagtttttaattatccgacgcgagcgaatgtaccggtattacaaggtctatcgctagaagttaaaaaaggtcaaacgctagcgttagttggttcgtcgggttgtggtaaatcgacggtagtacaactattagaacgtttttatgatccgctagcgggtacggtttttgttgattttggttttcaattattagatggtcaagaagcgaaaaaactaaatgtacaatggttacgtgcgcaattaggtatagtatcgcaagaaccgatattatttgattgttcgatagcggaaaatatagcgtatggtgataattcgcgtgtagtttcgcaagatgaaatagtttcggcggcgaaagcggcgaatatacatccgtttatagaaacgttaccgcataaatatgaaacgcgagtaggtgataaaggtacgcaattatcgggtggtcaaaaacaacgtatagcgatagcgcgagcgttaatacgacaaccgcaaatattattattagatgaagcgacgtcggcgctagatacggaatcggaaaaagttgtacaagaagcgttagataaagcgcgagaaggtcgaacgtgtatagtaatagcgcatcgtttatcgacgatacaaaatgcggatttaatagtagtatttcaaaatggtcgtgttaaagaacatggtacgcatcaacaactactagcgcaaaaaggtatatatttttcgatggtatcggttcaagcgggtacgcaaaattta

SEQ ID NO: 7522 - DNA, 3858 bp, Artificial Sequence
  Description of Artificial Sequence: Synthetic coding sequence
atggatctggaggccgccaaaaatggcaccgcatggcgacctaccagtgcggagggagacttcgagctggggatatcaagcaagcagaagaggaaaaagaccaagacggtcaaaatgattggagtccttaccctttttagatactcagattggcaagataagttgttcatgtccctcggcaccattatggcgattgctcatggatcgggtttgcctttgatgatgatcgtgtttggtgagatgaccgataagtttgtggatactgccggaaacttctcatttccagtcaactttagcctgtcacttctgaacccaggaaaaatcttggaagaagagatgaccaggtacgcatactactactcgggattgggtgcaggggtgctggttgcggcatacatccaggtttccttttggacccttgctgccgggcggcagattagaaagattaggcaaaagtttttccatgcgatcctccgccaagagattggctggttcgatatcaatgatactaccgaacttaacactcgactgaccgatgatatttcgaagatctccgagggaataggggataaggtgggtatgttcttccaggccgtggcaaccttctttgcgggattcatcgttggattcattcgtggttggaagctcacccttgttatcatggcaatctcaccaattttggggctgtcagccgccgtgtgggccaaaattctctcagcattttctgacaaggagttggcagcctacgcaaaggcgggtgctgtggcggaagaggcccttggagccatcagaactgtgattgcctttggcggtcagaataaagaactcgagcgataccaaaagcatctcgaaaacgctaaggagatcggtattaagaaagcaatttcagccaacatatctatgggtattgccttcctcctcatttacgcatcctacgccctcgcattttggtatggttcgactctcgtgatttctaaggaatacactatcggaaatgcaatgactgtgttcttttcgattttgattggtgctttctcggtgggtcaggctgcaccctgtattgacgcatttgccaacgcacgcggtgcagcatacgtcatttttgacattattgacaacaacccaaagattgattcctttagtgaacgtggccataaacccgatagcattaagggtaacctggagtttaacgatgtgcacttttcgtacccatcccgagccaatgtgaagatccttaagggtctgaacctcaaagtgcagtccggacagactgtagcacttgtggggagctctggttgcggtaaatcgaccaccgtgcagctcatccagcggctgtacgaccccgatgagggaaccattaacatcgatggtcaggatatcaggaacttcaacgtaaactaccttcgcgagattataggtgttgtgtctcaagaacctgtgctgtttagcactacgatagcggaaaacatatgctacggaaggggaaacgtgaccatggatgaaatcaagaaagcagtcaaggaagcgaatgcttacgaattcattatgaaactccctcagaaatttgacaccctggtgggagaaagaggtgcccaactcagcggtggtcaaaaacaacggatcgcaatcgcaagggcactggtgcggaaccccaaaatacttctgttggatgaggctactagcgctcttgataccgaatcagaagcagaggtgcaggcagcactggataaggcccgggaaggccgtacgaccattgtgattgcgcaccgactctccactgtcaggaatgccgatgtgatcgcagggtttgaagatggagtcatcgtcgaacagggttcacattccgagcttatgaagaaggagggagtgtactttaagttggtgaacatgcagacctcgggaagccaaatacaatcagaggaattcgaacttaacgacgagaaagcagccaccagaatggccccaaatggttggaaatccaggctgtttcggcattcgacccaaaagaacttgaagaactcccagatgtgtcaaaagtccctggacgtggagactgatggacttgaagccaatgtgcctcccgtgagcttcctgaaagtgctgaagctcaacaagaccgaatggccgtactttgtggtcgggactgtgtgtgcaattgcaaacgggggactgcagcctgcatttagcgtgatcttttccgaaatcatcgcaattttcgggcctggagatgacgcagtcaaacaacaaaagtgtaacatcttttccctcattttcctgtttttgggaataatctcatttttcactttcttcctccagggatttacgtttgggaaggccggtgaaatccttactagacggctgcgttcaatggcgtttaaggcaatgctgagacaagacatgtcgtggttcgacgaccacaagaactccaccggtgcgcttagcaccagactcgcgactgatgcagcacaagtgcagggtgcgactggcactcggttggcactgatcgcacagaatatagcaaatctcggtacggggatcatcatatctttcatatacggctggcagcttaccctgcttctgctggctgtcgtgcccatcatagccgtgtcggggatcgtcgagatgaagctgcttgcaggaaatgccaagagagataagaaggagctcgaggcagccggtaagattgccacggaggcaatcgaaaacataagaaccgtggtgtccctcacccaagaaagaaagttcgaatcgatgtatgtggagaagctgtacggcccatatcgtaactcagtgcaaaaggcccatatctacggaatcaccttcagcatctcacaggcatttatgtacttttcatacgctggttgctttcggtttggtgcatacctgatcgtgaatgggcatatgagatttagggacgtgattctggtgttttcagcaatcgtgtttggcgcagtggcattgggacacgcatccagctttgcccctgattacgccaaagcaaaactttcggcggcacatcttttcatgcttttcgaacggcagcctctcatcgattcgtattccgaagaggggctcaagcctgacaagtttgaaggaaacattacctttaacgaagtggtgtttaactacccaaccagagcgaatgtccctgtgctgcaaggcctgtcgctcgaagtgaagaagggacagactctggcacttgtgggatcctccgggtgtgggaagtcaacggtcgtgcagctcctggagcggttctacgacccacttgcaggaaccgtgtttgtggattttggctttcagctgcttgacggacaagaagcaaaaaagctgaacgtccaatggcttagagcccaacttggaattgtgagccaagaaccgatccttttcgactgttccattgcggagaatattgcatacggtgacaactcgagagttgtgtcacaagatgaaatagtgtccgcagcaaaggcagctaacattcacccctttatcgaaactcttccacataagtacgaaaccagggtgggagataagggcacccagctttccggcgggcaaaagcagaggattgcaatcgcacgggctctcatcaggcaaccacaaattctcctgctcgacgaagccacttcggctctggataccgagtcagagaaagtcgtgcaggaagctcttgacaaggcgcgagaaggcagaacttgtatagttatcgcacatagacttagcaccattcagaacgcagacctcattgtggtgttccaaaatggccgggttaaagagcacggaactcatcaacagctgctggcgcaaaagggaatctacttctcaatggtcagcgtgcaagcaggaactcaaaacctc

SEQ ID NO: 7523 - DNA, 3858 bp, Artificial Sequence
  Description of Artificial Sequence: Synthetic coding sequence
atggacttggaggccgccaagaatggcacagcttggcgaccaacttcagctgaaggcgactttgagctggggattagcagcaagcagaagagaaagaagactaaaacagtaaagatgatcggcgtactaaccctgtttcgatatagtgattggcaagacaagctttttatgtccctgggcactatcatggctatcgcgcatggatcaggccttccactgatgatgatcgtgttcggggagatgacagacaagttcgtggacacagctggcaatttctcctttcccgtgaatttctctctcagcttactcaatccaggtaagattctcgaggaagagatgacccgttatgcctactactactcaggtctgggggccggcgtacttgtcgcggcctacatccaggtgagcttctggactcttgctgctggacgacagatccgaaagatccgacagaagttctttcacgcaatcctgcgccaggaaatcgggtggtttgacatcaacgatacaaccgagctaaacaccaggctcacagatgatatctcgaaaatctcagaggggatcggggataaagtggggatgttctttcaagccgtggctacttttttcgcaggattcattgtaggtttcatacgtggttggaaactgacactagtcataatggctattagccccatcctcggactgagcgctgctgtttgggcaaaaattctttctgcttttagcgataaagagttggccgcttacgccaaggctggggccgtagcagaagaagccctgggggccataaggacagtgatagcatttggaggccagaacaaagaactagagcgataccagaaacacctagagaacgccaaggagattggcattaagaaagccattagcgccaatatctccatgggaatcgcttttctgctgatttacgcttcgtatgctttggcattctggtatgggagcacccttgtgatttctaaggaatacaccataggcaacgcgatgaccgtctttttctcaattctgattggcgcgttctctgtaggtcaggctgctccctgtatcgatgcatttgctaacgcaaggggggcagcttacgtgatttttgacataatcgacaataacccaaagattgactctttctctgaaaggggacataaacccgacagcatcaagggcaacctagaatttaacgacgttcacttctcgtatccatcaagagctaatgtaaagattctgaagggtctgaacctgaaggtgcaatcaggacagacagtagccctggttggcagtagcggctgtggaaaatctaccacagtgcagctgatccaacgtctctatgatccagatgagggcactataaacattgatggacaggatatccgaaatttcaacgttaactatcttcgagagattattggggtggtgtcccaggagccagtcctgttttctaccactatcgccgaaaatatctgctatggacgaggcaatgtgacgatggacgagataaaaaaggcggtgaaggaggcaaacgcctacgagttcatcatgaagctgcctcagaagtttgacactttagtgggcgaacgaggagctcagttgtccggggggcagaagcagaggatcgctattgcgcgagcactcgtccgaaatcccaaaatcctcctgctggatgaagcaacctccgccttggacaccgagtctgaggctgaagtgcaggctgctctagacaaggccagggaagggaggacaacgatagtcatcgcccaccgcctatctacagtacgaaatgccgatgtgattgctggctttgaagacggagtaattgttgagcagggctcccattccgagctgatgaagaaagaaggcgtctacttcaaactggtcaacatgcagactagtgggtctcagatccaatctgaagaatttgagctgaatgatgagaaagcagcgacaagaatggctcccaatggctggaagtccaggctctttcggcatagtacgcaaaaaaacttgaagaatagccagatgtgtcagaaatctctagacgttgagacggacgggctcgaggcgaatgtcccacctgtctccttcctgaaggtccttaaacttaacaaaacagaatggccctactttgtggtgggcacggtgtgcgcaatcgccaatgggggcctgcagccagccttttctgtaatcttctccgagatcattgccatcttcggaccgggggacgatgctgtgaaacaacaaaaatgcaatatcttctctctgatattcctgttcctgggcatcatctccttctttaccttttttcttcagggttttacgttcggaaaggcaggcgagatcctgacaaggcgactgaggagtatggccttcaaggcaatgctgcgccaggacatgagctggttcgacgaccataagaatagcaccggtgcactttccacacgcctcgcgactgacgctgctcaggtccagggagccaccggcactcgattggcactcattgcacaaaacattgcaaacttgggaacaggaattattatctcgtttatttatggctggcaacttacacttctccttctggcagtcgttccaataatagctgtcagcggaatcgtcgaaatgaaactcctcgcagggaacgcgaaaagagataagaaggaattggaagccgcgggaaaaatcgcgacagaagccattgaaaatatccgaaccgttgtttctctaacacaggagcgtaagtttgaatctatgtatgtggagaagctctacggcccataccgtaatagcgtacagaaggcgcatatctacggcataacgtttagtatctctcaggcattcatgtacttcagctacgctggatgcttcaggttcggagcctatctgatagttaatgggcatatgcgatttcgcgatgttatccttgttttctcggctatcgttttcggtgccgtagccttgggccacgcgagttccttcgctcctgattatgcaaaggctaaactttccgcggcccacctatttatgctgttcgaacgacagcctttaattgactcttacagcgaagaagggctcaaaccagacaaattcgagggtaacatcacatttaatgaggtggttttcaactatccgacaagagcaaacgtgcctgtgctgcaggggcttagcctggaagttaaaaagggccagacacttgccttggttggttcctcggggtgcggaaagagcacagttgtccaactcttggagaggttttacgatccactggcaggaaccgtttttgtcgactttggctttcaactcctggatggccaggaagccaaaaaactgaatgtacagtggctgagagcgcagctcgggatcgtttcccaggaaccaattctcttcgactgctccattgcggagaacattgcctatggagataactcaagagtggtgagccaggatgaaatagtgtccgccgccaaggctgcaaatatacacccctttattgaaaccctcccacataagtatgagactagggtcggtgacaaaggcacccaacttagcggtggccagaagcaaaggatcgccatcgcacgggccctgatcaggcaacctcagatcctactactggatgaggctacaagcgctctggatactgaatctgagaaagtggtccaggaagctctggacaaagcccgtgagggcagaacatgtatcgtgatcgcccaccgcctctccactatccagaatgccgatttgattgtcgtttttcagaatggcagggtgaaggaacacgggacccatcagcagctgttagctcaaaagggcatctatttttccatggtcagtgtacaagcagggactcagaatctg

SEQ ID NO: 7524 - DNA, 3858 bp, Artificial Sequence
  Description of Artificial Sequence: Synthetic coding sequence
atggacctggaagccgctaagaatggtactgcatggcggcccacctctgctgagggcgacttcgagctgggaattagctcaaaacaaaaacggaagaagaccaaaacagtcaagatgattggggtcttaacactgttcaggtatagtgattggcaggacaaattatttatgtctctgggcaccattatggcaatagcccatggatcagggctacccttaatgatgattgtctttggcgaaatgacagataaattcgtggatacagctggcaactttagctttcctgtgaactttagcctgagtcttctgaatcctggcaaaatcctggaagaagaaatgacaagatatgcctactattattctgggctgggcgccggtgtgttagtggccgcctacatacaggtgtcattctggactctggcagccggcagacaaattcggaaaatcaggcagaagttcttccatgcaatactaagacaggagatagggtggttcgatattaatgatacaactgagctgaatacccggctgactgacgatatatccaaaatttccgaggggatcggggacaaagtggggatgtttttccaggctgtggcaactttctttgctggcttcatagttggctttatacgcggctggaaactgaccctggtgatcatggccatatcaccaattctgggcctatccgcagctgtgtgggccaaaattctgagcgccttcagcgataaagagctggccgcttatgccaaggcaggagcagttgctgaggaagctctgggggctattcggaccgttatcgcatttggtggccaaaacaaagagttagagcgttatcagaagcacctggagaatgccaaagaaataggaatcaagaaagctatcagcgccaacataagtatgggcatcgctttccttctaatatacgcttcttacgctctggccttctggtacggcagcacactagtcatatccaaggaatacactatcggcaatgctatgaccgtttttttcagcatactgattggcgcattctctgtcggccaggccgcaccatgtattgatgctttcgcaaatgcacggggcgcagcctacgtgatttttgatattattgataataatcccaagatcgattccttttcagagaggggccacaagcctgattccatcaagggcaacctggagttcaacgatgtgcacttttcctaccccagcagagccaatgttaaaatcctgaaaggcctcaatctcaaagtgcagtcaggccagacagtcgccctggtgggcagttcaggctgcggaaaaagcactactgttcagctgatacaaagactgtacgatccagacgaagggactataaacatcgatggccaggacattcgcaatttcaatgttaattacttaagagaaataattggggtcgtgagccaggagcccgttctgtttagtaccactatagcagagaacatctgctatggaagaggaaatgtcacaatggacgagatcaaaaaagccgtgaaagaggcaaacgcatacgagttcataatgaaactgccccagaagtttgacaccttagtgggcgaaagaggggcccagctgtctgggggccagaagcagcgcatagccatagcccgcgcactggtgagaaatcctaagatattactcctggacgaagccacctcagctctggacactgaaagtgaagccgaagtccaggccgcactggataaagcacgtgaaggaagaactaccatcgtgattgctcatcgcctgtctaccgtgagaaatgcagatgtgatcgcaggcttcgaagacggtgttattgttgagcaggggtcccattccgagctcatgaagaaggagggcgtctactttaagctggtgaatatgcagaccagtggaagccagatccagtcagaggagttcgagctgaacgacgagaaagcagctactagaatggctcccaacggttggaaaagcaggctgtttcgacactcaacccagaagaaccttaagaacagtcagatgtgtcagaagagtctggacgtggaaaccgacgggctggaagccaacgtaccacccgtttcttttctgaaggttcttaagttaaacaaaaccgagtggccttactttgtcgtgggcacagtgtgtgccatcgctaatgggggtttgcagccagccttcagcgtcatttttagtgaaataattgccatttttggtcccggcgacgatgcagttaagcagcaaaagtgtaatatcttcagcctaattttcctgttcctggggataataagctttttcacatttttcctgcaagggtttacctttggaaaggccggggagattttaactaggcggttacgctcaatggcctttaaggccatgttgaggcaggacatgtcttggttcgacgaccacaaaaattccaccggggccctaagcacacggcttgcaacagatgcagcacaggtgcagggcgccaccgggaccagactcgcccttattgcccagaacattgcaaacctcggaaccggaatcataatatccttcatatatggatggcaacttactttattacttctagccgttgtccctattatcgccgtttccggcattgtggaaatgaaacttctggcaggaaatgctaagcgcgataagaaagagttagaggccgccggcaaaatcgccaccgaggccatcgagaatataaggactgtggtgtccctgactcaggagagaaagtttgagagcatgtatgttgaaaaattgtatggcccctacaggaattctgtgcagaaggctcacatctatggaattacattctccatctctcaggctttcatgtatttcagctacgctgggtgctttaggttcggagcctacctgatcgttaacgggcacatgagattccgagacgttatactggtgttctcagctattgtgttcggtgctgtggcacttggacacgcttcatcattcgcccctgactacgccaaggctaagctcagcgccgcacatctgttcatgctgttcgagaggcagcccctgatagacagctattctgaggaaggtcttaaaccagacaagttcgagggcaatattaccttcaacgaggtggtttttaactatcctactcgcgctaatgtgccagttttacagggtctatctctggaagtgaaaaagggccagaccttagctcttgtcggtagctcaggatgcggcaagtccaccgttgtccaactgctggaaaggttttacgacccactggcagggacagtgtttgtggattttggatttcagctgctcgatggacaagaggccaaaaagttaaacgtacagtggctgcgcgctcagctcggcatagtgtctcaggaacccatcctgttcgattgttccatcgcagagaacattgcctatggggataactcaagggttgtctcacaggacgagattgtttcagccgctaaggctgccaatattcacccttttatcgaaacattacctcataagtacgagactcgggttggtgacaaagggactcagctgagcggcggccagaagcagcgcatcgccatcgctagggccctaataaggcagccacagatcttactgctggacgaggccactagtgcccttgacactgaatcagagaaagtggtgcaggaggccctagacaaagctcgggagggccgtacctgcatagtcatcgcccatcgtctctctactatccagaatgccgatctcatcgtggtgtttcagaatggcagggtgaaagaacacggcacccaccagcagctgctagcccagaagggcatctacttctctatggtgtccgtgcaggctggaacccaaaacctg

SEQ ID NO: 7525 - DNA, 3858 bp, Artificial Sequence
  Description of Artificial Sequence: Synthetic coding sequence
atggatttggaagctgccaagaacggaactgcttggcgccccacctcggcagagggagacttcgaacttgggatctccagcaagcaaaagcggaaaaagaccaaaactgtgaaaatgatcggcgtgctgaccctcttccgatactccgattggcaggacaaactgttcatgtccttgggaactatcatggcaattgcgcacggctccggactgcccctcatgatgatcgtgttcggggagatgaccgacaagtttgtggacactgctggaaacttcagcttcccggttaacttcagcctgagcttgctgaatccgggaaagatcctggaggaagagatgaccagatacgcgtactactattccggactcggagcaggtgtcctcgtcgcggcgtatatccaggtatctttctggactctggctgcgggacggcagatccgcaagatccgtcagaagttctttcacgcaatcctccgccaagagataggctggttcgacatcaacgacacgactgagctcaacaccaggttgaccgatgacataagcaaaatctcagaaggaatcggtgacaaggtgggaatgttttttcaagcggtggcgacctttttcgcagggttcattgtcggttttatccggggatggaaactcactctggtgataatggccatttcaccaatcctgggactgtcggcagcggtgtgggcgaaaatcctttcggctttctcagacaaggaactggcggcatatgccaaggcgggggcggtggctgaagaagcactcggggcaatcagaactgtgatcgcctttggaggccaaaacaaggagctggagaggtaccagaagcacttggagaacgccaaggaaatcggtattaagaaagctatcagcgccaatatctcaatggggattgcgttcctgttgatctacgcatcatacgccctcgctttctggtacggatcaaccctcgtcatctcgaaagaatacaccatcggaaatgccatgaccgtgttcttctcaatcctgattggagccttctcagtcggacaagccgctccgtgcattgacgccttcgctaacgcccggggtgcggcatacgtgatcttcgatatcatcgacaataacccgaaaatcgactccttcagcgagcgcggccataagccggattccatcaaaggcaatctcgaattcaatgatgtccacttctcgtacccgagccgcgccaacgtcaagatcctgaagggactgaacctgaaggttcaatcaggccaaactgtcgctctcgttggcagttcgggatgcgggaagtcaactactgtccagttgattcagcgactgtacgaccctgacgaggggacgatcaatatcgatggacaagatatccgaaatttcaatgtgaactacctccgcgagatcattggagtggtgtcccaggagccggtgctcttctctactactatcgcagaaaacatctgttacggtcgaggtaacgtcactatggatgagataaagaaggccgtgaaagaagccaacgcgtacgaattcattatgaagttgccacagaagttcgacactctggtgggagagcgaggggcgcagctcagcggaggccagaagcagagaatcgctatagcgcgggcactcgtgaggaatccgaaaatccttctcctggacgaagcaacctcggcactggataccgaatctgaagccgaggtgcaagcagccttggacaaggctcgcgagggtagaacgaccattgttatcgcacatcgcttgtccactgtgcggaacgcagacgtcatcgccggcttcgaagatggagtgattgtggaacagggatcccattcggaactgatgaagaaggagggagtttacttcaaactggtgaatatgcagaccagcggcagccagatccagtcagaggaattcgagctgaacgatgaaaaggcggcaacccgcatggccccgaatgggtggaagtcacgccttttccggcactccacccagaagaacctcaagaattcccaaatgtgtcagaagtcgttggacgtcgaaactgacggtcttgaggccaacgtgcctccagtgtcgttcctgaaggtgcttaaacttaacaagaccgaatggccctacttcgtagtgggaaccgtctgcgcgatcgctaacggcggactgcagccagcgttctccgtcatcttctctgaaatcatcgccatcttcggaccgggagatgatgcggtgaagcagcagaagtgtaacatcttcagcctcatctttcttttcctgggaatcatctcgtttttcaccttcttcctgcaaggctttacttttggtaaagcaggcgaaatcctgacgaggcgcctgcggtctatggctttcaaggctatgctgcgtcaagatatgagttggttcgacgaccacaagaactcgacgggagcgctttcgaccagacttgccaccgacgccgcgcaggtgcagggagcaactggaactcggttggcgctgatcgcacagaacatcgccaatctcggaaccgggatcatcatttcgtttatctacggatggcaactgaccctgttgctgcttgccgtggtgcctatcattgctgtttccggtatagtggagatgaaactgctggccgggaacgctaaacgcgacaagaaagagctggaagcagctggaaagatcgccactgaagcaatcgaaaacatcaggaccgtggtttccctcactcaagagcggaaattcgaatcgatgtacgtcgagaagctctacgggccataccgcaattccgtgcaaaaggcgcatatctacgggatcactttttcaatcagccaagcctttatgtacttcagctacgccggctgctttcgcttcggagcgtacctgattgtgaatggccatatgagatttcgcgatgtcattctcgtgttctcagcaattgtgttcggggctgtggctctgggacacgcatccagcttcgcccctgattacgcgaaagcgaaactcagcgcggcccacctgttcatgctgtttgagcggcagccactcatcgactcatactccgaagaaggactgaagccagacaaattcgaaggtaacattacgttcaatgaggtggtgtttaactatcccactagggctaacgtcccggtcctgcaaggtttgtcgctggaagtgaagaagggacagactctcgctctcgtggggtcgtcaggatgtggaaaatcgaccgtcgttcagcttttggaaagattctacgatcctctcgccggcactgtgttcgtggacttcggattccagctcctcgacggccaggaggcgaagaaactgaatgtacaatggctgcgcgctcagctcgggatagtgtcgcaagaaccgatcctctttgactgctctattgccgagaacatcgcctacggtgataacagtcgcgtcgtcagccaggatgaaatcgtgagcgcagcaaaggccgcaaatatccatccttttatcgaaacccttccacacaagtacgagacgagagtgggagataagggtactcagctctccggcggtcagaagcagcggatcgccatcgcccgggcgctgattagacaaccgcaaatcctgctgctggacgaagcgacctccgctcttgacactgaatcggagaaggtggtccaggaggcgctggacaaggccagggaagggagaacctgcatcgtgatcgcccaccggctgtccaccatccaaaatgccgatctcatcgtggtatttcaaaatggaagggtgaaggagcacgggacccatcagcaactgctggcgcagaagggcatctacttctcgatggtgagcgtccaggccggaacccaaaacctc

SEQ ID NO: 7526 - DNA, 3858 bp, Artificial Sequence
  Description of Artificial Sequence: Synthetic coding sequence
atggacctcgaagcggcgaagaacggcactgcttggaggcccacgtccgcggagggcgactttgagctcggcatctcctctaagcagaagagaaagaaaaccaagacagtaaagatgattggagtgctgactcttttcagatactctgactggcaagacaagctgttcatgtctcttggcactataatggccattgctcacggtagcggtctccccttgatgatgattgtcttcggtgagatgaccgacaaattcgtggataccgcaggtaacttttcttttcctgtaaacttcagcctgtccctgctgaacccgggtaagatactggaagaggaaatgacgaggtacgcttactactattccggtttgggcgccggagtcctggtcgctgcctacattcaagttagtttttggacgctggccgctggtaggcagatcagaaaaataaggcagaaattcttccatgcgatccttagacaagagatcggatggttcgatatcaatgacacaacagaactgaatactaggcttacagatgacatctctaagatatcagagggtatcggcgacaaggtgggcatgtttttccaggctgttgccactttcttcgctggtttcatagttggattcatcagaggttggaaattgacgttggtcataatggctatttcaccaatcctgggtctctcagcggcagtctgggccaaaatcctctctgctttctcagacaaggagttggccgcctatgctaaggcgggagcagtggcggaggaagctctcggtgctattcgcacagttatagcgttcggtggtcagaacaaagagctcgagaggtaccagaagcacctggagaacgcaaaggagatcggcattaagaaggcaatctctgccaacataagcatgggcatcgcattccttttgatctacgcgtcatatgccctggccttctggtatggttccacactggtgatatctaaggagtacaccattggcaacgccatgaccgtatttttcagcatccttatcggcgctttcagtgttggacaagcagctccctgcatagatgccttcgccaacgccaggggtgcggcctatgttatctttgacatcatcgataataatccgaagatagattcattcagcgaaagaggtcataagcccgactcaataaagggcaacctggaattcaatgacgttcatttctcctacccttccagggcgaacgttaagatcttgaagggattgaacctgaaagtgcaaagtggccaaaccgtcgctctggtaggctccagcggatgcggaaagtctacaactgtccagctcatccagagactctacgaccccgatgagggcactataaatatcgacggtcaggacatccgcaattttaacgtgaactatttgagagagatcatcggcgtcgtttcccaagagcctgtcttgtttagtaccacgatcgccgagaacatttgttatggccgcggtaacgtgaccatggatgagatcaaaaaggccgtgaaagaggcaaatgcttacgagtttatcatgaagctgccacagaaattcgataccctcgtgggcgaaaggggtgcccaactttccggtggacagaagcaacgcatcgctatagcaagggcgcttgtgaggaatcccaagatcctcctgctggatgaagctacatctgcactggacactgagagcgaggcggaggtacaggcggcgctggacaaggctagagagggcaggacaaccatagttatagcacacagactgagcaccgtccgcaacgctgacgttatcgcaggctttgaagacggcgttatcgtggagcagggtagtcatagcgaactgatgaagaaggagggagtatacttcaagctggttaacatgcaaacttcaggatctcagatccagtctgaggaatttgagctcaatgacgagaaggctgcgaccaggatggcaccaaacggctggaaaagcaggctgttcagacacagcacgcaaaagaacctcaaaaatagtcaaatgtgtcagaagtccttggacgtggagacggacggtcttgaggccaacgtgccccctgtcagcttcctgaaggtcctgaagctgaacaaaaccgaatggccttactttgtcgtgggtactgtatgcgcgattgcgaacggaggtttgcaaccagccttctctgtcattttctctgagatcatagctattttcggacctggagacgatgccgtcaagcagcagaaatgtaacattttctccctgatctttttgttccttggtatcatctcctttttcacatttttcctccagggattcaccttcggcaaggccggcgagatcctgacccgcaggttgaggtctatggcttttaaagccatgctccgccaggatatgtcctggttcgacgatcacaagaactctaccggcgctctgtctacccgcttggccactgacgcggctcaggttcagggtgctacaggtaccaggctggcgctgatagcccagaacatcgccaacctcggaaccggtattatcatttcattcatctacggatggcagctcactctcctgctgctggctgtagtgcccattatcgcagtgtctggtattgtcgaaatgaagctcctcgctggtaacgctaaacgcgataagaaggagttggaagccgccggtaagattgcaaccgaagccatcgagaacattagaacggtggttagcttgacccaggaacgcaagttcgaatctatgtatgttgagaagctttatggtccatacaggaatagcgttcagaaggcgcacatatatggaattactttctctatcagtcaggcattcatgtacttctcttacgcaggatgcttcagatttggagcctacctgattgtcaacggccatatgcgctttcgcgatgttatcttggtgttcagcgccatcgtgtttggagctgttgcgttgggccatgctagtagcttcgcgcctgactatgctaaggccaaactgagtgccgcacacctgtttatgctctttgaacgccagccactgatcgactcatactctgaagaaggtcttaagcccgacaagttcgaaggtaatattacattcaatgaggtcgtattcaactaccctactagagctaacgtacccgtactgcagggcctgtcactcgaggttaagaagggtcagacactggcgttggttggctcctctggctgcggcaagtccaccgtggttcaactgctggaaagattttacgaccccctggccggaacagtgttcgtggatttcggcttccaactgctcgatggacaagaggccaaaaagctgaatgtgcagtggctccgcgcccaactgggcatcgtatctcaggagcccatcctcttcgactgttctatagctgagaacatcgcatacggtgacaactccagggttgtaagccaggatgaaatcgtgtccgccgccaaagccgctaacatccatccatttatcgagactcttccgcataagtacgaaaccagagtgggagataagggtacacagctgtccggcggtcagaagcaacgcatcgctatcgctagagccctgatcagacaacctcagatccttcttcttgacgaggcaacttccgcgctggacaccgagagtgagaaagttgtgcaagaggcactggacaaggctcgcgaaggacgcacttgtatcgtaatcgcccatcgcttgagcactatccagaacgcagacctcatcgtggtgttccaaaatggaagggtaaaggagcacggcacccaccaacagctgctggcccagaagggcatttactttagcatggtctctgtccaggctggcacccagaacttg

SEQ ID NO: 7527 - DNA, 3858 bp, Artificial Sequence
  Description of Artificial Sequence: Synthetic coding sequence
atggatctggaagcagccaagaacggtacggcctggcgtcctacttcagcggaaggagacttcgagttgggaatttcatccaagcagaagagaaaaaagactaagaccgtgaaaatgattggagtcctgaccctgttcagatactccgattggcaagataagctgttcatgtcgctgggtaccattatggctatcgcacatggctcgggattgccacttatgatgattgtgtttggagagatgaccgacaagtttgttgataccgcaggcaacttctcgtttccagtgaacttcagcctgtcccttctgaatcccggtaagattctggaagaagagatgactcgctatgcatactactactcggggctgggagcaggcgtgctggttgcagcatacattcaagtgtccttttggacccttgctgcgggtcgacaaataagaaagatcagacaaaagttttttcatgcaatccttaggcaagaaattggatggtttgacattaacgacaccactgagcttaatactagactgaccgacgacatcagcaagatttcagagggtataggagacaaggttggtatgttttttcaagctgtggccacgtttttcgccgggtttatcgtggggtttatacgaggatggaagctcaccctggtcatcatggcaatcagccctatactcggcttgagcgcagcggtgtgggccaagatcctcagcgcctttagcgacaaggaattggctgcatatgcaaaggcaggagctgtcgctgaggaagcccttggggcaattagaacggtcattgcatttggaggccaaaacaaggagctggagcgctaccaaaaacatcttgaaaacgcaaaggagattggaattaagaaggctatctcggcgaacatatcgatgggcattgcttttctgctgatttacgcctcgtacgcacttgcgttttggtacggatcgactctcgtgatttccaaggagtacactattggtaacgcaatgaccgtgttctttagcatccttatcggagcgttctcagtcggtcaagccgcaccatgtattgacgcttttgcaaacgcccggggcgcagcatacgtgatctttgatatcatagataacaacccaaagattgactcattcagcgagcgcggtcataaacctgattctataaagggaaacctcgagtttaatgacgtgcattttagctacccaagccgagccaacgtcaagattcttaaggggctcaatctcaaggtccaatccggacagactgtcgccctcgtgggaagctcaggttgtggaaaatcaactaccgtccagcttattcaacgcctttacgacccagatgaagggaccatcaacatagatggtcaagatatccggaactttaatgtgaattatctgagggagattattggagttgtgtcacaggaaccagtcctgtttagcacgaccatcgcagagaacatctgctacggacgtggcaacgtgactatggatgagattaagaaagccgtgaaggaagcgaacgcatacgagttcatcatgaagctgcctcaaaagttcgatacccttgtgggggagcgaggcgcacaactgtcgggaggccaaaagcaaaggattgcaatcgcaagagccctggtgagaaaccctaagattctccttctggacgaagcaacttccgccctcgatactgaatcagaagcggaagttcaagccgcgctggacaaggcacgcgagggaagaaccaccattgtgatcgcacatagactgtccacggtgaggaacgcagatgtcatcgcgggctttgaggatggcgttattgtcgaacaagggagccactcagaactgatgaagaaggaaggcgtgtactttaagctcgtcaatatgcagacctcgggttcgcaaattcaatcggaagaatttgaacttaacgatgagaaggcggcaacgcgcatggccccaaacgggtggaaatccagactgtttaggcattcgactcagaagaatctgaagaattcacagatgtgtcagaagagcctggatgtggagactgatgggcttgaagctaacgtgcctcccgtgtcatttcttaaggtgctgaaacttaacaagaccgaatggccttacttcgtggtgggaaccgtgtgcgccatagcaaatggaggactccaacccgctttttcggtcattttcagcgaaatcatagcaattttcggacccggagatgacgcagtgaaacagcagaagtgtaacatcttttcgctcatttttctgtttctcggaatcatttcgtttttcacgttctttctgcaaggtttcactttcggcaaagcgggggagatcttgactcggagacttaggagcatggccttcaaggcaatgctgagacaagatatgtcctggttcgacgatcataagaactcgactggggcactttcaacccggcttgcaactgatgcagcccaggtgcaaggagctactggaacccgacttgcactgatagcgcagaatatcgcaaacctcggaactggtatcattatctcgttcatctacggatggcaactcactctgctgctcctggccgtggtgcccattatagccgtgagcggcattgtcgagatgaaactgctggcaggcaatgcaaagcgtgacaagaaggagttggaggctgcaggaaaaatcgccaccgaagcaatcgaaaacattcgcactgtggtgtcgctcacccaggaacgcaagttcgaaagcatgtacgtggagaaactgtacggtccatacaggaatagcgtgcagaaggctcacatttacggtataacgttttccatttcccaagcatttatgtatttctcttacgccggatgcttcaggttcggcgcataccttattgtcaatggacacatgcgttttcgggatgtgattctcgtgtttagcgctattgtctttggcgccgtcgcactgggacacgcctcatcgtttgcacctgattacgcaaaagcaaaactctccgcagcccatctgttcatgctgttcgaaagacaaccccttatcgactcgtactccgaagaaggactcaagccggataagttcgaagggaacattacctttaacgaagttgtgttcaactacccaaccagagcaaatgtgcctgtgctgcaaggtctttcgctcgaggtgaaaaaaggtcaaaccctggcacttgtcggctcctccggctgtggtaaatccaccgtcgtgcaactccttgagcgcttctacgaccccctcgcgggtaccgtgtttgtggacttcggatttcaactgctggatggacaggaggctaagaagctgaacgtgcaatggctgcgggcccagctcggtattgtgagccaggagcctatcttgtttgattgttccattgcagaaaacattgcttacggagacaactcccgtgtggtcagccaagatgaaattgtgtccgcagcaaaggctgccaacattcacccttttatcgaaacccttccacataagtacgagactagagtcggtgataaaggaacccaactctcggggggacagaaacaacggattgccatagcacgggcactcattcgtcaacctcaaattcttctgctcgacgaagcgacttcggcgcttgacacggaatccgaaaaggtcgtccaagaagctctggataaggcgagagaaggaaggacgtgtattgtgatagcccataggcttagcacgatccaaaacgccgatcttatcgttgtgtttcagaacggacgcgttaaggaacatggaactcatcaacagctgcttgcacagaagggtatttactttagcatggtgtccgtgcaagccggtactcagaacctt

SEQ ID NO: 7528 - DNA, 3858 bp, Artificial Sequence
  Description of Artificial Sequence: Synthetic coding sequence
atggacttggaagctgctaagaacggcaccgcctggcgcccgacctctgcagagggcgattttgaattgggaatctcatccaaacagaaaagaaagaaaaccaagactgtaaaaatgataggcgtgctgacactgttcaggtactcagactggcaggacaagctctttatgagcctgggaaccatcatggctatcgcacatggatcaggacttccactcatgatgattgtattcggtgagatgactgacaagttcgtggatactgccggcaattttagttttcccgtcaacttctccctgtcattattgaaccctggaaagatcctggaagaggaaatgactcgttatgcctattactatagtgggcttggcgcgggcgtgctcgtggcagcatacatacaggtgtccttctggacgctagccgcgggaagacagatcaggaaaatacgtcagaagttcttccacgccatcctccgccaggagataggatggttcgatattaatgacacaaccgagctgaatacacgtctgaccgacgacatttctaaaatctctgaagggattggggacaaggtggggatgttttttcaggccgtggccaccttcttcgccgggtttatagtgggctttatccgagggtggaagctaacactggtgattatggctatttccccaattctggggttgagtgcggcagtctgggcgaagatactcagtgccttttctgacaaggaactcgctgcatatgcgaaggcgggtgcagtcgcggaggaagcacttggcgcaatccggaccgtcatcgcttttggcggtcagaataaggagcttgagcgatatcaaaaacacctagaaaatgcaaaggagatcgggataaagaaggccatcagcgccaatattagcatggggatagcctttttgttgatttacgcttcgtacgctctcgcgttttggtatggttctaccctcgtcatctcaaaagagtacacaattggcaacgcgatgactgtcttcttttcgattctgataggcgcttttagtgttgggcaggccgctccctgtattgatgcattcgccaatgcacggggcgccgcttacgtcatattcgacatcattgacaataacccaaagatcgattcatttagcgaacggggccacaagcccgacagcataaagggcaatctagagttcaatgatgtccacttttcttatccgtcccgtgcaaacgtgaagatactgaaggggttgaaccttaaagtgcagtccggtcagactgtagcacttgtgggatcttctggatgtggcaagtccacaactgtccagctgatccaacggctttatgaccccgatgaaggtacaatcaacatcgatggtcaggatattagaaactttaacgttaactatctcagagaaattatcggagttgtctcccaggagccagtcctttttagtacaacaatcgcagagaacatttgctatggcagaggcaacgttaccatggatgagatcaagaaagctgtgaaagaggccaacgcctacgagtttattatgaagcttccacaaaagttcgatacattagtcggtgagcggggggcacagctctcaggcggacaaaagcagcgcatagccatcgctagggctctggtgcggaatccaaaaatattgctattagacgaggctacttcagctcttgacacagaaagcgaggccgaagtgcaggccgctctggacaaagctagagaggggcgtactaccattgtgatcgcgcacagactgtccacggtgcgcaacgcggacgttattgccggctttgaagatggagtcatcgtcgagcaaggaagtcattccgagctgatgaaaaaggagggcgtttattttaagcttgtgaacatgcagacatcagggagccagatccaaagcgaggaattcgaattgaacgatgagaaggcagctacacgcatggcacccaacggttggaagagtcgcctcttccggcatagcacacagaagaatctgaagaactctcagatgtgtcaaaagtcattagacgtcgaaacagatgggttggaggctaatgtcccccccgtgtcgttcttaaaggtcctgaagctgaacaagactgagtggccctacttcgtcgtaggaactgtctgcgccatcgccaacggtggcttacagcccgcattttccgtcatcttttcagagatcatagccattttcggcccgggagatgatgccgtgaaacagcagaaatgtaacatcttttcactcatcttcctcttcctcggcatcatctccttcttcacattcttcctgcagggcttcacctttgggaaggcaggtgagatcctgacacggcggctcagatccatggcgtttaaggctatgctgcgtcaggatatgagctggttcgacgaccacaaaaattcaacgggcgcactgagtactagactggcaaccgacgctgcacaggtgcagggcgcaaccgggaccagactggctttgatcgcccagaacatcgccaacctgggtacagggattatcatttccttcatctacggctggcagttaactctgctgttgctggctgtggtgcctatcatcgcggtctcaggtatagttgagatgaagttgttggcaggtaatgctaagcgagacaaaaaggaactggaggccgcgggcaagattgccaccgaagccatagagaacatacgcaccgtggtgtcactgactcaggagagaaaattcgagtcaatgtatgtcgagaagttgtacggaccataccggaacagcgtccagaaggcgcatatctacggcattaccttttccattagtcaggccttcatgtacttctcgtacgcggggtgttttagattcggggcctacctcattgtgaacggtcatatgcgcttccgggacgtgatcctggttttttctgctatcgtgttcggagccgtggctttgggtcatgcgtcctccttcgcgcctgattatgcaaaagcaaaactgtccgccgcccacttgttcatgctgtttgagaggcaaccgctgattgatagctacagtgaagaaggtctgaagcccgataagtttgaaggaaatattaccttcaacgaggtggtgtttaattatcccacccgcgcaaatgtgcctgttctgcaaggcctgagcctcgaggttaagaagggccaaactctagctctggtggggagttcagggtgtggcaaatctaccgtggttcaactgctggaacgcttctatgaccccctggcaggaacggtttttgtcgactttgggtttcaactcctggatggccaggaagctaaaaaactcaatgtgcagtggctaagagctcagctaggaattgtcagccaggaaccaattcttttcgactgctctattgccgagaatatagcttatggggacaatagccgcgtggtctcgcaggacgagatagtgtctgccgctaaggctgcaaacatccatcccttcattgaaacactacctcacaaatatgaaactagggttggagacaaaggcactcagttgtctggcggacagaaacagaggatcgcgatcgctagagccctaatccgacagccccagatcctgctactggatgaggccaccagcgcactggacaccgagagtgaaaaagtcgtccaggaggccctggacaaagcgagagaaggacgaacttgtattgttatcgcccataggctctccacaattcagaatgccgacctcattgtagtcttccagaacgggcgagtgaaggagcacgggactcaccagcagctgctggctcagaaaggtatttacttttcgatggtttccgtgcaggccggcacccagaacctc

SEQ ID NO: 7529 - DNA, 3858 bp, Artificial Sequence
  Description of Artificial Sequence: Synthetic coding sequence
atggacctcgaagctgctaaaaacggaacagcgtggcgacccacctccgcagaaggcgactttgagctgggtataagtagcaagcaaaagcggaagaagacaaaaactgttaaaatgattggcgtcctgaccctattcagatacagtgactggcaggacaagctcttcatgtcactcgggacgataatggctattgctcacggatccggtctgccgttgatgatgatcgtgttcggggaaatgaccgataagtttgtcgacacggctggaaatttctccttccccgtcaacttttcactgagcctgctcaatccgggaaaaattcttgaagaagaaatgacacgatacgcctattattattccggtttgggcgccggcgtactagtcgcagcctacatccaagtaagcttctggacactggccgctgggcgacagatccgcaaaatccgtcagaaattcttccatgctatcctgagacaagaaatcggttggttcgatattaacgacactaccgaactcaacaccagactgacagacgacattagcaagatttccgagggcattggcgataaagtcggaatgttctttcaggcggtagcaaccttctttgcggggttcatcgtcggcttcattcgcggatggaaactcactctggtgattatggcgatttctcctattttaggactgtcagccgccgtatgggctaagatcctgtcagcgtttagtgacaaggaactggccgcatacgccaaagctggagccgtcgccgaagaagccttgggtgcaatcagaaccgtaattgcgtttggtggacagaacaaggaactcgagagataccaaaagcatctggagaacgcgaaagaaataggtattaaaaaagcgataagcgctaacatctctatgggtatcgcctttttgttgatctatgcttcctacgcacttgccttttggtacggatctacattggttatcagcaaagagtacaccatcggtaatgccatgacagtgttcttttcgatcctgattggagcgttttccgttggacaggccgccccatgtatcgacgcctttgcaaacgcgagaggtgccgcttatgtgattttcgacattatcgacaacaaccctaagattgattcgttctcagagagaggtcacaagccagactctatcaaaggtaacctggagttcaacgacgtacattttagctatccaagccgggccaacgtcaaaatactgaaaggcctcaacctgaaagtacagtcaggacaaacagtagccctcgtggggtcatcggggtgtgggaagagcaccaccgtgcaactgattcaaagattgtatgacccagatgaaggcacgatcaatattgatggacaagatatcaggaacttcaacgtaaactacttgagagagataatcggcgtggtgtctcaagaaccagtgctctttagcacaacaattgcagaaaacatatgttacggcagggggaatgttaccatggacgaaattaagaaagcggtcaaggaagctaacgcctacgaatttatcatgaaactgccccaaaagtttgacaccttggtgggagaaaggggagcgcagctaagcggtggccagaagcagcgcatcgcaattgccagagctctggtccgaaatcccaaaattttgctattggatgaagctacctcagccctcgacacagagtctgaggccgaggtgcaagctgcattagataaggccagagaaggacgcaccactattgttattgcgcaccgcttaagtacagtgcgaaacgcagacgtgattgcaggcttcgaagatggagttatcgtggagcagggcagccatagcgagctaatgaagaaggagggggtgtacttcaagttggtgaatatgcaaactagcggctcacagatccagtctgaggagttcgaactcaacgacgagaaagccgcgacccgtatggctccaaacggatggaaaagccgcctgttccgacattctacacagaagaacctgaagaattctcaaatgtgtcaaaaatctctggatgtcgagaccgacggactagaggcaaacgttccaccggtgagtttcctgaaagtgctgaaactaaacaagacggaatggccttattttgtggtgggcacagtttgtgcgattgcaaacggaggtctgcagccggccttttctgtgattttctctgaaattattgccatcttcggcccgggtgacgacgctgtgaagcagcaaaagtgcaacatcttcagcctcattttcctgtttctagggattatctcttttttcactttttttcttcaaggctttactttcgggaaggcaggagaaattctgactcgccgcctccgttccatggctttcaaagctatgttgagacaggatatgagctggtttgatgaccacaagaattccaccggcgccctgagcacgcgtctcgccaccgatgcagcccaagtacagggggccacagggactaggctggcgctgattgcccagaacattgcgaatctcgggaccggtatcataatttcattcatatacggctggcaactgacactcctactgttggcagtggtgcctattatcgctgttagcgggatcgtcgaaatgaaacttctggctggcaatgccaagagggacaaaaaagaactcgaggccgcggggaagattgcaactgaggccatcgaaaacatccgcacagtggtttccctaacacaggagaggaagtttgagagtatgtatgttgaaaaactctatggaccctataggaactctgtccagaaagcccacatatacggtatcacgttctcgatctcacaggcttttatgtatttctcatatgcaggttgtttcagattcggagcatatctaatagtcaacgggcatatgaggttccgagatgtgatcttggtgttctcagccattgtctttggtgcagtggcattgggacacgccagttcctttgcaccagactacgccaaagctaagctctccgcggcgcacctctttatgctgtttgaaagacagccacttatcgatagctacagcgaagagggcttgaagcccgataaatttgagggaaatattactttcaacgaagtggtgttcaactaccctacacgcgccaacgttcccgtcctccagggactgagcctcgaggtaaagaagggacagaccctggccctcgtagggagcagcggttgcggaaaatcaacggtggtccagttgcttgaaaggttctacgatccgctggcaggtacagttttcgtagactttggcttccagctgctcgacggtcaagaggccaagaaacttaatgttcagtggctgcgcgcccagctggggatagtgtcccaagagcctatcctattcgattgcagcatcgcagaaaatatcgcctatggagataactcacgtgtcgtgagtcaagacgagatcgtttccgctgcgaaagcggcaaacattcatccatttatagaaaccctgcctcacaagtatgaaacgagagtgggggataagggcacacagcttagcggcggccaaaaacagcggattgcaattgctagggccttgataaggcagccgcagatcttgctcctagacgaagccacaagtgccctagataccgaaagcgaaaaggtggtccaagaagccctggataaggccagagaaggcaggacctgtatcgtcatcgcacatcgtctgagtacgattcagaacgctgacctcattgtggtattccagaacggaagggtgaaggagcacggcacgcaccagcaactgctggctcagaagggcatttacttttccatggtcagtgtccaagcgggaacgcagaacctg

SEQ ID NO: 7530 - DNA, 3858 bp, Artificial Sequence
  Description of Artificial Sequence: Synthetic coding sequence
atggacctcgaggccgctaagaacggcaccgcctggcgtccgactagcgctgagggtgatttcgagcttggcatttctagcaaacagaagcgtaagaagaccaagactgtcaagatgattggtgtgctgaccctgttccgctacagcgattggcaggacaagcttttcatgtcgctcggcaccatcatggccatcgcgcatggctccgggttgcccctgatgatgattgtgttcggcgagatgaccgataagtttgtcgatactgccggtaacttctctttcccggtcaacttttctttaagtttgctcaatccaggcaagattctggaggaggagatgacccgctatgcttactactactccggtttgggtgcgggcgtactcgtcgccgcctacatacaagtgtctttctggaccttagcggccggtcggcagatcaggaagatccgccagaagttcttccacgccatactgcgccaggaaatcgggtggttcgacatcaacgatacgactgagctgaacacacggctgactgacgacatttccaagatctcggagggcattggtgataaggtcggcatgttcttccaggccgttgcgacgttctttgccggtttcattgtcggtttcattcgtggctggaagctcacgctggtcatcatggcgattagccccattctgggtctctcggcagccgtctgggccaagattttgtctgccttctcggacaaggagctcgccgcgtacgctaaggccggtgccgtcgctgaggaggcgctgggtgcgatccgcaccgttatcgcgttcggtggtcagaacaaggagctcgagcgctaccaaaagcatctcgagaatgcgaaggagatcggtatcaaaaaggccattagtgcaaacatctcaatggggatcgcgttcttgttgatctatgcctcctatgcgctcgctttctggtacggtagcactcttgtcatttccaaggaatacaccatcggtaacgcaatgactgtgttcttttcgatcctcatcggtgccttcagtgttggacaggcagctccctgcattgatgctttcgccaacgcccgcggcgctgcttacgttatcttcgatatcatcgacaataacccgaagattgattcctttagcgagcgtggccacaagcccgactccattaaggggaacttggaatttaacgatgttcatttctcgtaccctagccgcgctaacgtaaagatccttaaaggtcttaacttgaaggtgcaatccggtcagaccgtcgctttagtgggctcctctggctgcggtaaatctacgacggtgcagctcattcaacgtctttacgaccccgatgaggggactatcaacattgacggtcaggacattcgaaacttcaacgttaactacctccgtgagataattggggtcgtgtcgcaggagcctgttttgtttagtaccactatcgctgagaacatctgctacggtcgcggcaacgtcaccatggacgagatcaaaaaggctgtcaaggaggccaacgcttatgagtttatcatgaagctaccccaaaagttcgacactctcgtgggcgaacgaggggcccagttgtctggaggccagaagcaacgtatcgccatcgctcgtgcactcgtcagaaaccccaagatcctcttactggacgaggcgacttcggccttggatactgaatctgaggctgaggttcaagccgcgctggataaggcccgtgagggacggactaccatcgtgatcgcgcaccggctctcgacggtccggaacgctgacgtgattgctggcttcgaggacggagtcattgtagagcagggtagtcactccgagcttatgaagaaggagggtgtatactttaagcttgtgaacatgcaaacatcgggctcccagatccaatccgaagagttcgagcttaacgacgaaaaggctgctacccgcatggcacccaatggctggaagtcgcgcctgttccgccattccacgcagaagaacctgaagaatagccagatgtgtcagaaatccctggatgtggaaacagacggcttggaggccaacgtaccccctgtcagcttcctgaaggtcctgaaattaaataagaccgaatggccctatttcgtcgtgggtaccgtttgcgccatcgctaatggtggcttgcagcccgctttctcggtcatcttctctgagattatcgctatctttggacctggtgacgacgcggtgaagcaacagaaatgcaacatcttcagtctgattttcctctttctaggcattatctcgttcttcaccttcttccttcagggttttaccttcggaaaggcgggcgaaatcctcactcgcaggttgcgttcgatggcttttaaggcaatgctccgccaggacatgtcgtggttcgatgaccacaagaacagcactggcgctctttccacccgccttgccactgacgctgcccaggtccagggggccaccggcaccagactggccctcatcgcccagaatattgcaaacctcggcaccggaatcatcatctcattcatctatggttggcagctcaccctactcctcttggccgtcgtgcccattattgcggtgtccggaatcgtagagatgaagctgctcgctggtaatgctaagcgcgataagaaggaattggaggccgcgggcaagattgcgaccgaggctatcgagaacatccgcacagtcgtcagtctgacccaggagcgaaagttcgagtctatgtacgttgagaagttatacggaccgtaccgcaactcagtccagaaggctcatatttacggcatcaccttctccatttctcaggcctttatgtatttttcctacgcgggctgcttccgctttggcgcctatctcattgtcaacggccatatgcgatttcgcgatgttattctggtcttctccgcgattgtttttggggccgtggccctgggccacgcgtcctcttttgctccggattacgcgaaggccaagctttcggccgcccaccttttcatgctcttcgagcgtcagcctctcatcgattcctattcggaggagggattaaagccggacaagtttgagggcaacatcacattcaacgaggtcgtgttcaactacccaaccagggccaacgtccctgtcttgcagggcctttcgctcgaggtcaagaagggccaaacactcgccttggtcggttcttcgggatgcgggaaatccactgtcgttcagttgctcgagcgcttctacgaccccttggccggaaccgtgtttgtcgacttcggcttccaactgttggacggccaggaggccaagaagctaaatgtgcagtggctccgggcccagctcgggattgtttcccaggaaccgattctgttcgactgctcaatcgcggagaatatcgcctacggcgataactccagggtcgtttcccaggatgagatcgtgtctgccgccaaggctgctaacattcatccatttatcgagaccctgcctcacaagtacgagacccgggtcggtgataagggcacccagctgtctggtggccagaagcagcgtatcgccatcgcgcgcgctctcatccggcagccgcagatccttctcctggacgaggctacctcggccctagacaccgagagcgagaaagttgtccaggaggcactcgacaaggctcgtgagggccggacgtgcatcgtcattgcccaccggctctcaacaattcagaacgcggatctcatcgtggtgtttcagaacggacgcgttaaggaacacggaacgcaccagcagctattggcacaaaagggcatttacttctctatggtctccgttcaggccggtactcagaacctc

SEQ ID NO: 7531 - DNA, 3858 bp, Artificial Sequence
  Description of Artificial Sequence: Synthetic coding sequence
atggatcttgaagcagcaaagaatgggaccgcatggcgtcctacctcggcagaaggagactttgaactggggatttcctccaagcagaaaagaaaaaagactaaaactgtgaaaatgattggtgtcctgacccttttccgctactcggattggcaagacaagttgttcatgtcccttggaaccattatggctatcgctcacggatctggactgccactcatgatgattgtctttggagaaatgaccgacaagttcgtcgacaccgcaggcaactttagcttcccagtgaacttttcattgtcactgcttaaccctggcaagattctggaagaagagatgacgaggtacgcgtactactactccgggcttggagcaggggtcctcgtggcagcatacattcaagtctcattttggaccctggcagcaggacgacagatccggaagattaggcagaagttttttcatgcaatccttcgacaagaaatcggatggtttgatatcaatgacaccactgagcttaatacccggctgacggatgatatatccaagatatccgaaggcatcggagataaggtgggaatgttctttcaggcagttgcgactttctttgcaggattcatagtgggattcattagaggatggaagctcaccctcgtgatcatggcgatttcgcctatcctcggtctttcggccgccgtgtgggcaaaaatcctgtccgcatttagcgacaaggaactcgccgcatacgcaaaggctggggccgtcgcagaagaagcactgggcgcaatccgaaccgtcatcgcatttggtggtcaaaacaaggagcttgagcgctaccagaaacacctggaaaatgctaaggagattggcattaagaaggcaatttcggcaaatatctcaatgggtatcgcatttctgctcatttacgcatcgtacgcacttgcattttggtacggttcgactcttgtgatctcgaaggagtacactattggaaacgccatgactgtgtttttctccatactgattggggcattctctgtgggtcaggcggctccttgcattgacgcctttgccaacgcaagaggtgccgcgtatgtgatttttgatatcatagacaacaacccaaagattgattcgttttccgaacgggggcataagcctgactcgatcaagggcaatctcgagttcaatgacgtccatttctcgtacccttcacgtgccaacgtcaagattcttaagggtcttaaccttaaggtgcaaagcgggcaaacggtggcactcgtcggctcgtcaggctgcggtaagtcgaccactgtccaactgatacaacgcctctacgatccagatgaaggaactatcaacattgatggacaggatattcggaactttaacgtgaactacctgcgggagatcattggagtggtgtcgcaggaacctgtgctgttcagcactactattgcagaaaacatctgctatggacgaggaaacgttaccatggatgagattaagaaggccgtgaaagaagcaaacgcgtacgagtttatcatgaagctcccacaaaagttcgacactttggtgggagaacgtggtgcacaactgtccggcgggcagaagcagcggattgcaattgcgcgcgcacttgtgcgtaacccaaagatactgctgctcgatgaagcgacctcggcccttgatactgagtcggaagccgaagtgcaagcagcccttgacaaagccagggagggccgaactaccattgtcattgcccatcgcctttccactgtgcgtaatgccgatgtgattgccggtttcgaggacggtgttattgtagaacaaggaagccactcggagttgatgaagaaggagggcgtgtactttaaactcgtcaacatgcaaacctcgggatcccaaattcaatctgaagaattcgagctcaacgatgagaaagccgcaaccaggatggctcccaatggatggaagagcaggctcttcagacactcgacccaaaagaacttgaaaaactcgcaaatgtgtcaaaagtcccttgacgtcgaaaccgatggtcttgaggcaaacgtcccacctgtctcctttctcaaagtgctgaagctcaacaaaaccgaatggccctacttcgtggtgggtactgtctgcgcaatcgcaaacggtggacttcaaccagcattttcagtcattttcagcgagataattgcaatctttgggcctggagacgatgccgtcaaacagcaaaagtgtaacattttctcccttatctttcttttcctcggcataatcagctttttcacgttctttcttcaagggttcacctttggtaaggccggggaaattctgactaggcgtctccgaagcatggcttttaaggcaatgttgcgccaggatatgtcttggtttgatgatcacaaaaacagcaccggtgccctttccaccagattggcaactgatgcagcacaggtgcagggagcaaccggtactcggcttgcactgatcgcacagaatatagccaacctgggaactgggatcattatctcgttcatttacgggtggcagcttaccctcctgctcttggcagtggtccctattatcgccgtgtcgggaattgtcgagatgaagctgcttgccgggaacgcaaaacgggataagaaggagcttgaagcggctggcaagattgcgacggaggctattgagaacatccgaaccgtggtgagcctcacccaggaaagaaagtttgaaagcatgtacgtggaaaagctctatggaccataccgcaactcggtgcagaaagcacacatctacggaatcaccttttcaatttcacaggcattcatgtacttctcgtacgccgggtgttttcgattcggcgcatatctcatcgtgaatggtcatatgcgtttcagggatgtgattcttgtgttctcggcaatcgtgtttggagctgtggctctgggccatgcctccagcttcgcacctgactacgcaaaagcaaaactctcggctgctcatttgttcatgcttttcgaaagacaaccacttatcgactcatactccgaagaagggctcaaacctgataagtttgagggtaacataaccttcaacgaagtcgtgttcaactaccctacccgagccaatgtgcctgtgcttcagggtctgtcgctggaagtgaaaaagggacagacgctggctcttgtgggttcctcggggtgtggtaagtcaaccgtggtgcagctgctcgagaggttttacgatcctctggcaggtaccgtgtttgttgatttcggttttcagctgctcgatggacaagaagcgaagaagctgaatgtgcaatggctgagagcgcaactgggcatcgtatcacaagagcctattctttttgattgttccatagctgaaaacatcgcctacggggataattcccgcgtcgtgtcacaggatgagattgtgtccgcagcaaaagcggcaaacatccatccattcatagagactctgcctcataagtatgaaacccgggtcggagacaaagggactcaattgtcgggaggccagaaacaaaggatagcaattgcaagggcccttatcagacagccccaaattctcttgcttgatgaggcaacctcagccctggataccgaatccgaaaaggtggtgcaggaagcgctggataaagcgagggagggaagaacgtgtatagtcattgcacataggctgtccactatacagaacgcagacctgatagtggtgtttcaaaacgggcgggtgaaagagcatggaactcatcaacaactgctggcacaaaagggaatttacttctcgatggtgtcagtgcaggcagggactcaaaatctg

SEQ ID NO: 7532 - DNA, 3858 bp, Artificial Sequence
  Description of Artificial Sequence: Synthetic coding sequence
atggatctggaagcagcaaagaatggcaccgcctggaggccaacgagcgcagaaggcgatttcgagctgggaatctcctcaaaacaaaaacgcaaaaagacgaaaacggtcaagatgatcggagtcttgaccctgttcagatattctgattggcaggataaactcttcatgtccctggggaccatcatggccatcgcgcacggaagcggcctgcctctgatgatgattgtctttggtgaaatgaccgataagttcgtcgacactgccggtaacttttcgttcccagtcaacttttcgctgtccctgctgaatccgggtaaaatcctggaagaggagatgacccgctacgcctattactactcaggactgggggccggagtgctggtggctgcgtacattcaggtgtcattctggactttggcagccggacgccaaatccggaaaatcagacagaagtttttccacgccatcctccggcaggaaatcggctggtttgacattaatgacactactgaactgaatactcgcctgactgatgatatctcaaaaatctccgaaggaattggagacaaggtcggcatgttcttccaagctgtggcaaccttcttcgcaggattcatagtgggcttcatcagggggtggaagctgactctggtgatcatggcgatctcacccatcctgggcctctcggccgcggtctgggcgaagatactgtcggccttctccgataaggaactcgcggcctacgcaaaggctggggccgtcgctgaagaggctctgggcgccatcaggactgtcatcgccttcggcggccagaacaaggaacttgagaggtaccagaagcatctggagaatgcaaaggaaattggaatcaagaaggcaatttccgccaatatctcgatgggaatcgccttcctcttgatctacgcctcgtacgcgctggcattctggtacggttcaacgctcgtcatctcgaaggagtatactattgggaatgcaatgactgtgttcttctccatcctcatcggagcttttagcgtgggtcaagccgctccctgtattgacgcctttgcgaatgcccgcggggcggcttacgtgatctttgatatcatcgacaacaatccaaagatcgacagcttttcagaaaggggtcataagcccgactccatcaagggaaacctcgaattcaacgatgtgcatttctcctatccttcaagagccaacgtcaagatcctgaagggactgaatctcaaggtccagtcaggacaaactgtggctcttgtcggatcctcaggctgcggaaagtccactaccgtccagctcatccagaggctgtatgaccctgatgaaggcactattaacatcgatggtcaggacatccgcaacttcaacgtgaactacctcagagaaatcatcggggttgtgtcacaggagccggtgttgttctctactaccatcgcggagaatatctgctacggacggggcaatgtcaccatggatgaaatcaaaaaagcggtgaaggaagcgaatgcctacgagtttatcatgaagctgccgcagaagttcgacactctggtgggggaaagaggcgcacagctgtccggtggacagaaacagagaatcgctatcgctcgcgccctggtcagaaaccccaagattctcctgctggatgaggccactagcgccctcgacaccgagagcgaagcggaggtccaggccgctctcgacaaggcccgcgaaggaagaaccaccatcgtgatcgcccatagactgagcactgtgcggaacgcagacgtcatcgcagggttcgaagatggagtgatcgtggaacagggttcgcactccgagctcatgaagaaggaaggggtgtacttcaagctcgtgaacatgcaaacctccggctctcaaattcaatcggaggaatttgaattgaacgatgaaaaagcggctactagaatggcccctaacggttggaagagcaggctgtttcgccactcgacccagaaaaacctcaagaattcgcagatgtgccaaaaatcgctggatgtggagacggacggactggaggcaaatgtgccaccggtcagctttctgaaggtgctcaagctgaataagaccgaatggccgtactttgtggtgggcaccgtgtgcgccattgccaatggaggactccagccagcgttctcagtcatctttagcgagatcatcgcgatcttcggccccggagacgacgccgtgaagcaacagaagtgcaacatcttctcgctcatcttcctcttcctcggaatcatttcattcttcaccttctttttgcagggctttaccttcggcaaggccggagaaatcctcactcgccgcctccgcagcatggcgtttaaggcgatgttgaggcaggatatgtcgtggttcgatgatcataagaattccaccggtgctctgtccaccagattggctaccgatgcagcccaggtccagggggccactgggacccggcttgccctgattgcgcagaatatcgcgaatctgggcacgggaatcataatctctttcatctacggctggcaactgaccctccttctgctggcagtggtgcctattatcgcggtgtccggaattgtcgaaatgaaactgctggcaggtaacgcaaagcgcgacaaaaaggagctggaagccgcgggtaagatcgcaactgaggccatcgagaacatccggacggtggtcagcctgactcaagaaagaaagttcgaatccatgtacgtcgaaaagctgtacgggccgtacaggaattcagtccaaaaggcgcacatctacggaattaccttctcgatctcgcaagcattcatgtacttctcgtatgcaggatgcttcaggttcggagcatacctgatcgtgaacggccacatgcggtttcgcgatgtgatcctcgtctttagcgcgatcgtgttcggcgcagtcgctctgggacacgcctcgtcgttcgcccccgactacgctaaagcaaagctgtcagcggcgcacctgttcatgctgttcgagcgccagcctctgattgactcctactccgaagaggggctgaagcctgataagttcgagggcaacatcacgttcaatgaagtggttttcaactacccgactcgggcaaatgtaccggtgctgcaaggattgtcccttgaagtgaagaagggacagaccttggctctggtgggatcgtccggttgtggaaagtcaactgttgtgcagctgctggagagattttacgaccctctcgcagggaccgtgttcgtggacttcggattccaattgctcgacggacaagaagccaagaaactgaacgtgcagtggctgcgcgcacagctcggcatcgtgtcccaagaaccgatcctgtttgactgttccatcgcggaaaacatcgcctacggagacaactccagagtggtatcgcaggatgaaatcgtgtcggcggcaaaggctgccaacatccaccccttcattgagactttgccacacaaatacgaaactcgggtgggagacaagggaactcagctgtcggggggacaaaaacagcggatcgccatcgcgcgcgcgctgatccgccagccgcagatcctgctcctggacgaggctacctcggccctggacactgagtctgaaaaagtcgtgcaagaagccttggacaaggccagagaaggaagaacgtgcatcgtcattgcacatagactctcgaccatccagaacgccgaccttatcgtggtctttcagaacgggcgcgtcaaggaacatggaactcatcagcagctccttgcacagaagggaatttacttctccatggtcagcgtgcaggcaggaacccagaatctg

SEQ ID NO: 7533 - DNA, 3858 bp, Artificial Sequence
  Description of Artificial Sequence: Synthetic coding sequence
atggatctggaggccgccaagaatggcactgcctggcgcccgacgtctgcggaaggcgatttcgaactgggcatctcctccaagcagaagcggaagaaaacgaaaaccgtgaagatgattggcgtgctgactctgttccggtactctgactggcaagacaagttgttcatgtcactgggaaccatcatggctatcgctcatggttcgggcctcccattgatgatgatagtgttcggagaaatgacggacaagttcgtcgataccgccggaaacttcagcttcccagtcaatttctcactgtccctgctgaaccccggaaagattctcgaagaggaaatgactaggtacgcatactactactcgggcctgggagcgggcgtccttgtcgccgcctatatccaagtctcgttctggacgctggcagccggacgccaaattcgcaagattagacagaagttcttccatgccatcctgaggcaggagatcggctggttcgatatcaatgacactaccgagctcaacacgcgcctgactgacgacatctccaagatctcggagggaatcggagacaaggttggaatgttcttccaggcagtggctaccttctttgcaggtttcatcgttgggtttatccgcggatggaagctgaccctcgtcatcatggccatcagcccaatactggggctgtcagccgccgtgtgggccaagattctctccgcgttctccgataaggaattggcggcttacgcaaaggccggggcagtcgccgaagaagcgctgggagccatccggaccgttattgcttttggaggacagaacaaggagcttgaacgctatcagaagcacctcgagaatgccaaggaaatcggtatcaaaaaggcgatctccgcgaatatctcgatgggcatcgcattcctgctcatctacgcctcgtacgccctcgccttctggtacggctccacgctggtcatcagcaaggaatataccattgggaacgcgatgactgtgtttttctcaatcctgatcggagcgttttcagtgggacaggcggcaccttgcatcgacgcgttcgccaacgcccgaggagcagcctacgtcatctttgacatcatcgacaataacccaaaaatcgattcattctccgaaagaggacacaagcctgacagcatcaagggaaacctcgagttcaatgacgtgcacttctcataccctagccgggccaacgtgaagatcctgaagggtcttaacctcaaggtccaatcgggacagacggtcgcgctggtgggcagctcggggtgcggaaagtccactaccgtccagctgatccagcggctctacgacccggacgagggaactatcaacatcgatggacaggacatccggaatttcaatgtgaactacctccgcgaaatcatcggggtcgtgtcgcaagaaccggtgctgttctcgactaccatcgccgagaatatctgctacggaaggggaaatgtgacgatggacgaaatcaagaaagcagtgaaggaagcaaacgcgtacgaattcatcatgaagctgccacagaaatttgataccctcgttggggagcggggagcgcagctgagcgggggacaaaagcagcggattgccatcgcaagggccctcgtgcgcaaccctaagatccttctgctcgatgaagccacgtccgcactggatacggagtccgaggcggaagtccaggccgctctggacaaggcgcgggaggggcgcaccaccatcgtcattgcccatagattgagcactgtgaggaacgcagacgtgattgcaggattcgaagatggagtgatcgtggagcagggctcgcatagcgagctgatgaaaaaggaaggcgtgtacttcaagctcgtcaacatgcagacctccggaagccaaatccagtccgaagagtttgaactgaacgacgaaaaggctgcgactaggatggcgcctaatggttggaaatcccgcctgttccgccactcaacccagaagaatctcaaaaactcgcagatgtgccagaagtccctggatgtcgaaactgacggactcgaggcgaacgtcccgcctgtatcatttttgaaggtgctgaaactgaataagactgagtggccgtacttcgtcgtgggaaccgtgtgcgctatcgccaacggagggctgcagccagcatttagcgtgatcttttccgagatcatcgccattttcggaccgggtgatgacgctgtcaagcaacagaagtgcaacatcttctccctgatctttctgttccttggcatcatcagcttcttcacgttcttcctccagggattcaccttcggcaaagccggcgaaatcctgacccgcagactccgctcgatggcgttcaaagctatgttgcgccaggacatgtcgtggttcgatgaccacaagaattcaacgggtgctctgtcgaccaggctggcaactgacgctgcccaggtccaaggagccaccggcacccggttggccctcatcgcccagaatatcgcgaacctcggaaccggaattatcatttcattcatttacggatggcaactcactcttctccttctggcagtagtgccgatcatcgcggtgtccggtatcgtcgagatgaaacttctggccggaaacgctaagcgggacaagaaagagctggaagcagccggcaagatcgctaccgaagccatcgaaaacatccggactgtggtgtccttgacccaagagcgcaagttcgagtccatgtacgtggaaaagttgtacggcccataccggaattcggtgcaaaaggctcatatctacggcatcactttctccatctcacaggcttttatgtacttcagctacgctggatgcttcagattcggagcatacctgatcgtcaatggccacatgagattccgcgacgtcatcctggtgttcagcgcgatcgtttttggagccgtggccctgggccacgcatcctcgttcgcaccagattacgccaaggcaaaactctccgcagcccatctgttcatgctctttgagcggcagccccttatcgattcgtactccgaagaaggactcaagcctgacaaatttgagggaaatatcacttttaacgaagtggtgttcaattatcccacccgggccaatgtgccggtgctgcagggccttagcctcgaggtcaaaaagggccagaccttggccctggtgggaagctcaggctgtggcaagtcgaccgtggtgcaattgctggaacggttctacgaccctctggcgggaactgtatttgtggattttggattccagctgctggacggacaagaagccaagaaactgaatgtgcagtggttgcgcgcacaactgggcatcgtgtcccaagagccaatcctgttcgactgcagcattgcggaaaacattgcctacggggacaattcccgggtggtgtcgcaggatgagatcgtctccgccgccaaggcggccaatatccatcctttcatcgagactctcccgcacaaatatgagactagagtcggcgataaagggactcaattgagcggtggccagaaacagcgtatcgcgattgcaagagcactgatcagacagcctcagattttgctcctggatgaggcaaccagcgccctggataccgaatccgagaaggtggtgcaggaggcgctcgataaagcgcgcgagggaagaacttgcatcgtgattgcacaccggctgtccactatccagaatgcagatctcatcgtcgtgttccagaacgggcgcgtgaaagaacacggcacccaccagcaactgctggcccaaaagggaatctacttctccatggtgtcagtgcaagcaggtactcagaatttg

SEQ ID NO: 7534 - DNA, 3858 bp, Artificial Sequence
  Description of Artificial Sequence: Synthetic coding sequence
atggacctggaggccgcgaagaatggcacagcctggcgaccaacctcggcggagggagacttcgagctgggcatttcgtccaagcaaaagcgcaagaaaactaaaacagttaagatgattggcgtcctgacgctgttccgatacagcgactggcaagataagttgtttatgagcttaggaacaattatggccattgcacatggttccggcctcccgttgatgatgatcgtatttggcgagatgactgataagtttgtcgacaccgctggaaatttttctttccccgtaaactttagcctaagcctgctgaacccaggtaaaatcttggaggaagagatgacacgttacgcgtattattattcgggactcggtgcgggagtcctagttgccgcctacattcaggttagtttctggaccttggccgcaggacggcaaatcagaaaaatcagacagaaatttttccacgccatcctgagacaggagatcggctggttcgacatcaacgatactactgagctcaataccagactgaccgacgatatctcgaagatctcagagggcattggcgataaggtgggtatgttctttcaggctgtggccacgttcttcgcaggcttcatagtcggattcatccgtggttggaagctgaccctggtaattatggcgatctcccctatactgggattgagcgccgccgtgtgggccaagatcctctcggctttttccgataaagagttagcagcgtatgccaaagccggggccgttgcggaagaggccctgggcgccattcgcaccgttattgcatttggtggccaaaataaggagctggagcgttaccagaagcacctggagaacgcaaaagagatcgggattaagaaggcaataagtgccaatattagcatgggtatagccttcctgctcatctacgcgtcttatgcgctggctttctggtatggaagcacattggtgatttcgaaagaatacaccatcggcaatgccatgacagtattcttctctattctgataggcgcattttcggtgggtcaggccgccccctgtattgacgccttcgcgaacgcgcgtggcgccgcgtatgttatttttgacatcatcgacaataacccaaaaatagactccttcagtgaaagaggacataagcccgatagtatcaaaggcaatctagaattcaatgatgttcatttctcctacccatcccgggccaacgtcaagatcctgaagggcttgaacctgaaggtccaatccggccagaccgttgctctggttggatcttccggttgtggtaagtcaacaacagtgcaactcatacagcggctgtatgacccggatgaaggcaccatcaacattgacggacaagatatacgaaattttaacgtgaactacctaagggagatcattggcgtcgtgagccaggagcccgttctgttcagcacgaccattgccgagaacatatgctacggacgcggtaacgtgacaatggatgagatcaagaaagcggttaaggaggcaaacgcctacgagtttatcatgaaactgccgcaaaagttcgatacgctggtaggcgagcgcggcgcacagttgtcaggcggccagaaacagaggatcgccatagcccgtgctttagtcagaaatccgaaaatattactgttagacgaagccaccagtgctctggatacggagtcggaagccgaggtacaggcggcccttgataaagcccgcgaaggtaggaccacaatcgtgattgcgcatcggctgagcactgtgcgcaacgccgatgtcattgcaggatttgaggacggcgtcattgtcgagcagggtagtcactcggaattgatgaagaaggagggagtgtacttcaaactcgtgaatatgcaaacgagcggctcgcagatacaatcggaagagtttgaactcaacgatgaaaaggctgccacgcgaatggccccgaacggatggaagtcccgcctgtttaggcactccactcagaaaaatctgaagaactcgcagatgtgccaaaagtcgttggacgttgaaaccgacggactggaggcaaacgtccccccggttagtttccttaaggtcctaaagctcaataaaaccgaatggccatacttcgtggtcggcacagtgtgtgccatagcaaacggcgggcttcagcccgcttttagcgtgattttctccgaaatcattgctatatttggtcccggagatgacgcagtgaagcagcagaagtgtaacatattttcgttaattttcctgtttctgggtatcatcagtttcttcacgttcttcctccaaggctttacttttggtaaagccggtgagatcttgacacgccgcctgcgttccatggctttcaaagcaatgctcagacaggatatgagctggttcgatgaccacaaaaatagcactggcgcactgagtacgcgcctggccaccgatgcagcccaagtgcagggcgccacggggacccgactggctttgattgcccagaacatcgcaaacctgggtaccggtattatcatttccttcatttacgggtggcagcttacgctgctgcttctagccgtcgttccgataatcgcagtcagcggcattgttgaaatgaaattgttagcgggcaacgcgaagcgagacaagaaggagctggaggcagctggaaagattgccaccgaggccatcgagaacattcgtacggtggtcagcctaactcaggagcgaaagttcgaatcgatgtacgtggagaagctatatggcccttatcggaactcggtgcaaaaggcacatatatatggcatcactttcagcatcagccaggcgttcatgtacttcagctacgccggctgcttcagattcggcgcctacctgatcgtgaatggacacatgaggttccgtgacgtgatactggtgttttcagcgatagtgtttggagcggtggctctgggtcatgccagctcattcgcccccgattatgctaaggcaaagctcagcgctgcacacctgtttatgctgttcgaaaggcagccactgatcgactcgtactcggaggagggactcaaaccagataagtttgagggcaatataacatttaacgaagtggtgttcaattaccccacgagggcaaatgtgcctgtattgcagggcttgagtctggaggtcaaaaaggggcagacgctcgcccttgtaggatcaagtggatgcggtaaatcaactgtggtgcagctattggagcgcttttatgatccgttggcaggaacggttttcgtcgactttggctttcagttgctggatggccaggaggcaaagaaactgaatgtccagtggctgcgcgcgcagctgggaatagtatcccaggagcccatcttgttcgattgttccattgccgagaatatcgcatacggtgacaattcccgcgtggtgtcacaggacgagatagtgtccgccgcgaaggctgctaatatccacccgtttatcgaaacactcccccataagtacgaaactcgggttggggataagggcacgcagttaagtggcggccagaagcagaggatcgccatcgcacgggcgctgattcgtcaaccccagatactacttctggatgaggccaccagcgcactggatacagaatcagagaaggtggttcaggaggctctcgacaaggcccgcgaggggcgcacctgcatcgttatcgcccaccgcctgagtacaattcaaaacgctgacctaattgtggtcttccagaacggacgtgtgaaggagcatggcacacaccagcaactgctagcacagaaaggaatctattttagtatggtttcggtccaggctggaacccagaatctg

SEQ ID NO: 7535 - DNA, 3858 bp, Artificial Sequence
  Description of Artificial Sequence: Synthetic coding sequence
atggacctggaggcagccaagaatggcactgcctggcgccctactagcgctgaaggtgacttcgaactgggaatctcatctaagcagaagagaaagaagacaaaaactgttaaaatgatcggcgtcttgacgctgttccggtacagtgattggcaggataagttgtttatgagcctcgggactattatggcaattgcacacggttcggggcttcctctcatgatgatcgtgtttggcgagatgacagataaatttgttgacactgccggcaacttctcgttccccgtcaatttcagcctgtctctgttgaatccagggaaaatccttgaggaggagatgacccgatacgcttattactattccggactaggagccggtgtgctggtagctgcttatattcaggtctctttctggacccttgccgccgggaggcagatccgcaagatccgtcaaaaattttttcacgccattctgagacaggaaataggatggttcgatataaatgacaccactgagctaaatactcgactgaccgacgacattagtaaaatatcagaaggcattggagacaaagttggcatgttttttcaagctgtggctacattctttgccggattcattgttggcttcatacggggctggaagttgacacttgtcatcatggctatcagtcctattctcggactgagcgctgctgtctgggccaagatattatccgcgttctcagataaggaattagccgcctacgccaaggcaggggccgtggctgaggaagcgttgggtgccatccgcacagtgatcgctttcggcggccagaacaaagagctggaaagataccaaaaacatttagagaatgccaaagagatcgggattaaaaaagctatttccgccaatatcagtatgggtattgccttcctccttatctacgcctcctacgcccttgctttctggtacggtagcacgcttgtgatctcgaaagagtataccatcggcaatgcaatgacagtctttttcagcatactgatcggggcttttagcgtagggcaagccgccccatgcatcgacgcgttcgccaatgcgagaggtgcagcgtacgtgatcttcgatatcatcgacaataacccaaagatcgattccttttcagaaagggggcacaaacctgattccataaaaggcaacctggagttcaatgacgttcattttagttatcctagtcgcgcaaacgtaaaaatcttaaagggacttaacctcaaggttcaaagcggccagacagtggctctcgtgggttcttcgggctgcggcaaatctactaccgtgcaacttattcagagactatatgatccagacgaaggtacaatcaacatcgacgggcaagatataaggaactttaacgtgaactacctgagggagataatcggagtggtgtctcaggaacccgtgctcttttcgaccactattgccgaaaatatttgctacggccggggaaatgtgacgatggatgagattaagaaggctgtgaaggaggcaaacgcatatgagtttatcatgaagttaccacagaaattcgacacactggtcggcgagcggggcgctcagctctccgggggacagaaacagagaatcgccattgcgcgcgccctggtcaggaatccaaaaatcttgctacttgacgaggctactagcgcgttggataccgagagtgaggccgaggtccaggctgctctggataaagcccgagagggccgcacaactattgtgatagctcaccgtctctccacagtcaggaacgctgacgtaatagcggggttcgaagatggcgtgatcgtggagcagggaagccactctgagcttatgaaaaaagaaggggtgtactttaaactagtaaatatgcaaacctcagggtcacaaatccagtccgaggaattcgagctcaacgacgagaaagctgcaacccgaatggcgccaaacggatggaaatcccgcctgttccgacactccacccagaagaaccttaagaatagtcaaatgtgtcagaaatcattggacgtcgaaaccgacgggttagaagctaacgttcctcccgtcagtttcctgaaagtgctcaagctgaacaagactgagtggccctattttgtagttggaactgtgtgtgctatcgctaatggaggactgcagccagcattctctgtcattttcagtgagattatcgcaatcttcggccccggagacgatgcagttaaacagcagaagtgtaacatcttttcactaatttttctatttttgggaattatctcctttttcacattcttcctgcagggctttacattcggcaaggccggcgagatattgacccgcaggcttagaagcatggctttcaaagctatgttaaggcaagatatgagctggttcgatgaccacaagaactccaccggagccctttctacgcggctggcaaccgatgctgcccaggtgcagggggcaactgggacgagactggctctaatcgcacagaatatcgctaatttgggcacgggcatcattataagttttatttatggttggcagctgacacttcttttgctggcagttgtacccattattgcagttagcggaatcgtggagatgaagctgctcgcgggcaatgcaaagagagataaaaaagagctcgaagcagctggtaagatcgccactgaagccatcgagaacatccggactgtggtgtcgctcacacaggagcgcaagttcgagagtatgtacgtcgagaaattgtatggcccctacaggaactctgtgcaaaaggcccacatctacggaattacattcagtatatcccaggctttcatgtatttttcctatgcgggctgcttcaggttcggggcttacctgatagtgaatggccacatgcgctttagggacgtgatcctggtctttagcgctatcgtgttcggagccgtggcgcttggccatgcctcctcctttgcccctgattacgccaaagccaagctgtccgctgctcaccttttcatgctttttgagcgccagccgttgattgacagttactcagaggaaggcctgaaacccgacaagttcgaaggaaacattacattcaacgaggtggtatttaattacccaacccgtgccaacgtgcccgtcctacagggcctctccctagaggttaaaaagggacagaccctagcactggttggatcaagtgggtgtggtaagagtacggtggttcagcttctggagcgtttctatgatccactggcgggtactgtcttcgttgactttggattccagctcctcgacggtcaagaggccaaaaaactgaatgtccaatggctccgggcccagctcgggattgttagtcaagaacctatcctattcgattgtagcattgctgaaaacatcgcctacggtgacaattctagggtcgttagccaggacgaaatcgtttcagcagccaaggctgccaatatccatccctttatagagacgctcccacacaagtacgagaccagagtcggtgacaaagggacacagctctccggaggccagaaacaacgcattgccattgccagggcactgattcgacagccacagatcctcctgctcgacgaggccacaagcgctctggatacagaatctgagaaagttgtccaggaggccttggacaaggctagggaggggaggacgtgcattgtaatcgctcaccggctctcgacaatccagaatgctgatctgatcgtcgtctttcaaaatggcagagttaaagaacacgggacacaccaacagctcctagcccagaaaggtatctatttctcaatggtgagcgtgcaggccgggacacagaattta

SEQ ID NO: 7536 - DNA, 3858 bp, Artificial Sequence
  Description of Artificial Sequence: Synthetic coding sequence
atggacctggaagccgctaaaaatggcaccgcatggcggccaacctctgccgaaggagatttcgagttggggatctcttcaaaacagaagagaaagaaaaccaaaacagtgaagatgataggggtgctgacattgtttagatatagcgattggcaggataagctcttcatgtctctgggcaccatcatggccatcgcacacggctcaggtctccctttgatgatgattgtgttcggggagatgactgacaagttcgttgataccgcaggcaatttctccttcccggtgaatttttcactgagtctcctcaaccccggaaaaatcctcgaggaggagatgacaaggtacgcgtattattatagtggactgggcgcaggtgtcctggtggccgcatacatacaggtgagtttctggaccttagccgctggacggcagatcaggaagataagacagaagttcttccatgcaatattacggcaggaaataggctggttcgacatcaacgacaccacagaactcaatacgcgactgacggatgatatctcaaagatcagcgaaggcattggagacaaggtcggtatgttcttccaagccgtcgccaccttcttcgccgggtttatcgtgggttttataaggggctggaaactgacgctggtgatcatggccatttcaccgatcttgggtctgagcgcggcagtgtgggcgaagattctgtcagcattctccgataaagagttggctgcgtacgccaaggccggagctgtggccgaagaggcccttggcgctatcagaactgtgatagcgtttggcgggcagaacaaggaattagaacgctatcagaagcatctggagaacgctaaagagattgggataaaaaaagccatctcagccaacatctccatggggatcgctttcctcttgatttatgcctcttacgccctcgccttttggtatggcagtaccttggtcatttccaaggagtataccatcggcaacgctatgacggtattttttagtatcctgatcggtgccttttccgtgggccaggcagcgccttgcatagatgccttcgctaacgcacgtggagctgcttatgtcattttcgacattatcgacaacaaccccaaaatcgatagcttttcagagcggggacataagccggattccattaagggcaatctcgagttcaacgatgtacactttagctatccttctcgtgctaatgtgaagattcttaagggcctgaatctgaaagttcagagtggccagaccgtggccctagtgggctcgtcaggatgcgggaagtccaccaccgttcagcttattcagaggctatacgacccggatgagggtacaattaatatcgatggtcaggacatcaggaacttcaatgttaactatctgcgagagattatcggcgtcgtctctcaggaacctgtgctgttcagcaccaccatcgcagaaaatatttgctacggacgagggaacgtgactatggacgaaatcaagaaggcggtgaaggaggccaacgcttatgagtttatcatgaagctccctcagaaatttgatacactggttggtgagcggggggcacagcttagtggaggccagaaacagcgcattgctattgcgcgggctctagtgcggaaccccaaaatccttcttctggacgaggctaccagtgccctagacacagagagtgaggccgaggtgcaagcagcactagataaggctagagagggcagaactactatcgtgattgctcataggctctccactgtgaggaatgctgacgtaatagctggatttgaggacggagtgatcgtggagcaagggtctcactcagaactgatgaagaaggagggagtgtattttaagctggtgaacatgcagacctcaggatcacagatccaatcagaggaatttgagctaaatgacgagaaagccgcaactaggatggcccccaacggctggaagtccagactctttaggcactctactcagaagaacctgaagaatagccagatgtgtcagaaatcccttgacgtagagaccgatgggctggaagccaatgtcccccctgtatcatttctaaaagtgcttaagttgaacaagactgagtggccctacttcgtggttgggacagtgtgcgcaattgcaaacggagggcttcagcccgccttttcagtgattttctctgagatcatcgccatctttggccccggggatgacgctgtaaagcagcagaagtgtaacatcttctcactcatttttctctttctaggcattatctctttcttcaccttctttctgcagggatttacctttggaaaagcaggggaaatattgacaaggcggctgcgatccatggctttcaaagctatgctgcggcaagacatgtcatggttcgatgatcataagaatagcaccggcgctctatcaacacggctggccactgatgcggcacaagttcagggtgcaactggtacccgactggctctgattgcacagaatatcgcgaacttgggcaccggtattattatctccttcatttacggctggcaactgacattattactcctggctgtcgtgccaatcatcgcagtgagcgggatcgtggagatgaagctgctcgctgggaacgccaagcgggataaaaaggagctagaggccgccggcaagattgccacagaggcaatcgaaaacattaggactgtggtttctctcacacaggagagaaagtttgaatccatgtacgttgagaagctgtatgggccataccggaactctgtgcagaaagctcatatttacggaatcacgttttcaatttcccaagcgtttatgtacttcagttacgcaggctgctttcgctttggagcctatctcatcgtaaacggacacatgcgcttccgggacgtgatcctggtgttcagtgcgatcgtgttcggtgccgtggccttaggtcacgcatcttcttttgcgcccgattatgccaaggctaagctctctgctgctcacctcttcatgctcttcgaaaggcagcctctgatcgatagctattccgaggagggccttaagcccgacaaatttgaggggaacatcacttttaatgaggtggtgttcaattatcccaccagggccaacgtgcctgtcctgcaggggcttagccttgaagtcaagaaaggacagacccttgctctggtcggtagctcagggtgcggtaaatccacagtggtgcagctcctggagcgtttctatgaccccttggctggtactgtgtttgtggattttggatttcagctactggatggccaggaggccaaaaagctcaacgttcagtggctgcgcgcgcaactggggatcgtgtctcaggaacctattctttttgattgctcaattgctgaaaatattgcgtacggcgacaactcacgtgtagtctcacaggatgagatcgtcagtgccgctaaagcagccaatattcacccctttatcgagacactcccgcataagtatgaaacgcgggttggcgataagggtacccagctgtccggcggtcaaaagcagcgcatcgccatagcccgggctttaatccgacagccacagattctgctgcttgacgaggcaacctctgcactcgacaccgagagcgagaaagttgtccaggaagcacttgacaaagctagggagggcagaacttgtatcgtgatcgcgcataggctcagcactattcagaacgctgacctgattgtagtgtttcaaaacggaagggtgaaagagcacggtactcatcagcagctgctggcgcaaaaggggatatatttctctatggtctcagtgcaagccggcacacagaatctc

SEQ ID NO: 7537 - DNA, 3858 bp, Artificial Sequence
  Description of Artificial Sequence: Synthetic coding sequence
atggacttagaggccgctaaaaatgggactgcgtggcgtcctacctccgcagaaggagattttgagttaggtattagctctaaacagaagcggaagaagacaaaaaccgttaagatgatcggtgtactcaccctcttcagatactccgattggcaggacaagctttttatgtcactgggcaccattatggctatcgcccacggatctggactgccgctgatgatgattgttttcggcgagatgacagacaaatttgtggacacggctgggaatttcagtttcccggtgaatttctccttgtccctgctgaatcctggaaagattctcgaggaggaaatgacccggtatgcgtattactactctggactcggtgccggggtgctggtggccgcctatattcaggtgagcttttggaccttggcggccggaaggcaaattagaaaaatcaggcagaagttcttccacgccatcctacgccaggagattggctggtttgatattaacgacacaacagagctcaatactaggcttaccgatgatatttccaagatctccgaagggattggcgacaaagtaggtatgttttttcaggcagtagcgacgttctttgccggttttatagtaggcttcatcagagggtggaaactaacacttgtcattatggcaatttcacctattctgggcctgtcagccgctgtatgggccaagatcctatccgcattttcagataaggaactggccgcttacgctaaagctggcgccgtggcagaggaagccctgggcgccataaggactgtcatcgcattcggcggccagaataaagaattggagaggtatcagaaacacctagagaacgcaaaagagatcggcattaagaaagctatttcggctaacataagcatggggatagctttcttattaatctatgcatcttacgcgctggctttttggtatgggtccacattggtcataagcaaagaatacaccatcggcaatgcaatgactgtgttcttttctatactgattggtgcattcagcgtgggtcaggctgctccatgcattgacgcctttgcgaatgccaggggagcagcttatgtcatcttcgatatcatcgataacaacccaaaaatcgacagcttttctgaaagaggccacaagccggatagtatcaaaggaaacctcgaattcaatgacgttcatttctcttatccctctagagcgaacgtgaaaatcctcaaggggctgaatctgaaggtgcagtcaggacagactgtagcgctcgtggggagcagtggatgtggcaaaagcaccacagttcagttgatacaacggctgtatgaccccgatgaaggaaccattaacattgatgggcaggatataagaaactttaatgttaattatctgagggaaataataggcgtcgtttcccaagaaccggtactgttttcaacgactattgccgagaatatttgttatgggcgaggaaacgtgacgatggatgagatcaagaaggctgtgaaggaggccaatgcctatgagttcataatgaaactccctcagaagtttgatacactggtcggtgaacggggagcacagctttctggaggtcagaagcagagaatcgctatcgcacgggccctggttcgcaatccgaagattctgcttctggacgaggcgactagcgcattagacaccgagagtgaagccgaggtgcaggccgccctggacaaggcaagagagggacggactacaatcgtgattgcccaccgtctcagcacagtccgtaacgcagacgttatcgcgggtttcgaagatggcgtaattgtcgagcagggctctcactccgagttaatgaaaaaggaaggagtttatttcaaactggttaacatgcagacatcaggcagtcagattcagtcagaggaattcgagctgaatgatgagaaagccgcgacgagaatggcacctaatggatggaaatctcggcttttcaggcactccactcagaaaaatctaaaaaacagtcagatgtgtcagaaaagcctggacgtcgaaacagacggtcttgaggccaacgtgccacctgtgtcctttctcaaggttttaaaactgaataaaaccgagtggccctacttcgttgtgggaaccgtctgcgctattgccaatggaggcctccagcccgccttcagtgtaatcttctccgaaatcatcgccatatttggacccggggacgatgcggtgaagcaacagaaatgtaacatcttctctctcattttcttgttcttggggatcatctccttcttcaccttctttctccagggattcactttcggtaaagccggagagattttgacaagacgcctgcgatcgatggccttcaaagcaatgcttcggcaggatatgagctggtttgacgatcataaaaacagtaccggggcactgtcaacccggctggcaacagacgcagctcaggtgcaaggagcgacgggtaccaggttggctctgattgctcagaacattgctaatctcggcactggcattatcataagctttatatacggctggcagctcactctgctgctccttgccgtcgttccaattatcgccgttagcggtatcgtcgaaatgaagctgcttgcaggtaatgccaagcgcgacaagaaagaacttgaggctgccggcaaaatcgctacagaggcaatcgaaaatataaggacagtagtcagcttgacacaggagagaaaattcgagtcgatgtatgttgaaaagctatatggtccttataggaactctgtgcagaaagcacacatctacggaattaccttttctatttcccaggcgtttatgtatttttcctacgctggttgtttcagatttggcgcctacttaattgtgaatggccacatgcgctttcgtgacgtgatcctcgttttctcagcgatcgtgttcggggcagtggcgctcggacatgcttcatcctttgccccagattacgctaaggcaaaactctccgctgcccatctgtttatgctgttcgaaagacaaccactgatcgattcttattccgaagaggggctgaagccagataagttcgaggggaatataacgtttaacgaagttgtattcaattacccaacaagggccaatgtgccggtccttcaagggctgtccctggaagtcaagaaggggcaaaccttggccctagttggctcctctggatgcgggaaaagtaccgtggtgcagctgcttgagcggttttatgatcctcttgccgggacagtgtttgtggattttggattccagcttctggatggccaggaggctaaaaaactgaacgtccagtggctgagagcccaattaggtattgtctcccaggagcccatactctttgactgtagcatagcggaaaatattgcatatggtgacaactcccgcgtcgtgtctcaggacgagatagtttctgcggcaaaggccgctaatatccaccccttcatcgaaacgctcccgcacaagtatgagaccagagtaggcgacaagggaacacagctgagcggtggccaaaagcaaaggattgctatcgctagagccctgattagacagccccagatcctcctacttgatgaggccacaagtgccttggataccgaaagcgagaaagtggtgcaggaggctttggacaaagccagggaggggaggacttgtatcgtcattgcacacaggctaagcaccatccagaacgccgatcttatcgtcgtttttcagaatggccgagtgaaggaacatggaacacaccaacaactactggcccagaaggggatctatttctccatggtgagtgtccaggctggtacccagaatctg

SEQ ID NO: 7538 - DNA, 3858 bp, Artificial Sequence
  Description of Artificial Sequence: Synthetic coding sequence
atggaccttgaagcagcaaaaaatggaactgcatggcgaccaacttctgccgagggagatttcgaacttggaatctcgtcgaaacaaaaacgcaagaaaacaaaaacagtaaaaatgatcggggtgcttacactctttcgatattcagactggcaagacaagctttttatgagcctcgggactataatggcgattgcacatgggtcgggacttccgttgatgatgattgtgtttggagaaatgactgataagttcgtcgatacagcagggaacttctctttccccgttaatttctcattgtcgctgcttaatccaggaaagattctagaagaggagatgactagatatgcatactactatagtgggttaggagcaggagttctagttgcagcatacattcaggtctcgttctggaccttggcggctgggcggcaaattcgaaaaattcgccaaaaattcttccacgctattctccgtcaagagataggatggtttgatattaatgataccaccgaactcaacacccgcctcaccgacgacatttccaagatttcagaaggaattggggacaaggttggaatgttcttccaagcagttgcaacgttctttgctgggttcattgtgggtttcatacgaggctggaagctaaccctggtgattatggcgatctcgccaattctgggactctcggccgcagtgtgggccaaaattctttccgcattttcggacaaggagctcgcagcctacgccaaggcaggagccgttgcagaggaggcattgggtgctattagaacagttatcgctttcggtgggcaaaataaagaattggagcgctatcaaaaacacctagaaaacgccaaagaaatcggaattaaaaaagctatatcagccaacatatcaatgggaatagcattcttgctgatatacgcttcatacgcactggctttctggtatggctccactctcgtgatctcaaaggagtacactatcgggaatgcaatgacagttttcttcagcatattaattggtgccttctcggttggtcaagctgcaccctgcattgatgcgttcgctaatgcgagaggcgccgcatatgttatcttcgacattattgataataacccaaaaattgactcatttagtgaaagagggcataagccagactcaattaagggcaatcttgaatttaatgacgtgcatttttcgtatccatctcgagctaatgtgaagattctaaaaggacttaatcttaaggttcaatcaggacaaacggttgctttggtgggcagttcggggtgcggaaagtcaacaacagtgcaactcatccaacgtctctatgatcccgatgaaggaactattaacatcgatggacaagatatacgtaacttcaatgttaactaccttagagaaattattggggtcgtatcacaggagccggtccttttctctacaacgatcgcagaaaatatctgctacggacggggaaatgtaaccatggatgaaataaaaaaagctgttaaggaggcaaatgcctatgaatttataatgaagcttccacaaaaatttgacacgctggtcggtgaacgtggagcacagctgagtggaggtcaaaagcaacgaattgctatagccagagctctagttagaaacccaaaaattttgcttctagacgaagcgactagtgcattggataccgaaagtgaggccgaagtccaagcagcactggacaaagccagagagggtcgcactaccatagttatagctcacagactctcgacagtacggaacgctgatgttatcgccggcttcgaggacggagtcattgttgaacaaggatcgcattcagaacttatgaaaaaagaaggtgtatatttcaaacttgttaatatgcagacatctggatctcagattcaatcggaggagtttgagttgaacgatgaaaaggctgcaactagaatggccccaaatggttggaaatcacgtctcttccgacactctacccaaaagaatttgaaaaactcacagatgtgccagaaatctttggacgtcgaaactgatgggctagaagcaaacgtcccacctgttagttttttgaaggtcttaaaattaaacaaaactgaatggccatatttcgtggtggggactgtgtgtgctattgccaacggaggtttacaaccggcattctctgtaatattctccgaaattattgctatatttggacctggagatgatgccgttaaacagcaaaagtgtaatatttttagcctcattttcttgtttttgggcattatctcattctttacattctttctacaaggatttacattcggtaaggcaggtgaaatccttacacgtcgactacggtcaatggctttcaaagctatgctgcgtcaagatatgtcttggtttgatgaccataaaaattccacgggagcattaagtactagactagcgactgatgcggcccaagttcaaggagctactggaactagactcgcgttgatcgcgcaaaacattgcaaatttaggaactggaataattatctccttcatttacggatggcagttaacgctactattgcttgcggttgtgccaatcattgctgtttctggtatcgttgaaatgaagctccttgctggaaatgccaagcgtgataagaaagaacttgaagctgcgggcaaaatcgcaactgaagctattgagaatatccgaacagtagtatcactcacacaggaacgaaagttcgaaagtatgtatgttgagaagctatacggaccttatagaaattcagtacaaaaagctcacatctacggaattacgttctctatcagccaggcctttatgtatttctcgtatgccggttgttttagattcggagcttacttaatcgtaaatggtcatatgcgattccgagacgtaatattggttttcagtgcaattgtgttcggtgcagtggctcttggccatgcatccagctttgccccagattatgcgaaagcgaagttgtcggctgctcatttgtttatgttgtttgagcggcagcctcttattgattcttactcggaagaaggacttaaaccagataagttcgaagggaatatcacttttaacgaagtcgtttttaattatccaactcgggccaatgtaccagtgctccaaggattgtccttagaggtgaagaaaggccaaacattagccctggtcggtagtagtggttgcggaaaatctactgttgttcagctgctggaaagattttatgatccgttggcaggtactgtttttgttgattttggatttcaactattggatggccaagaagcaaaaaaacttaacgttcaatggttacgcgctcaactggggattgtaagtcaagagccaattttgttcgactgctctattgcagaaaacatcgcttatggagacaattctcgcgtagttagtcaagatgaaatagtgtcggctgcaaaggcggcaaatattcatccgtttatagagactctaccacataagtatgaaactagggttggagacaagggcactcaactgtctggaggacaaaaacagcgaattgcaattgcgcgagcattgattcgtcaaccacaaattttactgctagacgaggcgacttctgcattagatactgagtctgagaaagttgttcaggaggcactcgataaggcgagagagggacggacttgcatcgtgatcgcgcatcgcctcagcactattcagaatgcagatctcatcgttgtatttcaaaatggaagagtcaaagagcacggaactcatcagcaacttctggcacagaaaggcatttatttctcaatggtgtccgttcaggccggcactcaaaaccta

SEQ ID NO: 7539 - DNA, 3858 bp, Artificial Sequence
  Description of Artificial Sequence: Synthetic coding sequence
atggatttggaagccgcaaagaatggtaccgcttggaggccgaccagcgccgaaggagattttgaactgggcatttcatccaagcagaaacgaaagaaaactaaaaccgtcaaaatgattggtgtgctgactctgtttcgctactcagactggcaagataagctgtttatgtcacttggtactataatggcaattgcgcatggatcgggactgcctctgatgatgatcgtgtttggagaaatgaccgacaagttcgttgacaccgccggaaacttctcatttccagtgaacttcagcctttcgctgctgaatcctggtaagatcttggaggaagaaatgactcgctatgcatactactactccggactcggcgcaggtgtgcttgtggccgcatacatacaagtgtccttctggaccctggctgccgggcggcaaattcgcaagatcagacagaaattctttcacgcgatcctcagacaggagattggatggttcgacataaatgacaccactgaactgaacactagactgactgatgatatatcgaagatatcagaaggaattggagataaggttggtatgtttttccaagccgtcgccaccttttttgccggctttatcgtgggattcatccgtggttggaaactgacgcttgtgataatggcaatatcgccaatccttggactttcggcagcagtgtgggcaaaaatcttgtccgccttttctgataaagaactggcagcatatgcaaaagctggtgccgtcgcagaagaagcacttggggctatccgcactgtcatcgcatttggcggacaaaacaaggagttggagagataccaaaagcatcttgaaaatgcaaaggagattgggattaagaaggcgattagcgcaaatatctctatgggcattgcatttcttcttatctacgcatcctacgcactcgcattttggtacggatccaccctggtgatcagcaaagaatacaccattggaaacgcaatgaccgtgttcttctcgattctgatcggtgctttttcggtcggccaagcagcaccctgtattgatgcattcgccaacgctcgcggcgcggcctacgtgatttttgatatcattgacaacaatcccaagatagattcttttagcgaaagaggccataagccagattccataaagggtaaccttgaattcaacgacgtgcatttctcctatccttcacgtgcgaacgttaagatcctcaagggccttaaccttaaggtgcagagcggacaaactgtggcgcttgtgggttcgtcggggtgtgggaagtctactactgtccagcttattcaaaggctgtacgatcccgacgagggaactataaacattgacggacaggatattagaaactttaatgtgaattacctgcgcgagataattggcgttgtgtcccaagaacctgttctgttctcgactaccatcgccgagaatatctgttacggaagaggtaacgtgactatggatgagataaagaaagcggtgaaggaagccaacgcgtacgagtttatcatgaaactgcctcaaaagttcgacaccctcgtgggggaaagaggagctcaactgtcgggtggacagaagcagcgcatcgcgatagcacgcgcattggtgaggaaccctaagattctgcttctggatgaagcaaccagcgcactggacactgaatcagaggcagaagtgcaggcagcgcttgataaggcacgtgagggtagaacgaccatcgtcatcgcccacagactctcgacggtgcgcaacgcggatgttatcgcaggattcgaggacggagtcatcgtggagcagggatctcacagcgaacttatgaagaaggagggggtgtactttaagctggtgaacatgcagacgagcggtagccaaatccagagcgaagaattcgaactcaatgacgagaaggcagcaactcggatggcaccgaatggttggaagtcgcggctctttaggcattccactcagaagaacttgaagaattcgcaaatgtgtcagaagtcacttgatgtggagactgatggacttgaagctaatgtccctccggtgtcgtttctgaaagtgctgaagttgaacaagaccgaatggccatacttcgtcgtgggaaccgtgtgtgcgattgctaacggtggactgcaacccgcattttccgtgattttctcggagattatcgcaatctttggtcctggcgacgacgccgtcaagcagcagaaatgcaacatcttttcgctgatctttctgttcctcggcattatctcatttttcaccttttttctgcaagggtttactttcggaaaggcaggggaaattctcactcggcggctgcgatcgatggcctttaaggccatgctcaggcaagatatgtcgtggttcgacgaccataagaactccactggggcattgtcgacccgcctggcaacggacgccgctcaggtgcaaggcgccaccggaacccggctggcgttgatagcgcagaatattgcaaacctgggtactggtattatcatctcatttatctacggctggcaactcactctccttctccttgcggtggtgccgataattgcagtctcaggaattgtcgagatgaaactgcttgctggcaacgcgaagcgcgataagaaggagctggaggcagcaggtaagattgcaactgaagcaatcgaaaacatcagaacggtggtcagcctgacccaagagaggaaatttgaaagcatgtacgtggaaaaactgtacggaccataccgcaacagcgtgcagaaagcacacatttacgggatcactttctcaatttcccaagcctttatgtacttctcatacgcggggtgctttagattcggcgcctacctgattgtgaacggacatatgagattcagggatgtcattcttgtctttagcgccatagtgttcggagctgtggcccttggccacgcaagctcgtttgcacctgattatgcgaaagcaaaactgagcgctgcacatcttttcatgttgttcgagcgacaacccctcatagattcttacagcgaagaaggtcttaagcctgataagttcgagggcaacattacgttcaacgaggtcgtgtttaactacccgacgcgggcgaacgtgccagtgctgcagggcctgtccctcgaagtcaagaagggacagactcttgcacttgtcgggagctcgggctgtggcaagtccaccgtggtccaattgctcgagagattttacgatccgctcgccggtaccgtgtttgttgattttggatttcagctgctggacggacaggaagccaagaagctgaatgtgcaatggcttagagcacagctcggtatagtgtcgcaagaaccaatcctgttcgactgctccatcgcggagaatattgcctacggagacaactcaagggtcgtctctcaagatgagattgtctccgcggcaaaggcggccaatattcatccctttatcgaaaccctgccacacaaatacgaaaccagagtgggggataagggcacccaactgtccggaggtcaaaaacagcggattgcaatcgcacgcgcccttatcaggcaacctcagatcctgctgctcgatgaagcgacgagcgcactcgataccgagagcgaaaaggtggtgcaggaggcactggacaaagcacgggaaggtcgcacctgcatcgtgattgctcacagactgtccaccattcagaacgcagatctgattgtggtgtttcagaatgggagggtgaaagaacatggtacgcatcaacaacttcttgcccaaaagggaatatactttagcatggtcagcgtgcaagcgggtacccagaatttg

SEQ ID NO: 7540 - DNA, 3858 bp, Artificial Sequence
  Description of Artificial Sequence: Synthetic coding sequence
atggatctggaagcagccaaaaacggcactgcatggcgacctactagcgcagaaggtgatttcgagctgggtatctcgtcgaaacagaagcgcaagaaaactaagacggtcaagatgataggagtgcttactctcttccgctacagcgactggcaagacaaattgtttatgtcccttgggactattatggcaattgcacatggttccggcctcccactgatgatgattgtgtttggagaaatgaccgacaaattcgtggatactgcaggaaatttctcgttccccgtcaactttagcctttcccttctgaacccaggaaagatcctggaagaagaaatgaccaggtacgcatattactactctggtcttggagcaggagtcctcgtggctgcgtatattcaagtctccttttggactctggcggccggtcggcagattcgcaagatccgtcagaagttttttcacgctatccttaggcaggaaataggatggtttgacatcaacgacaccactgaactcaacacgcgcctgaccgacgatatttcaaagatatctgaaggaattggggataaggtgggtatgtttttccaggcagtggcaacttttttcgcgggtttcattgtcggatttatccgaggatggaaacttacccttgtgataatggcaatctcgccaattcttggcctctcggccgcggtgtgggcaaagatcctcagcgcattttcagacaaagaactggcggcatacgcgaaggcgggagcggtcgcagaagaagcgcttggtgccatccgaaccgtgatagcctttggcgggcaaaacaaggaattggaacggtaccaaaagcaccttgagaatgcaaaagaaataggcataaagaaagcgatctcagctaacatatcgatgggaatcgccttcctgctgatttatgccagctacgcattggccttttggtatggatcgacgctggtgatttctaaagagtacaccatcggtaacgcaatgacggtgtttttctcaatcctgatcggtgcattctccgtcggtcaagccgcaccatgtatcgatgcctttgccaatgccaggggagcagcgtacgtgatcttcgacataatcgataacaaccctaaaatcgatagctttagcgaacggggacacaaaccagactcgattaagggaaatcttgagtttaatgatgtgcattttagctacccaagcagagcgaatgtgaagattttgaagggtctgaatctgaaggtgcagtccgggcagactgtggcgcttgtcgggtcctccggatgtgggaagagcaccacggtgcaacttattcaaagactgtacgatccagatgaaggtaccatcaatatcgatgggcaggatatccgtaactttaatgtgaactacctgagggaaatcattggagtcgtgagtcaggaaccagttttgttttcgacgactattgcagaaaacatctgttacggaaggggaaacgtcactatggatgagatcaaaaaagctgtgaaggaggcaaacgcatacgagttcattatgaagctgccccagaaatttgacactctggtgggagaaagaggagcccaactgtcgggaggacaaaagcaacgcatcgccatcgcaagggcactggtgcggaaccctaagatcttgctgcttgacgaagcaacctctgcgttggatactgagtccgaagcagaagtgcaggcagccctcgataaagcacgcgaaggacgcaccactatcgttatagcccaccgtctttccactgtccgcaacgctgacgtgattgcaggattcgaagatggagtgattgtggaacagggcagccattccgaactgatgaagaaggaaggggtctactttaagctcgtgaatatgcagacctccggaagccaaattcagtcggaagaatttgagttgaatgatgaaaaggcagcaactaggatggcgccgaacggctggaagtcaaggctgtttagacattccacccaaaagaacttgaaaaactcccagatgtgtcagaaaagccttgatgtggaaactgacggacttgaggcaaatgtgcctcctgtgtccttccttaaggtcctgaaacttaacaaaacggagtggccttactttgtggtgggtacggtgtgcgccattgctaacggcggtttgcaacctgcattctctgtgattttcagtgagatcatagcgatttttggacctggagatgatgccgtcaagcaacagaagtgtaacatcttctcactcatttttctttttctgggaatcattagctttttcaccttcttcttgcaagggtttacctttggtaaggccggagaaattcttacccggagactcagaagcatggcatttaaggctatgttgcgccaagatatgtcctggtttgatgaccacaagaattccactggagcactgtcgacccggcttgcaaccgatgcggcccaggtccagggcgcaactggaacgcggctcgcactgattgcacagaacatcgcaaacctcgggaccggcattatcatttcgtttatctacggttggcaacttaccctgcttcttctggccgtggttccaataatcgctgtctcaggcattgtggagatgaagttgctcgcaggaaacgcaaagagagacaagaaggaactggaggccgcaggaaaaatcgcaacggaggcgatagaaaacataagaactgtggtatcactgactcaggagcgcaagtttgaatcgatgtacgtggaaaagctgtacggaccttaccgtaattcagtgcagaaggcccacatttacggaattactttttccatttcccaagcatttatgtacttctcatacgcaggatgtttccgttttggtgcctacctgattgtgaacgggcatatgaggttccgagatgtcatactggtcttttcggcaattgtgttcggtgcagtcgcacttgggcatgcatcgtcgtttgcaccagattacgcaaaggcgaagctgagcgcagctcacctctttatgctgtttgagagacaaccgttgattgattcgtattcggaggaggggctgaaaccagataagttcgaaggcaacatcacctttaatgaagttgtgttcaactaccctactagggcaaacgttcctgtccttcagggacttagccttgaagtgaagaagggccaaacgcttgcccttgtgggctcgtcagggtgtggaaagtcgactgtcgtccagctgcttgaacggttttacgatccactggcaggaaccgtgtttgtcgatttcggatttcaactgcttgatggacaagaagcaaagaagctgaacgtgcaatggttgagggcacaactcggtattgtgtcacaagagcctatcctttttgactgctcgattgccgaaaacattgcatacggcgataactcgagagtggtgtcgcaggatgagattgtgtctgctgccaaggccgccaacatacatcccttcatcgaaactctgccccacaaatacgaaacccgggtgggggacaagggaactcagctttcaggaggccaaaaacaacggatcgccatcgctcgcgcacttatccgtcaacctcaaatccttcttttggacgaggcaacctccgcactcgataccgaatctgaaaaggtggtccaggaggcactggataaggcaagggagggaagaacttgtatagtcatcgcacatagactgagcactattcagaacgcggatctgattgtggtgttccagaacggccgggttaaggagcatggcactcatcagcaactgcttgcgcaaaagggaatctacttttccatggtgtctgtccaagcaggcacccagaacctc

SEQ ID NO: 7541 - DNA, 3858 bp, Artificial Sequence
  Description of Artificial Sequence: Synthetic coding sequence
atggatctagaggccgcgaaaaacgggacagcttggcgcccaacgagcgccgagggggatttcgagctcggaattagtagcaagcaaaaaaggaagaagacgaaaaccgtcaaaatgattggggttctgacgttgttccgctattctgactggcaggacaagctgttcatgtctctgggtactatcatggccatcgcacacggtagtggactgccactcatgatgattgtgtttggggaaatgaccgataaattcgtggatactgctggcaatttctctttccccgtcaacttcagcctgtccctgttaaacccgggaaaaatattagaggaagaaatgacccggtacgcttactactactctggactgggagcaggcgtcctcgttgccgcatacatccaggtttcgttctggacactggccgcagggcgccaaatacgaaagatcagacaaaagttcttccacgcaatcctgcggcaagagatcggctggtttgatattaacgacactacggagctaaacacaaggctgacggatgacatttctaaaattagcgagggcatcggtgataaggttggaatgttttttcaagccgttgctacattcttcgctgggtttatcgtcggtttcatcagagggtggaaactgaccctggttatcatggcaatcagtcccatcctgggactcagcgctgcagtctgggccaagatactttccgctttttctgacaaagaattagccgcctacgcaaaggcaggcgccgtcgccgaagaggctttgggagctattcggaccgttattgcctttgggggacagaacaaagaacttgagaggtatcaaaaacacctcgagaacgcaaaggaaattgggatcaagaaggccatcagtgcaaatatcagtatgggaattgccttcctcctgatttatgccagctacgcacttgccttctggtacgggagcacactggtcatttcaaaggaatataccattggcaatgccatgacagtattttttagtatcttgattggtgcgtttagtgtcggccaggccgcgccatgcattgacgcatttgccaatgctcgaggcgccgcctacgtgatctttgatattatcgacaacaacccaaaaatagactcattctcggagcggggtcacaaaccagactccatcaagggcaatctagaatttaacgacgtgcacttctcctatccctcaagagccaacgtgaagatcctcaagggcctcaatctcaaagtgcagagtggccagactgttgctcttgttgggagtagcggatgtggtaagtcaaccaccgtccagctgatccagcgactgtacgacccagacgagggcaccatcaacattgatgggcaagatattagaaactttaatgtgaattatctgcgggagatcataggcgtggtgagtcaggaaccagtcctgtttagcaccaccattgccgagaatatctgttatggccgaggtaatgttacaatggatgaaattaaaaaagctgtgaaagaggccaacgcctatgagtttatcatgaagctgccgcagaagtttgacacacttgtgggcgaacggggcgcacaacttagtggtggtcagaagcagcggatcgctattgctagggccttggtgcgaaatcctaagatactactcttggacgaagccactagcgctcttgacacagagagcgaagcagaagtgcaggccgcgctggataaggcccgagagggccgaacaacaattgtgattgcccatcgactgagtaccgtccgcaatgcagatgtaattgctggttttgaagacggcgttattgtagagcagggcagtcattccgaacttatgaagaaagaaggagtatactttaagctggtgaatatgcaaaccagtggttcccagatccagtccgaggagtttgagctgaacgatgagaaggccgcgacgaggatggcccctaacggctggaaatcacggctgtttcgccattctacgcagaaaaatttgaaaaactcccagatgtgtcagaaatctctggacgtggagaccgacgggttagaggccaacgtaccacctgtgtcctttctcaaagttctgaagcttaacaagacggaatggccttacttcgtcgtgggcaccgtttgcgccatcgccaatggcggtctccagccagcattcagcgtgattttcagtgaaataatcgcgatctttgggccaggggacgacgccgtgaagcaacaaaagtgtaacatctttagcttaatttttctcttcctcggcatcataagcttcttcacgttcttcctccagggatttacttttgggaaagctggcgagatactcacccgccgcctacgcagtatggcattcaaagcgatgttgaggcaggacatgtcttggtttgatgaccataagaactcgacaggcgccctgagtacgagactcgctactgatgccgctcaggtccaaggggctaccggtactcgactcgcactgattgcgcagaatatcgctaacctcggaaccggcattatcatcagcttcatttatgggtggcaactcacactcctactgctggctgtggtgccaatcatcgccgtgagtggaattgtggaaatgaagctgctcgcaggtaatgcaaaacgtgacaagaaggagctagaggccgctgggaagatcgccaccgaggccatcgagaatattaggaccgtggttagtctgacacaggagcgcaagttcgagtcaatgtacgttgagaagctgtacggcccctataggaacagcgtgcagaaagctcatatatacgggataacttttagtatctctcaagcttttatgtacttctcgtacgctggctgcttccgcttcggggcttatctcattgtcaacggccatatgcggttccgcgacgtaatcttagtgttttccgccattgtgtttggagctgttgctctgggtcacgcatctagttttgcaccagactacgcaaaggccaagctcagcgcggcccatctcttcatgctgtttgaaaggcaacctttgatcgatagctatagcgaagagggcttgaagccagataaatttgagggaaacataacattcaatgaagttgtatttaattacccaacaagggcgaatgtgcccgtgctgcaagggctgtctctcgaagttaaaaaggggcagacgctggcactggttggcagctctggctgcgggaaatcaacagtggtgcagctcctggagaggttctacgatccattagctggaactgtgttcgtggatttcgggtttcaactccttgacgggcaggaagctaaaaagctgaacgtgcagtggctgagagcccagcttggtatagtgagtcaagaaccaatcctttttgactgctccatagcggaaaatatagcttatggagataacagcagagtagtatcccaggacgaaatcgtgagtgcagccaaggccgccaacatccacccctttattgaaacattgccccacaagtatgaaactagagtgggcgataaaggaacgcagctctccggcggccagaaacaacgtatcgcaatcgctcgcgcccttattcggcagccccagattctactactggacgaggccaccagtgccctcgacacagagagcgaaaaagtggttcaggaggctctggataaggcccgcgaaggaaggacctgcatagtgattgcccatcgcctttccacgatccaaaatgctgatctgattgtggtgtttcagaacggtagggtgaaagagcacggtacgcatcagcagctgcttgctcaaaagggaatctactttagtatggtcagcgtgcaggccggcacacagaacctt

SEQ ID NO: 7542 - DNA, 3858 bp, Artificial Sequence
  Description of Artificial Sequence: Synthetic coding sequence
atggaccttgaggccgcaaagaacgggaccgcctggcggccgacttccgctgaaggagacttcgaactcggaatttcgtcgaagcagaagaggaaaaagaccaaaactgtgaagatgatcggagtgttgaccctgttcagatattcagactggcaagataagctctttatgtcgctcggcaccataatggccatagctcacggctcaggcctcccactgatgatgattgttttcggggagatgaccgacaaattcgtcgatacggcaggcaactttagcttccctgtgaatttctcgctgtcgctgctcaacccgggtaaaatcctggaggaggagatgacccggtacgcctactactattccggcctcggagccggagtgctcgtggcggcgtacattcaggtgagcttctggaccttggcggctggacgccaaatcagaaagatcaggcaaaagtttttccacgctatcctccggcaagaaatcggctggttcgacatcaatgacactactgagctgaacactcgactgactgacgacatctctaagatttctgaaggtatcggcgacaaggtgggaatgttctttcaggccgtggccacttttttcgccggattcatcgtcggcttcatcagaggatggaaactcactctggtgattatggccatttcgcctatcctggggctgtcggcggcagtgtgggcgaaaatcctctcggctttctcggacaaagagctggccgcatacgcaaaggcgggggccgtggcagaagaggccctgggcgccatccgcaccgtgatcgccttcggaggacaaaacaaagaattggagcgctaccagaagcacctcgaaaatgcgaaggaaatcggaattaagaaggccatctcggccaacatttcgatggggatcgccttccttctgatctacgcgtcctacgccctggcattctggtacggatcgacccttgtgatctcgaaggagtacactatcggaaacgcgatgaccgtgttcttctcaatcctgatcggagctttctcagtcggccaggccgcaccgtgcatcgacgctttcgccaacgctagaggagccgcctacgtgatctttgacatcatcgacaataacccaaagattgattccttctcagagcggggccacaagcccgactcgatcaagggaaatttggaattcaacgacgtgcacttctcctatccatccagggccaatgtgaagattctcaaaggactcaatctgaaagtgcaatcggggcagactgtggccctggtgggtagctcagggtgcggaaagtcgaccaccgtccaactcatccagagactctacgatcctgacgaagggaccatcaacatcgacggacaggacatccggaacttcaacgtgaattacttgcgggagatcatcggagtggtgtcacaggagcctgtgctcttcagcaccacgatcgccgaaaacatctgctacggacgggggaacgtgaccatggatgagatcaagaaggccgtgaaggaggcgaacgcctacgaattcatcatgaagctgccgcagaagttcgacaccctcgtcggcgaacgcggcgcacaactctccggaggtcagaaacagcggatcgcaattgcacgcgcactcgtgaggaacccgaagatcttgctgctggatgaagccacttcggcgctggacaccgaaagcgaagctgaagtccaagcggcgcttgacaaagcccgtgagggacgcaccactatcgtgatcgcacatcgcctgagcaccgtcaggaatgccgacgtgattgcggggttcgaggatggagtgatcgtcgaacagggatcgcattccgaactcatgaagaaggaaggagtgtacttcaagttggtgaacatgcagacttccggctcccaaatacagtctgaggaattcgaattgaacgacgagaaggcggcgaccagaatggccccgaacggctggaagtcacggctcttccggcactcgactcagaaaaatctgaagaatagccagatgtgtcaaaagtcgctggacgtggagacggacggccttgaggcaaatgtgccccctgtctccttcctcaaggtgctcaagctgaacaagaccgagtggccgtacttcgtcgtgggaacggtctgcgcaattgccaacggaggactgcagccagccttctcggtgatcttctcggagatcatcgcaatcttcggccctggagatgacgcggtcaaacagcaaaagtgcaacatcttctccctgatcttcctgttcctgggaatcatctccttctttacctttttcctgcaaggtttcactttcggaaaggcaggcgaaattctgactcgccggctcagatcgatggcgtttaaagccatgctcagacaggatatgtcctggtttgacgaccacaaaaacagcaccggcgccctgtccactcgcttggcgaccgacgctgcccaggtgcagggtgccacgggcacgcggctggctctgatcgcacaaaacatcgcgaatttgggtactggcatcataatctcgttcatctacggatggcaactgactctgttgctgctcgccgttgtgcccatcatcgcagtgtcgggaatcgtggaaatgaagctgcttgccggtaacgccaagcgcgacaaaaaggagcttgaggcagccggcaagatcgcgaccgaagccatcgaaaacattcggactgttgtctccctgactcaagaacggaagtttgaatccatgtacgtggaaaagctgtacggaccctacagaaatagcgtgcaaaaagcgcacatctacgggatcactttctccatctcacaagcattcatgtacttctcctacgcgggatgctttagattcggggcctacctgatcgtgaatgggcatatgagatttagagatgtgatcctggtgttttccgccatcgtgtttggagctgttgcccttggacacgcatcctcgttcgcccccgattacgcgaaggctaagctcagcgcagcccatcttttcatgctgtttgagcgccagcccctgatcgattcatacagcgaggaggggctgaagccggacaaattcgagggaaacatcactttcaatgaggttgtctttaactacccgacccgggccaacgtcccagtgctgcagggactgtccctggaagtgaagaagggacagacgttggctctcgtcgggtcaagcggatgcggcaagtccacggttgtccagctcctcgagaggttctacgacccgttggccggcacggtgtttgttgacttcggcttccaactgctggacgggcaggaggcaaagaaactgaacgtgcaatggctccgggcacagctgggaatcgtgtcccaggagcctatcctgttcgactgttcaatcgccgagaacattgcgtacggagacaattcgcgcgtagtctcgcaagacgaaatcgtgtccgccgccaaggctgcaaacatccacccatttatcgaaacgctcccgcacaaatacgaaacccgcgtgggagataagggtacgcagctgtcgggaggacagaagcagcgcatcgccattgcgcgcgcacttatcagacagcctcaaattctgctcctcgacgaggcgacctcggccctcgatacggagtcggagaaagtggttcaggaggctctcgacaaggccagggagggacggacttgcatcgtcatcgcgcaccggctctccacgatccagaacgcagatctgatcgtggtgttccagaacggccgggtcaaggagcacggtactcaccagcagcttttggcccagaagggaatctacttcagcatggtgagcgtgcaggcgggaacccagaacctc

SEQ ID NO: 7543 - DNA, 3858 bp, Artificial Sequence
  Description of Artificial Sequence: Synthetic coding sequence
atggatttggaagccgcaaagaatgggaccgcttggaggcctacttcagcagaaggggattttgagctgggtatcagctcgaaacaaaaaagaaagaaaactaaaaccgtgaaaatgattggagtcctgaccctgttcagatactccgactggcaagataaactgttcatgtcccttggaactataatggccattgcgcatggctccggtttgccactgatgatgattgtctttggtgaaatgaccgataagtttgtggacacggcgggtaacttttcgttccccgtgaatttcagcctgagcctccttaatccgggtaagattcttgaagaggaaatgacgcggtacgcatattactactcagggctcggcgcaggtgtgctggtggcagcatacattcaggtgtccttttggaccctcgcggcaggccgccaaatcagaaagatcagacaaaagttttttcatgcaatactgcggcaggaaatcggatggtttgatatcaatgacaccactgaattgaacactcgtcttaccgacgatattagcaagatttcggagggtattggtgataaggtgggtatgttttttcaagccgtcgcaactttcttcgcaggattcatagtaggattcattagaggatggaagctgactctcgtgattatggctataagcccaatcctcgggctttctgcagcagtgtgggcaaagatattgtccgcatttagcgataaagagctcgcggcctacgccaaggcaggcgcagtggcggaagaagcactgggggcgattcgaaccgtcatcgcgttcggggggcagaacaaagaacttgaaagataccagaagcatctggagaacgccaaggagatcggaatcaaaaaagccatctccgcaaacatctcgatgggaattgcatttttgctgatttacgcaagctacgcgctggcgttttggtacgggtcgacgctggtaatctcgaaagaatacactataggtaatgccatgacggtgttctttagcattcttattggtgcttttagcgtcggacaagcagccccttgtatcgacgcttttgccaacgcaagaggagcagcatacgtgattttcgacattattgacaacaaccccaagatcgactcctttagcgagcgaggacataagcctgactccataaagggaaacctcgaattcaatgacgtccactttagctacccatcacgagccaacgtgaagatacttaagggtctgaacctgaaggtgcaatccggacagaccgtggccttggtcggatcctcgggttgtggtaagtcgacgactgtgcaactcattcaaagactctacgatcctgatgaaggtactatcaacattgacggccaagatattagaaactttaacgtgaattacctgagggagatcattggcgtcgtgtcgcaggaacctgtgttgtttagcaccaccattgccgaaaacatctgctatggacgcggtaatgttacgatggatgagataaagaaagcagttaaggaagcaaatgcatacgaattcatcatgaaacttccacagaagttcgacactctggtgggtgagcgcggtgcccagctctcgggaggacaaaagcaacgtatagccattgcacgggcgctggtgcgtaatcctaagatcctgctgcttgatgaagccacctctgcattggacactgagtcagaagccgaagtgcaagcagctcttgataaagcacgggagggtaggaccacgattgtgattgcccatcgactttctaccgtacggaatgcagatgtgatagccggtttcgaagatggggtgatcgttgagcaaggaagccacagcgaactgatgaagaaggaaggtgtctactttaagctggtgaatatgcaaacctcaggatcacagatccagtcggaagaatttgaactcaatgatgaaaaagccgctacccggatggcacctaacgggtggaaatcaaggctttttcgccattcgactcagaaaaaccttaagaactcacagatgtgtcagaaaagcctggacgttgaaaccgatggcctcgaagcaaatgtgcctcctgtgtcattccttaaggtcctgaagctgaataagactgaatggccctactttgtcgtgggaaccgtgtgtgcgattgccaacggaggacttcagcctgctttcagcgtcatattcagcgagattattgcaatcttcggacccggagatgacgcagtgaaacagcagaagtgtaacatcttctcgctgatatttctttttctcgggattatctcatttttcacttttttcctgcaaggcttcacctttggaaaggccggtgagattttgactaggcgcctgcggtcaatggcatttaaggcaatgctgcgtcaagatatgtcgtggtttgacgatcacaaaaactccaccggagctctgtccacgcggttggctaccgatgcggcacaagtccaaggagcgaccggtactcggctcgcactcatagcgcaaaacatcgcaaaccttggtaccggaattatcatcagtttcatttacggatggcaactcaccctgcttcttttggccgtcgtaccgattatagcagtgtccggaattgtcgaaatgaaattgcttgcagggaacgcaaagagagacaaaaaggaactcgaagcagccggaaagattgccactgaagcgattgagaacattagaaccgtggtgtcgctcactcaagaaaggaagtttgagtccatgtacgtggagaagctgtatgggccttacagaaacagcgtgcaaaaggcacacatctacgggattaccttctcgatctcacaggccttcatgtatttctcctatgcaggatgtttcagatttggagcttacctcatagtgaatggacacatgaggtttagagacgttattcttgttttttccgcaattgtatttggtgcagtggcactggggcatgcaagcagctttgcaccagattacgcgaaggcaaagctgtccgctgcgcatctgttcatgctttttgaacgccagcccctgatcgattcgtactcggaggagggcctgaaaccagataagtttgaaggaaacattacctttaatgaagtcgttttcaattaccctacgagggctaacgtgcctgtgcttcagggcctctcgcttgaagtgaagaagggccaaactcttgcgcttgtcggatcatcgggctgtggtaagtcaaccgtggtgcaactgctcgagcgtttttacgatcccctggcaggtactgtctttgtggactttggctttcaactcctcgatggccaggaggcaaagaaattgaacgtgcagtggttgcgggcacaactgggaatcgtgtcccaggagccaattctgttcgactgctcgatagctgagaatatcgcttacggggataactcccgtgtggtgtcacaagatgagattgtctccgcggcgaaggctgcaaacattcatccattcattgagactcttccacataagtatgaaaccagggtcggcgacaagggaactcaactcagcggcggacaaaaacaacggattgccattgccagagcacttatccgacagccacagattctgcttttggatgaagcaacttcggcactggatactgagtcagagaaggtggtgcaagaggcattggataaggccagggaaggtcgtacgtgtatagtgatcgcgcatcgtctcagcaccatacagaatgcagacctgatcgtcgtctttcaaaacggacgcgttaaggaacacggtacccaccagcaactgctggcgcagaagggaatttacttttctatggtgtccgtgcaggcaggaactcaaaatctt

SEQ ID NO: 7544 - DNA, 3858 bp, Artificial Sequence
  Description of Artificial Sequence: Synthetic coding sequence
atggacctagaggccgctaagaacggtactgcatggaggccaacatcggcggagggagactttgaattgggcattagctcgaagcagaagcggaaaaagaccaagactgttaaaatgatcggagtgttgaccctttttaggtactctgactggcaggataaacttttcatgtctctcggcactataatggcgattgctcatggatccggactcccactgatgatgatcgtatttggtgagatgactgataaattcgtggataccgctggcaatttctcctttcctgtcaattttagtctaagtcttttgaatcctggtaagattctggaagaggagatgacaaggtatgcatattattattccggtttaggtgctggggtgcttgtcgctgcttacattcaagtttccttttggaccctcgctgcgggacgccaaatccgaaaaattagacagaagttttttcatgcaatattgagacaagaaattgggtggttcgacattaacgatactactgaacttaatactaggctgacagatgatatctcaaagattagcgagggaattggggataaagttggaatgttctttcaagccgtcgcgaccttttttgccggattcattgttgggttcatacgagggtggaagttgaccttggtcatcatggctataagccctatcttgggactcagcgctgctgtatgggccaagattctcagcgcattctccgataaggagttagcagcttatgcaaaggccggtgctgttgctgaagaggcgcttggtgcaataaggactgtgatcgcattcgggggacagaataaggaactcgagaggtatcaaaagcaccttgagaatgctaaggaaatagggataaagaaagctatctctgctaacatctccatgggcattgcttttttgctcatatacgcaagttacgccttagccttttggtatggctcaaccctagttatatcgaaagaatataccatcgggaacgcaatgactgttttcttctcaatacttattggagcattcagcgtgggccaagcggccccctgtattgacgctttcgcaaacgcacgtggtgcagcttacgtcatcttcgacattatagataacaatccaaaaattgattcattttcagaaagaggacacaaaccagatagcattaaaggaaacctagagttcaatgatgtgcatttttcctatccatcccgtgctaatgtcaaaattctcaagggcctcaaccttaaagtgcagagtggacaaaccgtggctctggtcggatccagtggttgcggtaaaagtactaccgtgcagctaatccaaagactatacgaccccgatgagggtacgattaatatcgatgggcaggatattaggaattttaatgtgaactatttgcgtgaaattattggagtggttagtcaagaacctgtactctttagcactactattgccgagaatatttgttatgggcgtggtaatgtaaccatggatgagatcaagaaggcggtaaaagaggcaaatgcttacgagtttatcatgaaattgcctcagaagtttgatacactcgtcggcgagagaggggcgcaactttcaggaggtcaaaaacaaaggatcgctattgctagggctttggtccgtaacccaaaaatccttctcttggatgaggccacttcggctctcgataccgaatcagaggcagaagtacaagccgcccttgataaggctcgagaggggcgtacaacgattgttattgcccatcggttgagtacagtgcggaatgctgatgttattgctggtttcgaagatggggttattgttgaacaaggttctcacagtgagctcatgaaaaaggagggagtatattttaaactcgtgaatatgcaaacctctggtagccagatacaaagcgaagaatttgaattgaatgacgagaaggctgcaacacgaatggcaccaaatggctggaaaagtagactttttcggcatagtacacagaaaaaccttaagaattcccaaatgtgtcaaaagtcacttgatgtagaaaccgatggtcttgaggctaatgtgcctccagtatcttttctgaaagttctgaaacttaacaagacagagtggccatactttgttgtggggaccgtgtgcgccattgccaatgggggactacaaccggccttttccgttattttcagcgaaatcatagcaatctttgggcctggtgatgatgccgttaagcagcaaaaatgcaacattttcagccttatcttcctatttcttggtatcatttcattttttaccttcttcctacaagggtttacttttggaaaggctggcgaaatccttacgcgacgtttacgtagcatggcttttaaagctatgcttcgacaggatatgtcatggtttgatgatcataagaactctaccggcgctttgtctacaaggttagcaactgacgctgcacaagttcaaggagctactgggacccggctggcccttatcgcccaaaatattgctaacttggggactgggatcatcatcagtttcatttatggatggcaacttaccttgctccttcttgcagtggttcctataattgcagtttcgggtattgtagaaatgaaattacttgcgggtaatgccaagcgtgacaaaaaagagttggaggctgctggcaagatagctactgaagctatagaaaatattaggacagttgtgtcactgacacaagaaaggaaattcgagtctatgtacgtggagaaattgtacggcccatatcgtaattcggtgcaaaaagcacatatctacggtataaccttcagcatttcccaggcatttatgtactttagttatgctgggtgtttcaggtttggagcatatctgattgtcaacggacatatgagattcagggatgtgatccttgtattcagcgccatagtttttggtgcagtagctcttggacacgcctcatcctttgcgccagattatgctaaggcaaagctatctgccgctcatttattcatgttatttgagaggcaaccacttattgattcatattcagaagagggcctcaagccagataaatttgaaggtaatattacttttaatgaagtggtgtttaattaccccacaagagcaaatgttcccgtgcttcagggtttgtctttagaagttaagaagggtcaaactctagcactagttggatctagtgggtgcgggaaatccactgttgtgcaattgttggaaagattttacgatcctctagctggtactgtttttgttgacttcggatttcagctgctagacggtcaagaggcaaagaaactcaatgtgcaatggcttagggcccagctgggaatagtgtcacaggaacctattctttttgactgttcgattgccgagaatattgcctatggagataacagccgcgtggtaagtcaagatgaaatcgtgtctgcagccaaagccgctaatattcatccatttattgagactcttccacataagtacgaaactagagtaggcgataagggtactcagctctccggcgggcaaaagcagaggattgctatcgcaagagccctgattagacaaccacaaattctcttattggacgaggctaccagcgctctggatacagaaagtgaaaaagtcgttcaggaagctttggataaggcgcgcgagggaagaacgtgcatcgtgatcgctcatcggctttccaccattcaaaatgcagatctgatcgtagtttttcaaaatgggcgagttaaagaacatggtacccatcaacaacttctagcccagaaggggatttatttttctatggttagtgttcaagcaggaacacagaattta

SEQ ID NO: 7545 - DNA, 3858 bp, Artificial Sequence
  Description of Artificial Sequence: Synthetic coding sequence
atggatttggaagctgcaaaaaacggcaccgcctggagaccgacaagcgcagagggtgacttcgagctggggatttcctcaaaacagaaaagaaaaaaaacaaaaaccgttaaaatgattggggtgctgacgctgttccggtactctgactggcaggacaaattgtttatgagcttagggaccatcatggcgatagctcatggctcaggcctcccactgatgatgattgtttttggtgaaatgacggataagttcgtggacacagccggcaacttctcttttcctgtgaattttagccttagcctgcttaatcctggaaagatcttagaggaagagatgacccgttatgcatactactactcaggcctgggtgccggtgtcttggttgcagcctacattcaggtatcattttggaccctcgccgcaggtagacagattagaaaaataagacagaaattttttcacgcaatactgaggcaggagataggatggttcgatattaatgataccacggaactcaatacacgtctcaccgatgacatttccaaaatcagcgaagggatcggggacaaagtaggcatgttcttccaggcagtggcaaccttctttgcggggttcatcgtcggttttatacgtggatggaagctcaccctggtgatcatggccatctcaccgatactagggctgtctgccgccgtgtgggctaagattctgtctgccttctccgataaggagctcgccgcgtacgctaaggccggcgccgtcgctgaggaagcactgggcgcaattcgaacagtgatagcctttggcggtcaaaacaaggagcttgaacggtaccagaagcacttggagaacgctaaagaaatcggaatcaaaaaggccatcagcgctaacatctctatggggattgcttttttattgatctacgcctcatatgcattagccttctggtacggcagtactcttgtgatatctaaggagtacacgatcggaaacgccatgaccgtatttttcagtattcttatcggtgcattcagcgtaggacaagccgccccttgcatcgacgcctttgcgaatgctcgcggggccgcttacgtgatattcgatatcatcgacaacaaccctaaaatcgacagcttctccgaaaggggccataagccagattcaatcaaaggcaacttggaattcaatgacgttcatttctcctatcccagccgggcaaacgtgaaaattctgaagggactgaacttgaaggtgcaatctgggcagaccgtggcactggtggggtccagtggttgcggtaagagtaccactgtccagctgatccagcgtctctacgatcccgatgaaggaacaatcaatatcgatggtcaggatatacgaaactttaacgttaattacctgagggagattatcggggtggtatcccaagagccagtcctgttcagtacaaccatcgcagaaaatatatgttacggccgcggaaatgttactatggatgagataaagaaagctgttaaagaagctaacgcatatgagttcattatgaaactgccccagaaatttgacaccttggtcggggaaagaggagcgcagctttccggaggacagaagcagcggatagctatagctcgggccttagtaagaaatcccaaaatactcctgttggacgaagctactagcgccctggacacagagtctgaagcggaggttcaagccgctctggacaaggcccgtgaaggacggaccaccattgtgattgcccatcggctgtccacagtgcgtaacgctgatgtgattgcaggcttcgaagatggcgtcatcgttgagcagggctctcacagcgagctgatgaaaaaggaaggggtgtacttcaagctggtcaatatgcagacaagcggatcccagattcagtcagaggaatttgaactgaatgatgaaaaggcagcaactaggatggctccgaatggctggaaaagtaggttgtttaggcatagcacccagaagaatttgaaaaactcgcaaatgtgtcagaagtccctggacgtggaaacagacggcttggaggcgaacgtgcccccggttagctttctgaaggtactgaagttaaacaaaacggaatggccttatttcgttgtcggcaccgtgtgcgcaatcgcaaatggcggtctgcagccggctttctccgttatcttcagcgagattatcgctatcttcgggccgggtgatgacgctgtcaagcaacaaaagtgtaacattttctccctgatcttcctgttcctgggtataatttcattctttacatttttcttacagggattcacgttcgggaaagctggtgagattctcactaggcggctgcgcagcatggcctttaaagccatgctccggcaggacatgtcttggtttgacgatcacaagaactcaaccggcgctctgagtactcgcttggcaaccgacgccgcccaggttcaaggggctaccggtactcgcctggcgctgatcgctcagaacattgcaaatctcggaactgggatcattatatcatttatctatggctggcagcttactttgctcctcctggctgtggtgcccatcatcgcagtgtctggcatagtggagatgaagctgctggccgggaatgccaagagagataagaaggaactggaagctgccggtaagattgcgaccgaggccattgaaaatatcagaactgttgtttcactcacacaggaacgtaaattcgaaagtatgtatgtggaaaagctatatggtccgtatcgtaattccgttcagaaagcgcacatatacggaatcactttcagcatctctcaagcatttatgtactttagctatgcgggatgcttcagattcggggcctatcttatcgtgaatgggcacatgagatttcgggacgtgatcttagtgttttcggctattgtgttcggggctgtggctttgggtcacgcctcatcattcgcgcccgactatgccaaggccaaactctcagccgcacacctgttcatgctgttcgagcggcagccattgattgactcctactctgaagaaggactgaagcctgacaaattcgagggcaatattaccttcaatgaggtcgtgtttaattaccctaccagagctaatgtccccgtcttgcaagggttgtctttggaggtcaagaaaggccagactctggcactggttggaagctcgggatgtgggaaatcgacagtggttcagctgctggagcgattttacgaccctctcgccgggactgtgttcgtggacttcgggttccagctgctggacggccaggaggctaaaaaactgaacgttcagtggctacgcgctcagcttgggatcgtatctcaggagccaatcctttttgattgttcaatagcggaaaacattgcctacggcgacaatagccgggtagtgtcccaggatgagatagtatccgccgccaaagccgccaacatccatccatttattgaaactctaccccacaagtacgagacaagggtaggagacaaaggtacacagctgagcggtgggcagaagcagagaatcgctatagcccgcgcactgattcgccagccacagatcctgctactggacgaagcaaccagtgcactcgacacagagtctgaaaaagtggttcaggaggcactggacaaggcacgtgaggggcgtacttgcattgtgatcgcgcaccgtctgagcacgatccagaatgcagacctgatagtcgtcttccaaaatggcagggttaaggagcatgggactcatcagcagctacttgcacagaaaggcatctatttttctatggtgtccgtgcaggcaggcacgcaaaatctc

SEQ ID NO: 7546 - DNA, 3858 bp, Artificial Sequence
  Description of Artificial Sequence: Synthetic coding sequence
atggacctggaagctgctaagaacggaactgcctggcgccctacatccgccgagggagacttcgaattgggcatttctagtaagcagaagagaaaaaagaccaaaaccgtgaaaatgatcggtgtcctgacactgtttcgctactctgattggcaagacaagctgtttatgtcactgggtactattatggccatcgcccacggcagtggattgcccctcatgatgattgtgttcggtgagatgaccgataagttcgtagatactgctggcaacttcagctttcctgtaaacttttcactgtcattgctgaatcccggaaagatcctggaagaggagatgacacgttacgcttactactatagtggccttggtgctggagtgctggtggctgcttatattcaggtctctttttggactctggcagccggacgtcagattcgtaagattcgtcagaagttttttcatgccattctgagacaggagatcggctggtttgatataaatgacactactgagctgaacaccaggcttaccgacgacatctccaaaattagcgagggaattggagataaggtgggaatgtttttccaggctgtggctacattcttcgccggctttatcgtgggatttatccgcggctggaagctgactctggtaatcatggctatcagccctatcctgggtctcagcgcagccgtgtgggctaagatcctttccgcttttagtgacaaggagctggccgcctacgcaaaagccggcgccgttgcagaagaggcactgggtgccattcgtaccgtgatcgcctttggtggccaaaataaggaactcgagaggtaccaaaaacacctggagaacgccaaggaaataggtattaaaaaggccatcagtgcaaatatctccatgggtatcgctttcttgctgatttacgcttcatatgcccttgctttctggtatggctccacactggtgattagcaaagagtacactatcggtaacgctatgacagtgttcttctccatcctcattggagccttttccgtcggtcaggcagctccctgcatcgatgcctttgctaacgcccgcggtgctgcttatgtaatttttgatataattgacaacaatccaaagatcgactccttctctgagcgtggtcacaaacctgattccattaaaggaaacctggagttcaacgatgtacacttctcctatccatccagggcaaacgtgaaaattctgaaaggtctgaacctgaaagtccagtccggtcagaccgtggccctcgtcggttcaagtggttgcggtaagagtacaactgtgcaactgattcagcgcctctacgaccctgacgagggcactatcaacatagatggccaggatatccgtaatttcaatgtgaactacctgagagagattataggagtcgtctcccaggagcctgtcctgttttctacaacaattgctgagaacatatgctacggccgcggcaacgtcactatggatgaaattaaaaaggccgtcaaggaggcaaacgcctacgaattcatcatgaagttgcctcagaagttcgatacccttgtgggcgaacgcggcgctcagcttagtggtggtcaaaagcaacgcatcgctattgcccgtgccctggtgagaaatcctaagatactgctgctggacgaagctacttctgcccttgacacagaatcagaggctgaggtgcaagccgctctggacaaggcaagggagggtcgcacaactatcgtgatcgcccaccgcctcagtactgtgaggaatgcagacgttatagccggtttcgaagacggagtaattgtggagcagggtagccattccgagctgatgaaaaaagaaggcgtatactttaaattggttaacatgcaaacctctggtagccaaatccaatcagaggagttcgagctcaacgatgaaaaagctgccacccgcatggcacctaacggctggaaatccaggcttttccgtcactccacacagaagaatcttaagaatagtcagatgtgtcagaagagcctggacgtcgaaaccgatggcctggaagcaaatgttccaccagtttccttcctgaaggtcctcaaactcaacaagaccgagtggccctacttcgtggtaggtacagtgtgtgccatcgccaatggaggattgcaacccgccttcagtgttatcttctccgagatcattgctattttcggccctggtgacgacgcagtgaaacaacaaaagtgcaatatcttcagcttgattttccttttcctcggtattatcagcttcttcacattctttctgcaaggtttcacttttggaaaggcaggagaaattctgaccaggcgcctgaggagcatggcattcaaagcaatgctgcgccaggatatgagttggttcgatgatcacaagaattccaccggtgctctcagtacacgcttggccaccgacgccgctcaagtgcagggagctacaggcacaagactcgcactgatcgcccaaaacattgccaatctgggtaccggtattataatctccttcatctatggctggcagcttaccttgctgctgctcgctgtggtacccatcattgccgtgtctggcattgtcgagatgaaacttctggctggaaacgctaagcgtgacaaaaaggagctcgaggccgcaggcaagattgctacagaagctatcgagaacatccgcaccgttgtgtccttgacccaggaacgtaagttcgagtccatgtacgtggagaaattgtacggcccttacagaaactcagtgcaaaaggctcatatttacggcattacattcagtatctctcaagctttcatgtatttctcctatgccggctgcttcagattcggagcttatctgattgttaacggtcacatgcgctttcgtgacgtaatcctggtattttccgccattgttttcggagctgtcgcactgggacacgcctcctctttcgcaccagactacgccaaggctaagcttagtgccgcccacctgttcatgctcttcgagagacagccactgatcgattcttacagtgaagaaggattgaaaccagataagtttgagggcaacatcacattcaacgaggttgtgtttaattacccaaccagagcaaatgtccctgtattgcagggcctcagcctggaggtgaaaaagggccagaccctcgccctggtcggttcctccggatgcggcaagtccactgtcgtccaattgcttgagcgcttttacgatcctctcgcaggtaccgtcttcgtcgactttggatttcagttgttggacggccaggaggccaagaagctgaacgtacaatggctgagagcccaactcggcatcgtttcccaggaacccatattgtttgactgctcaatcgctgagaacatcgcttacggcgataatagccgtgtggtgagtcaggatgaaatcgtctcagctgctaaggctgctaatatccatccatttatcgaaaccctgccccataagtatgagactcgtgtgggtgacaaaggtactcagctgtccggaggacaaaaacaacgtatcgccattgccagggcacttatccgtcagccccagatcctgttgcttgacgaagcaacttctgcacttgacactgaatcagaaaaggtggtgcaggaggctttggacaaggcacgcgaaggccgtacctgtatcgtgatcgcccaccgtctttccacaatccaaaacgctgacttgatcgtagtatttcaaaatggcagagtcaaagaacatggcactcatcagcagcttctggcacagaagggtatatacttctccatggtgtctgtccaagctggaacacaaaacctg

SEQ ID NO: 7547 - DNA, 3858 bp, Artificial Sequence
  Description of Artificial Sequence: Synthetic coding sequence
atggacctggaggccgccaagaatggcaccgcatggcgacctacgtccgctgagggagattttgagctcggaatttcatcaaagcaaaaacggaaaaagaccaaaaccgtgaagatgatcggagtcctgaccctcttcaggtactcggactggcaagataagctgtttatgagcctcggcactatcatggcgatcgcacatggaagcgggctgccgctgatgatgatcgtgtttggggaaatgactgacaaatttgtggataccgcggggaacttctcattccctgtcaatttctcgctgtcgctgctgaatccaggcaagatcctggaggaagagatgacgcgctacgcgtactactattccggtctgggagcgggtgtgctggtggcggcctacatccaggtgtccttctggaccctcgcggcgggccgacagatcagaaagatccgtcagaagttcttccacgccattctgagacaggaaatcggatggtttgacatcaatgacaccaccgaactcaacacccggctgaccgacgacatctccaaaatctcagaaggcatcggtgacaaggtgggaatgttcttccaggccgtggccaccttcttcgcaggattcatcgtgggattcatccgcgggtggaagctgaccctggtgataatggctatctccccgattctgggattgtcggcagcagtgtgggcaaagattctgtccgccttttccgacaaggagctggcggcttacgctaaagcaggagctgttgccgaggaagcactgggggccatccgcaccgtcatcgcgttcgggggacagaacaaggaactcgaaagatatcaaaaacacctggagaacgcaaaggaaattggaattaagaaagctatcagcgcaaacatctcaatgggcatcgctttccttctgatctatgcttcgtacgctctggcgttctggtacggatcgacgctcgtgatcagcaaagaatacactatcggtaatgcaatgaccgtgttcttttccatccttataggcgctttctcggtcggccaggccgctccctgcatcgacgcgtttgctaacgccagaggcgcggcgtacgtgatctttgacatcatcgataacaacccgaaaatcgactcgttttcggagcgcggacacaaaccagactcgatcaagggaaatctcgagtttaatgatgtccacttctcctacccttcaagagctaatgtgaagatcctcaagggactgaacctgaaagtgcagtcaggacagaccgtggcgctcgtgggctcgtcagggtgtggaaagtcgactacggtgcagcttatccagcgcttgtacgaccccgatgagggaacgatcaacatcgacggacaggacattaggaactttaacgtcaattacctgcgggagatcatcggggtggtgtcccaagagccggtgctgttttcaactaccatcgcggaaaacatttgctacggtcgcggaaatgtgactatggatgaaatcaaaaaggccgtcaaggaagcaaatgcttacgaattcattatgaaactgccgcagaaattcgacactctcgttggcgaacgcggagcccagctgtccggcggccaaaaacagcggattgcgatcgctagggcgttggtgaggaaccctaaaatcctgctgctcgacgaggccacttcagctctggacactgagagcgaagcagaggtgcaggcggctcttgacaaagctcgcgaaggacggactaccatcgtaatcgctcaccgcctgagcaccgtgaggaacgcggacgtgatcgctggcttcgaagatggagtgatcgtggagcaaggatcgcactcggagctcatgaagaaagagggagtctactttaaacttgtgaatatgcaaacttccggatcacagattcagagcgaagagttcgagctgaacgatgaaaaagctgccaccaggatggcgccgaatggttggaaatcccgcctgttccggcattccacccagaagaacctcaagaactctcagatgtgccagaagtcgctggacgtggagactgacggattggaggccaatgtgccgcccgtgagcttccttaaggtgttgaaattgaataagacggaatggccttacttcgtggtgggaactgtgtgcgccatagccaacggaggattgcagccggcctttagcgtcatcttcagcgaaatcatcgccatcttcggaccaggggacgatgccgtcaagcaacaaaagtgtaacattttctcactgatcttcctgttcctggggatcatttcgttcttcaccttcttcttgcagggattcactttcggaaaggccggagagatcctgactcggcgcctgcgctcgatggcctttaaggccatgttgaggcaggacatgtcgtggttcgatgaccataagaactccactggagctctgtccacccggctcgcaaccgacgccgcccaagtgcaaggcgcaaccgggacccgcctcgctctgattgcccaaaacatcgcgaacctgggaaccggaatcatcatctcctttatctacggctggcaactcactttgctgcttctggccgtggtcccaatcattgcggtgtctggaatcgtcgaaatgaaactgctggccgggaacgccaagcgggataagaaagaactggaggcagcgggcaagatcgccaccgaggcaatcgaaaacatccggactgtggtgtcactgacccaagaacggaagttcgaatcgatgtacgtggagaagctctacggtccctacagaaactcagtgcaaaaggcgcatatctacggcatcaccttttccatctcacaggctttcatgtacttctcttacgctggatgcttcagattcggtgcgtacctgatcgtgaatggacacatgcgctttcgggacgtgatcctcgtgttctccgccatcgtctttggagctgtggctctgggacatgcatcgagcttcgccccagactacgccaaggcgaagttgtcggccgcacatctcttcatgctcttcgagagacagccgttgatcgacagctatagcgaggaaggtctgaagcctgataagttcgaaggcaacatcacgttcaacgaagtggttttcaattacccgaccagagctaacgtgccagtgctccagggcctgagccttgaggtgaagaagggacagactctggcgcttgtgggatccagcggatgtggaaaatctacggtggtgcagctcctggaacgcttctacgatccgcttgccggcaccgtctttgtggacttcggctttcagttgctcgatggacaagaggcgaagaaactgaacgtgcagtggctgcgcgcccaactgggaattgtgagccaggagcctatcctgtttgactgctccatcgctgaaaacatagcgtatggggacaactcgcgggtggtatctcaggacgagattgttagcgcagcgaaggcagccaacatccaccccttcatcgagactctgccgcataagtatgaaacccgcgtgggagataaaggcactcagctgtccggagggcagaaacagaggatcgcgattgctcgcgccctgattagacagccacagatcctgctcctcgacgaggcgacttcggcgctggatacggagagcgaaaaggtggttcaggaggccctcgataaggcccgggaaggccgcacgtgcatcgtgatcgctcaccggctgtcgaccatccagaatgctgacctgatcgtggtctttcagaacggaagggtcaaggagcacggtacgcatcagcagcttctggcccaaaagggaatttacttttcgatggtgtccgtgcaggcaggcacccagaatctt

SEQ ID NO: 7548 - DNA, 3858 bp, Artificial Sequence
  Description of Artificial Sequence: Synthetic coding sequence
atggaccttgaggccgcgaagaacggaactgcctggcggccaacctcggcggaaggtgacttcgaactggggatttcgtcgaagcaaaagcgcaagaaaaccaagactgtgaaaatgattggagtccttaccctgtttcgctattcggactggcaagacaagctgttcatgtcactgggaaccatcatggcaatcgcgcacggcagcggtctgccgctgatgatgattgtgttcggagagatgaccgacaaatttgttgataccgcgggaaatttctctttccccgtcaacttctcgctctcgttgctgaaccccggaaagattctggaagaagaaatgactaggtacgcgtactactacagcggactgggagcgggtgtcttggtcgccgcatacatccaagtgtcattctggactttggcagcaggccggcagatcagaaagattagacaaaagttctttcatgctatcctgagacaagagatcggttggttcgacatcaacgacactaccgaactgaatactcgcctcaccgacgacatcagcaagatttccgaaggaatcggagacaaggtgggaatgttttttcaagcagtcgcaaccttcttcgcgggattcatcgtgggtttcatccggggctggaagctgaccctcgtgatcatggctatttccccgattctgggcctcagcgccgccgtgtgggccaagattttgtccgcatttagcgacaaagaattggcggcatacgcgaaggccggggccgtggctgaagaagcgctgggagccatcagaaccgtgatcgcattcggagggcaaaacaaggagctcgaaaggtaccagaaacatctggagaacgccaaagaaatcggaatcaagaaagctatcagcgcgaacatctcaatgggaatcgcgttcttgctcatctatgcctcctacgccctcgccttctggtacggatctaccctggttattagcaaggaatacacgatcggcaacgccatgactgtctttttcagcatccttattggagcattttccgtcggacaggcagcgccgtgcatcgacgctttcgcaaatgccaggggggcggcctacgtgatattcgacattatcgacaacaaccctaagatcgattccttttcggagcggggccataagccagactcaattaagggaaatctcgagttcaatgacgtgcacttctcgtacccttcccgagctaatgtgaagatcctcaaagggcttaatctcaaagtgcagtcaggacaaactgtcgctctcgtcggctcctccggctgcggcaaatccaccactgtgcagcttatccagcgcctgtacgatccggacgagggcactatcaacatagacggacaagatatcagaaatttcaatgtgaattatctgagagaaatcatcggggtggtgtcgcaggaaccggtgctgttctccacgacgatcgctgagaacatctgctacggccgagggaacgtgactatggatgagattaagaaggccgtgaaggaggccaacgcctacgagtttatcatgaagctcccgcagaagttcgataccctggtcggtgaacgcggggcgcagctttccggcggacaaaaacagcggattgcaatcgcgcgcgcgctggtccggaatcccaagattctcctgctggatgaggccacctccgcacttgacactgagagcgaagctgaagtgcaggctgcactggataaggcccgcgaggggcgcaccacgatcgtgattgcccataggctctcaacggtgagaaatgcggatgttatcgctggattcgaggacggggtgatcgtggagcagggatcacacagcgaattgatgaagaaggaaggcgtgtatttcaagctcgtcaacatgcagacttcaggctcccagatccagtccgaggagttcgagctgaatgacgagaaggccgcgactcgtatggccccaaatgggtggaagagcagactgttccgccattccactcaaaagaatcttaagaactcccagatgtgccagaagagcctcgacgtggaaaccgatggactggaagccaacgtgccgccggtgtcttttttgaaggtgctgaagctcaacaagactgaatggccgtacttcgtcgtcggcacggtgtgtgcgattgcaaacggagggctccagcctgcattctcagtgatcttctcggaaatcatagcgattttcggacccggagacgatgcagtcaagcaacagaaatgcaatatcttctcgctcatcttcctgtttctgggaatcatctcctttttcaccttcttcttgcaaggatttactttcgggaaggctggagagatcctgaccagacgcctcagaagcatggcgttcaaggcaatgctgcggcaggatatgtcttggttcgatgaccataagaattcgaccggagccctgtcgacgcgactggcaaccgatgccgcgcaggtgcaaggagctaccggaacccggctcgcgctgatcgcccagaacattgcgaatctgggaaccggcatcatcatctccttcatctacggatggcagctgaccctgctgctgttggccgtggtccccattattgcagtctcaggaatcgtggagatgaaactcctggctggcaacgcaaaacgggacaagaaggagcttgaagcagcgggaaagatcgcgactgaggctatcgagaatatccgcactgtggtgtcactgacccaggaaagaaagttcgaatccatgtacgtcgagaaactctatggaccgtaccgcaactcggtccagaaggcgcatatctacggcatcaccttttcaatcagccaggccttcatgtacttctcatacgcgggatgttttagattcggcgcctacctcatcgtgaacggacacatgagatttagagatgtcatcctggtgttctccgccatcgtgttcggagcggtcgcccttggacacgcctcatcctttgcgccggactacgcgaaggctaaactgtcagcagcccatctctttatgctgttcgaaagacagccgctcatcgattcgtactcagaggaaggtctgaagccagacaagttcgaaggaaacattacttttaacgaggtcgtgttcaattacccgaccagagcgaacgtcccagtgcttcagggcctctctctggaagtgaagaagggtcaaacgcttgctctggtcggatcatcgggctgcggaaagtccaccgtggtgcaactgctggagcgcttctacgatccattggcaggaactgtgttcgtggacttcggctttcagcttttggacgggcaggaggcgaagaagctcaatgtgcagtggctgcgggcccagttgggcatcgtctcgcaagaacccatcctgttcgactgctcgattgccgaaaacatcgcgtacggcgacaattcgagggtcgtgtcacaggacgaaatcgtgtccgccgccaaggcagccaacatccacccgtttatcgaaacgctgcctcacaagtacgaaactcgcgttggagacaaaggtactcagctgagcggaggccaaaagcagcggatcgccatagcccgcgctctcatccgccaaccacagatcttgttgctggacgaggccacttccgcattggacaccgagtccgagaaggtggtgcaagaagccttggataaggcgagagaagggcggacttgcatcgttatcgcgcacaggctttcgactatccagaacgcagatctgattgtggtgtttcagaatggacgggtcaaggaacacggaactcatcagcagctcctggcacaaaagggaatttacttctcgatggtgagcgtgcaggccgggactcaaaacctg

SEQ ID NO: 7549 - DNA, 3858 bp, Artificial Sequence
  Description of Artificial Sequence: Synthetic coding sequence
atggatctggaggcagccaaaaacggcaccgcctggagacccaccagtgcagaaggggattttgagctgggaatcagtagcaaacagaagaggaagaagaccaaaactgtcaagatgattggggtgctgaccctgtttcggtattctgactggcaggacaaactttttatgtctctcggtacaatcatggccatcgcccatggcagcggcctgcctttgatgatgattgtgtttggcgaaatgactgacaaatttgttgacaccgctggaaacttctcttttcctgtgaatttctcactgtcattgctgaatcccggcaagatcctcgaagaggaaatgactcggtacgcctattactatagcgggctgggcgcaggcgtgcttgtggccgcatatatccaggtgtcattctggacactggccgccggccgacagattcggaagattaggcaaaagtttttccacgcaatcctcagacaagaaatcgggtggtttgatatcaatgataccaccgagctgaacactcggctgacagatgatatttctaagatttctgagggcatcggagacaaggtcgggatgtttttccaggccgtcgctaccttttttgctggattcatcgtcggctttatccgcggctggaagctgacgttggtgatcatggcgattagccctatcctcggcctgtccgccgccgtttgggcaaagattctgagtgcattttccgataaagaactcgccgcttatgccaaggctggggctgtcgccgaagaagcacttggagcaataagaacagtgattgcattcggtggtcaaaataaggagctggaacggtaccagaagcacctcgaaaacgccaaggagatcggcatcaaaaaggccatatctgcaaatattagcatggggatcgccttcctgctgatttacgcttcctacgcactggccttttggtatggaagcacactggtgatctccaaggaatatacgattggtaacgccatgaccgtcttctttagcatactgattggcgcgttctctgtaggacaggccgcgccatgcattgatgcattcgccaacgcccggggggcagcatacgttatattcgacatcatcgacaacaacccgaagatcgacagctttagtgagaggggtcacaaaccagattctataaaaggtaatcttgagtttaacgatgttcatttcagttaccccagccgagcgaacgtgaaaattcttaaagggcttaatctgaaggtccaatcaggacagacggtggcccttgtcgggtcctcaggatgcggcaaatctactaccgtccagcttatacagaggctctacgatcctgatgaaggtacgattaatatagatggccaggacattaggaattttaatgtgaattacctgagggaaatcatcggagtggtgtctcaagagcccgtgcttttctccaccactatcgcggagaacatttgttatgggagaggcaacgttaccatggatgagataaaaaaggccgtcaaggaagctaatgcgtatgagttcataatgaagctcccacagaagtttgatacactggtcggagagcgaggcgcacagctttcaggtggacagaaacagaggattgccatcgcacgagcgctggtcaggaaccccaaaattctgcttctggacgaagccacgagtgctctggacactgagtccgaagcagaggtgcaggccgccctggataaggctcgagagggaagaacgactatcgtgatagctcaccgcctgtccaccgtcaggaacgcagacgtgattgctgggtttgaggacggagtcatcgtggaacaggggagtcattcagagctgatgaaaaaggagggagtgtacttcaaactcgtcaatatgcagacaagcggcagccagatccagtctgaagagtttgagttgaatgatgagaaagcggctacacggatggcccccaacgggtggaagagccggcttttccgccattctactcagaaaaacctgaagaattcacaaatgtgccagaagtctttggacgtggagaccgacggcttggaagctaacgttcctccagtctcctttctgaaggtgctgaagctgaataaaactgaatggccttactttgtggtaggcaccgtctgcgcgatcgccaacggcgggcttcagcccgctttctctgttatatttagcgaaatcatcgctatctttgggcctggcgatgatgccgttaaacagcagaaatgtaatatattttccctgatcttcctgttcctgggaattatttccttctttacattctttttgcagggattcaccttcggtaaggcaggcgagatccttaccaggcggttgcgaagcatggcattcaaggctatgctgcggcaagatatgagctggttcgatgaccataagaactcaacaggggcactgagcactcgcttggctacagacgcagcccaggtgcaaggcgctactggaactaggcttgcgctgattgcacagaatatcgccaatctcggaaccggcattattatcagcttcatctacgggtggcagctcacgctgttgcttctggcagttgttccaataattgccgtctctggaatcgtggagatgaaactcctggcaggtaatgctaaaagggataaaaaagagctggaagccgcaggaaagattgcaacagaggccatagaaaacattcggaccgttgtgtctctgacccaggagcggaagttcgagagtatgtacgtggaaaaattgtacggaccgtacagaaatagcgtgcagaaggcccatatttatgggataacgttttccatctctcaggccttcatgtacttcagttacgccggttgcttcagattcggcgcctacctcattgtaaacggtcacatgaggtttcgggacgtgattttggtgttcagtgcaatcgtgtttggcgcagtggcactgggacacgcttcctcttttgcacctgactacgcgaaggccaaactgagcgccgctcacctgttcatgctcttcgagcggcagccacttatagactcctacagcgaggagggactgaagcccgataagttcgaaggaaatattacgttcaacgaagtcgtgttcaattacccaaccagagcaaatgtgcccgtgctgcaggggctctctctggaagttaagaaaggacagacattggccctggtgggttcttccggatgtggtaaaagtaccgttgtacagttgctcgaaaggttttacgatcccctggccggcacggtgtttgttgattttggctttcagctgctcgatggacaagaggccaaaaagctgaatgtgcagtggttgcgggctcagctgggaatagtgtcacaggagcctatcttgttcgactgctctatagccgaaaatattgcctatggggacaacagccgcgttgtgagtcaagatgagattgttagcgcggccaaagccgctaacatccatccttttatcgaaaccctgccccacaagtacgagaccagggtaggagacaagggtacccagctctccggcgggcagaagcagcggatcgctatcgcaagagcactgattaggcagccccagattttgctgctggacgaggccacctctgcgttggatactgagtctgaaaaagttgttcaggaagccttggacaaagcacgggaggggcggacctgtattgtgattgctcacagactctccactattcaaaacgcagacctgattgtagttttccaaaacgggagggtcaaagagcacggtacccaccaacagctgctcgcgcaaaaaggcatttacttttctatggttagcgtgcaagccggtactcagaacttg

SEQ ID NO: 7550 - DNA, 3858 bp, Artificial Sequence
  Description of Artificial Sequence: Synthetic coding sequence
atggatctggaggcagcaaagaacgggaccgcatggaggccaacctcagcagaaggtgattttgaacttgggatttcatccaagcagaagagaaaaaagaccaaaaccgtcaagatgatcggagtgctcaccctgttccgatactcggattggcaagacaagctgttcatgtcgctcggcacgatcatggctatagcacacgggagcggactgccacttatgatgatagtgtttggcgagatgactgataagtttgtcgacactgcaggcaactttagctttccagtcaatttctctcttagcctgcttaatcccggaaaaatccttgaggaagagatgactaggtacgcatactactactcaggcctcggcgcaggagtactggtagctgcttacatccaagtgtctttttggactctggcggccggacgccaaatccggaagatccggcaaaagttttttcatgctattctccgtcaggaaatagggtggtttgatatcaacgatacgaccgagcttaacaccagattgacggatgatatcagcaaaatctcggaaggaattggggataaggtcggaatgtttttccaagctgtcgcaaccttttttgcaggattcatagtgggatttatcaggggatggaagttgaccctcgtcatcatggccatttcaccaatactgggactttccgccgcggtttgggcaaagatactttctgccttctccgacaaggagctggcagcctacgcaaaggcgggtgccgtggcagaagaagcccttggtgctattcgcacggtgattgcctttgggggtcaaaacaaagaacttgaacgctaccaaaagcatcttgaaaacgcaaaggaaattggaatcaagaaggctatttccgcaaatatctcaatgggaatagccttccttcttatctacgcatcctacgctctggcgttttggtatggttcgaccctggtgatctcgaaagagtacactattggcaacgcaatgaccgtctttttctccattctgattggagcctttagcgtcggccaagccgcgccctgcattgacgcatttgcaaacgcaagaggagccgcctacgtgattttcgatatcattgacaataacccaaaaatcgattcgttttcagaaagaggtcataaacctgattccatcaaggggaacttggagtttaatgacgtgcatttctcatatccatcgcgggcaaacgtgaaaatccttaaaggccttaatctgaaggtccaatccgggcagactgtggccctcgtgggaagctccggctgcggcaagagcactaccgtgcagctgattcagcgtctctatgatccggacgaagggacgataaacatcgatggccaggatattagaaactttaacgtcaattacctgcgtgagattattggagtggtgtcccaggaaccggtgctgttttcgaccaccattgcggaaaacatttgttacggacgggggaacgtgactatggatgagattaagaaggcggttaaagaggccaatgcttacgagttcattatgaagctgccacagaaattcgacaccctggtgggcgaaagaggggcccaactgagtggaggccagaagcaacggatcgccattgcaagggcactggtgcggaacccaaagatactgttgctcgacgaagcaacctctgcactggatactgaatcggaagcagaggttcaggccgccctcgacaaggcacgtgaaggacgcactactattgtgattgcacaccgactgtccaccgtgagaaacgcagatgtgattgcaggctttgaagatggtgttattgtcgagcagggatcacattcggaactcatgaagaaagagggtgtctactttaagctcgtcaatatgcaaacctcgggatcacagatacaatcggaagaatttgagctgaacgacgaaaaagccgccacccgtatggcgcctaatgggtggaagtccagactgtttcgccactccactcaaaagaaccttaagaattcgcagatgtgccaaaagtcgctggacgtggagacggatggtctggaagcaaacgtccccccagtgtcgtttctgaaagtgcttaagctgaacaaaactgaatggccctactttgtcgtcgggactgtgtgtgccatcgcaaacggaggattgcaacccgcattctcggtgatctttagcgagattatcgccatattcgggccaggagatgatgcagtgaagcaacagaaatgtaatatcttctcactcattttcctctttttgggaattatctcgttctttaccttcttcctgcaaggattcaccttcggtaaagccggcgaaatccttactcgacgcctgaggtcgatggcctttaaggccatgcttcgtcaggatatgagctggtttgatgaccataagaattctactggagcgctttccaccaggctggcaacggatgcggcccaagtccaaggagcaacgggaaccagactggcacttattgcacagaatatagctaacctgggcaccggaatcataatcagtttcatttacggctggcaacttaccctgctcctgttggcggtggtgcctatcattgcagtgtcaggtatcgttgaaatgaagttgcttgcggggaatgcaaaaagagacaagaaagagctcgaagcggccggcaagattgcaactgaagcaatcgagaacatccggaccgtggtgtctctgactcaggaacggaagtttgagtcgatgtatgtggagaagctgtacggaccataccggaactcggtccaaaaggcacatatctacggtatcactttttcaattagccaagcatttatgtacttttcttacgcagggtgtttcaggttcggtgcataccttattgtgaacgggcacatgaggtttcgggatgtgatccttgtgttcagcgcaattgtgttcggagcagtggcgctgggccatgcatcatcatttgcacctgattacgcaaaagccaagctgtcggctgcacaccttttcatgctgttcgaacgccaacctcttattgactcctattcggaggaggggctgaaacccgacaaattcgagggcaatatcacttttaacgaagtggtgtttaactacccaaccagagcgaatgtgccagtgcttcagggtctttccttggaggtgaagaagggtcagactctggccctggtcggatcgagcggttgtggtaagagcaccgtggttcagctgctcgaacggttttacgatcctctcgccggaacggtctttgtggattttggatttcaactcctcgatggacaagaagctaagaagctcaatgtacaatggctccgggcacaattgggaattgtttcacaggagcctattctgttcgactgttcaattgctgagaacattgcttacggagacaactccagggtcgtctcccaggatgagatcgtcagcgcggcaaaggcggccaatattcatccgttcatcgaaactctcccacacaagtacgaaactagggtcggagataagggcactcaactctccggaggacagaagcagcggattgccatcgccagggcgctgattcgacaacctcaaatacttctgcttgacgaggcaacctcagcacttgataccgaatcggaaaaagtggtgcaagaagcactcgataaggcccgggagggtagaacttgcattgtgatagcgcatcgtctttcgactattcagaacgcagatctgatcgtggtatttcagaacggccgggtgaaagagcacggcactcatcagcaactgcttgcgcagaaaggtatttacttctcgatggtcagtgtgcaggcaggtacccaaaatctc

SEQ ID NO: 7551 - DNA, 3858 bp, Artificial Sequence
  Description of Artificial Sequence: Synthetic coding sequence
atggacctcgaagccgccaagaatgggacggcatggcgtcctacttccgcagaaggcgattttgagctagggatctcctctaaacagaaacgcaaaaaaaccaagacggttaaaatgattggcgtattgaccttattccgatatagtgattggcaggataaactttttatgtctctggggaccattatggccatcgcccatggttctggtctacccctgatgatgattgttttcggagagatgacagacaaattcgtggacacggcgggaaatttcagctttcctgtcaacttctctttgtccttgctaaacccaggcaaaatcttagaggaagaaatgaccagatatgcctactactattctggattgggggccggggtccttgttgcggcctatatccaggtatcattttggacacttgccgccggccgacagatccgcaagatccggcagaaattttttcatgccatcctgaggcaggaaataggctggtttgacatcaatgataccacagaattaaatacacgcttgaccgatgacatctctaagatatcagagggaattggagacaaggtggggatgttttttcaagcagttgcaacattcttcgccggctttatcgttggtttcatccgtggttggaaactcactctggtcatcatggctatttcacccattctcggcctgtccgccgccgtgtgggccaaaatcctttctgcattcagcgataaagaactggctgcttacgccaaagccggcgcagtggctgaggaggctctcggggccattcgaaccgtgatagcatttggcgggcagaataaggaattggagaggtaccagaagcacctggagaatgcaaaggaaataggtatcaagaaagccatttccgctaacatttcgatgggcattgccttcctgcttatttatgcatcatacgccctcgctttttggtatggcagcactcttgtgatatcaaaggagtacacaatcggcaacgccatgacagtctttttttctatactgataggtgctttttccgtaggtcaggcagcaccgtgcatcgacgcattcgcaaacgcaaggggagcagcctatgtaatttttgatataattgataacaacccgaaaatcgattcctttagcgaaagaggtcacaaacccgattctataaagggtaacctagagtttaacgacgtgcatttttcataccccagcagagcgaacgtcaagatactcaagggcttaaaccttaaagtccagtcaggacagaccgtagccctggtaggcagttccggctgcggaaagagcacaactgtccagttgattcaaagactgtatgacccagatgagggtacaattaacattgatgggcaggacatccgcaactttaatgtgaattatctgcgcgaaatcataggagttgtgagccaagagccagtattgtttagcactacgatcgccgaaaacatctgttatgggagaggaaatgtgacaatggatgagatcaagaaggcggtcaaagaggccaacgcttacgaattcataatgaagttgcctcagaagttcgacacccttgttggggagcggggtgctcagttgagtggaggccaaaagcaaagaatagccatagccagagccctggtgcggaatcccaaaatcctactcctggacgaagcgactagtgctctggacacagaaagtgaggcagaagtccaggccgcgctagataaggcaagagaaggccgcacaaccatcgtgatagcccacaggttgtccaccgtgcgcaacgcggacgtgatcgctgggttcgaggacggcgttattgtcgaacagggtagccactctgagcttatgaagaaggaaggagtctatttcaagctcgtgaacatgcaaacatctggaagccagatacagtcggaagagtttgagctgaatgacgaaaaagcggctaccaggatggccccgaatggttggaagtcccggctcttcagacacagcactcaaaagaatcttaagaattcacagatgtgccagaagagtctagacgtggagacggacgggctggaagctaatgttcccccggtctcttttctcaaggtactgaagctcaacaaaacagaatggccatattttgtcgtcggtacagtttgcgctatagccaacgggggcttgcagccagccttctccgtcatctttagtgagataatcgctattttcggaccaggggatgacgccgtgaaacagcagaaatgtaatattttctcactgatctttctcttccttggaataatttccttctttacctttttcctacagggtttcaccttcgggaaggcaggggagattctgaccagaagactacggtccatggccttcaaggccatgctgaggcaggacatgagctggttcgacgaccacaaaaattcgacgggcgcgctcagtacacgattagccacagatgcagcacaagtacagggagcaacaggcacacgactcgctttgatcgcacaaaacatcgccaacctcggcacggggatcatcataagcttcatatacggatggcagctgacacttctgctcctggctgtggtgccaatcatcgcagtttccggcattgttgagatgaagctgctggccggaaacgccaaacgggataagaaggaattggaagcagcaggaaagattgccacagaggctattgagaatatcagaactgtcgtctcgttgacacaagagcggaagtttgagagtatgtacgtggaaaagttgtatggtccttatcgaaatagcgttcagaaagctcacatatacggcatcacattttctatctctcaggcgttcatgtatttcagttatgctggctgcttcagattcggcgcttacctcattgtaaacgggcacatgcggttcagggacgtgattctggtgttttctgctattgtgttcggtgccgtcgccctgggtcacgcctcatcattcgcccccgactacgcaaaggcaaagctgtcggccgcacatctgttcatgttatttgagagacagccactgatcgactcttactctgaggagggcctcaaaccagataagtttgagggtaacattacttttaatgaggtggtatttaactaccccacacgtgcaaacgtgcccgtcttacagggtctctcactggaagtcaaaaagggacagactcttgcccttgtgggtagctcaggctgtggcaagagtaccgtagttcagctgctagagcggttttacgacccgctggcgggaactgtcttcgtcgatttcgggttccaactcttagatggccaagaagcaaagaagctcaatgtgcagtggctgcgagcccagctggggatagtatctcaggaacctatcttgttcgattgtagcattgctgaaaacatcgcttacggcgacaattcaagggtggtatctcaggacgagatcgtgtccgccgccaaggctgcaaacatacacccttttatcgagaccctgccgcacaaatacgagactcgtgtgggcgataagggaacgcagctttctggtgggcagaagcagcgcattgcaatagcccgggccttgatccgacaacctcagatcctcctgttggatgaggcaacgtcagctctagatacggagagcgaaaaagtggttcaggaggccctagataaagcccgcgagggacgcacatgcatcgttatcgcccatcgattaagcactatccagaacgctgatctcatcgtcgtgttccaaaatggacgcgtcaaggagcacgggacacaccagcagttgcttgcacagaaaggcatctacttcagcatggtgtcagtgcaggcagggacacagaacctc

SEQ ID NO: 7552 - DNA, 3858 bp, Artificial Sequence; identical to SEQ ID NO: 7508
  Description of Artificial Sequence: Synthetic coding sequence

SEQ ID NO: 7553 - DNA, 3858 bp, Artificial Sequence
  Description of Artificial Sequence: Synthetic coding sequence
atggatctcgaggcggccaagaatggaacggcttggaggccgacttccgccgaaggggactttgagctaggcatctctagcaagcaaaaacgcaaaaagactaagaccgttaaaatgataggggtgctcacactgttccgatactccgattggcaggacaaactgttcatgtccctggggaccattatggccatcgcccacggttcagggctgccgctcatgatgattgtattcggggagatgaccgataaatttgtggacacggcaggaaacttttcgttccctgtcaactttagcctttctctgctgaatccagggaaaattctcgaggaggagatgacgcggtacgcttattactatagcgggctgggcgctggcgtccttgttgcggcctacattcaggtgtccttctggactctagcagccggtaggcagattcgcaagatccgccagaagttcttccatgcaatcttgcgacaggagataggatggttcgacataaacgacaccaccgagctgaatacacgtctaacagacgacatctccaagatttctgaaggcatcggcgataaagtggggatgttctttcaggccgtggcaacctttttcgctgggtttatcgtgggcttcatcagggggtggaagctcaccctggtaattatggcaatctcaccaatccttgggttgtccgctgccgtgtgggccaaaatcctctcagcattctctgacaaggagctggccgcctacgcaaaagccggcgcggttgccgaggaagcccttggagcgattcgcaccgtgattgccttcggtggccaaaataaggagttggaaaggtaccagaagcatctggaaaacgcaaaggaaatcggaatcaagaaggccatctctgccaacatcagtatgggcattgcttttctactgatatacgcctcatacgcactggctttctggtacgggagtacactggtgatctctaaggaatacactataggcaatgcaatgacggtctttttttccatccttattggagccttctctgtgggtcaggccgccccatgcattgatgctttcgcgaatgccagaggagcggcatacgtcatctttgatattatcgacaataatcctaagattgacagcttctccgaacgaggccacaaaccagattccatcaaggggaatttggagtttaatgatgtgcacttctcttatcctagcagagccaacgtaaagattctcaagggactcaacctgaaggtgcagagcgggcagacggtcgctttagtcggctcgtcaggatgcggaaaatcaacaacagtccagctgattcagcggctgtacgaccctgatgaaggaactattaatatcgacggacaggatatccggaactttaatgtcaattacctcagagagattatcggggtagtttcccaggaacccgtgctgtttagcacgactattgctgaaaacatttgttatggaagaggaaacgtcaccatggatgagatcaagaaagccgtgaaagaagccaacgcatacgagttcatcatgaagttgccccagaaatttgatacactggtgggggagaggggcgctcagctctccggaggccagaaacagcgaatagctatcgcccgtgcattagtgaggaaccctaaaatcctgttattggacgaggccactagcgccctggataccgaatcagaggccgaagtgcaggccgcgctggataaagcccgtgagggacgcacgacaatcgtcattgcgcataggctgtccaccgtgcggaatgctgacgtgatcgccgggtttgaggatggcgtgatagtagaacaagggtcacactccgaactaatgaagaaggagggcgtgtacttcaaactggtaaacatgcagacttccggctctcagatccagtccgaggagtttgagctaaatgacgagaaggcagctaccaggatggctcccaacggctggaagtccaggctttttcggcacagcacccagaagaacctcaagaattcgcagatgtgtcagaagtctctggatgtcgagaccgatggactggaagcaaacgtgcctcctgtcagcttcctgaaagtgctcaagcttaacaagactgaatggccatattttgtggttggcactgtgtgtgccattgctaatggtggcctgcaaccggccttcagcgtcatattctcagagatcatagcaatattcggtcccggagacgatgcagtgaaacagcagaagtgcaatatcttcagcttaatctttctttttctgggaataatctctttctttactttcttcctgcagggattcacctttgggaaggctggcgaaatcctcacccgacgcttgcgttccatggcctttaaggctatgcttagacaggacatgtcatggtttgatgaccacaagaatagtaccggcgcattgagcactagattggcgacggacgcagctcaggttcagggggccaccggcacccggttggcactgatcgctcagaatattgccaacctgggtaccggcatcattattagcttcatctatggctggcagctgactctccttcttttagctgtagtcccaattatcgcagtcagcggcattgtggaaatgaaactactcgctggaaacgcaaagagggataaaaaggaattagaagccgctgggaaaatcgcgaccgaggccattgagaacattcgcacagtggtgagtctgacccaggaacgaaagtttgaatccatgtacgtcgaaaagctctatggcccttacaggaactccgtgcagaaagctcacatttacggaataacattctccatttctcaggcattcatgtacttcagttacgccggatgtttccggttcggagcttatctaatcgtaaatggccatatgcgcttcagggatgtaattctggtgtttagtgccattgtctttggagccgtggccttgggccacgcctcttcattcgcccctgattacgccaaagctaagttgagtgcggcccacctatttatgctgttcgaaagacagccactgattgatagctactccgaagagggccttaagccggataagttcgaagggaacattacgttcaacgaagttgtatttaactacccaactcgtgccaacgtgccagtgctgcagggcttaagtctggaggtcaagaaagggcagacgcttgcactggtcgggagtagtggctgcggaaagtctaccgtggttcaactgctggaacggttctatgatccattagcgggaacggtgttcgtggatttcgggtttcagctgctggacgggcaagaggccaaaaaactgaatgtgcagtggctgagagctcagctggggatcgtctctcaggagcccattctttttgattgcagtatagcagaaaatattgcatatggggacaatagtcgtgtcgtttcccaggacgaaattgtgagcgctgccaaagcagccaacattcatcctttcatcgaaaccttgccgcacaagtatgagacacgggtgggcgacaagggcacgcagttgagtggcgggcagaagcagagaatcgccatcgcccgggcgttaattaggcaaccccagattctgttgctggacgaggctacctccgctttggatacggaatccgaaaaggttgtccaggaagccctggataaagctcgggaaggcagaacttgcattgtcattgctcataggctgagtacgatccagaatgcagatctcattgtggtcttccagaatggcagagtcaaagagcacggcacacaccaacagctgctggcccagaaggggatttacttctctatggttagcgtgcaggccgggacgcagaacctg

SEQ ID NO: 7554 - DNA, 3858 bp, Artificial Sequence
  Description of Artificial Sequence: Synthetic coding sequence
atggacctcgaggccgccaaaaacgggactgcatggcgcccaaccagcgccgaaggagattttgaactcggcattagcagcaagcaaaaacgcaaaaagacaaagaccgtaaaaatgataggcgtgctcaccctgttcaggtactctgactggcaggataagctgttcatgtctctcgggactattatggccatcgcacatggtagcggactgcccttgatgatgattgtcttcggcgaaatgactgataagttcgtcgacacggcgggaaacttcagtttcccagtgaatttttctttgagtctgctgaatcctggcaaaatcctcgaggaagagatgacgcgatacgcctactactacagtggactgggagcaggagtgctcgtcgccgcgtatattcaggtttctttttggactctggccgctgggcgccagatcagaaagattaggcagaagttttttcacgcgattctgaggcaggagatcgggtggttcgatatcaacgataccacagaactgaatactcggctgaccgatgacatcagtaagatttccgagggcatcggggataaggttggcatgttctttcaggcggtggccacctttttcgccgggttcattgtcggcttcattcgagggtggaaattgacattggttattatggccattagtcccatcctgggtctctccgccgctgtctgggctaaaattcttagtgccttttcagataaagagctcgccgcctacgctaaggccggagctgtggcagaagaggccctcggcgccattagaaccgtgatcgcattcggtgggcagaataaggaactcgaacgctaccaaaaacacttggagaacgctaaagaaattggaatcaagaaagcgattagcgctaatattagcatgggcattgccttcctgcttatctacgccagttacgcgctggccttttggtatggtagtacacttgtgatcagcaaggaatacactattggaaacgcaatgaccgtgttcttttcaattttgatcggtgcgttctccgtgggtcaagccgccccgtgcattgacgccttcgccaacgcaagaggggctgcttacgtaatattcgacattatcgataataatcccaaaatagactcattctcagagcgcggccacaaacccgattcaattaagggcaacctggagttcaatgacgtgcatttctcctacccctctcgggccaacgtgaagatccttaaaggactcaatctgaaggtgcagagcgggcagaccgtcgcgctggtgggaagcagcgggtgcggtaagagcacgaccgtccagctgattcagagactgtacgatccggacgaggggaccattaacattgacggccaggacataagaaatttcaacgtgaactatctgagagagatcattggcgtggtcagccaggagcccgtgcttttttccacgactattgcagagaacatctgctatggacggggcaatgtcaccatggatgaaataaagaaggcagtcaaagaggccaacgcatacgagtttataatgaagttgccgcagaagttcgacacgcttgtcggggagcggggcgcccagctgagtggtggccagaaacagcggatcgccatcgcaagagccctcgttagaaacccgaagattctcctgttggacgaagcaacttccgctctggacacggagagtgaggcagaggtgcaggctgcgctggataaagcgcgggaaggacgcactactatagtaattgcacataggcttagtacggttaggaatgctgatgttatcgcgggatttgaggatggcgtgatagtggaacagggtagtcattccgagttgatgaagaaggagggagtgtacttcaagcttgtgaacatgcagacgtcaggatcccagatccagagcgaggaattcgaactgaacgatgaaaaggccgctacccggatggctcctaatggatggaaaagccgcctgttccgccacagcacccagaagaatctcaaaaattcccagatgtgtcagaagtctcttgatgtggagactgacggcctggaagcaaacgtcccaccggtatctttcctgaaggtactcaagctgaacaagaccgaatggccctatttcgtcgtgggaacagtgtgcgcaatcgctaacggaggtctgcagcctgctttctccgttatcttttctgaaatcattgctattttcggacctggagacgatgcagttaaacagcaaaaatgtaacatctttagtctgatatttctctttctgggaataatctcttttttcactttttttctgcagggcttcacattcggaaaggccggcgagattttgacgcgaaggctccgaagcatggctttcaaggccatgttgagacaagacatgagctggttcgatgatcacaagaatagcaccggtgcccttagcacccgcctggccacagatgctgcgcaggtgcaaggcgcgacagggacccggttggccctcattgcccagaatatagccaacttgggaacaggtatcatcatctcctttatctacgggtggcaactgacccttctcctgctggccgtcgtccctattatagctgtgtccgggattgttgagatgaagcttttggctggcaatgctaagagagataaaaaggaactggaggctgccggaaaaatcgctacagaagccattgagaacatccggactgtcgtgagtcttacgcaggaacgcaagttcgagtcaatgtatgtggagaagctttacggcccttataggaattccgtccagaaggcccacatttacggcattacctttagcatttctcaggcattcatgtatttcagttatgccggctgctttcggtttggggcatacctcatcgtgaacggtcacatgaggttcagagatgtgatcctggtcttcagcgcaatcgttttcggcgctgtggcactggggcatgcttcaagtttcgctcctgactacgcaaaggccaaactgagcgccgctcacctcttcatgcttttcgagcggcagcctctgatcgatagttatagcgaggagggactgaaacccgacaagttcgaggggaacatcactttcaatgaagtggtctttaattatccaaccagagctaatgtgcctgtgctccagggactcagtctcgaagtgaagaaggggcagactctggccttggtaggcagctccggttgcggcaaaagtaccgtggttcagctcctggaacggttctacgaccctcttgccggtaccgtctttgtcgacttcgggttccaacttctggacggtcaggaggccaaaaagttgaatgttcagtggcttcgagcacagctgggcatcgtcagtcaggaacccattttgttcgattgtagcatcgccgaaaacattgcctatggcgataactctagggtggttagccaggacgagatagtctcagcagcgaaggccgccaacattcatcccttcatagaaacactccctcataagtacgaaactagggtgggcgataaaggaacccagctttctgggggccagaagcagaggattgcgatcgcaagggccctgattcgccagccccaaattttgctcctcgatgaggctacgtcagcgctggatacagagtctgagaaggttgtgcaagaggccctcgataaagcccgcgagggtagaacatgcattgtaattgcccaccgcctcagcacaattcagaatgcagacttgatagtcgtgttccagaatggccgagtcaaagaacacggaacccaccagcaactcctggcacagaaaggcatctatttctctatggtttccgttcaggccggtacccagaatttg

SEQ ID NO: 7555 - DNA, 3858 bp, Artificial Sequence
  Description of Artificial Sequence: Synthetic coding sequence
atggaccttgaggcagccaaaaacggaaccgcatggcgtcccacgtcggcagaaggcgatttcgaacttggtatttccagtaaacaaaaacgcaaaaagaccaagaccgtgaagatgattggtgtattgactctgttccgatactcggactggcaagacaagctgttcatgtcactcggcactataatggccatcgcgcacggcagcggcctgccacttatgatgattgtgtttggcgagatgactgataagtttgtggacactgcaggaaatttcagctttcctgtgaacttttccctttccctccttaatcccgggaaaatactggaagaggagatgaccagatacgcatactactactccggactcggagctggagtgcttgtggcagcatacattcaagtctctttctggactctcgccgcaggacgtcaaattagaaagattcgacagaaattcttccatgctattttgaggcaagagattggatggttcgatatcaacgacaccaccgaactgaatactcgcctgaccgatgatatctctaaaatctcagaaggcatcggagataaggtcggcatgttttttcaggcggtggcaacctttttcgcaggttttatcgtgggattcatacgaggatggaaactcacccttgtgattatggccatatcccctatacttggactttcggcagcggtgtgggccaagatcctgtctgctttctcggataaggaacttgccgcatatgcaaaggccggtgcggtcgcagaagaggcgcttggggcaattagaacggtcatagcctttggaggtcagaacaaggagctggaacggtaccaaaagcatttggaaaatgccaaggaaattggaatcaaaaaggctatttccgcaaatatctcgatgggaatcgcctttcttctcatatacgcaagctacgcacttgcattttggtacggatcaactctggtcatttcgaaggagtacaccataggcaatgctatgacggtgtttttctcaattctcataggggcgttctccgtcgggcaagccgcaccttgtattgatgcatttgccaacgctcgtggagcagcgtacgtgatctttgatatcattgacaacaatcctaaaatcgactcgttttccgagcggggtcataaacctgatagcatcaagggaaaccttgagtttaatgacgtccatttctcctacccttcccgcgcgaacgttaagattttgaagggactgaacctcaaggtgcaatcaggacaaactgtcgctctggtgggatcgtcgggttgtggaaagagcaccacggtgcaactgattcaaaggctgtacgatccagatgaagggactataaacattgatggacaggacattcgcaactttaatgtgaactaccttcgagagatcattggggtcgtgagccaagaaccagtattgtttagtactaccattgccgagaacatctgctatgggcgcggtaatgttaccatggatgagatcaagaaggcagtgaaagaagcaaatgcctacgagttcatcatgaaactgccgcagaagtttgacactcttgttggtgaaagaggtgcacaacttagtggagggcagaagcaaaggatcgcaatcgcaagagctctggtgagaaaccctaagattctcttgcttgatgaggctacctccgccctggacactgagtccgaagcggaagtccaagcagcactcgataaggcacgagaaggtagaactaccattgtcattgcccataggctgagcactgtgcggaacgcagacgtgattgctggttttgaagatggagtaatcgtggaacaggggtcacatagcgagcttatgaaaaaggaaggagtgtactttaaacttgtcaatatgcagaccagtgggtcacaaattcaatccgaggaatttgagctgaacgacgaaaaggcggcaacgagaatggcccctaacggatggaagagcagactctttcgccactccacccagaagaatctcaagaattcgcaaatgtgtcaaaagagcctggacgtggaaaccgacggattggaagccaacgtaccacctgtgagctttctcaaagtgctgaagctgaacaagaccgagtggccgtactttgtcgtgggaaccgtgtgcgcaatagcaaacgggggacttcagccagcattcagcgtgattttctcagagattatagccatcttcggccccggagacgacgcggtgaagcagcaaaagtgcaacattttcagccttatctttctctttctgggtatcatatcgtttttcactttctttctgcaaggatttacctttggtaaggccggagaaattcttactaggcggttgagatccatggcgtttaaagcaatgttgagacaggatatgtcgtggttcgatgaccataagaactcaacgggtgcactgtcaacgcggctggctaccgacgcggcacaagtgcaaggcgctaccgggacccgactcgcactgattgcacagaatattgctaaccttggcactggaattatcattagcttcatttacggatggcaactgaccctccttctgctcgcagtggtccctattatcgcagttagcggtatcgtcgagatgaaacttctggcaggtaacgctaagagagacaaaaaagagcttgaagcggctggtaaaatcgcaaccgaggccatagaaaacattcgcactgtcgtctcactcacccaggaaaggaagtttgaatcgatgtacgtggaaaaactctacggtccataccggaattcagtgcaaaaggcacatatctatggaatcaccttttcgatctcgcaggcatttatgtacttttcgtacgcaggatgttttcgctttggtgcatacctgattgtgaacgggcacatgcgctttcgggatgtgattcttgtttttagtgcaatcgtgtttggggccgtggcactggggcacgcatcttcgttcgctcctgattacgcaaaggccaagctgtccgccgcacatcttttcatgctcttcgaaaggcaaccgctgatagattcatactccgaagaagggctgaagccagataagttcgaaggaaatatcaccttcaacgaggtcgtctttaactacccaactcgcgccaacgtgccagtgctccaaggcctgtcccttgaagtgaagaaaggccaaactcttgcgttggtgggcagctcaggctgcgggaaatctactgttgtgcaactgctggaaaggttttacgatccccttgcaggtaccgtctttgtggattttggttttcagctgctcgatggacaggaggcgaagaagctcaacgtgcagtggctgcgggcacagcttggtatagtgtcccaggaacccattctgttcgattgttcgatcgctgagaacattgcgtacggagataattccagagtcgtgtcccaggatgaaattgtgtcggcagcgaaggccgccaatattcacccttttatcgaaactctcccacataagtacgaaacgcgggtgggcgataagggcacccagctctccggtgggcaaaagcagagaatcgcaattgcacgcgcactgatccgtcagccccaaatactgctcctggacgaagcaacctcggcccttgatactgaatccgaaaaagtcgtacaggaggcccttgataaggcccgtgaaggtcggacttgtattgtgatcgcccatagactctccacgattcagaacgcagatcttatcgtggtgtttcagaatgggcgtgtcaaggaacacggaacccaccaacagctgcttgcgcaaaaaggaatctatttctctatggtgtcggtgcaagcgggcactcagaacctc

SEQ ID NO: 7556 - DNA, 3858 bp, Artificial Sequence
  Description of Artificial Sequence: Synthetic coding sequence
atggatctggaagcggccaaaaatgggacagcttggcggcctacatccgccgaaggagacttcgaactcgggattagttcaaaacagaaaaggaaaaaaacaaaaactgttaaaatgataggagtattaactctatttcgatattctgattggcaggataagttattcatgtctttaggaacaataatggcaatcgcccatgggtccggacttcccctaatgatgatcgtatttggagagatgactgataagttcgtggatacagccggaaacttttctttccccgtgaacttttcactcagtctgctcaatccagggaaaatcttggaagaggagatgacaagatacgcttattactattcagggctaggggctggagtgcttgtggccgcctacatccaggtcagtttctggacactggccgctggaaggcagatcagaaaaataaggcagaaattcttccacgccatactgcggcaggagatagggtggtttgatataaacgatactactgagctaaatactcggcttacagatgatatatccaaaatctcggaagggatcggggataaggtagggatgttctttcaggctgtagcaactttcttcgctggattcatagtggggtttatcagggggtggaaactcactctagtcataatggcaatctctcccatcctaggactatctgccgcagtgtgggctaagatcttgagtgcattctccgataaagaacttgctgcctacgcaaaagccggggcagttgcagaagaagccttaggagccatcaggactgtgattgctttcgggggacagaataaagagctggagagatatcagaaacatctagaaaatgcgaaagaaatcgggatcaaaaaagccataagtgccaatatctccatgggaatagcgttcctcttaatatatgcatcttatgcactagcattctggtacgggtccactcttgtaatctcaaaagaatatacaattgggaacgcaatgactgtgtttttttccattctgatcggagcattctcggttgggcaggccgcaccctgtatcgatgcctttgccaatgcaagaggggctgcttacgttatttttgacattattgataacaaccctaaaattgatagtttcagtgagcgcggacacaaacctgatagtataaaaggaaacttggaattcaatgatgtacatttctcttatccttctcgagcaaatgtaaaaatcctaaaaggactcaatttgaaagtccagagtgggcagacagtcgctttggtaggaagttccggatgcggaaagagtacaacagtacagctcatccagcggctctatgatcccgatgaaggaactataaacatagacgggcaggatattcgaaacttcaatgtgaattatctcagggaaattataggagtcgtgtcacaggaacccgtcctcttttctacaacaatcgctgaaaacatttgttatggacgagggaatgtgacaatggacgagatcaaaaaggccgtgaaagaagctaacgcctatgaattcattatgaaactgccacagaaattcgatacactcgtcggggaaaggggggcccagctgtcaggagggcagaaacagcggatcgctatcgcacgggctctagtcaggaaccccaaaattcttcttttagatgaagccacttccgccctggatactgaatcagaggccgaagtacaggccgctcttgataaagcccgcgaaggaaggacaacaattgtgatagcccacaggctttccactgtgcgcaatgcagatgttatagctggatttgaagatggggtgatcgtggagcagggatctcattccgaactcatgaaaaaggaaggagtgtacttcaaattggtcaacatgcagacatcaggatctcaaatccagtccgaagagttcgaactaaatgacgaaaaggcagcaacacggatggctcccaacgggtggaaatctaggctgtttcgccattcgactcagaagaacttgaaaaatagtcagatgtgtcagaaatcactcgatgttgaaacagatgggcttgaagccaatgtgcccccagtctctttcctcaaggttttaaaactaaacaaaactgaatggccttattttgtggtcgggactgtgtgtgcaattgctaatggggggctgcagcccgcattcagtgttatattctctgaaattattgccatcttcggaccaggagatgatgcagtgaaacagcagaaatgtaacattttttcgctgatctttctgtttctgggaataatctcttttttcacgttttttctgcagggattcacttttggaaaagctggagaaattctcactcggagacttcgaagtatggcatttaaagccatgctcagacaggacatgtcgtggtttgatgatcataaaaattccacaggggcactatctactagactggccacagatgccgctcaggttcagggagcaactgggactcggttagccctcattgcccagaacatagcaaacttaggaacagggattatcatctcttttatatacggatggcagcttactctgctactactggcagtcgtccccattatcgccgtgtccgggatagtggagatgaagttactggctggaaatgcaaagcgagataaaaaagaactagaggctgctggaaaaatagcaacagaagctatcgaaaacatcaggacagtggtctcactaactcaggaaaggaaatttgaatccatgtatgttgagaaactttacggaccctatagaaacagtgtgcagaaagcacacatttatggaatcacattttcaataagtcaggcctttatgtattttagttatgcggggtgcttcagattcggagcttatctgatagttaacgggcacatgaggtttagagatgttatactcgtattttctgcaatcgtgttcggagccgtggccttagggcacgcttcttcgtttgcccctgactacgctaaagcgaagctctcagcagctcatttgttcatgttatttgaaaggcagcctctcattgattcttattctgaagaggggctcaaacccgataaattcgaaggaaacatcacattcaacgaggttgtgtttaattatcctacacgagctaacgtgcctgtgctacaggggctctctctcgaagtgaagaagggacagacactggccctcgtcgggtcgtccgggtgtgggaaatctacagtagtgcagctcctagagagattttatgacccactagctggaacagtttttgtggattttgggtttcagttactcgatggacaggaagctaaaaaactcaatgttcaatggctacgcgcccaactgggaatagtgagtcaggaaccgatattgtttgattgcagtatcgccgaaaacattgcatatggggataattctagggtggtgtcccaggatgagatcgtgtctgctgccaaagctgccaacatacatcccttcattgaaactcttccacataaatatgagacaagagtaggagataaaggaactcagctgtcaggagggcagaaacagcgcatagctatcgcacgggcactaatacggcagccccagatactactgctggacgaggccacgtcggctctcgatacagaatctgaaaaggtagttcaggaagccctcgataaagcccgcgaagggagaacttgcatcgtgatagcgcaccgcctttcaactattcagaatgctgatttgatagttgtttttcagaatggaagggtgaaagagcatggaacacatcagcagttattggctcagaaagggatatacttttctatggtgtcagtgcaggcaggaacacagaacctc

SEQ ID NO: 7557 - DNA, 3858 bp, Artificial Sequence
  Description of Artificial Sequence: Synthetic coding sequence
atggatctcgaggccgctaaaaatggaactgcgtggcgacctacaagcgcggagggagacttcgaactgggcatctcaagcaaacagaagagaaaaaagaccaaaaccgtgaagatgattggagttctgactctttttcgctatagcgactggcaagacaaactctttatgtccctgggcaccatcatggctatcgcccatggttccggcctgccactgatgatgatcgtgttcggggagatgaccgacaagttcgtggataccgcgggcaacttcagtttccctgtcaatttttcccttagcctgcttaatccggggaagattcttgaagaggagatgacacggtacgcatactattactcagggttgggagcaggcgtactcgtggctgcatacatacaggtaagcttttggacgctggcagccgggcgccagatacgcaaaattcgccaaaaattttttcatgccatcctcagacaggagataggctggttcgacattaatgacacgacagaactgaacacacgactgactgacgacattagcaagatcagtgagggcatcggcgataaggttggtatgttttttcaggcagtggcaacctttttcgcaggtttcattgttggttttatccgcgggtggaagctcacccttgttatcatggccatctctcctattttaggcctcagtgctgccgtttgggccaagatcctgagtgccttctccgataaagaactggctgcctacgccaaagctggcgcagtggccgaagaggccctcggcgcaatccggacagtgatagcctttggaggccagaacaaggaactcgaaagataccagaaacatctggagaacgccaaggaaattgggattaagaaggctatttccgccaacattagcatgggcatcgcattcttgctgatctacgctagctatgccctggccttctggtacggttctacccttgtgatctctaaggagtataccatcggaaacgctatgaccgtctttttttcgatcttgattggcgcctttagcgttggtcaggccgccccttgtatcgacgctttcgcaaacgcacggggcgcagcgtatgtgatcttcgacatcatcgataacaatccaaagatcgattcattcagcgaaagaggccacaagccagactcaatcaagggaaacttggaatttaacgacgttcatttttcttatccatctcgggccaacgtgaagattctgaaggggttaaatctgaaggtacagagcgggcagacagttgctctggtgggcagctctggatgcggtaagtcaaccacggttcagttaatccaaagactctatgatccggatgaaggtaccataaacattgatggccaggacatccgcaactttaacgtgaattacctgcgagagattatcggggtcgtgtcccaggaacccgtcctcttttccaccaccatcgcggaaaacatctgttacgggcgtggaaatgtgaccatggacgagattaagaaagcggtgaaggaggccaacgcctatgagtttataatgaagctgccccaaaagttcgacactctggtgggtgagcgaggggcacagctctctggaggtcagaaacagaggatcgcaatcgcccgagccctggttcgaaaccccaagatcttgctgctcgatgaggccacttctgccctcgatacagagagtgaagccgaggtgcaggcggcgctggataaggcacgggagggtagaaccactatcgtcatagcgcacagactgtcaactgtgcgcaacgccgatgtgatagccggcttcgaagacggcgtcatagtggaacagggatctcatagcgagttaatgaagaaagaaggtgtgtacttcaaactggtgaacatgcaaacatctggaagccaaatccagagcgaggaattcgagcttaatgacgagaaggccgccaccaggatggcccctaacggatggaagtcccgactctttcgccactctactcaaaaaaaccttaaaaactctcagatgtgccaaaagagcctggatgtcgagaccgacgggctcgaagccaatgtgccccctgtctctttcctgaaggtgctcaagctgaacaaaacagagtggccctactttgtggtgggcacagtgtgcgccatcgccaacggaggtctccagcccgctttctccgttatcttctcagagatcatcgccatatttggtccaggcgatgatgccgtcaagcagcagaagtgcaacatcttcagcctgatattcctgtttctgggcattatttccttttttacctttttccttcagggctttaccttcggaaaggccggggagattcttactaggagacttcgttctatggcttttaaggccatgttacgtcaggatatgtcctggtttgacgaccataaaaacagtacaggagccctaagcacccgtctggcaaccgacgcggcccaggtgcagggtgccacaggtaccaggctggcacttatagcccagaacatcgccaatctgggcaccggtatcatcattagtttcatatatggctggcagctgaccctgctactcctggccgtagtacccatcattgccgtgtccgggattgtcgagatgaaattgctggccggcaatgcgaaacgggataagaaggaattggaggccgctgggaaaattgccacagaagctatcgaaaacatccggaccgtcgtttccctgacccaggagaggaaatttgaaagtatgtatgtggagaagctgtatggcccatatcgcaattctgtgcagaaggcccacatctatggcatcacgttcagtattagtcaggcatttatgtatttttcctatgctggttgcttccgtttcggtgcttacctaatcgtgaatggtcatatgagattcagagatgtgatcctggttttcagcgctattgtctttggcgctgtggcgctgggccatgcgagctcattcgcgcctgattatgccaaagcaaagctcagcgcggctcatcttttcatgctgtttgagaggcagccacttatagattcttattctgaggaggggcttaaacccgataaattcgagggaaacattactttcaacgaggtggtctttaattacccaacccgtgctaacgtgccggtccttcagggcctgtctcttgaggtaaagaaggggcagaccctggcattggtagggtctagcggatgcggcaagagcacggtggtacaactgctcgagcggttctacgacccactcgcgggcactgtgttcgtcgatttcgggtttcagctgctggatggccaagaagcgaaaaagctcaacgtccagtggctccgcgcgcagctggggatcgtgtctcaggaaccaatattgttcgactgcagcatagcagagaatatcgcatacggcgacaacagtagggtcgtaagtcaggacgagattgtgtccgctgccaaagctgcaaatattcacccattcatcgagaccctgccccataagtatgagactcgagtgggcgataagggaacccagcttagcggcggccaaaagcagaggatagccattgccagggctctcattaggcagccccagatcctgctgttggacgaggccacaagcgcactggatacggagtccgaaaaagtcgtgcaggaagctttagataaggcccgagagggaagaacttgtattgtgattgcacatcgccttagcaccatccagaatgcagacttaattgtcgtgtttcagaatgggagggtgaaggagcatggtacccaccagcagctattggcccagaagggcatctacttcagcatggtgtctgtccaagccggcacgcaaaacctg

SEQ ID NO: 7558 - DNA, 3858 bp, Artificial Sequence
  Description of Artificial Sequence: Synthetic coding sequence
atggatctcgaagcggccaagaacggaactgcttggcggccaaccagcgcggagggggacttcgagctggggatctcatccaagcagaaacgcaagaaaacgaaaaccgtcaagatgatcggtgtgctcactttgttccgctactccgattggcaggacaaactcttcatgtctctgggtaccatcatggctattgcacatggttctggcctccccctgatgatgatcgtgttcggtgagatgactgacaagttcgtcgataccgcggggaacttcagcttccccgtgaacttctccctgtccctgctgaaccccggaaagatactggaggaggaaatgacgaggtacgcttactactacagcggcttgggagcaggagtgctcgtggccgcatacatacaagtctcattctggactctggcggccggacgacaaatcagaaagatccgccagaaattcttccacgcaatcctcagacaggaaatcggatggttcgatatcaatgacaccactgagttgaacacccgcttgactgacgacattagcaagatctccgagggaattggagacaaggtgggaatgttttttcaagcggttgctaccttcttcgccggcttcatcgtgggtttcatcagaggatggaagctgactctggtgatcatggctatctcgccaattctggggttgtcagccgccgtctgggcaaagatcctgtcggcgttctccgataaagaactggccgcttacgcaaaggccggcgcagttgccgaagaagccttgggagctatacggaccgttattgcctttggagggcagaataaggaactggagagataccagaaacacttggaaaatgctaaggagatcggtatcaagaaggccatttcggcgaacatcagcatgggcatagccttcctgctgatctacgcgagctacgcccttgcgttttggtacggctccaccctcgtgatctcaaaggaatacactatcggaaacgcgatgaccgtgttcttttcgatcctcattggggctttctcggtgggacaggcagctccctgtattgacgcattcgccaatgcccggggcgcggcatatgtgatcttcgatatcatcgataacaatccgaagatagattccttctccgaacgcggacataaaccggactcgatcaaagggaatctggagttcaatgatgtgcacttcagctacccatcgcgcgcaaacgtcaagatcctcaagggcctgaatctgaaagtgcagtcaggccagaccgtggctcttgtgggttcctcgggctgcggcaagtccactacggtgcagctcatccagcgcctgtacgaccctgacgaaggaactatcaacatcgacggccaagacattcgcaactttaacgtgaactatttgagagagatcatcggggtcgtcagccaggagccggtgctgttctcaaccaccatcgctgaaaacatctgctacgggagaggaaacgtgactatggacgaaatcaagaaggctgtgaaagaggccaacgcctacgagtttatcatgaagctgcctcaaaagttcgatacgctcgtcggcgagcggggtgcccaactgtcaggcgggcagaagcaacggatcgcaattgcccgcgcgctggtcaggaaccctaaaatcctgctcctcgatgaggccacctcggcgcttgacaccgaatcagaagccgaagtgcaggccgcacttgacaaagcaagggaaggccgcacgactatcgtgatcgcgcaccggctgtctaccgtgcgcaatgcagacgtgatcgcggggtttgaagatggagtcattgtcgagcagggatcgcactcagagctgatgaaaaaggagggagtgtacttcaaactggtgaacatgcaaaccagcggatcacagatccaatccgaggaattcgagctgaacgatgaaaaggccgccacgcggatggcgccaaacggatggaagagccgactgttccggcactcgacccagaaaaatcttaagaattcacaaatgtgtcaaaaatcgctcgacgttgagactgatggactggaagcaaacgtgcctccggtgtcgtttctcaaggtgctcaagttgaataagactgagtggccgtacttcgtggtgggaacggtgtgtgccatcgctaacggcggcttgcaacctgccttttcagtcatcttcagcgaaatcatcgcgatctttggaccgggcgacgacgcagttaagcaacagaaatgtaatatcttttcactgatcttcctctttctggggattatcagcttcttcaccttcttccttcaaggattcacctttggaaaagccggagaaatcctgactcgacggctcagatctatggctttcaaagcgatgctgaggcaggatatgtcttggtttgacgaccataagaattcgactggagctctgtcgaccagactcgccactgacgcggcccaggtccagggagccacgggtacccggttggccctgatcgcccaaaacatcgccaatctgggcaccgggatcattatctcatttatctatggatggcagctcaccctgcttctgctcgccgtcgtcccaattatcgccgtgtctggcatcgttgagatgaagctgcttgccgggaatgcaaagcgagataagaaggaacttgaagccgctggcaagatcgcgaccgaagcgatcgaaaacatccgcactgtcgtgtcgctcactcaggaaaggaagtttgaatccatgtacgtggagaagctgtacggaccatacagaaatagcgtgcagaaggcacacatctacggcatcactttctccatctcgcaagccttcatgtacttcagctacgcaggatgcttccgcttcggagcttacctgatcgtgaatggccacatgagattcagagacgtgatccttgtgttctcagccatcgtgttcggagcagtggcactcggacatgctagctccttcgccccggattacgcgaaggccaagctgtcagccgcgcatttgtttatgctgttcgaacgccagccgctgattgattcttactccgaggaaggtttgaaaccagataagttcgaaggaaacatcactttcaacgaagtggttttcaactacccgactcgcgctaacgtgccagtgctccaaggactctcgctggaggtgaaaaaggggcagaccctggcacttgtgggttcgtccggatgcggtaaaagcactgtggtccagctgctggaacggttctatgacccgctcgctgggactgtctttgtcgacttcggctttcagttgttggatggccaggaagctaagaagctcaacgtccaatggctccgagcccagctgggtatcgtctcccaagagccgattctttttgattgctccatagccgaaaacattgcttacggagataactcccgggtggtgagccaagacgagattgtctcggcggcaaaagccgcgaacatacatccgtttatcgaaactttgcctcacaagtacgaaaccagggtcggcgacaagggaacgcagctgtcgggaggacaaaagcaacgtattgcgattgctcgggcccttattcggcagccgcagatcctgctgcttgacgaagcgacctcggcattggacactgagtccgagaaagtcgtgcaggaggctttggacaaggcgcgcgaggggcgcacgtgcatcgtgatcgcacaccggctctccactatccagaatgccgacctcatcgtggtctttcagaacggaagggtgaaggagcacgggacccatcagcagcttctggcgcagaaaggcatctacttctctatggtttccgtgcaggcgggaacccaaaatctg

SEQ ID NO: 7559 - DNA, 3858 bp, Artificial Sequence
  Description of Artificial Sequence: Synthetic coding sequence
atggatctggaggcagccaagaatggtactgcatggaggcccacttcagccgaaggagactttgagctggggatctcctccaagcagaagagaaagaaaacgaaaactgtcaaaatgattggagtgctcaccctttttagatactcagattggcaagacaagttgtttatgtcgctgggcactataatggcaattgcacatggcagcggacttcctctgatgatgatagtatttggggaaatgaccgataagtttgtggataccgcaggaaacttctcgtttccggtcaatttctccctgtcgcttctcaatccaggtaagattcttgaagaagaaatgacgagatacgcctactactactcgggacttggcgcgggagtgctggtcgcagcatacattcaagtgtccttctggaccctggccgcaggccggcagattcgaaaaatccgtcaaaagtttttccatgcaatccttcgtcaagaaattggttggttcgacattaacgacaccaccgagctgaatacccggcttaccgacgacatttcgaaaatctccgaggggattggcgataaagtcggaatgttttttcaagcagtggcaacgttttttgcgggtttcatcgtgggtttcattagaggatggaaacttaccctggtcataatggcgatttccccaatcctcggtctgtcggcagcagtgtgggcaaagatattgagcgccttctcagataaagagctggccgcgtacgcaaaggctggcgcagtggcggaggaagcccttggtgccattagaactgtgatcgcattcggtggtcagaataaggaactcgagcggtaccaaaaacatcttgaaaacgctaaagaaatcggtatcaagaaagcaatctctgcgaacatttcgatgggtatcgcttttctgctgatctacgcgagctacgcacttgcattttggtacgggtccactctggtcatatctaaggagtatactatcggtaacgccatgaccgtctttttcagcatcctgatcggagcattttccgtggggcaggcagcgccttgtattgatgcttttgcaaatgcaaggggagcagcatacgtcatatttgatatcatcgacaataacccaaagattgattcattttcagaacgcggacataagcccgattccattaaaggcaacctcgagtttaacgacgtgcatttctcctacccaagccgcgcaaacgtcaagatactcaaaggacttaacttgaaagtccaatccggacaaactgtcgccttggtcggatcctccggatgtggaaagtcaaccaccgtgcaactgatccaacgcctttacgatcctgacgaaggaacgatcaatatcgacggacaagatatacgaaatttcaatgtgaactacctcagagagataatcggcgtggtgagccaagaacctgtgcttttttcaaccactattgccgaaaacatctgctacggacgcggcaatgtgaccatggacgagattaagaaggctgtgaaggaagccaatgcctacgaattcattatgaaacttcctcagaagtttgatacccttgtgggtgagagaggcgcacaactctcagggggacagaaacagcggatagcaattgcacgcgcactggtccggaatcctaagattctccttctggatgaagctacttcggcacttgatactgagtcggaagccgaagtccaagcagcgcttgacaaagcaagagaaggacggactaccattgtgattgcacataggcttagcaccgtgcgtaacgccgatgtgatcgcaggttttgaggacggggtgatcgtggaacagggaagccactccgaacttatgaagaaggaaggggtgtactttaagctggtgaacatgcagaccagcgggtcgcagatacaatccgaagaatttgaactgaatgatgaaaaagcggcaacccgaatggcgccgaacgggtggaagtcacgcctgtttagacacagcactcaaaagaacctgaagaactcacagatgtgccagaagtcgcttgatgtggaaactgatggtcttgaagccaacgtgccccccgtctcgtttctgaaagtgctgaagctgaataagaccgaatggccttacttcgtggtgggaactgtgtgtgcgatcgcaaacggaggtctgcagccagcattttcagtgatcttttcggaaatcatcgcaatctttggccctggggatgatgcggttaagcaacaaaagtgtaacattttcagtttgatctttctgtttctgggtattatcagcttctttaccttttttcttcagggttttacctttggaaaggcaggcgaaatactcactagaaggcttagatccatggcgtttaaagccatgcttagacaggacatgtcatggttcgatgaccacaagaattcgaccggtgcactgtccactcggcttgcaaccgatgcagcacaggtgcagggagcaaccggtaccaggctcgcattgattgcgcagaacatagctaacctcgggacgggaatcatcatttcttttatctacggttggcaacttaccctccttctcctggccgtcgtccccattatcgcagtgtccggaatcgtggaaatgaaactccttgcaggtaatgcaaagcgagataagaaggagcttgaggcggcaggaaagatcgcaactgaagcaatcgagaatatcaggacggtggtgtcactgacccaggaacgcaagtttgaatcgatgtacgtggaaaagctgtatggaccataccggaattcggtccaaaaagcgcacatttacggaattaccttttcgataagccaagcgtttatgtactttagctacgccggttgttttaggtttggagcataccttattgtcaacggccatatgaggtttcgagacgtcattcttgtgttctcggcaatcgtctttggtgctgtcgcactgggacacgcgtcgagcttcgcgcccgattacgcaaaggcaaaactttcggcagcgcacctgtttatgctgttcgaacgacagccattgattgacagctactcggaagaaggccttaagcctgacaagttcgaaggtaatatcacttttaacgaggtggtgtttaactatcctacccgggccaacgtgccagtgcttcagggcttgagccttgaagtgaagaaaggacaaacccttgcactggtgggatccagcggttgcggcaagagcacggtggtccagttgttggaacggttttacgatcctcttgcaggaaccgtgttcgtcgacttcggtttccaacttctggatggacaggaagcaaagaaacttaacgtgcaatggctgcgggcacagcttggcattgtgtcgcaggaaccgatcctgtttgattgctcaatagcggaaaacatcgcatacggtgataattcgcgagtggttagccaggatgaaatcgtgtcggcggccaaagcagccaatattcacccgtttattgaaactttgccccacaagtacgagactcgggtgggcgataagggtactcagctttcaggaggccaaaagcagcgtatagcaatcgccagagcactgatcagacagccacaaattctgctgctcgatgaagccacctcggctctcgataccgagtccgaaaaggtggttcaagaggccctggataaggcaagagagggtcggacttgtattgtgatcgcacaccgactctcaactatacaaaacgcagaccttatcgtggtgttccaaaacggacgtgtgaaagagcatggtacccatcaacaactccttgcacagaagggaatttacttttccatggtgtcggtccaggccggcacccagaacctc

SEQ ID NO: 7560 - DNA, 3858 bp, Artificial Sequence
  Description of Artificial Sequence: Synthetic coding sequence
atggacctcgaggctgccaagaatgggaccgcgtggaggcctaccagcgcggaaggagactttgagctgggtatctcctcaaaacaaaagcgtaagaaaactaagaccgtgaaaatgatcggtgtcctgacgctgttccgctactcagactggcaagacaagttgtttatgtcgctgggaacgatcatggccatcgcccatggatcgggactcccactgatgatgatcgtgttcggcgagatgactgacaaattcgtggacacggccggcaacttctccttcccggtgaactttagtctttcgttgttgaacccgggaaagatactcgaggaagaaatgacccgctacgcatactactactcaggactgggagctggggtgttggtggctgcatacatccaggtgtcattctggaccctggcggccgggagacaaattcgcaaaatccggcagaagttcttccatgccattctgagacaggagatcggatggttcgacattaatgacactaccgagctgaacaccagactcactgacgacatctctaagatttcggaaggcatcggggataaagtgggtatgttttttcaagctgtggcgaccttcttcgccgggtttatcgtcggattcataagaggctggaaactgactctcgtcatcatggcgatctctccaatcttgggcctgtcggctgctgtgtgggccaagatcttgtccgccttctcggacaaggaactggctgcgtacgccaaagcgggagcagtggcagaagaagctctcggcgccatcaggactgtcatcgcgttcggaggacaaaacaaggagctcgaaagataccagaaacacctcgaaaatgccaaggagatcggaatcaagaaggcgatctcagccaatatctcaatgggtatcgcgtttctgctgatctacgccagctacgcgctggcattctggtacggtagcaccctggtgatctcaaaggagtacactattgggaatgcgatgactgtgtttttcagcatactcatcggagccttcagcgtgggccaagctgctccttgcattgatgcatttgctaatgcgcggggcgccgcatacgtgatttttgacatcatcgacaataacccgaagatcgattccttcagcgaacgcggtcacaagccagatagcatcaaggggaatcttgaattcaatgatgtccatttctcatacccgagcagggcaaacgtaaagatcctcaagggactgaacctgaaggtgcagtccggccaaaccgtggcactggtggggagctccggatgcggcaagtcgactaccgtccagttgattcaacgcctctacgatcccgatgaaggcaccatcaacatcgacggacaggacatccggaactttaacgtgaattacctccgcgaaatcatcggggtggtatcgcaggagcctgtgcttttctcgaccactatcgctgagaacatctgttacggccgcggcaacgtgacgatggatgagatcaaaaaagcggtcaaggaagccaatgcctacgagtttatcatgaagctgccccagaagttcgacaccctggtcggcgaacgcggagcgcagctttcgggcggacagaagcaaagaattgcgattgcgcgcgcgctggtccgcaatccaaagatcttgttgctggacgaagccacgagcgctcttgacaccgaatcggaagcggaagtccaggcggcgctcgacaaagcgcgggagggccggactaccatcgtcattgcacatcggctgagcactgtgcggaacgccgacgtgatagctggatttgaagatggagttatcgtggagcagggaagccactctgagctcatgaaaaaggaaggtgtgtactttaaacttgtaaacatgcaaacttcagggtcccagatccagtccgaggagttcgagctgaatgacgagaaagccgccacccggatggcaccgaatggatggaaatccaggctgtttcgccattcgactcagaaaaacctgaagaactcccaaatgtgccaaaaatcgctcgacgtggaaaccgacggtttggaagcaaatgtccccccagtctcctttcttaaggtgctcaaactgaataagaccgagtggccttacttcgtcgtcgggaccgtgtgtgctatcgccaatggaggactccagccggctttctccgtcattttctcggagatcattgcgattttcgggccgggagatgatgcggtgaagcaacaaaagtgcaacattttcagcctcatcttcctgttcctcgggatcatcagcttcttcacgttcttcctgcagggattcaccttcgggaaggccggtgagatcctgacccggcgcctgcgctccatggcgttcaaagcaatgctcagacaagacatgtcgtggtttgatgatcacaagaactctaccggtgccctttcgactcgcttggcgactgacgccgcacaggtgcagggggccactggaactcgcctggcactcatcgcacagaacattgccaacctgggaactggaatcatcatctcctttatctacggctggcagctcacgctgctgcttctggccgtcgtccccatcatcgctgtgtccggaatcgttgaaatgaagctgttggccggcaacgccaagcgcgataagaaggaactggaggcggctggaaagatcgctactgaagctatcgaaaacattcggacggtggtgtcgctgacccaggagaggaaatttgaatccatgtacgtcgaaaaactgtatggtccgtacaggaactcggtgcaaaaggcccacatctacggtattactttctcgatctcgcaggccttcatgtacttctcatacgcagggtgcttccgcttcggcgcatatctgatcgtcaacggccacatgcgctttagagacgtgatcctcgtattctcggccattgtttttggagccgtggctttgggccacgccagctccttcgcccccgattacgccaaagcaaagctgtcggccgcccacctcttcatgctgttcgaacggcaaccgctgatcgactcctatagcgaggaaggacttaaaccggacaagttcgaggggaatatcacctttaatgaagtcgtgtttaactatccaactcgggccaatgttccagtgctccagggactttcattggaggtaaagaagggacagactttggccttggtgggatcaagcggatgtggtaagtcgaccgtcgtgcaactgcttgaacgcttttacgatcctctcgcgggaacggtgttcgtagatttcggattccagctgctcgacgggcaggaggccaagaaactgaacgtgcagtggctgagagcacagctgggtatcgtctcccaggagccgattctcttcgactgctccatcgctgaaaacatcgcctacggtgataactccagggttgtctcccaggacgaaattgtctcggcagccaaggccgcaaacatccacccgttcatcgaaactctgcctcacaagtacgaaaccagagtgggagataaaggaacccagcttagcggagggcagaagcagcgtatcgctattgcccgagcactgattcggcagccgcagatcctgctcctcgacgaggccacctcggccctggatacggagtcagaaaaggtcgtccaagaagccctggacaaggcgcgcgaaggacgcacttgcatcgtcatcgcacatagattgtccactatccagaacgcggatctcattgtggtgttccaaaacggacgggtgaaggagcatggaacccaccagcaattgcttgcccaaaaaggcatatacttctcaatggtgagcgtgcaagctggcacccagaacctg

SEQ ID NO: 7561 - DNA, 3858 bp, Artificial Sequence
  Description of Artificial Sequence: Synthetic coding sequence
atggatctggaggctgcaaagaacggtacagcctggcgcccgacatcggcagaaggcgatttcgagttaggtatctcctccaagcagaagcggaaaaaaacaaagacggtgaaaatgattggagttctaacgctcttcaggtattctgactggcaagacaaactgtttatgagcttggggacgatcatggctatagcacacgggagcggcctgccgctgatgatgattgtgtttggcgagatgactgacaagtttgtcgataccgccggaaattttagttttccagtgaacttctcgctttcacttttaaaccctgggaagattttggaggaagaaatgacgaggtacgcctattactacagtggccttggggcaggagttctggttgcggcgtacatccaggtgtcattctggactttggcagcaggaagacagattagaaagatacgacagaaattcttccatgcaatcctaaggcaggaaatagggtggtttgacattaatgataccacggagctgaacacaaggctgactgacgatatttcaaaaatttctgagggcatcggggataaagttgggatgtttttccaagcagtcgccacgttcttcgccggcttcattgtggggtttattcggggatggaaactcactctcgtgatcatggcaatttctccaatcttgggactgtccgcagcagtctgggccaagatcctgtcagcgtttagtgacaaggaactggccgcatatgcgaaagctggcgctgttgcggaggaggctctgggagcaattcgaacagtgattgcctttggcgggcagaataaggagcttgagagatatcagaagcacttggagaatgctaaagagataggaatcaagaaagctatctcagccaacatctctatgggcattgcctttctgcttatctacgccagttatgcacttgccttctggtatgggagcactctggttatctcaaaggaatataccatcggtaatgctatgaccgtgtttttcagtattctgatcggggctttctctgtcggtcaagcggccccctgtatcgatgcctttgcgaatgcgcgcggggcagcctatgtcattttcgatatcattgataataatcccaagattgatagttttagcgaacggggccacaagccagactctataaagggtaatctcgagtttaacgacgttcacttctcctatccttcacgcgcaaatgtcaaaattttgaaaggcttgaatttaaaagtgcagagcggacagactgttgctctcgtgggaagcagcggatgtgggaagtccactaccgtacagttaatccagcggttgtacgacccggacgaggggaccattaacatcgatggacaggacattcggaacttcaatgtaaactacctaagagagattatcggagtggtgtctcaagagcctgtcctgttctctaccaccatagcagagaacatctgctacggtagggggaatgtaaccatggacgagataaagaaggccgtcaaggaagctaatgcgtacgagttcatcatgaaactaccacagaaatttgacactctcgttggtgagcgaggtgcgcaactaagcggcggacaaaaacagcggattgcaatcgctagggccttggttcggaaccccaaaattctgctgttggacgaagcaacctcagcccttgacaccgaatctgaagctgaggtgcaggctgcgttagataaggcacgcgaggggcgcaccactattgttatcgctcatcgcctaagcactgtacgcaacgctgacgtaattgcgggcttcgaggacggagtgatagtggagcaaggttctcattcagagctgatgaaaaaggagggggtttacttcaaactagtcaatatgcagacaagtggatcacagattcagtccgaggagttcgagttgaatgacgagaaagccgcaacaagaatggcgcctaacggctggaagtctcgccttttcaggcactctactcagaagaatctcaagaactcgcagatgtgtcagaagtcactcgacgtggagacggatggccttgaagccaacgttccgccagtgtcattcctgaaggttctgaaactgaataagaccgagtggccatactttgtagtagggaccgtgtgtgcaattgccaatggcgggctccagcccgcatttagtgtcatattctctgaaataatcgccatctttggcccaggcgatgatgcagtgaagcagcagaagtgtaatatctttagtctaatcttcctcttcttagggattattagtttttttacctttttcctgcagggtttcacctttggaaaagccggggagattctcacccggcgcctgagatctatggcttttaaggcgatgctgaggcaggatatgtcgtggtttgacgatcataagaactccaccggcgccctgtcgacgagactggcaactgacgctgcacaggttcagggcgccacgggtacccgactcgctctgatagctcaaaacatagccaatttgggcacaggcattattattagcttcatctacgggtggcagctgacgctactgcttttggccgtggtgcccattattgcagtgtcagggatcgtggaaatgaagttgttggccgggaacgcaaaaagggacaagaaggagctcgaggccgcaggaaaaatcgccacggaggcaatagaaaacatacgtacggtggtgagcctgacccaggagcgcaaattcgagagcatgtacgtggagaaactctatggtccgtaccgaaacagcgtgcagaaggcccacatctacggtataacattttcaatctcacaggcttttatgtacttctcttatgctgggtgttttagattcggagcatacttgatcgttaatggccacatgcgcttcagggacgtcatcctggtcttctctgcgatcgtcttcggagctgttgcgttgggacacgcgagctccttcgcccctgactatgccaaggcaaaactgagcgctgcacaccttttcatgctgttcgaaagacaaccactcatcgactcttactccgaagagggcctgaaacccgacaagttcgaaggtaacatcactttcaacgaggtggtgtttaattatcccacacgtgcgaacgtgcccgttctgcaagggctgtcgctggaggtgaagaaagggcaaaccttagccttggttggcagttccggttgtgggaaaagcaccgtggttcagctccttgaaagattttacgatcccctcgccggcacagtattcgtggactttggattccaattactagacgggcaggaggccaaaaaactcaacgtgcagtggctccgggcacaattggggatcgtgagtcaggagcctattctgttcgactgtagtatcgccgagaacatcgcgtacggcgataatagtagagttgtctcacaggacgagatcgtgtccgccgcgaaagcagcaaacattcacccctttatagaaacattgccacacaagtacgagactagagtgggtgacaagggcactcaattgtcagggggccagaaacagcggattgccattgcgcgtgcactgattcgacagccacagattctgttactggacgaggccacctcagccctagacactgaatctgagaaagttgtgcaggaagccctggacaaggcccgggaaggtagaacctgcatagttatcgcccatcggctctctactatccaaaacgctgatctcattgtagtgtttcagaacggacgtgtgaaggaacatggtactcatcagcaactgcttgcacagaaaggaatttactttagtatggtgagcgtccaggcaggcacacagaacttg

SEQ ID NO: 7562 - DNA, 3858 bp, Artificial Sequence
  Description of Artificial Sequence: Synthetic coding sequence
atggatctcgaagctgcgaaaaacggtaccgcatggcgccccacctctgctgagggcgatttcgaactggggatatcatctaagcagaaacgaaagaagaccaagactgtgaaaatgattggtgtgctgactctttttagatacagtgattggcaggataagttatttatgagcctagggacaatcatggccatcgcccatgggtcgggactgcctctgatgatgatagtgttcggcgagatgacagacaagtttgtcgatactgctggtaacttttcatttcccgtgaacttcagccttagtctcttgaatcccggaaaaatactggaggaggaaatgactcgttacgcatactattactcagggctgggggccggtgtattagtggccgcgtatattcaagtctctttctggacgctcgccgccgggagacagattcgaaagatacggcagaagttcttccacgctattttgcgccaagagattggatggttcgatatcaatgacacaactgagctcaacaccagactgacagacgacattagtaagattagcgaggggataggcgacaaggtagggatgttcttccaagcagtcgccactttttttgccggattcatcgtcgggttcatcagaggttggaagttgacactggtgataatggccatttcacctatcctaggtctgtccgcggcggtgtgggctaaaattttgtccgcgttctccgacaaagagttggccgcatacgcaaaggccggagctgtggccgaggaagcgcttggcgccattcgtactgtgatagcttttggaggacagaacaaggagttggagagataccagaagcatctggagaatgccaaggagatcggaataaaaaaagcaatctctgctaatatttcaatgggcattgcatttctcttaatctacgccagttacgccctcgctttttggtatggcagtactctggtcattagcaaagaatacaccatcggtaacgccatgactgttttttttagtattctgatcggggctttcagtgtcggccaggctgccccctgcattgatgcctttgcaaatgctcgtggagccgcatatgtgatctttgacatcatcgataacaaccccaagatcgactcattctccgagaggggtcacaagcctgactctatcaagggaaacctggagtttaacgatgttcatttctcctacccttctagggccaacgtgaagattcttaaaggcctcaacttgaaagtgcaaagtggccaaaccgtggctctggtcggaagtagtggatgcggcaaatcaaccaccgtacaactgatccaacgactgtatgaccctgacgagggtaccatcaatatcgatggccaggatatccgaaattttaatgtgaattatttacgcgagattatcggagtcgttagccaggaaccagttttgttctccactaccatcgctgaaaatatctgttatggaagagggaacgtgacgatggacgagattaagaaggctgtcaaggaagccaacgcatatgagtttattatgaagctacctcagaagttcgataccctggtgggggagagaggcgcacagttgagcgggggacagaaacagagaatagcaatagcacgcgcgctggtccgaaacccgaagatactgttgcttgacgaggcgacctctgccttggacaccgaatcagaggcagaggtgcaagcagccctggacaaggcccgggaagggcgaacaacaatcgtgattgcccacagattaagtaccgtgaggaacgctgacgttatcgccggctttgaagatggcgtcattgtggagcaggggagtcattccgagctgatgaagaaagagggggtgtatttcaagctcgtcaacatgcagacttccgggtcacagatacagtccgaggaattcgaattgaacgacgaaaaggctgcaacgcggatggcccctaacgggtggaagtctaggctcttcaggcactcaacacagaaaaacctgaagaactcccagatgtgccaaaagtcccttgatgtggaaaccgacgggttggaagcaaacgtgccacccgtgtctttcctcaaagtacttaagctgaacaaaacagagtggccttactttgtcgtcggcaccgtgtgcgccatcgcaaacggcggattgcagcctgcgttttctgttatttttagcgagatcatcgcaattttcggacccggagatgatgcggttaaacagcaaaagtgcaatatcttttccctcatatttctgtttctggggatcatctctttctttaccttcttcctccaggggtttactttcgggaaggctggcgagatcctgactcgccgcctgaggagtatggcttttaaggcaatgctcaggcaggacatgtcgtggttcgatgatcataaaaatagtaccggggctctgtcgacccgcctggcgaccgacgcggcacaagtgcaaggcgcaacggggacacgtctggccctgattgcccaaaatatcgccaacctcggcaccggcatcatcattagctttatttatgggtggcagctaactctgctgttgctggccgttgtgcccataatcgcagtctcaggcatagtagagatgaaactactggccgggaatgccaaacgtgacaaaaaggagctcgaggctgcagggaaaattgcgactgaagctatagagaacatccgaaccgtagtgtccctgacgcaggaaaggaaatttgagtctatgtatgttgaaaagctctatgggccataccgaaactccgtgcagaaggcccacatctatggaattaccttctctatcagtcaggccttcatgtatttctcttatgctggctgcttcagatttggcgcctatcttattgtgaatgggcatatgagatttcgagatgttatattggtgttttccgccattgtgtttggagccgtggctttgggccacgcaagcagtttcgccccggactacgcaaaggccaagctgtctgccgcccatctgtttatgctgtttgagcgacagccactaatcgattcctactcagaagagggcctcaagcccgacaagttcgagggtaacattacttttaatgaggtggtgtttaattacccgactcgggccaatgttccggtcttgcagggactcagcctcgaggtgaagaagggacagaccttggctctagtgggaagctctggatgcggcaagtccacggtcgttcagcttctagagcggttttacgatcctctcgctggtacagttttcgttgactttggttttcaactactcgacggtcaggaagccaagaagttgaacgttcaatggctcagggcccaacttgggatcgtctcacaggaaccgattcttttcgattgcagcatcgccgagaatatcgcctatggagataattcccgtgttgtgagtcaggacgagatcgttagtgctgccaaggccgcaaatattcatccgtttatagagactctcccgcataaatacgaaaccagggtcggcgataagggcacacagttaagtgggggtcagaagcaaagaatcgcaatcgccagagcacttatcaggcaaccacaaattctcctgctggacgaggccacaagtgccctcgataccgagagcgaaaaggtcgtgcaggaggccctggacaaggccagagagggtcgcacatgcatagtgatcgcccatcggctgtctacaattcagaatgcggatcttatcgtggtgttccagaatggaagggtgaaagaacatgggacccaccaacagttgcttgctcagaagggcatctacttctctatggtatctgtgcaggctggaacacagaattta

SEQ ID NO: 7563 - DNA, 3858 bp, Artificial Sequence
  Description of Artificial Sequence: Synthetic coding sequence
atggatcttgaggctgcgaaaaacggtacggcgtggcgcccaactagcgctgagggggacttcgagctgggaatcagctccaagcagaagcgcaagaagaccaagacggtcaaaatgatcggagtgctgaccctcttccgttactcggactggcaggataaactgttcatgtccttgggtaccataatggccatcgcacacgggtcgggactcccgctgatgatgatcgtgttcggagaaatgacggataaattcgtggacactgctggaaatttcagctttccagtcaacttttcactttcgctcctgaatcctggaaagatcctcgaggaggaaatgacgcggtacgcatactactactccgggctgggagcaggtgtgctggtcgccgcatacatccaggtgtccttctggacccttgcggctggaaggcagatacggaaaatccgccagaagtttttccatgcaatcctgagacaggagataggatggtttgacatcaacgacaccaccgaattgaatacccgcctgaccgatgacatctcgaagatctcggaaggcatcggtgataaggtgggcatgttctttcaggccgtggctactttctttgcggggtttatagtgggatttatccgcggttggaagctcactctggtgataatggccatatcaccaatccttggcttgagcgcagctgtttgggcaaaaatcctgtccgccttttcggataaggaactggctgcttatgccaaggctggagccgtagctgaagaagctctgggagccattcgcactgtgatcgcattcggaggccagaacaaggagttggagagataccagaagcacctggagaatgcaaaggaaatcggaatcaagaaagccatctccgccaatatctccatgggcattgcgttcctccttatctacgcttcgtacgcattggctttttggtatgggtcgactctggttatctctaaggagtatactatcgggaacgctatgactgtgttcttctcaattctgattggcgccttcagcgtggggcaagccgccccgtgcatcgacgccttcgcaaacgcgagaggtgctgcgtatgtcatcttcgacattatcgacaataatccgaagatcgacagcttctcggaacgggggcataaaccagattcgatcaagggcaacctcgaattcaacgatgtgcacttttcttaccccagccgcgctaacgtgaagattcttaagggactgaacctgaaggtgcaatctgggcaaaccgtggcgctggtgggatcttctggatgcggaaagtcgaccactgtgcagctcatccagcgcctgtacgatccagacgaggggactatcaacatcgacggacaagacatcagaaatttcaacgtgaactaccttagagagatcattggagtggtgagccaggagccggtgctctttagcacgaccatcgcggagaacatctgctacggcagaggaaacgtgactatggatgaaatcaagaaggcagtcaaggaagccaatgcttacgaattcatcatgaagttgcctcagaagtttgacaccctggttggagaacgcggcgcgcagctctcaggagggcagaaacagagaatcgcaatcgctagagccctcgtcaggaatcccaagatcctcctccttgacgaggccacctcagcactcgataccgaatcggaagcagaggtgcaagcggctctggacaaggcgagagaagggcgcaccaccatcgtgatcgcccaccggttgtcgaccgtgcggaatgcagacgtcatcgctggattcgaggatggtgtcatcgtcgaacagggatcgcactcagaactgatgaagaaagaaggtgtgtactttaagctcgtcaacatgcagaccagcggctcgcaaattcagtcagaagaatttgagctgaacgacgagaaggcagccaccagaatggccccgaatggatggaagtcgagactcttcaggcattcaacgcagaaaaaccttaagaactcacaaatgtgccagaaatcgctggatgtcgagactgacggacttgaagccaatgtcccaccagtctcatttctcaaggtgctcaaactgaacaagactgagtggccgtatttcgttgtgggaactgtctgtgccatcgccaatggtggactgcagccggccttctcagtgatcttcagcgaaatcattgctatcttcggccccggagatgatgcagtgaaacagcaaaagtgcaacattttttcactgatctttttgtttttgggaatcatttcatttttcaccttcttcctgcagggattcactttcgggaaagccggagagatcctgaccagaagactccgctccatggccttcaaagcgatgctccgccaggacatgtcgtggtttgatgaccacaagaattcaactggagcgctttccactcggctggccactgacgctgcacaggtccagggcgcaaccggtacccggctggcactgatcgcccaaaacatcgccaaccttggcaccggaattatcatctcgttcatctatggttggcagttgactctcctgttgctggccgtcgtgccgatcattgcagtgtccgggatcgtcgaaatgaaactccttgcgggaaatgcgaaacgcgataagaaggagctcgaagccgccggaaagatcgccaccgaggccatcgagaacatccggactgtggtgtcactgacccaagagcggaagtttgaaagcatgtatgtggagaaactgtacggcccgtaccggaattccgtgcaaaaggcgcacatctacggaatcactttctccatctcacaggcgttcatgtacttcagctacgctggctgtttccggttcggcgcctaccttatcgtgaatggacacatgaggttccgcgatgtcatcctggtgttcagcgcgattgtctttggagcagtagcgcttgggcatgcctcatcgttcgcccccgattacgcaaaggctaaactctccgcggcccacctgttcatgttgtttgagcgccagccgctcatcgatagttacagcgaggagggcctgaaacccgataagttcgaaggcaacatcaccttcaacgaggtcgtcttcaattacccaacccgggctaacgtgcctgtgctgcagggactctcattggaagtgaaaaagggacagactctggcacttgtcggcagcagcggatgcggaaaatccaccgtggtgcaacttctggaaagattctacgatcccctggcgggaaccgttttcgttgactttggattccagctgctggatgggcaggaggccaagaagttgaatgtgcaatggctgcgggcccaactcggaatcgtgtcgcaagaaccgattctgtttgactgctccattgccgagaacatcgcatacggcgataattccagggtcgtctcccaggacgagattgtgtccgccgcaaaggcagctaacatccatccgttcatcgaaaccttgccgcataaatacgaaaccagagtgggcgataaggggacccaactctccggcggtcagaaacaacgcattgccattgccagagccctcatccggcagcctcaaattcttttgctggatgaagctaccagcgcgctcgacactgagtccgagaaggtggtgcaggaagccctcgacaaagcccgcgagggacgaacgtgcatcgttatcgcccaccgcctctccaccatccaaaatgctgatctgatcgtggtgttccagaacggacgggtgaaggagcatgggactcaccagcagctcctggcccaaaagggaatttacttcagcatggtgtcagtccaggctggaacccaaaacctg

SEQ ID NO: 7564 - DNA, 3858 bp, Artificial Sequence
  Description of Artificial Sequence: Synthetic coding sequence
atggacctcgaagcggccaagaatggtaccgcctggcgtccgacgagcgcggaaggtgattttgaacttggcatcagcagcaagcaaaagcgtaaaaagacgaaaaccgtcaagatgatcggtgtgctgaccctgttccggtatagtgactggcaggataaactgtttatgagcctggggaccatcatggcgattgcccacggctctggactgcctttaatgatgatcgtcttcggtgagatgaccgataaattcgtcgatacagccggcaatttcagcttcccagttaattttagcctgagcctgctgaacccgggcaagattcttgaagaagaaatgaccaggtatgcatattattactcagggctgggtgcaggagttctggtggctgcttacatacaggtgtcattttggaccctggccgccggcaggcaaatacgcaaaattcgtcagaagttttttcacgccattctgcgtcaggagattggctggttcgacatcaacgatacgaccgagctgaataccagattgacagatgacatttcaaagattagtgaaggtatcggtgataaagttggtatgttttttcaagccgttgccaccttttttgccggctttattgtgggcttcatcagaggctggaagctgacgttggtcatcatggcaattagcccaatcctgggactgtccgccgccgtttgggcaaagatcctgagcgcatttagcgacaaggagctggcggcctatgctaaagctggtgctgtcgcggaagaggccctgggtgcaatacggactgtgatcgccttcggcggccagaataaggagctggagcgctaccagaagcatttggaaaatgcgaaggagataggtataaaaaaggcaatcagcgcaaacattagcatgggtattgcgttcttgcttatctacgcgtcatacgcacttgcgttttggtacggtagtaccctcgttatctcgaaggagtataccatcggtaacgcgatgacagtgttttttagcattcttatcggtgctttcagcgtcggtcaagccgcgccttgcatcgatgcattcgcgaatgcacgaggagcggcatacgtcatcttcgacatcatcgataataatccgaaaattgacagttttagcgagcgtggtcataagccagactccatcaagggtaatctggaattcaatgacgtccactttagctatccctcacgcgcgaacgttaagattctgaagggactgaatctgaaagtgcagagcggccagactgtcgcgcttgtgggaagcagcggctgcggtaaatccaccaccgtccagctgatccagagattgtatgatccagacgaaggaaccattaacatcgacggccaggatatccgcaactttaatgtgaactatttgagagaaattatcggtgtggtgtctcaggaaccagtcctgttctctaccacgattgctgaaaacatatgttacgggcgcggtaacgttactatggatgagatcaagaaggctgttaaagaagccaacgcctatgaattcatcatgaaactgccccagaaattcgacaccttggttggtgagcgcggcgctcaactgagcggcggccaaaaacagcggatcgcgatcgcccgggccctggtccgcaacccgaagatcctgctgctggacgaagcgaccagcgctctcgacaccgagagcgaggccgaggttcaggctgctctggataaagcacgggagggtcgcacgacaatcgtgattgcgcatcgactttctaccgtgcgcaacgcggatgttatcgcgggttttgaagacggcgtgattgtggaacagggttctcacagcgaactcatgaagaaggagggtgtatatttcaagctcgtgaacatgcagaccagtggttcacaaatccaatctgaggagttcgagctcaacgacgagaaggcggcaacgcgtatggcgcccaacggctggaagtcccgcctgtttcgtcacagcacccaaaaaaaccttaaaaactcacaaatgtgccagaaatcattggacgtggaaactgatgggctggaagcgaatgtgcctccagtgagtttcctgaaggtcctgaagctgaacaagacggaatggccttattttgtcgttggtaccgtgtgcgctattgcgaatggcggcctgcagccggctttttctgtgattttcagcgagatcatcgctattttcgggcctggcgacgacgcagtcaagcagcagaagtgcaatatattctcgttgatcttcctgtttcttgggataatttccttttttaccttcttcttgcaaggcttcacctttggcaaagcgggcgagattttgactcgccgtctcagatctatggctttcaaggcaatgctgaggcaggacatgtcctggttcgacgaccacaagaacagtacaggcgccttgagtactcgactggcgaccgatgcagcacaggtgcagggagctaccggcacccgcctggctttaattgcccaaaacattgcaaatttaggaacgggtattattatttcctttatttatggctggcagctgacgctgctgctgctcgcggtggttccgattatcgccgtcagcggaattgttgaaatgaaactgctcgccggtaacgcaaagcgggataagaaggaactggaggcagcaggtaagatcgcaaccgaagctatcgaaaacatcaggaccgtggtctcgctgacccaggagcggaaatttgagtccatgtatgtcgaaaaactgtacggcccgtaccgtaacagcgtgcagaaagcccacatctatgggatcacgttcagcatctctcaagccttcatgtacttctcatacgcgggttgctttcgctttggagcatatctcattgtcaatgggcacatgaggttccgcgacgttatcctggtgtttagcgctattgtcttcggtgccgtggcactgggccatgcttcctcatttgcgccagattatgctaaagccaagctttccgccgcccatctgttcatgctgttcgagcgacagcctctgattgacagctattctgaagaggggctgaaaccggacaaatttgagggtaatattacttttaatgaggttgttttcaactatccaactcgcgcgaacgtgccggtcctccaaggcctcagcctggaggttaagaaaggccagactttggcgctggttggttccagcggatgtggtaagagtaccgttgtccagctgctggaacggttctacgatcccttggccggcaccgtattcgttgacttcggcttccaactcctggacggccaggaagccaaaaaactgaacgtccaatggctgcgcgcgcagctgggtattgtgagccaggagcccatcctttttgactgttcgattgcggagaacatagcctacggtgacaacagccgagttgtgagccaggacgaaattgtttcggctgccaaagcagctaatattcacccgtttatcgagactctgccgcataaatatgagacccgggtgggcgacaaaggcacccagttgagcggaggacagaagcaacggatcgctattgcgcgtgcactgatccgtcaaccacaaattctgctgctggatgaggctacgagcgcgctggacacggagagcgaaaaagtagtacaagaggccctggataaagcccgggaaggccgcacctgcatcgtgatagcgcatcgactgtcgaccattcagaatgcggacctcatcgttgtcttccagaacggtcgcgtgaaagagcacggtacccaccagcagctcttagcacaaaaaggcatctactttagcatggtctcagtccaggcgggaacccagaatctg

SEQ ID NO: 7565 - DNA, 3858 bp, Artificial Sequence
  Description of Artificial Sequence: Synthetic coding sequence
atggacttagaggcagctaaaaatggcactgcttggcgcccaacctctgccgaaggcgattttgaactgggaatttctagcaagcagaaacgcaagaagaccaaaaccgtgaaaatgataggcgttctcactctctttagatattccgactggcaagataagctcttcatgtctctcgggacaataatggctatcgctcacggtagcggtctacctctcatgatgattgtctttggcgaaatgaccgataaattcgttgacacagccgggaattttagcttcccggtgaattttagccttagcctgctaaaccccggcaaaattctggaagaagagatgactcgatatgcctattactattctgggctaggcgccggagttctggtggcagcgtatatacaggtctccttctggactctggcggccggccgccaaatccgaaagatcaggcagaagtttttccacgccatactgagacaggagattggctggttcgatattaacgacactacggagctcaacacaagactgaccgacgatataagcaaaatctccgagggcataggggataaagtggggatgttctttcaggcagtagctactttcttcgccggttttattgtcggctttatccgaggctggaagctgacattagtgatcatggccatcagtccaattcttggtctgagcgccgcagtgtgggctaaaattctgagtgctttctcagataaagagctggcggcttacgccaaagcaggggccgtggcagaggaggcacttggcgctattaggacagtgattgccttcggcggacagaacaaggagctggagcgctaccaaaagcacctggagaatgcgaaagagattgggatcaagaaagccatcagtgcaaacatttcaatgggaattgcattcttactgatttatgcatcctatgccctggccttctggtatggttcaactctggtcatttctaaggaatacacgatcgggaacgccatgactgtcttcttctcgattctgattggcgcattttcagtggggcaggctgcgccatgcatcgatgcgtttgctaatgctagaggtgcggcttacgtaatctttgatatcatagacaacaacccaaaaattgacagtttttctgaacgtggccataagccggactctatcaaaggcaacctggaatttaatgacgtgcactttagctatccttcgcgagcaaacgtgaagatccttaaaggactgaacctgaaggtacaatctggccagaccgtggccctagttggatcctcagggtgtgggaagtctactactgtccaattaatccaacggttgtacgatccagatgaaggaacgataaatatcgacgggcaagatatcaggaatttcaacgtgaactatcttcgggaaataatcggcgtggtctcccaggaacccgttctattttcaacaacgatcgcagagaatatctgctatgggaggggtaacgtgacaatggacgaaataaaaaaggccgtaaaagaggcaaacgcatatgagttcattatgaagttgccacagaagttcgacaccttggtgggggaaaggggtgctcagctaagtggggggcagaagcaaagaattgctatcgctcgagcgttagtacgcaatcctaagatcttgctgctggacgaggccacttccgctctagacacagaatctgaggctgaggttcaagctgccctcgacaaggctcgggaggggcgcactacgatcgtgattgcacatagattgtccaccgtccgcaacgccgacgttatcgccggatttgaggatggcgtaatcgtagagcagggctcacactccgagttgatgaagaaagaaggagtgtactttaaattagtcaatatgcagacctcaggatctcaaatccaatctgaggaattcgaactgaatgacgagaaggcggccacacggatggccccaaatggatggaaatcacggctgtttagacacagcacgcagaagaatctcaaaaacagccagatgtgtcagaagtccctcgatgtcgaaacagacggcctggaggcgaatgtgccacccgtgtcttttttgaaagtcttgaagctaaataaaactgagtggccctacttcgtggtcggcaccgtgtgtgcaattgcaaatggaggcctacagccagctttcagcgtaatcttctctgaaattattgctatcttcggcccaggcgatgacgccgttaagcagcaaaaatgtaatatcttcagtctcatatttttgtttctgggaatcatttcattcttcactttctttttgcagggtttcaccttcggcaaagccggggagatcctgaccagaagactgaggtctatggctttcaaagccatgttgaggcaggatatgagctggttcgatgaccacaagaactccaccggagcgctttctactaggctggcgacagacgccgcccaggtccaaggcgcgaccggcacacgactagctctcatcgcacagaacattgcgaacctgggcacaggcatcattattagctttatttacggatggcagctcacacttctgctcctcgcagttgtgcccattattgcagtcagtggaattgtggaaatgaagctccttgcaggcaatgcgaagagggacaaaaaggagctggaggccgcaggcaaaatcgcgactgaagctattgagaacattcgcactgtcgtgagtttaacccaggaaagaaaattcgaatctatgtacgttgaaaagctatatggtccttaccgtaactccgtgcagaaggcgcacatttatggaataactttttcaatcagtcaggccttcatgtacttctcatatgctggatgttttcgatttggggcttacctcattgtcaacggacatatgcggttcagggatgttattctcgtattttctgccatagtgttcggcgctgtcgctctgggacatgcttcaagtttcgcccccgattatgccaaggccaagctgtccgccgcacatctcttcatgctattcgagcgacagcccttaatcgatagttattccgaagaaggcctcaagcctgataagttcgagggcaatataacatttaacgaagtcgtgtttaactatcctacgcgcgctaacgtgcccgtcttgcagggcctgtccctggaggtgaagaagggacaaaccctagctctggtcggttcgtcggggtgcggcaagtcaactgtcgtccagctcctggaacggttctacgaccccttggctggaactgtattcgtcgattttggtttccagctgctcgatggccaagaggccaaaaagctgaacgtccagtggctcagggcccagttaggtattgtgagtcaggaacctatactatttgactgctccatcgcagaaaatattgcttatggtgacaacagtagagtggtgagccaggatgagatagtgtctgccgccaaggccgctaacatacacccgttcatcgagactcttccacataaatatgaaacccgagtcggggacaaaggcactcagctcagcggagggcagaagcagcggatagctatcgctcgggcgctgataaggcagccacagatcctcctcttagacgaggctactagcgctttagacacagagtctgagaaagtggtgcaagaggccctggataaagcacgtgaaggacgcacgtgtatcgtgattgcccatagactgtctaccattcagaacgccgaccttattgtggtatttcaaaacggtcgggtgaaggagcacggaacacaccagcagcttctagctcagaagggtatctacttttctatggtcagtgtgcaagcaggtacacaaaatctc

SEQ ID NO: 7566 - DNA, 3858 bp, Artificial Sequence
  Description of Artificial Sequence: Synthetic coding sequence
atggacttggaggctgccaagaacggcactgcatggcgccccacatccgctgagggagattttgaactgggcatcagttctaaacaaaagcgcaaaaaaacaaaaaccgtgaagatgatcggggtcctgactctctttagatacagcgactggcaagacaaactgtttatgtcattgggcactatcatggcaattgctcatggctccgggctgccattgatgatgatcgttttcggtgaaatgactgataagtttgtagacaccgctggcaacttcagttttcctgttaacttttcacttagcctgctgaaccccgggaaaatcttggaagaagaaatgaccaggtatgcatactactacagtggcctcggagctggggtcctggttgccgcctacatccaagtgtctttttggaccctggctgcaggcagacagattcgcaagataaggcagaaattcttccacgctatcctgcgtcaggaaattggctggttcgacataaatgatacaacagaactcaatactagactgaccgatgatattagtaaaatatcagaagggatcggagacaaagtgggaatgtttttccaggccgtcgccaccttttttgcaggcttcatcgttggattcatcagggggtggaagctgaccctagttatcatggcgatttcaccgatcctgggtctgtctgctgccgtttgggctaaaattttatctgctttcagcgataaggagctggctgcttacgccaaggctggagccgtcgcagaagaggccctcggagccatcagaaccgtcattgcgtttggtggccagaacaaagaacttgaaaggtaccaaaagcacttggaaaacgcaaaagagatcggaataaaaaaggcgatcagtgctaatatcagcatgggaatcgcattcttactgatctacgcaagctacgcgttagccttttggtatggtagcacacttgtgatttccaaagagtacactatcggcaacgctatgactgttttcttcagcatacttataggagcttttagcgtcggtcaggcagctccgtgcatagatgcgtttgctaacgctcggggcgccgcatacgttattttcgatatcattgacaacaaccctaagattgactcgttttctgaaaggggacacaagcctgactcaatcaagggtaacctggagttcaacgacgtacactttagctaccccagtagggctaacgttaaaattctaaagggcctaaaccttaaagtacagagcggacaaaccgtcgccctggtagggtcctcaggatgtgggaaatcgacaaccgtgcaactcatccagagactttacgacccagatgaaggcaccataaacattgatggccaagacatccggaacttcaatgtgaactacctgagagaaataatcggagtcgtgtctcaggaaccagtgcttttttcgaccacgattgccgaaaatatttgttatggcagagggaacgtgacaatggacgaaatcaaaaaagcagtgaaagaagctaacgcatacgagtttatcatgaaacttccccagaagtttgatacactcgtgggagaaagaggagctcaacttagcggtggacagaaacaaagaatcgcgatcgctcgtgcacttgtccggaaccctaagatattgttgctggacgaggctaccagcgcattggacaccgagagcgaagcagaggttcaggcagcacttgacaaagccagagaagggcgaactaccatcgtgatcgcccaccgcctctcaactgtccggaacgcggacgtcatcgcagggttcgaggatggcgtgattgtagagcagggatcacatagtgagttaatgaagaaagaaggcgtttattttaaactggtgaacatgcaaacatctggatctcagattcagagcgaagaatttgagttgaatgatgaaaaagcagccacgagaatggcgccgaacggatggaaaagtagactgttcagacactctacccagaaaaacctcaagaacagtcagatgtgtcaaaagagtttagacgtagaaaccgacggacttgaggctaacgtgcctcctgtaagctttctgaaggttctcaagttgaacaagaccgagtggccctactttgtcgttggcaccgtgtgcgccattgccaacggcggactgcaaccagcttttagcgtgattttcagcgaaatcattgctatctttgggcccggtgacgatgcagtcaaacaacaaaaatgtaatatcttcagtctgattttccttttcctgggcataatttccttcttcaccttctttctccaaggctttaccttcggcaaggcaggggaaatcctgactaggaggctcaggtccatggctttcaaagccatgctgaggcaggatatgagttggtttgacgatcacaagaactccaccggcgctctgtccacacgcctagccacagacgcggctcaggtccaaggggcaactgggacaaggttagccctgatagcccagaacatcgccaacttgggaaccggaatcatcatctctttcatatatggctggcaactcacacttttgttgctggcagttgtaccaatcatcgccgtatcaggaatcgtcgaaatgaaacttctcgctggaaatgctaagcgcgataaaaaggagctggaagccgctggtaaaatcgccacagaagctatcgagaatatccggactgtcgtgtcgcttacccaagagaggaaattcgaaagcatgtacgtagaaaagttgtatggcccatatagaaacagtgtccaaaaagctcacatttatggaataaccttttctatttcccaggcgtttatgtatttctcctacgctggctgttttcgatttggtgcatacctcatagtcaacggacacatgcggttccgggacgtcatattagtattctccgctatcgtgtttggcgccgtggccctggggcacgcctccagcttcgcacccgattacgcaaaagccaaactctccgctgctcacttatttatgctgttcgagaggcagccactaatcgatagctactccgaagaaggccttaagcccgataaatttgaaggtaacataacattcaatgaggtggtctttaactatcctacaagggcaaatgttccagtacttcagggcctcagcctggaagtgaagaagggacaaacactcgcgctggtgggaagctctggatgcggaaaatcaaccgtggttcagctgttggagcgtttttacgatccgctggcaggaacagttttcgtcgattttggcttccagctcctggacggccaagaagcaaaaaaacttaatgtgcagtggctgagggcccagcttggaatcgtgagtcaggagcctatcctcttcgattgctctatcgctgagaacattgcctatggggataactcaagagttgtgagtcaagatgaaattgtcagcgcagcaaaagctgctaacatccatccatttatcgagactcttcctcacaaatatgagaccagagtgggggacaaggggacgcagctctcgggtggtcagaagcaacgtatcgctatcgctagagccctcattcggcagccccaaattctgttgttagacgaggcaacatcagcgcttgatacagagtcagaaaaggtggtgcaagaagcacttgacaaagctcgcgaagggaggacatgcatagtgattgctcacaggttgagtaccatacagaacgcagatttgatcgtcgtctttcaaaatggtcgtgtgaaggagcacgggactcatcaacaactcttggcacagaaggggatctacttttctatggtttcggtacaggcagggacacaaaacctg

SEQ ID NO: 7567 - DNA, 3858 bp, Artificial Sequence
  Description of Artificial Sequence: Synthetic coding sequence
atggacttggaggccgcgaaaaatggtaccgcttggcggcccaccagcgctgaaggagacttcgagcttggaatcagctcgaagcagaaacgcaagaaaactaagactgtgaaaatgatcggagtcctcaccctgtttcggtactcggattggcaggataagctgttcatgtccctggggaccatcatggccatcgcgcacggatcaggcctgccgctcatgatgatcgtctttggcgagatgaccgacaagttcgtggataccgcgggcaacttctcatttccagtgaacttctctctctcccttctgaatccgggcaaaatcctggaagaagagatgacgagatacgcgtactactactccggattgggagccggggtcctggtggccgcctacattcaggtgtcattctggactctcgccgcggggcgccaaatccggaaaatcagacagaagttcttccacgccatcctgcggcaggaaatcgggtggttcgatattaacgacactactgaactcaatacccgcctgactgatgatatcagcaaaattagcgaaggaatcggtgataaggtgggaatgttttttcaagccgtcgctactttcttcgccggatttatcgtgggattcatccgaggatggaagctgacccttgtcatcatggctatcagcccgattttgggacttagcgcagccgtctgggcgaaaattctgtcggctttctccgacaaggaactggcagcgtacgcgaaggccggagctgtggctgaggaggccctcggtgctatccgcaccgtgatcgcgtttggaggtcagaataaagagttggaaagataccaaaaacacctcgagaacgctaaggaaataggaatcaaaaaggcaatttctgctaacatcagtatgggcatcgctttcctcttgatctacgcgtcctatgcactcgcgttctggtacggctcgactctggtgatctccaaggaatacactatcgggaatgccatgaccgtcttttttagcatcctcattggagccttcagcgtcggacaggcggccccctgtatcgatgcattcgccaacgccaggggcgccgcctacgtcatcttcgacattattgataacaatcctaaaatcgactccttctccgaacggggccacaagccggacagtatcaagggaaacctggagtttaatgacgtccatttctcatacccctcccgggccaatgttaaaatcttgaagggactcaatctgaaggtgcagtcgggacagactgtggcactcgtcggatcgtcaggctgcggcaagtcaacgacggtgcagctcattcagcgcctgtatgatccagacgaaggaaccatcaatatcgacgggcaagatatccggaatttcaacgtcaactacttgcgagaaatcatcggtgtggtgtcgcaggaaccagtcctgttctcgactaccattgccgagaacatttgttacggccgcgggaacgtgactatggatgaaatcaagaaggcagtgaaggaagccaatgcgtacgagttcatcatgaaattgccgcagaagttcgacaccctggtgggtgagcggggagcgcagctgagcggaggacagaagcaaagaatcgccatcgcacgggcgctggtgcgcaaccctaagatcctgctgctggacgaagcaacttccgccctggacacggagtcagaggccgaggtgcaagctgcccttgacaaggccagagagggcaggaccacgattgtgatcgcccacagactgtcgaccgtccgaaacgctgatgtgatcgctggattcgaggacggagtcatcgttgagcaagggagccacagcgaactcatgaagaaggaaggcgtgtacttcaagctggtaaacatgcaaacgtccggttcccaaatccaatctgaggaattcgaactgaacgatgaaaaagcagcgactcgcatggcaccaaatggatggaagtcccgcctcttcagacactcaacccagaagaacctgaaaaattcgcagatgtgccagaagtcgcttgacgtcgaaaccgacggcctggaagcgaacgtgccgcctgtgtcgttcctgaaggtcctgaagctgaacaagaccgaatggccttacttcgtggtggggactgtctgcgctatcgctaatggcgggctccagccggccttctcagtgatcttcagcgagattatcgccatcttcggtccgggcgacgacgcggtgaagcaacagaagtgcaacattttttcgctcatctttctgttcctcggaatcatctcgtttttcaccttcttccttcaaggcttcacctttggtaaagcgggtgagatcctcactcggaggctgcggtcgatggcgttcaaagcaatgctccggcaggacatgtcgtggttcgacgatcacaagaatagcactggcgccctgtccactaggctcgccactgacgcggcccaagtgcagggagctactggaacccgcctggcgctcatcgcgcaaaatatcgcgaatctggggaccgggatcatcattagctttatctacgggtggcagctgactctcctgctgttggcggtggtgccgatcattgctgtgtcgggaattgtggagatgaagctcctggcaggcaacgccaagagggataagaaagagctggaggcagccggaaagatcgccaccgaagcaatcgagaacatccggaccgtcgtgtctctgactcaagaacgcaagttcgaatcaatgtacgtggaaaagctgtatggcccgtaccggaactcggtccagaaggcccacatctacggcatcactttctccatcagccaggccttcatgtacttttcatacgctggatgcttccgcttcggcgcatacctcatagtcaacggacacatgcgctttagggacgtgatactcgtgttttccgccatcgttttcggtgccgtggcactgggccatgcaagctcgttcgccccagactacgcgaaagcaaaactgtcggcggcccatctgttcatgctgtttgaacggcagccgcttattgactcgtactcagaggaaggactgaaacctgataagttcgagggaaatatcacctttaacgaagtcgttttcaactacccgactagagccaacgtgcccgtgctccaaggactctcattggaagtaaagaagggccaaaccctggccctggtcggaagctcgggatgcgggaagtccactgtcgtgcagctcttggagaggttttacgatccactggcgggcactgttttcgtggatttcggatttcaactcctggacggacaagaagccaaaaagctgaatgtccagtggcttagagcacagctgggaatcgtgtcacaagaaccaattctgttcgactgctcaatcgccgaaaacatcgcatacggggacaactcgcgcgtggtgtcccaggatgagatcgtctccgcggcaaaggctgccaacattcatcctttcatcgaaacgcttccgcataagtacgaaactcgcgtgggagacaaaggaacccaactgtccggtggacagaaacagcgtatcgcaatcgctagagctctcatacgccagccacagatcctcctgcttgatgaggccacgtccgcattggacaccgagagcgaaaaggtggtgcaagaggcgctggataaggcccgggaaggccgcacctgtatcgttatcgcacatcgcctttcaaccatccagaacgccgacctcatcgtggtgttccagaacggtagagtgaaggagcacggaacccatcaacagctgcttgcccagaagggaatctatttcagcatggtgtccgtgcaggctggaacccagaacctc

SEQ ID NO: 7568 - DNA, 3858 bp, Artificial Sequence
  Description of Artificial Sequence: Synthetic coding sequence
atggacctggaagccgcaaagaacggcacggcatggaggcccacttcggcggagggcgatttcgaactcggtatttcctcgaagcagaaacggaagaaaaccaagacagtcaagatgataggggtacttacactgttcagatactccgactggcaggataagctatttatgtccttgggaactattatggcaatcgcccatggctccggactacccctgatgatgatagtcttcggcgagatgaccgacaaatttgtggacacggccgggaacttctctttcccagtcaacttttcactttctctgctgaatccagggaagattctcgaggaggagatgacacgttacgcatattactattccggactaggcgccggggtgctagtggcggcctacattcaggtgtctttctggacattagctgccgggcgccaaatcaggaagataagacagaaattttttcacgccatccttaggcaggaaattggatggttcgacatcaatgacacaacggaactgaatacccgcctaactgatgacataagtaagatctctgaaggcatcggggataaggtggggatgttttttcaggccgtcgcgacatttttcgccggatttattgttggctttatcaggggctggaaactcacactggttatcatggctatttcaccgattctcggcctgagtgccgctgtctgggctaaaattctcagcgctttttcggacaaggaactggccgcatacgccaaagcaggggccgtggcagaggaggctctgggcgcaatccggaccgtcattgcttttggaggacaaaataaagaactggagcggtatcaaaagcacttggaaaacgccaaggagataggcataaaaaaagccatctcagccaatatcagtatgggcatcgctttcctactgatctacgcgtcctatgctctcgcattttggtacggatcaaccctggtgattagcaaggaatatacaattggaaacgctatgaccgtattcttctccatcctcatcggtgccttcagcgtgggtcaggcagccccatgcatcgacgcctttgctaatgcaaggggggctgcctatgtgatcttcgatatcatcgataataaccctaaaatcgactcgtttagcgaaaggggtcataagcccgactcgattaaaggcaacctggaattcaacgacgtgcacttcagttaccctagccgggctaatgtgaagattctgaagggactcaacttgaaagtacaaagcggccagacagttgccctggtcggatctagtggctgcggtaaatcgacaaccgtccagctgattcagagactgtatgatccagacgaggggaccattaacattgacggtcaggatatccgcaatttcaacgtgaactacctacgggaaattatcggcgttgtgtctcaggaacccgtgttattctctacgaccatagcggagaacatttgttacggaagggggaacgtcacgatggacgaaatcaaaaaggcagtgaaggaggcgaatgcctacgagttcattatgaaacttccacaaaagtttgacaccctagtgggcgaacggggagctcagctttccggcggccagaagcagaggattgcaattgcacgcgcgctagtcaggaaccctaagatcctgctgttggacgaggctacatctgcacttgacacagaatccgaagcggaggtgcaggcagccttggacaaggcccgggagggcagaaccacaatcgtcatcgctcatagattaagcaccgtccgcaatgcagatgttatcgcgggcttcgaggacggggttattgtggagcaggggtcccacagcgagctgatgaagaaggagggggtttacttcaagctggttaatatgcagacttcagggtcgcagattcagagcgaagagtttgagctgaacgacgaaaaagctgccactaggatggctccaaacggatggaagtctcgactatttcgccactccacacagaagaatctgaagaactctcagatgtgtcagaaatctctcgatgtcgagactgacggcctggaggcaaatgtgccacccgtgtccttcttgaaagttcttaagctcaataaaaccgagtggccgtatttcgtagtaggcaccgtctgtgcaatcgccaacgggggcttgcagccagccttctcagtgatcttttctgagatcatagcaatctttgggcccggggacgatgctgtgaagcaacagaagtgcaatatcttcagccttattttcctcttcctcggcattatctcatttttcacatttttcctgcagggattcacattcggcaaagcgggggagatcttaacccgaagattacgaagcatggccttcaaggccatgttaaggcaggatatgtcttggttcgacgatcacaagaacagtaccggtgccctgagtacccgcctggcaacggatgccgcgcaagtccagggggcgactgggacaaggctggcactgatcgcgcagaatatcgccaatttagggacaggaattataatctcctttatatacggctggcaactgacacttctcctgctggcagtcgtgcccataatcgcagttagcggcatcgttgaaatgaagctgctggccgggaacgcaaagcgggacaagaaggagttggaggctgcaggaaagatagccactgaggcgatcgaaaacattaggacagtggtgtctctgacccaagagcggaagtttgagtccatgtacgtagagaaactgtatggtccctacagaaactccgtgcagaaggcacatatttacgggataaccttttcgatctcccaggcattcatgtacttttcctatgctggatgctttcggttcggcgcttacctgattgtgaatggtcatatgcgatttcgcgacgtaatactcgtattcagtgcgattgtgtttggggcggtcgcccttggccatgccagttcatttgctcctgattacgccaaggccaaactgtcagctgcgcacttgttcatgctgttcgaacgccagcccctcattgacagttacagcgaagaggggctaaaaccagataaattcgagggcaacattacgtttaacgaagtggtgttcaactatcccactagagcaaacgttcctgtcctgcagggcctttcactggaagttaaaaaaggccagacactggctctcgtgggcagttcaggatgcggaaagtccactgtcgtccagctgctagagcgtttctacgaccccctcgcaggcacggtttttgttgacttcggattccagctccttgacggccaggaggcgaaaaagcttaatgtacaatggctgagggcacagttgggaattgtcagccaagagccaatcctttttgactgcagtattgccgaaaacattgcgtatggggacaactcacgagttgtgagccaggacgagatcgtcagcgccgcaaaggcggcaaacatccacccattcatagaaactctgccccacaaatacgaaacacgagtgggtgacaaggggacccagctgtctggcggccagaaacagcggattgcgatagcaagagccctcattcggcagcctcagattttactactggatgaggcgacctccgctctggacacagagtcagaaaaggtcgttcaagaggcactggacaaggcccgggaagggcggacttgcatagtgattgcccatagactgagcacgatccagaacgctgatctcatcgtagtttttcaaaacgggagagtcaaggagcatgggacacaccagcagcttctggcgcagaaggggatctatttcagcatggtctctgtccaggcagggactcagaacctg

SEQ ID NO: 7569 - DNA, 3858 bp, Artificial Sequence
  Description of Artificial Sequence: Synthetic coding sequence
atggacctggaagcagccaagaacggaaccgcatggcgtccaactagcgctgaaggagattttgaactgggtatatccagcaagcaaaagcgcaaaaagactaagaccgtgaagatgatcggcgtgctgaccctgttccgatactcggattggcaagataagctgtttatgagcctggggaccattatggcaattgcacatgggtccggcctgccacttatgatgatagtctttggagaaatgaccgacaagttcgtggatactgcgggaaacttttccttcccagtgaacttttccctttccctcctgaaccctgggaaaattcttgaagaggagatgactagatacgcatactactactcaggactgggagccggtgtccttgtggcggcctacatacaggtgtcattttggactctggctgcaggacgccaaattcgcaagattagacaaaagttcttccatgcaattctgcgacaggaaattggttggttcgatatcaacgacaccaccgaactgaatactcggttgaccgatgatatatccaagattagcgagggcattggtgataaagtgggaatgtttttccaggccgtggcaacttttttcgccggttttatcgtcggctttattcgcggatggaaactgaccctcgttatcatggccatcagcccaatactgggactctcggcggccgtctgggccaagattctgtccgcgttttcggataaggaactggcagcgtacgcaaaggcaggagcagtggcagaagaagccctgggagcaattagaactgtcatcgcctttggcgggcagaacaaagagttggaacggtaccaaaagcatcttgaaaatgcgaaagaaatcggaattaagaaggcgatttcggcaaacatctcaatgggcattgcatttctgttgatctacgccagctacgctcttgcgttttggtacgggtccacccttgtgatctcgaaggaatacaccatcggaaacgcaatgaccgtgtttttctccatacttattggtgctttttcggtggggcaggcagcgccctgtatcgatgcatttgcgaacgcacggggagccgcctacgtcatcttcgatatcatcgacaacaaccccaagattgacagctttagcgaacgaggtcataagcccgatagcattaagggtaatttggagtttaatgatgtccatttttcgtacccaagccgggctaatgtgaagattctgaagggacttaatctgaaagtgcaatctggtcagaccgtcgcccttgtgggtagcagcgggtgtggaaagtcaacgactgtgcaactgattcaacgcctttacgacccagacgaagggacgatcaacattgatggtcaggatatccggaactttaatgtgaactacctgcgtgaaatcattggcgtggtgtcgcaggagccagtgctgttttctactactattgctgaaaacatctgttacggtagaggaaacgtgactatggacgaaatcaaaaaggcggtgaaagaggcaaatgcatacgagttcattatgaaactccctcaaaagtttgacaccctcgtgggcgagagaggggcacaacttagcggaggtcagaaacagagaatagccatcgcccgtgctctcgtccgaaacccaaagatcctcctgctggatgaggcaacttcggcgctggatacggaaagcgaagcggaggtccaggcagccctggataaagcgcgcgaagggaggactacgatagtgattgcacatagactctccaccgtcaggaatgcagatgtgatcgcagggttcgaagatggtgtgattgtggagcagggttcgcatagcgaactcatgaagaaggaaggggtgtacttcaagctcgtgaatatgcaaacctctggttcacaaatccaatccgaggagtttgaacttaacgacgagaaagctgcaactagaatggcaccgaacgggtggaagtccaggctgttccgccattcgacccaaaagaacttgaaaaactcacagatgtgccaaaagtctcttgatgtcgaaaccgatggacttgaagccaatgttccgcctgtgtccttcctcaaagtgctcaaacttaacaaaacggaatggccctatttcgtggtgggtactgtgtgcgccatcgccaacgggggtctgcagcctgcattttcggtgattttctcagagatcatcgcaatctttgggcctggggacgacgcagtgaagcagcaaaagtgcaacatcttctcactgatctttctgtttcttgggatcattagcttctttacttttttcctgcaaggatttacctttggaaaggcaggtgaaattctcacccggagactgagatccatggcatttaaggcgatgcttagacaagacatgtcatggtttgatgatcacaagaattccactggagctctgtccaccaggctggctaccgacgccgcgcaagtccaaggtgcaacggggacccgtttggcacttattgcacagaacattgcaaacctcggcacgggaattatcatttcatttatctacgggtggcaactgaccctcctgctgctggcagtggtgcctattatcgccgtttcaggcatagttgaaatgaaactgctggcaggcaacgccaagagagataagaaagaactggaagctgcaggtaaaatcgctaccgaagcaattgaaaacatcagaactgtcgtgtcactgacccaggaaaggaaatttgagtccatgtacgtggagaagctgtacggtccttaccggaatagcgtgcagaaagcccatatctacggaattaccttcagcattagccaagcattcatgtatttctcctatgcaggttgttttcgatttggagcttacctcatcgttaatggtcacatgagatttagagacgtgatcctggtgttttccgcgattgtttttggtgcagtcgcactcgggcatgcatcatcattcgcaccagactacgcgaaggcgaaactgtcggcggcacatctgttcatgctgttcgagcgtcaacctctcattgatagctactcggaagagggtcttaagccagataagtttgaaggaaacatcactttcaatgaagtggtgttcaattaccccactcgagcaaatgtcccagtgcttcagggcctttccctggaagtgaaaaagggtcagactcttgccttggtgggatcgtcgggttgcggaaagtcgaccgtggtgcaactcctggaaagattctacgatcctctcgcagggactgtgtttgtggactttggattccaactcctcgatggacaagaagctaaaaagctcaatgtgcaatggctccgggcgcaattgggcattgtgtcccaagaacctatacttttcgactgttcaattgcagaaaacattgcttacggagacaacagccgggtggtgtcccaggatgaaattgtgtccgcagcgaaagccgcaaatatccatccttttatcgaaaccctgccccacaagtacgaaacccgggtgggtgacaaaggcactcagcttagcgggggtcaaaagcaacgcatcgcaattgcacgcgcgttgattaggcagccccagatcctcctgttggatgaagccacttctgccctcgacaccgaatccgaaaaggtggtccaagaggcactggataaagcacgcgaaggaagaacgtgcatcgtcatcgcacaccgactcagcactatccaaaacgctgatctgatcgtcgtctttcaaaacgggcgagtcaaagaacatggaactcaccaacagttgttggctcagaagggaatctactttagcatggtgtcagtgcaagccggtacccagaatttg

SEQ ID NO: 7570 - DNA, 3858 bp, Artificial Sequence
  Description of Artificial Sequence: Synthetic coding sequence
atggatctcgaggctgcgaagaacggtacagcatggagacctacctctgcagaaggggattttgagctgggaatctcttctaaacagaagcgcaaaaaaaccaaaacagtaaagatgatcggcgtgctaactctctttcggtacagtgactggcaggacaagctgtttatgagcctggggacaattatggcaatcgcccacggatccggactgcccctgatgatgattgtgttcggcgaaatgaccgataagttcgtggatactgctgggaacttttctttccctgtcaatttttcgttgtcactgctgaaccctgggaaaatcctcgaggaggagatgactagatacgcttattattacagtggcctgggggcgggcgtactggtggccgcgtacattcaggtatctttctggactctcgctgcagggagacagatccgcaagataaggcagaaatttttccatgccattttgcggcaggaaatcggctggtttgatatcaatgataccacggaattgaacactcgtctaaccgacgatatctccaaaatcagtgaaggtatcggggataaagttggcatgttttttcaggccgtggctaccttcttcgccggattcatcgtcgggtttattagggggtggaaactgacactggtcatcatggcaatttccccgattctcggactgtctgcagcggtgtgggcgaagatactatcagcgttctctgataaggagctcgctgcttacgcaaaggccggcgctgtggctgaggaagcactgggggcaataagaacagtgatcgcatttggtggtcagaataaggagctcgagaggtatcagaagcatcttgagaatgctaaggagatcggaatcaagaaagcaatctcagctaatattagcatgggcattgcatttctgctaatctacgcctcatacgccctcgctttctggtacggatcgaccctagttattagcaaggagtacacgatcggcaatgctatgaccgtgtttttctcaattctgattggcgcgtttagcgtcggccaggctgcgccgtgcatcgatgccttcgcaaacgcgcgcggagcagcctacgtaattttcgacatcattgacaataatcccaaaatcgattccttcagtgagcgaggacataagccggactccattaaaggcaacctggaatttaatgatgtccacttctcctatccgtcgagggccaatgtaaagatccttaaggggctcaatcttaaggtgcagtctggacagacggtggccctggtgggttcaagcggctgtggtaagtctaccacggtccagctcattcagagattgtacgaccccgatgaaggaacaattaacatcgacggacaagatatccggaattttaacgtgaattacttgcgggagatcatcggagtggtgtcccaggaacccgtactcttcagcacgaccattgctgagaacatctgttacggcaggggaaacgtcactatggacgagatcaagaaggcagtgaaggaggccaacgcctacgagttcattatgaagctacctcagaagttcgacacgcttgtgggtgaaagaggagcacagctttccggcggccagaagcagcgaatcgcaattgctcgagccctggttcgcaaccccaagatactactgctggacgaagctacaagcgcccttgacaccgagagcgaggccgaagtgcaggctgccctggataaggcacgcgaggggaggaccactattgttatcgcccatcggctgtctaccgtgcgcaacgcagatgtgatcgcagggtttgaggacggggtgatcgtggaacagggatcacactcagaactcatgaagaaggagggtgtgtacttcaagctggtgaatatgcaaacctctggctcacagatccaatcagaggagtttgagctcaatgatgaaaaggccgcaacacggatggctccaaacggatggaagtccagactctttcggcactctacacagaagaacctcaaaaacagtcagatgtgtcagaaatcactggacgtagagacggacggcttggaggctaatgtcccccccgtgtcatttctcaaagtgctcaagcttaacaaaaccgagtggccctactttgtcgtcggaactgtgtgcgccatcgctaatggcgggctgcagccggctttctccgtcatcttctccgaaattatcgcaattttcggccccggggatgacgctgtgaaacagcagaagtgtaacatcttcagcctaatatttctgttcctgggcatcatcagcttctttacattcttccttcagggctttacatttggaaaagctggggagatattgaccaggaggctccgttctatggcgtttaaagcaatgctgaggcaggacatgagttggttcgatgaccacaaaaatagcactggagccttgagtacacggttggccaccgacgcagcgcaagtgcagggagccacgggcactagactggccctgatagcacagaacattgctaatttggggaccggcataatcatctcatttatctatggctggcaactcactttgttgctcctcgccgttgtccctatcatcgccgtctcaggaatcgtcgagatgaagctgttggcaggcaacgctaaacgagacaagaaagaactggaggcggccggaaagatcgctactgaggccatcgaaaacataaggacggtggtgtccctgacccaggagcgcaaatttgaatccatgtatgtagaaaagctgtacggaccttaccgaaactcggttcagaaggctcatatatacgggataacgttttccatctcccaggcctttatgtatttcagctacgccgggtgcttccggttcggagcctatctgatcgtgaacggccatatgagatttcgcgacgtgattctggtcttctctgctatcgtttttggagctgtggctctgggacatgcttctagttttgcacccgactacgccaaagccaagttaagcgctgcccacctcttcatgctgtttgagcgacagccactcatagactcgtacagcgaggaggggctgaagcctgacaagtttgaagggaacattaccttcaatgaggtggtgttcaactatccgacaagagccaatgtccccgtgctccaaggcctcagcttagaggttaagaagggccaaactctcgctcttgtggggtcatccggatgtggaaagagcactgtcgtgcaactgctggaacggttttatgacccactggccggaacagtgttcgtcgacttcgggttccaacttctggacggccaggaagctaaaaagctaaatgtgcagtggctgcgcgcccaactcggcatcgtgtcacaggaaccaatactcttcgactgcagcattgctgagaacatcgcctacggggataactcccgggtcgtgagtcaggatgaaattgtgtctgccgccaaagctgccaacatccacccattcattgagacgctcccccataaatatgagacaagggtgggggacaaagggacccagttgtccggcgggcagaaacaaagaatcgcgattgctagggcgctgatcaggcaaccccaaatactgctgctcgatgaggccacctccgccctggacaccgagtctgagaaggtggtacaggaagccctcgacaaagcacgcgagggtcgaacgtgtatagtcattgcccatcgcctgagtactatccagaatgctgatctgattgttgtgttccagaacggcagggtcaaggagcacggcactcaccagcaattgctggcgcagaaaggaatttacttctccatggtcagcgtgcaggcggggactcagaacctc

SEQ ID NO: 7571 - DNA, 3858 bp, Artificial Sequence
  Description of Artificial Sequence: Synthetic coding sequence
atggatctggaggccgccaaaaatggaactgcttggcgcccaacctcggccgaaggagactttgaactgggtatatcctcaaagcaaaagcgcaaaaagaccaagaccgtgaaaatgattggagtccttaccctttttcgatattctgactggcaagacaaactgttcatgtcgcttggtactattatggccatagcccatgggtccggtctgcctcttatgatgatcgtgtttggagaaatgaccgacaagttcgtggacaccgcggggaacttctctttccccgtgaacttcagcctcagtctcctcaatccaggaaagattttggaagaagaaatgacccgctatgcatactactactcggggctgggcgcaggagtgctggtggctgcctacatccaggtgtccttttggaccctcgcggcgggcaggcagattcgaaagattagacagaagtttttccatgcgatcctgagacaagaaattggctggtttgacatcaacgatactactgagctgaacacccggctcaccgatgatatttcgaaaatctcggaaggcataggagataaggtgggtatgttttttcaagccgtggcaacgttctttgcgggattcatcgtcggttttatccgaggttggaaattgactctggtgattatggccatttcccctattttgggactctcggcagcggtttgggcaaagattctgtcggccttttccgataaagagctcgcagcctacgcgaaagccggcgccgtcgcagaggaagccctgggtgcaattaggaccgtgatcgcatttggtggacaaaacaaggaactcgagcgttaccagaagcacctcgagaacgcaaaggaaattggaattaagaaggccatatcggcaaacatctctatgggaattgcatttctcctgatctacgcttcatacgcactggccttttggtacggatcaaccctcgtcatttcgaaagaatacaccataggcaacgccatgactgtgttcttctctatattgattggtgcattttccgttggccaggccgcaccttgtattgatgcttttgcgaacgcaagaggagcagcatacgtcatatttgacattatagataacaatccaaagattgactcgttttccgaaagaggtcataagccggatagcatcaagggcaacctcgagtttaacgacgtgcacttttcatacccatcgagagcaaatgttaagatccttaagggactgaaccttaaggtgcagtccggacagaccgtcgccctcgtcggaagcagcggttgcggaaagtcgacgaccgtgcaacttatccaaagactttacgatcctgacgaaggaaccatcaacattgacggtcaggatatccgaaatttcaacgtgaactacctgcgggagattataggagtggtgtcgcaagaaccggtccttttctccacgactatcgctgagaacatctgttacggaagaggaaatgttaccatggacgagattaagaaggcggtgaaggaagcaaacgcctacgagttcataatgaaacttcctcaaaagttcgataccctggtcggtgagcggggcgcccaactgagcgggggtcagaaacaaaggattgcgattgcaagagccctcgtgagaaatcctaagattctgcttcttgatgaggctaccagcgcattggatactgaatcagaggcagaagtccaagcggcactggacaaggccagagagggtaggactactatcgtgatcgcacatcgcctctctactgtgcgcaacgcagacgttattgctggatttgaggacggtgtgattgtggagcaaggttcccactcagaactgatgaagaaggaaggagtctactttaaactcgtgaacatgcagactagcgggtcgcaaatccaaagcgaagaatttgaactgaacgatgaaaaagctgccactaggatggctcctaatggctggaaatcgcgccttttcaggcatagcacccaaaagaatcttaagaatagccagatgtgtcagaagtcgctcgatgtggaaactgatgggcttgaagctaacgtgccacccgtgtcctttctcaaagtgcttaagttgaacaagactgaatggccttacttcgttgtcggaacggtgtgcgcgattgcaaacggagggctccagcctgcattttcagtgattttcagcgaaatcatcgctatcttcggcccaggtgatgatgccgtgaagcaacaaaaatgtaacatattcagtcttatctttctctttctcggtatcatttcattcttcactttcttcctccaagggttcacttttggtaaagcgggggaaatccttactcgccgactgcgttccatggcattcaaagccatgcttagacaagatatgtcatggtttgatgaccacaagaattccaccggagccctcagtacgcgcctggcaaccgatgcggcacaagtccaaggtgctaccggcacccgcctggcactgattgctcagaacatagcaaatctgggaactggaattatcatatcatttatctacgggtggcagctcactctgctcctcctggctgtggtgccaatcattgctgtcagcggaattgtcgagatgaagctgctcgcaggtaacgccaagcgtgataagaaagaacttgaggcagccggaaagattgcaaccgaagctatcgaaaacatacgcaccgttgtctcgttgacccaagaacggaagtttgaatccatgtacgtggagaagctgtatggtccctatagaaactcggtgcagaaagcacatatctacgggataactttttccatctcacaagcatttatgtacttttcttacgcaggttgttttagatttggtgcatacctgatcgtgaacggtcacatgaggtttcgcgatgtgatactcgtcttttcggcaattgtgtttggagcagtggcacttggccacgcatcgtcatttgcccccgattacgcaaaagctaaattgtccgcagcacatcttttcatgctttttgaacgacaacctcttattgactcttactccgaggagggccttaagccagataagtttgaggggaacattacctttaacgaagtggtgtttaactacccaacccgggcgaacgtgccagttctgcagggactttctcttgaagtgaaaaaggggcagactctggcacttgtcgggagctcgggatgcggaaaatcgaccgtcgtccagcttcttgaacgcttctacgaccccctggcagggaccgtgtttgtggattttggtttccagctgcttgatggacaagaagctaagaagctcaacgtgcagtggctgcgtgcgcagttgggaattgtctcccaggaaccaattctttttgattgctccatcgccgagaatattgcatacggcgataattcgcgggtcgtgtcacaagacgaaattgtgagcgcagccaaggccgcaaacatccatccgtttatcgagactctgcctcataagtacgagactcgggtgggtgataaaggcacccaactttcaggaggtcaaaagcagagaatcgctattgcacgcgcactcatacgacaacctcaaattctgctgctcgatgaagcaacttccgcacttgacacggaatctgaaaaggtggtgcaggaagctctggataaagcgcgcgagggacgaacctgtatcgtcatcgcccatcggctttccacgattcaaaatgcagatctgatcgtcgtttttcaaaatggccgggtgaaagagcacggaacgcatcaacagttgctcgcccagaaagggatctacttttcgatggtgagtgttcaagcgggaactcagaacctt

SEQ ID NO: 7572 - DNA, 3858 bp, Artificial Sequence
  Description of Artificial Sequence: Synthetic coding sequence
atggacctggaagcagccaagaatggcacagcctggcgtccgacaagtgcagaaggggattttgagcttggaatctcgtctaaacaaaaaagaaaaaaaactaaaacggttaaaatgattggcgtgttaacactgttccgctactctgattggcaagataaactgttcatgtctctaggcacaatcatggcgatagcacatgggtcgggcttaccgttgatgatgatcgtttttggagaaatgactgacaaattcgtagacactgcaggaaactttagctttccagtcaacttcagcctttccctgttaaacccgggtaagattctggaggaggaaatgacgcggtatgcctattattattcaggacttggagccggagttttggtcgcggcatatattcaggtgagcttctggacactggctgccgggcggcaaatccgcaaaattcgtcaaaaatttttccatgcaatcctccgtcaagagattggttggtttgatattaacgatacaacggaactcaatacacggttgacggatgatatttcaaagatatcggaaggcatcggtgataaggttggaatgttttttcaagcggttgctacattctttgcaggcttcatagtgggtttcatccgcggatggaaactgaccctggtgatcatggctattagtccgattttgggcttgtcagcggcggtgtgggctaagatcctttcagctttttcagacaaggaacttgctgcatatgcaaaagctggagcagtggcagaggaagctttaggagcaatccgcacagtgatcgcatttgggggccagaataaagaactggaaaggtatcagaaacaccttgagaatgcaaaggagattgggattaaaaaggcgattagcgctaatatttcaatgggtattgccttcttgcttatttatgcgtcatacgcgctggcattttggtatggttcgacgctcgtaatatcaaaggaatacacgattggtaatgctatgacagtttttttttcgattttaatcggagcatttagcgtaggacaggcagctccgtgtattgacgcgtttgccaatgcgagaggagcggcctatgttattttcgatattatcgacaataacccaaaaattgactcctttagcgagagaggccataagccggattccattaaaggaaatctcgaatttaatgatgtccatttcagctacccttctagagcgaatgtaaaaatcttgaagggactgaacctcaaagtccaaagtggccaaacggtcgccttagtgggaagtagcggctgcggcaagagcacaacggtacaattgatacaaagactctatgacccagacgagggaaccataaacattgatggccaggatatccgcaattttaacgtaaattatttacgggaaattattggagttgtgagtcaagagccggtactattttcaacaacaatcgccgaaaacatctgctatggacgcggaaacgtcaccatggacgaaattaaaaaggccgttaaagaggctaatgcgtatgaatttataatgaaactgcctcagaaatttgatacacttgttggagaaagaggggctcaattatcagggggccaaaaacaacgcattgcgatagctcgtgctctggtacggaaccctaaaatattacttctcgatgaggcgacaagcgcattagacactgaatcagaggctgaggtacaagccgcgcttgataaggcaagagaagggcgcacaacaatagtgatcgcgcatcgtctgtctacggttcgtaatgctgatgtgatagctggctttgaggacggcgtcatcgtggaacagggctcgcattccgaactgatgaaaaaagaaggtgtatactttaagttagtcaatatgcaaacatctgggagccagattcaatctgaggaatttgagcttaatgatgaaaaagcggctacacgaatggctcctaacggatggaaatcaagactatttaggcatagtacacaaaaaaatttaaagaatagccaaatgtgtcagaaaagcttagatgttgagacggacggccttgaagcgaatgtgccgccggtgagctttttgaaggttctgaagttgaataagacggagtggccttattttgttgtgggtaccgtctgcgctattgcaaatggggggctgcaaccagcattttctgtaattttttcagaaatcatcgcgattttcggaccaggagacgatgctgttaaacaacaaaaatgtaacatcttctcacttatttttctttttctcgggataatttcattttttacgttttttcttcaaggctttaccttcggcaaagcaggagagattctgacgcgacggttacgcagcatggcgttcaaagcaatgttaaggcaggacatgtcatggtttgacgaccataaaaattcaacgggagcgctttccacgcgcctcgccaccgatgcggcgcaggttcaaggcgcgacaggtactcgcttagcgctgattgcgcagaatattgctaatctaggcactggcatcatcataagcttcatttatggttggcagctgacgctgttattacttgcagtcgtgccaatcatagcagtttccggaatcgtggagatgaaactcttagctggcaacgcgaagcgagacaaaaaagaacttgaagcggcgggcaaaatcgcaacggaggcgattgaaaacattagaaccgttgtaagcttaacacaagagcgtaagtttgaatctatgtatgttgaaaaactgtacgggccttacagaaattcagttcagaaagcacatatatatggaatcacttttagcatcagccaagcatttatgtacttttcctacgctggatgttttagatttggtgcttatttaattgttaatggacatatgcgctttcgagacgtgatccttgtattttccgccatcgtttttggcgctgttgcgttaggacatgcgtcatcatttgcccccgattacgcaaaagcgaaactatctgcagcgcatttgtttatgctgtttgaacgccaaccgctgatcgatagctactcagaagaaggattgaaaccggataaattcgagggaaacattacatttaatgaggtagtatttaattacccaacacgggcaaatgtacccgtcttacagggtctgtcgttagaggttaaaaagggtcagacattagcattggtcggatcaagcggctgtggcaaatcaactgtggtccagttacttgaaagattttatgatccgctggcgggcacagtatttgttgattttggttttcaattattagatgggcaggaagcgaaaaagttgaatgtgcagtggttgcgtgcgcaactggggatcgtctcacaagaacctattcttttcgactgctctattgctgaaaacattgcatacggtgataactcacgggtggtgagtcaagatgaaattgtgtccgcggcgaaagcggccaacatacatccatttatcgaaacactgccccataaatacgaaacgcgcgtcggcgataaagggacgcagttatctggcggacagaaacagagaatagcgatagcacgagcgctgatccgccagccgcagatattactgcttgacgaagcaactagcgcccttgatacagaatcagaaaaagtcgttcaagaagctctcgataaagctcgtgaaggccggacctgcatcgtcattgcgcataggttatccacgatccaaaatgcagacttaattgtcgtctttcagaacggtcgggtcaaggaacatggaacacatcagcaattgctagcacagaaaggaatttatttttcaatggtctccgttcaggcaggcacccagaatcta

SEQ ID NO: 7573 - DNA, 3858 bp, Artificial Sequence
  Description of Artificial Sequence: Synthetic coding sequence
atggacctcgaggcggccaagaacggaaccgcatggcggcccacctcagccgaaggtgattttgagctcggaatctcgtcaaagcagaagagaaaaaagacgaaaactgtgaagatgatcggagtgttgaccctgttccggtactcggattggcaagataagctgtttatgtcgctgggcactattatggccattgctcacggttcaggcctccctctgatgatgatagtgtttggagaaatgaccgataagttcgtggacaccgcaggaaacttttccttcccggtgaatttctcgctctcccttttgaacccaggtaagatcctggaggaagaaatgactcgatacgcatactactactccggactcggtgccggagtcctcgtggccgcttacatccaagtgagcttttggaccctcgctgcaggtcgccaaatccggaagattaggcagaaattcttccatgcaattctccgccaagagattggatggttcgatatcaatgacactacggaactcaacactcgactgactgatgatatctccaagatttcggaaggtatcggagacaaggtgggcatgttctttcaagcagtcgcaacttttttcgcaggattcatagtcggtttcattagaggttggaagttgacccttgtgataatggccatctcccccattcttggtctgagcgcagccgtgtgggcaaaaatcctttcagcattctccgataaagagctggcagcatacgcgaaggcaggagccgtggcagaggaggcacttggcgccatacgtactgtgattgcctttgggggtcagaacaaagagctggagcggtatcaaaaacacttggagaacgcaaaggagataggcatcaagaaggcgattagcgcaaacattagcatgggtatcgcgttccttcttatctacgcgtcgtatgcgttggcattttggtacggatctaccctggtcatttctaaagagtacactattggtaacgcaatgacggtgtttttctccattcttattggagcattttcagtcggacaagcagcgccatgtatcgacgcatttgcaaacgcaagaggcgcagcttacgtgatttttgatatcattgacaacaaccctaagattgactcgttctcggaacgggggcacaaacctgattctattaagggaaacctggaattcaacgatgtgcatttttcgtatccatccagagctaacgtgaagattctgaagggtctgaatctcaaggtccaatcgggccaaaccgtggcactcgtggggtccagcggatgcggcaagtcgaccactgtgcaattgatacagagactttacgatcctgacgaagggaccattaacattgatggtcaggatatcaggaatttcaatgtgaactacctgagagagattattggtgtggtgagccaggagccagtgctgttcagcaccacgatcgcagagaacatctgttacggtcggggcaacgtcactatggacgagatcaagaaggccgtgaaggaggcaaacgcatacgaattcataatgaaacttccacagaaatttgatacccttgtgggggagagaggtgcgcaactctcaggtggccaaaagcagcgcattgccattgcacgagcacttgtgagaaatcctaagattctcctgctggatgaggctacgtcggcacttgacacggaaagcgaggcagaggtccaagcagccctggataaggccagagaaggacgcaccactattgtgatcgcacatcgtttgagcactgtgcgcaatgctgatgtcattgcgggttttgaagatggcgtgattgtggaacaagggagccattcggaacttatgaagaaggaaggcgtgtactttaaacttgtgaatatgcagacgtccggaagccaaatacagagcgaggagtttgaacttaacgatgagaaagcagcaacccggatggcaccgaacggatggaaatctaggctttttagacattcaactcagaaaaaccttaagaatagccaaatgtgccagaaatcgctcgatgttgaaaccgatggactggaggcaaacgtgcctccagtgagctttctgaaagtgctgaaactcaataagactgaatggccatactttgtggttggcaccgtctgtgctattgcaaatggtgggctgcagccagctttctcagtgattttctctgaaatcatcgcaattttcggtcctggggatgacgcagtgaagcagcaaaagtgcaacattttcagcctcatctttcttttccttggtatcatctcgtttttcactttctttctgcaaggctttacgtttgggaaggcaggagaaattctcactcgaagattgcgatcgatggcatttaaggcgatgctgagacaagatatgtcgtggtttgacgatcacaagaattccaccggtgcattgtcgactaggctcgcaaccgacgcagcacaggtgcagggagcaaccggaacccgcctcgcactgatcgcccaaaacatcgcaaacctgggtaccggcatcatcatctccttcatatatggttggcagctcaccttgcttcttcttgctgtcgtgcccataattgcagtcagcgggattgttgagatgaaacttcttgcgggaaacgcaaagagagacaaaaaggaactggaagcagccggcaagatcgcaaccgaggcaatagaaaacatacggaccgttgtctcccttactcaggagcgcaagtttgagtcgatgtacgtcgaaaaactttatgggccatacaggaatagcgtgcagaaagcccacatctacggtattacctttagcatctcgcaggcctttatgtatttctcatacgcgggatgttttcgtttcggagcatacctgattgtcaatggtcacatgagatttcgggatgtcattctcgtgttctctgccatcgtctttggagcagtcgcccttggacatgcttcatcattcgctcccgactacgccaaggcaaaactttcagcagcacatctgttcatgctgttcgaacgtcagcccctgatcgattcgtactcagaggaaggactcaagcctgacaagtttgaaggaaacatcaccttcaatgaggtcgtattcaactaccctacccgggccaacgtcccggtccttcagggactttccttggaagtcaagaagggccaaaccctggccctggtcggaagctcgggatgtgggaagtcgactgtggtgcaacttctggaaagattttacgacccgctggcgggaactgtttttgtggatttcgggttccaactccttgatgggcaagaggcaaaaaagctcaacgtccaatggctccgggcacaactcggaatagtgtcgcaggaaccgatcctgtttgactgctctatcgcagaaaacattgcctacggagataactcgagagtggtgtcgcaagatgaaattgtgtctgcagccaaggctgctaacatccaccccttcattgagactcttccacataagtacgagactcgtgtgggtgataagggaacgcagctttcgggtggacaaaaacaacgcattgctattgcgagggcactcattagacagcctcagattctgctgcttgacgaagcaacctcggcgctcgacaccgagtcggagaaggtggtgcaggaagcattggataaagcccgggaaggtcggacctgtatcgtcatcgctcatcgcctgtcgactattcagaatgcggatctcattgtcgtgttccaaaatggtcgtgtgaaggagcatggcacgcatcagcaactgcttgcacagaagggaatttacttctcaatggtttcggtccaggcaggaacgcagaacctg

SEQ ID NO: 7574 - DNA, 3858 bp, Artificial Sequence
  Description of Artificial Sequence: Synthetic coding sequence
atggacctggaggcggctaaaaatggcacagcatggcgacctacctcagcggagggcgacttcgagctggggataagctcaaagcaaaaacggaaaaaaactaagacagttaaaatgatcggagtgctcacccttttccggtacagtgattggcaggacaaacttttcatgtcacttggaacgattatggcgattgcacatggctcgggacttcctctcatgatgatagtctttggcgagatgaccgacaaatttgtcgataccgcaggaaacttttcttttcccgttaacttctcgctctccctgcttaaccccggtaagatccttgaagaggaaatgacacggtacgcttattactacagcggtcttggcgcgggagttctggtggcagcctatatccaagtaagcttctggacccttgctgctggcaggcaaatccgtaagatcaggcagaagttcttccatgctatcctgagacaagaaatcggttggtttgatatcaacgatacgacggaactcaatacaagactgacggatgatatctctaaaatcagtgagggtattggagacaaggtgggcatgttcttccaagccgtggccacattcttcgcagggttcattgttggttttattcgtggctggaagttgaccctggtcatcatggcaataagccccatccttggactgtctgccgcagtgtgggcaaagattctgagtgccttttcagataaagaacttgccgcctacgcaaaggctggtgccgtcgcagaagaagcccttggcgctattagaactgtgatcgcatttggtggtcagaataaagaattagagcggtatcagaaacacctggaaaacgcgaaggaaatcggaatcaagaaagccatctcggccaacatcagcatgggaattgcctttcttctgatctatgcatcctatgctttggcattctggtacggatcgaccctcgtgatttccaaggaatatacaatcggaaacgccatgactgtgtttttcagcatcctgatcggcgcgttcagtgtgggtcaggctgccccctgcatagacgctttcgccaatgcgcgtggggccgcctacgtgatcttcgacataatagacaacaaccctaagattgattcgttttccgagcgagggcataagccagactccataaaaggaaatctggagtttaatgatgtccacttctcctatccttccagagccaacgttaagatcctaaaaggactaaatctaaaggtgcagtcaggtcagactgtggccctggtggggtccagcggctgtggcaagtctactactgtgcagctaatacagagactgtacgatccggacgagggcaccatcaacattgatggacaagatatacgcaatttcaacgtgaactatctgcgcgagattatcggagtggtttcacaggagccggtactcttttcaactaccattgccgagaacatctgttacggcagagggaatgtcaccatggacgagattaagaaggctgtgaaagaggccaacgcctatgaattcattatgaaactccctcaaaagttcgacacattagttggcgagcgcggagcacagctgtcaggaggccagaaacagagaatcgcaatcgctcgggctctggtgaggaaccccaaaattcttctactcgacgaagccacctccgcccttgataccgagtccgaggctgaagtgcaggctgccctggacaaggcccgggagggaagaactaccatcgtcatagcccaccgcctcagtacagttcgcaatgccgacgtgatcgcaggcttcgaagatggcgtgatcgtggaacaaggcagccattccgaactcatgaagaaggaaggcgtgtatttcaagctggtcaatatgcaaacctcagggtctcagattcagtctgaggagtttgaactgaatgatgaaaaggcggccactcgaatggcccctaacggatggaagagcaggttgttcaggcactcaacgcagaagaatttaaaaaactcacagatgtgtcaaaagagtctggacgtggagactgacggcctcgaagccaacgtgccgcccgtctctttcttgaaggtgttgaagctgaacaaaaccgagtggccgtatttcgtggtaggcactgtttgcgccatagctaatggcgggttacagccagctttctccgttattttttcagaaattattgcaatttttgggcctggcgatgacgccgtgaagcagcagaagtgcaacatctttagtttgatcttcctcttcttaggcatcatcagcttttttacttttttcctacaggggtttacgttcggtaaggctggagagatcctcactaggagactgcgttccatggctttcaaggccatgctccggcaggatatgagctggtttgatgaccacaaaaacagcacaggtgctctcagtacccgcctggctactgacgcagcccaagtacagggggctaccggtactcggctggcccttatcgcccagaacattgcgaatctcggcactggcattataatctcatttatctacggttggcaacttactcttcttctgttagccgtcgtgcctattatcgccgtgagcggcatcgtagaaatgaaattgcttgcaggaaatgctaagcgggacaagaaggagttagaagcagctggtaagatcgccaccgaggcgattgaaaacatcaggaccgttgtcagccttactcaggaacggaaatttgagtctatgtacgtggagaaactgtatggcccttataggaactctgtacagaaggcacacatttacgggatcacgttcagcatctctcaggccttcatgtacttcagctatgcaggctgttttcggtttggagcgtacctcattgtcaatggccacatgcgattccgcgacgtgatactcgtgttcagcgcaattgttttcggagcagtggccctgggacacgctagttctttcgcccctgactatgccaaagccaagctatccgctgcgcacttgttcatgctgtttgaacgccagccacttattgatagttacagcgaggaaggccttaaacccgacaagtttgaagggaacatcactttcaatgaagtggtcttcaactatccgacccgggcaaacgtcccagtccttcagggcctcagcttggaggtcaaaaagggccagactctggccctggtgggatctagtgggtgcggaaaatctactgtggtccagctgttggagagattttatgaccctcttgctgggaccgttttcgtggacttcgggtttcagctcctagatgggcaggaagccaagaaattgaacgttcagtggcttcgagctcagctgggcatagtttcccaggagcccattcttttcgactgctccatcgccgagaacatcgcctacggcgacaattctagggtggtctctcaggacgagatcgtgtctgctgcgaaagccgccaatattcaccccttcatcgaaactctgccacacaaatacgaaaccagggtgggtgacaaaggaactcagcttagtggtgggcaaaagcaacggatagcaatcgcccgcgccctcatccgccaaccgcagattctcttattggatgaggcaacatccgctctcgacacagagtccgagaaggtggtgcaggaagcgctggacaaggcccgagagggtcggacatgcattgtcatcgcacaccgtctgtcaacgatccaaaatgccgatctgatcgtcgtgtttcagaatggcagggtgaaagagcacggaacacatcagcagctcctggcccagaagggaatttatttttcaatggtgtcggtgcaagcgggcacgcaaaatctt

SEQ ID NO: 7575 - DNA, 3858 bp, Artificial Sequence
  Description of Artificial Sequence: Synthetic coding sequence
atggatctggaggctgcaaagaacggtactgcttggcgacctacatcagctgaaggcgacttcgaactgggaatctcctcgaagcagaagcggaagaagacgaaaaccgtcaaaatgataggagttctcacactgttcaggtattcagactggcaggacaagctgtttatgtccctgggaacaatcatggccattgcacatggcagcggcttgcccttaatgatgattgtgtttggcgagatgaccgataagttcgtcgataccgccggaaatttcagctttcctgtaaatttctccctaagccttctgaatccaggcaaaatcctcgaagaagaaatgacgaggtacgcctactactattccggtctcggcgccggggtgctcgtggcagcctacatccaagtgtctttctggacgttagcagcgggtaggcagatccgtaaaatcaggcaaaagtttttccatgctattttaaggcaggagatcggctggttcgatatcaatgatacaaccgagctgaacaccaggttgacggacgacatctctaaaataagcgagggcattggggacaaagtcggtatgttcttccaggccgtcgctactttttttgctgggtttattgtggggtttatccggggttggaagctgacactcgtgatcatggctatatcaccgatcctgggactgtccgcagcagtttgggctaaaatcctgtctgccttttctgacaaggaactggccgcctacgccaaggctggcgctgtcgcagaggaggcccttggtgcaataagaacagtgatagccttcggcggtcagaacaaggagctggagaggtatcagaaacacttggaaaacgcaaaagagattgggatcaagaaggctatttcggctaatattagcatggggatcgcctttctgcttatatacgcatcatatgcacttgcattttggtatggaagcaccctcgttatttccaaagagtatactatcggcaacgcgatgactgtgttcttctccatcctcatcggggccttctcagtgggacaggccgctccatgcattgatgcctttgccaatgccagaggcgcagcctacgtcatttttgacataatcgataataatccaaaaatcgatagtttctctgaaaggggtcacaagccagacagcattaagggcaatctcgagttcaacgatgtccactttagctaccccagtagagccaacgtgaagatattgaaggggttgaatctaaaagtgcagagcggccagactgtcgccctggtggggtcttcaggctgtggaaagagtaccacagtgcaacttattcagcgcctttacgatccagacgagggcaccatcaacattgacgggcaagatattagaaattttaacgttaactatctgcgcgagatcataggtgttgtgtcacaggagcctgttctcttttccaccacgatcgcagagaacatatgttacgggcgaggaaacgtaactatggatgagatcaagaaggccgtgaaggaggccaacgcctatgagtttatcatgaagctgccccagaagttcgataccctggtcggagagaggggcgcccagctgtcagggggacagaagcagcggatcgcaatcgccagggcactggtgaggaatccaaagattcttttgctagacgaagccactagtgctttagataccgagagcgaggctgaggtgcaggccgcattagacaaagctcgcgaaggacgtactacaatcgtcatcgctcacagacttagcactgtgcggaatgcggatgttatagccggcttcgaggacggtgtcatcgtggagcaggggtcgcattctgagctgatgaagaaggaaggtgtgtattttaagctagtaaacatgcagacctctggctctcagatccagagcgaggagtttgagctaaatgacgagaaagcagctacacgtatggcaccaaacggttggaagagccggctgtttcgacatagtactcagaaaaatctgaaaaactcccagatgtgtcagaagtctctcgatgtggaaacggatggactcgaagccaatgtgcctccagtgagttttctcaaggtcttgaagctgaacaaaaccgagtggccgtattttgtggttggcacagtgtgcgctattgccaatggggggctccagccagccttctctgttatcttctcggagatcattgcaatattcgggcctggcgatgacgctgtgaagcagcagaagtgtaatatctttagtctcatcttcctttttctcggaattatttcttttttcacttttttcctgcagggattcaccttcggaaaggcaggggaaatcctgacccggaggctgcgtagcatggcattcaaggcgatgttgagacaggacatgtcatggttcgatgatcacaagaactctactggcgcgctcagcactaggctcgctacagacgctgctcaggtgcaaggcgcaactggaactagattggcacttattgcgcagaacatagccaatctggggacgggcatcatcatcagttttatttacggctggcagcttacactgctcctactggcagtggtccctattatcgccgtctccgggattgtcgaaatgaagctgctagccggcaatgccaagagggataaaaaagagctggaggcggcgggcaagatcgccacagaagcgattgagaatatcagaaccgtcgtgtctctaactcaggaacgaaagtttgaaagtatgtacgtcgagaaactctatggcccatacaggaatagcgtgcagaaagcacatatctatgggataactttctccatttctcaagcattcatgtacttcagttacgctggctgttttcgtttcggcgcctatctaatcgtgaacggccatatgagattcagggacgtcatcctggtcttttccgccatagtgtttggagccgtcgcgctcggccacgcatcaagctttgcaccagactacgccaaagctaagctgtctgccgcccacctgttcatgctcttcgaaaggcagcctcttattgacagttattcagaggaaggccttaaacctgacaaatttgagggtaatattaccttcaacgaggttgtctttaattatccaaccagagctaatgttccggtgttacaggggctaagcctagaagtaaagaagggacaaacgttagctttagttggctcttctggatgcgggaagagtactgtagtgcaactgttggagagattttacgatcccctggcgggcactgtgtttgtggactttggatttcagttgctagacggccaggaggccaagaagctgaatgtgcagtggcttcgcgctcagctcggcatcgtgtcccaggaaccaatcttatttgactgcagcattgccgagaacatcgcgtatggggataatagcagagttgtaagccaagacgagatcgtgtccgcggccaaggcagcgaatattcatccctttatcgaaaccctgccccataagtatgaaactcgtgtcggggataaggggacccagctttctggggggcagaagcagagaatcgcaatcgccagggctctgattcggcagcctcagatcttgctgctggatgaggctacgtccgcactggacactgagagtgagaaggtggtccaggaggcccttgataaggccagggaagggcggacctgcatcgtgattgcacaccgcctgtcaactattcagaatgccgacttgattgtggtcttccagaatggccgggtgaaggaacacggcactcaccaacagctcctggctcagaagggcatctatttcagcatggtctctgtccaggccggcactcagaatctg

SEQ ID NO: 7576 - DNA, 3858 bp, Artificial Sequence
  Description of Artificial Sequence: Synthetic coding sequence
atggacctggaggcagccaagaatggaacagcatggcgcccgaccagtgcagaaggggactttgaactcggcatttcttccaaacagaagcgcaaaaagacgaagactgtaaagatgatcggtgtgctgacactgtttcgatattctgattggcaggacaaactctttatgtcactggggaccatcatggcaatcgcacatggaagcggactgcctttaatgatgatcgtgttcggggaaatgacagataaatttgtggacacggcaggcaacttttcatttccagtgaatttctctttaagtttgcttaatcccgggaagattctggaagaggaaatgacaaggtacgcctattattactctggtctcggtgccggggtgttggtggccgcgtatatccaggtgtccttctggaccttagccgctggtaggcagattcgaaagataagacagaaattctttcatgctattctgaggcaggagatcggctggtttgacattaatgataccacagagttgaacacccgcctgaccgacgatatatccaaaatctcagaagggatcggggataaggtcgggatgttctttcaggcagtggctacttttttcgctgggttcatcgtcgggtttattcgaggatggaaactaactttggtgatcatggctatttccccaattttgggactgagcgcagccgtgtgggctaaaatcctcagtgccttttctgacaaggagctggccgcttacgctaaagccggtgcagtagcggaagaagccctcggggccattcgaaccgtgatcgctttcggtgggcagaataaagagctggaaaggtaccaaaaacatctggagaatgctaaggagatcggaataaagaaagccataagtgctaacatcagcatgggtatcgcctttttgctgatctacgcaagctacgcactagccttctggtatgggtctactctcgttatttcgaaggaatataccatcggaaatgctatgactgtatttttctctatcctgatcggagcatttagcgtaggacaagccgccccttgtatagacgcattcgcaaacgcccggggcgccgcatacgttatcttcgatatcatagataataaccccaaaatagactctttctcagagagaggacacaagccagactcgatcaagggcaacctagagtttaacgacgttcacttttcttacccttcacgggccaatgtcaaaatccttaaaggtctcaatctcaaggttcagagtgggcagacggtcgctctagtagggtcctccggatgtgggaagtccaccaccgtacaactcatccagagactatatgatccagatgagggtaccatcaacatagatggacaggatatcagaaactttaacgtgaattatttgcgggagataattggagtggtgagtcaagagccagttctttttagcacaactatcgcagagaatatttgctacggacgcgggaacgtaactatggatgagatcaagaaggccgtgaaagaggcaaatgcctacgagtttatcatgaagcttccccagaaattcgacaccctcgttggagagaggggagcccaactctctgggggccagaaacagcgaatcgctatcgcaagagccctcgtacgtaatcccaaaattctcctgctcgacgaggccacttcggccctagacaccgagtctgaagcagaagttcaagcagccctggacaaggccagagagggtaggacaactatagtgatcgcccacaggctctccacagtgagaaacgcggacgtcattgcaggattcgaggacggagtcatcgtggagcagggtagtcacagcgagctgatgaagaaggaaggagtgtattttaagctagtaaatatgcagacatcgggctctcagatccagagcgaggagtttgagttgaacgatgagaaagctgccaccaggatggctcccaacggctggaagagccgcttgttccggcacagtacccagaaaaatttgaagaattcccagatgtgccaaaagagtctggatgtggagacagatggactcgaggccaacgtgcctcccgtgtccttcctgaaagtgctcaaattgaataagacggagtggccctacttcgtggttggtacggtgtgtgcaattgcgaatggcgggctccagcccgcattcagtgtaatattttctgagatcattgccatctttggacccggggatgacgccgtcaagcagcagaaatgtaatattttttctctgatatttctttttttggggatcatctccttcttcacctttttcctgcagggcttcactttcggaaaagccggcgagattttaacaaggaggctgcggtctatggcattcaaagcaatgcttcggcaggatatgagctggtttgacgaccacaaaaactctaccggcgccctgtcaacaaggctggccacagatgccgcgcaggtacagggtgctacaggcacccgcctggcgctgatagcccagaacattgccaatctgggcacgggaattatcatttccttcatttatggctggcagcttactctcctgctccttgccgttgttcctattatagccgtctctggtatcgtcgaaatgaagctgctggctgggaatgccaagcgcgacaaaaaggagttggaagccgccgggaagatagccacagaggccatcgagaatattcggaccgtggtgtctctgactcaggaacgaaaattcgagtcgatgtatgtggagaaattgtacggcccgtatcgaaactcagtgcagaaggctcatatttatgggatcacattttccatctcccaggcattcatgtatttctcctatgctggttgctttcgctttggagcttatctgattgtcaacggtcatatgcgctttcgagacgtaatactcgtgtttagcgcaattgtgttcggagctgtagctcttgggcatgcgagcagcttcgcacctgactacgcaaaggccaagctctccgctgcgcacctattcatgttgtttgagcggcagcctctgatcgatagctacagcgaagaaggattaaagcccgataagttcgagggtaatataacttttaacgaagtggtgtttaactatcccactcgcgccaacgtcccggtgctgcagggcctatctctcgaagtcaaaaagggacagacattggccttagttggttcttcagggtgcggtaagtcaacagtggtgcagctactggaacgcttttatgaccccctagccggtacagtatttgtggattttggctttcagctgctggacgggcaggaggctaagaagctgaacgtacagtggctgcgtgcccagctcggcattgtcagccaggagccaattttgtttgattgttctattgcggaaaacatcgcctacggagacaactcccgcgtggtgtctcaggacgagattgtgagcgccgccaaggccgccaatattcacccattcattgagaccctgccacataaatatgagactcgcgttggagataaaggcacccaacttagcggaggacagaagcagagaatcgccatcgctcgggcactgatccggcaacctcagattctgctgctcgatgaagccacaagcgccctggacacagagagtgaaaaggtcgtgcaggaggctctggataaagctagggaggggaggacatgcatagtcatcgcccatagacttagtaccatccaaaatgctgatctaatagtggtttttcagaatggtcgtgtgaaggagcatggcacacatcaacaattgctggcccaaaaaggcatatactttagcatggtcagcgtgcaggccggaacacagaatctg

SEQ ID NO: 7577 - DNA, 3858 bp, Artificial Sequence
  Description of Artificial Sequence: Synthetic coding sequence
atggacttggaagccgcaaaaaatggtacggcctggcggcccacttctgccgaaggggacttcgaattaggcatcagcagcaagcaaaaaaggaaaaagacaaaaactgtgaagatgatcggggtgttgaccttgttccgatatagcgattggcaggacaagttatttatgtccttaggcaccatcatggctatcgctcacggctcaggcctgccactcatgatgattgtgtttggcgagatgactgacaagtttgttgacactgcaggaaacttcagctttcctgtcaatttcagtctgtcacttctcaaccctggaaaaatactggaagaggaaatgacaagatatgcctactactactcaggactaggggctggagttctggttgctgcttacattcaggtatccttttggacattggccgcaggccgccagatacgaaaaattcgccagaagttttttcacgcaatcctgcgacaagaaatcgggtggtttgatattaacgacaccacggagctgaacacccgactgactgacgacatcagtaagatatcagagggtataggggacaaggtagggatgttttttcaggcggtagctacctttttcgcaggttttattgtcggatttatccgagggtggaagctcaccctggttattatggcaatcagccctatcttggggctgtcagcagctgtgtgggcgaagatcctctcggccttttcagacaaagaactcgcggcctacgcaaaggccggcgctgtggctgaggaggccctgggggcaatacggacagttatcgccttcgggggccagaacaaggagctggagagatatcagaaacatttagagaatgctaaggaaataggaatcaaaaaggcaatcagtgccaatatttccatgggcatagcttttctgctgatatatgcaagctacgcgcttgccttttggtacgggtctacattagtgatcagcaaagaatacactattggcaatgcaatgactgtgtttttttccatactaatcggggcattttccgtgggccaggccgccccctgtattgacgctttcgctaatgctcgtggcgcagcttatgtcatattcgacattatcgacaacaatcccaaaatagattctttctcggagcgaggacataagcctgactccataaagggaaatctggaattcaatgacgtgcatttctcttacccgagtcgggcaaatgtgaagatccttaagggactgaacttgaaggtacaaagtgggcagaccgtcgccctggtgggcagctctggctgcgggaaatctaccaccgtgcaactcattcaacgtctttacgacccagacgaaggaacaatcaatattgacggccaggatatcaggaattttaacgtgaattacctgcgggagatcatcggagtcgtgagtcaggaaccggtcctgttttcaactactatcgcggaaaacatttgctatggaaggggaaacgtcacaatggatgaaatcaagaaagccgtcaaggaggcgaatgcatatgaattcatcatgaaactgccccagaagttcgacacccttgtcggggagagaggtgcccagctatccgggggtcagaagcaaaggattgcaatcgcccgggcactggtaagaaatcctaaaatactcctactcgacgaggctacttcggccctggacacagagtcagaggcagaagttcaggctgccttggataaagctagggaaggcagaacgaccatagtgattgcccatcgtctgtctaccgtgcgcaacgcggacgtaattgcagggttcgaagatggcgtcatagttgaacaggggagtcactctgaactaatgaagaaagagggggtatatttcaagctggtgaacatgcagacatcaggcagtcagatccagagtgaggagttcgaattgaacgacgaaaaggccgcaaccagaatggctcccaacggttggaagagccgtctttttaggcactctacccaaaagaatctcaaaaattcacagatgtgtcaaaagtcattggacgtggagacggatggactggaagccaatgtgcctccggtttcttttttgaaagtcttaaaactgaacaagaccgaatggccttacttcgtcgtcgggacagtgtgcgccatcgcaaacggcggtctgcaacctgcgttctccgtgatctttagtgagattattgcaatctttggccctggcgatgatgcagtgaagcaacagaagtgcaatatcttctcactcattttcttgtttttgggcatcatatcgttttttacgttcttcctgcaaggtttcactttcgggaaggcaggcgaaattctaactagaagattgcgcagtatggcttttaaggcaatgctgcggcaggacatgagctggtttgacgaccataagaactccaccggtgctctgtctacaagactggctacagatgctgcccaggtccagggggccaccggcaccaggcttgcgctgattgctcaaaatatcgcaaatctgggcaccggcataatcatttcgttcatttacggctggcaattgaccctcctccttctggccgtcgtgcccatcattgctgtgagtggcatcgtggagatgaaactgcttgcaggaaacgctaaaagagataaaaaagagctggaagccgccgggaagatcgccaccgaagctatagaaaatatccgcacggtcgttagtctaactcaggaaagaaaatttgaatctatgtatgtggaaaaactgtatggtccctaccgcaactctgtgcagaaggcacacatatatggaatcacgttttcaatctcacaggctttcatgtacttctcctacgccggctgttttcggttcggtgcatacctgatcgtcaacgggcacatgagattccgtgatgtcattctggtgttcagtgctatcgtgtttggggccgtcgccctcggccatgccagctcctttgcccctgactacgcaaaagccaaactctctgcagctcaccttttcatgctcttcgaacggcagcccctgattgattcttactccgaggaggggctaaagccagataagttcgagggaaatatcacctttaatgaggtcgtattcaactaccccacacgggctaacgttcctgttctacagggtctatctctggaggtgaagaaggggcagaccctagcgttagtaggcagctccggctgcggaaaaagtacagtggtccaactactggagagattttatgatcccctggcggggaccgtgttcgtggatttcggttttcaactgctcgacggacaggaggcgaaaaaactcaacgtacagtggctgcgcgcacaattgggcattgtatcgcaagagccgattctttttgattgtagcatcgccgagaacatagcatacggagataatagtcgcgttgtgtcccaggacgagatcgtttccgcagcaaaagccgctaacatccatccttttattgagactctcccacacaaatacgaaacgagggtgggtgataaggggacccaactctcgggagggcagaaacagagaattgccatcgccagggcactgattcggcagccacagatcctgctgctggacgaagctactagcgcgttggacaccgagagcgaaaaagtagttcaggaggcccttgacaaagcccgtgaaggccggacgtgcatcgtgattgctcatcgtttatcaacaatccagaatgccgacttgatcgtggtcttccagaacggtagagttaaggaacatggaacccaccagcaactcctggcgcagaaaggaatctattttagtatggtgagcgttcaagcaggaactcagaacctt

SEQ ID NO: 7578 - DNA, 3858 bp, Artificial Sequence
  Description of Artificial Sequence: Synthetic coding sequence
atggatctggaggccgcgaagaacggcaccgcctggcgcccgacttcggcggagggtgacttcgaactgggaatctcgtctaaacagaagagaaagaaaaccaaaaccgtcaaaatgatcggagtcctgaccctcttcagatacagcgattggcaagataagctctttatgtccctgggaacgatcatggccattgcacatggaagcggcctccctctcatgatgatcgtgttcggagaaatgactgataagttcgttgatactgctgggaacttctctttccctgtcaatttctccctgtccctgctgaaccccggtaagatcctggaagaagagatgaccaggtacgcatactactactccggcctgggagccggagtgctcgtcgcagcatacatccaagtctcgttttggaccctggctgcgggcagacagattaggaagatccggcagaagtttttccatgccatcctgcgccaagagatcggatggtttgacattaacgataccaccgaattgaacactcggctgactgacgacatctctaagatctccgaaggtatcggcgacaaggtgggcatgttcttccaggctgtggcgacctttttcgcgggattcattgtcggtttcatccgaggttggaaactcaccctggtcatcatggctatttcgccgatccttggcttgtcggctgcagtgtgggccaagatcctgtccgcattctccgacaaggaactggccgcctacgccaaagcaggcgcagtggccgaagaggcgctgggagccatcagaactgtcatcgcattcggtggccagaataaggagctcgaaagataccagaaacatctcgaaaatgcaaaggagatcggaatcaagaaggctatctccgccaacatctcaatgggaattgccttcctcctgatctacgcttcgtacgccctcgccttctggtacggttcgacccttgtgatctcaaaggaatacaccatcggaaacgcaatgaccgtgttcttttcaatccttattggtgcctttagcgtggggcaggcagcaccgtgtatcgacgcttttgcgaacgcacggggcgccgcatatgtgatcttcgacatcatcgacaataaccccaaaattgatagcttttcggagcggggacataagcccgacagcatcaaggggaacctggagtttaacgacgttcacttcagctacccaagtcgcgccaacgtcaaaatccttaagggattgaaccttaaggtgcagagcggacaaaccgtggcgctggtcggaagctccggctgtggaaagtcaactactgtgcagctgatccaacggctgtacgacccggacgagggaactataaacattgatggacaagacattcggaatttcaacgtgaactacctgcgcgaaatcatcggggtggtgtcgcaagagccagtcctgttcagcaccactattgcagaaaacatctgctacggacgcggaaacgtgaccatggatgaaatcaaaaaggctgtcaaggaagccaacgcctacgaattcattatgaagctgccgcagaagtttgacaccctggtcggggaacgcggagcccagctctcgggagggcagaagcagagaatcgccatcgcgagagccctggtgcgcaatccaaagatcctgctgctcgacgaggcaacttcggcactggacactgagtccgaagctgaagtgcaggccgccctggacaaagcccgggaaggacgcaccacgattgtcattgctcacagactgtcaaccgtgcggaatgccgatgtcatcgcgggattcgaagatggggtgattgtggagcagggcagccattccgagctgatgaagaaggagggggtctacttcaagctggtcaacatgcagactagcggtagccaaatccagagcgaggagtttgaactgaacgatgaaaaggctgccactcggatggcacctaacggatggaaatcccggctgttccgccatagcacgcagaagaacctgaagaactcccagatgtgtcaaaaatccctggacgtcgaaactgacggactcgaagcaaacgtgcctccagtgtccttcttgaaagtcctgaaactgaacaagactgagtggccctacttcgtggtgggtaccgtttgtgctatcgccaacggaggattgcagccggcgttctcggtcatcttttctgagatcatcgccatcttcggtcctggggacgacgcggtgaagcagcaaaaatgcaacatcttctcactcatctttttgttcctggggattatctcgtttttcaccttcttcctccaaggatttactttcgggaaggccggagagatcctgacccggcgcctgcgctctatggcgttcaaggctatgctccggcaggatatgtcctggttcgatgaccacaaaaactcgactggagcccttagtacccggctggcgactgacgctgcgcaggtgcagggggccactggaacgcgcctcgccctgatcgcgcaaaacatcgcaaacctgggaaccggcatcatcatctccttcatctacggatggcagctgactcttctcctgctggccgtggtccctatcatcgctgtcagcgggatcgtggaaatgaaactccttgccggtaatgcaaagcgggacaaaaaggagctggaggctgctggaaagatcgctaccgaagcgatcgagaacattagaaccgtcgtcagcctgacgcaagaacgcaaatttgagtccatgtacgtggaaaagttgtacggaccctataggaattccgttcagaaggcccacatatacggaattaccttttcgatctcgcaggccttcatgtacttttcgtacgcaggctgcttcagattcggagcctacttgatcgtgaacggacacatgcggtttcgcgatgttatcctggtgttctccgccatcgtgtttggagcagttgctttgggccatgcctcaagtttcgccccagactacgcaaaggccaaactgtccgcggcccacctcttcatgctgtttgaacgccagcctctcattgactcatacagcgaagaaggcctcaaaccagataagttcgaaggtaacattaccttcaatgaagtcgtctttaactacccgacccgggcgaacgtccctgtgttgcaaggcctgagcctcgaggtgaagaaagggcagactctggcccttgtgggttcttccggttgcggaaaatcgactgtggttcaactcctcgagaggttctacgacccccttgcgggaaccgtgttcgtggacttcggcttccagctcttggatggtcaggaagccaagaagctgaatgtccagtggcttcgcgcccaactcggaatcgtgtcccaggaaccaatcctcttcgattgctccatcgccgaaaacatcgcctacggagataattcgcgggtggtgagccaggacgaaatcgtgtcagctgctaaggccgccaacatccaccctttcatcgaaaccctcccacacaagtacgaaacccgcgtgggggacaaaggcacccagctgtcaggcggacaaaagcaacgcattgccattgctcgcgccctgattaggcagccacagatactcctgctggacgaggcgacctccgccctcgatactgaatcagaaaaggtcgtgcaggaagcgctcgataaagcgcgggaagggagaacctgcattgtgatcgcccaccgcctgtccactatccagaacgctgatctcatcgtcgtctttcagaacgggagagtgaaagaacacggaactcatcaacaattgcttgcacagaaggggatctacttttccatggtttccgtgcaggccgggacccaaaatctg

SEQ ID NO: 7579 - DNA, 3858 bp, Artificial Sequence
  Description of Artificial Sequence: Synthetic coding sequence
atggacctggaggcggcgaagaacggaaccgcgtggcgtccaaccagcgccgagggagatttcgaactggggatctcctcgaagcagaagcgcaagaaaacgaaaaccgtcaagatgatcggggtgctgactctctttcgctactcggactggcaagataagttgttcatgtccctgggtactatcatggctattgcacacggaagcgggctgccgctgatgatgatcgtgtttggtgagatgaccgacaagttcgttgacactgctggaaatttctcatttcctgtgaacttctcgctgtccctcttgaatcctgggaaaatcctggaggaagaaatgaccagatacgcttattactactcaggactgggagcgggagtgctggtggccgcctacatccaagtctcgttttggaccttggctgctggtaggcagatcaggaaaatccgccagaagtttttccacgcaatactccggcaagaaataggatggtttgatatcaatgatactaccgaactgaacactcgcttgactgatgacatctccaaaatctcggagggaatcggcgacaaggtcggaatgtttttccaagctgtggcgacttttttcgccggctttatcgttggatttatcagaggatggaaactgacgttggtgatcatggctatctctcctatcctcggactttctgcagccgtgtgggcaaagatcctgtccgccttttccgataaggaactggccgcgtacgcgaaggcaggggctgtggccgaagaggcactgggagccatcagaaccgtgatcgcgttcggcgggcagaataaggaactcgagcgttaccagaaacatctcgaaaatgcgaaagaaattgggatcaaaaaggcgatctctgccaatatcagcatgggcatcgcgtttctgctgatctacgccagctacgcgcttgcattctggtacggatcaactttggtcatctcgaaggagtacaccattggcaacgccatgaccgtgttcttctcaatcctgattggggcgttctcagtaggccaggccgcgccgtgcatcgatgcttttgccaacgcgagaggggccgcctacgtgatcttcgatatcattgataacaatccgaaaatcgattcattttccgaacgcgggcacaagccagatagcatcaagggaaatctggagttcaatgacgtccacttctcgtacccgtctcgggccaacgtcaaaattctgaaggggctcaatctgaaggtgcaatccggccagaccgtggctcttgtcggcagcagcgggtgcggaaagtcgactactgtccagctcatccagagactctacgaccccgacgaaggcaccatcaatatcgacggacaggatattcggaactttaacgtgaattatctgcgcgagatcatcggagtagtctcccaagaaccggtgttgttttccactactatcgccgagaacatttgctacggaagaggaaatgtcactatggatgagatcaagaaggcagtcaaggaagccaatgcctacgaattcatcatgaaactgccccagaagttcgacactctggtgggggagcgcggcgcccagctctccggaggacagaagcagcgcatcgcaattgcgcgggcgttggtgcgcaacccgaagattctgctgctggatgaagcgacttcggcccttgacactgaatccgaagcggaggtgcaggccgccctggataaggctagagagggaagaaccactatcgtgatcgcccaccgcctgtcaacggtccgcaacgccgacgtgatcgccggattcgaggatggtgtgattgtggaacagggatcacattcggagctgatgaaaaaagaaggagtgtacttcaaactggtcaatatgcaaacttctggatcgcagattcaatctgaggaattcgaattgaacgacgaaaaggccgcgacccgaatggcgcccaatggttggaagtcgcgactcttccgccattcgacccagaagaacctgaagaatagccagatgtgccagaagtcgcttgacgttgagacggatggactcgaggccaatgtgcctccggtgtccttcctcaaagttctgaagctcaataagactgagtggccatacttcgtggtgggaactgtttgcgcgatcgccaacggagggctgcaacccgccttcagcgtcatcttctcagaaatcatcgcgatttttggcccgggagacgacgcggtgaaacagcaaaaatgtaatatcttctcgctgatcttcttgttcctgggtattatcagcttcttcaccttcttcctgcaaggattcactttcggaaaagcgggagagatcctgacccggcggcttcgctcgatggccttcaaggcgatgttgagacaggacatgtcatggttcgatgatcataagaactcgaccggcgccctctcgacccggctggcgaccgacgctgcacaggtgcaaggggcaaccgggactcgcctggccctgatcgctcaaaacatcgcaaacttgggcaccggaatcatcatctcctttatctacggttggcagttgaccctcctgcttctggccgtggtgccgatcatcgcggtgagtgggatcgtggaaatgaagctgctggccggtaacgccaagagagacaaaaaggagttggaggcggcaggaaagattgccaccgaagccatcgaaaacatccgcaccgtcgtgagcctgactcaggagcgcaagttcgagtcgatgtacgtggagaagctgtatggcccgtaccgcaacagcgtccagaaggcccatatctacgggatcaccttctctatctcacaggcctttatgtacttctcgtacgccggatgcttcagattcggagcgtacctgattgtcaatggacacatgcgattcagagacgtgatcctcgtgttctcagctattgtgttcggagccgtcgctcttggtcacgcttccagtttcgcaccggactatgcgaaggcaaaactgagcgccgctcacctgtttatgctcttcgaacggcaaccgctcatcgactcctactcggaagaggggctgaagccagataagttcgaaggaaacatcaccttcaacgaggtcgttttcaattatccgacccgcgcaaacgtgccggtgctgcaagggctttcgttggaggtcaaaaagggacaaaccttggccctggtcggatccagcggttgcgggaagtcaactgtggtccaactgttggaacgcttctacgacccactggcaggaactgtgtttgtggatttcggtttccagctcttggacggccaggaagctaagaaactcaatgtgcagtggctcagggctcagctgggtatcgtgtcgcaagagcccattcttttcgactgcagcatcgctgagaacatagcttacggcgataactcccgggtggtgtcgcaggacgagatagtgtccgccgcgaaagcggcaaatatccacccgttcatcgaaaccctcccacacaagtacgaaaccagagtgggagacaaggggactcaactgtcaggcggacagaaacaaagaatcgcgattgcgcgggccctgatccgccagccacagattttgctgctcgacgaggccactagcgccctggacaccgaatccgaaaaggtggtgcaagaggcgctcgacaaggccagagaaggacgcacctgtattgtcatcgcccaccggctgtccaccatccagaatgccgacctgatcgtggtgtttcagaacggaagagtcaaagagcatggaactcatcagcaactgctcgctcagaaaggcatctacttctccatggtgtcggtgcaagccggaacccagaacctg

SEQ ID NO: 7580 - DNA, 3858 bp, Artificial Sequence
  Description of Artificial Sequence: Synthetic coding sequence
atggacttagaggcagccaagaacggaacagcatggaggccaaccagcgccgagggcgatttcgaattgggcatcagttcaaagcagaaaaggaagaagaccaaaactgttaagatgatcggcgtcctcactctctttcggtatagtgactggcaggataagctatttatgtcacttggcacgattatggccatcgcccatggcagcggcttgccactcatgatgatagtcttcggagaaatgaccgacaagttcgtggacacagccggcaactttagtttcccagtgaacttctccctctcactccttaacccaggaaaaatccttgaggaagagatgacccgttacgcatattattacagcggtttgggggctggcgtactcgtcgctgcctacatccaggtgagcttctggaccctggctgccggaaggcagatccgcaaaatcagacagaagttttttcacgctatacttcgacaagagatcggatggttcgacatcaatgacaccactgaactcaataccaggctgacagacgatatatccaagatctctgagggaataggcgataaggtgggtatgttcttccaggcagtcgccactttcttcgccggatttatcgtcggcttcattagagggtggaaactcactctcgtgatcatggcaatatccccgatcctggggctgagcgccgctgtttgggcgaaaatcctgagcgctttttcagacaaagagctggccgcttacgccaaagcaggcgccgttgctgaagaggccctgggagcaatacggaccgtcattgctttcggaggccagaacaaagagttagagaggtaccaaaagcacctggagaatgctaaagagattggaattaagaaggctattagtgcaaatatttccatgggcatcgcttttctccttatttacgcctcctatgccctcgcgttctggtacggcagcaccctcgtcatatcaaaagagtacacaattggcaatgcgatgaccgtgttcttttcaattctcattggcgctttcagtgtcggacaggccgccccttgtatagatgcctttgcaaacgctagaggagcagcatacgttatcttcgacatcatcgacaataaccccaagatcgatagcttttctgagagagggcataagcctgactcgatcaaggggaacctggagtttaacgacgttcacttctcctacccgagtagagccaacgtgaaaatcctgaaggggctgaacctgaaggttcagagcggccaaactgtcgccctggtgggcagcagcggctgtggtaagagtaccactgtgcagctcatccagcgcctatacgaccctgacgagggcaccataaatatagacggacaggacattcggaactttaacgtgaactatttgagagaaatcatcggcgtagtctcacaggaacccgtgctgttcagtactaccatcgcggaaaacatttgctacggccggggtaacgttactatggacgaaattaaaaaggccgttaaggaggccaatgcctatgagttcatcatgaagcttccccagaagtttgacacacttgtgggcgagcggggtgcacagctgagtggaggtcagaagcagcggatcgccattgcccgagcgctcgtaaggaatcctaaaatcttacttctggacgaggctacatctgcattagataccgagagcgaggcggaagttcaggccgccctcgacaaggcaagagaaggccgcacaacaattgtcatagcacacaggctgtccactgtgaggaacgccgacgtcatcgctggctttgaggacggcgttatcgtcgagcagggatctcactctgaactgatgaagaaggaaggagtctactttaaactggtcaacatgcagacctcagggtctcaaattcaatcagaggaatttgagcttaatgacgaaaaggccgccacgagaatggcccccaatggctggaagtctcgcctcttccgtcacagtacgcagaagaacctgaagaactctcagatgtgccagaagagtctcgacgtggaaactgacggcctggaagccaatgtgcccccggtatcatttctaaaggtgctcaaattgaataagacagaatggccatacttcgttgtggggaccgtgtgcgccatagccaatggggggctgcaacccgctttttctgtgatctttagcgagatcattgctatctttggtcccggggacgacgccgtcaaacagcagaaatgcaatatcttcagtctgatcttcctgttcctgggtataattagcttcttcacattctttctgcaggggttcacatttggaaaagctggcgagatcctgacaaggcgactccggagcatggcatttaaggcaatgctgaggcaggacatgagctggttcgacgatcataagaactctactggcgcactgagcactcgcttagccaccgacgccgcccaggtgcaaggggcaactgggacgcgcctggcattaatcgcccagaacatagcaaatctgggcaccgggattattatttcattcatctacggatggcaacttaccctgcttctgctggcagtggtgcctatcattgctgtgtcaggtatcgtggagatgaaactgcttgccggcaacgccaagagagacaaaaaggaactggaagcggccggtaaaattgccacagaggccattgaaaacattaggaccgttgtgagtctgacacaggaacgcaaatttgagtcaatgtacgtggagaagctgtatggtccctacaggaatagtgtgcagaaggcccacatctatggcattacatttagtatatcacaggctttcatgtacttctcctatgccggctgtttcaggttcggtgcctacctgatcgtgaatgggcatatgaggttccgcgacgtcatcctcgttttttccgctattgtttttggcgcagtcgcactggggcacgcatcttcattcgcccctgattacgcaaaggcgaaactatccgccgcgcacctgtttatgctgtttgaacggcagcctctgattgacagttactctgaggagggcctgaagcccgataagttcgaggggaacattactttcaacgaagtggtgttcaattatcctaccagagctaacgtccccgtactacaggggctgtcacttgaagtgaagaaaggccagacgctggcccttgtaggttcttccggttgcggtaaatctacagtggtacagctacttgaacgattctacgatccactggcaggcactgtctttgtggattttggatttcagttgcttgacgggcaggaagcgaaaaagctcaatgttcagtggctgcgggcccaactcggtatcgttagtcaggagccaattctgttcgattgcagtatcgccgagaacattgcatacggggataactcccgtgtggtgagtcaggatgagatcgtgagcgccgccaaagcggcaaacatacatccattcatcgagactcttcctcacaagtacgagactcgggtgggcgataaaggaacacagctgtcaggggggcaaaaacaacgaattgctattgcacgggccctcatccgccagcctcaaattctgctgctggatgaagctacaagcgcactcgatacagaatccgaaaaagtcgtgcaagaggctctggataaggctcgtgagggtcggacatgcattgtgatcgcacatagattatctacaattcagaatgctgacctgatcgtcgtcttccagaacggcagagtgaaggagcacggcacccaccagcaactgttggcacaaaaaggtatctacttttcaatggttagcgttcaggccggaacacagaacctc

SEQ ID NO: 7581 - DNA, 3858 bp, Artificial Sequence
  Description of Artificial Sequence: Synthetic coding sequence
atggacctcgaagccgcaaagaatggaactgcctggcggccaacctcggcagaaggagattttgaactgggaataagctccaaacaaaaacgcaagaaaacgaagacagtgaaaatgatcggggtgttaacccttttcagatacagtgattggcaggataagctctttatgtccctaggaactataatggctattgctcatgggtccggactgcccctgatgatgattgtgtttggggaaatgacagacaagttcgttgacaccgccggaaatttcagtttccctgtaaatttcagcctttccctcctcaatcctggtaaaattcttgaagaggaaatgacaaggtacgcgtattattactctggtcttggtgccggagtccttgtcgccgcttacatccaggtctccttctggaccctagcggccgggcggcaaatcagaaagatccgacagaagtttttccatgcgatcctgaggcaagaaataggttggttcgatatcaacgatacaacagaactcaacactcgcctgaccgatgacatcagtaagatatccgagggcataggtgacaaggtaggaatgtttttccaagccgtggcaacatttttcgctggttttattgtcgggtttatcagaggttggaaactgaccctggttataatggccattagtcctatcctagggctatccgctgctgtgtgggcaaagattctctcggcattcagtgataaggagctggcagcgtatgcaaaagctggtgctgtagccgaggaagcactgggggcaatcaggaccgtgattgctttcggaggccagaacaaagagctagaaagataccagaaacatctcgaaaacgccaaggaaattgggatcaagaaggcgataagcgcgaatatcagtatgggcatcgccttcctgctgatctacgcatcatatgccctggctttttggtacgggtccaccctagtgatatctaaagagtatactataggaaacgcgatgactgtgtttttcagtatcctcattggtgccttctcagttggacaggccgctccatgtatcgacgccttcgccaacgctagaggagcagcttatgtcatattcgatatcattgacaacaatcccaagatcgattctttctccgaacgtggtcataagcccgacagcatcaagggtaacctggagttcaatgacgtgcatttctcctatcccagccgcgccaatgtgaagatcctgaagggcctcaatctgaaggtgcaatcaggccagaccgtggcgctagtggggagctcaggatgtggaaagagtactactgtccagctgattcaaagactgtacgatcctgatgaaggcactattaacatcgatgggcaggatatccggaactttaacgtgaattacctgcgagaaatcatcggcgtggtgagccaagaaccagtactcttttcaacaacgatcgccgaaaacatctgctatggccggggcaacgtgacaatggatgagatcaagaaggccgtcaaggaagccaatgcctacgagtttataatgaaacttccacaaaaatttgataccctggtaggggagagaggggcccagctgtcaggggggcagaagcaacggattgcaatcgcaagagcactcgttagaaatcctaaaattttgctgcttgatgaagctacgagcgctttggataccgaatccgaggcggaggtgcaggccgcactcgacaaggctagagaaggtagaaccaccatcgtgatcgcacatagactcagcacggtaaggaacgcggacgtgatcgccgggttcgaggatggcgtgatcgtggagcagggaagccacagtgagctgatgaagaaagagggggtttattttaaactggtgaacatgcagacaagcggatctcagattcagtctgaagagttcgagctcaatgacgaaaaggccgctaccagaatggcaccgaatggttggaagtccaggctattcagacacagtacccaaaaaaatttaaagaactcccagatgtgccaaaaatccctagatgtggagacagatggattagaagcgaacgttccaccagtgtctttcctgaaggtgttgaagttaaataaaaccgaatggccgtacttcgttgtgggtacagtatgcgctattgcaaacgggggacttcagccagcattctctgtgattttttcagaaatcatagccatattcggccccggggatgacgctgtgaagcagcagaaatgtaacattttttccctgatttttctttttttgggcattattagtttctttacctttttcttgcaagggttcacgtttggaaaggcgggggagattttgaccaggagattgcgctcaatggccttcaaagccatgctgcggcaagatatgtcatggttcgacgaccataagaactccacaggggcactgtccacccgcctggccaccgacgctgcacaggtacagggtgctacagggacccgcttggcgctgatcgctcagaatatcgcaaatcttggtacggggatcatcatcagttttatatatgggtggcagctgacattactgctcttagcagtcgtgcccatcatcgccgtctccgggatcgtggaaatgaaactactggccggcaatgctaagagggataagaaagagcttgaggccgcaggcaaaatcgctaccgaggccatcgagaacatcagaacagtcgtgtcgctaacccaggagcgcaagttcgaaagcatgtatgtggagaagctgtacggaccctacaggaactctgtacagaaagctcacatttatggaataaccttctcaatctcacaggcgttcatgtacttttcgtacgccgggtgcttccgatttggggcttacttgatcgtgaacgggcacatgcggtttcgggacgtgatcctggtattctcagctatagtcttcggggccgtggcactgggacacgccagttctttcgctccagattatgcaaaagccaaattgtcagcagctcatctgtttatgctcttcgagcgacagcccctgatcgactcttattcagaggagggcctgaaacctgacaaattcgaggggaatatcacctttaacgaagtggtgttcaattacccaactagggcgaatgtgccagttctgcagggattgtctctagaggtgaagaaaggccaaactttagcgcttgttgggagtagcggatgcggaaaaagtactgttgttcagttgcttgagaggttctacgacccccttgccggcacagtctttgtagatttcgggtttcagctgctggacggccaggaggccaagaagctgaacgtgcagtggctaagagctcagctcgggatcgtgtcacaggagcccatcctgtttgattgcagcattgcagagaatatcgcgtatggagataattccagggtagtgagccaagacgagattgttagcgcggcaaaagccgccaatatccatccatttattgagactctccctcacaaatatgagacacgcgtgggcgataagggtacacagctgtccggaggccagaagcagcgaattgcaatcgcccgtgcgctgataaggcagcctcagattctactgctggatgaggctacgtctgctctggacaccgagtccgaaaaggtagtgcaagaagctctggataaggctcgagagggccggacctgcatcgtgatagcccaccgactgagtactattcagaacgcagacctcatagtcgtgttccagaacggcagagttaaagagcatggaacccaccagcaactgcttgctcagaagggaatttactttagcatggtctcagtgcaagcaggaacgcagaatctt

SEQ ID NO: 7582 - DNA, 3858 bp, Artificial Sequence
  Description of Artificial Sequence: Synthetic coding sequence
atggacctggaagcggccaaaaatggaaccgcatggaggcccacttctgcggagggggactttgagctggggatcagtagcaaacaaaaacggaagaaaaccaaaacagtaaagatgatcggtgttctgacactattcaggtactctgattggcaggataagctgtttatgtctctgggaacgataatggctattgctcacgggtccggtcttccccttatgatgatagtctttggggaaatgacagataagttcgtggataccgccgggaattttagtttccctgtcaatttttcactatctctgctcaaccccgggaaaatactggaagaagagatgacccgttatgcatactactactccggtttaggcgccggtgtgttagtggccgcctacatacaggtgtctttctggaccctggctgcgggacggcagattcggaaaatccgtcagaagtttttccacgccatcttgcgacaggagattggctggttcgacataaatgatacaaccgagcttaacaccaggttaaccgatgatatatccaaaattagcgaagggattggcgataaagtgggaatgtttttccaggctgtagctaccttttttgccggtttcatagtcggtttcattcgcggatggaaactgaccttagttatcatggccatatctccaatcctagggctgagcgctgctgtgtgggcaaaaattctcagcgcctttagtgataaggagctcgccgcatacgctaaggcaggtgcagtggcagaggaagccctcggagcgatcagaactgtaattgcctttgggggacagaacaaggaattggaaagataccagaaacacctcgaaaatgcaaaagagatagggatcaaaaaagcgatctccgcaaatatttccatgggtattgccttcctgcttatctatgctagttacgcattggccttttggtacggctccactcttgtgatcagcaaggaatacacaattggaaacgccatgaccgtttttttctcaatccttatcggggcgtttagtgttggacaggccgcgccttgcatagatgcctttgcaaatgcaagaggcgcagcctacgtgatctttgacataatcgacaacaaccctaaaatcgactctttctccgaacggggccataaacctgacagtataaagggcaatctggagtttaatgatgtgcacttttcataccccagccgagctaatgtaaagatcttgaagggacttaatctcaaggtccagagcggccagaccgttgcccttgttggatcctctggatgcggcaaaagtactactgtccagctgatccagaggctgtatgaccccgatgaggggaccatcaacattgatggccaggacattcgcaatttcaacgtaaactacttacgagaaattatcggggtcgtgagccaggaaccggtactgttctccacaaccatcgctgagaatatttgttatgggcgcggcaatgtcactatggacgagatcaaaaaggcggttaaagaggccaacgcctatgaatttataatgaaattaccccagaagtttgacacattggttggcgagagaggcgcccagctgtcgggaggccaaaaacagcgtatcgccattgcccgcgccttagttcgaaatccgaagatattgctgctggatgaagctacctccgctcttgacacagaaagcgaggctgaggtacaggctgcgctggacaaggcacgcgagggaagaaccactatcgtcattgctcaccgcctgagtacagtgaggaatgcagacgttatcgcggggtttgaggacggggttatagtggaacagggcagtcattctgagctgatgaagaaagagggcgtgtatttcaaactggtgaatatgcagacaagtggctctcagattcagtcggaggaatttgaactaaacgacgaaaaagccgcgaccagaatggccccgaacggatggaaatcaaggcttttccggcacagcacccagaaaaacctgaaaaactcccagatgtgtcagaagtcacttgacgtagagactgacggcctggaagcgaatgttcctcccgtgagttttctgaaagtgttgaagctgaataagaccgaatggccatacttcgtcgtcgggacagtctgcgctatcgccaatgggggtttacagcctgcatttagtgttatctttagcgaaatcattgctatcttcggacctggagatgacgcggtcaagcagcagaagtgtaacatcttttccctcatctttctgttcctgggtatcatctccttctttacattttttctgcagggcttcaccttcggcaaagcaggtgagattctgactcggcggttgcggagcatggccttcaaggccatgctgaggcaggacatgtcttggtttgatgaccacaagaattctacgggcgccttatccacccgactagccaccgacgctgcccaggtgcagggagctacaggaacccgcctcgcactgatcgcccagaacatcgctaacctcggaacagggataataatttcattcatctacggctggcagctcactttgcttctgctggctgtagtgcctatcatagccgtttccggaatagttgagatgaagctgctcgctggcaacgccaagcgggataaaaaagaattggaggcagctggcaagatcgctactgaggcaatcgaaaacatccggactgtggtgagcctgacacaagaaagaaaatttgagtctatgtatgtggagaagctgtacggaccatatcgcaatagcgtgcagaaggcccacatctacggtatcacgtttagcataagtcaggccttcatgtacttctcatacgctggttgcttccgctttggcgcataccttatcgtgaacggccacatgagatttcgcgatgtcatcttggtttttagcgccattgtttttggggccgtggcacttggacatgcctcaagttttgcacccgactacgccaaagctaagctgtccgccgcccacctgtttatgcttttcgagcgacagccacttatcgatagctactctgaagagggccttaaaccagacaaattcgaaggcaatattacgtttaacgaggtcgttttcaactacccgactcgtgccaacgtaccggtccttcaggggctgagccttgaagtaaaaaagggacagactcttgctctcgtcggcagttctgggtgcggcaagtctactgtggtgcaactgttagaacggttttacgatccactggccggaacagtatttgtggactttggctttcagctgttagatggccaagaagccaaaaagctgaatgtgcagtggttgcgcgcacagctgggcattgtcagccaggagccaatactgttcgattgtagcatcgcagagaatattgcctacggagataactccagagtcgtttctcaggacgaaatcgtgagcgcggccaaagccgccaacatccacccgttcatcgagaccttgccccacaaatatgaaacccgagtcggcgacaagggtacccagctttccgggggccagaagcaacgcatagctatcgcacgggcattaataaggcagcctcagatactgctgctggacgaagctacctccgccctcgacaccgagtctgagaaggtcgtccaagaagccctggataaagcaagggaaggacgcacctgtattgtaattgcacacaggctctccaccattcagaatgccgacctcatagtcgtgtttcagaacgggcgggtcaaggagcacgggactcaccagcagcttctggcccagaaaggtatatattttagtatggtgagtgtgcaagcggggacgcaaaatctg

SEQ ID NO: 7583 - DNA, 3858 bp, Artificial Sequence
  Description of Artificial Sequence: Synthetic coding sequence
atggatttagaagcggcgaaaaatggtacggcgtggcgtccgacgtcggcggaaggtgattttgaattaggtatatcgtcgaaacaaaaacgaaaaaaaacgaaaacggtaaaaatgataggtgttttaacgttatttcgatattcggattggcaagataaactatttatgtcgttaggtacgataatggcgatagcgcatggttcgggtctaccgttaatgatgatagtttttggtgaaatgacggataaatttgtagatacggcgggtaatttttcgtttccggtaaatttttcgctatcgctattaaatccgggtaaaatactagaagaagaaatgacgcgttatgcgtattattattcgggtctaggtgcgggtgtattagttgcggcgtatatacaagtatcgttttggacgttagcggcgggtcgtcaaatacgaaaaatacgacaaaaattttttcatgcgatactacgtcaagaaataggttggtttgatataaatgatacgacggaactaaatacgcgattaacggatgatatatcgaaaatatcggaaggtataggtgataaagtaggtatgttttttcaagcggttgcgacgttttttgcgggttttatagttggttttatacgaggttggaaactaacgctagttataatggcgatatcgccgatattaggtttatcggcggcggtatgggcgaaaatactatcggcgttttcggataaagaactagcggcgtatgcgaaagcgggtgcggtagcggaagaagcgctaggtgcgatacgtacggttatagcgtttggtggtcaaaataaagaattagaacgttatcaaaaacatctagaaaatgcgaaagaaataggtataaaaaaagcgatatcggcgaatatatcgatgggtatagcgtttctactaatatatgcgtcgtatgcgttagcgttttggtatggttcgacgctagtaatatcgaaagaatatacgataggtaatgcgatgacggtatttttttcgatactaataggtgcgttttcggttggtcaagcggcgccgtgtatagatgcgtttgcgaatgcgcgaggtgcggcgtatgttatatttgatataatagataataatccgaaaatagattcgttttcggaacgaggtcataaaccggattcgataaaaggtaatttagaatttaatgatgtacatttttcgtatccgtcgcgagcgaatgtaaaaatattaaaaggtctaaatctaaaagttcaatcgggtcaaacggtagcgctagtaggttcgtcgggttgtggtaaatcgacgacggtacaattaatacaacgactatatgatccggatgaaggtacgataaatatagatggtcaagatatacgaaattttaatgtaaattatttacgtgaaataataggtgttgtttcgcaagaaccggttttattttcgacgacgatagcggaaaatatatgttatggtcgaggtaatgtaacgatggatgaaataaaaaaagcggttaaagaagcgaatgcgtatgaatttataatgaaactaccgcaaaaatttgatacgttagtaggtgaacgtggtgcgcaactatcgggtggtcaaaaacaacgtatagcgatagcgcgtgcgttagttcgaaatccgaaaatattactactagatgaagcgacgtcggcgctagatacggaatcggaagcggaagttcaagcggcgctagataaagcgcgtgaaggtcgtacgacgatagtaatagcgcatcgtttatcgacggtacgtaatgcggatgtaatagcgggttttgaagatggtgttatagttgaacaaggttcgcattcggaactaatgaaaaaagaaggtgtttattttaaattagtaaatatgcaaacgtcgggttcgcaaatacaatcggaagaatttgaattaaatgatgaaaaagcggcgacgcgaatggcgccgaatggttggaaatcgcgtctatttcgacattcgacgcaaaaaaatctaaaaaattcgcaaatgtgtcaaaaatcgctagatgttgaaacggatggtttagaagcgaatgtaccgccggtttcgtttttaaaagtattaaaattaaataaaacggaatggccgtattttgttgtaggtacggtttgtgcgatagcgaatggtggtttacaaccggcgttttcggttatattttcggaaataatagcgatatttggtccgggtgatgatgcggtaaaacaacaaaaatgtaatatattttcgctaatatttctatttctaggtataatatcgttttttacgttttttttacaaggttttacgtttggtaaagcgggtgaaatactaacgcgtcgattacgttcgatggcgtttaaagcgatgttacgacaagatatgtcgtggtttgatgatcataaaaattcgacgggtgcgttatcgacgcgtctagcgacggatgcggcgcaagttcaaggtgcgacgggtacgcgtctagcgctaatagcgcaaaatatagcgaatttaggtacgggtataataatatcgtttatatatggttggcaactaacgttactactactagcggtagttccgataatagcggtatcgggtatagttgaaatgaaactattagcgggtaatgcgaaacgagataaaaaagaattagaagcggcgggtaaaatagcgacggaagcgatagaaaatatacgaacggtagtttcgttaacgcaagaacgtaaatttgaatcgatgtatgtagaaaaactatatggtccgtatcgaaattcggtacaaaaagcgcatatatatggtataacgttttcgatatcgcaagcgtttatgtatttttcgtatgcgggttgttttcgatttggtgcgtatctaatagtaaatggtcatatgcgttttcgtgatgtaatattagtattttcggcgatagtatttggtgcggttgcgttaggtcatgcgtcgtcgtttgcgccggattatgcgaaagcgaaactatcggcggcgcatttatttatgttatttgaacgacaaccgctaatagattcgtattcggaagaaggtctaaaaccggataaatttgaaggtaatataacgtttaatgaagtagtatttaattatccgacgcgtgcgaatgtaccggttttacaaggtctatcgttagaagtaaaaaaaggtcaaacgctagcgttagttggttcgtcgggttgtggtaaatcgacggtagtacaattactagaacgtttttatgatccgctagcgggtacggtatttgtagattttggttttcaattattagatggtcaagaagcgaaaaaattaaatgttcaatggctacgagcgcaactaggtatagtatcgcaagaaccgatattatttgattgttcgatagcggaaaatatagcgtatggtgataattcgcgagtagtatcgcaagatgaaatagtatcggcggcgaaagcggcgaatatacatccgtttatagaaacgttaccgcataaatatgaaacgcgtgtaggtgataaaggtacgcaattatcgggtggtcaaaaacaacgaatagcgatagcgcgtgcgctaatacgacaaccgcaaatactattattagatgaagcgacgtcggcgttagatacggaatcggaaaaagtagtacaagaagcgttagataaagcgcgtgaaggtcgtacgtgtatagtaatagcgcatcgtctatcgacgatacaaaatgcggatttaatagtagtttttcaaaatggtcgagtaaaagaacatggtacgcatcaacaactattagcgcaaaaaggtatatatttttcgatggtatcggtacaagcgggtacgcaaaatcta

SEQ ID NO: 7584 - DNA, 3858 bp, Artificial Sequence
  Description of Artificial Sequence: Synthetic coding sequence
atggatttggaggctgcgaaaaacggtacagcttggcgaccaacctcggccgaaggagacttcgagctggggattagctcaaaacagaaaaggaaaaagaccaagaccgtaaaaatgattggcgtcctgactctgttccggtattcagactggcaggataagctgtttatgtctctcggtactatcatggctattgcgcacggctcagggctcccgctgatgatgatagtcttcggtgaaatgaccgacaaattcgtggacaccgccggcaacttctcctttccagtcaattttagtctgtctttactgaaccccggaaagattcttgaggaggaaatgacaagatacgcatactactactctgggctcggtgcaggcgtgttggtggccgcctatatccaggtatctttctggaccctggccgcaggtcggcagattaggaaaatccggcagaagttctttcacgccattctcagacaggagatcggttggtttgacatcaacgacaccaccgagctcaatacaaggctgacagacgatatctctaagatctccgagggtattggagataaggtaggtatgttcttccaggcagtcgcaacctttttcgcgggtttcattgtcggcttcatacgcgggtggaaactcacactggtaattatggctattagccctattctcggcctttcagctgccgtctgggccaaaattttgagcgcgttctcagacaaagagctggctgcctacgcaaaggcaggggcagttgcagaagaggctttgggagccatcaggactgtgatcgcttttgggggccagaacaaagagttggaaagatatcaaaaacatctcgaaaacgcaaaagagatcggcatcaagaaagccatctccgccaacataagtatgggaattgcctttctgctcatatatgcctcctacgctctggccttctggtatggcagcaccctcgtgattagcaaggagtatacaatcgggaatgccatgactgtctttttcagcatcctcatcggagcctttagcgtgggccaggctgcgccatgcatcgacgccttcgcaaacgccaggggggccgcctatgtgatttttgacataatcgataacaaccccaagatagattcattctctgaacgcggccacaaacctgattccattaaggggaaccttgagtttaacgacgtccacttctcgtacccttctagagctaacgtaaagatcctgaagggcctgaatttgaaagtacagagcggtcagaccgttgccctcgtggggtcctccggctgtggaaaaagtaccaccgtccagcttattcagagactgtacgacccggatgaaggcaccattaatatagatggacaggacattcggaattttaatgttaactacctgcgagagattattggggtggtgtctcaagaacctgtgttgttttcgaccaccattgccgagaacatctgctatgggaggggcaacgttaccatggacgaaatcaaaaaagccgtgaaggaggcaaacgcatatgagtttatcatgaaactgccacagaagttcgacacgctggtcggcgaaagaggcgcacagctgagcggaggccagaaacagcgcattgcaatagcaagagccttggtgcgaaaccccaagattctattgttggatgaagcgacgagtgccctggacactgaaagcgaagctgaggtgcaagccgccttagacaaagcgcgcgaggggagaactaccatcgtgatcgctcaccgactttccactgtcagaaatgccgacgtcatcgccggctttgaggacggggtaatagttgaacagggatcgcatagcgagctaatgaagaaggaaggagtgtactttaaactcgtcaatatgcagactagcggcagtcagatacagtcagaggagttcgagctaaatgatgaaaaagccgccacaaggatggcccctaatggatggaaaagcagattgtttagacattcaacccagaagaacctgaagaattctcagatgtgccagaagtccctggatgttgaaacggacggtctggaagctaatgtgccccctgtcagtttcctgaaggtgctcaagcttaacaagaccgaatggccctattttgttgtaggtactgtttgtgctatcgccaacggagggctgcagccagccttcagtgtaattttctcagagattatcgccatttttggccctggggatgatgccgttaaacaacaaaaatgcaatatcttcagtctgatattcttgttcctcggtattatatcctttttcaccttctttctacaaggctttacctttgggaaagcaggagaaatcctcacacgtcgtttacggtcaatggccttcaaagcaatgttgcgccaggacatgagctggttcgatgaccacaaaaacagtaccggcgcgttgagtacgcgcctggcgacagacgccgctcaggtgcagggtgctactgggaccaggctcgcccttattgcccagaatatcgccaatcttggaactggcattattatcagttttatctacggttggcagctgacactgttactacttgctgttgtcccgatcatcgccgtaagcggtattgtggagatgaagctactggcgggaaatgctaagagggacaaaaaggagctcgaggcagcaggaaaaattgcaacagaggcaattgagaatattcgtaccgtggtatcattaacccaggagcgcaagttcgagtccatgtatgtcgaaaagctttatggcccgtataggaacagcgtgcagaaggcccacatatatgggatcacctttagcatcagtcaggccttcatgtatttctcgtatgctgggtgttttcgctttggagcctaccttattgtgaacggccatatgaggttccgggatgtgatcctggtgttttctgccatcgtgtttggggccgtggctctgggtcatgcgagctcattcgcccctgattatgctaaggccaagctttccgctgcccacctgtttatgctgttcgagagacagccactgattgattcatactcagaggaggggctaaagcccgacaagtttgagggaaacatcacattcaatgaggttgtctttaactatccaactagggccaacgtcccagttctgcaaggactgagtcttgaggttaaaaagggccaaaccctcgccttagttggatctagcggctgcgggaagagtaccgtcgtccagctcctggaacggttttatgatccactagcagggacagtttttgttgatttcggttttcagcttctggacggccaagaagcaaaaaagttgaatgtccagtggctgagggctcagctaggaatcgtctctcaggagcccattctgttcgactgttctattgccgagaacatcgcttacggtgacaatagcagagtggtctcccaggatgaaatagtgtccgcagccaaagcagccaatattcacccatttatagagacactgccccacaaatatgagacccgtgtgggcgataaaggtacacagctcagtggcggtcaaaagcagcggatcgccattgctagggcgttgatcagacagccgcagatcctgttgctggacgaagctacgtccgcattggacactgaatcagagaaggtagttcaggaggctcttgacaaggctcgtgaaggacgcacatgtatcgttatcgctcacagattgtccacaatccaaaatgccgacctgatcgtggtgttccagaacggaagggtcaaggagcacgggacacatcagcagttgctggcacaaaaaggaatatatttctcaatggtctccgttcaggcgggcacacagaatctg

SEQ ID NO: 7585 - DNA, 3858 bp, Artificial Sequence
  Description of Artificial Sequence: Synthetic coding sequence
atggacctcgaagcagcgaagaacggaaccgcgtggcgcccgacctccgccgagggagactttgaattgggaatctcgtcaaaacagaaaagaaagaaaaccaaaaccgtgaaaatgataggagtgttgactttgttccggtactcggactggcaagacaagctgtttatgtcactgggtaccataatggctattgcccacgggtccgggctgccgctgatgatgatcgtctttggggagatgaccgacaagttcgtggatactgccggaaacttttccttcccggtcaacttttccctgtcactgctgaatccagggaagattttggaggaagagatgacgcggtacgcctactactactcaggcctcggagcgggagtgctggtcgctgcatacattcaagtgagcttttggactcttgccgccggccgccagatcaggaagatccggcagaagttcttccatgccatcttgcggcaagagatcggctggtttgatatcaacgatacgaccgagcttaatactaggctgactgatgacatttcaaagatcagcgaaggaatcggagacaaggtcggcatgttcttccaagccgtggccactttcttcgccggcttcatcgtcggtttcatacgcggatggaagctcaccctcgtgatcatggccatttcccccatccttggcctctcagccgccgtgtgggcaaaaatcctgtcggcttttagcgacaaggaactggccgcgtacgctaaggcaggcgctgtggccgaagaagcgctcggggcgattcggacggtgatcgcgtttggagggcagaacaaagagctggaaagataccagaagcatctggaaaatgccaaagaaatcggcatcaagaaggctatttccgctaacatctcgatgggcatcgccttcctgctgatctatgcatcatacgcgcttgcgttttggtacgggtccactcttgttatcagcaaagaatacactatagggaacgccatgactgtctttttctccattcttatcggagccttttccgtgggccaggctgcgccgtgcatcgacgccttcgcaaatgctcggggcgccgcctacgtgatcttcgacatcatcgacaacaaccctaagatcgattcgttctccgagaggggacacaagcctgacagcatcaagggcaacctcgagtttaacgatgtccatttcagctacccatcccgcgctaacgttaagatcctcaaaggactgaatctgaaggtccagagcggccaaactgtggccctggtgggttcaagcggctgcggaaagtcgaccaccgtgcagctgatccagcgactgtacgacccggatgagggaaccattaacatcgacggacaggacatcagaaacttcaatgtcaactacctgcgtgagatcatcggcgtggtgtcccaggagcctgtcctcttttccactaccatcgcggagaatatctgctacggacggggaaatgtcactatggacgagatcaagaaagccgtgaaggaagccaacgcgtacgagttcatcatgaaactgccgcagaaatttgataccctggtgggagaaagaggagctcagctctcgggcggacaaaagcagcgcattgcaatcgccagagcccttgtgcggaaccccaaaattctgctcctcgacgaagcaaccagcgccctggacaccgagtcggaagccgaggtgcaagcagctttggataaggctcgcgagggtcgcaccactatcgttattgcacatcggctgtcaacggtgcgcaacgccgacgtgatcgccggattcgaggacggagtgatcgtggagcaggggtcacactcagaacttatgaagaaagaaggagtgtacttcaaactcgttaacatgcaaacctcgggttcgcagatccaatcggaggaatttgaacttaatgatgaaaaggccgctacgaggatggcaccgaatggatggaagtcaagactgttcagacactccactcaaaagaatctcaagaattcccagatgtgtcagaagtcattggatgtcgaaaccgacggactggaagcaaacgtccctcccgtgtcctttctcaaggtcctgaagctgaataagactgagtggccatacttcgttgtcggaacggtctgcgccatcgcgaatggaggactgcagccggccttctcggtcatcttcagcgaaatcatcgcgatctttggtccaggagacgatgcagtgaaacagcagaagtgtaacatcttctccctgatcttcctgttcttgggaatcatctcctttttcactttctttctgcaagggtttactttcgggaaggcgggggaaattctgactcgccggctccggagcatggcgttcaaggccatgctgcgccaagacatgtcatggttcgatgatcacaaaaactccaccggtgccctgtccacgagactggcgacggacgcagctcaggttcaaggagccactggaactagactggcacttatagcacagaacatcgctaatcttggaactggaatcatcatatcgttcatctatggctggcagctgaccctgctgctgctcgcggtcgtgccgatcatcgcagtgtcggggatcgtcgagatgaagctgctcgcgggaaacgccaagcgggataagaaggaactggaggccgcgggaaagattgcgaccgaggccatcgagaacattcggactgtcgtctccctcacccaggagcgcaaattcgaaagcatgtacgtggaaaagctctacggtccgtaccgaaactcggtccagaaagcccacatttacggaatcaccttctcaattagccaggccttcatgtatttctcatacgcaggctgcttccggttcggagcgtatttgatcgtgaatggacacatgagattccgcgatgtgattcttgtgttctcagccatcgtgttcggggcggtggccctgggccatgcttcatcgttcgccccagactacgcaaaggctaagctgtcagcggcgcacttgttcatgctgtttgaacggcagccgctcatagacagctactcagaagaggggctcaagccggacaagtttgagggcaacatcaccttcaacgaagtggtgttcaattatcccaccagggcgaatgtgcctgtgctgcagggcctcagcttggaggtcaagaaaggtcaaactctggctctcgtgggatcttctggatgcggaaaatccacggtggtgcaactcctcgaacgcttctacgatccactcgcgggaactgttttcgtggactttggtttccagcttcttgacgggcaagaagccaagaagctcaacgtgcaatggctgagagcacaactgggtattgtgagccaagagccaatccttttcgactgttcgatcgctgagaacatcgcgtacggtgataattctcgcgtcgtgtcacaagatgaaattgtctcggccgcgaaagcagccaatatccacccgttcatcgaaaccctccctcacaaatacgagactcgcgtgggagacaagggcacccagctgtctggggggcaaaagcaaagaatcgccatcgcccgcgctctcatacgccagccacagattctgctgttggacgaagcgacctcagctctggatactgagtctgagaaagtggtccaggaagccctcgacaaggcccgggaaggacggacttgcatcgtcatcgcacatcgcctcagcactatccagaacgctgatcttatcgtggtgttccagaacggccgagtgaaagaacacggcacccatcaacagctgctggctcagaagggaatctacttctcgatggtttccgtgcaggccggaactcaaaatctg

SEQ ID NO: 7586 - DNA, 3858 bp, Artificial Sequence
  Description of Artificial Sequence: Synthetic coding sequence
atggatttggaggccgccaagaacgggaccgcctggaggcccacatccgccgagggcgactttgaactgggcatatctagtaaacagaaaagaaagaaaacaaagaccgtgaaaatgataggtgtcttgactctttttaggtactcagactggcaggacaagttatttatgagtctgggcacaattatggccatcgcgcatggcagcggcctccctttgatgatgatcgtgtttggcgagatgactgacaaattcgtggataccgccggtaacttttctttcccggtaaactttagtcttagcctgttgaaccccgggaagatcctggaggaagagatgacccggtatgcttattattattcgggcctgggagccggcgttctggttgccgcatatatccaggtgagtttttggacccttgctgctgggcggcagatccgcaagatacggcaaaagttcttccacgccatcctcagacaggaaattggctggttcgatattaatgacactacggaattgaataccagacttaccgacgatatttcaaagattagcgagggcatcggcgataaggtaggcatgttttttcaggccgtagccacatttttcgcgggatttattgtggggtttattcgaggatggaagctgacactggttattatggcgattagcccaattctggggctgtctgccgccgtttgggccaaaatactgtctgccttcagcgacaaggagctggctgcatatgctaaggcgggagctgtcgcagaggaggctctcggcgcaattagaaccgtgatagcttttggcggtcaaaataaagagctagagcgttaccagaagcatctagagaacgctaaggaaatagggataaagaaagcaatttctgctaacatatctatgggcattgcattcctgctgatctatgcttcttacgcccttgccttttggtacggcagtactcttgttatctccaaagagtacacaatcggcaatgctatgaccgtcttctttagcatcctgattggagcttttagtgtcgggcaggcagccccatgcattgatgcatttgcaaacgccaggggggccgcatatgttatcttcgacatcatcgataataaccctaagatcgattccttttctgagagaggccacaaaccggactctattaagggcaacttggagttcaatgatgttcatttcagctacccgtctcgcgccaatgtcaaaatcctgaaagggctaaaccttaaagttcagtcgggacagacagtggctctggttggttccagcgggtgcggtaagtccaccaccgtgcagctcattcagcggctgtacgatcccgatgagggcacaatcaacattgatggacaagatattcggaacttcaacgttaattacctgcgcgaaataattggtgtcgtgtctcaggagcctgtgctgttctcaaccacgatagcagaaaatatctgttacgggcgtggcaatgtaactatggatgagatcaagaaagcggtgaaggaggctaatgcctacgagtttataatgaagctgccccaaaagtttgatactttggtgggcgaaaggggagcccagttgtccggcgggcagaagcagagaattgctatcgcaagggcactggtgagaaatcctaagatactgctgctagatgaggctacctccgcactggacactgaatccgaggctgaggttcaggccgccttggataaggcaagggagggacggactactatcgtcatagcccaccgcttgtcgaccgtgagaaacgccgatgtgatcgccggctttgaagacggcgtgattgtcgagcagggtagccactcagagttaatgaagaaagagggcgtgtactttaaattagtgaacatgcagacatctggaagtcaaatccagtccgaagaattcgagctgaatgatgagaaagcagcaacccggatggcccctaatgggtggaaatcacgcctgtttcgccattccactcagaagaaccttaagaactctcagatgtgtcagaaatcactagacgtggagaccgatggtctggaagcgaacgttccccccgttagcttcttgaaagtgctgaaactgaataaaaccgaatggccctatttcgtggtgggcacagtctgcgcgatcgccaacggcggactccaacccgccttcagcgtgatttttagtgaaattatagctatctttgggccaggggacgatgcagttaagcaacaaaaatgtaatatttttagtctgatttttcttttcctgggtattatatcgtttttcacttttttcttgcagggattcacgttcggaaaggcgggtgagattctcactcgccggctccgctccatggctttcaaagccatgcttcggcaggacatgtcctggttcgacgaccacaagaacagtacgggtgcccttagcacacgtctggctacggatgcagctcaggttcagggagctaccggcacacggttggccttgatagctcaaaacatcgccaacctggggacaggcattattatatccttcatttatgggtggcagctaacacttctgctgttggcggtggtgcctattatcgctgtgagtggaatcgtggaaatgaaactgcttgcgggtaatgccaagagggacaaaaaggaattggaggcagctggcaagatcgctacggaggcgatcgagaacattcgcacagtcgtctccctgactcaagagcgcaagttcgaaagcatgtatgtggagaagctgtacgggccttaccgaaattcagtgcagaaggcccacatatacggaattactttctccatatctcaggcattcatgtacttcagttacgctgggtgcttccgtttcggtgcctacctcattgtgaacgggcacatgaggtttagagacgtgatactggtgttttcggcgatagttttcggtgctgtggccttgggccatgcaagcagctttgcgcccgactacgccaaggctaaactgtcagcggcccacttatttatgttgtttgagaggcagccgctaatcgactcctattctgaagagggcctcaagccagacaagtttgaagggaacattacctttaatgaggtggtcttcaactatccgactcgagcaaacgttcccgtcttgcaaggactgtcactcgaggttaagaagggacagaccctcgcgttggtaggatcctcaggatgtggcaaatctacagtggtgcagttgctggagaggttttatgacccattggccggaacagtgtttgtggacttcggctttcagctgctggacgggcaagaagctaagaagctgaacgttcagtggctgagagcccaattgggtatcgtgagtcaggagccaatcctgtttgattgtagcatcgccgagaatattgcatacggagacaacagcagagttgtaagccaggatgagattgtgagcgcggcgaaggcagccaatatacaccccttcatagaaaccctgcctcataaatatgagacccgagtaggggataaaggaacccagcttagtggagggcaaaagcaacgcattgcaatcgcgcgtgctcttattagacagcctcaaattctgctcttggacgaggccacttctgctctcgataccgagtccgaaaaggtagtgcaggaggcgcttgacaaagcacgagaggggaggacttgcatcgttatagctcatcgcctgagtactatccaaaacgcagatctgattgtggtgttccagaacgggcgggtgaaggaacatggaacccatcagcaactactcgcgcaaaagggcatctatttctccatggtgtcagtgcaggcaggcacgcaaaatctc

SEQ ID NO: 7587 - DNA, 3858 bp, Artificial Sequence
  Description of Artificial Sequence: Synthetic coding sequence
atggatctcgaagccgccaaaaatggcaccgcctggcgccctacttccgccgagggcgacttcgagttgggaatcagctcaaagcagaagagaaagaaaaccaaaacggtgaagatgatcggggtcctgacactcttccggtactcagactggcaggataaactgtttatgtccctcggcacaattatggccatcgcccacgggtccgggcttccgctgatgatgattgttttcggcgaaatgaccgataaattcgttgatactgccggcaatttcagctttcctgttaatttctcccttagtctgctgaatccaggaaaaatcctggaagaggagatgaccaggtatgcgtactattatagtggcctgggagctggggttctcgttgctgcctacatacaggtgtctttctggaccttggctgccggtagacaaatcaggaagattcgccagaaattctttcacgctatcctcaggcaggagatcggctggttcgacatcaacgacacaactgagctcaacacccgactcaccgacgacatatctaagatctccgaggggattggggacaaggtaggcatgttcttccaggcagtcgcaaccttttttgctgggttcattgttgggttcatccggggttggaagctgaccctggtgattatggccatctctccaatattggggttgtcagctgctgtttgggccaagattttgagtgcttttagcgacaaggagctggccgcttacgccaaggctggggccgtggctgaggaggccttgggagctattcgcaccgtgatcgccttcggaggtcaaaataaggaattggaaaggtaccagaaacacctggagaacgccaaggaaatcggaattaagaaagccatctcagccaatatctccatgggaatcgctttcctgctgatctacgccagttacgcactggccttttggtacggatctactttggttattagtaaggagtacactatcggtaatgctatgacggtgtttttctccattctgattggagccttcagcgtgggtcaggcggctccgtgcatcgacgcatttgccaacgctcggggcgctgcatatgtgatcttcgacatcatcgataacaacccaaaaattgacagtttctcagagaggggccacaagcccgattccattaagggaaatctcgaattcaacgatgtgcactttagttaccccagtagggccaatgtaaaaattctgaagggactcaatctcaaggtgcagtcaggccagacagttgcattggtggggtcctccggatgtggcaagtccaccactgttcagctgattcagcgcctttatgacccagatgagggcacgattaacattgatgggcaagatatacgcaattttaatgtgaattacctgcgggagatcatcggtgtggtgagccaggagcctgtcctgtttagtactacaatcgccgagaacatttgttacgggcgcggaaatgtcaccatggacgaaatcaagaaagccgttaaagaggctaatgcctacgaatttattatgaaattgccccaaaagtttgatacgttggttggtgagaggggagcccaactcagcggcgggcagaagcaacggatcgcgatagccagagccctcgtacgcaaccccaaaattcttctcctggatgaggccacgtctgcccttgacaccgagtcagaggctgaagttcaggccgcactggacaaggcccgggaaggaagaactaccatcgttatcgcccatagactgtctaccgtccgaaacgccgacgtgattgcgggcttcgaggatggcgtaatcgtggaacaagggagccacagtgagctcatgaagaaagagggtgtctattttaaacttgtgaacatgcagacatcaggcagccaaatccaatctgaggagtttgagcttaacgacgaaaaggcagctactcggatggcacctaatggctggaagagtaggctttttcgccattcaactcagaaaaacctgaagaacagccagatgtgccaaaagtccctggatgttgaaaccgatggcctcgaggcgaatgtgcctcccgtgtcattcctcaaggttctcaagctgaataagaccgagtggccttattttgtggtgggaaccgtctgcgctatcgcgaatggcggcctgcagcctgcattttccgtaattttcagcgagatcatcgctatcttcggcccgggagacgacgccgtgaagcagcagaaatgcaacatcttctccttgatctttctgttccttggaattatcagctttttcacatttttcctccaaggcttcacctttggaaaagccggagagattctcacccggaggttgcgatctatggctttcaaggctatgctcagacaggatatgagctggtttgacgatcacaagaactcaaccggcgccctctcaacgcggctggcaaccgatgcagcccaggttcaaggggccaccgggacccggctggccctgattgcacagaatatcgcaaatctggggacggggatcattatctcttttatctacggttggcagctgaccctcctgctgcttgccgtagttcccattatcgccgtcagcgggatcgtagaaatgaagctgctggccggcaacgccaagcgcgacaaaaaggagctggaagccgctggcaagatcgcaaccgaggccattgagaacattagaacagtagtttcactgacacaggagcggaaattcgagagcatgtatgtggaaaaactgtatggaccatatcgcaacagcgttcagaaggcacatatctacggcataactttcagcatcagccaggcttttatgtacttttcttatgccgggtgttttcgattcggcgcttacctgatcgtgaatggtcacatgcgctttagggacgtgatactcgttttctcagccatcgtcttcggggccgttgcgctgggacatgcctcctcttttgcccctgactatgccaaagcgaaattgtctgctgcgcatttgttcatgctgtttgagagacaacctctcattgactcctacagtgaagagggcctgaagcctgataagtttgagggcaatataacattcaatgaagttgtgttcaactatcccacccgggcaaatgtccccgtcttgcagggcctgtccctcgaggtgaaaaaaggccaaactcttgccctggtgggcagctccggttgtggcaagagcactgtggtgcagctgctggagcgcttttacgacccactcgcaggaactgtgttcgtggattttggctttcagctgctcgatggacaggaggccaagaagctcaatgtgcagtggctccgagcacaattggggattgtgagtcaagagcccatactcttcgactgctcaattgccgaaaacatcgcgtacggagacaatagccgggttgtgagccaagacgaaatcgtgagtgccgcaaaagccgcgaatattcacccctttatcgagacccttcctcacaagtacgagacaagagtgggagataaaggcacacaactctccggtggccaaaaacaacgaattgccatcgcccgagctctgatccggcagccccagatcctgctcctcgatgaagccacttcagccctggatactgaatcagagaaggtcgtgcaggaggctctcgacaaggctcgggagggtaggacatgtattgtgattgcgcacaggctgtccacgatacagaatgcagatctgatcgtggtgttccagaatggcagagttaaagaacatggcacccaccagcagcttcttgctcagaagggcatctacttcagcatggtcagtgtacaggccggaacgcagaacctg

SEQ ID NO: 7588 - DNA, 3858 bp, Artificial Sequence
  Description of Artificial Sequence: Synthetic coding sequence
atggatctggaggccgctaaaaacggtacagcttggcgtcccacctccgctgaaggggacttcgagctcggcataagttccaagcagaagaggaagaagacaaagacagtcaagatgatcggagtgctgaccttgttccgctactctgactggcaggataagttgttcatgtccctgggaactattatggccattgcccatggcagcggcctgccattaatgatgattgtgtttggggagatgaccgacaagtttgtggatactgcaggcaatttcagcttccctgtcaatttttccctctctctgctgaatcctggaaaaattctcgaagaagagatgactcggtatgcttattactactctggcctcggggccggcgtgctggtggccgcctatattcaggtctcgttttggacactggctgctgggagacagattcgaaaaatcagacagaagttcttccatgccatcctgcgacaggagatcgggtggttcgatattaatgacaccacggaactcaacacaagactgaccgacgatatctctaagatctctgaaggtatcggcgacaaggtaggtatgttctttcaggctgtcgctacctttttcgctggctttattgtcggattcatcagaggttggaaactcacgctcgtcatcatggctattagccccatcctcgggctgtctgctgccgtgtgggccaagattctcagtgccttcagcgataaggaattagcagcctacgcaaaagcaggggcggtcgccgaagaggcccttggcgctatccggacggtgatcgcttttgggggacagaataaagagctggagagataccagaagcatttggaaaacgccaaagaaataggtattaaaaaggctattagcgcaaacatatcaatgggaattgcctttcttcttatctacgctagttatgctcttgccttttggtacggatccactctggtcatttcaaaggagtacaccattggcaatgcgatgaccgttttcttctcaatcctgatcggtgcctttagcgtgggccaggccgcaccctgcatcgatgccttcgccaacgcgagaggtgccgcctacgtgatattcgacataatcgataacaatccaaagatcgacagcttctctgaaaggggtcacaagccagacagcatcaagggcaatctcgaattcaacgacgtgcactttagctatccaagccgggccaacgtcaagatccttaaggggcttaatctgaaggtccaatccgggcagacagtcgcactggtggggtcaagcggttgtggaaagtcgactaccgtccagctgatccagaggctatacgatcctgacgagggaaccatcaatatcgacggtcaagatatccgcaatttcaacgtcaactacctgcgtgagattatcggagttgtctctcaggagcccgttctgttttcgaccactattgcggagaacatatgttatggaaggggtaatgtgacaatggatgaaatcaaaaaagctgtaaaggaggccaacgcctatgagttcattatgaagctgcctcagaagttcgataccctggttggagaacgcggcgcccagctgtctgggggccagaagcagcgcatcgcaattgcgcgggcccttgtgagaaaccccaagatattattactggatgaggcaaccagtgcactggacaccgagtcagaagctgaggtccaggctgccttggataaagcacgggaaggcaggacaaccatcgtgatcgcccaccgattgagcaccgtacggaacgccgatgtaattgctggctttgaagatggagtgatcgtggagcaagggtcccatagcgaactcatgaagaaggagggcgtctacttcaagctggtgaacatgcaaacctctgggagccagatccagtctgaggaattcgagctgaacgacgagaaagcagcgactaggatggctccaaatgggtggaagagtcgtctgttccgacactcaacgcaaaaaaacctgaagaactcgcagatgtgtcagaagtcgctggatgtcgaaacggacggcttggaggctaacgtgcccccagtgtcgtttcttaaggtccttaaactaaacaaaactgagtggccatatttcgtggttgggactgtgtgcgccatcgcgaatggcgggctgcagcccgcttttagcgtgattttttctgaaataattgccatcttcggacccggcgatgatgctgttaaacagcaaaagtgcaatatttttagcctaatttttttgttcttaggcatcatcagcttttttaccttcttcctgcaagggttcaccttcggtaaagctggggagattcttacgagacgattgcgcagtatggcattcaaggccatgctccgtcaggacatgtcttggttcgacgatcataagaacagcactggcgctcttagtactcggctggctactgatgctgcccaggttcagggcgcaaccggcactcgtctggccttgatcgcccagaacatcgctaacctcggtactggaatcatcatctcttttatttacggatggcagctgaccctgctgcttctggccgtagttcctataattgccgtgtccgggattgtggagatgaagctcctcgctggcaacgcaaagagggacaagaaggagctcgaagccgctggaaagattgctactgaggcaatagagaatattcggactgtggtctctctcacccaggaacgtaagttcgagtccatgtatgtagagaagctgtacggaccttatcggaactctgttcaaaaagcacacatctacggcatcacgttcagtatcagccaggcttttatgtatttctcctacgcaggatgcttccgctttggagcatacctcattgtgaatgggcatatgcgttttagggacgtcatcctggtattttccgcaatcgtgttcggagccgtggcacttggccacgcctcctcttttgcgccggattatgccaaggccaaactgtccgccgcccacctctttatgctttttgagaggcagccgctgatagattcttattccgaggaaggcctgaagccagataagtttgaaggcaatatcactttcaacgaagtggttttcaattaccctacgcgggctaacgtgcccgtgctccagggactctcgctggaagtgaaaaaaggacagaccctagctctggtgggttcaagtgggtgcggaaaatccaccgtcgtccaacttctggagcggttttatgaccctctggccggcactgtctttgttgattttggttttcagcttctggatgggcaagaagccaaaaaacttaacgtgcagtggttaagggcacagttaggaatcgtgagtcaagagcctatactgttcgattgctccatcgctgagaatatcgcctacggcgataactctcgagtggtgtcacaggatgagatagtttctgctgccaaagctgccaatattcacccttttattgagaccctaccacacaagtacgagacgcgagtgggcgacaagggcactcaactctccgggggacagaagcagcgaatagccatcgctcgtgctttaattcgacagccccagatcctcttgctcgacgaggcaacaagtgcacttgatactgaatctgagaaggtggtacaggaagccttggataaagcacgcgaaggccgtacatgtattgtaatagcccaccgccttagtacaattcaaaatgccgacctgatagtggtgtttcagaatgggcgggtcaaagagcatggaacgcaccagcagcttctggcgcaaaaggggatatattttagcatggtctccgtgcaagctggaacgcaaaatctg

SEQ ID NO: 7589 - DNA, 3858 bp, Artificial Sequence
  Description of Artificial Sequence: Synthetic coding sequence
atggatcttgaggcggcaaagaatggaactgcatggcgcccaactagcgcagaaggagatttcgaactgggaatctcgtcaaagcagaaacgcaagaaaaccaaaactgtgaagatgattggtgtgcttactctcttcagatacagcgactggcaggataagttgtttatgtcccttggaactatcatggcaatagcacacgggagcggactcccactcatgatgatcgttttcggcgaaatgactgataagtttgtcgacactgccggcaacttctcgtttccagtcaacttttccttgtcattgctgaatcccggaaagattctcgaagaagaaatgactcgctatgcatactactacagcggccttggggcgggtgtgcttgtggcggcatacattcaagttagcttttggaccctcgcagcgggccggcaaattagaaaaatcagacagaagtttttccatgcaattctgcgacaagaaatcgggtggttcgacataaacgacaccacggaactgaacacccgcttgaccgatgatatctccaagatctcagaaggtattggagacaaggtggggatgttttttcaagcagtcgcaaccttttttgctggattcatagtcggattcataagaggctggaagctgactctcgtcatcatggcgatttcacctattctcgggctgtcagccgcggtgtgggccaaaatcctgtccgcctttagcgataaggagctggcggcttacgcgaaagccggagcagtggcagaagaggcgctgggtgcgattcgaaccgtgatcgcatttggcggccagaataaggaactggagagataccagaagcatcttgaaaatgccaaggaaattggaattaagaaagcaatttcggccaatatctccatgggcatagcgtttcttctgatatacgcatcctacgcacttgcgttttggtacggaagcacccttgtgatttcaaaggaatacacgattggaaacgcgatgactgtgttcttttccattcttattggcgcgttttcggtgggacaagcagcaccctgcattgatgcatttgccaacgcacggggagccgcttacgtgatttttgacattatcgacaacaatcctaagattgatagcttttcagaaagaggtcacaagccagattccattaagggtaatcttgagtttaacgatgtgcattttagctacccaagccgggcaaatgtgaagattctcaagggtcttaacctgaaagtgcaaagcggtcaaaccgtggcgctggtgggttcgtcaggatgtggtaaatcgaccactgtgcaactgatacaaagactctacgaccccgacgaaggtaccatcaatatcgatgggcaggatattcgcaacttcaatgtgaactacctgagagaaatcatcggtgtcgtgagtcaggagcccgtgcttttctcgaccaccatcgcagagaacatttgttacgggcgagggaatgtgactatggatgagatcaaaaaggcagtgaaggaagcaaacgcatacgaattcatcatgaaacttcctcagaaattcgacactctcgtgggagaacgtggtgcgcaactgtccggaggtcaaaagcaaaggatagccattgcgcgggcccttgtcaggaaccctaagatactgcttctggacgaggccactagtgcacttgacaccgaatccgaggccgaggtccaggcagcgttggacaaagctcgggaagggaggaccacgattgtcatcgcccatcgtctctcaaccgtgcgtaatgcagacgtgatagcaggatttgaggatggagttattgtggagcaaggatcccactccgaactcatgaagaaggagggagtctactttaagctggtgaatatgcaaaccagcggtagccaaattcagtccgaagaattcgagctgaacgacgagaaggcagccacccgaatggcgccaaatggatggaagtcgagactctttcggcattccacgcagaaaaacctgaagaatagccaaatgtgtcagaaatccctggatgtcgaaaccgatggactggaagcaaacgtccccccagtgtctttcctgaaagtgctgaaacttaacaaaaccgagtggccttatttcgtggtgggtactgtgtgtgcaatagctaacgggggactccaacctgcattcagcgtcatattcagcgagattatcgcaattttcggtccaggagatgatgcagtgaaacagcagaaatgcaacatcttttccttgatattcctgttccttgggattatctcctttttcaccttttttctgcaaggtttcacttttggtaaagcaggtgaaatccttaccagaaggctgcggtctatggcctttaaagcgatgctgaggcaggacatgagctggtttgatgaccataagaattcaactggcgcactctccacccgcctggcgactgacgccgcgcaggtgcaaggtgcaaccgggactcgcctggctcttatcgctcagaacatcgcaaatctcggaactgggattatcatttccttcatctacggctggcagctgaccctgcttcttcttgccgtggtgcctatcatcgcagtcagcggtattgtggaaatgaagctgctcgcagggaacgcgaagagagataagaaagaactggaggcagccggcaagatagctacggaagcaatagaaaacattcgtacggtcgttagcctcacccaggaacgcaagttcgaatcgatgtacgtggaaaagctctacggaccataccggaatagcgtgcaaaaggctcacatttacggtataaccttttcgatatcacaagcatttatgtacttctcctacgccggttgttttcgcttcggcgcctacttgatcgtcaatggtcatatgcgttttagagatgtcattcttgtgttttccgcgatagtgttcggcgcagtcgctctcggacatgcatcctcgtttgcgccagactacgcgaaggcaaagctgagcgccgcacaccttttcatgctctttgaaaggcaaccactgatcgattcatactcggaggaaggactgaagccagataagtttgagggcaacattacgtttaatgaagtggtgttcaactaccctactagggcaaacgtgcctgtgcttcagggcctctcactcgaagtgaagaagggtcaaactctggcactggtcggatcgagcggctgtggcaagtcaactgtggtgcagcttttggaacgtttttacgatcctctcgcgggaaccgtctttgtcgacttcggattccaactgctggacggccaagaagccaagaagctcaatgtgcaatggcttagagcacaacttggaattgtgtcccaagaacctattttgtttgactgctccatagcagagaatattgcatacggtgataatagcagggtggtcagccaagatgaaattgtgtcggcagcgaaggctgccaatattcaccctttcattgagactctcccgcacaagtacgaaacccgtgtgggggacaagggaacccaactgtcgggaggacaaaaacagcgcattgcaatagctcgtgcactcatccggcaacctcaaattcttctcctcgatgaagccacttccgccctcgatactgagagcgaaaaggtcgtccaagaagcgctcgacaaggcccgagaaggcagaacctgtattgtgatagcgcaccgcctttcgactattcagaatgcagatcttatcgtggtgttccaaaacggaagagtgaaggagcatggcactcatcagcagcttcttgcacaaaagggaatttactttagcatggtcagtgtgcaggccggtactcaaaacctg

SEQ ID NO: 7590 - DNA, 3858 bp, Artificial Sequence
  Description of Artificial Sequence: Synthetic coding sequence
atggacctcgaggcagcgaagaatggaaccgcatggcgaccgacctcagcagagggtgactttgaactcggaattagctcgaagcaaaagaggaagaaaactaagactgtgaagatgatcggtgtgctgactctttttcggtacagcgattggcaagataagctgttcatgtcactggggaccattatggcaatcgcccatggttcaggactgcctctcatgatgatagtgtttggagaaatgaccgataagttcgtggatactgcaggtaacttttcctttccagtgaatttctccctcagccttttgaatcctggcaaaatactggaggaggaaatgactaggtatgcctactactactcaggactgggcgcgggagtgcttgtcgccgcatacattcaggtgtcattttggactctggcagcaggtagacagattcggaagattagacaaaagtttttccacgcgatccttcgccaagaaatcgggtggtttgacattaatgacactactgaacttaacaccaggcttactgatgatattagcaagatcagtgaaggtatcggagataaagtgggtatgttttttcaggcagtggctacgttctttgcgggattcatagtgggatttatccgcggatggaagctgaccctggttatcatggccatttcgcccattctggggctttccgcagcggtgtgggcgaagatcttgtcagcctttagcgacaaggaattggcagcatacgcaaaagcaggggctgtggcagaagaagccctcggagcgattcgcactgtcattgccttcggaggacagaataaggaactggaaaggtatcagaagcatctggaaaacgcaaaagaaattggtattaagaaggctattagcgcaaacatcagcatgggaattgcatttctcctgatatatgcgtcctacgccctggcattttggtacggatccacccttgtcatctcgaaggagtacactatcgggaatgcaatgaccgtgtttttcagcattctgattggagcattttccgtggggcaggccgccccttgtattgatgcgttcgccaatgcaagaggtgcggcctacgtcatttttgatatcatcgataacaatccgaaaatagactcgttttccgaaagaggtcataagccggatagtataaagggaaacctggagtttaacgacgtgcatttctcataccctagcagagcaaacgtgaagatattgaagggtctgaatcttaaggtgcaaagcggccagactgtggcacttgttggctcgtccggatgtggcaagtccaccactgtccaactgatacagcggctgtacgacccggacgaaggaacgattaacattgatgggcaagacattcgcaactttaatgtcaactaccttcgggagataatcggcgtcgtatcgcaagaacccgtgctgtttagcactacgattgccgagaacatttgttacggtagaggtaacgtgacgatggacgagattaagaaagcagtgaaggaagcaaacgcatacgagtttatcatgaaacttcctcagaaatttgacaccttggtgggagaacgcggtgcacaactttcaggtggtcaaaagcaacgcattgctatcgcccgcgctctcgtcagaaatccaaagatacttcttttggatgaagcgaccagcgcactggatactgagtcggaagcagaagtgcaggcagcactggataaggcacgagagggaagaaccaccattgtgattgcacataggctctccactgtccgcaacgcagatgtgattgcaggctttgaggacggggtgattgtggaacaaggcagccattcggaacttatgaagaaagaaggagtgtactttaagttggtcaacatgcagacgtccggctcccagattcaatcggaagaatttgagctgaatgatgaaaaggcagcaaccagaatggctcctaatggttggaagtccagactcttccgccactcaactcaaaagaacctcaagaacagccaaatgtgccaaaagtcacttgacgtggaaactgacggactggaagcaaacgtgcccccagtctccttccttaaggtgctgaagctgaacaagactgaatggccctattttgtcgtcgggactgtctgtgcgattgccaatgggggactgcagccagcattttcagtgatcttttcagagataatagcaatctttggacctggcgacgatgcagtgaagcaacaaaaatgtaacatcttttcgctcatttttctttttctgggaattatctcgtttttcaccttttttcttcagggatttacttttggtaaagccggcgaaattctcacccgtagactgcgatcgatggccttcaaagcaatgctgcgacaggatatgagctggttcgatgatcacaaaaactcgaccggcgcactgtccacgaggctggcaaccgatgcagcacaagtgcagggcgccactggtactaggctggcccttatcgcacaaaacattgccaatctcggtactggaattatcattagcttcatctacggctggcagctgactcttctgctgcttgcagtggtgccgatcattgcagtctcaggaatcgttgagatgaaacttcttgcgggaaatgctaagcgcgacaaaaaagagctggaagcagcaggcaagatcgcaactgaggcaatcgaaaacatccggacggtggtgtcgcttacccaagagcgcaagtttgaatccatgtacgtggagaagctgtatgggccttaccgcaactcggtgcaaaaagcacatatctacgggattaccttttctatatcacaggccttcatgtactttagctacgcaggttgttttcgctttggcgcctacctgattgtgaatggtcatatgcgattcagagatgtgatacttgtgttcagcgcaattgtctttggagcggtggcacttggacatgcatcgtcattcgctcctgactacgcaaaggcaaagctgagcgcagcccatctgttcatgctgtttgaaagacagcctcttatagactcctactcggaggagggtctgaaacctgataagttcgaagggaatatcacctttaacgaggtggtgtttaactaccccaccagggcaaatgtccccgtgcttcaaggactgtcactcgaggtgaagaaaggacaaactctggcgcttgtggggagcagcggctgcggaaagtcaactgtcgtgcagcttctggaacggttttacgaccctcttgccggtactgtctttgtggactttggctttcagctgctcgatggacaagaagcaaaaaagctcaatgtccaatggctgcgtgctcaactgggtatagtctcccaggagccgatcctgtttgattgctcaattgcagaaaacatcgcgtacggcgataactcaagagtcgtgagccaagatgaaatcgtgtcggcagccaaggccgcaaacattcatccctttatagagactcttccacacaagtatgagacgcgggtgggcgataaggggactcagctttcgggaggccaaaagcaacggattgccattgccagagcattgattagacaacctcagatacttctgctcgatgaagcaacttcggcactggacaccgagtccgagaaggtggtgcaagaggcactcgacaaggcaagagaaggcagaacttgtatcgtcatcgcacatagacttagcaccattcaaaacgctgatctgatagtggtgttccagaatggtagagtcaaggagcacggtacccatcagcaactgctggcccagaagggtatatacttttccatggtgtctgtgcaggcgggcacccaaaatctc

SEQ ID NO: 7591 - DNA, 3858 bp, Artificial Sequence
  Description of Artificial Sequence: Synthetic coding sequence
atggatcttgaagctgcaaagaatggcacagcttggagacccacctcggctgaaggtgatttcgaactcggcatttcaagcaaacagaaacgaaaaaaaactaaaacagtcaagatgattggagtgcttacgctttttaggtacagcgactggcaggataagttgtttatgtctctgggcacaattatggcgattgctcacggaagtggcttaccccttatgatgattgtctttggagagatgacggacaaatttgttgacacagctggaaactttagcttcccggttaacttcagcctttcacttcttaatcctggaaaaattttagaggaagagatgacaagatatgcttactattattcaggattgggcgcaggagtcttggtcgccgcctatatccaagttagcttttggacgctcgcggctggtcgccagatcaggaaaatccggcaaaaattttttcatgctatcttgcgtcaggaaattggctggtttgacattaacgatacgacagagttaaacactcgtttgactgatgatatttcaaaaatttcagaaggtattggcgataaggtgggaatgttctttcaagcagttgcaacgttttttgccggattcattgtagggtttatacgcgggtggaagttaaccttggtgattatggcaatctcacccattctgggactgagcgctgcggtgtgggccaaaattctttctgccttctcggataaagaactcgccgcctatgcgaaagcaggcgcagttgcggaagaagctttaggcgcaatccgtacggtaattgcctttggtggtcagaataaggagttggaacgatatcaaaaacatcttgaaaatgctaaagaaattggtatcaagaaagctatctctgcaaatattagcatggggatcgcgttcttattaatttatgcgagttacgctctggcgttttggtacggcagtacacttgtcatctcaaaagagtacacgatcggaaacgctatgactgtatttttctctattcttattggcgcgttctctgtggggcaagctgccccttgcatcgatgcgtttgcgaacgcgagaggagctgcctatgtcatctttgacattatcgacaacaacccgaaaattgacagctttagtgaacggggacataaacctgattcaattaagggaaatttggagtttaatgacgtacattttagctacccttctcgcgctaatgtcaagatactaaaagggttaaacttgaaagtacagagcgggcaaacagttgctcttgtaggctcgtctggatgcggaaaatctaccacggtgcaacttattcagcgtctgtacgatccggatgagggaacaattaatattgatggacaagacattcggaattttaatgtgaactatcttcgcgaaattatcggtgtggtttctcaagaaccagttttattctccacgaccatagcagaaaatatttgttatggacggggcaacgtgacaatggacgaaattaaaaaagcggttaaagaagcgaatgcctacgagtttatcatgaaactgccacagaaattcgacacgctggtaggcgaacgaggtgctcaattatctggaggccagaagcagagaatcgctatcgccagagcgttagttaggaaccctaagatcttactgcttgatgaagcgacaagcgcgttagatacagaaagtgaagcggaggttcaagcggctctggataaggcgcgggaaggaagaacgaccatcgtaatagcacatagattgtctactgtcagaaacgctgatgttattgcgggattcgaagacggggtcattgtcgaacaaggaagccattctgaattgatgaagaaagaaggagtctattttaagctagtgaacatgcagacttcaggctcccagatacagtctgaggaatttgaacttaacgacgaaaaagccgcgacgagaatggcaccaaacggttggaaatctagattgtttcgccacagcacccagaaaaatttaaaaaattctcagatgtgtcagaaatcgttagatgtcgaaaccgatggcctcgaagcgaacgtcccaccggtttcattcttaaaagttctgaagttaaacaaaactgagtggccatattttgttgtaggaaccgtttgcgcgattgctaatggtgggttacaaccggctttcagcgtgattttctcggaaataattgccatcttcggaccgggtgatgacgccgtaaaacaacagaaatgcaacattttttcacttatttttttatttttaggcattattagctttttcacattttttcttcagggatttacatttggcaaggcgggagagatcttaactcgtagactcagatcaatggcattcaaagctatgttacgccaggacatgagttggtttgatgatcataaaaattcaacaggtgcgttgagcacacggttagccacagacgcggcgcaagttcaaggagccacaggcacgcgcctagcactcatcgcacaaaatattgcaaatctggggacgggaattatcatcagttttatttacgggtggcaattgacgctcctgttgcttgcagttgtcccgattatcgctgtgtcaggcattgtggagatgaaattacttgctgggaatgccaaaagagataagaaggaattagaagcggctggaaaaattgcgacggaagcaattgagaatattagaacagttgtgagccttacgcaggagagaaaattcgagtctatgtatgttgagaaattatatggaccgtatcggaattctgttcagaaagctcatatctacgggatcacattcagcatttcgcaagcctttatgtatttttcttatgcgggctgtttccggtttggtgcatacctgattgtcaatggccatatgcgtttcagggacgttatccttgtcttttcagcaattgtcttcggggctgtagctctgggccacgctagctcttttgctccggattatgcgaaggcaaaactctcagctgcacatcttttcatgctcttcgaaagacaaccacttattgactcatatagtgaagagggcctcaaaccggataaattcgaaggaaacataacgtttaatgaagtcgtgtttaattatcctacgagagctaatgtaccggtcctgcagggactatccctcgaggtgaaaaaagggcaaactctggcgcttgttgggtctagcgggtgcggtaaatcaacagttgtgcagcttttggaacgtttttatgacccacttgcaggcacagtctttgttgactttggttttcaacttctggatggacaagaagctaaaaaactgaatgttcaatggcttagagcgcaacttgggattgtttcacaagaaccgatattgtttgattgtagtattgcagaaaacatcgcttacggcgataattctcgggttgtcagccaggacgaaatcgtgtctgcagcgaaggctgctaatatacacccgttcatagaaacactgccgcataagtatgagacaagagtaggagacaaaggaacgcaactctctgggggccaaaagcaaagaattgcaatagcaagagccctgatccgccaaccgcagatccttctcttggatgaagcgacctccgcgctcgataccgaatccgaaaaagtggtccaagaagcgctggataaggcacgggagggacgcacgtgcattgtgatagctcaccgtttatcaacgattcagaatgcggatttaatcgtggtatttcagaacggtagggttaaagaacacggcacacatcagcaacttttggcacaaaaaggaatctacttttcgatggtcagtgttcaggcgggaactcaaaacctt

SEQ ID NO: 7592 - DNA, 3858 bp, Artificial Sequence
  Description of Artificial Sequence: Synthetic coding sequence
atggacctcgaggccgcgaagaacggaaccgcctggcggcccacttctgccgagggagatttcgagcttggtatttcctcaaagcagaaaagaaagaaaaccaaaaccgtaaagatgattggagtcctgaccctgttccgatactccgattggcaggacaagttgtttatgagcctcggaactatcatggccatcgcccacggctcaggactacctcttatgatgatagtgtttggggaaatgactgacaaattcgttgatacagcgggtaatttcagttttcccgttaattttagtctttcactgcttaacccaggaaaaatacttgaggaggagatgacaaggtacgcttattattactcaggactcggagcaggtgttctcgtggctgcatatatccaggtctctttttggactctggctgcagggcgccagatacgcaaaatcagacagaaattctttcacgcaattctgcgccaggagatcggttggttcgatatcaacgataccactgagttgaatacccgtctcaccgatgacattagcaagatctccgaaggcattggagacaaagtcgggatgtttttccaagccgtcgccaccttctttgccgggttcatcgtgggcttcatccggggctggaaactgaccttagtgatcatggctatctccccaattttgggccttagcgcggctgtctgggctaagatactgtcagctttttctgacaaggaactcgcagcatatgccaaggcaggagctgtcgctgaggaggccttgggggcaatcaggactgtgattgcatttggtggccagaacaaggagttggagcgctatcaaaagcaccttgaaaatgcaaaggaaatcgggattaagaaggccataagcgctaacatcagtatgggcattgccttcctgctgatttacgcttcctatgctctggccttctggtacggctctactctggttatcagcaaggaatacactataggtaatgccatgacggtattcttcagcatcctgatcggagctttttcagtcggtcaggctgcaccctgtatagacgcctttgcgaatgcccgaggcgccgcctatgttattttcgatataatcgacaacaaccctaagatcgactctttttcagagcggggccacaagccggactccattaagggcaatcttgaatttaacgacgtgcattttagttacccatcacgcgcgaatgtaaagatcctgaagggtctgaatctgaaggtccagtcaggccagacagtcgccctcgtaggcagcagcggatgtggtaaatccaccaccgttcaattaattcagagactatatgaccccgatgagggtactattaacatcgatgggcaggacatcaggaactttaacgtgaattacctaagggaaattatcggagtggtttcacaggagccggttctgttttcgaccacaatcgccgaaaacatctgttacggcagaggcaatgtcaccatggacgaaataaagaaagctgtgaaggaggcaaatgcatacgagtttatcatgaaactccctcaaaagtttgacaccttagtcggcgaaaggggggcccagttaagcggtggccaaaaacagcggattgcaattgccagggccctggtgcgaaaccccaaaatcctccttttggatgaagccacgtcagccttggacacagaatccgaagcagaggtccaggccgccctggacaaagctcgggaaggccgaaccactattgtgatcgcacatcggctcagcaccgttaggaacgctgatgtgattgcgggatttgaggatggcgtgattgttgaacaggggtcacactctgaacttatgaaaaaagaaggcgtctatttcaagttggtcaacatgcaaaccagcggaagccagatccaaagcgaggagttcgagctcaatgacgaaaaagccgcgacgaggatggcccctaatgggtggaagtcacgcctctttcggcatagcacacagaagaacttgaaaaactctcaaatgtgtcagaagtccctggacgttgagactgacgggttggaagccaacgtgcccccggtttctttcctaaaggttctaaaactaaataaaactgagtggccgtattttgttgttggaactgtctgtgccattgccaacggcggcctccagccggctttctccgtgatattctccgaaattatcgcaatttttggcccgggcgatgacgccgttaaacagcagaagtgcaatatcttctcactcattttcctcttcttgggtattattagcttttttactttctttctccagggctttacttttgggaaagcaggcgagattctaacgagaaggttaagatccatggcctttaaggccatgctccgccaggacatgagctggtttgacgatcacaagaattcaaccggcgccctgtcaacccggttggcgactgacgcggcccaggtgcagggagcaacaggaactaggctagcattgatcgcacagaacatcgccaatcttgggactggcataataattagcttcatctatggctggcagctcactttgcttttgctggctgtggtgcctatcatcgctgtgtcgggtatcgtcgagatgaagctgctcgcgggcaacgccaaacgcgacaagaaagagctggaagccgccgggaagattgctaccgaagccattgagaatattaggactgtggtaagcctgactcaagagagaaaattcgagtctatgtacgtggagaagttgtatggtccatatcgaaactccgtacagaaggcgcacatatacggaatcactttcagtatctcccaggccttcatgtacttctcctatgcggggtgcttccgctttggcgcgtacctgattgtgaacggacatatgagattcagagacgttatcttggttttctcggctatcgtgttcggcgccgtggcattagggcatgcttcttccttcgcacccgactacgctaaagcaaagctcagtgccgcacacctgttcatgctgtttgaaagacaacccttaattgactcttattccgaagaaggattgaagccagataagtttgaggggaatataactttcaatgaggtagtctttaactacccgactagggccaacgttccagtcctccaggggctctcactcgaagtgaaaaaagggcaaactctggcactagtggggtcttccggatgtggcaagagcactgtagtgcagctcctggaacgtttctatgacccattggccggcacagtttttgtggattttggtttccaactgctggatggtcaggaagcaaagaagctgaatgtccagtggttgcgcgcacaactgggaattgtctcccaagaacctattctgtttgattgtagtatagctgaaaatattgcatacggcgacaactcacgagtagtgagccaagatgagattgttagcgctgctaaggctgccaatattcatccctttatcgaaactctacctcataagtacgagacccgggtgggagataagggtacgcagctgtcagggggacagaaacagagaattgcaattgcccgggcactcatccgacagccacagattttgctattggacgaagctacctccgctctggacacagagtctgagaaagtggtgcaggaggcactggacaaggcccgagagggccgcacttgcatcgttatcgcccatcggttatctaccatccagaacgctgatcttattgtggtttttcagaacggacgagtcaaagaacacgggacccaccagcagctgttggcacagaagggaatctatttttccatggttagtgtgcaagccgggacccagaacctg

SEQ ID NO: 7593 - DNA, 3858 bp, Artificial Sequence
  Description of Artificial Sequence: Synthetic coding sequence
atggatttggaggctgccaaaaatggtacagcctggagacccactagcgcagagggagatttcgagctgggcattagtagcaagcagaaaagaaagaagactaagactgtcaaaatgatcggtgtcttaacactcttccggtactccgattggcaagacaagttatttatgtcactggggacaataatggctatcgcacacggctcaggactccctcttatgatgatcgtgttcggggagatgacagacaagttcgttgatactgctgggaacttcagcttccccgtgaacttctccctgtcacttctgaatccagggaaaatcctcgaagaagagatgacgagatacgcctattattattccggcttgggggccggtgtgcttgtggccgcatacatacaagtatctttttggactctggcggcgggccgtcagattcggaaaatcaggcagaaattcttccacgctatacttcgtcaggagatcggctggtttgatattaatgacactactgagcttaacacccggctgacagacgatatttcgaaaatttcagagggcatcggcgacaaagtgggcatgttctttcaggctgtggctacctttttcgccggctttatcgtcggctttatacgcggctggaaattaacgcttgtaatcatggcgatttccccgatcctaggactgtccgccgctgtgtgggccaaaatcctgagcgctttttctgacaaggagttagcggcgtacgctaaggcaggagccgtggccgaggaggcactgggggctattcgaacggtcatcgccttcggcggccagaataaggagctcgaacgctaccagaagcacctagaaaacgccaaggagatcgggattaaaaaagctataagcgctaacatcagcatggggatcgcttttctcctgatctacgcttcttacgcgttagctttttggtacggttccactcttgttatctcaaaggagtacacgatcggcaatgcaatgacagtgtttttttcaatcctcatcggcgcattctccgtcggtcaggctgccccttgtatcgacgcctttgctaatgcccgaggcgctgcttatgttatctttgacatcattgacaacaatcccaaaatagactcatttagcgagcggggccacaagccagactcaattaaaggaaatcttgagttcaacgacgtgcatttttcttacccttccagagctaacgtgaagatcctgaaaggattaaatctcaaggttcagtctgggcaaaccgtggccttggttggctctagtgggtgcggcaagtctaccaccgtccagctcattcagaggctgtacgaccccgacgaaggcaccatcaatattgacgggcaggatattagaaattttaatgtaaattacctgagagaaataatcggggtggtgtctcaagaaccggtgcttttctcaacaacaattgccgagaatatttgctatggtaggggtaatgtcactatggacgaaatcaagaaggcagtcaaagaagcaaatgcctatgaattcatcatgaaactgccccagaaatttgataccctcgttggcgaacggggagcgcagctcagcggagggcaaaaacagaggatagccattgcaagggccttggttcgcaatccaaagatcctactcctagatgaggctacttccgctctcgacactgagtctgaagccgaagtccaagccgccctcgacaaagctagggagggtcgtactacgatcgtgatcgcacaccggttgtcaactgtgcgcaatgccgatgttattgctgggtttgaggacggagtcattgtggagcagggttcccactccgaacttatgaaaaaggagggtgtttactttaaactggtgaatatgcagacatctggcagccagatacagtctgaggagttcgaactgaacgatgaaaaagccgccacacggatggcaccgaatggttggaagtcacgtctctttaggcatagcacccagaagaatcttaaaaatagccaaatgtgtcagaagtctctggatgttgagacggacgggctggaagccaacgtgcccccggtgagttttcttaaagttctcaaacttaacaagaccgagtggccatattttgtagtcggaaccgtgtgcgctatcgcaaatggggggctgcaaccagccttctcggttatattcagtgagatcatcgcaatttttggcccaggtgacgacgctgtaaagcagcagaaatgtaacattttctctctgatctttttgtttttaggcatcatctcatttttcacattttttctgcagggctttacttttggcaaagccggagaaatcttgaccagaagattaaggtctatggcctttaaggctatgttacgacaggatatgtcttggtttgatgatcataagaactcgaccggtgccttgagtacccggctggcgactgacgctgcccaggtgcaaggagcaacgggcacacgactggctcttattgctcagaatatcgccaatctcggtactggcatcatcattagttttatctacggttggcagcttaccctactcctgctcgccgtggtacccattattgccgtgtctggtatagtcgaaatgaagctcctggccgggaacgcaaaaagagataagaaggagctcgaggcagcgggcaaaatcgcaacagaagcaattgaaaacattcggactgtggtgagcctaacccaggagcgtaagttcgaatcaatgtacgtggaaaagctgtacggcccctacaggaactccgtccagaaagcacacatctatggtatcacattttccatttcgcaggcttttatgtactttagctacgccggatgctttcgcttcggtgcttatctgattgtaaatggccacatgcgctttcgggatgtgatcctggtgttctctgctatagtgtttggggccgtggctctgggtcacgcctcttcttttgcgccagactacgccaaggccaagctgtcagcggcccacctcttcatgctctttgaacggcagccactcattgatagttacagcgaagaaggactaaaacccgataagttcgaagggaacataaccttcaatgaagtcgtgtttaactaccccacccgtgccaacgttcctgtgctgcagggtctcagtctagaggtgaaaaaaggccagacactggctcttgttggatccagcggatgtggaaaatccactgttgtccagctgttagaacgcttttacgatcccctcgccggcacggtgttcgttgattttggcttccaattgctggatggacaggaagcgaagaaactgaatgtccaatggctaagagctcagctgggaattgtaagtcaggagccaattctgttcgattgctctatcgctgagaacatcgcctatggcgataactcacgggttgttagtcaggatgagatcgtaagtgcagctaaggccgctaatatccaccccttcatcgagacccttccgcacaagtacgaaacacgcgtcggggacaaaggcactcagctgtccggagggcagaagcaaagaattgcgatcgcccgcgctctgattcgtcagcctcagattctgctcctggacgaagctacttccgcgctagatacagaatccgagaaagtggtgcaggaagcccttgataaggcgagagagggcagaacttgcatagtgattgcccatcggctctcaaccattcaaaatgccgatcttatcgttgttttccagaacggtcgggtcaaggaacacggcactcaccaacagctgctcgctcaaaagggaatttacttttctatggttagcgtgcaggccgggactcagaatctc

SEQ ID NO: 7594 - DNA, 3858 bp, Artificial Sequence
  Description of Artificial Sequence: Synthetic coding sequence
atggacctggaagctgctaaaaacggaacagcatggcggccaacttcagccgaaggagactttgaactaggcatttcatcgaaacaaaaacgtaagaagactaagacagtcaaaatgattggagtactaacacttttccgctatagtgactggcaagacaaattgtttatgagtttgggaaccattatggccatagctcatgggtcaggactcccattaatgatgatagtttttggggaaatgactgataagttcgtcgatactgcgggaaatttctcatttcccgttaatttttccctttcactcctgaatcctggaaagatactcgaagaagaaatgacgagatatgcctattattacagcggactcggagctggagtcttagtggcagcatatattcaagtttcattttggacactcgcggcgggaagacaaattcgtaagattcgtcagaagttttttcacgcgatactccgacaggaaatcggatggtttgacataaacgatactacagagttgaacacgagattgacggatgatattagcaaaatttcagaaggcattggggataaggtaggcatgttttttcaggcagtcgctacgttcttcgctgggtttatagttggatttattagaggttggaagttaacgttggtcatcatggctatctcgcctatcttaggattgagtgcagctgtgtgggctaagatccttagcgcattctctgacaaggaacttgcggcatatgcaaaagcaggggctgttgctgaagaggcccttggagctatccggacagtgattgcattcggaggacaaaataaagagctggaaagataccaaaagcatctcgaaaatgcgaaagaaattggaatcaagaaagctatctctgctaacatttctatgggcattgctttcttgctcatttatgcttcctatgcgcttgcattctggtatggatccacgcttgttatttctaaagaatatacgattggaaacgcaatgaccgtcttcttcagtatccttattggagcgttttcggtaggtcaggcggccccatgcatagatgctttcgctaacgcacgtggagcagcatatgttatatttgatataattgataacaatccaaagattgactcattttcagaaagaggacataaaccagattcaatcaagggaaatttggagtttaatgatgtgcatttctcgtatccatcaagagctaatgtaaaaatcctgaagggattgaatctgaaagtgcaatcgggtcaaacggtggctttagttggttcttccggttgcggtaaatcgactaccgtacaattgatccaacgtctgtacgatcccgacgaaggtaccatcaatattgacggacaagacatcagaaacttcaacgtcaactatcttcgtgaaattataggagttgtgtctcaggaaccagtgctgttctccactacaatcgctgaaaatatttgctatggaaggggcaacgttacaatggatgagatcaaaaaagccgttaaggaagccaatgcttatgaattcatcatgaaactccctcaaaagttcgatacgttggtgggtgaaagaggagctcaactttctggaggacaaaaacaaagaattgctattgcaagagctctcgtgaggaacccgaaaatcctgctgcttgatgaagcaacttcagctttagacactgaatccgaggcagaggtccaagcagcattggataaggctagagaaggacggactaccatagtcatcgcacaccgactcagtaccgttcgtaatgcagacgttatcgcgggttttgaggacggtgttattgtcgaacaaggatcccattcagaattgatgaaaaaagagggcgtgtacttcaagctcgtaaatatgcaaacgtctggatcgcaaattcaatctgaagaattcgagctcaatgatgagaaggcagcgacgcgaatggcaccaaacggatggaaatcacgtctgttccgacactctactcaaaagaatctcaaaaactcacaaatgtgtcaaaagtcattagatgtggaaactgacggtttggaagcaaacgttccacctgttagtttcttgaaagttttaaaattaaataagactgaatggccgtactttgttgtcgggacagtgtgtgcgattgctaacggaggactacaaccagcattttcagttattttcagcgagattattgctattttcggacctggagatgatgctgttaaacagcaaaagtgtaacatcttctcactgattttcctttttttgggaattatctcgtttttcactttcttcctccaaggattcactttcggaaaagctggcgaaatactgactcgacgattacgttcgatggcgttcaaagctatgcttcgacaggatatgtcttggtttgatgaccacaagaacagtacaggtgctctgtcaaccagactagcaacagacgcggcacaggtccaaggcgccacaggaacacgattggccttgatcgcccaaaacatcgcaaacttgggaactggaattattataagttttatttacggatggcaacttacacttcttctcttagctgtggtccccataattgcggtctcgggtatcgtggaaatgaaactgttggccggaaacgccaaaagggataagaaagaactggaagctgctggaaagattgcaactgaagcaattgagaacattagaacggtcgttagcctcacccaagaacggaaattcgaatctatgtatgtagaaaagctctatggtccgtaccggaactcagttcagaaggcacacatttatggaataacgttttctattagtcaggcctttatgtacttctcttacgcagggtgtttcagatttggagcctaccttattgttaatggtcatatgcggtttagagatgtcatcttggtgttttccgcaatagtgtttggagcagttgcgctaggacatgcatcgtcctttgcaccagattatgctaaagctaagctctcagctgctcatctgtttatgttgttcgaacgacagccattgatagatagttactcagaagaagggctcaagccggacaaattcgaaggaaatattacttttaatgaggttgtattcaattacccgacgcgcgcaaacgtcccagttctccaaggattgtcgttagaagttaagaagggtcaaacattggctctcgtcggttcaagcggatgtggaaagtcaaccgttgttcagctgttggagcgtttttatgatccgctcgcaggaacggtcttcgttgactttggatttcagcttctggatggacaagaagctaaaaagcttaacgttcaatggttgagagcccaactcggaatcgtctcccaggaaccaattcttttcgactgctcgattgctgaaaatattgcctacggagacaattcgcgcgtcgttagtcaggacgaaatagtctcggcggcgaaagctgccaatatccatccctttatcgaaactcttccacacaaatacgaaacgcgggtaggcgataagggcactcagcttagtggaggacaaaaacaaagaattgccattgctcgagctctaattcgtcaacctcagatactcttgcttgatgaggctacttcagctttagacacagaatccgagaaggtagttcaagaagctttggacaaagcaagagaaggtagaacttgcatcgttatcgcccatcgactctctacaattcaaaacgcagatttgattgtagttttccaaaacggaagagttaaagagcatggcactcaccaacagcttcttgctcagaaaggaatatacttttcaatggtttcggttcaagctggaacccaaaacctg

SEQ ID NO: 7595 - DNA, 3858 bp, Artificial Sequence
  Description of Artificial Sequence: Synthetic coding sequence
atggaccttgaggccgctaaaaacggcacggcatggaggccaacgtcagcagaaggtgactttgaacttggcatctcctcaaagcagaaaagaaagaagaccaagacagttaagatgatcggcgtccttacattgttcaggtattccgactggcaggacaaactttttatgtcactggggactatcatggccattgctcacggttctggtttgcctttgatgatgatagtgtttggagagatgacggataagttcgtggacaccgctgggaacttcagctttccagtcaacttctcactctccttgcttaacccgggtaagatcctagaggaggaaatgacacgctatgcttattattattccggacttggcgctggcgttcttgtggcggcatatatccaggtctcgttctggactcttgctgctggccgccaaattcgcaagatccgacaaaagttctttcacgctattctacgccaggaaataggctggtttgacatcaacgatacaactgagttgaacactaggcttactgacgacatctccaagatctcagaaggaatcggtgacaaggttggcatgttcttccaggcggttgccactttctttgcaggcttcatcgtcggattcatccgtggatggaaattgactctagtgattatggccatcagtccaatccttgggttatcggcggccgtctgggcaaaaattctgtctgccttctcggacaaggaattagctgcatacgcgaaggcgggtgcagtggccgaagaagctcttggggcaatccgtacggtgattgcatttggtggccagaataaagagcttgaacggtaccagaaacaccttgaaaatgcaaaggagatcggaatcaagaaggccatctccgctaacatctcaatgggcattgctttcctcctcatctatgcaagttacgcgttagctttctggtacggatctacactagttatcagcaaggaatacacgatcggtaacgctatgaccgtcttcttctctatcttgatcggagcgttttccgtcgggcaggcggccccttgcatcgatgccttcgcgaatgcgcgaggcgctgcgtatgttattttcgatatcatcgacaacaatcctaagatcgactctttttccgagcgtggccacaagcctgatagtattaagggtaatttggaattcaatgacgtccatttctcatacccctctcgggctaatgttaagatcctcaagggattaaatttgaaagtccagagcggacagaccgtggctctcgtcggctcctctggttgcggtaagagcacgacagtgcagcttattcagcgattgtacgaccccgatgagggaacgatcaacatcgacgggcaggatataaggaatttcaatgtcaactacctccgagagatcatcggggtcgtttctcaagaaccagtcttgtttagtaccacgatcgcggagaatatttgttatggacgtggcaatgtgacgatggatgagataaagaaggcggtcaaggaagctaatgcatatgaattcattatgaagctcccacaaaagtttgatacattggtcggcgagcgcggggctcaattgagtgggggacagaagcaacgtattgcaatagcaagggcgctggttcgtaaccccaagattttgcttctggatgaggcgacgtccgccctagacactgagtctgaggctgaggtgcaagctgccctggacaaagcacgggaaggtcggacgacgatcgtaatagcgcaccggttaagtaccgtaaggaatgccgatgttattgcaggatttgaagacggtgtcatagtcgaacaaggctcgcacagtgagctcatgaagaaagaaggtgtctatttcaaattggtaaacatgcagacgtcaggaagtcagatacaatcagaagagtttgagttaaacgacgagaaagctgcgacgcgtatggctccaaatggatggaaaagtcgtctgtttcgacattccacccagaaaaacctaaagaactcgcaaatgtgtcagaaatcacttgacgtggagacagatggcttagaggccaacgtaccgccggtctcgtttcttaaagtgctcaaactaaacaaaaccgaatggccatacttcgtcgtagggaccgtctgcgctattgctaacggtgggttgcagccagcattttcggttatattttcggagataattgcgatttttggtccgggtgatgatgccgtgaagcagcaaaagtgtaacatcttctcccttatttttctcttcctcggcataataagctttttcacattcttccttcaaggttttacattcgggaaagccggcgagattttgacccgacgcctgcgctcaatggcctttaaggcaatgctccgccaggatatgtcttggttcgacgaccataagaacagcacgggtgcattgagcacaagactggcgactgacgccgcgcaggttcagggagcaactggaacacgtctcgctctcatcgcgcagaatatcgcaaatctcggaaccgggatcataatttccttcatttacggttggcaactgaccttgctcttgctcgccgttgttcctattattgctgtctcaggaatagtcgaaatgaaactgttggccggtaatgctaaacgtgataagaaggagttggaggcagctgggaagatcgcgaccgaagccatagaaaatatccggacggttgtgtccttgacgcaagagcgcaagttcgagtcgatgtatgtagaaaagttatatggaccgtatcgaaactctgtccagaaggcacatatttatggtatcaccttcagtatatcacaggcgttcatgtatttctcttatgctggttgctttcgattcggagcttacttaatagtcaacggccatatgcgatttcgcgacgttatcctcgtgttctcggctattgtctttggtgcagtcgcgctcggccatgcttcgtccttcgcgccagactatgccaaggccaagctttcggccgctcacttatttatgctgtttgagcgtcagccgctgattgactcatactccgaagaagggctcaaacccgataagtttgagggtaatattacatttaacgaggttgtcttcaactacccaaccagggccaatgtcccggtgttgcaagggttgtcgcttgaggttaagaagggccaaaccctggccctcgtgggtagtagcggatgtggaaagtcaactgtagtacaactactggaaaggttttatgacccactggccggtactgtctttgtcgactttggtttccaactgctggacggacaggaggctaagaagcttaatgtacaatggttgcgagctcagcttggaatcgtttcgcaggagccgattctcttcgattgctccattgctgaaaatattgcgtacggagataacagccgcgtggtctcgcaggacgagatcgtgtcggcagcgaaggctgctaatatccatccatttatcgaaaccttaccccacaaatatgagactagggtcggggataaaggtacacagttgtccggcggtcagaaacaacgcatcgcgattgcccgtgcgttaatcagacaaccccagatcctgctgctcgatgaggcaaccagcgctcttgacactgaatcggagaaggtcgttcaagaagcgttggacaaagcacgtgaggggcgtacctgcattgtcattgcacatagactctcaacgatccagaacgctgatctgatcgttgtctttcagaatggacgcgtcaaggaacatggcacgcatcagcaattactagcacagaagggaatttacttctcaatggtctctgtgcaggcgggcacacagaacctt

SEQ ID NO: 7596 - DNA, 3858 bp, Artificial Sequence
  Description of Artificial Sequence: Synthetic coding sequence
atggacctggaagcagctaagaacggtaccgcctggcggccgacctccgccgaaggtgacttcgaactgggtattagctcaaagcagaagcgtaagaaaaccaaaaccgtgaagatgattggggtcctgactctgttccgctactcggactggcaggacaagctcttcatgtcactcgggactattatggccatcgcacatgggagcggcctgccgctcatgatgatcgttttcggtgagatgaccgacaagttcgtggatactgcaggcaactttagttttcctgtgaacttttctctgtcgctgctgaaccccggaaagatacttgaagaagaaatgacccggtatgcctactactacagcggactcggagcgggtgtgctggttgctgcctacattcaggtatcattctggaccctggccgccggccggcagattcgtaaaatccggcaaaagttcttccatgccatccttagacaagagatcggatggttcgatatcaatgatactactgagctcaacacccggctgactgacgatatctcgaagatctcagaagggatcggcgataaagtgggaatgttttttcaggcggtggccacttttttcgctggattcatcgtggggttcattaggggatggaaactgacgctggttatcatggcgatctccccaattctgggcctctcagccgcagtttgggccaagatcctctcagccttcagcgataaagaactcgccgcctacgccaaggcgggcgccgtcgcggaggaagcgttgggagccatccggacggtgatcgcttttggaggccaaaacaaagaacttgagcgctaccagaagcacctcgagaacgccaaagaaatcggtatcaagaaggcgatctcagcaaatatctcaatggggatcgcgttcctgttgatctacgcatcctacgccctggctttttggtatggatctaccctggtgatcagcaaggagtacactatcggaaatgccatgactgttttcttcagcatcctgattggagccttctcggtggggcaggcggcaccgtgtatcgacgcgttcgcgaatgccagaggagctgcgtacgtgatcttcgatatcatcgacaataatcctaagattgactcgttctcagaacgggggcataagcctgatagcattaagggcaatctcgagtttaacgacgtccatttctcctacccgtcccgagctaatgtcaaaatcctcaagggcttgaatctcaaggtgcagtccggacaaacggttgccctggtaggttcaagcgggtgtggaaagtcgaccacggtccagctcatccaacgcctctatgacccagatgagggaaccattaacatcgacggacaggatatcaggaactttaacgtgaactacctcagggagatcatcggcgtggtgtcacaagaaccggtgctgttctcgactacgatcgctgagaacatctgctacggtcgcggcaacgtgaccatggatgaaatcaaaaaggccgtgaaggaggcgaacgcatacgaattcatcatgaagctgccacagaagttcgacactctggtgggcgagcggggagcccagttgtcgggaggacagaagcaaaggatcgcaattgcccgcgctcttgtccgcaatcccaaaatcctgctcctggacgaggccaccagcgcgctcgacaccgaatctgaggcagaagtacaagctgccctggataaggcgcgcgaaggccgcaccacgatcgtcatcgcacaccgcctgtcaaccgtccgtaacgcggacgtcatcgcaggcttcgaggatggagtgatcgtggaacaaggctcgcatagcgagcttatgaaaaaggagggcgtgtacttcaaactggtgaacatgcagacttccggctctcagatccagtcggaagaatttgaactgaatgatgaaaaggcagcgacccgcatggcaccgaatggatggaagagccgccttttcagacacagtacccagaaaaacttgaagaattcgcagatgtgccaaaagtcgctcgacgtcgaaactgacggtctggaagcaaacgtcccgcctgtctcgttcctcaaagtgctgaagctcaataagactgagtggccttacttcgtggtcggtactgtgtgcgcaatcgctaatgggggcctgcagccggcattctcagtcatcttctccgagattatcgctatcttcggaccgggcgatgacgcagttaaacaacagaagtgcaacatcttctccctgatcttcctttttctgggcattatctcgttctttactttcttcctccaaggattcactttcggtaaagccggagagatcttgacgcggcgcctgcggtccatggccttcaaagcgatgttgcgacaagatatgtcctggttcgacgatcacaagaactccaccggagcactctcgacgcgcctcgccaccgatgccgcgcaagtgcaaggcgctactggcacgcggctcgccctcatcgcccagaatatagccaacctgggcaccggaattatcatctcgttcatctacggatggcagctcactctgttgctcctcgccgtggtgccgattatcgcagtgtccggaatcgtagagatgaagctgctggccggcaatgcaaagcgggacaagaaagagcttgaggccgccggcaagatcgcgaccgaagcaatcgagaatattcgcaccgtggtttcgctcacccaggaacgcaaatttgagtcaatgtacgtcgaaaaactgtacggaccgtacaggaactcggtccaaaaggctcacatctacggaatcactttctcgatttcccaggcgtttatgtacttttcatacgccgggtgcttccggtttggcgcttatttgatcgtgaacggacatatgcggttccgcgatgtgatcctggtgttcagcgccatcgtgtttggagccgtggcccttggccacgccagctcgttcgcaccggattacgcgaaggctaagttgtccgctgcgcacctcttcatgctttttgagagacaaccattgatagactcgtactcagaggaaggactgaagccagacaaattcgaaggaaacattactttcaacgaggtcgtgttcaattaccctacccgcgctaacgtcccagtgctccagggcctgtccttggaagtgaagaaaggtcaaactctggcactggtcggaagcagcggctgtggaaagagcaccgtggttcagctgctggaacgcttttacgacccgttggccggtacggtctttgtggacttcggatttcagcttctggacggacaagaagccaagaagctgaacgtgcagtggctgcgggcgcagctgggtatcgtcagccaggaaccaatcctgttcgattgctcaatcgcggagaatatcgcgtacggcgataactcgcgggtggtgtcccaggacgaaattgtttccgctgcgaaggccgccaacatccacccctttattgaaactctcccacataagtacgagactagagtcggagacaagggcacccagctcagcggaggacaaaagcagcggatagccattgcacgtgctctgatccgccagccccaaatcctgttgcttgacgaggccacttcggccctcgacactgagtcagaaaaagtggtgcaagaagcgcttgacaaggcacgcgaaggaagaacctgcatcgtgattgctcaccgactctccactatccaaaacgccgacttgattgtcgtgtttcagaacggccgggtcaaagaacacggaacccaccaacagttgttggcgcagaagggtatctacttctcgatggtcagcgtgcaagctgggacccagaatctg

SEQ ID NO: 7597 - DNA, 3858 bp, Artificial Sequence
  Description of Artificial Sequence: Synthetic coding sequence
atggatctcgaagccgcaaagaacggaaccgcatggcgacccaccagcgcagaaggagattttgaactgggaatctcgagtaagcaaaagcggaaaaagactaagaccgttaagatgatcggggtgcttactttgtttcggtactccgattggcaagataagctgttcatgtcgctgggtactataatggctattgcacacggcagcgggctccctcttatgatgatcgtgtttggagaaatgactgacaaatttgtggatactgcggggaatttctcattccccgtgaacttttcacttagccttctgaatcctgggaagattctcgaagaagaaatgacccgttatgcatactactattcgggactgggggcaggagtgctggttgccgcttacatacaagtgtccttttggactttggccgcgggacggcaaattcggaagattaggcagaaattctttcatgccattttgcggcaggaaatcggttggtttgacattaatgataccactgaactgaacacccggcttaccgacgatatctcgaagatttcagaaggaatcggagataaggtgggaatgttttttcaagcagtggccacgttctttgcaggtttcatcgtgggattcattcgaggctggaagctcactcttgtcattatggcgatttccccgattctgggccttagcgcagcagtgtgggcaaagatactgtccgcattctccgataaggaactggcagcatatgccaaggcaggggctgtggccgaggaagcgctgggagcgataaggaccgtcattgcatttggaggacagaataaggaacttgagagataccaaaagcacctcgaaaatgcaaaggagattggtattaagaaagccatttcggcaaacataagtatggggattgccttcctgcttatctacgcgagctacgccctggcgttttggtacggcagcactcttgtaatatcaaaggaatacaccatcggaaacgcgatgacggtgttcttttcgattctcattggtgcattctcagtgggtcaagctgctccttgcatcgatgcctttgccaacgcacgcggcgcagcctacgtgatcttcgacattattgataacaatcccaaaattgattccttctccgaacgcggtcataaaccggacagcataaagggtaatcttgagtttaacgacgtccacttttcgtacccctcaagggcaaacgtgaagatactgaagggtctgaatcttaaggtgcagtctgggcagaccgtggcgctcgtcggtagctccgggtgcggaaaatccacgactgtacagctgatacaacgcttgtacgatccagatgaaggcactattaacattgacggacaagacattagaaatttcaatgtgaattacctgagggaaatcataggagtagtctcccaagaacctgtccttttttcaaccacgattgccgaaaacatttgctacggtagaggtaatgtaaccatggatgaaatcaaaaaggccgtcaaggaagcaaacgcatacgagtttatcatgaaacttccgcagaagttcgataccctggtgggagagcgcggcgcacagctgtccggtggccagaagcagcgtatagcaattgcacgcgcacttgttcggaacccaaaaatcttgctgctggacgaggctacttctgcactggatactgagagcgaagcagaggtccaagccgcacttgataaggcgagagaaggccgtaccaccattgtcattgcacatcgtctgtccaccgtgagaaatgcggacgttattgcaggatttgaagatggcgttattgtggagcaaggatctcactctgaattgatgaagaaagagggggtgtatttcaaactcgtgaatatgcagacttcaggatctcagattcagtcggaggaattcgagctgaacgatgaaaaggcagcaacgagaatggcccccaacggctggaagagcaggctgtttcgacactcaactcagaaaaaccttaagaactcccaaatgtgtcagaagagcctggacgtggagacggatggtcttgaggctaacgtgccacctgtgtcgttcctgaaggtgctgaaactgaacaaaactgagtggccgtactttgtggtgggtaccgtgtgtgcaattgcaaatggtggactgcaacccgcgttcagcgtgatcttttccgaaatcatagccatctttggcccaggagatgacgcggtcaagcagcaaaagtgcaacatctttagcctgatatttcttttcctcggaattatctcgttctttaccttctttctccaggggtttactttcgggaaagcaggtgagatcctcactcgacgtttgagatccatggcatttaaggcaatgctcagacaagatatgagctggtttgatgaccacaagaattcgaccggagcactctcaaccaggcttgctaccgacgcagcacaagtgcaaggcgcaacgggcactcgactcgcactgattgcacaaaacatcgccaatcttggtaccggaattatcatttcctttatctacggttggcagttgactctgctcctcctggcggtggtgccaatcatcgcagtctcgggtatcgtggaaatgaaactgcttgctggtaatgcaaagagagataagaaggaactcgaggcggcaggaaagatcgcaactgaggcaattgagaacatcagaactgtggtcagtctcactcaggaacgcaaatttgaatccatgtacgtcgaaaagttgtacggaccttaccgcaacagcgtgcaaaaggcccatatctacggcatcacctttagtatctcgcaggcctttatgtacttctcgtacgcaggatgttttcgttttggtgcctaccttatcgtcaatggacatatgagatttcgcgatgtgatacttgtgttcagcgctatagtctttggagcggtggcactggggcatgcctccagcttcgcacctgattacgcaaaggcgaaacttagcgccgcacatctgttcatgctttttgaacgccagcctctgatcgatagctactccgaggagggacttaagccagacaaatttgaaggaaacatcacttttaacgaagtggtgttcaactacccaaccagggcaaacgtcccagtccttcaggggctctccctcgaagtcaagaaaggtcaaaccctcgcactggtgggatcgtccggatgcggtaagtcgactgtcgtccaactccttgaacgattttacgaccctttggcaggaaccgtgtttgtggacttcgggtttcaactgcttgatggccaagaagccaaaaagctgaatgtccaatggctccgagcacaactcggtatcgtgtcccaagagccaattctgttcgactgttccattgctgaaaacatcgcttacggggataacagccgcgtcgtcagtcaagacgagatcgttagcgctgcaaaagctgcgaacatccatccattcatagaaacccttcctcataagtacgagactagagtgggtgataaaggtactcaactgagcggaggacagaaacagcgcattgcgatcgcccgcgccctgattcggcagcctcagattctgctgttggacgaagcgaccagcgcacttgacactgaatcagaaaaggtggtccaggaggcgctcgacaaagcaagagaaggtagaacctgtattgttattgcacacagactgtccaccatacaaaacgcagatcttatagtggtgtttcaaaatggcagggttaaggagcatggcacccatcaacaacttctggcccaaaagggaatatacttttccatggtgagcgtccaggccggaactcagaacctt

SEQ ID NO: 7598 - DNA, 3858 bp, Artificial Sequence
  Description of Artificial Sequence: Synthetic coding sequence
atggaccttgaagccgcaaagaatggaaccgcttggcgccccacttccgctgaaggagacttcgaactggggatctccagcaagcaaaaacggaagaaaactaaaactgtcaagatgatcggagtgctgactctcttcaggtactcggactggcaagataaactcttcatgtcgctggggaccataatggcgatcgcacacggttccggactgcctcttatgatgatcgtctttggcgagatgaccgacaagtttgtggacaccgcggggaatttctcattcccagtgaacttcagcctttctctcttgaatccaggaaagattctggaagaggagatgacgcgatacgcatattactactccgggctgggagcgggagtgctggtggcagcatatatccaggtgtcattctggactttggcggccggacggcaaatcaggaaaatccggcagaaattcttccatgccatcctccggcaggaaatcggctggttcgacatcaacgacaccactgagctgaacacgcgcctgaccgacgatatcagcaagatcagcgaagggatcggagataaagtcggaatgttcttccaggcagtggccaccttctttgcgggcttcatcgtgggattcatccgcggctggaagctcacgctcgtgataatggccatttcgccgatcctgggcctgagcgcggccgtgtgggctaagatcctctcagccttcagcgacaaagagctggcagcctacgcaaaggccggagcggtggcggaagaggcgctgggtgctattagaaccgtcattgcattcggaggacagaataaagagctcgaaaggtaccagaagcacctcgagaacgccaaggagatcggaatcaaaaaggcgatctcggccaacatttccatgggtattgcgttcctcttgatttacgccagctacgcactcgccttctggtacggatccaccttggtaatctcgaaggaatacactatcggaaatgccatgaccgtgttcttcagcattcttatcggcgccttctccgtgggacaagccgccccgtgtatcgacgcgttcgcaaatgcccgcggcgcggcttacgtgatcttcgatatcatcgacaacaatccaaagatcgacagcttcagcgaaagaggacataaacctgattcgattaagggaaacctggaattcaacgatgtccacttctcgtacccatcccgggccaacgtgaaaatcttgaagggtctgaacctgaaggtgcagtcgggccagactgtggcgctggtcggatcgtcagggtgcggcaagtccactaccgtgcagttgattcaacggctttatgacccggacgagggcactatcaacattgacggccaggacatccgcaacttcaatgtgaactacctgcgggagatcattggcgtggtcagtcaagagccggtgctgttctccaccactatcgcggaaaacatctgctacggcaggggaaatgtcactatggacgagatcaagaaggcggtcaaagaggcaaatgcctacgaattcatcatgaagctccctcagaaattcgataccctggtgggtgaacgcggagcacaactgtccggaggacaaaagcaacgcatcgccattgcgagagcgctggtcaggaacccaaagattctgctcctggacgaagccacctcagcacttgataccgagtccgaagcggaagtccaagccgccttggacaaagccagggaggggagaaccactattgtgatcgcccatcgcctttccactgtgcgcaacgccgacgtgatcgccggattcgaagatggcgtgatcgtcgagcagggatcacactcagaacttatgaagaaagaaggagtgtacttcaaactcgtgaacatgcaaacgtctggctcgcaaatccagtccgaggagtttgaactgaacgacgaaaaggccgccacccgaatggcccctaacggatggaagagcagactgttccgccattcgacccagaagaacctgaagaactcgcagatgtgtcaaaaatcactcgatgtggaaaccgatggtctggaagcaaacgtgccgccagtgtcatttctgaaggtccttaagctcaacaagactgagtggccttacttcgtcgtgggtaccgtgtgtgcgattgcgaacgggggcctgcagccggcgttcagcgttatcttctcggaaatcatcgccatcttcggcccgggagatgatgcggtgaagcaacaaaaatgtaatatcttctccctgatcttcctcttcctcggaatcatctcattcttcaccttttttctgcagggtttcaccttcggaaaggccggagaaatcctgacgaggcgcctgaggtcgatggctttcaaggctatgctccgccaggacatgtcgtggtttgacgaccacaagaatagcaccggtgcactgagcacccggctggctactgacgcggcccaggtccaaggcgccactggaacccgcctcgcactcatcgcgcaaaacatcgccaacctcggaaccggcatcatcatcagctttatctacgggtggcagctgactctgctgcttctcgctgtcgtgcctatcatcgcggtgtccggaattgtggagatgaagctgctggcgggcaatgcgaaacgggacaaaaaggaactcgaagcggcggggaaaattgccactgaggcaatcgaaaacatccggactgtcgtcagcctcacccaggaacggaaattcgaaagcatgtacgttgagaaactgtatggaccgtaccggaactcggtgcagaaggcacacatttacggaatcaccttcagcatttcccaggccttcatgtacttcagctacgcaggatgcttccgattcggggcctacctgatcgtgaacgggcatatgcgcttcagggacgtcatcctggtgttcagcgccatcgtgttcggggccgtggccctggggcacgcttcctcattcgcaccggactacgccaaagcaaagctgtcggcggcgcacctcttcatgctgttcgagcgccagcccctcatcgactcctactcggaagaaggcctgaagccggataagttcgaaggtaacataaccttcaacgaggtcgtgttcaattacccgactagagccaacgtcccggtgctccagggactttccctcgaagtcaagaaaggacagaccttggcactcgtgggatcaagcggatgcgggaaatccactgtggtgcagctgctggaacgcttttacgacccgctggccggaactgtgttcgtagatttcggatttcaactccttgatggtcaggaagccaagaagctgaacgtccagtggctccgcgcccagctgggaatcgtgtcgcaggaaccaatactgttcgactgctccatcgctgagaacatcgcctacggggataattcccgggtggtgtcacaagacgaaatcgtgtccgcagccaaagctgctaacatccaccctttcatcgaaaccctcccccacaaatacgaaactcgggtcggagacaagggaacgcaactctctgggggacagaaacagcggattgctatcgctagagcacttatccggcagccgcaaatccttttgctggacgaggctactagcgcgcttgacaccgaatccgagaaagtggtccaagaggctctggacaaagcaagagaagggcggacctgcatcgtcatcgcacatcgactgtcgacgatccagaacgcagacctgattgtggttttccaaaacggacgggtgaaggagcacggtacgcaccaacagctgcttgcgcaaaagggtatctacttttcgatggtgagcgtgcaggcaggaactcaaaacctg

SEQ ID NO: 7599 - DNA, 3858 bp, Artificial Sequence
  Description of Artificial Sequence: Synthetic coding sequence
atggacctggaggcagccaaaaacggcacagcctggaggcctacgtccgccgagggagatttcgaactgggaatatcaagcaaacagaagagaaaaaagacgaaaactgtcaagatgatcggcgtacttaccctgttccggtactccgactggcaggataagctgtttatgagcctcggcactattatggcaatcgcccatgggtcaggcctgcccctcatgatgatagtctttggagaaatgacggacaaattcgtggacacagccggcaatttttcttttcctgtaaacttcagcctctcactcttgaatcctggaaagattttggaagaggaaatgacccgctacgcatactactactcagggctcggagcgggagtgctggtcgctgcttatatacaggtttccttctggacgctcgccgcaggaaggcagattagaaagatacggcagaagttcttccacgccatcctcaggcaggagatcggatggttcgatatcaacgataccactgagctcaacactcgccttacggacgacatcagtaaaatatcagagggcatcggggataaggtggggatgttctttcaagctgtggctacgttcttcgctgggttcattgtaggatttattaggggatggaagctgacactcgtcataatggctatctctccgattctgggcctgtctgctgctgtgtgggccaagattctgtccgcctttagcgacaaagaactcgccgcctacgcgaaagccggggctgtcgcggaggaagccctgggtgcaattcgcacagttattgctttcggagggcaaaataaagaactcgaaagatatcagaaacacctggagaacgcaaaagaaattggaatcaagaaagctatttccgcaaacatcagtatgggcatcgcatttcttcttatttatgcttcctatgctctcgcgttctggtacgggagtacacttgtgattagcaaggagtatactattggtaatgccatgacagtgttcttctccattctgattggcgccttcagcgttggccaggctgcaccttgcatagacgccttcgccaacgcacgaggcgctgcctacgtgatattcgacatcatcgataataatcccaaaatcgacagtttctccgagcggggccataaaccagacagcatcaagggcaatttggaatttaatgatgtgcactttagctatccctcccgagccaatgtgaagatactcaaagggctcaacttgaaggtgcaaagcgggcaaacggtggccctcgtggggagttcaggatgtggcaagagtaccactgtacagctcatccagcggctgtatgacccagatgaagggacaatcaatatcgatggccaggacattaggaacttcaatgtgaattatctgcgagagatcatcggggtggtgagccaggaacccgtcctgttctccactaccatcgccgagaacatatgctatggaagagggaacgtcaccatggacgaaattaaaaaagcagtgaaagaggcaaacgcgtatgaattcatcatgaagctgccacaaaagttcgacaccctggtgggggagcggggcgcccagctgtccggcggacagaagcagcgaattgctatcgcgcgggctctggtacggaaccccaaaatcctgttgctggatgaagctacatccgccctcgatacagaatctgaggctgaggtgcaggccgctctcgacaaagcaagagaggggcgaacaaccatagtgatcgcacacagactttccacggttaggaacgccgatgtcatagctggcttcgaagatggcgtgatagtggaacagggcagtcactccgaacttatgaagaaagagggggtttactttaagctcgtgaacatgcagacaagcggctctcagattcagagtgaggaattcgagctcaacgatgagaaagcagccacgcggatggcacccaacggttggaagtcccggctctttaggcattctactcaaaaaaatctcaagaattcccagatgtgccagaagtccttggatgtggagacagatggactggaggccaatgtgccaccggtgtcattcctgaaggtgctcaagttgaataaaacagagtggccatacttcgtggtgggcacagtatgcgctatagcgaacggaggcctgcagcctgccttttctgtgatattcagtgagataattgccattttcggacccggcgatgatgccgttaagcagcagaaatgcaacatcttttctctcatcttcttgtttctcggaattatttcttttttcacttttttcctgcaaggttttacgttcgggaaagccggcgagattctgacacggcgactgcggagcatggctttcaaagccatgctgaggcaggatatgagctggttcgatgatcacaagaattctaccggtgctttgtctacccggcttgcaaccgatgccgcgcaggtccagggagcaaccggtactaggctcgctctcattgcccagaacattgccaacctcggaaccggcattattatctccttcatctacggatggcagctgactttgttgttgttggccgtggtgccaatcatcgctgtctcaggcatcgtagagatgaaactgctcgctgggaatgcgaaaagggataagaaagaactcgaagcggccgggaagatagctacagaggctatcgagaacatccggaccgtcgtcagtctgacccaggaacgaaagtttgaatcaatgtatgtggagaaactttacggaccctacagaaatagtgtgcagaaggcccatatttacgggattactttcagcatctcacaggcattcatgtatttctcttacgctggctgttttcgctttggtgcatacctgatagtgaacggacatatgagattccgggatgtgatattggtcttctctgccatagtgttcggagctgtggctctggggcatgcgtcttcattcgcacctgattacgctaaagcaaagctcagcgctgcccacctgttcatgttgtttgaacgccagccgctgatcgattcctattccgaagagggtttgaagcctgataagttcgaggggaatatcacgtttaacgaagttgtgttcaactaccctacaagagcgaatgttccagtgctgcaggggctgtccctcgaggtgaaaaaaggacagacgctggcccttgtcggaagcagtgggtgtggaaagtcaacagtggttcaactcctcgagcgcttctatgacccattggctggaacagtgtttgtcgattttgggtttcagctcctggacgggcaggaagccaagaagttgaatgtgcagtggctgcgagcccagcttgggattgtttctcaggagccaatcttgttcgactgctctattgctgaaaacatcgcgtatggagacaattccagggtcgtgtcacaggacgagattgtgtccgcagctaaagcagcaaacattcacccattcattgagacgctgcctcacaagtatgagactagggtgggggataaaggaacgcagctgtccggggggcagaagcagaggatagccattgcccgcgctcttatacgccagcctcaaatcctgctgctggatgaggccaccagtgctctggatactgaatccgaaaaggtggtgcaggaggcgctcgataaggctcgcgaagggagaacttgtatcgttatcgcccaccgactcagtaccattcagaacgccgatctgatcgtggtcttccagaatggccgagtgaaagagcacggcacccaccagcagctgctggcccaaaaagggatctacttttcaatggtgtcagttcaagctgggacccagaacttg

SEQ ID NO: 7600 - DNA, 3858 bp, Artificial Sequence
  Description of Artificial Sequence: Synthetic coding sequence
atggacctggaggcagctaagaacggcaccgcttggcggcctacctctgctgaaggagacttcgaactgggaatctcgtccaaacagaagcggaaaaagactaagactgtcaaaatgatcggtgtactgactctgttccgctacagcgattggcaagacaagctctttatgtcgctgggaaccattatggcaatcgcacacgggtcagggctgcccctcatgatgatcgtctttggagagatgactgataagttcgtggacactgcaggaaactttagcttccctgtcaacttcagcctttcattgctgaaccctggaaagatccttgaagaagaaatgacgcggtacgcctactactactctgggctcggggcaggcgtgcttgtggcggcgtacatccaggtgtccttctggactctggccgcgggcagacagatcaggaagattcggcagaaattctttcacgcgattctgcggcaggaaatcggatggtttgacatcaacgacaccaccgaattgaatacccgcctgactgacgacatctccaagatatcggaggggattggagacaaggtcgggatgttcttccaggcggtcgccaccttttttgccgggttcatcgtgggattcatccgcggctggaagctgactttggtcattatggctatctcgccgatcctgggtctgtccgccgccgtgtgggcaaagatcctcagcgcgttcagtgataaggagctggctgcctacgccaaagctggagccgtggccgaggaagcgctcggtgcgatcagaacggtgatcgctttcggagggcagaataaagaactggaacgataccaaaaacatttggaaaatgcaaaagagatcggaatcaaaaaagctatcagcgcgaacatttcgatgggaatcgccttcctcctgatctatgctagctatgccttggccttctggtacggatcaactctcgtgatctcaaaggagtacactatcggcaacgcaatgaccgtctttttcagcattctcatcggagccttctccgtcggccaggccgcaccgtgtatcgacgcgtttgcgaacgcccggggcgcggcatacgtgatcttcgacatcattgacaacaaccccaaaattgattccttcagtgagcgcggacacaagccagattctatcaaaggcaatctggagtttaatgacgtgcacttctcctacccttctcgggccaacgtgaaaatcctcaagggcctcaacctgaaggtgcaatctggacaaactgtcgcgctcgtgggttcgtccggatgtggaaaatcgaccaccgttcagctcatacagcggctgtacgacccagatgaaggaaccatcaacatcgatggtcaggatatccggaatttcaacgtcaattaccttagagaaatcatcggagtcgtgtcgcaagaacccgtgctcttctctacgaccatagcggaaaacatttgctacggacgcggaaacgtgaccatggacgaaatcaagaaggctgttaaggaggccaacgcctacgaattcatcatgaaactcccacagaagtttgacactctggtgggagaaagaggagctcaactgtcaggcggccaaaagcagcggatcgccatcgcacgggctctcgtccgcaatccgaaaatcctgcttcttgatgaagcgacgagtgctctggacactgagtccgaagccgaagtgcaggccgctttggataaagcaagagagggccgaaccacgatcgtcatcgcacatagactctctactgtgcgaaatgccgatgtcatagcaggattcgaggacggcgtcatcgtggaacaaggctcgcacagtgagctcatgaagaaggagggagtgtacttcaagctggtgaatatgcagaccagcggcagccagatccagtccgaggagtttgaacttaacgacgaaaaggccgctacccgcatggcgccaaacggctggaaaagccggttgttcagacactccacccagaagaacctgaagaacagccagatgtgccagaagagcctggatgtggagactgatggactggaggccaacgtcccgccggtgtcctttctgaaagtgctgaagctgaacaagacggaatggccgtactttgtggtgggaaccgtttgcgctattgctaacggaggtctgcaaccggccttctcagtgatcttttcggaaatcatcgcgattttcggaccaggtgatgacgcggtcaaacagcagaaatgtaatatcttctccttgatcttcctttttcttggcattatctcgttcttcaccttctttctccagggattcaccttcgggaaggctggagagatcctcactaggcggctcagatccatggcattcaaggctatgctgcgccaggacatgagctggttcgacgaccataagaattcaactggggcgctcagcactcgcctggcaaccgacgcagcccaggtgcagggggcgactggaacccgtctggccctgatcgcgcaaaacatcgccaatctcggcacggggatcatcatttcgttcatttacgggtggcaacttacccttcttcttctcgccgtggtgccgatcatcgctgtctccggaatcgtcgaaatgaaattgctggcaggtaacgccaagcgcgataagaaagagttggaggcggccggaaagatcgctactgaggcgattgagaacatacgcaccgttgtgtccctgacgcaagagaggaagttcgaatccatgtacgtggaaaagttgtacggcccgtaccgcaacagcgtccaaaaggcccacatttacggtattaccttctccatcagccaagcattcatgtacttctcatacgcaggatgctttcgcttcggcgcgtaccttatcgtgaacggccacatgaggttccgcgacgtgatcctcgtgttcagcgcaatcgtgttcggagcggtggcactgggccatgcttcatcattcgccccggactacgcaaaggccaaactgtcggcagcacaccttttcatgctcttcgagagacagccattgatcgattcatattcggaggagggactgaagccggacaagttcgaagggaacattactttcaacgaagtggtgttcaattatccgaccagagcaaatgtgcccgtgctccagggcttgtccctggaagtgaagaagggacaaacccttgccctcgtcggtagctcgggatgcggaaaatcaacggtcgtgcaactgctggaacgcttttacgatccgctcgcgggcactgtgtttgtggacttcgggtttcaactcctggacggtcaggaagccaagaagctcaatgtccaatggctgcgcgcccaactcggtatcgtgagtcaggaaccaatcctctttgattgctcgatcgccgagaatatcgcgtacggtgacaattcgagggtggtatctcaagacgagattgtttctgccgcaaaagcggcgaacatccatcccttcatcgaaaccctcccacacaagtacgagacgagagtcggagataaaggtactcaactgtcgggcgggcagaagcagcgcattgcgatcgcccgcgccctgatccgccagcctcaaatcttgctcctcgacgaggcaacctccgcccttgatactgaatcagagaaggtggtgcaggaagctctggataaggcacgcgaaggaaggacttgcatcgttatcgcccataggctctcgaccattcagaatgcagatctgatcgtggtgtttcagaatggccgggttaaggaacacggcacccatcagcagctgttggcccaaaagggaatatacttctcaatggtttccgtgcaagccggaacccagaacctg

SEQ ID NO: 7601 - DNA, 3858 bp, Artificial Sequence
  Description of Artificial Sequence: Synthetic coding sequence
atggacctggaggctgcgaaaaacggcaccgcttggcggcccacttcagccgaaggagatttcgaactcggtatcagctccaaacagaagcgaaaaaagacaaaaaccgtgaaaatgatcggcgtcttgaccctgttccgctattcagattggcaggataaactttttatgagccttggcactatcatggccatcgcccatggcagcggtctgccactgatgatgattgtcttcggtgaaatgactgataagtttgtggacactgctggaaacttttcttttccggttaatttctccctgtcgctacttaatccaggcaagatactcgaagaggaaatgaccaggtatgcatattattactctgggttgggggcaggcgttttagttgccgcatacatccaagtgtccttctggacgctagcggccgggaggcagattcgcaaaattcgacagaagtttttccacgcaatcctgcgacaagaaatcggttggttcgatataaatgacacgaccgagcttaacaccaggcttaccgacgacatctctaaaatttctgagggtattggggataaagtcgggatgttctttcaggctgttgccacttttttcgcgggatttatcgtaggattcatcagggggtggaaactcaccctagtcattatggccatctctccgattctgggtttgtctgctgcagtctgggctaagatcctgtctgccttttccgataaagagctggccgcctacgccaaggctggcgctgttgccgaagaggctctaggcgcaattcgcacagttatcgccttcggaggacagaacaaggagctggagcgctaccagaaacatctggagaatgcaaaggagatcggaattaagaaggcgatatccgctaatataagcatgggcattgcattcctgctgatctacgcttcttacgccctcgcgttctggtatgggagcacacttgtgattagcaaagaatacacaattggcaacgccatgactgtgttctttagcatcctgattggtgcattcagtgtaggccaagctgccccttgcattgatgccttcgccaacgcccggggggccgcatatgttatcttcgacattatagacaacaaccccaagatagatagctttagtgagagggggcacaagcccgactctataaagggtaatctggagtttaacgacgtgcatttttcttatccttccagagccaatgtgaagatcctcaagggactgaatctcaaagtgcagtctggacagacagtggctcttgtgggtagctcaggctgcggtaagtcaactaccgtgcaactgatccagcgtctgtacgaccctgatgagggcaccatcaacattgatggccaagacattcggaacttcaatgtcaactacttacgcgaaatcatcggggttgttagccaggaacccgtcctctttagtaccaccatagcagaaaacatctgttacggtcgggggaatgtcacaatggatgaaattaagaaggctgtaaaagaggcgaacgcgtacgagtttataatgaaactgccccagaaattcgataccttagtgggcgagagaggggcccagctctcaggggggcagaagcaacggatagccattgctagggcactggtccggaacccaaaaatattgctgcttgacgaagcgaccagtgctctcgacacggagagtgaggctgaagttcaggccgctctggacaaggctcgcgagggccgaactaccatcgtaatcgcacaccgcctttccacggtgagaaacgccgatgtgatcgctggttttgaagacggggttatcgtcgagcaaggcagccactctgagctgatgaagaaggaaggtgtctacttcaagttagtgaacatgcagacttctggatcacagattcaaagtgaagagtttgagctcaacgatgaaaaagccgccacacggatggctcccaatgggtggaaaagtcgactttttagacatagcacacagaagaacctaaaaaacagccagatgtgtcagaaatctctggatgtggagactgatggacttgaggcaaatgtgcctcctgtcagttttttgaaggtcctcaaactgaacaagaccgaatggccatatttcgtcgtgggcacagtatgcgccattgccaacggagggctccagcctgcgttttctgtcatattctctgagatcatcgctattttcgggcccggcgacgatgccgttaagcagcagaaatgcaatatcttctcccttatttttttatttctggggatcattagcttcttcaccttctttctgcagggcttcacattcggtaaggctggggagattctgactaggaggcttcgctccatggccttcaaggcaatgctgcggcaagacatgagttggtttgatgatcacaagaattccaccggcgctctaagtaccagactggctactgacgcagcacaagtgcaaggggctaccggcacccggttggccttgattgcgcagaacattgctaatcttggaaccgggatcattatcagcttcatctatggctggcagttgacactgctgctgcttgctgtcgtccctattattgcagtctcggggatcgtggagatgaagctgcttgccggcaacgcaaagcgggacaagaaagagttggaagctgccgggaagatcgccaccgaagcaatagaaaatattcggactgtggtgagcctcacccaggaaagaaaattcgagtccatgtatgtagaaaagctctatggaccgtaccgcaactcggtgcagaaagctcacatttatggcattaccttttccatttctcaggcatttatgtacttttcatatgcaggctgctttcgatttggcgcctatctgatagtcaatgggcatatgcgtttcagggatgtgattttagtcttctcagccatagtcttcggggccgtagcccttggccatgcctccagttttgcccctgactacgccaaggcaaaactaagcgcagcgcacctatttatgctctttgagaggcagccactcatcgattcatattcagaggaaggcttgaagcccgataagtttgaaggaaatataacctttaatgaagtggtgttcaattatcccacacgagctaatgttccggtgctgcagggtctgtccctggaggttaagaagggccaaactttggccctcgttggatcatctggctgcggaaaatctaccgtcgttcaactccttgagagattctacgacccacttgcgggcaccgtatttgtggatttcggttttcagttgcttgatggccaagaagctaaaaagttgaatgttcagtggcttcgggcacagctcggtatcgtctcgcaggagcccattctgttcgactgttcaatcgcggaaaacattgcctatggcgataacagccgcgtggtcagtcaggatgagatcgtctccgcagccaaagccgcaaacatccacccctttatagaaacgttgcctcacaagtacgaaacaagagtgggtgataaggggacccagctgagtggcggccagaaacaaaggattgccatcgctagagcgttaatacgccagccccagattctattgttggatgaagctacctccgccctagacacagaatctgagaaggtcgtccaggaagcactggataaggccagggagggccggacttgcattgtgattgcccacagattatcaacaattcagaatgctgatctcatcgtggtcttccagaacggaagagtaaaggaacacgggacacatcagcagcttctggctcagaagggcatctatttctcaatggttagtgtgcaggctggaacacagaatctc

SEQ ID NO: 7602 - DNA, 3858 bp, Artificial Sequence
  Description of Artificial Sequence: Synthetic coding sequence
atggatctcgaggccgcaaaaaacgggactgcctggaggccgacttcagcagagggagattttgaactcggcatcagcagcaagcagaaacgcaaaaagactaaaaccgtcaagatgattggagtcctgactctgttccgatacagcgattggcaagacaagctcttcatgtcactgggaactatcatggccattgcccacggatcaggactgccactgatgatgattgtgttcggagagatgactgacaagttcgtggacaccgcggggaacttctcattcccggtgaacttttcgctgtccctgctgaatcctggaaagatcctggaggaggagatgactaggtacgcctactactactcgggactgggcgcgggggtgctggtggcggcgtacattcaagtttccttctggaccctggcagctggacgtcagatcaggaagatcagacagaagttctttcacgcaattctgcgccaggaaatcggctggttcgacatcaacgatactactgagcttaacacgagactgactgacgacatttcgaagatcagcgaaggaatcggagacaaagtggggatgtttttccaagcagtggcaactttcttcgcagggttcattgtgggctttatccgaggatggaagctgactctggtcatcatggccatcagccctatcctcgggctgtcggccgccgtgtgggcgaaaatcctgtcagccttctccgataaagagctggccgcgtacgccaaggctggcgctgtggccgaagaagccctcggtgcgatcagaaccgtgatcgccttcggcggccagaacaaggagctcgagcggtaccaaaagcacctggagaatgcgaaggagatcggtatcaaaaaggcgatctccgcaaatatctcgatgggtatcgcgttcctcctgatatacgcttcatacgctctggcgttctggtacgggtcgaccttggtgatatccaaggaatataccatcggaaatgccatgaccgtgttcttcagcatccttattggagcattctcggtcggccaagcggccccttgcatcgatgccttcgcgaacgctagaggagctgcctacgtgatctttgatatcatcgacaataacccaaagattgactcattctctgaacgcgggcataagcctgactctatcaagggaaacctggagttcaatgacgtgcatttctcgtacccgtcaagagctaacgtcaagatccttaaaggcttgaatctgaaagtccaatctggccaaactgtggccctcgtgggttcgtcaggatgcggaaagtcgaccaccgtgcagctcatccaacgcctgtacgatcccgatgagggaaccatcaacatcgatggacaggacatccggaacttcaacgtgaactacctgcgggaaatcattggtgtcgtgtcacaagaaccggtgctcttctcgacgaccatcgctgaaaacatctgctacggacgcggcaacgtcaccatggacgagatcaagaaagctgtgaaggaagcaaatgcctacgaattcatcatgaagctgccgcagaaatttgacacgctggtgggggaacgaggcgcccagctgtcaggcggacaaaagcagcgcatcgccatcgcccgggccctggtacggaatccaaaaatcttgctgttggacgaagccacttcagctctcgacaccgagtcagaagctgaggtgcaggccgctctcgacaaggcccgggaagggaggaccacgattgtcatcgcccatcggctgtcgactgtccggaacgctgacgtgatcgccggatttgaggacggagtgatcgtggaacaaggatctcactcggagctgatgaaaaaagagggggtgtacttcaaacttgtgaatatgcagacttccggatcgcagatccagtccgaggagttcgaacttaacgacgagaaggcggcgacccgcatggctccgaacggctggaaatcgaggctgttccggcattcaactcagaagaacctgaagaattcccagatgtgtcagaaaagcctggacgtcgaaaccgacggattggaggccaacgtcccgcctgtgagctttctcaaggtcctgaagctgaacaaaactgagtggccatactttgtggtgggaacggtgtgtgccattgccaatggcggactgcaaccagccttttccgtgatcttctccgaaatcatcgctatctttggacccggagacgacgccgtgaagcagcaaaagtgtaacatcttcagcctcatctttctgttcctgggtatcatctcattcttcactttcttcctgcagggcttcaccttcggaaaagctggagaaatcctgactcgccgcttgagatccatggccttcaaagcgatgttgcggcaagacatgtcgtggtttgacgatcacaagaactcgaccggagccctgtccacccgcctggccaccgacgccgcccaagtgcagggtgccaccggaactagactggcgctgattgcccagaacattgcgaacctcggaactggcatcatcatctccttcatatacggatggcagctgactctgctgctgctggctgtggtgcccattattgccgtgagcggaatcgtggaaatgaagctcctggccggcaatgcgaagcgggataagaaagagctggaggcagcgggtaagatcgcgactgaggccatcgagaacatccgcactgtggtgagcctgactcaggaacggaagtttgaatcaatgtacgtggagaagctctatggtccataccggaactcagtccagaaggcacatatctacggcattactttttcaatttcgcaagcgttcatgtacttctcatacgccggatgctttcgcttcggagcatacctgatcgtcaacgggcacatgcggtttcgggatgtgatcttggtgttttctgctatcgtctttggagcggtggcattgggacacgcgagtagcttcgcacctgactacgcaaaagcaaagctcagcgcggcccacctgttcatgctgttcgaacgccagccgcttatcgatagctattcggaagagggcctgaagccggacaaattcgagggcaatatcactttcaacgaagtggtgttcaactacccgacccgcgccaatgtgccagtgctgcaaggtctttcactggaggtgaagaagggacagaccttggcactggtgggatcctcaggatgcggcaagtctaccgtggtgcagctcctggaaaggttctacgatcctcttgcgggcaccgtgttcgtcgactttggcttccagctgcttgacggacaagaagccaagaagttgaacgtgcagtggctgagagcgcaactcggaatcgtgtcacaggagcctatcctgtttgactgctcaatcgcagaaaacatcgcgtacggagacaattcccgcgtcgtctcacaggacgagatcgtgtcagcagccaaggccgccaatatccatcccttcattgaaactttgccacataagtacgagactagagtgggtgacaagggtactcagctgtccggaggacagaagcagcggatcgcaatcgcgcgcgccctcatccgccagccacagattctcctcttggacgaagcaaccagcgccctggacactgaatcggagaaagtcgtccaggaagccctcgataaggccagagagggacgcacgtgcatcgtcatcgcacacaggctcagcactattcaaaacgcagatctgatcgtggtgtttcaaaacggccgggtgaaggaacacggaacccaccagcagctgctcgcgcagaagggtatctacttttcaatggtgtcagtgcaggcaggcacccagaacttg

SEQ ID NO: 7603 - DNA, 3858 bp, Artificial Sequence
  Description of Artificial Sequence: Synthetic coding sequence
atggacctggaagcagcaaagaatggaaccgcgtggcggccgacaagcgcggaaggtgacttcgaactgggaatctcctctaagcagaagcggaaaaagacaaagaccgtgaagatgattggagttctcaccctgttccggtactcggattggcaggataagctgtttatgtcgcttggcaccataatggccattgcccatggctccggcctgccactgatgatgatcgtgtttggtgagatgacggataagttcgtcgacaccgcgggtaacttctcgtttccagtgaacttttcattgtctctgctcaatcccgggaagatcttagaggaagagatgacccggtatgcctattactacagcggtctaggtgcaggggtcctggtggctgcctatatccaggtgtccttctggaccctggctgctgggagacaaatacggaaaataaggcagaagtttttccacgccatactccgtcaggaaatcgggtggtttgacattaacgataccactgaactgaatactcgcttgacagatgacatctcgaaaatcagcgaaggcataggggacaaggtgggaatgttctttcaggccgttgctacattctttgccggcttcattgtcggattcattcggggatggaagctgacacttgtaatcatggccatcagccctattctagggttgtcagcagccgtctgggccaagatcctgtccgcgttcagcgataaggagttggccgcatatgccaaggcaggagccgtggccgaggaggcactgggagctatccgaacggtgatcgcgttcggtggccagaataaagagttagaaagataccagaagcacttggaaaatgccaaggaaattggcataaagaaggccatctctgcgaatatcagcatgggaattgcgttcctgctgatctacgcctcttacgcccttgctttctggtatggcagtacacttgtgatctccaaggaatacacaatcggaaacgcaatgaccgtgtttttctccatccttatcggagccttctccgtgggacaggccgctccgtgcattgacgcttttgcgaatgcaaggggagctgcctacgtcatctttgatattatagataataatccaaagatcgattcatttagtgagcggggccataagcctgatagcatcaagggtaacctggaatttaacgacgtccacttttcatatccatccagggcaaatgtgaagatactcaaggggttaaacctgaaagtacagtcgggacagacagtcgctcttgtaggcagctccgggtgtgggaagtccacaacagtgcagctgatccaacggctctatgacccagatgagggcacgatcaatatagacgggcaggatatccggaatttcaatgtgaattatctcagagagatcatcggcgtcgtcagccaggaaccagtacttttctcaactacaatagccgagaatatttgctacggccgggggaacgtgaccatggacgagatcaagaaggcagtaaaggaggccaacgcttatgaattcatcatgaaactccctcagaagtttgatacactcgttggggagcgaggtgcacaactgtccggaggccagaaacaacgaattgctatcgccagagcccttgtccgcaatccaaagatccttttactcgatgaggcaacgtctgctctcgataccgaatcagaagcagaagtgcaggcagccctagataaagctcgcgagggtcgcacgactatcgtgatcgcacataggttatctacagtaagaaacgcagatgtgattgccggcttcgaagacggtgtgatcgtggagcaggggagtcattcagagctcatgaaaaaggagggtgtgtactttaagctggtaaatatgcagacttctgggtcgcagatacaatccgaggagttcgagctgaacgacgagaaagccgccacgcggatggctcccaacggatggaagtctcgcctttttcgtcattccacgcagaaaaatctgaagaattcccagatgtgtcagaaatctcttgacgttgagacagacggtctcgaggctaacgtacctccggtgagctttcttaaggttctgaagctcaacaagaccgaatggccatatttcgtcgtcggcaccgtctgtgcaatcgcgaacggcgggctgcagcccgcgttcagcgtaatcttttctgaaatcattgccatctttggtcctggcgacgatgccgttaaacagcagaagtgcaacattttcagtctgatattcctgttcctcggaattatctcatttttcacgtttttccttcagggattcactttcgggaaggcgggcgaaatactgacccggaggttaaggagcatggctttcaaggccatgctgcgccaggatatgtcatggttcgacgaccataagaatagcactggcgccctgagcaccaggctggccaccgacgcggcccaggtccagggggccacgggaacacggctggcgcttatagcccagaatatcgccaacctgggaaccggtatcataatttcttttatctatggctggcagctcacactgctactcctggccgtggttccaataatcgccgtctcgggcatcgtggaaatgaagttgttagcgggcaacgccaagcgagacaagaaagagttagaggccgctggcaagattgccactgaagctatcgaaaacatccggaccgtcgtatccctcacacaggaacgtaaatttgaaagcatgtatgtcgagaagctttatggaccctaccgcaattcggtgcagaaggcccacatttacggtatcactttttcaatctctcaggcctttatgtatttttcttatgctgggtgcttcagattcggagcatatttgatcgttaacggtcacatgaggtttcgggatgtgattttagtgttctctgccatagttttcggtgccgtcgctctcggtcacgcgagcagcttcgcacctgattacgccaaggccaaactctcagccgcccacttattcatgctgtttgagcgacagcccctgattgatagctattccgaggaggggttaaagcccgataaattcgaaggcaacataacctttaacgaagtcgtgttcaattatcctacacgcgccaatgtgcctgtcctgcagggtctgtcactagaggttaagaagggacagacccttgctttggttggatcatccgggtgcggaaagtccaccgtggtccaactgttggagaggttctacgatcctttggccggcacagtgtttgttgattttggattccagttactggatggacaagaagctaaaaagctcaatgtgcagtggctgcgcgcacagctgggcatcgtctcccaggagcctatactgtttgactgctcaatcgctgagaatatcgcgtatggcgataactccagggtcgtgagccaggatgagatagtgtcggctgcaaaggcggccaacattcatcctttcatagagaccctgccccacaagtacgagactagagtgggtgacaaagggactcaactgagcgggggacagaaacagaggatcgcaatcgcgagggccctcatcaggcagcctcagatccttttgttggacgaggccacctccgccttggataccgagtctgaaaaagtagtgcaggaggcactggataaggctcgggaggggcgcacatgcatcgtcatcgcccatcggctcagtacgatccaaaatgccgacctgattgtggtctttcagaatgggagggtgaaggagcacggcactcatcagcagctgcttgctcaaaaggggatttatttttcaatggtgtctgtccaggccggcacccagaacctg

SEQ ID NO: 7604 - DNA, 3858 bp, Artificial Sequence
  Description of Artificial Sequence: Synthetic coding sequence
atggatcttgaagcggcgaagaatggcaccgcgtggaggccgacctcggctgaaggcgacttcgaactgggaatctcgtccaagcaaaaacggaagaaaactaagacggtcaaaatgatcggagtgctcactttgtttaggtactccgattggcaagacaagctcttcatgtccctgggaactatcatggccattgctcacgggtccggcctgccactgatgatgatcgttttcggagagatgactgataagttcgtggataccgcgggcaatttctctttcccggtgaatttctccttgtcgcttctcaacccaggaaaaatcctcgaggaggagatgacgagatacgcctactactactcgggactgggagccggcgtgctcgtcgcggcgtacattcaggtgtccttttggactctggcagctggacggcaaatccggaagatccgccagaagtttttccatgctatcctccgacaagaaatcggttggttcgacataaacgataccacggagctgaacacgcgactgaccgatgacatctcgaagatctcggagggtatcggagataaggtcggaatgtttttccaggcggtggcgactttcttcgcaggcttcatcgtgggattcatccgaggctggaagttgacgctggtgatcatggcgatctcaccgatcttgggactctccgccgcggtgtgggccaagatcctgtcggccttttcggacaaggaacttgccgcctacgccaaggccggagcagtggctgaggaagccctgggggcgatccgcaccgtcattgcgttcggcggacagaacaaagaacttgagagataccagaagcacctggaaaacgcgaaggaaatcgggatcaagaaagctataagcgctaatatctcgatgggcatcgctttcctgctgatctacgcatcgtacgccctcgcattctggtacggatcgactcttgtgatcagcaaggagtacactatcggaaatgctatgaccgtctttttctccatcctcatcggagcgttctccgtgggccaggcagcgccgtgcattgacgccttcgcaaacgcgcggggcgccgcctatgttatcttcgacatcattgacaacaatcccaagattgattctttctcggaacgcggccacaaaccggacagcatcaaggggaatctggagtttaacgacgtgcatttctcatacccgtcgcgcgcaaacgtgaagatactcaaaggtctgaatctgaaggtgcagagcggccaaaccgtggctctggttggatccagcggctgcggaaagagcaccaccgtccagctcatccagaggctttacgacccggatgagggaactatcaatatcgatggacaagatatccgcaacttcaatgtgaactacctgcgcgaaatcatcggcgtggtgagccaggagccagtcctcttttcaactactattgccgagaacatttgctacggacgcggcaatgtcacgatggatgaaatcaagaaggcggttaaagaagcgaacgcgtacgagtttatcatgaagctgcctcaaaagtttgatactctggtcggagaacggggagcccagctctccggcgggcagaagcaacggatcgccattgcccgagccctcgtgcgcaaccccaaaatcctcctcctcgatgaggcaacgtcggctctggacaccgaatccgaagccgaagtccaagcggccctcgacaaggctagagagggcaggaccaccatcgtgatcgctcaccggctttccactgtgcgcaatgccgatgtgattgccggattcgaagatggcgtgatcgtggaacagggatcacactcagagttgatgaaaaaggagggtgtgtactttaaactcgtcaatatgcaaacttccggatcgcaaatccagtccgaagaattcgaactgaacgatgagaaggccgccacccggatggcacccaatggatggaaaagccggttgttccgccatagcactcaaaagaatctgaagaacagtcagatgtgtcaaaagagcctggatgtggagacggatgggctggaggcaaatgtgccgccggtgtccttcctcaaagtgctgaagctcaataagacggaatggccctacttcgtcgtgggtactgtgtgtgcaatcgcgaatggaggtttgcagccggcattcagcgtgatcttttcagaaatcatcgctatctttggaccgggcgatgacgcggtcaagcagcaaaagtgcaatatcttctccctgatcttccttttcctgggcatcatctccttctttacctttttcctgcagggattcaccttcggcaaggcgggagagattttgacccggagattgcggtcgatggccttcaaggcgatgcttcgccaggatatgtcctggttcgatgatcacaagaattccactggggcactgagcacccgcctcgcgaccgacgcggcgcaagtgcagggggccactggtacgcgcctggcattgatcgctcagaacattgcaaacctgggaactggaatcatcatctcgttcatctacggctggcagctcactctgctcctgctggccgtggtgccgattatcgcggtgtcgggaatcgtggaaatgaagctcctcgccggaaatgccaagcgggacaagaaggaactcgaggctgccgggaagattgccacggaggctatcgaaaacatccggaccgtcgtctccctgacccaggaacggaagttcgaatctatgtacgtggaaaaactttacggaccgtaccggaactcagtgcaaaaggcgcatatctatggcatcacgttctcaatctcccaggcattcatgtatttctcgtacgccggatgtttccggttcggggcctaccttatcgtgaacggacatatgcggttccgcgatgtgatcctcgtgttttcggctatcgtgttcggcgccgtcgccctgggacatgcctctagcttcgcacctgattacgcgaaggccaagctgtcagcggcccatctcttcatgctcttcgaacgccagcccttgatcgattcgtattcagaggagggactcaagcccgacaagtttgagggaaacatcaccttcaatgaagtcgtgttcaattacccgactcgcgcgaacgttccagtgctccagggccttagcttggaggtgaagaaaggacagaccctcgcattggtcggctcgtcgggatgcggaaagtcgaccgtggtgcagctgcttgagcgcttctacgaccccctggctggaaccgttttcgttgattttggattccagctcctggatggacaggaagcgaagaaactgaacgtgcaatggctgcgcgctcagctgggaatcgtgtcccaggaacctatcctgttcgactgctcgatcgctgaaaacatcgcatacggcgacaatagccgcgtcgtgagccaggatgagatcgtgtcagccgccaaagccgcgaatatccacccattcatcgaaactctcccacataagtacgagactcgggtgggtgacaaggggacccagctgtcaggaggacaaaaacaacggattgccatcgcccgggctctgatccggcagccgcagatcctgctcctggacgaagcaacctcggcactggacactgaaagcgaaaaggtcgtccaagaagccctggataaagctcgagaaggtcggacctgcattgtcatcgcacatagactgtcgaccatccagaacgcggacctgatcgtcgtattccagaacgggcgcgtcaaagaacacgggactcatcaacaacttttggcacaaaaaggaatttacttctcaatggtgtcagtgcaggctggtactcaaaacctg

SEQ ID NO: 7605 - DNA, 3858 bp, Artificial Sequence
  Description of Artificial Sequence: Synthetic coding sequence
atggatcttgaagcagccaaaaatgggactgcatggaggcctacctcagcggaaggagattttgagctcggaataagctcgaagcaaaagcgtaagaaaactaagaccgtgaagatgattggtgtactgaccttgttccggtacagcgattggcaggataagctgtttatgtcgcttggtactattatggctattgcacatggaagcggcctgcctttgatgatgatagtgtttggtgaaatgaccgacaagtttgtggatacggccggcaatttctcatttccagtcaacttttccctttcgttgctcaatccgggcaagattcttgaagaagaaatgaccagatacgcatattactatagcggtcttggtgccggtgtgttggtcgcagcctacatccaggtcagcttttggactctcgctgcgggtagacaaattagaaaaatcagacaaaagttttttcatgccattcttcggcaagagattggttggtttgacataaacgatactaccgaactgaacactcggctcactgacgatatctccaagatttcggaaggcatcggggataaagtgggaatgttctttcaagcagtggctaccttttttgccggatttatcgtcgggttcatccgcggttggaagctcaccttggtgatcatggcaataagccctatcctgggtctttccgcggcggtctgggcgaagattctgtcggctttctccgataaggagttggcggcatacgctaaagcaggagcggtggcagaggaggcactgggagcaatacggacggttattgccttcggaggccagaacaaagaactcgaacgataccagaaacacctcgaaaacgcaaaggagataggaataaagaaagcgatatccgcgaacatctccatggggatcgcttttctcttgatttacgcatcctacgcgctcgcattttggtacggatctactctcgtcatttcgaaggaatacactattgggaacgctatgactgtctttttctcaattctcattggtgcgttttcagtcgggcaagccgctccttgcattgatgcttttgcaaacgcaagaggcgcagcatacgtgatctttgacatcatcgataacaatccaaagatagactcgttttcggaacgaggacataaacctgactcgatcaaagggaacctggagtttaacgatgtgcatttttcgtacccatcgcgggcaaatgtcaagattctcaaaggcctgaacctgaaagtgcaaagcggtcaaaccgtcgcgctggtgggttcgtccggatgtgggaaatccaccactgtgcaactcattcagcggctgtacgatcctgatgagggaaccattaacatagacgggcaagatatccggaactttaacgtcaactaccttcgcgagatcatcggtgtcgtctcccaagagccggtgcttttttcaaccactattgcggaaaacatttgttatggacggggcaatgtgactatggacgaaatcaagaaagcggtcaaggaggcaaatgcgtacgagttcattatgaaacttcctcaaaagtttgataccttggtgggagagaggggagctcaactgtcgggtggacagaagcagagaattgcaatcgcccgcgccctggtcagaaatccgaagatccttctccttgatgaagccacttccgccctggatactgagtcggaggctgaagtccaagccgcactggacaaggcaagagagggtcggaccaccattgtgatagcacaccgcctctcaactgtgagaaatgctgatgtgattgcgggtttcgaagatggtgtgatagtggaacaaggatcccactcggagctgatgaagaaagaaggcgtttactttaagctggtgaatatgcaaacttcgggatcgcaaatccagtctgaagagttcgagctcaacgacgaaaaggcagctactcggatggcaccaaacggatggaaatctcgtctgttcagacatagcacgcaaaagaaccttaagaactcgcagatgtgtcagaagtcacttgacgtggaaaccgacggactcgaagcgaacgtgcctcccgtttcctttcttaaggtgctgaagctgaacaaaactgaatggccctactttgtggtgggaaccgtgtgcgcgatcgcaaacggtggacttcaacccgcatttagcgtaatcttctccgaaatcatcgcaattttcgggcctggggatgatgccgtgaagcagcaaaaatgtaatatctttagcctgatctttctctttctcggcatcatttcatttttcaccttttttctccagggttttacgttcggaaaagccggtgaaatccttacgcgacggctgcgaagtatggctttcaaggccatgctgcggcaggacatgtcatggtttgatgatcataagaactcgacgggcgcactgagcacccgacttgcgaccgatgcggcacaggtgcaaggtgcgaccggaacgcgtcttgcactgatagcgcagaacatagcgaatctgggaaccgggattatcatttcctttatctacggatggcaacttactcttttgcttcttgcggttgtgcccatcattgccgtgagcggtattgtcgaaatgaagctgctggcaggaaatgccaagagagacaagaaggagctggaagcggcaggtaaaatcgctactgaagccatcgaaaacatcaggactgtcgtgtcgcttacccaggaaaggaagtttgaaagcatgtacgttgagaagctgtacgggccataccgcaattcagtgcagaaagctcacatatatggaataactttttcaatttcgcaagcattcatgtacttctcgtacgccggatgctttaggttcggagcgtaccttattgtgaatggacatatgcggttcagggatgttatacttgtgttcagcgcaattgtgttcggtgcggtggcattgggacacgcctcttcgttcgcacctgattacgccaaagcgaaactgagcgccgcccaccttttcatgctttttgaacgccaaccacttatagattcttacagcgaggagggacttaagccagataagttcgaaggtaacatcacctttaacgaagttgtgttcaactaccctaccagagccaatgtccctgtgctccaaggactctccctcgaagtgaaaaagggacaaacgctggccctggtcggatctagcggctgcggaaaaagcacggtggtgcaacttctggagcgtttttacgatccacttgccggtaccgtctttgtggacttcgggttccaacttctcgacggtcaggaagcaaagaaactgaacgtccagtggctgagggcgcaattgggaattgtgtcccaggaaccaatacttttcgactgttcgattgcagagaatatcgcatatggtgacaattcccgcgtggtgtcccaggatgagattgtgtctgccgcaaaggctgccaatattcatccgtttatagaaactcttcctcataagtacgaaactcgcgtcggagataagggaactcagctttctggaggccaaaagcaaagaatcgcaattgcgcgcgccctcatacgccagccacagattctgctgctggacgaagcaacgtctgcactcgataccgaatcggagaaggtggtccaggaagcactcgacaaggcacgagaaggtcgcacctgtattgtgattgcacacagactgagcaccattcaaaacgcagacctgattgttgtttttcaaaatggcagagtgaaggaacatggcacccatcagcagctgctcgcacaaaagggcatttacttttcgatggtttccgtacaggccggcactcagaacctc

SEQ ID NO: 7606 - DNA, 3858 bp, Artificial Sequence
  Description of Artificial Sequence: Synthetic coding sequence
atggacctcgaggccgctaagaacggcaccgcctggcgaccaactagtgccgagggcgacttcgaattaggcatttcgtcaaaacagaagcggaagaaaacaaagactgttaagatgatcggggtgttgacccttttcaggtactctgactggcaggacaagctgttcatgagcctcggcacaatcatggccattgcgcacgggtcaggcctaccgttaatgatgatagtattcggtgaaatgactgataaatttgtggacacggccgggaacttctccttcccagtgaacttctccctatctctcctcaatcccggtaagatcctggaggaagaaatgacccgatatgcgtactattacagcggcctgggagccggagtgctggtggccgcgtacatccaggtctccttctggactctggctgctggccgacagattcgaaagatcaggcagaaattcttccacgccatcctgcgacaggagatcgggtggtttgatattaacgatactaccgagctcaacaccagactaaccgacgacatttctaagatcagcgaaggaatcggggacaaagtgggtatgttttttcaggcggttgctactttcttcgctgggtttatcgtcggctttatcaggggatggaaactgacacttgtgatcatggctatttcaccgatacttgggctaagcgccgctgtttgggccaaaatcctcagtgcattttccgacaaagaattggcggcctacgctaaggcaggcgcagtcgccgaggaagcactcggcgccattaggactgtgatcgcatttggaggacagaataaggagctggaacgctaccagaagcacctggaaaatgccaaagaaatcggcatcaaaaaagctattagcgcaaacattagcatgggcatcgccttcctgcttatctacgctagctatgctttagctttctggtacggctcaactctggttatcagcaaggagtacactattggaaatgccatgacggtgttcttctcaatcctgatcggggccttctccgttggccaagcagcaccatgcatcgatgcgttcgccaacgcaaggggcgcagcttacgttatcttcgacatcatcgacaataaccccaagatcgattccttctctgaaagagggcataaacccgacagcatcaaggggaaccttgagttcaacgatgtacatttctcttatcccagccgcgctaatgtaaagatactaaaaggcttaaatctgaaagttcagtcaggccagaccgttgcgctcgtaggttcttcgggttgcggtaaaagtaccacggtccaacttatccagagactctatgatccagacgaaggcacaataaatattgacggccaagatattagaaactttaatgtcaattacttaagggagattatcggagtggtctcacaggagccggtgctattctccactacaatcgcagagaacatctgctacggacgaggcaacgtcactatggatgaaattaagaaagccgtgaaggaagccaacgcatatgagttcatcatgaaattaccccaaaaattcgataccttagtcggcgagaggggcgctcaactttccggtggccaaaagcaaagaattgccatcgcaagagcactcgtccggaacccgaaaatccttctgctggatgaagccacgagcgccctggacaccgaaagcgaggcagaggttcaagcggcactcgataaagctcgagagggtaggactactatcgtcattgctcacaggctcagcacagttcgaaacgctgatgtcatcgctggcttcgaagacggcgttatcgtggaacagggcagccactcagagctcatgaagaaagaaggcgtttactttaaactggtgaacatgcagacttctggctcccaaattcagtccgaagagttcgagctgaatgatgagaaagctgcgaccaggatggcacccaatgggtggaagagcaggctttttcgccactctactcagaagaacctaaagaactcgcagatgtgtcagaaaagtctggatgtggaaactgacggcctagaagccaatgttcccccagtgagttttttgaaagtgctgaagctgaataagactgagtggccatacttcgtggtgggaaccgtctgcgctatagctaatggcgggctccagcccgcctttagcgtgatcttttccgaaattatcgccatcttcggacccggagatgatgcagtgaagcagcagaaatgtaacatcttctccttgatcttcttattccttggaatcatcagttttttcaccttcttcctacaggggttcacatttggcaaagcaggggaaatcctgaccaggaggctcaggtcgatggccttcaaagctatgctgaggcaggatatgtcatggtttgatgatcacaagaactcgaccggcgcactgtccaccaggttggcaacagatgctgcacaggtgcagggcgccactggtacgcgactcgcactcattgcccagaacatcgctaatctggggactggtatcataattagctttatctatgggtggcagctgacactgctgctactagccgtggtgcctattattgctgtctctgggatcgtggaaatgaagctattagccggcaatgccaagagggacaaaaaggagcttgaagcggccggtaagatcgcgactgaagccattgaaaatatcaggactgtggtgagcctgacccaggagagaaaattcgaaagtatgtacgtagagaagctctacgggccttatagaaactccgtgcagaaggcacatatctacggaattacattctcaattagccaggcttttatgtatttcagctacgcaggttgcttcagattcggcgcttacctgatcgtgaatggccatatgagattcagagatgtgatcctggtgttttcggctatcgtgtttggtgcggtggccctgggccacgcatcaagtttcgctccagactacgcgaaagctaaactctctgcagcccatctgtttatgttgtttgaaaggcaacctctgatagatagctacagcgaggaaggtctcaaacccgacaagtttgagggaaacatcaccttcaacgaggttgtctttaactacccaaccagagcaaacgtgcccgtgctgcagggcctgagcttggaggtgaagaagggacaaaccctggcactcgtcggctcctccggatgcgggaagtcaaccgtcgttcagctgttggagcgcttctacgacccgctggccggcactgtctttgtggacttcggcttccagctactcgatggccaggaggctaaaaaactgaacgtgcagtggcttcgagcgcagctcggcattgtgagtcaggagcccattttattcgactgttctatcgcagagaatatagcctacggagacaattcgagggtggtgagtcaggacgaaatcgtttcagccgcaaaagccgccaatattcacccattcattgaaacattgccccataagtacgaaactcgagtaggtgacaaggggactcagctgtccggaggacagaagcaacgaattgctatagcaagagctctgattcgccagccgcagatcctgctgctcgatgaggcaacaagcgcgctggatacagagtccgaaaaagttgtgcaagaagctttagacaaggccagggaagggcgaacatgcatagtaattgcacacaggctgtcaacaatccagaatgctgatctgatcgtggtgtttcagaacgggcgtgtcaaagagcacgggacacaccagcagctcctcgcccagaaaggcatctacttctcgatggtatcagtccaggcaggaacgcaaaacctg

SEQ ID NO: 7607 - DNA, 3858 bp, Artificial Sequence
  Description of Artificial Sequence: Synthetic coding sequence
atggacttggaagcggctaaaaatggaactgcatggaggcctacatcagccgaaggagacttcgagctcggaatttcctccaagcagaaacgcaagaagactaagacggtgaagatgattggagttttgactctgtttaggtactctgattggcaggacaaacttttcatgtccttgggcacgatcatggcaatcgcacatggttcaggcctgcctttgatgatgattgtgttcggtgagatgactgacaagtttgttgataccgctggtaactttagttttccagtcaattttagcctgtcccttctgaatcctggtaagatccttgaagaagaaatgacacgctacgcatattactattcaggtctcggcgctggagtcctcgtcgctgcttatatacaagtgtctttttggaccctggcagcaggcagacagattaggaaaattcgccagaaattcttccatgcaatcctcaggcaggagataggttggttcgacatcaacgacaccaccgaattgaataccaggctgacagacgacatctcaaagatctccgagggtattggagataaagtgggtatgtttttccaggctgtggctactttcttcgcgggttttattgtgggcttcatccgcggttggaagttgacactggtcattatggcaattagccccatcctgggcttgagtgctgctgtgtgggcaaagatactgagtgccttctccgacaaggaactcgctgcttacgccaaggcgggagccgtggcggaagaggcattgggtgccatcaggaccgtcatcgcttttggcggccagaataaagagctggaacgctaccagaaacatctggagaacgccaaggaaattggcattaaaaaagccattagcgcaaacatttctatgggtatcgcttttttgctcatctatgccagctacgctctggcattctggtacggtagcactttggtaatctccaaggaatacactataggaaatgctatgaccgtattcttttctattcttatcggcgctttttctgtgggccaagccgcgccgtgcattgacgcctttgccaatgcgcgcggcgcggcgtatgtgattttcgacataatcgataacaacccaaaaatcgacagcttcagcgaacgcggacataaacccgactcaatcaagggcaacctcgagttcaatgacgtgcacttctcttacccgagccgcgcgaatgtcaaaattctcaagggactgaatctcaaggtacagagcggtcaaactgttgccttggtgggcagctctggttgtggcaaatccacaaccgtgcagctcatccagagactgtatgatcccgacgagggaactattaatatcgacggacaggatattaggaacttcaacgtcaactacctgcgcgagattatcggtgtggtatctcaggaacccgtgctgttctccaccacaatagcagaaaatatatgttacggccgcggaaacgtgacaatggacgagattaagaaagccgtcaaggaagccaacgcatatgaattcatcatgaagcttccccagaaatttgacaccctcgtgggagaaagaggagcacaactgtctggaggtcagaagcaaagaattgcgattgcaagagctctcgtgcgcaacccgaagattctcttgctcgatgaagccacttctgccctggataccgaaagcgaggcggaagttcaggccgcactggataaggctcgcgagggacgcaccaccattgtcatagcccacaggctctccaccgtgaggaacgctgatgtgatcgctggattcgaggacggcgttatcgtcgagcagggctcacacagcgaactgatgaagaaagagggagtgtatttcaagttggtgaacatgcagacgtccggtagccagattcagagtgaagagtttgaattgaatgatgagaaggctgccactcgcatggctcctaacggctggaagtccaggcttttcagacactccacccaaaagaacctcaaaaacagccagatgtgccagaaatccctcgatgtcgaaactgacggtctggaggcgaacgtgccaccagtgagtttcctcaaggtgctcaaactcaacaagacagaatggccttatttcgttgttggaactgtctgtgctattgcgaatggtggcttgcaacccgcgttcagtgtaatcttcagcgagatcatagctatcttcggtccaggtgacgacgcagtaaaacagcaaaagtgtaacattttcagtctgattttcttgttcctgggcatcatcagcttcttcactttcttcctgcaaggtttcacattcggtaaggcaggtgagatattgaccagacgcctgcgcagtatggccttcaaagccatgctgcgccaggatatgagttggttcgacgaccataagaatagcactggagcgttgtccacgaggctcgctaccgacgcggctcaggtgcagggtgctactggaaccaggcttgctctcattgcccaaaacattgctaacctgggcactggcatcatcatctcctttatttacggttggcaactcacccttcttttgctcgctgtcgtccctatcatcgccgtgtccggaattgtcgaaatgaaattgctggcgggaaacgctaaaagggacaaaaaggaattggaagcagccggtaagattgcaaccgaagcaatcgaaaacattagaaccgtagtgtccctcacccaagaaaggaagtttgaatccatgtacgtggagaaattgtatggcccgtatcgcaactctgtgcagaaggctcacatttacggtatcaccttctccatctcacaagcttttatgtacttctcctacgccggttgcttcaggtttggtgcatacctgatcgtgaatggccacatgaggtttagagacgtcattctggtatttagtgcgattgtcttcggcgcggtggctctcggccacgcatctagcttcgccccagattatgctaaggctaagctgtcagcggcccaccttttcatgttgtttgagcgccagccgctgatcgattcttacagcgaagagggcctcaagccggataagttcgagggtaatattacattcaacgaggtggtctttaattaccctacaagagctaacgttcctgtcctccagggtctctcactcgaggtcaaaaagggccagaccctcgctctggtgggtagtagtggatgcggtaaaagcaccgtcgtccagctgctcgaacgcttttacgaccccttggcgggaactgtgttcgttgattttggtttccagctgctggatggtcaggaagccaagaaactcaatgttcaatggctgagggcccaactgggaatcgttagccaagagcctattctgtttgattgcagcatcgctgagaacatagcttatggtgacaattctcgcgtcgtatctcaggatgaaatcgttagcgccgccaaggcggctaacatccacccttttattgagactttgccgcataaatatgagacgagagtgggagataagggaacccagctctctggaggccagaagcaaagaatcgcaatagcgcgcgccctcatcagacaacctcaaatactcctcctggacgaggctacttctgccctcgacactgaatctgagaaggtcgtccaagaggctttggataaagcgcgcgagggtcgcacctgcatcgtcattgctcaccgcctgtcaaccatccagaacgcagatctgattgtcgtgttccagaacggaagagtgaaggaacacggtacccatcaacaactgctggcacagaaaggaatctacttcagcatggtatcagttcaggccggtacacaaaacctc

SEQ ID NO: 7608 - DNA, 3858 bp, Artificial Sequence
  Description of Artificial Sequence: Synthetic coding sequence
atggatctcgaggctgctaagaacggaaccgcgtggaggccgactagcgccgagggagacttcgagctcggcatctcgtccaagcagaaacggaaaaagaccaagactgtcaagatgatcggagtgctcaccttgttcagatactcggactggcaggacaagctcttcatgtcccttggcaccattatggcaatcgcccacggatccggactgcctctcatgatgatcgtgttcggggaaatgactgacaagttcgtcgatactgcaggaaacttttccttcccggtgaacttttcactgagcctccttaatccgggcaagatactggaggaagagatgacgcggtatgcgtactactactcgggcctcggcgccggtgtgctggtcgctgcatacatccaagtgtctttctggactttggcggcgggtcgccagatccgtaagatcagacagaagtttttccatgccattctgaggcaggaaatcggctggttcgacatcaatgatactaccgagctgaataccagactcactgatgacatctcgaagatctccgagggcatcggcgacaaggtgggcatgttcttccaagccgtcgcaaccttcttcgccgggttcatcgtgggttttatcagaggatggaagctgaccctggtcatcatggctatctcccctattctgggcctgtcggccgccgtgtgggccaagatcctcagcgcgttctccgacaaggagttggcagcctacgcgaaggccggagccgtggccgaggaagccctgggagcaattaggaccgtgatagcatttggaggtcagaataaagagttggaacgctaccaaaagcaccttgaaaacgctaaggagattggtataaagaaggccatctcggccaacatatccatgggaattgcatttttgttgatctacgcttcctacgctcttgccttctggtacggaagcaccctggtgatcagcaaggagtacaccattggaaacgctatgactgtgttcttttcgatcctcatcggagccttcagcgtgggccaggcggcaccatgcatcgacgcgttcgcgaatgcaagaggggcagcctacgtgatcttcgatatcatcgacaataacccgaagatcgattccttcagcgagagaggacataaaccggactcaattaagggaaatctcgagttcaacgacgtccactttagctacccgagcagagccaacgtcaaaatcctcaagggcctgaacctcaaggtgcagtcggggcagactgtggcactggtgggctccagcggatgtggaaagtctaccacggtgcagctgatacaacgcctgtacgacccggacgaaggaacgattaacattgacggacaggacatccggaatttcaacgtgaattacctccgggaaatcattggagtcgtcagccaagaaccggtgctctttagcactactatcgctgagaacatatgctacggacggggcaacgtgactatggatgagatcaagaaggcagtgaaggaagccaacgcgtacgaattcatcatgaagctcccccagaagtttgacactctggtgggggagaggggagctcagctctcgggtgggcaaaaacaacgcatcgcaatcgcacgggcgcttgtgcgcaacccaaaaatcctcctccttgatgaagctacgtcggccctggataccgaaagcgaagccgaggtccaggcggctctggacaaagctcgggaaggaagaaccaccatcgttatcgctcaccggttgtcgaccgtccgaaatgcggatgtgattgccggatttgaagatggggtgatcgtggaacaaggatcacactcggagctgatgaagaaggaaggagtctacttcaagctggtgaacatgcaaacgtcgggcagccagatccagtcagaagaattcgagctcaatgacgaaaaggccgccactcggatggcgccaaacggatggaagagtcgcttgtttcggcactccacccagaagaacttgaaaaactcacagatgtgccagaagagtctggatgtggagactgacggacttgaagcgaatgtgccgccggtgtccttcttgaaggtcctcaaactcaataagactgagtggccgtacttcgtggtcggaactgtgtgcgccatcgccaatggtggactgcaaccggcgttcagcgtgatcttctcggaaatcatagccatctttggacctggcgatgacgccgtgaaacaacaaaaatgtaacattttctcactgatcttcctctttctgggaataatcagctttttcacgtttttcttgcaggggttcactttcgggaaagccggagaaatcctgaccagaaggctgcgcagcatggcattcaaagccatgctgcggcaggacatgtcgtggttcgacgatcataagaattcaaccggagccctgtcgacccggctcgcaaccgacgccgctcaagtgcagggcgccacgggcacccgcctggctctgatcgcccagaatatcgccaatcttggcactggcattatcatctcgtttatctatggatggcagctcacccttctgctgctggctgtggtcccaataatcgcagtcagcggtatcgtcgaaatgaagctgctggcgggaaacgcgaaacgagacaagaaggaactggaagcggctggaaagattgccactgaagccatcgagaatatccggaccgtggtttcgctgacccaagaacggaagtttgagagcatgtatgtcgagaaactttacggcccctacagaaactcggtgcaaaaggcgcacatctatggaatcacctttagcatctcccaggcattcatgtacttctcctacgctggatgcttccgcttcggagcgtacctgatcgtgaacggtcacatgaggttccgggacgtcatcctggtgttctcagcaattgtgttcggagcggtcgcgttgggacatgcctcgtcattcgcgccagattacgccaaagcgaaattgtcggcagcacacctgttcatgctcttcgaacgccagccactcatcgattcatactcagaagaaggtctgaagcccgataagttcgaaggcaacatcacttttaacgaagttgtctttaactacccgacgagggcaaatgtgcctgtgctccagggtctgtcgcttgaggtgaaaaagggccagactttggcgctggtggggagctcggggtgcggaaagtccactgtggtgcagctgctggagcgcttctacgatcccctggctggaaccgtgtttgtcgacttcggtttccagctgctggacggtcaagaggctaagaaactgaacgtgcaatggctgcgcgcccaactgggtatcgtgtcacaagagccgatactgttcgattgctcaattgccgaaaacattgcatatggagacaattcccgcgtagtgtcccaagatgaaatcgtttccgcagccaaggccgctaacatccacccgttcatcgagactctgccacataagtacgagactcgggtgggggacaaaggaactcagctctccggaggacagaagcaacggattgccattgcgagagccctgattcgccagccgcagatcctgctcttggatgaagccacttccgctctggacaccgaaagcgagaaagtcgtgcaggaagctctggataaagccagagagggtaggacctgtatcgtgatcgcacatcgcctgtccaccatccagaacgcggacctgatcgtggtgttccaaaatggccgcgtgaaggaacatggcactcatcagcaactgctggcccagaagggaatctacttctcgatggtgtccgtgcaggcagggacccaaaatctg

SEQ ID NO: 7609 - DNA, 3858 bp, Artificial Sequence
  Description of Artificial Sequence: Synthetic coding sequence
atggacctggaggctgctaaaaatggaactgcatggcggccgacatcagccgaaggtgacttcgagttaggaatttcaagcaaacagaagcggaagaagacgaagacagtgaagatgatcggagtcctgacccttttccggtactccgattggcaggataaactttttatgtccctgggaactataatggccatcgctcatgggtcgggcctccctctgatgatgatcgttttcggggagatgacagataagttcgtggatacagctggaaacttctccttccctgtcaatttcagcctatccctgctcaaccccggtaagatccttgaagaggaaatgaccagatatgcctattattattcagggctgggggctggggtgttggtcgcggcttatattcaggtgtccttctggacccttgccgcagggaggcagataaggaaaatcagacagaagttctttcacgccatcttgcggcaggagatcggatggtttgatataaacgataccaccgagctgaatacgaggctgacagacgacattagtaagatcagcgaggggattggagataaggtaggtatgttcttccaggctgtggctacttttttcgcaggctttatagttgggttcatcagagggtggaaactaacgctagtcattatggctatcagccctatcctaggactgagcgctgccgtgtgggctaaaatcttgtcggcgttctctgataaagaattggccgcgtatgcgaaggccggagcggtagctgaggaggctctgggagctattagaacagtaatcgcctttggcggccagaacaaggaactggagcggtaccagaagcaccttgagaacgcaaaggagataggcattaagaaggcgatttctgcaaacatttccatggggatagcatttctcttgatctacgcttcttatgctctggcgttctggtacgggagcactctggtgatatcaaaagaatacacaatcggaaatgcaatgacagtgttttttagcatcctcatcggggctttcagcgtcgggcaggcagccccgtgcatagacgcctttgctaacgcccggggcgcggcctatgtgatttttgacatcatcgataataacccaaaaattgacagcttctctgaacggggacacaaaccagacagcatcaaaggcaacctggaattcaatgacgttcacttttcttaccctagcagggcaaatgtgaagattctgaaagggctcaacttgaaagttcaatcagggcagactgttgccctggttgggtcatcagggtgcgggaagtccaccactgtacagctgatacaaagattgtatgaccctgacgagggtaccatcaacatcgacggccaggatattagaaattttaacgtgaactacctgcgtgaaatcatcggggtggtgtcccaagaacccgtcctgttttctacaactatcgctgaaaatatttgttacggccgtggcaatgtcacaatggacgaaattaaaaaggctgtgaaagaagcaaacgcctatgagtttattatgaaactcccacagaagttcgacactctggttggcgagcgaggggctcagttgagcggcgggcaaaagcagaggatagcaatcgcccgcgccttggtgcggaaccctaagatactattactggacgaggctacctctgcactcgacaccgaaagcgaggccgaagttcaggctgctctcgataaagccagggagggacggacaaccatcgttatcgcccaccggctctccactgtcaggaacgccgacgtcatagccggatttgaggatggtgtgattgtcgagcaagggtcacactccgagttgatgaaaaaagagggcgtttattttaagctagtgaacatgcagacgtcaggttcgcagattcagtctgaggaatttgagctgaatgatgagaaagccgctacgcgtatggcgccaaacggttggaagagccgactcttccggcattcaacccagaagaatctcaaaaactcacagatgtgccaaaaatcactagacgttgagactgatggactggaggcaaacgtgccaccggtatcattcctcaaggttctgaagttgaacaagacagaatggccttattttgtcgtcggcaccgtctgcgctatagccaatggagggctgcagcccgccttcagcgtgatttttagtgaaataattgctatcttcggccctggggatgatgccgtaaagcagcaaaagtgcaatatcttttctcttatcttcctgttcttaggcatcatttcctttttcacattcttcctgcaagggtttacctttggtaaagccggcgagatactgacccggaggctgaggtcgatggcattcaaggcaatgctgcgtcaggacatgtcttggtttgacgatcacaagaacagtactggagctctgtccactcggttagcgacagacgctgctcaagtacagggggccacgggaacgagattggcccttattgcccagaacattgctaacctcggaacaggcattatcatctcatttatttatgggtggcagctaacattgctgctgctcgccgttgtgcctatcatcgctgtgtccggcatagtcgaaatgaaactgctggcaggcaatgcaaaacgggacaagaaggagcttgaggccgctgggaaaattgctaccgaggccatcgagaatattagaacggtcgtttccctgacccaggagcgtaaattcgagtctatgtacgtggagaagctgtacggaccgtatcgaaacagtgttcaaaaggcccacatttatggaatcactttttccatcagccaggccttcatgtatttcagttacgcaggatgtttcagattcggtgcctaccttattgtgaatggtcatatgcggttccgggatgttatcctggtgttctcagccatcgtcttcggggctgttgcgttgggacacgcatccagttttgcacccgattatgctaaggccaagctgtcagccgctcatctgtttatgctgttcgaacggcagcccctcattgactcctactcagaggagggcctcaaacctgacaagttcgaaggcaacataacttttaacgaggtggtgttcaattatcctacaagagccaatgtgccagtcctccaaggactttctttggaagtcaagaaggggcagactcttgccctggtgggatcctcagggtgcggcaaaagcaccgtggtgcagttactggaacgcttctatgacccactcgcggggaccgtctttgtcgatttcgggtttcagctcctggacggtcaggaggctaagaaattgaatgttcagtggctgcgagcccaacttggaattgtttctcaggagccaattcttttcgattgtagtattgccgagaacattgcgtacggcgacaattctcgcgtagtctcacaggatgagatcgtgtcagctgcgaaagctgctaacattcacccatttatcgagactctgccgcacaagtacgagactagagtgggtgataaggggacacagctgtctggcggtcaaaagcaaaggattgcgattgctcgcgcattgattagacagccccagatcctactccttgacgaggctacaagcgcacttgacaccgagtcagagaaggtggtacaggaagcgctggacaaggcaagggaagggcgaacctgcattgtcattgctcatcgactatccacaattcagaatgccgacctcatcgtcgtgttccagaatggcagagtaaaagaacatggaacccaccaacagctgttggcccagaagggaatctactttagtatggtgtcagtccaagccgggacccagaatctg

SEQ ID NO: 7610 - DNA, 3858 bp, Artificial Sequence
  Description of Artificial Sequence: Synthetic coding sequence
atggatctggaagcagcaaagaacggcaccgcatggcgcccaacgtctgccgagggtgattttgagctcggcatttcgtccaagcaaaagcgaaagaaaaccaagaccgtgaagatgatcggtgtgctgaccctgtttagatactcggactggcaagacaaactcttcatgtcactgggaacgattatggcgatcgcacatggtagcggcctgcctctcatgatgattgtgtttggggaaatgactgataagttcgtcgacactgcaggaaatttctcattcccagtgaacttctccctctcactgcttaatccaggtaagatccttgaagaagagatgactcggtatgcatactactactcgggactcggagcaggagtcctggtcgcggcttacattcaggtttcattctggacccttgcagcaggaaggcaaatccgaaagatccgccaaaagttctttcatgcaatcctccgtcaagaaattggctggtttgatatcaacgacaccactgagcttaatactagacttactgatgatatatcgaagatttcggaaggaattggggataaagtgggaatgttcttccaggccgtggccacctttttcgcaggattcatcgtcggtttcatccggggctggaagttgactctcgtgatcatggcaatctccccaattctgggactctcagccgcagtgtgggcaaagattctgagcgcgttttccgacaaggagttggcagcgtacgcaaaggccggagcggtggcagaggaggcgctgggagcaattagaaccgtcatagcatttggcggtcagaacaaagaactggaaaggtaccagaaacatctggaaaatgcaaaggagattggaattaagaaagcaatttcggctaacatatccatgggtattgcattccttttgatctacgcgtcatacgcacttgctttttggtacggttccacccttgtcatttcaaaagaatacactattggaaatgcaatgaccgtctttttctcgatcctgataggagccttttcggtggggcaggccgcaccgtgcattgatgcattcgcaaacgcccggggagcagcctacgtgatttttgacatcatagataacaacccaaagatagattcatttagcgaaagaggtcataagcctgacagcattaagggaaacctggagtttaatgacgtccacttcagctatccttcccgggccaacgtgaagatccttaagggtcttaatcttaaagttcagtcaggccagactgttgcgctggttgggtcgtcgggctgcggtaaaagcaccaccgtccagcttattcagcgactttacgatcctgatgaaggaaccattaacattgacgggcaagatattcggaatttcaatgttaactacctccgagaaatcataggggtggtgtcacaagaaccagtgctcttttcaaccacgattgcagaaaacatctgttatggccgcgggaacgtgactatggatgagattaagaaagccgtgaaggaggcaaacgcatacgaattcatcatgaagctccctcaaaagtttgacacgcttgtgggggagagaggagcacaactgtcaggaggccaaaaacagcgaatcgcaatcgcccgagccctggtccgtaacccgaagattcttctcctggatgaggccacttccgcccttgacactgaatccgaagcagaggtccaggcagccctggacaaggcacgcgagggccgcaccactatcgtgatcgcccatcggctttccaccgtccggaatgcagatgtgatcgccggtttcgaagatggtgtcattgtggagcaagggtcacattccgaacttatgaagaaggaaggggtctacttcaagttggtgaatatgcaaacctcgggtagccagatccaatcagaagaattcgaactcaacgatgaaaaggccgcaactagaatggcacccaacgggtggaagtcgagattgttccgacattcgacccaaaagaatctgaagaattcccaaatgtgtcagaagtcactggatgtcgagactgatggacttgaggccaacgtgcctcctgtcagctttctgaaggtcctgaagctcaacaaaactgagtggccttactttgtggtcggcaccgtgtgtgctatcgcaaacggcggactccaaccagcgttttccgtgatcttttccgagattattgcgatattcggacctggagacgatgcggtgaaacaacagaagtgcaacatcttttctctgatttttctttttctgggtataatctcgtttttcacttttttccttcaaggtttcacttttgggaaggcgggagagattctgacccggcgccttcgttccatggcctttaaagcaatgctccggcaggacatgtcatggtttgatgatcataagaactcgactggagcactcagcaccagactcgccacggatgcagctcaggtccaaggggctaccggcactcgcctggcactcattgcacagaacattgccaatctgggtactgggattatcatctcgttcatctacggatggcagctgacccttttgctgctggccgtggtccccattatagccgtttcaggtattgtggagatgaagctcctggcaggtaacgcaaaacgggacaagaaagaacttgaggccgccgggaagatcgccaccgaagcaattgagaacatccgcactgtcgtgtcactgacgcaggaacggaaattcgaatccatgtacgtcgaaaagttgtacggaccctacagaaactccgtgcagaaggcgcacatctacgggataactttctcgatttcccaggcttttatgtacttctcatacgcgggctgctttcgctttggagcatacctgatagtgaatgggcatatgcgctttagagacgtgattctggtgttctccgccattgtgtttggcgcagtcgcactcggtcacgcatcgtccttcgcaccagactacgcgaaagcaaagctctcagcagcacatctcttcatgctgtttgaacggcagccccttatcgatagctacagcgaagaaggtctgaagcccgataagtttgaagggaatatcacctttaatgaggtggtctttaactaccctacccgtgcaaatgtgcctgtgcttcagggactcagcctcgaggtgaagaaggggcaaaccctggcactggtcggttcgtcagggtgcggtaaatcgactgtcgtgcaactgcttgagcggttctatgatcctctcgcaggaactgtgtttgtggactttggatttcagctgttggatgggcaagaggcaaagaagctgaatgtgcaatggttgagagcacagcttggtattgtcagccaggaaccaatcctctttgattgttcaatcgcagagaacatcgcctacggagataactcccgcgttgtctcgcaggatgagatagttagcgccgccaaggcagcaaacattcaccctttcatcgaaaccctgcctcataagtacgaaactagggtgggtgacaaaggtactcaactctccggaggacagaagcaaaggattgcaatcgctagagcgttgatccgccaaccccagatcctgcttcttgatgaggcaacctccgcactggacactgaatcagaaaaggtcgtgcaagaagcattggataaggcgagagagggacgcacttgtattgtgattgcacacagactgtccactattcaaaacgcggatctgatcgtggtctttcaaaatggtcgcgtgaaggaacatggtacccatcagcagctgctcgcgcagaagggcatctacttttcaatggtcagcgtgcaggcaggaactcagaacctg

SEQ ID NO: 7611 - DNA, 3858 bp, Artificial Sequence
  Description of Artificial Sequence: Synthetic coding sequence
atggatctagaggcagccaagaacggcaccgcttggcgccccacctccgcagaaggggattttgaactgggaatcagtagcaaacagaaaaggaagaagaccaagactgtgaaaatgataggggttttaacgctttttagatattccgattggcaggacaaattattcatgtcacttgggactattatggccatcgcccacgggtccggtctgcctcttatgatgatcgtctttggagagatgaccgacaagtttgtcgataccgcaggaaatttcagctttcccgtgaatttttctctgagcttactgaatccaggcaagattctggaagaagagatgactcgctatgcgtattattatagcggcttgggcgctggggtgctggtggccgcatatatccaggtatccttctggaccctggccgccgggcgacagataaggaagatcagacagaaatttttccatgccattttacgacaggagattgggtggttcgatatcaacgatactacagaattgaatacacgtctgacagatgatatttcgaagatctccgagggtataggcgataaagttggcatgttctttcaggctgtggctacgttttttgccgggtttattgtaggattcatccgaggatggaagcttacccttgtgatcatggccatctctcctatcctgggactgagcgccgcagtatgggcaaaaatactctcagccttttcagataaggagctggccgcttacgccaaggccggggccgtggccgaagaagctctgggtgccattcggaccgtgattgccttcgggggccagaataaggaactagagcggtatcagaaacatctggaaaacgcgaaggagattggaatcaagaaggccattagcgccaacatctcgatgggaattgcgtttttattgatctatgccagctatgctctggccttctggtacggctcgaccctggtgatctccaaggagtacactattggcaatgcaatgacggtgttcttcagtattctgataggcgcatttagcgtgggtcaagcggccccctgcatcgatgccttcgccaacgcgcgcggcgcagcctatgtgatcttcgacattattgataacaatcccaaaattgatagcttcagtgaacggggacacaagcctgactcaattaaggggaatttggaattcaatgacgtgcatttctcataccccagtcgggccaatgtgaaaatacttaagggcctgaatctgaaagtccagtctggacagaccgtggctcttgtcggcagtagcggatgcgggaaatctacaacagtacaattaatccagagattatatgatcctgacgaaggcaccattaatatcgatggccaggacatcagaaactttaacgtgaactacctgcgcgagattatcggagtggtgagccaagagcccgttctgttttcgaccacaatcgccgagaacatctgctacggtcgagggaatgtgaccatggacgagattaaaaaggcagtgaaagaggccaacgcgtacgagttcattatgaagctgcctcagaaattcgacactcttgtcggcgaaaggggcgcccaactttctggcggacagaagcagcggatcgctatagcccgggccttggtgcgaaatcctaagatccttttgttagacgaagccacatccgctttggacacggaatcagaggcggaggtccaagctgcactggataaggctcgagaggggcggacgaccatcgtaattgctcatagattgagcacagtgcgcaatgcagatgttatcgcagggtttgaggatggtgtgattgtcgagcaggggagccatagcgagttgatgaaaaaggaaggcgtttacttcaagctggtgaatatgcagactagtgggtcgcaaattcaaagcgaggagttcgaactcaatgatgaaaaagctgctactcgcatggcccccaacggctggaagagccgactgtttagacattccacgcaaaagaatctgaaaaattcacaaatgtgtcagaaatcactcgatgtcgagactgatggattagaagctaacgttcctccggttagtttcctgaaagtactcaagctgaataagaccgaatggccctattttgtggtgggcacggtgtgcgctatcgctaacgggggcttacaaccagcgttttccgttatcttctctgagattattgccatcttcgggcccggggacgacgctgtgaaacagcagaaatgcaatattttctccctgattttcctgttcctgggaattatctcctttttcacctttttcctgcagggattcacattcggaaaagctggggagatcttaacacgccggctgagatcgatggcctttaaggctatgctcagacaggacatgagctggttcgatgaccacaaaaattccacaggggccctgagtactcgcctggccaccgacgctgcccaggtgcagggggctacaggaacaagactcgcactcatcgctcagaacattgcgaatcttggaaccggcattattatctctttcatttacggatggcaacttactctgctgctcctcgctgttgtacccattatagcagttagcggcattgtggaaatgaagctgttggcagggaacgcaaaaagggataagaaggagctagaagctgccggcaagatagcaacagaagccatagagaacattcggacagtggtgagcttgacacaggagaggaagtttgagagtatgtacgtggagaaactgtatggcccatatcgcaactccgtccagaaagcacacatctacggtattactttctccattagtcaggcctttatgtacttcagctatgctggctgcttcagatttggcgcctacctcattgtgaacggtcatatgcggttccgtgacgttattctggttttctctgctattgtcttcggtgcggtcgccctgggccacgctagcagctttgctcctgattatgccaaggcaaagctcagcgccgctcacctgttcatgctgttcgagagacaacccctcatcgattcatatagcgaagaaggtctcaaacctgacaagttcgagggaaatattacctttaatgaagtggtgttcaactatccaacccgggcgaacgtaccagtgctgcagggattgtcgctcgaagtgaaaaaaggtcagaccctggccctggtcggctcttctggctgtggtaagtccactgtggtgcagctgttggaaaggttttacgatcccttggccggtacagtgttcgtggatttcggattccagctacttgacggacaggaggcgaagaaactcaatgtccagtggctgagggctcagctgggcatcgtgagccaggaacccatcctttttgactgttctatcgccgagaatatcgcatacggagacaactcacgagttgtgtctcaggatgaaatcgtctcagcggcaaaagccgccaacatccatccttttattgagacacttcctcataaatacgagaccagagttggcgataaaggaacccagctcagcggggggcagaagcaacggattgccatagctagggcccttatacggcaaccccagatcctgttgctggatgaggccacatctgccctggacacagagtctgaaaaggtggtgcaggaagccctcgacaaggcacgcgaaggccgtacgtgcatcgtcatagcacaccggctgagcaccatacagaacgccgatctgattgtcgtgttccaaaatggacgcgtgaaggagcacgggacccaccagcagttgttggcacaaaaaggcatctattttagcatggttagcgtacaggcaggcacgcaaaatctt

SEQ ID NO: 7612 - DNA, 3858 bp, Artificial Sequence
  Description of Artificial Sequence: Synthetic coding sequence
atggacctcgaggccgccaagaacggaacggcatggcgtccgacctcggctgaaggtgactttgagctcggaatctcgtccaaacagaagcggaagaaaactaagacggtgaaaatgatcggtgtattgaccctgttccggtactcagattggcaagacaaactcttcatgtcgcttggaactattatggccatcgcccacggctcagggcttcccttgatgatgattgtgttcggcgagatgaccgacaagttcgttgacaccgcaggtaacttttcctttccagtcaacttctccctgagcctgctgaacccggggaagattttggaagaggaaatgactcggtacgcctactactactccgggcttggagccggagtgttggtggctgcatacatccaggtgtccttctggaccctcgcggcaggccgccaaatccggaagatcaggcaaaagtttttccatgcgatcctgcgccaagagatcggttggtttgatatcaatgacaccactgaactgaataccagactgacggatgacatctcgaagatcagcgaaggcatcggagataaagtcggaatgttcttccaggcagtggccaccttcttcgcgggattcatcgtgggcttcattcggggatggaagctgaccctggtgatcatggcaatctcgccgatcctgggcctcagcgccgcggtctgggcgaagatcttgtctgcattctccgacaaggagctcgccgcctacgccaaagcgggagcagtcgcagaggaagcgctcggcgcaattcggactgtgatcgcgttcggagggcagaacaaggaactggagagataccagaagcacctcgagaacgccaaggaaatcggcatcaagaaagccatcagtgccaatatctccatgggaatcgcgttcctgctgatttacgcgtcatacgcgctggctttttggtacggctcgaccttggtcatctccaaagaatacaccattggaaatgctatgactgttttcttctccatcctgatcggagcattctccgtaggacaagcagcaccgtgtatcgacgcctttgcgaacgcccggggagctgcctacgtgattttcgacattattgacaacaaccctaagatcgactcattctcagagcgcggacacaagcctgatagcatcaaggggaacctggagtttaacgatgtgcacttctcgtacccttcgcgcgcaaacgttaagatcctgaaaggactcaacctgaaggtgcaatcggggcaaactgtcgccctggtgggaagcagtgggtgcggtaagagcaccaccgtgcaactgatccagagactgtacgatccggacgagggtactatcaatatcgacgggcaggatatccgaaactttaacgtcaattacctgagagagatcatcggtgtcgtgtcccaggagccagtcctgttttcaaccaccattgctgaaaacatttgttacgggcgtggaaacgtgacgatggacgaaatcaaaaaggccgtcaaggaagcaaatgcgtacgaattcatcatgaagctgccgcagaaatttgacaccttggtgggagaacgcggggcccaactgagcggtggtcagaaacaacggatcgctatcgcaagagccctggtccgcaatccgaaaatcctgctcctggatgaggctaccagcgcattggataccgaatccgaagctgaagtgcaggccgcactcgataaggcacgcgaaggaaggactaccatcgtgattgcccatcggctctcaactgtgcgcaatgccgacgtcatcgccggtttcgaggacggagtgatagtggagcaaggatctcatagcgagctcatgaagaaggaaggtgtgtacttcaaactggtgaacatgcaaactagcggatctcagatccaaagcgaggaatttgagctgaacgacgaaaaggcagccacgcggatggcgccaaacggatggaaatccaggctgttcagacacagtactcagaagaatttgaaaaactcccagatgtgccaaaaatcactggatgtggaaactgatggactggaggcgaacgtgccaccagtgtcattcctgaaggtcctcaaactgaacaaaacggagtggccatatttcgtcgtcggcactgtgtgtgctatcgctaacgggggactgcagcctgcgttctccgtgatcttctcggagatcatcgctatcttcggccccggagacgacgccgtgaaacagcagaagtgtaacatcttttctctgatctttctgttccttggcatcatctcgtttttcacttttttcttgcaaggattcaccttcggaaaggccggcgaaattctcactagacggctgaggtcgatggcatttaaggccatgctgcggcaggacatgtcatggtttgacgaccataagaactctactggggctttgtccaccaggctggccaccgacgcggcgcaggtgcagggcgctaccggcactcgactggcgctcatcgcgcaaaacattgcaaatctgggaactgggatcatcatcagcttcatctacggatggcagctgaccctgctcctgctcgccgtggtgcccatcatcgccgtcagcgggatcgtggaaatgaagctcctggccggaaacgcgaaacgcgacaaaaaggaacttgaggccgcagggaagatagccactgaagccattgagaatatccgcaccgtcgtgtcgcttacccaggagcgcaagttcgaaagtatgtatgttgaaaagctgtatggcccgtaccgcaacagcgtacagaaggcgcacatatacggaatcaccttctcgatctcacaggcttttatgtacttcagctacgccggttgcttccggtttggagcctacctcattgtcaatgggcacatgcgatttagagatgtcattctcgtgtttagcgccatcgtgttcggagcggtggccctgggacatgcctcctccttcgccccggattacgctaaggccaagctgtctgccgcgcacctgttcatgctgttcgagcgccagcccctgatcgattcctactcggaagagggcttgaagcctgacaagttcgaaggcaacatcaccttcaatgaagtggtgttcaactacccgacccgcgcaaatgtgccggtcctgcaagggctctcgctggaagtgaagaagggacagactctggccttggtcggctcgtcagggtgcggaaagtcaactgtagtgcagcttctcgagcgcttctacgacccgctggccggaaccgtgttcgtcgactttggattccaacttctggatggacaggaagccaagaagctcaatgtccagtggttgagggcgcagcttggcattgtgtcacaggagcctatcctcttcgactgcagcatcgccgagaacatagcctatggggataattcgcgcgtggtttcgcaggacgagatcgtgtccgccgcgaaggcggcaaatatccacccattcatcgaaaccctcccacacaaatacgaaactcgggtcggcgacaaaggaacccagctctcaggaggccagaagcaacggattgccatcgcacgtgctctcatccggcagccgcaaattctccttctcgatgaagctacctcggctctggacacggagagcgaaaaggttgtgcaggaagccttggataaggcgcgcgagggtaggacgtgcatcgtgatcgcacaccggttgtccactatccagaacgccgatctgattgtggtgttccaaaatggccgcgtgaaggaacatggtacgcatcagcagctccttgcgcaaaaaggaatctacttctcgatggtgtccgtacaagctggcacgcagaacctg

SEQ ID NO: 7613 - DNA, 3858 bp, Artificial Sequence
  Description of Artificial Sequence: Synthetic coding sequence
atggatctggaggccgcaaaaaacggaactgcatggaggcctacgtccgccgaaggtgacttcgaactcggaatctcgagcaaacagaaacggaaaaagactaaaacggtgaagatgattggagtgctcactctgttccgctactcggactggcaggataaactgttcatgtccttgggaaccatcatggcaatcgcccatgggagcggactcccccttatgatgattgtattcggcgagatgaccgataagttcgtcgataccgccggaaatttctctttccctgtcaatttctccctttcactgctgaacccgggaaagatccttgaagaagaaatgactcgctatgcatactactacagcggattgggggccggcgtgttggtcgccgcgtacatccaagtgagcttctggaccctggcggccggacggcagatcagaaaaatccgccagaagttctttcacgccatacttcgccaggagattggatggttcgacatcaatgatactaccgaactgaacactcggcttaccgacgatatctcaaagatctcggagggaatcggagacaaagtcggtatgttcttccaggccgtggcgactttcttcgccggattcatcgtggggttcatccgaggctggaagttgaccctcgtgatcatggcaatttcccctattctgggtctgagcgcggccgtgtgggctaagatcctgtccgccttctcggataaggaactcgcggcctacgccaaggctggggctgtggccgaagaagccctgggcgccatccgcaccgtaattgcatttggaggccagaacaaagaattggaaaggtaccagaaacatctggagaatgcaaaggagatcggcatcaagaaagccatctcggcgaacatttcgatgggtatcgcctttttgctcatctacgcgtcgtacgctctggccttctggtacggcagcacccttgtgatctccaaggagtacaccatcggaaacgccatgaccgtgttcttttcaatccttatcggggcgtttagcgtgggacaggcggccccgtgcatcgacgctttcgcaaacgcccgcggcgccgcttacgtcatattcgacataattgacaacaatcccaagatcgattccttctccgagagaggacacaaacctgattcgatcaaaggcaatctggagtttaacgacgtgcatttctcctacccttcacgcgcaaatgtgaagatcctgaagggtctgaacctgaaggtgcaatcgggacaaactgttgctctcgtcggatcgtctggatgcgggaagagcactacggtccaattgatccagagactctatgacccggatgagggaacgattaacatcgatgggcaggacattcggaatttcaacgtgaattacctgagggagatcatcggggtcgtctcccaagaaccagtgcttttctccactaccatcgcggaaaacatctgctacggaaggggaaacgttaccatggacgaaatcaagaaggcagtgaaggaggccaacgcctacgagtttatcatgaaattgccacaaaagtttgatactctggtgggagaaagaggcgcacagctctcggggggacagaagcagcgcatcgcaattgcgcgggctctggtccgtaatccaaagattctgctcctcgacgaggcaaccagcgcccttgataccgagagtgaagctgaagtccaagccgcactggataaggcccgcgaaggaagaactaccatcgtgatcgcccataggctctcgactgttcggaacgctgatgtgatcgcgggctttgaggacggcgttatcgtcgaacaaggatcacactccgaactgatgaaaaaagaaggagtgtacttcaagctcgtgaatatgcaaacttcgggctcgcaaatccaatcggaagagtttgagctgaatgatgaaaaggcagccaccaggatggcgccgaacggatggaagtcgaggttgttccggcactcgacccagaagaatctcaaaaactctcagatgtgccagaagtccctggacgtggaaacggatggacttgaagctaacgtgcccccggtttcattcttgaaggtcttgaagctgaacaaaacggaatggccgtatttcgtggtcggaaccgtgtgtgccatcgccaacggggggctccaaccggccttctccgtaatcttcagcgaaatcatcgccatctttggtccgggagacgacgcggtcaagcagcaaaagtgcaatatcttctccctgattttcctgttcctgggcatcatcagcttctttactttcttcttgcaggggtttacttttgggaaagcaggagagatcctgaccagacggctgagatctatggcatttaaggccatgctccgccaggatatgtcatggttcgacgatcataagaattcaactggagccctcagcaccaggctcgcaacggacgcggcccaggtccagggagcgactggaactcgcctggccctcatagcgcagaatattgccaacctcggaaccggcatcatcatctcattcatctacggatggcagctgacgctgctgctgcttgctgtggtgccgatcattgcggtgtctggaattgtggaaatgaagctgttggcaggaaatgcgaaacgggataagaaggaactggaggctgcgggaaagattgcgactgaggctatcgagaacatcagaactgtggtgtcgctgacccaggaacgcaaatttgagagcatgtacgtggagaaactgtatggtccatacaggaactcggtccagaaggcccacatatacggaatcaccttctccattagccaggcgtttatgtacttttcgtacgccgggtgttttcggttcggggcgtacctgatcgtgaacggccacatgcggttccgcgacgtgatcctcgtgttctcggcaatcgtttttggagctgtggcgttgggccacgcgtcatcattcgcaccggactacgcaaaagccaagctgtcggcggcgcacctgttcatgctgtttgaacggcagcccctcatcgacagctactccgaggaaggcttgaagccagataagttcgaaggcaacatcactttcaacgaggtggttttcaactacccaacccgcgctaatgtcccggtgctgcaaggactgtccctggaggtgaagaaggggcagactttggccctggtcggctcttccggatgtggcaagtccacggtggtccagctccttgaacgcttttacgacccgctggcgggaacggtattcgtcgacttcggtttccagctgctcgatggccaggaggccaagaaattgaacgtgcaatggctgagagcccaattgggtattgtgtcccaggaaccaatcctcttcgactgctccattgctgaaaacatcgcctacggcgacaacagtagagtggtgtctcaggacgaaatcgtgtcggctgctaaggcagctaacattcacccattcatcgaaacccttccacacaagtatgaaactcgggtgggagacaagggaacgcagctgagtggcggtcaaaaacaacggattgcgatcgcccgggcacttattcggcagcctcaaatcctgctgctggacgaagcgacttcagctctggacaccgaatcagagaaagtggtgcaagaggcactggacaaggccagagagggccgtacctgcatcgtcatcgcccatcggctgtccaccatccagaacgctgacctgatcgtggtgttccaaaacggcagagtgaaggagcacgggacccatcaacaactcctcgcacagaagggaatctacttctcaatggtttccgtgcaggcgggaactcagaatctg

SEQ ID NO: 7614 - DNA, 3858 bp, Artificial Sequence
  Description of Artificial Sequence: Synthetic coding sequence
atggaccttgaagcagctaagaatgggaccgcgtggcggccaactagcgcagaaggagactttgagctggggatctcgagcaagcagaagcgaaaaaagactaagactgtgaaaatgattggagtgttgacccttttccgctacagcgactggcaggacaaactgttcatgtcactggggactattatggcgatcgcgcacggctcaggactccctcttatgatgatcgtgtttggcgaaatgaccgacaagtttgtggataccgcaggaaatttctctttcccagtgaacttttcactttccctgttgaacccgggaaagatactggaagaagagatgactcgctacgcatactactacagcggactgggagcaggcgtgttggtggcagcctacatacaagtctcgttctggactcttgcagccggccggcaaatccgcaagattcggcaaaagttctttcatgcgattctgcgccaggagattggatggttcgacattaatgatactactgaacttaacaccagactgactgacgatatctccaagatatccgaagggattggggacaaggtgggcatgttttttcaagcggtcgccacctttttcgccgggtttatagtgggtttcatacggggctggaaacttactcttgtgattatggccatctccccaattctcggtctttccgccgctgtgtgggccaagattctgtcggcgtttagcgataaggaacttgcagcctacgccaaggccggggcagtcgctgaagaggcgctgggggcgatcagaacggtcattgcctttggaggtcaaaacaaagaactcgaacgttaccaaaaacatttggagaacgcgaaggagattggaatcaaaaaagcaataagcgcaaacatttcaatgggaattgccttccttctcatttacgcatcgtacgcacttgcattttggtacggcagcacccttgtgatttccaaggagtacactatcggaaatgcaatgaccgtgttcttctccatcttgataggcgccttttccgtgggccaagcagctccatgtattgatgcattcgcaaacgcccgtggagccgcatacgtgatttttgatatcatagataacaatcccaagattgactcatttagcgaacggggacataagcctgatagcatcaaaggtaacctggagttcaacgacgtgcatttcagctaccctagcagggcaaacgtgaagatccttaagggactgaaccttaaggtgcagagcggccagaccgtcgctttggtcggctctagcggttgtggcaagtcaaccaccgtgcagctgatccaaagactctatgatcctgatgaagggaccattaacatagacggccaagatatcagaaacttcaacgtgaattacctcagagagatcataggagttgtgtcgcaggaaccagtccttttctcgacgaccattgccgagaatatctgttacggacgtgggaacgtgactatggacgagattaagaaagctgtcaaggaagccaacgcctacgagtttatcatgaaactcccacagaagtttgataccctggtgggcgaaaggggagcccaactttccggtggtcagaaacaaagaatcgcaattgcaagagccctcgtgcgaaatcctaaaatcctccttctcgatgaggcaacctccgcactggatacggaatccgaagcggaagtgcaggctgctctcgataaagccagggagggaagaactactattgttatagctcatcgcttgtcgacggttcgcaacgcggatgtcatcgcgggatttgaggacggagtgatcgtggagcagggatcgcattccgaactgatgaagaaggaaggggtctactttaaactggtgaatatgcagacctcgggctcacagatccagtccgaggaatttgagcttaatgatgaaaaggccgctactcggatggcccctaacggttggaagtcacgcctttttcgtcactccacgcaaaagaacctcaaaaactcgcaaatgtgtcaaaagtcgctggatgtggaaactgatggattggaagcaaatgtgccgcccgtctcctttcttaaagtgcttaagctcaataagaccgaatggccctacttcgtggtcggcactgtgtgtgcaatcgcaaacggaggactgcagccagctttctctgtgatcttttccgagattatcgctatattcggtcccggtgacgacgcagtgaagcagcagaagtgcaacattttcagcctcatcttcctgtttctggggataatcagcttctttacttttttcctccaaggatttacttttggaaaagccggggagattctgacgcggagactcaggagcatggcctttaaagcgatgttgcgtcaggatatgtcatggttcgatgatcataagaattcgaccggtgcgctttccactaggcttgccaccgacgctgcacaagttcaaggagcaaccgggactcgtctggcgcttatagcgcaaaacattgcaaatctgggcactggaattatcatttcttttatctatggctggcaactgaccctgctcctcctcgcagtggtgcccatcatcgcagtcagcggtattgtcgagatgaaactccttgccggaaacgccaagagagataagaaggagctcgaagcagctgggaagatcgcaaccgaggcaattgaaaacatccgaactgtggtttcccttacccaagaacgaaagttcgaatcgatgtacgtcgagaagctgtacggcccttaccgaaattctgtgcaaaaggctcacatttacggcataaccttttcgatttcacaagcattcatgtacttttcgtacgcaggatgctttcgatttggtgcttacctgatagtgaacgggcatatgcgttttcgggatgttatcttggtgttttccgcgattgtctttggagcagtggcactcgggcatgcaagctcgttcgcgcctgattacgcaaaggccaagctgtcggcagcgcacctgttcatgctttttgaacgccaaccgctcatcgattcctacagcgaggagggtctgaagccagataagttcgagggaaacatcacgtttaacgaggtcgtgttcaattaccccactcgcgcaaatgtcccagtgcttcaagggctttcactcgaagtcaagaagggtcaaaccctcgcacttgtgggatcatcggggtgcggaaaatccactgtggtccaactccttgagagattttacgatccccttgcgggtaccgtttttgtggactttggttttcagctgctggacggacaagaagccaagaaattgaatgtccaatggctgagagcccaactgggaatagtgtcacaggagcctattctgtttgactgttccattgcagaaaacatcgcatatggagataattctcgcgtggtcagccaagacgaaattgtgtcggctgcaaaggcggctaacatacatcctttcatagaaacgcttccccacaagtatgaaacccgcgttggtgacaaaggcacccagctctctgggggtcaaaaacagaggattgcaatcgcccgtgcacttatccgccaacctcagattctgttgttggatgaagctacctcggcacttgataccgaaagcgaaaaggtcgtccaggaagcactggacaaggcacgcgaaggtcggacgtgcattgtcatcgctcacagactttcaaccatccagaatgcagatcttatagtggtctttcagaacggacgggtgaaggaacacggtacgcatcaacagcttctggcccagaaggggatttacttctctatggtgtcagtgcaggcaggtacccaaaacttg

SEQ ID NO: 7615 - DNA, 3858 bp, Artificial Sequence
  Description of Artificial Sequence: Synthetic coding sequence
atggatcttgaggcagcgaaaaatggaaccgcgtggcgcccaacttcggcagaaggcgatttcgagctcggaatttcgtcgaagcagaagcggaaaaagactaagactgtaaagatgatcggcgtgcttaccctcttcagatacagcgactggcaggataagctgtttatgtcactgggaactattatggcaatcgcccatgggtccggccttccacttatgatgatagtgttcggagaaatgactgataagttcgtggatacggccgggaatttctcgttcccagttaacttttcgctttcgctccttaatccaggtaagatcctcgaagaggagatgactagatacgcctactactactcggggctcggcgcgggcgtgctcgttgcagcatacattcaggtgagcttctggactttggcagccggacggcagataaggaagatccgccaaaagtttttccacgcaattctgcgccaagaaataggctggttcgatatcaatgataccaccgagctcaacaccaggctcactgatgatatttccaagatatcggaaggcatcggggataaggtggggatgtttttccaggcagtggcaaccttctttgccggattcattgtggggtttatcagaggctggaagctcactttggtgattatggcgatctcgccaattctcggactctcggcagccgtgtgggcgaagattttgtcggccttttcggacaaggagcttgccgcatatgcaaaagccggagctgtggcagaagaggcacttggtgctataaggaccgtgattgcatttggaggtcaaaacaaggagctggaacgatatcagaaacacctggagaacgcaaaggagatcggcatcaagaaggctatttcggcgaacatttcgatgggtattgctttccttctcatttacgcaagctatgcactggccttctggtacggttccacgcttgtcatctcgaaggaatacaccattggtaacgcaatgactgtgttcttttccatcttgattggcgcatttagcgtgggccaggcggcaccttgtattgatgcattcgcaaatgcgagaggtgcagcttacgtgatctttgacataatcgacaataaccccaaaatagactcctttagcgaacggggccataagcccgatagcattaagggaaaccttgaattcaacgatgtgcatttttcctacccaagccgggcaaatgtgaagatattgaagggacttaacctgaaggttcaatcgggccaaacggtcgcactcgtcgggtccagcggatgcggcaaatccaccactgtgcaactgattcaaagactctatgaccccgatgaaggaaccataaacatcgatggacaggatatccgtaatttcaatgttaactacctcagagagataattggagtcgtgagccaggagcctgtgctttttagcactactattgcggagaacatctgttacggaaggggaaatgtgaccatggatgaaatcaagaaggccgtgaaggaggcaaacgcatacgaattcatcatgaagctgccacagaagttcgacactctcgtcggagaacgaggagcacagctgtcgggaggtcaaaagcagcggatcgcgattgcccgcgccctggtgcgaaaccctaagatcctgctgctcgatgaagcaacgtcggcgctggatactgagagcgaagccgaagttcaggctgcactggataaggcaagagagggtcgaaccaccattgtgatagcgcatagattgtcaactgtccggaacgcggacgtgattgcgggttttgaggatggcgtcatcgtcgagcaagggtcacattcggaactcatgaaaaaggaaggcgtgtacttcaagctggtgaacatgcaaacctcagggtcccagatacaatccgaggaatttgagctgaatgacgagaaggcggcaaccagaatggctccaaacggatggaagtcccgactttttcggcattccactcagaagaacttgaagaactcccagatgtgtcaaaagtccctcgacgtggagacggacggcctggaagccaacgtgcctccagtgtccttcctgaaagtgttgaaacttaacaagaccgaatggccgtacttcgtcgtgggtaccgtgtgtgcaatagcgaatggaggactgcaaccagcattctccgtgatcttttcggagattattgccatctttggccccggtgatgatgctgtgaaacagcaaaaatgtaacatcttttcacttatctttctttttcttggtatcatttcattctttaccttttttctccagggatttacctttggaaaggcaggcgagattcttaccagacgacttcgctccatggcatttaaggccatgcttagacaggatatgtcgtggtttgatgatcacaaaaactcgaccggagcactctccacgagactggcaacggatgcagcgcaggtgcagggagcaaccggtaccaggctggccctcatcgcccagaacattgcaaacttgggaaccggaatcataatctcgttcatttacggttggcagctgaccctcttgctcctcgcggtcgtgcccataattgcagtgtcagggatcgtcgaaatgaaactgctggcgggaaatgccaagcgagataagaaggagttggaagctgccggtaagatcgcgactgaggcaatcgagaatattcgtactgtggtttcccttacccaggagagaaagtttgagtcgatgtacgtggagaaactttacggcccttacaggaattccgtgcagaaggcccatatctacggcatcacgttttccatttcacaagcgtttatgtacttttcctacgcaggttgtttccgcttcggtgcatacctgattgttaacggacacatgagatttcgcgacgtcatccttgtgtttagtgccattgtgtttggggcagttgcattgggtcatgcaagctcttttgcccctgactacgcaaaagcaaagctctcggccgcgcatttgtttatgctgtttgaacgacagccgctcattgattcatacagcgaagaaggtttgaaacctgacaaatttgaaggtaacattacttttaacgaagtcgtgtttaactacccaacccgagccaatgtgcctgtcctgcaaggactgtcgctggaagtgaagaaaggccaaactctggcattggtgggttcctctggctgcggtaagagcaccgtcgtccaacttcttgaacgcttttacgaccccctggccggtaccgtgtttgtggattttggcttccaactgctcgatggacaagaagcgaaaaaacttaacgtgcaatggctcagagcacaacttgggattgtgtcacaagagcctatactgtttgactgcagtatagctgagaatatcgcgtacggtgataatagccgtgtggtgagccaagacgaaattgtctccgccgcgaaggctgcaaacattcatcccttcattgagactctgccacataagtacgaaacccgcgtgggagacaaaggtacgcaactttcgggcggacagaagcaacggatcgccatcgcaagggcactcatcagacagcctcaaatacttcttcttgatgaagccacttcagcacttgatactgaatcggaaaaagtggtgcaggaggcgctcgacaaggccagggaagggcggacctgcattgtgattgcacatagactctcgacgattcagaacgcagatctgattgtggtgttccagaatggtagagtcaaggaacacggaactcaccaacaattgcttgcacaaaagggcatctacttctccatggtgtcggtgcaagctggtacccaaaacctt

SEQ ID NO: 7616 - DNA, 3858 bp, Artificial Sequence
  Description of Artificial Sequence: Synthetic coding sequence
atggatttggaagccgccaaaaatggaactgcttggcgaccaacgagcgcagagggcgacttcgaactgggaatcagcagtaagcaaaagcgtaagaagactaagactgtgaagatgataggcgtcctgaccctattccgttacagcgactggcaagacaagctgttcatgtctttaggcactatcatggccatagcacacgggtctggcctacctctcatgatgatagtgttcggggaaatgaccgataagttcgtggatactgctggcaacttttctttccccgtcaatttctccttatcactgctgaaccctggtaagatccttgaagaagagatgacaaggtatgcctactattattctggcttaggtgccggagttttggttgctgcatacattcaggtctctttctggactcttgcggcgggtcgtcagattcgtaaaatacgccagaaattttttcatgctatccttaggcaggagataggctggttcgatattaatgacaccactgagctgaatacacgtcttactgacgatatttccaagattagcgaggggatcggagacaaggtgggaatgttctttcaagcagtagctacttttttcgccggattcatagtgggattcatccgcgggtggaagctaactctggtgatcatggctatcagccccatactggggctatcagccgctgtgtgggccaagattttgagcgcattcagtgataaggaacttgcagcatacgctaaggccggggcagttgccgaagaggcgctgggcgcgatacgcactgtcatcgctttcggaggccaaaacaaggaactagagagatatcagaagcacctcgagaatgcgaaggagattgggataaaaaaggctatctcagccaacatcagcatggggatagcctttcttcttatttacgcctcttatgcgttagccttctggtacggtagcacactggttatcagcaaagagtacacgatcgggaatgcgatgaccgtgtttttcagcatccttatcggagcattttcggtgggtcaagcggccccttgcatagacgcgtttgctaatgcacgaggtgctgcgtatgtgattttcgacattattgataacaatcccaagatcgactcgttctctgagaggggccataagcctgatagcatcaagggaaacctggagtttaacgacgtacatttcagttacccctctcgcgctaacgttaagatactcaaaggcttaaacctgaaggtacagagtggacagacagtggcgctagtggggtctagtggttgtgggaaatccacgacagtccaactgattcaacggctctatgaccctgatgaggggactattaatatagacggacaggatattcggaactttaatgtaaattatctccgggagatcattggggtagtatcacaagaaccagtcctcttttctactacaatcgctgaaaatatttgctatgggcggggaaacgtgaccatggatgaaatcaagaaggccgtgaaagaggccaacgcctatgaattcatcatgaagctgccacaaaagttcgacaccttggtgggggagcggggggcccagctctcaggagggcagaagcagcggattgcaatcgcccgagctctggttagaaacccaaagattctactgctcgatgaggcgacctccgccctggatactgaatcagaagcggaggttcaggccgcactcgataaagctcgcgaaggtcgcaccacaattgtaattgcccacagactgagcaccgttaggaacgcggatgtgatagccggcttcgaagatggggtgatcgtggaacaaggatcccattctgaactgatgaagaaagaaggtgtgtatttcaaactggtgaatatgcagacatccggctcacagatccagagtgaagaatttgagcttaacgacgaaaaagcggccacaaggatggctccgaatggctggaagagtcgactgtttcgtcacagtacacagaagaacctgaagaactcccaaatgtgtcaaaagtccttggatgttgagactgatgggcttgaggcaaatgtgcccccggtctcatttctgaaggtgctgaagctgaacaagacagaatggccctactttgttgtaggcacagtttgtgccatagccaacggaggtcttcagcctgccttcagcgtgatttttagtgaaattatcgctattttcggtccgggcgatgatgcagtgaagcagcaaaagtgtaacatatttagcctcatctttctttttctgggaatcatttcattttttacatttttcctccaggggtttacgttcggtaaagcaggtgaaatcctcacgcggaggttgagatctatggcgttcaaggccatgcttaggcaggacatgtcatggtttgacgatcataaaaatagcacaggagctctttcaaccaggctggccaccgatgcggcacaagtccagggggccactggaacgaggctggctctgattgcccaaaatattgcaaacttgggtacaggcatcatcatttcctttatctacggctggcagttaacactcctgttactggccgttgtgcccatcatcgctgtgagtggcatcgtagagatgaagctgctcgccgggaacgccaagcgggacaaaaaggagctggaagcggcagggaagatcgcaaccgaggcgatcgaaaacatccggaccgttgtgagccttacccaggagcgcaaattcgaatctatgtatgtcgagaagctctatgggccataccgcaattccgttcagaaggcccacatctacggcattacttttagcatctcacaagcctttatgtacttctcctacgctgggtgttttcggtttggtgcctatctaatcgtgaatggccacatgaggttccgggatgtgattctagttttctcggcgatcgttttcggtgccgtcgccctgggtcatgctagctcatttgcacccgattacgccaaggcgaagctctctgctgctcatctgttcatgctgtttgagaggcagccactgatagacagttattcagaggaaggtttgaaacctgacaagttcgaaggcaacataacttttaatgaggtagtgtttaactaccccaccagggcaaacgtgccagttctgcagggattatccttggaagtgaaaaaaggacagaccttggcattggtaggcagctctggatgcggcaaatccactgtggtacagctgcttgagaggttttatgatccactggccggcactgtatttgttgactttggcttccagctcttggatggccaggaagcaaaaaagctcaacgtacagtggctccgagcgcagttaggcatcgttagccaggagcccatattgttcgactgttctattgccgaaaacattgcctacggagataattcgcgcgtcgtaagccaggacgagattgtctcggctgccaaagctgccaatatccaccctttcattgaaacactgcctcataagtacgaaacacgcgtgggcgataagggaacgcaactctctggcggccaaaaacagaggatcgctatagcaagggcactcattcggcagccgcagatacttttgctcgacgaggcgacttccgcccttgacaccgagagtgagaaagtagtgcaggaagcgcttgacaaggctagggaaggcaggacatgtatcgtgatcgcccataggttatcaacaatccaaaatgctgacctgatcgtcgtatttcagaacggaagggtgaaagagcacggcactcaccaacaactgctcgcccaaaaaggcatttacttttccatggtgtccgtgcaagccggcacacagaacctt

SEQ ID NO: 7617 - DNA, 3858 bp, Artificial Sequence
  Description of Artificial Sequence: Synthetic coding sequence
atggacctggaagccgccaagaacggcaccgcctggaggccgacatccgccgaaggagacttcgaactaggaataagcagcaaacagaagcgaaaaaagaccaaaacagttaaaatgatcggtgtgctgacactgttccggtacagtgattggcaagacaagctgtttatgtctctgggtaccatcatggccattgcacacgggagcggcttgcccctcatgatgatcgtgttcggcgagatgaccgacaagttcgttgacacagccggtaatttctcatttccagtgaacttttccctgagcttactcaacccagggaaaatactggaagaggaaatgacacgctacgcttattactacagcgggctgggcgccggagttctggtggcagcatatatacaggtcagtttctggaccctggccgccggaagacagatcagaaagataagacagaaattctttcatgccatcctgaggcaggagattggatggttcgacattaacgacactactgaactgaatacaagactcaccgacgatatctcaaagatatccgaaggtattggcgataaggtcggaatgttctttcaagcagttgccacctttttcgccggattcatcgtcggtttcattcgcggatggaaattgacactagttattatggccatttcccctatactcggcttgagtgctgcagtgtgggccaagattctgagtgcattttccgacaaagagttagcagcctacgccaaggctggggctgttgccgaagaggccctgggagctattcggaccgtgatcgctttcggtgggcagaataaagagctcgagcggtaccagaagcacctggaaaacgccaaggagatagggatcaagaaggctattagtgccaacatatccatgggcattgcctttcttctgatttacgctagttatgctctagcattttggtatggctctaccctggtgatctctaaggagtatactattggcaacgccatgacagtgttcttctctatcctgatcggagctttttccgttgggcaggctgccccatgcatcgatgccttcgctaatgcccgtggcgccgcatatgttatattcgacattattgacaacaatccaaaaatcgattcctttagcgaaagaggccataagccagacagcatcaagggcaatctggagtttaacgatgtgcattttagttatccatctcgagcaaatgtcaagattctaaagggcttaaacttaaaggtccagagtgggcagactgtggccttggttggcagttcagggtgtggaaagtctaccactgtccagctgattcagcgactctacgaccccgatgaaggcaccatcaacatagatggacaagacatacgaaattttaatgttaactatttacgagagattatcggtgttgtgagccaggagccagtgcttttttctacaactatagcagagaatatctgctatgggcgcggtaacgtgactatggatgagattaagaaagctgtcaaggaagccaatgcctacgaattcattatgaaacttccacagaagtttgatacactagttggcgaacgaggggctcagctgagtggggggcagaaacagcgtattgccatagctcgcgcactggttagaaaccccaagattctgctgctggacgaagccacaagtgccctagacaccgagtccgaagcagaggtacaagccgcactggacaaagcacgggagggcagaactacaattgttattgcccatcgtctctctaccgtgaggaatgcagatgtgatcgctggatttgaggacggcgtgatagttgagcaaggctctcactccgagctgatgaagaaggagggggtatactttaaactggtgaatatgcagacatctggctcccagatccagagcgaggaattcgaacttaacgatgagaaagcagctactcgaatggcaccaaatggctggaagtcccggctatttagacattcaacccagaagaacttaaagaacagccagatgtgccagaagtctctggatgtggaaaccgatggcctggaagccaatgtgccacctgtgtccttcctgaaggttttgaagttgaacaagacagagtggccctacttcgtcgttggaaccgtgtgtgccattgcaaatggcggcctgcagcccgctttcagtgtgattttctctgagatcatcgccatatttggccccggcgacgatgcagtcaagcaacagaagtgcaacatcttcagcctgatcttcctgttcctgggaattataagctttttcacatttttcctgcaagggtttactttcggcaaggccggggagatcctaactcgacgtctgagaagcatggcttttaaggccatgctgcggcaggatatgtcttggttcgacgaccataagaactctactggtgccttatcaacccggttagccacagacgctgctcaggtgcagggcgctaccgggacccggctagccctgattgctcagaatattgccaatctgggcactggcatcattatatcttttatctacggctggcagctcactctgttgctactggctgtggtgcctatcatagctgtgtccggaatagttgaaatgaagctactggcaggcaatgcaaaaagggataaaaaagaactggaggctgccggcaaaatagccaccgaagccatcgaaaatattaggacagtggtcagtctgacacaggagcggaagttcgaaagtatgtacgtggagaagttatacgggccataccgtaatagcgtccaaaaggcacacatttacggcatcactttttctattagccaagctttcatgtatttctcttacgccgggtgcttccgcttcggcgcttacctgattgtcaatggtcacatgaggtttagggacgtcattctggtgttttctgcaatagtgttcggggccgttgccctgggacatgcctcatcattcgccccagactatgcaaaggctaagctctccgcagcccacctattcatgctcttcgagcggcaaccactcatagacagctactctgaggaggggttaaagcccgacaaattcgagggcaacataacttttaatgaggtggtgtttaactatcctactcgcgcaaatgtgcccgttctgcagggcctgtccttagaagtgaagaagggtcagactctagctctagtgggcagtagcggatgtggcaagtctactgtcgttcagttactggagcgcttctacgaccctttggccggtacagtgttcgtagattttgggttccagctgctggatgggcaggaggccaagaagcttaatgtgcagtggctacgagcccaacttgggatcgttagtcaggagccaattctattcgactgctctattgcagaaaatatcgcatacggagataacagtcgggtggtatctcaggatgaaatcgtgagtgccgccaaggctgccaacattcaccccttcatagagactttacctcacaagtatgagacccgtgttggagacaagggtacacagctgtctggcgggcagaaacagagaattgcaattgcccgcgcattaattcgccagcctcaaatcctgctgttagacgaagccacttccgcactcgacaccgaaagtgagaaggtagtgcaagaggcacttgataaagccagagagggccggacttgcatcgttatagcccatcgtctgagcacaatacaaaacgccgatctgatagtggtttttcaaaatgggagggtcaaagagcatggcacccaccagcagttactggcacagaaaggcatatatttcagcatggtgagcgtccaggccggcacacagaatctc

SEQ ID NO: 7618 - DNA, 3858 bp, Artificial Sequence
  Description of Artificial Sequence: Synthetic coding sequence
atggatctggaagccgcaaagaacggtacggcatggcggccgacctcggcggaaggtgattttgagctgggaatttcctcaaaacaaaagagaaagaaaaccaagactgtgaagatgattggtgtcctgaccctcttcaggtacagcgattggcaggacaagttgtttatgtcgctgggtactatcatggcaatagcacacggatcaggcttgcccctcatgatgatcgtgtttggggaaatgactgacaaattcgtggacaccgccggaaacttctcctttccggtgaacttctccctttcccttctcaatcccggcaagattttggaggaagagatgacgcgatatgcatactactactccggtcttggagctggagttctggtggctgcatacatccaggtttccttctggactctggcagctggacggcaaatccggaagatacgccagaagttctttcacgcaattcttcgtcaagaaataggctggtttgatatcaatgacaccaccgagcttaacacccgactgaccgatgatatctcgaagatttcagaaggaattggtgataaagttggaatgttctttcaagccgtggccaccttctttgccggattcatagtggggtttattcggggttggaaactcactctggtgatcatggccattagccctatcctcggtctttcggcagctgtgtgggctaagatactctccgcgtttagcgataaggaactggcggcatacgcaaaggctggcgcagtggcagaggaagcgctgggcgcaatcagaactgtgattgcattcggaggccaaaacaaagaactcgaaagataccagaaacatcttgaaaatgcaaaggagattggcataaagaaagcaatctcagcgaacatatcgatgggtatcgcttttctgctgatttacgcttcatacgcactggcattttggtacggttcgaccctggttatttccaaggaatacaccatcgggaacgcaatgactgtgttctttagtattcttatcggggcattttcggtgggacaagctgcaccatgtattgatgcatttgcaaacgcaagaggagcagcatacgtgattttcgacataatcgacaataacccaaagatcgattcgttttctgagcgtggacacaagccagactccattaaaggaaatcttgagtttaatgatgtgcatttctcatacccatccagagctaacgtgaagattcttaagggactgaatctgaaggtgcagtccggtcagactgtcgcccttgtaggatcctcggggtgcggtaagtctactactgttcaacttatacagcgcctttacgatccagacgaaggtaccatcaacatcgacggtcaggatatacgtaacttcaatgtgaactacttgagggagatcatcggcgtggtatcccaagagcctgtcctgttttcgaccaccatagcggagaacatatgctacgggagaggtaatgtcactatggacgaaatcaagaaggcagtcaaggaagcaaacgcatacgagtttatcatgaagctcccacagaagtttgacacccttgtgggagaaagaggggcccaactgtccggagggcagaagcagagaattgcaatcgcacgtgccctcgtgcggaaccctaagatactccttctggatgaggcaacctccgcacttgatactgaatcggaagctgaggtacaggcagcacttgataaagcgcgggagggccgaaccactattgtgattgcacatagattgagtactgtccgaaatgccgatgtcattgccggattcgaagatggggtgattgtcgaacagggatcgcacagcgagcttatgaagaaggagggagtgtacttcaaactggtcaacatgcagacttcaggatcccaaatccagtctgaagagttcgagctgaatgacgaaaaagcagcgactcgcatggctcccaatggatggaagagcagacttttccgacattcaacgcaaaagaacctgaagaacagtcaaatgtgtcaaaagtcactggatgtcgaaactgatggtcttgaggcaaacgtgccccctgtgtccttcctgaaggtgcttaagctgaataagacggaatggccgtactttgtcgtcgggaccgtatgcgccatagccaacggcggactccaacctgctttttcagtcatattctctgagataattgccatttttggtcctggagatgacgccgtgaaacaacagaaatgtaacatcttttcgttgatatttctgttccttggaatcatttcctttttcacgtttttccttcaagggtttacttttggaaaagccggcgaaatcctgactcgcagactgcgcagcatggcattcaaggccatgctcaggcaagatatgagctggtttgatgaccacaagaatagcaccggtgcacttagcacccgcctggcaaccgacgccgctcaggtgcaaggagcaactggtaccaggcttgcacttattgcccaaaacatcgctaatcttgggacgggtatcataatcagcttcatttacggctggcaacttacccttttgctgctcgcagtggtgcccatcattgcggtgtcgggaattgtggaaatgaaactgctggccgggaacgcaaagagggataagaaggaacttgaggcggctggtaagattgcgaccgaagccattgaaaacattcggaccgtcgtgtcgcttacccaggaacgcaagtttgaaagcatgtatgtggaaaagttgtacggaccgtaccgaaattcggtgcaaaaagcacacatttacggcatcacttttagcatttcccaggcattcatgtatttctcatacgccggatgtttccggtttggggcctaccttattgttaatggccacatgcgcttcagagacgtcattctcgtcttttccgcaatcgtctttggtgcagtggcactcggccatgcctcatcgtttgctcccgattacgcaaaagcgaagctgtccgctgctcatctgtttatgttgttcgaacgccaacctcttatcgactcgtactcggaagagggccttaagcctgacaagtttgaaggaaacattaccttcaatgaagtggtctttaactacccaactagggcaaacgtccccgtgctgcaaggtttgtcacttgaagtgaagaaaggccagacgctggcactcgtgggatcatccggttgtgggaagagcactgtggtgcagctccttgaacgcttttacgatccgctggctggaaccgtgtttgtggattttggatttcagttgctggacggtcaggaagcaaaaaagctcaacgtccaatggctgagggcacaactgggtattgtctcccaggaacctattctttttgattgcagcatcgccgaaaacatcgcttatggcgacaatagcagagttgtgtcccaagacgaaatcgtcagcgcagctaaagcggcaaacatccatccctttattgaaacgctccctcataagtatgaaactcgcgtgggggataagggaacccagctgtcgggaggacaaaaacaacgcattgcgattgcgcgggcgctcatccgccaacctcaaattctcctcctggacgaggccacttctgcactcgataccgaatcggaaaaggtcgtgcaggaggcactggataaagcacgggaggggagaacttgtatcgtgattgcccatagactgagcactattcaaaatgcggatttgattgtggtgtttcaaaacggcagagtaaaagaacacggaacccatcagcagcttctcgcacaaaaaggtatttacttttcgatggtaagcgtccaggcgggaacccaaaacctc

SEQ ID NO: 7619 - DNA, 3858 bp, Artificial Sequence
  Description of Artificial Sequence: Synthetic coding sequence
atggacctggaagctgctaagaacggaaccgcctggcggccaacatccgccgagggcgacttcgagcttggaatatcctctaagcagaagcgcaaaaaaaccaagaccgtgaaaatgatcggagtcctgacactgttccgatacagcgactggcaggataaactctttatgtcacttggtactatcatggcaattgctcacggctctgggctgcctctcatgatgatcgtcttcggcgagatgactgataaatttgtggatactgccgggaattttagttttccggtcaattttagtctcagcctcctcaacccaggcaaaattcttgaagaagagatgacacgctatgcttattactacagcggactaggcgccggcgtcctcgtagccgcctatatccaggtgagcttctggaccctcgcagcgggcaggcagatcaggaagatcagacagaagttcttccacgcgatcctgcgccaggaaatcggctggtttgacataaacgatactacagagctgaatacccgactcacagacgacatttcgaaaatatcagagggaataggcgataaagtgggaatgtttttccaggctgtagccaccttcttcgcgggtttcatcgtgggattcataagagggtggaaactcacactcgtgataatggctatctctcccatcctgggactcagcgcagccgtctgggctaagatcctcagtgcctttagtgacaaggaactagcggcatacgccaaagcaggggccgtggcagaggaggccctcggggcaattcggactgtcatagcctttggaggccagaataaggagctcgaacgatatcagaaacatctggaaaacgctaaggagattggaattaaaaaggcaatatctgcaaacatctccatgggtattgctttcctactgatctatgctagttacgccttggcattttggtatggatcaacactggtcatctccaaagaatacactattggcaacgccatgactgtattcttttccattctgataggtgctttctccgtcggacaggctgctccctgcattgacgcatttgctaacgcccgtggagcagcttacgtgatcttcgatatcatcgacaataaccctaaaatcgattcgttctctgaacggggacacaagcctgatagcataaaaggaaatctggaattcaacgacgtacacttcagctatccaagtagagctaatgtgaaaatcctcaaggggcttaacttgaaggttcagtctggacagacagtggcacttgtaggcagctcaggctgtggtaagtccacgaccgtgcaacttatccagagactatatgatcctgacgaaggcaccataaatatcgatggacaagacatccgtaattttaatgtcaattacctgagagaaattatcggcgtggtcagccaggagccagtgttattttcaacgaccatcgccgagaatatttgctacgggagggggaatgtaacgatggatgagattaaaaaggctgtgaaggaggccaatgcatatgagttcatcatgaagcttccccaaaagttcgacactctggtaggggagagaggcgcccagctgagcggcggtcagaaacagcggattgccattgcccgggcccttgtgcgcaatccgaaaatactccttctggacgaggcaacatctgcattggacacggaatccgaggctgaggtgcaggccgccctggataaagcaagggaaggtcggaccaccatagtgatcgcacatagattgtcgactgtaaggaatgccgatgtcatagctggcttcgaggacggagtcatcgtcgagcaggggtctcatagcgaactgatgaagaaggagggagtctacttcaagctagtcaatatgcagacctcaggttcgcaaatacaatcagaggagttcgaactgaacgacgagaaagccgcaacccgcatggccccaaacggatggaagtcccgcctttttcggcatagcacccagaaaaacttgaaaaacagccagatgtgtcagaaatccttagacgtggaaaccgacgggctcgaggccaatgtgccccctgtctcctttctgaaagtcttaaaattaaacaaaaccgagtggccatacttcgttgtgggcactgtttgcgctatcgcaaacggtgggctccagccagccttctcggttatattcagcgagatcattgccattttcgggcccggagacgatgccgtgaaacagcagaagtgtaatatcttttctctgatctttctgtttctaggcatcatcagcttcttcacattttttctccaggggtttacctttggcaaagcaggggagatccttaccaggagactcagaagcatggcctttaaggccatgcttagacaggatatgagctggtttgatgaccacaaaaatagcaccggagctctctccactagactggcgacagacgccgcccaggttcagggggcaaccgggacccggctggcacttatcgctcagaatattgccaacctagggaccggaatcattatttcgttcatatatggttggcaactgaccctgctcctgttggcggtcgttccaatcatcgcagtctccgggattgtcgagatgaagctgctggcaggaaatgccaagcgcgataaaaaagaattagaagccgccggaaagatcgccacggaggccatcgagaatattagaaccgttgtgtccctgacccaggagcgtaagttcgaatctatgtatgtagaaaaattgtatggaccttataggaatagcgtacagaaggctcacatctatggaattaccttcagtatttcccaggcattcatgtatttttcttacgccggatgctttcgttttggtgcttacctaatagtgaatggccatatgaggttccgcgacgtgatactggtgttcagtgctattgtgtttggtgctgttgctctgggccacgcaagctcattcgccccagactacgcaaaggcgaagctcagcgctgcccatttgtttatgctgttcgagcggcagccactgatcgatagctatagcgaagaagggcttaagccagataaatttgagggcaacattacttttaacgaggtcgtcttcaactaccccacgagagcaaatgtccccgtgctgcaaggcctctcgcttgaggtgaagaaaggacaaacactagccctcgtgggatcaagcggatgcggaaaaagtacggtggttcagctgctggagaggttttatgatccgttggcaggcacagtgttcgtggacttcgggtttcagctattagatgggcaggaggcaaagaagcttaatgtgcaatggctgagagcccagctgggcatcgtgtcccaggagccaatcctcttcgactgttcaatcgcagaaaacatcgcatatggcgataactcaagagtggtgtctcaagacgaaattgtgtccgcagctaaggctgccaatattcatccattcatagaaacattaccccacaagtatgagactcgcgtgggggacaaagggactcaattgtctggtggccagaagcagcggatagctatcgcccgggcactcatccggcagccacaaatcctactgctcgacgaggccactagtgcccttgataccgaatcagaaaaagttgtccaggaagcacttgataaagctcgggaggggcgcacctgcatcgtaatagcccataggctgagcacaattcagaatgctgacttgattgtggtgttccagaatggcagggtcaaggaacatgggacacatcagcagttgctggcacagaaaggaatatactttagcatggtgagcgttcaggccgggactcaaaacctc

SEQ ID NO: 7620 - DNA, 3858 bp, Artificial Sequence
  Description of Artificial Sequence: Synthetic coding sequence
atggacttagaagcagcaaagaatggtactgcctggaggccaacatctgctgaaggcgattttgaattaggcatctcctctaagcagaaaaggaagaagactaagacagtgaaaatgatcggcgtgcttactttgtttcgttattcggattggcaagacaagctgttcatgtctctcggcacaataatggccattgctcatggatctggtctcccgttgatgatgattgtgttcggtgagatgaccgacaagttcgttgatacagcaggcaacttttcattccctgtcaactttagcctctcgttgctaaatcccggaaagattctggaggaagagatgactaggtacgcttactactactccggtttgggagctggcgtgttggtcgctgcgtatatccaagtttcattttggactctcgcagcaggacggcaaatccgtaaaatccgtcaaaagttctttcacgctatactaagacaggaaattggatggttcgatataaacgatactacagaacttaacacacgcctgactgatgacatttctaaaatttctgaaggtattggtgacaaggttggaatgttcttccaggctgtggccactttctttgctggttttattgttggctttataaggggttggaagctcaccttagtgataatggcaatatcccctattttgggactaagcgcggctgtttgggctaagatactttcagcttttagtgataaggaactcgctgcttatgctaaggctggtgctgttgctgaagaggctcttggggccattcgtaccgtcatcgcatttggtggccaaaacaaagaacttgaacgatatcaaaaacacctagagaatgccaaagaaatcggaattaaaaaggcaatatctgctaacatatcgatgggtattgcttttctccttatatatgctagttacgctttggccttctggtacgggtcgacccttgtaatctccaaagaatatacaatcggcaatgctatgaccgtttttttttccattctgatcggcgctttttctgtcggacaagcggctccctgcattgatgccttcgcaaatgctcgtggtgcagcttacgtgattttcgacataatcgataataaccctaaaattgatagcttctccgagaggggacacaagcccgattcaattaagggcaatctcgagtttaatgatgttcacttttcgtaccctagtagagccaacgttaagatcttgaaaggccttaacctgaaagttcagtcagggcaaactgtggctttggttggcagtagcggctgcgggaagagcaccaccgttcaattgattcagaggttgtacgacccggatgaaggtacaattaatatcgatggacaagacatacggaatttcaacgttaactatttacgtgaaatcatcggtgttgtttcccaagaaccagtgctgttctcgaccacaatcgctgaaaacatctgctacgggaggggaaacgtgactatggacgaaatcaagaaagcagttaaagaggctaatgcatacgaattcatcatgaaattgcctcaaaaatttgatacactggtgggagagaggggtgctcagttatccggaggccaaaaacagcgaatcgctatcgctagagcattggttagaaatcctaaaattttgctcctggatgaagctacatctgctcttgatactgaatctgaggctgaggttcaggctgcacttgacaaggcaagggaaggaaggacaactattgttatagcacacaggttgagcacagtgcgtaatgccgatgtgattgctggatttgaagatggcgttatcgtggaacaaggatcacactctgagttgatgaagaaggaaggtgtgtactttaagttggtgaacatgcagacttcaggttcccaaatacagtcagaggaatttgagctcaatgatgaaaaagccgcaacaagaatggcacccaacgggtggaaatccaggctgtttcgacatagtacccagaaaaatttgaagaactctcaaatgtgccaaaaatccttggacgtcgaaaccgatggccttgaagcgaacgtccctcccgtgagtttcctaaaagtactgaaactaaataaaacagaatggccttattttgtagttggcactgtgtgtgctattgctaatggtggacttcaaccagcttttagcgttatattttctgaaataatagctatcttcggccctggtgatgatgcggttaagcaacaaaagtgcaatattttctcactcattttcctctttttgggtataatttcatttttcacattttttttgcaaggtttcacattcggtaaagccggtgagattctcacgaggcgtcttagatctatggcctttaaggctatgctacgtcaggatatgtcttggttcgatgatcataaaaactcaactggtgcccttagtacaaggcttgctaccgatgctgcacaagttcagggtgctacaggtactcgtttggcattgattgctcagaacattgctaatcttggaacaggtatcataatatccttcatttacgggtggcagttaacattgttgctgcttgcagtggtccctatcatcgcggtctccgggatcgttgaaatgaaattactagctgggaatgctaaacgagacaaaaaggagctcgaagcagccggaaagattgccaccgaggcaatcgaaaatattaggactgtagtttcattgacgcaggaaaggaaatttgaaagcatgtacgtcgagaaactttatggaccataccgaaatagcgtgcagaaggcgcacatctacggtatcactttttctattagccaggcatttatgtatttcagctacgcaggttgctttaggttcggagcttacttgatcgtaaatggacacatgaggttcagagacgttattcttgtctttagtgcaattgttttcggagcggttgccctcggtcacgccagttctttcgctcccgattatgccaaagccaagctttccgctgctcatttgttcatgctatttgaacgccagcctcttattgattcttattcggaagaaggattaaagcctgacaagtttgaaggcaacatcactttcaatgaggttgtgttcaactacccaaccagggcaaacgttcctgttcttcagggactatcattagaggttaagaagggccaaaccctagcgctcgttggatcgtctggttgcgggaaaagtaccgtagttcaactcctcgaacgcttctatgatcctctagctggcacagtgtttgttgacttcggattccaacttctggacggtcaggaagctaaaaagcttaatgttcagtggttacgtgctcaactagggattgtgagtcaggagccaattcttttcgattgcagtatagcagaaaatatagcctatggtgataattccagagtggttagtcaagatgagatcgtgtcagccgctaaagctgctaacatccatcccttcatcgagacattgcctcacaagtacgagacacgtgttggggacaaaggtacgcaactaagcggtggacagaagcagagaattgctatagccagggcactcatcagacaaccacagatattgttgctggatgaagctacttccgctttggacaccgaaagtgagaaggtggttcaggaggctcttgataaggctagagaggggaggacctgcatcgtcattgctcacaggctaagcacaattcaaaacgcggacctcatcgtagttttccaaaatggtcgtgttaaggaacatggcacccatcagcaacttctcgcacaaaaggggatctatttttcaatggtcagcgttcaggccgggacccagaacttg

SEQ ID NO: 7621 - DNA, 3858 bp, Artificial Sequence
  Description of Artificial Sequence: Synthetic coding sequence
atggaccttgaagccgcgaaaaatggcactgcgtggaggccaacctctgcagaaggtgattttgagctgggcatctcaagtaagcagaaacggaagaaaaccaagacagttaaaatgataggcgtcctgacgctgtttagatacagcgactggcaagacaagcttttcatgagccttggaactatcatggctattgcccacggatctggcttgccactcatgatgatagtttttggagagatgacggataagttcgtggacacggccggcaattttagctttccggtgaacttcagtctcagtctgctcaatcccggcaagatcctggaggaagaaatgaccaggtacgcttattattactcgggcttgggagccggtgtcctcgtggcagcctatattcaggtttctttctggacacttgctgccggtagacagatacggaaaatccggcagaaattctttcacgccattctaagacaggagatcggctggtttgatattaacgatacgacggaactgaacacaaggttgaccgacgatatctccaaaatctccgagggtataggggacaaggtgggaatgtttttccaagcggtagccacattctttgcaggcttcattgtgggctttatccggggatggaagctgacactggtcattatggccatttcgcctatcctgggcctgtcagctgccgtgtgggccaaaatactaagcgccttctctgataaagaacttgcagcctacgcgaaggcaggagcagtagccgaagaggcactcggagccatccgcactgttattgcatttggtggccagaataaggagctggaaagatatcagaaacacttagagaatgcaaaggaaatcggaattaagaaagctatctcagccaacatctctatgggaattgcatttcttctcatatatgcatcctacgccctcgcattttggtatggatctacgctggttatctcaaaagaatacacaataggcaacgcaatgactgtgtttttttctatcctcattggtgccttcagtgtgggacaggccgcaccgtgcattgatgcctttgctaatgcgagaggagccgcatatgttatttttgacattatcgacaacaaccctaaaatcgacagttttagcgagaggggtcacaagccagattccatcaagggcaatctcgagttcaatgatgttcacttctcatatcctagtcgtgccaacgtgaaaatactgaaagggctgaacctgaaggtccagtcagggcagaccgtcgccttggtcggaagcagtggatgcggaaaaagtacgaccgttcaactgatccagcggctatatgatcccgatgaaggcacgatcaatattgatggccaagacatcagaaactttaacgtcaactacctcagggaaatcataggcgtggtttctcaggagcctgtgctgttctcaaccactattgccgaaaatatctgttacgggcgcgggaacgtaacaatggatgagatcaagaaagctgtgaaagaagcaaacgcctatgagttcataatgaaactgccacagaaatttgacacattggttggcgagagaggagcacagttgagcgggggccagaagcagagaattgctattgcgcgcgcgctcgtacggaaccccaaaatcctgttactggacgaggccacgagtgcccttgacacagagagtgaggccgaggtgcaagctgcgctggacaaggcccgtgaagggcgtactaccatagtgatagctcaccgtctctccacagtccgcaatgctgatgtcattgcggggttcgaagatggagttatcgtggagcaaggctctcacagcgagcttatgaagaaagagggcgtctacttcaaactcgtcaacatgcagacgtctggctcacagattcagagcgaagagttcgagttaaacgacgaaaaggctgcaacccgaatggctccaaatggatggaaaagtaggctgtttaggcattcgactcaaaagaacttgaaaaattcacagatgtgccaaaagagtctggatgtggagaccgatggattggaggctaatgtcccccctgtgagtttccttaaagtactcaaactgaacaagacagagtggccgtacttcgtggtaggtactgtctgcgctatcgcaaatgggggattgcagccggccttttctgtgatcttcagcgagatcattgctatttttggacccggagacgatgccgttaagcagcagaagtgcaatatctttagcctgatatttctatttctcgggattatttcctttttcacgtttttcttgcagggatttactttcggaaaagccggagaaattttaactcgccgccttcgaagcatggcatttaaagcaatgctgcggcaggatatgtcctggttcgatgatcacaagaattccactggagctttaagcacgaggttggcaaccgatgccgcccaggtgcagggtgccacggggacccgcctcgcattaattgctcagaatattgccaacctgggaacagggatcattattagttttatttatgggtggcaactcaccttactgctgctggccgtggtccccatcattgcagtttccggaattgttgagatgaaactcttagcgggaaatgccaaaagggataaaaaggaactcgaagctgcgggtaaaattgcaacagaggccatagaaaacatacggacagtagtgtctttaacccaagaacgaaaattcgaatcaatgtacgtggagaagctctatggtccttatcgtaacagcgtgcaaaaagcccacatatatggcatcacgttcagcatttcacaagcatttatgtattttagctatgcggggtgcttccggttcggggcctacttaatcgtgaatggacatatgagatttcgggacgtgattctggtttttagtgccatcgtgttcggagccgtggctctgggccatgcaagttccttcgcccctgattatgctaaggccaagttgtccgccgcacatctattcatgctcttcgagcggcagcccctcatagacagctattcagaagagggcctcaaacccgataagtttgaggggaatataacctttaatgaggtggtcttcaactacccgactagagcgaatgtacctgtcctccaaggactgtcactcgaagttaaaaaaggccaaacgcttgccttagtgggcagttccggttgcggaaagtcaacggtcgtgcagttgctggaacggttttatgacccgctggctgggactgtgtttgtagactttggctttcagttgttagatggccaagaagcaaagaaactgaatgtgcagtggctgcgcgcccagttgggaatcgtgtcccaagaaccaatcctctttgattgttctatcgcagagaatattgcctatggcgataactctagagtggtgagtcaggacgagatcgtgtctgcggcgaaagccgccaacatccacccattcattgaaactttaccccacaaatatgagacccgcgtcggagacaaaggaactcaactgtcagggggtcagaaacagcgaatcgctattgctagagctttgattcgacagccccaaatattgctcctggatgaagccacatctgcgctggacaccgaatcagaaaaagtagtgcaggaggcgctggacaaggctcgtgaggggcggacttgcattgtgatcgctcataggctcagcactattcagaacgccgacctgattgtggtattccagaatgggcgtgtgaaggaacatggcacacatcaacagctgctcgcccagaagggaatttatttcagcatggtatcggtccaggcaggcacccagaatctc

SEQ ID NO: 7622 - DNA, 3858 bp, Artificial Sequence
  Description of Artificial Sequence: Synthetic coding sequence
atggatctcgaagccgcaaaaaacggtacagcctggaggccaacatctgccgagggtgactttgaactgggcatctcttccaagcagaagaggaagaagactaaaactgtgaagatgatcggtgttctgaccctttttcgttactctgactggcaggacaaactgtttatgagcctcggtaccattatggccatagcccacggctccggactgcctttgatgatgatagtcttcggcgagatgaccgataagtttgtggacaccgcaggaaatttctctttccctgtgaacttcagtctctctttgctgaatcccggcaagattctggaggaagagatgaccaggtacgcttactattattccggtttgggcgcaggtgtcctcgtagctgcctacattcaagtatctttttggactctggccgcaggccgccagattcgcaagattcgccagaagttctttcatgccattttgcgccaagaaattggttggtttgacataaatgatacaaccgagctgaacactaggctgaccgatgacatcagtaaaatctccgagggtataggtgataaagtgggtatgttcttccaggctgttgccaccttcttcgctggtttcatcgtgggcttcatcagaggatggaagcttaccttggttatcatggccatctcccctatcctgggcttgtccgctgcagtgtgggccaaaattctcagtgcctttagcgataaggagctggcagcttatgccaaagcaggagctgtagccgaagaggcccttggcgctatcagaactgttatcgccttcggcggacaaaacaaggagctggaaaggtaccagaagcacctggagaacgctaaggagataggtatcaagaaggccatctctgccaacatcagcatgggaatcgcttttctgctgatttatgcctcttacgccctcgctttttggtacggatccactctggttatcagcaaggagtacaccatcggcaacgctatgaccgtgtttttctccattctgattggagccttttccgttggacaagcagctccatgtattgacgctttcgctaacgccaggggagctgcctatgtcattttcgacataatcgataataatcctaagatcgactccttctcagagcgcggtcataagcctgactcaatcaaaggtaatcttgagttcaacgatgttcatttttcctacccttcaagggctaatgtgaaaattctgaagggactgaacctcaaagtgcaatctggacagaccgtagcactggtgggatctagcggttgtggtaagtctactaccgtccaattgatccaacgtctctacgacccagatgagggtactattaacatagatggccaggatatcaggaattttaatgtgaactacctgagggagattatcggtgtggtttctcaggagccagtgctcttctccacaacaattgcagaaaacatctgttatggaagaggaaacgttaccatggatgagatcaaaaaggccgtcaaggaggccaacgcttacgagttcatcatgaaattgccccagaagttcgataccctggtgggcgagcgcggcgcacaactctcaggcggtcagaagcaacgtatcgccatcgcacgtgcccttgtacgcaaccctaagatcctgctccttgacgaagctaccagcgcacttgacacagaatctgaggctgaagttcaagccgcactcgacaaagctagagaaggacgtacaactattgtcatagctcacagactgtctacagtccgtaatgctgatgtgattgctggattcgaagacggagtcatagtggagcagggatcccattccgaactgatgaaaaaggaaggagtttactttaaactggttaacatgcagacctctggttcacagatccagtccgaggagtttgagctcaacgacgagaaggccgccaccaggatggcccccaatggttggaagtcccgcttgttcagacactctactcaaaagaatcttaagaactctcagatgtgtcagaagagcctcgacgtcgagacagacggtctggaggccaatgtgccacctgtctcattcctcaaggtactgaagctgaacaagaccgagtggccttattttgtcgtcggaactgtatgcgccattgctaacggcggcctgcagcccgcattctccgtaatcttctcagaaatcattgcaatcttcggacctggagacgatgccgtcaagcagcagaagtgcaatatcttcagtcttatcttcctctttctcggtataatctctttcttcactttttttctgcaaggcttcaccttcggtaaagctggagagatcctgactaggagactcaggtctatggctttcaaggccatgctgagacaggacatgagttggtttgacgaccataagaactccacaggcgcactcagcaccaggttggcaacagatgcagcacaagtgcagggtgctaccggaactagactggctcttattgcccaaaacattgccaatctcggaactggtattataatcagctttatttatggttggcaattgacactcctgttgcttgccgtggtgccaatcattgctgtctcaggaatcgtagaaatgaagcttctggcaggcaatgcaaagagggataagaaggagcttgaggccgctggaaaaattgctactgaggcaatcgagaacattcgcacagttgtatccctcacacaggaacgcaagttcgaaagcatgtacgtagagaaactttacggaccctaccgcaactccgtgcagaaggcccacatctacggcattactttctcaatttcacaggccttcatgtacttttcatacgctggctgcttcaggttcggcgcctacctcatcgtgaatggccatatgcgtttccgcgatgttatcttggtcttctctgccattgtgttcggtgctgttgccctgggtcacgcttcatctttcgctcctgattacgccaaggccaaactgagtgccgcccacttgttcatgttgttcgagagacagccactcatcgattcttactctgaggagggcctgaagcctgataaattcgaaggcaatataaccttcaatgaagtagtgtttaactatcccacacgcgctaatgtgcccgtgcttcagggcctgagcctggaagtcaagaagggacagactctcgctctggtgggatcaagtggctgcggcaagtcaactgtggtgcagctcctcgagaggttctacgacccacttgccggcacagtttttgtggatttcggcttccaactcctcgatggtcaagaagccaaaaagttgaacgtgcaatggctgagggcccagctgggtatcgtgagccaagagcccatattgttcgattgttcaatcgccgagaacatcgcttacggcgacaattcaagagtagtgtcacaggacgagatcgtcagcgcagccaaggcagctaacattcacccttttattgagaccctgccacataagtatgaaacaagggtaggcgacaaaggaacccagctttccggcggacagaagcagaggattgctattgcaagagccttgatcagacagccacaaatccttctcctcgacgaggcaacaagtgcacttgacacagagtctgagaaggtcgttcaggaagctcttgacaaggcccgcgagggacgcacctgtatcgttatcgcccaccgcttgtccaccatccagaacgccgatttgatagtcgtgtttcaaaacggacgtgtgaaggaacacggcactcaccagcaactgctcgcacagaagggtatatatttcagtatggtaagtgtgcaggctggtacccagaacctc

SEQ ID NO: 7623 - DNA, 3858 bp, Artificial Sequence
  Description of Artificial Sequence: Synthetic coding sequence
atggacttggaggctgccaagaatggtacagcttggaggcccacatccgcagagggcgacttcgagttgggaattagttcaaaacagaagagaaaaaagactaagaccgtgaaaatgattggtgtcctgactctgttccgttattccgactggcaggataaactttttatgagtttaggtactataatggctattgcacatggatcaggactgcctcttatgatgattgtttttggcgaaatgacagataagttcgtcgacaccgcgggcaatttcagttttcccgtgaacttctctctttctttgctcaaccccggaaaaatactcgaggaagaaatgacccggtatgcttattactatagcggattgggtgccggcgtgctcgtcgccgcctacatccaggtgtctttctggacgctcgcggccggaagacagattaggaagatcagacagaaattttttcacgctattcttcgccaggagattggatggtttgacattaacgacactacagaattgaacacccgcttaactgacgatattagtaaaatttccgaaggaatcggcgacaaggtgggaatgttttttcaggcggtggctacgttctttgcagggtttattgttggattcataagaggatggaagctcaccctggtaattatggccattagtcccattttgggcctgtccgcagccgtgtgggccaagattttaagtgccttcagtgacaaggagctcgcagcgtacgccaaggcgggcgccgttgccgaggaggccctgggcgctatccgcacagtgattgcctttggcggccagaacaaagaattggagaggtaccaaaagcatttggagaatgcaaaggaaatcggcattaagaaggcaatttctgcaaatatctctatgggtatagcattcctgcttatatacgcttcttatgcccttgctttttggtacgggagtactctggtgatcagtaaggagtacaccattggcaatgccatgacagtcttcttcagtattctcatcggagcctttagcgttggacaggcagcaccctgtattgatgccttcgccaacgcgcggggcgccgcttacgtgattttcgatataatagacaataatcccaaaatcgatagtttcagtgaacgcggccacaagcctgattcaatcaagggcaatcttgaatttaacgatgtgcacttttcatatccctccagagccaatgtgaagatactcaagggcctaaacctgaaggtgcagtctggacagacagtggctctggtcggttcttccggatgtgggaagagcaccaccgtgcagcttattcagcgtctgtatgatcccgacgagggaactattaacatcgatgggcaggatataaggaacttcaatgtcaactaccttagggagatcattggcgtggtctcgcaggaacccgtccttttttcaaccaccatagctgagaacatatgttatggaaggggcaacgtgacaatggatgaaataaagaaggccgtgaaagaagctaacgcctatgaatttatcatgaagctcccacagaagttcgatacccttgtaggtgagaggggagcccaattgtctggtgggcaaaagcagcgtatagctatagctagagcactggttaggaaccccaaaattctactcttagatgaagccacatcggctctggacaccgaatctgaggctgaagtccaagccgcactggacaaggctcgcgagggcagaactaccatcgttatcgctcacaggctgtccacggtgcggaatgcagacgtgattgcgggatttgaggatggcgtcattgtcgagcaggggtcccatagtgaattgatgaagaaagagggtgtttatttcaagctggtcaacatgcagacatccggatcccagattcagtccgaggagttcgaactgaacgacgagaaggcagccacgcggatggctccaaacggatggaagtcccgactgttcaggcattctacacaaaaaaaccttaaaaattctcagatgtgccagaagagcctcgacgtggagaccgatggtctggaggctaatgttccacccgtgagctttctgaaagtgctaaagctcaacaagactgagtggccctacttcgtggtaggcactgtgtgcgcaatcgccaatggtgggctgcagccagccttctcagtaatctttagcgagatcattgcgatttttggacctggtgacgacgcagtgaagcagcagaagtgcaacatcttctccctgatctttttgttcctaggaattatttcgttcttcacattttttctccaaggctttactttcgggaaagctggcgagatcctaacccggcgcttgcgttctatggcattcaaagctatgctcagacaagatatgagttggtttgacgaccataagaattccacaggagccctcagtacacgcctagcaactgacgcagcccaggtacagggcgccacaggaacgcgtctggccctcatagcccaaaatatagccaaccttggcacaggcattattatctcctttatatatgggtggcagctgacgctgctgctgctggctgtcgtccctatcatcgccgtgtcagggattgtcgaaatgaagctcctggccgggaatgctaagagggataaaaaggagctggaggcggccggcaaaatcgccacggaggcaatagagaacatcagaacagtggtgtctttaacccaggaacgcaagttcgagagcatgtacgtggagaaactttatggtccatatagaaacagtgtgcagaaagcccacatttatggtattaccttctctatctcccaggctttcatgtatttttcgtatgccggctgctttcggtttggtgcatatctaattgtcaatggtcatatgcggttcagagatgtgatattggtgttttcggcgatagtctttggtgcggttgccctgggccacgcttccagctttgctcctgactacgccaaagcaaaactgagcgccgcccacctgtttatgctctttgaaaggcagcccttgattgatagttacagtgaggaagggttaaaacccgacaaattcgaggggaatatcacgtttaatgaggttgtgttcaactacccgaccagggctaacgtgcctgtcctgcagggactgagcctcgaagtgaagaaaggccagactctagccttagtcggcagttccgggtgcggcaagtcaacagtggtccaactgctcgaaaggttctacgatccacttgcaggtacagtctttgtggattttggattccagttgttagacggtcaggaggccaaaaagctgaacgtccagtggttgcgcgctcagttaggaattgtgtcccaggagccaattctgtttgattgtagcatcgcagagaatatcgcctatggcgacaatagtagagtggtaagccaggacgaaattgtatcagccgccaaggccgctaacattcatcccttcatcgagaccctacctcacaaatatgagactagagtcggagataaggggacgcagctgtccggcggccaaaagcaacgaatagcgatcgcaagagcactcatcaggcagccccaaatcctgctgcttgacgaggcgaccagcgcccttgacaccgagtcggagaaggttgtgcaggaggctctcgataaagcccgcgaaggacggacctgtatcgtaatcgctcacaggctatctaccattcagaatgcggacctcattgtagtctttcagaatgggcgagttaaggaacacgggacacatcaacagcttttagcacaaaaaggcatctacttttccatggtgagcgtccaggccggaactcaaaacctc

SEQ ID NO: 7624 - DNA, 3858 bp, Artificial Sequence
  Description of Artificial Sequence: Synthetic coding sequence
atggaccttgaagcagcgaagaatggcactgcgtggcgtcctaccagcgcagagggtgactttgaactcgggatatcaagcaagcagaagcgaaaaaagactaaaactgtcaagatgattggagtcttgaccctgttcagatacagcgactggcaggacaagctgtttatgtcgctgggcactattatggcaattgcccatgggtcgggactgccgctgatgatgattgtctttggagaaatgaccgataagttcgtggacacggccggaaacttttcctttcccgtcaacttcagcctttcgctgttgaaccctggaaaaatcttggaagaggaaatgacccgatacgcatactactactcgggcctcggagcaggagtccttgtggcagcctacattcaagtgagcttctggactctggcagccgggcgccaaattcgcaagatcagacagaaattctttcatgcgattctgcgtcaagaaattggatggtttgacataaatgacactactgaattgaacactagacttaccgatgatatttccaagatcagcgagggaataggggacaaggtggggatgttttttcaagcagtggcaacttttttcgcaggatttatcgtgggtttcattagggggtggaagctgaccctggtgattatggcaatctcgccaattctgggactgtcggctgcagtctgggctaagattctgtcggcattcagcgacaaggagctggcagcatacgcaaaagcaggtgcagtcgcagaagaagccctcggcgccattaggacggtgattgcattcggagggcaaaacaaggaactggaacgataccagaagcacctggaaaacgccaaagagatcgggattaagaaagcaatttccgcaaacattagcatgggtattgcgtttctcctcatctacgcatcctacgcccttgcattttggtacggcagcacgctcgtgatttcgaaggaatacaccatcgggaacgcaatgaccgtctttttctctattcttatcggtgcattttcagtcggacaggcggcaccgtgtatcgacgcttttgcaaatgcacggggtgcagcttacgtgattttcgacataatcgacaataacccgaaaattgattccttttccgaacgcggacataaaccagactccattaagggcaaccttgagtttaacgacgtccattttagctacccttcgagagcaaacgtgaagatcctgaaaggactcaatctgaaggttcaaagcggccagaccgtggcattggtgggaagctcggggtgtggtaagagcactactgtgcagctgatccagcgcctgtacgatcccgatgagggaacgatcaatattgacggacaagatatcaggaactttaatgtcaactaccttagagagattataggtgtggtttcgcaagagcccgtcctgttttcaaccaccatagctgaaaacatttgctacggccgtgggaacgtgaccatggatgaaatcaaaaaggcagtgaaggaggctaatgcatacgaattcattatgaagctcccccagaaattcgataccctggtcggagagcgcggggcacaactgtctggtggacagaaacaacgtattgccattgcacgcgcactcgtgagaaaccccaaaattcttcttttggatgaggcaaccagcgcactggacactgagtcagaagctgaggtgcaagcagcccttgacaaagctagagagggtcgaaccactatcgtgatcgcacatcggctttctaccgtgcgaaacgctgacgtcattgcaggattcgaagatggggtgattgtggagcagggctcgcattcagagttgatgaagaaagaaggcgtgtactttaagttggtcaacatgcaaacctccggttctcaaattcagtcggaggaatttgaactgaacgatgagaaggcagccaccagaatggcaccaaatggatggaaatcccggctttttaggcactcgacgcaaaagaacctgaagaactcccaaatgtgtcagaagtcccttgatgtcgaaactgatgggcttgaggcaaacgtgccacccgtgtcgtttctcaaagtgctgaaactcaataagaccgaatggccttactttgtggtgggtaccgtgtgcgcaatcgcaaacggaggactgcagcctgcgttctccgtgatcttttcagagatcattgccatttttggaccgggggatgatgcagtgaaacagcagaagtgcaacattttctcgcttatctttctgtttctcggtatcattagcttctttaccttttttctgcagggatttactttcggtaaagcaggtgaaatacttaccaggcggcttagatcgatggcattcaaggcgatgctgcgccaagatatgtcatggttcgacgatcacaagaactccaccggtgccctgtcaacccgcttggcaaccgatgcagcacaagtccaaggcgcaactgggacccggcttgcactgatcgcacaaaacattgccaacttgggtactgggatcatcatctcgttcatttatgggtggcaactgaccttgttgctgctggcggtcgtgccgatcatagccgtgagcggtatcgtggaaatgaaactgctcgcaggaaacgcaaagcgggacaaaaaggagctggaggccgccggtaagatcgcaactgaggcaattgaaaacattagaaccgtggtgtcccttactcaagaaaggaaatttgaatccatgtacgtcgaaaaactttacggaccttatagaaattcggtgcagaaggcgcacatttatggaattacgttcagcatctcgcaggcattcatgtacttctcgtacgcgggatgttttaggtttggtgcatacctcatagtgaacggtcatatgagatttagagacgtgatcctggtgttctcggccattgtgttcggagcagtggccctgggccatgcaagctcctttgcaccagactatgcaaaggccaagctgtcagcagcacatcttttcatgctgttcgaacgacaaccacttatcgattcgtactccgaagaaggtctgaagccagacaaattcgaaggaaacataacctttaatgaggtcgtctttaactatcctacgcgggcaaatgtgcctgtcctccagggtctgtcactcgaagtcaagaagggtcaaacgcttgccctggtggggagctccggatgtgggaaaagcaccgtggtgcaattgctcgaaagattttacgatcccctcgcgggtaccgtttttgtggactttggatttcagctgttggacggtcaggaagcaaagaagctgaacgtgcaatggctgagggcccaactggggatcgtctcccaggaacctatcctctttgattgttcaattgcggagaacattgcgtatggcgataactcgcgcgtagtgtcgcaggatgagattgtttccgcagcaaaagccgcaaatatccatccgtttatagaaacccttccccataagtacgaaacgcgggtgggtgacaagggtacccaactctccggcggccagaaacaacggattgccatcgctcgtgcacttatcagacagcctcagatactgctgttggacgaagcaacctcggcccttgatactgaaagcgagaaagtggtccaggaagcacttgataaagccagagaaggtcgtacctgtattgtcattgcgcatagactgtcaactatccaaaatgcagatttgattgtcgtctttcaaaacggccgagtgaaggagcacggcacccatcaacagctgctcgcccagaagggaatctacttttcaatggtgtcggtgcaggcgggaacccaaaacctc

SEQ ID NO: 7625 - DNA, 3858 bp, Artificial Sequence
  Description of Artificial Sequence: Synthetic coding sequence
atggatcttgaggcagcgaagaatggtaccgcatggcggcctacctcagcagagggtgacttcgaactgggcattagtagcaagcagaagaggaaaaagactaagaccgtcaagatgattggtgtgctgacgctgtttagatactcagactggcaagataagctgttcatgtcccttggtactattatggctattgcccacggctcggggcttcccctgatgatgattgtgtttggggagatgactgataagtttgtggacaccgcgggaaacttctcgttccctgtgaatttctcgctttcccttctgaaccctggtaagattcttgaagaagagatgaccaggtacgcatactactactccggactgggcgcgggggtgctggtcgcggcgtatatacaggtcagcttctggactctcgctgcaggtagacagatccggaagattcgccagaaattcttccatgccattctgagacaagaaatcgggtggtttgacattaacgatactaccgaactcaatacccgcctcactgatgacataagcaagattagcgagggaattggggataaggtgggaatgttctttcaggcagtggccaccttttttgccggatttatcgtgggattcattaggggatggaaacttactcttgtaatcatggccatttcaccaattctcggtctgtcggcagcagtgtgggcaaagatactttcggcattttccgataaggaactggccgcatacgcaaaggccggagcagtggcagaagaagccctgggggcaattaggactgtgatcgcattcggcggacaaaacaaggaactggaaaggtaccagaagcaccttgagaacgccaaagagatcggtattaagaaagcgatttcagcgaacattagcatgggaattgcgtttctgctcatctacgcctcgtacgcactcgcattttggtacgggtctaccctggtcatttcaaaggaatacacgattggaaacgcgatgaccgtgttcttcagcatcctgataggtgcattttccgtgggacaagcagcaccttgtattgatgcatttgccaatgcaaggggagcagcgtacgtgatttttgacattattgacaacaaccctaaaatcgactcgttctccgaaagaggtcataagcctgattcaatcaagggaaacctcgagttcaatgatgtgcacttttcgtacccatcgcgagccaacgtgaagatccttaagggactgaatcttaaggtgcagtccggccaaactgtcgcccttgtcggatctagcggctgcgggaagtcaaccaccgtgcaattgattcaaagactctacgatcctgacgaaggaaccataaacattgatggacaagatatcagaaatttcaacgtgaactacctgcgcgagataattggcgtggtgtcacaggaacctgtcctcttttccactaccatcgcagaaaacatatgttacggccgtggtaatgttaccatggatgagattaagaaggcagtgaaggaagcaaacgcatacgaattcattatgaaactccctcagaaatttgataccctggtgggtgagcgaggagcgcagctgtccggagggcaaaagcagcggatcgctatcgcgcgcgcactggttagaaaccccaaaatcctgctgctggatgaggcaactagcgcactcgatacggagagcgaggcagaagtgcaagctgctttggataaggcccgcgagggtcgtactactattgtgattgcccataggctgtcgaccgtgcgcaatgcggacgtcatcgcaggattcgaagatggcgtgattgtggaacaaggttcccatagcgagcttatgaaaaaggagggagtgtactttaaactggtgaatatgcagacctcgggatcccaaatccaatccgaggaatttgagcttaatgatgagaaggcagccacccgcatggcaccgaatggatggaagtcccgtctctttagacattccactcagaagaatctgaagaatagccagatgtgtcaaaagtcgcttgatgtggagactgacgggcttgaagcaaacgtgccaccagtgtcctttcttaaggtgctgaaactcaacaagaccgaatggccctactttgtcgtcgggaccgtgtgtgccattgccaacggcggtttgcagcccgcattctcggtgatattcagtgaaatcatcgcaattttcggaccaggagatgatgcagttaaacaacaaaaatgtaatatcttttcactgatttttctgtttctcggcatcatctcgtttttcaccttttttctgcagggattcacttttggaaaggcaggagaaattctgactcggcgactgagaagcatggcgttcaaagcgatgttgaggcaagacatgtcgtggtttgatgatcacaagaactccactggagccctctcaacgagactcgcaaccgatgcagcgcaagtgcagggggcaaccgggaccaggcttgcactgattgctcagaacattgcaaacctgggaactggaattatcatttcgttcatttatgggtggcagcttactcttcttttgcttgcggtcgtccccatcatcgctgtgagcggcatcgtggaaatgaagctccttgcaggtaatgccaaaagagataagaaggagctcgaagccgcaggaaaaatcgcaaccgaggcgatcgagaacattaggactgtcgtcagccttactcaagagcgcaagttcgagagcatgtacgtggaaaaactgtacgggccttaccgcaattcggttcaaaaggcacatatctacggaattactttttcgatatcgcaggcattcatgtacttttcctacgcaggttgtttcagatttggggcatacctcatcgtgaatggacatatgcgctttcgtgacgtgattttggtcttttccgccattgtgttcggcgcggtggccctcggtcatgcatccagctttgcacctgattacgcaaaggcaaagttgtcggccgcccatctgtttatgttgtttgagaggcaacctctgatagatagctactccgaggagggtctgaaaccggataagtttgaaggaaacatcacctttaacgaggtcgtgttcaactacccaacgcgtgcaaatgtgcctgtccttcagggactctcacttgaagtgaaaaaggggcaaaccttggcacttgtgggttcatcgggatgtggaaaatccaccgtggtccaattgcttgagcgcttctacgatccccttgccggaaccgtgttcgtggacttcgggtttcagcttcttgacgggcaagaagcaaagaaactgaatgtgcagtggctcagagctcaactgggcatcgtctcccaagagcctatactgtttgattgttccatcgcggaaaacatcgcatacggcgataattcacgcgtcgtttcccaagacgaaatagtttccgccgcaaaagcagcaaacatacacccttttatcgagactctccctcacaagtacgaaacccgagtgggagacaagggtactcaactgtcgggtggccaaaagcaaaggattgcaatagcaagagcactcatccgccagccgcagatactcttgctggacgaggctacttcggcacttgacactgagagtgaaaaggtggtccaagaagcactcgataaggcaagggaaggtcggacttgtatagtgatcgcacaccggcttagcactatccagaatgccgatcttattgtggtgttccaaaatggacgtgtcaaagaacacgggactcatcaacagttgctggcacaaaagggaatttacttttcaatggtgtcggtacaagcaggtacccaaaacctt

SEQ ID NO: 7626 - DNA, 3858 bp, Artificial Sequence
  Description of Artificial Sequence: Synthetic coding sequence
atggatcttgaggctgcaaaaaacgggaccgcttggcgtccgacctccgcagaaggtgacttcgagctcggcatttcgagcaagcagaagagaaaaaagactaaaaccgtcaaaatgataggggtgcttacgctcttccgatactctgattggcaggacaagctcttcatgtctctggggaccattatggcgattgcccacggctccgggctcccacttatgatgatcgtgttcggagaaatgaccgataagtttgtcgacactgccggcaacttttcgttcccggtgaacttctccctctcccttttgaatcccggaaagattctggaagaagaaatgactagatatgcctattactactcggggctgggagcaggtgttctggtggcagcctacattcaagtgtccttttggaccctcgccgccggtagacaaattcggaagattcgacaaaagtttttccatgctatactgaggcaagagatcggatggttcgatatcaacgacactaccgaactgaataccagactcactgatgacatctccaagatttcggaaggaatcggcgataaggtcggaatgtttttccaagcggtggccaccttttttgctggttttatcgtgggtttcatacgggggtggaaactgacgctcgtgatcatggcaatttctcctattctgggacttagcgccgcagtgtgggcaaaaatcctgtccgcgttcagcgacaaagaactggcagcatacgcaaaggccggggccgtcgcagaagaggcccttggagcaatccgtactgtgattgcgtttgggggtcagaacaaagaacttgagcggtaccaaaagcacctcgaaaacgcgaaggaaattgggatcaaaaaagcaatttccgccaacatttcaatggggatcgcattccttctgatttacgcatcatacgcgctggccttctggtatggatccacgcttgtcatttccaaggaatacaccattggaaacgcaatgaccgtgtttttctccatccttattggagcattttccgtcggacaggcggcgccctgtattgatgctttcgccaatgcccgcggtgcagcatacgtgatctttgacataatagacaacaaccccaagatcgattcctttagcgaacggggtcacaaacccgactcgataaagggcaatctcgaattcaacgacgtccactttagctacccctcgagagcgaacgtgaaaatcctcaagggtctgaatctgaaggtgcaatccggtcagactgtggcactggtgggcagctcaggctgtggaaaatcgactaccgtgcaactgattcaacgcctctacgatccagacgaaggaaccattaacattgatggacaagacatcagaaatttcaacgtgaactaccttcgagagatcattggtgttgtgtcgcaagagcctgttctgttcagcactactatagcagagaacatttgttacggacgaggcaatgtcacgatggatgagattaagaaggcagtgaaagaggccaatgcttatgaattcatcatgaagttgccacaaaagttcgataccctcgtgggggagcggggtgctcagctttcgggcggtcaaaagcagcgtatcgcaatcgcaagggccctggtgagaaacccaaagattctgctccttgatgaggcaactagcgccctggatacggagtccgaagccgaagtccaggcagcacttgataaagcacgcgaaggacgcactaccatcgtcatcgcacatcgactttcgactgtgagaaacgccgacgtgatcgctggctttgaggatggggtgatagtggagcagggttcacattcggaactcatgaagaaggaaggggtgtactttaaacttgtcaacatgcaaacttcaggaagccaaattcaaagcgaggagttcgagttgaacgacgaaaaggcagccacgaggatggcacctaacgggtggaaatcgcgtctctttcgccattcaacccaaaagaatctcaaaaactcgcagatgtgccaaaagtccctggatgtggaaaccgatggtctggaagcgaacgtccctcccgtctcattccttaaggtgcttaagctgaacaagactgagtggccttacttcgtggtgggtactgtctgtgcgatcgccaacggtggccttcagcccgcatttagcgtcatctttagcgaaatcatcgcaattttcggcccgggtgatgatgcggtcaagcaacaaaagtgtaacatcttttcgctgatctttctctttttgggcatcatctcattctttacctttttcttgcaaggctttacgtttggcaaggcaggagagattttgacccgtcgcctccgttcaatggcgtttaaggcaatgcttcgtcaggatatgagctggtttgatgaccataagaattcgaccggagcactcagcactagattggccaccgatgcggcccaagtccaaggagcgactggaacccggctggcacttattgcacaaaacattgcgaatcttgggaccgggatcattatctcgttcatctacggatggcagctgaccctcctgctcctggcagtcgtcccgataattgcagtgtcaggtatcgtggagatgaaacttttggccggcaacgccaaacgcgataagaaggaattggaagcagcaggaaagattgccaccgaggcgattgaaaacattaggaccgtggtgtcactgacccaggaaagaaagtttgaatcaatgtacgtcgagaagctctatggtccttaccgaaactccgtccagaaggcacatatctacggtataacgttttcaatctcccaagcatttatgtactttagctacgcaggatgttttcgcttcggagcctacctgattgttaatgggcatatgcgattcagagatgtgattctggtcttttccgcaattgtgtttggggctgtggccctcgggcacgcctcgtcgttcgcaccagattacgcaaaagcaaagctgtccgcggctcaccttttcatgctttttgaacgccaaccactgatcgattcctacagcgaagaagggctcaagcctgacaaatttgaaggcaacattactttcaatgaggtggtgtttaactatcctacgcgcgccaacgtgccggtgctgcagggtctttcgctggaagttaagaaagggcaaaccctggcactggtcggttccagcggctgtggcaagtcgaccgtggttcagcttctggaaaggttttacgatccactggcaggtactgtctttgtggacttcggtttccaacttctggacgggcaagaggcaaaaaagttgaatgtgcaatggcttagagcccagctcggtattgtgtcccaggagccaatcctttttgattgcagcatagccgagaacattgcatacggagacaatagccgggtcgtttcccaagatgaaattgtgagcgccgcaaaggcggcaaatatccacccattcatcgaaaccctcccccataagtacgagactcgtgtgggtgataaaggtactcagctctcgggtggacagaagcaaagaatcgcaatagcccgggcactcattagacagcctcaaatccttctgctggacgaagcaacctcggctctggacaccgagtccgaaaaggtggtgcaagaggcacttgataaggcgagggagggcagaacctgcattgtgatagcccatcgcctttctacgattcaaaatgctgatctcatagtggtgtttcaaaatggacgcgttaaggaacatggaacccaccaacagcttctcgcgcaaaaggggatctacttcagcatggtgagcgtccaggcaggaactcagaacctt

SEQ ID NO: 7627 - DNA, 3858 bp, Artificial Sequence
  Description of Artificial Sequence: Synthetic coding sequence
atggatctcgaagctgccaaaaacgggactgcttggcggccgacctccgcagagggggacttcgagctgggaatctcgtcgaagcagaagcgcaagaaaaccaagaccgtcaagatgatcggcgtcctcaccttgtttcgatacagcgattggcaggataagttgttcatgtcgctgggtaccattatggccatcgcacatggatccggtctgccactgatgatgatcgtgttcggagaaatgaccgacaagttcgtggataccgctggcaatttctcattcccggtgaacttttctcttagcctcctgaacccggggaagatcctggaggaagagatgacgcgctacgcctactactactcggggctcggagcgggcgtgctcgtcgcggcgtacatccaggtcagcttttggaccctcgcggcaggccggcagatacgcaaaatcaggcaaaagttcttccacgcgatcctccggcaggaaattggatggttcgacatcaacgatactactgagttgaacacgcgcctgaccgacgacatctccaagatctcggaagggatcggcgacaaggtcggcatgttctttcaggccgtggctaccttctttgctggatttatcgtcggcttcatccgaggctggaagttgaccctggtgatcatggcaatctccccgatcttgggactgtccgccgcagtgtgggctaagatcctttccgctttctcagacaaggaactcgctgcatacgccaaggcaggagctgtggccgaagaagcgctgggtgccattagaactgtgatcgccttcggaggccagaacaaagaactggagcgctaccagaagcatctggaaaacgccaaggagatcggaatcaagaaagctatcagcgctaatatctcgatgggcatcgcgttcctgctgatctacgcctcctacgccttggcattctggtacggatccacgctggtgatcagcaaagagtacaccatcggaaatgccatgaccgtctttttcagcattctgatcggcgcgttctcagtcggacaagccgcaccatgcatcgacgcattcgcaaacgcacggggtgcggcatatgtcattttcgatatcatcgataacaacccgaaaatcgactccttttcggagcggggccacaagccggattcgatcaaggggaatctggaattcaatgacgtccatttctcgtacccgagccgggcgaatgtgaagatcttgaagggacttaacctgaaggtgcaatcgggacaaactgtcgcccttgtgggatcctcaggatgtggaaagtcgaccactgtgcaactgatccaaaggctctacgacccagacgagggaactattaacatcgatggacaggatatccgcaactttaatgtcaattacctccgcgagatcatcggcgtggtgtcccaagagcccgtgctgttcagcaccaccatcgctgagaacatctgctacggccgcggaaatgtgaccatggacgagatcaaaaaggctgtcaaggaggccaacgcttacgaattcattatgaagctgccgcagaaattcgatactcttgtgggagaacggggagctcagttgtcaggcgggcagaaacaacgcatagccattgctcgggccctcgtccgcaaccctaagatcctcctcctggacgaagcgacttccgcactcgacacggaaagcgaagccgaggtgcaggccgccttggacaaggcccgggagggtaggacgaccatcgtcatcgcgcacagactttccaccgtgaggaacgccgatgtgattgcaggtttcgaggacggggtgattgtcgaacaagggagccatagcgagctgatgaagaaggagggagtgtatttcaagctcgtcaacatgcaaactagcgggtcacagattcagtcagaggaattcgagttgaatgacgaaaaagccgcgactaggatggcgccaaatggctggaaatcccgcctctttcggcatagcacgcagaagaacctcaagaattcccagatgtgccaaaagagcctcgatgtcgaaacggatggtctggaggccaacgtgccgcccgtgtcttttctgaaggtactgaaactgaacaagacggagtggccatacttcgtcgtcggcaccgtttgcgccatcgcgaatggtggactccaaccggccttttcggttatcttctcggagattattgcaattttcggcccgggagacgacgcggtgaaacaacagaagtgcaacatcttttcccttatcttcctgtttctcggtatcatctccttcttcaccttcttcctgcaggggttcacctttggtaaggcgggtgaaatccttacccggcgcctcagatcgatggcatttaaggccatgctcagacaggatatgtcgtggttcgacgaccacaagaacagcactggggcgttgtcaactcggttggcgacggatgcggcccaggtgcagggagctaccggaacgaggctggctctcatcgcgcaaaacatcgcgaacctcggaactggcatcatcatatcctttatctacggctggcaactgaccctgctgttgctggcggtggtgccgatcattgcagtctctggaatcgtggagatgaagctgctcgccggcaatgccaagcgggacaagaaagaattggaagcggctggaaaaatcgccactgaggcaatcgaaaacattcggactgtcgtctccctcactcaggagagaaagttcgagtccatgtacgtggaaaagttgtacggcccttatcggaattcggtgcagaaggctcacatctatggtatcactttctcgatctcccaggcctttatgtacttctcgtatgccggatgttttcggttcggcgcgtacctgatcgtgaacggacatatgcggtttcgcgacgtcattttggtgttctctgctattgtctttggagcagtggctctcggccacgccagctcattcgctccagattacgctaaagccaagttgtccgctgcgcacctcttcatgctgttcgaacgccagcctctgatcgactcatactcggaagagggtcttaagccggacaaattcgagggcaacattactttcaatgaggtggtctttaactatccgactcgcgccaatgtgcctgtgctgcagggtctgtcactggaagtgaagaagggtcaaactctcgctttggtggggtccagcggctgtggcaaatcgaccgtggtgcaacttcttgagagattctacgacccgctggcagggacggtgttcgtcgattttggatttcaactcctggacggacaggaagccaagaagttgaacgtccagtggctgcgcgcccaactcggaatcgtgagccaggagccgatcctgttcgattgttcgatcgcggagaatatcgcgtacggggacaacagcagagtcgtgagccaagacgagattgtgtccgctgccaaagcagccaacatccaccctttcatcgaaaccctgcctcacaagtacgaaactcgcgtgggcgataaaggtacccagttgtccgggggtcaaaaacagcgaatcgccatcgcaagagcacttatcagacagccgcagatcctgcttctggatgaagctacgtccgccctcgacactgagtccgaaaaagtggtccaagaagccttggacaaagcacgcgagggaaggacttgtatcgtgatcgcccaccgtctctcaaccatccaaaatgccgatctgatcgtcgtgtttcaaaacggacgcgtgaaggaacacggtacccaccaacagctcctggcgcagaaggggatctacttctccatggtgtcggtccaagcgggaacccagaatctg

SEQ ID NO: 7628 - DNA, 3858 bp, Artificial Sequence
  Description of Artificial Sequence: Synthetic coding sequence
atggaccttgaggcagcaaagaacggaaccgcgtggcggccaacgtccgcagagggagattttgaactcgggatctcatcaaaacaaaagaggaaaaagactaaaaccgtgaagatgataggtgtgctgaccctttttagatacagcgactggcaggataagctgtttatgtcattggggaccatcatggcaatagctcatggctcgggcttgccgctgatgatgatagtgttcggagaaatgaccgacaagtttgtcgatactgcgggaaactttagcttcccagtgaacttttcgctgtccctgctgaacccaggaaagatactggaggaagaaatgactagatacgcatattactactctggtctgggagcaggagtgctggtggcggcctacatacaagtgtcgttttggactctggcagcgggtaggcaaattcgtaagattagacagaagttcttccacgccatactccgtcaagaaatcggatggtttgacataaatgacaccaccgaacttaacacccgcctgaccgatgatatttcaaagatttcggaaggaattggggataaggttggaatgtttttccaggctgtggcaacgtttttcgcaggattcattgtgggtttcattcggggttggaaacttactctggtgattatggccatttcgcccattttgggcctctcggcagcggtgtgggcaaaaatccttagcgccttttccgataaggagcttgcggcctacgcaaaggctggagcagtggcagaagaagccctcggtgcgattagaacggtcatcgccttcgggggacagaataaagagcttgaacgctatcaaaaacatctggagaacgcaaaggagattgggattaagaaggcaatttccgcaaacatctccatgggcatagcatttcttctcatatacgctagctatgcattggccttttggtacgggtctactcttgtcatcagcaaggagtacacgattggaaacgcaatgaccgtctttttcagcatcctcataggtgcgttttcggtgggacaagcagcaccttgtatcgacgcattcgcaaatgcacggggggcggcatatgttatcttcgacattattgataacaatcctaagattgatagctttagtgaacgcgggcataaaccagattcgatcaaaggtaaccttgagttcaacgatgtgcatttctcctacccctcccgggcgaacgtcaagattctcaaaggtttgaacctgaaggtccaaagcggacaaacggtcgcattggtcgggtctagtggctgcggaaagtctactacggtgcagctgattcagcgcctttacgaccctgatgagggcacgattaacattgatggccaagacatccgcaacttcaacgtcaactacctgagagaaatcattggtgtggtgtcgcaggagcccgtgctcttttccacgactatagcggagaatatctgttacggccggggaaacgtcactatggatgaaatcaaaaaagccgtgaaggaggctaacgcttacgagtttatcatgaagttgcctcaaaagtttgacacccttgttggggagcgcggcgctcagctttccggtggacagaaacaacggattgcaattgccagagctcttgtaagaaatccaaagatccttcttcttgacgaagccacctcggctctcgacactgaatcggaagcagaagtgcaggcagcactggacaaggcacgtgaagggcggactactattgtgatcgcccatagactttcaactgtaagaaacgcggatgtcatagccggcttcgaagatggggtgatcgtggagcaggggtcacattcagaactcatgaagaaggaaggcgtgtactttaagctcgtgaacatgcaaacttcaggtagtcaaatccaatccgaagaattcgaattgaatgacgagaaggccgcgactagaatggcccctaacggatggaagtcgagacttttcaggcactcgacccagaaaaatcttaagaatagccagatgtgccaaaaatccctcgatgtcgaaactgatggtctggaggcgaatgtccctcctgtgagtttcctgaaagtcctcaagctgaataagaccgaatggccttacttcgtggtaggaaccgtctgtgccattgcaaatggaggtttgcagcccgcattttcggtgatcttttcggaaatcatcgcaatcttcggacctggtgacgatgctgtcaagcaacaaaaatgcaacatcttctcattgatttttctgtttcttggcattatctcattcttcactttctttttgcagggctttacgttcggaaaagctggggaaattcttactcgaaggcttagatcgatggcttttaaggcaatgctgagacaggacatgagttggttcgatgatcataagaattcgactggagcactgtcgacccgtctcgcgactgacgcagcccaagtgcagggagccactgggacccgactggccctcattgcccaaaacatcgcgaatctcggcaccggtataatcatcagttttatctacggttggcagcttaccctcctccttcttgcagtggtgccaattatcgcagtgtccggcatcgtcgaaatgaaactgctggcaggtaacgcgaaacgggataagaaggaactggaagccgcggggaaaattgcaaccgaggcaattgaaaacattagaactgtggtgtctctgacccaagaacgaaagtttgaatcaatgtacgtcgaaaagctgtacggaccgtatcgcaattccgtccagaaagcacacatttacggtattaccttcagcatttcccaagcatttatgtacttctcctacgctgggtgctttcggtttggtgcataccttattgtgaatggacatatgaggtttagggatgtgattctcgtgttttcagccattgtttttggtgcagtcgcacttggacatgcttcatcgttcgctcctgattacgcaaaggccaagctgtccgctgcacatctgtttatgctttttgaaagacagcctttgatagatagctactccgaggaaggtctgaagccggataagtttgaggggaacatcacttttaacgaagtggtgttcaattatcctactcgcgccaacgtgccagtcctccagggattgagcctggaggtgaagaagggtcaaactctcgccctggtgggaagctcgggctgtggtaagtcgaccgttgtgcaactgctggagaggttttacgatccccttgcaggaaccgtgtttgtggattttggatttcaactgctggatggacaagaagccaaaaaactcaacgtgcagtggcttcgagcccaacttggcatcgtgtcacaagaaccaattcttttcgattgttcaatcgcagaaaacattgcatacggggataattcgcgggtggtatcccaggacgagatagtttcggcggcaaaggcagcaaacatccacccctttattgaaaccctcccacataagtacgaaacccgcgtgggcgacaagggtacccaactgtccggcggacaaaagcagcgtattgccatcgcccgcgcccttatccgccagccgcaaatacttctgctggatgaggcaacgagcgccctggacaccgagtccgagaaggtcgtgcaggaggcactcgataaggccagagaaggtagaacgtgtattgtgattgcacaccggctgagcaccattcaaaatgcggacttgattgtcgtctttcaaaacggtagggtcaaagaacacggcactcaccagcagcttcttgcgcaaaagggaatttactttagcatggtgtcggtgcaagcgggaactcagaatctg

SEQ ID NO: 7629 - DNA, 3858 bp, Artificial Sequence
  Description of Artificial Sequence: Synthetic coding sequence
atggatctggaggcagccaaaaacggcaccgcatggagaccaacctcagccgagggggattttgaactcggcatatctagcaagcaaaagagaaaaaaaacaaaaacagtaaagatgatcggagtgctaacgctgtttcgttattcagactggcaagataaactgttcatgtcgcttgggactataatggcgatagcccacgggagcggtctgcctctgatgatgatagtgttcggagagatgactgacaagtttgtggatactgccggaaatttcagcttcccagtaaatttctctctgagtcttctcaatcccggcaagatcctcgaagaggagatgactcggtatgcttattactacagcggccttggcgctggcgttctcgtagcggcttacatccaggtgtcattctggactcttgccgccgggaggcagatacgaaagatccgtcagaaattcttccatgcaatcttgaggcaggaaatcggctggttcgatattaatgacacgaccgagctcaacacccgcctcactgacgatatttccaagatatccgaggggatcggcgataaagtgggcatgttcttccaagctgtcgctaccttttttgctggcttcatcgtgggcttcatccgcggatggaagctcacactggtaattatggctatttcacccattctagggctctccgccgctgtgtgggccaaaattctttcggcttttagtgataaagaattagccgcctatgccaaggctggggccgtcgcagaggaggccctaggcgcgattaggactgtgatcgcctttgggggccagaacaaggagttggagcgttatcaaaagcacctagaaaacgccaaggagatcggaatcaagaaggcgatctccgctaatatctcaatggggatcgcgttcctgcttatttacgcctcttacgccctcgctttctggtatggcagcactctggtaattagcaaagaatatacgatcggcaatgccatgactgtgttctttagtatcctcatcggagccttctccgtgggccaagcggcaccctgcatagatgcattcgccaatgcaaggggggctgcttatgtcatattcgatataatcgacaataatccaaaaattgatagcttctcagaacgcggtcataaaccggatagtattaagggaaatctcgagtttaacgatgtgcatttctcctatccaagccgggccaacgtgaagatactgaagggactcaacttgaaggtgcagagtggacagactgtcgcactagttggttctagcggctgcggaaagtccaccaccgttcagctaatacagagattgtacgatccagacgagggtaccataaatatcgatgggcaggacatccggaacttcaatgtcaattacctcagggaaataattggcgtggtgtcccaggagcccgtgctcttctccaccactattgccgagaacatctgttatggaagggggaatgtgacaatggacgagattaagaaggctgtgaaagaagctaatgcttacgagtttatcatgaaattgccccagaaattcgacacacttgtgggggaaaggggcgcccagttatccggaggccagaagcagcggattgccattgcgcgggctttggtccgtaatccaaaaatccttctcttagacgaagccacatcagccctggacactgagagtgaggccgaagttcaggccgcgctcgacaaggcacgggaaggccgaacgaccatcgtgatcgcccatcgactctccactgttagaaacgccgacgttatagccggcttcgaggacggagtcattgtcgaacagggctcacactctgagctcatgaagaaagaaggcgtctactttaagttagtgaatatgcagaccagcggttcacagattcagagcgaggaatttgagctaaatgacgaaaaagcagccacccgcatggcccccaacggatggaagagccggcttttccgccacagcacacaaaaaaacctaaagaattcacagatgtgtcagaaatccctggatgttgagacagacggcctggaggccaacgtgccacccgtgtctttcctgaaagtcctcaaattgaacaagacagaatggccttactttgtagtcggcactgtgtgcgccattgccaacgggggtttgcaacctgcattctccgtgatctttagcgagatcatcgcaatcttcggccctggtgacgacgcagtgaagcagcagaagtgtaatattttttcgctgatctttctgtttctcggcattattagcttctttaccttttttctccagggctttacatttggaaaggctggtgaaatcctaacccgtcgccttcggagcatggcctttaaggccatgctgaggcaagacatgtcatggttcgatgaccacaagaactctaccggagccttatccacccgcctcgcaactgatgcggctcaggtgcaaggggctacaggcacacgcttggcactgattgctcagaatattgcaaacctgggcacgggcatcattatctcttttatctatggatggcagctgaccctcttactgctggctgtggtgcccatcattgctgtctcaggtattgtagaaatgaaactgttagcagggaacgcaaaacgcgataagaaggaactagaggcagctggaaagatcgctaccgaagcaattgagaacatcagaaccgtcgtgagcctgacacaggaacgtaagttcgaaagcatgtacgttgagaaactgtacgggccttacagaaattcagtgcagaaagcccacatctacggcatcacattcagcatctctcaagcatttatgtactttagttacgctgggtgttttcgatttggcgcctacctcattgtgaacggtcatatgcgcttcagggacgtcatactggtgtttagcgctatcgtatttggcgctgtggctctgggccatgcgtcctcctttgcccctgactatgcaaaggccaaactatctgccgcgcatttgtttatgttgtttgagcgacaacccctgattgacagttattctgaggaagggctgaaacccgacaaatttgaggggaatattacatttaatgaagtggtctttaattatcctacgcgggctaatgtgccagtcctccaaggcctttccctagaggtgaagaagggccagaccttggccctggttggcagttcagggtgcggtaagagcacggtagtgcaactgttggagaggttctacgaccccctagcgggtacggtatttgttgacttcggtttccagctgctggatgggcaggaggctaaaaaactgaacgttcagtggttaagagcccaactaggaattgtgtctcaagaaccaatcctgtttgattgctcaatagctgagaacatcgcctacggtgataactcaagggttgttagtcaggatgaaattgtgagcgcagccaaggcggcgaatatccacccattcatcgagaccctcccgcacaagtatgagacacgcgtgggtgataagggcactcagcttagtggaggccagaagcaacgcatcgccatagcccgagcactgattagacagccccagattctactgctggatgaggcaacttccgcactggacactgaatcggagaaagtggtgcaggaagctttggataaggccagagagggacgcacctgcatagtgatagcccacagactgtctaccattcagaatgcagacctcatagtcgtgtttcaaaacggcagggtgaaagagcacggaactcaccagcaattactcgcccagaaagggatctactttagcatggtgtcagtgcaggctggtacccaaaacttg

SEQ ID NO: 7630 - DNA, 3858 bp, Artificial Sequence
  Description of Artificial Sequence: Synthetic coding sequence
atggatttggaagcagctaaaaatggaactgcatggaggccaacatctgccgaaggggacttcgaattgggaatctcgtccaaacagaaaaggaaaaagacaaaaacagtgaaaatgatcggagtgctcacgctgttcagatattccgattggcaggataaactattcatgagtttagggactataatggccatcgctcatgggagtggacttcctctaatgatgattgtgtttggagaaatgactgataaatttgtggatactgccgggaatttttcattcccagtcaattttagtctatctttgctcaaccccgggaaaattctcgaagaagagatgactaggtacgcctattattatagtggactcggggccggagtcctcgttgcggcctatatccaggtgtctttttggactctggcagcagggcgccagatccggaagatcaggcagaaattttttcacgctatcctacgacaggaaattgggtggttcgatatcaacgatactacagaactaaacactagactgactgatgatatctctaaaattagtgaaggaataggggataaagtgggaatgttttttcaggctgtagctacattcttcgccggattcattgttggattcatcagaggatggaaacttacactggtgatcatggcaataagtcccatcctcggattgtccgctgccgtctgggccaaaatcctctcggccttttctgataaagaattagctgcgtacgctaaggcaggagccgtcgccgaagaagccttaggggccattcggactgtgatcgcttttggggggcagaataaagagttagagcggtatcagaaacaccttgaaaatgctaaagagataggaataaaaaaagccatatcagctaacatctcaatgggaattgcgtttctcctaatctatgcgtcttatgcactcgcattttggtacggatcaactctggttatctccaaagaatacactatcggaaacgccatgacagtgttcttctctatactgataggagctttttctgtaggacaggccgccccatgtatagacgcatttgctaatgcccgcggggccgcctatgtgatcttcgatatcatcgataacaatcccaaaatcgactctttttccgaaagagggcacaaacctgattctataaaagggaatctcgaattcaacgatgtgcatttctcatatccttcaagagccaatgtaaaaatccttaaagggcttaacctgaaagtgcagagtgggcagactgtcgcactggttggatctagtgggtgtggaaagtctacaactgttcaactcatccagcggctgtatgaccctgatgagggaactattaatattgatggacaggatatccgaaatttcaatgtgaactatctacgcgaaattataggggtagttagtcaggaaccagtcctattttctacaacaatagctgaaaatatctgttatggaagaggaaacgtcacaatggatgaaatcaaaaaagcagttaaagaagctaacgcctacgaatttatcatgaaattaccccagaaatttgatactcttgtaggagagaggggagcccagctctctggagggcagaaacagcgcatagccatcgctagggccctggtgaggaatcccaaaatactcctcctggacgaagccacttcagcactagatacagaatctgaagcagaagtacaagccgcgctggataaagccagggaaggacgaactacaatagtcatcgcacatagactttccacagtgcggaacgcggatgtgatcgctgggtttgaagatggggtcatagtggagcagggatcccattctgaattgatgaaaaaagaaggggtgtatttcaagctggtgaatatgcagacatccggatctcagatacagtccgaggaatttgaactcaatgatgaaaaagccgccacacgcatggcacctaacggatggaaatccaggctattcagacattctactcaaaaaaatctaaaaaattcccagatgtgccagaaatcattagatgtcgaaactgatggactcgaagccaatgtcccccctgtctcctttctgaaagtcctcaaattaaacaaaacagaatggccatatttcgtcgtcggaacggtgtgtgccatagcaaatggagggctgcagccagctttttcagtcatattttcagagattatagccatctttgggccaggagatgatgccgtcaagcagcagaaatgcaatatattctctctaatattcctctttctgggaatcatctccttcttcactttttttctccaggggttcacattcgggaaagctggggaaatccttacacgccggctcagaagtatggcgttcaaagcaatgcttaggcaggacatgtcttggtttgatgatcacaagaacagtactggggcattgtctactcgactagccacagatgccgcccaggtccagggagcaactgggacaaggcttgctctgatcgcacagaatatagccaatcttggaactggaatcatcatctctttcatttatggatggcagctcacactcctcctcctggccgtcgtgccaataatcgctgtttctggaatagtcgaaatgaagctgcttgctgggaacgccaagagagataaaaaagaactagaagccgctggaaaaatagcaactgaagctatcgaaaatatcagaacagtggttagtctaacacaggaacggaagttcgaatcaatgtacgtagaaaaactttatggaccttatcggaatagtgtacagaaagcacatatatatgggataacattcagtatctcacaggcctttatgtattttagttatgctgggtgtttcaggttcggagcgtatttaatcgttaacggacacatgaggttcagggatgtcattctggtattctctgccatagttttcggggcagtggctctcgggcatgcttcttccttcgcacctgattatgcaaaggccaaattatccgccgcgcatcttttcatgctgttcgagcgccagcctttaattgattcctacagtgaagaagggctaaagcctgataaatttgaagggaacataacttttaatgaggtagtgtttaattaccccacaagggccaacgttcctgttctacagggactgtctctggaggtaaaaaaaggacagacactcgctctagtcggatcatctgggtgtgggaaatctacagtcgtacagctgctggaaaggttctatgatccactcgctggaactgttttcgttgatttcggattccagctattggatggacaggaagcgaaaaagctcaatgtccagtggctaagagcgcagctggggattgtgtctcaggaacccatactcttcgattgctccattgcagaaaatatagcatacggggataattcacgggtggtgtcccaggatgaaatcgtgtcagcagctaaggctgctaacatccaccccttcatagaaactcttccccataaatatgagacacgcgttggggataaaggaactcagctttctggaggacagaaacagaggatagccatcgcaagagcactcatccgacagcctcagatcctattacttgatgaagccacgtctgccctcgatactgaatctgaaaaagtggttcaggaagcattggataaggcccgagaagggcgcacttgtattgttatagctcatcggctatctacaatccagaacgcagatctcatagtagtatttcaaaatgggagagtgaaagagcatgggacacaccagcagctcctggcccagaaagggatctacttctctatggtgtccgtgcaggcagggactcaaaacctt

SEQ ID NO: 7631 - DNA, 3858 bp, Artificial Sequence
  Description of Artificial Sequence: Synthetic coding sequence
atggacctggaggcagctaagaatggtacggcctggcgcccgacgagcgccgaaggagacttcgagctggggatctcttccaagcagaaacggaaaaagaccaagacggttaagatgattggcgtgcttactctctttcgctacagcgactggcaggacaaactctttatgtccttggggactatcatggcaatcgcccacggatcgggacttccactcatgatgatcgttttcggggagatgacggacaaatttgtggacaccgcgggtaacttctccttcccagttaactttagtctctccctgctgaaccccggaaagatcctggaagaggaaatgactcgctacgcatactactactcgggactcggagccggcgtgctcgtggccgcgtacatccaggtgtcgttctggaccctggctgccggacgccagattcgcaaaatccggcaaaagttcttccatgcaatcctgagacaagagatcggttggtttgacatcaacgataccaccgaactcaacactaggctgactgatgacatcagcaagatcagcgagggaatcggtgataaggtcggaatgttcttccaagccgtggcaacgttctttgcggggttcatcgtgggattcatcagaggctggaagctgactctggtcattatggccatctcaccgatcctcggcctctcagccgccgtgtgggcgaaaatcctgagcgcgttcagtgacaaggaactcgccgcgtacgcaaaggcaggcgccgtcgcggaggaggccctcggagcgatccgcactgtgattgcgtttgggggccaaaacaaggaattggaaagataccagaaacacctggagaacgcgaaggagatcggcatcaagaaggcgatttccgcgaacatatcgatgggaattgccttcttgttgatctacgcttcctacgcgctggccttctggtacgggtctactctcgtgatcagcaaggaatatactattggcaacgccatgactgtgttcttctccatcttgatcggcgccttctccgtcggccaggctgcaccgtgcatcgacgccttcgcgaatgcgcgcggcgcggcatacgtcatattcgacataattgataacaatccgaagatcgactcgttctcggagcgcggccacaagcctgattcgatcaaaggcaacctcgaattcaatgacgttcacttttcctacccgagccgcgccaatgtcaaaatcctgaagggactgaatctcaaagttcagtccggacaaaccgttgcactggtgggaagcagcggctgcggaaagagcactaccgtccagctgattcaaagactctacgatccggacgaaggaacgattaacatcgacggacaagatattcgcaacttcaatgtcaactacctccgggagattatcggtgtggtgtcacaggaacccgtgttgttctcaaccactatcgcagagaacatttgttacggacgcggtaacgtcaccatggacgagatcaagaaagcggtgaaggaagctaatgcctacgagtttatcatgaagctgccgcagaaattcgatactctcgtgggggaacgtggagcgcagctttccggaggacagaagcagcgcattgccatcgctcgcgcattggtccgcaacccaaagattctccttctggacgaggctacctcagccctggatactgaatcggaagctgaggtccaggctgccctggacaaggctcgggagggacggactaccatcgtaatcgcccataggctgagcactgtccggaacgccgatgtgattgccgggttcgaggacggggtcatcgtggaacagggctcccactctgagctcatgaagaaggaaggcgtgtactttaaactggtcaacatgcaaacctcgggatcccagatccagagcgaggaattcgagctgaatgatgaaaaggccgccacccgaatggcccctaacggctggaagagcaggctttttagacactcaactcaaaagaacttgaagaactcccagatgtgccagaaatccctggatgtcgaaaccgacggactggaagccaatgtccccccagtgtcgttcctgaaagtgctgaagctgaacaaaaccgaatggccgtatttcgtggtgggcaccgtgtgcgccatcgcgaatggcggcctgcaaccggctttttcggtgatcttctcggaaatcattgcgatcttcggaccgggcgacgacgccgtgaagcagcaaaagtgcaacatcttctcactcattttcttgttcctgggaatcatctcctttttcaccttctttctgcaaggcttcaccttcggaaaagcaggagaaatcctgaccagacggctgaggtcaatggcttttaaggcgatgttgaggcaggatatgagttggtttgatgaccataagaactcaactggagccctgtcgacgagactggccacggacgccgcccaggtccagggcgcgacgggtactagactggcactgatcgcccagaatattgccaacctgggtaccggaatcatcatatcctttatctacgggtggcagctcactctgctgctgctggcagtggtgcctatcattgcggtgtcaggcatcgtggagatgaagctccttgcgggaaacgcaaagcgagataagaaagagctggaagccgcgggaaagatcgccactgaagcgatcgaaaacatcagaaccgtggttagcctgacccaggagcgtaagtttgagtccatgtacgtggaaaagctgtacggaccgtatagaaatagcgtccagaaagcccatatctatggaatcaccttcagcatctcgcaagcctttatgtacttctcctacgcaggatgcttccggtttggagcctacctgattgtcaacggacatatgaggtttcgggacgtgatcctggttttctccgccatcgtgtttggggcggtcgcacttggtcacgccagctcgttcgcccctgactacgctaaagcaaaattgtctgcagctcaccttttcatgctgtttgaacggcagcccctcattgactcgtacagcgaggaaggcctcaaacctgacaaattcgaaggtaacatcacctttaatgaagtggtattcaattacccgacccgcgcaaacgtccctgtgctgcaaggcctgtcacttgaagtcaagaagggacagactctcgccctggtcggatccagtgggtgcgggaagtcaaccgtggtccagctcctggaaaggttctatgacccgctcgcaggtaccgtctttgtcgatttcggatttcagcttctggatggacaagaggcgaagaaacttaacgtgcagtggctcagagcacaactgggaatcgtatcgcaggagccgatcctcttcgattgctcgatcgccgaaaacatcgcctacggagacaattcaagagtggtgtcccaagatgaaatcgtttcagccgcaaaggctgcaaacatccatccgttcatcgaaaccttgccgcacaagtacgaaactcgcgtgggggataagggtactcaactcagcggtggtcagaaacaacggattgcgatcgcccgggcccttattcgccagccgcagatcctcctgctcgatgaggctactagcgccctggacaccgagtcggagaaggttgtgcaggaggcgcttgacaaagcccgggaaggcagaacctgcatagtgatcgcccaccggctttcgacgatccagaacgcagacttgatcgtggtgttccagaacgggcgagtgaaggaacatggcacgcaccaacaactcctggcacagaaaggaatctacttcagcatggtgtcggtccaggcaggtactcagaacctg

SEQ ID NO: 7632 - DNA, 3858 bp, Artificial Sequence
  Description of Artificial Sequence: Synthetic coding sequence
atggatctggaagcagccaaaaatgggacagcatggcggccaaccagcgccgaaggggatttcgagctgggaattagctccaagcagaaacgcaaaaagaccaagactgtgaaaatgatcggagtgcttactcttttccggtattcggactggcaagacaagttattcatgagtctgggcaccattatggccatcgctcatgggtctggtctgccgctgatgatgatagtgtttggagaaatgaccgataagttcgttgacactgcgggaaactttagctttccagtgaatttttccctgtctctgctgaacccaggtaagattctcgaagaagaaatgacccgttacgcttactattattcaggactgggcgctggggtcctggtcgcagcgtacatacaagtcagcttctggaccctggctgcaggtcgccagattcggaaaatcagacagaagttctttcacgcgattctaagacaggaaattgggtggttcgacataaacgataccacagagcttaacacgcgtctcacagacgacatctcaaaaattagtgaggggatcggggataaggtcggtatgttttttcaggccgttgcaaccttcttcgccggttttattgtgggattcattcgaggctggaagctgactctggtgatcatggcaatctcacccattctaggattgtccgcggccgtgtgggccaaaatactgagcgccttcagcgacaaggagcttgccgcctacgccaaagccggagccgtggcagaggaagcgttgggcgccattcgcactgtcatagcttttggaggccagaacaaggagctcgagcggtaccagaaacatctcgagaatgctaaggagattggcataaaaaaagccatctccgccaatatttcgatgggaattgcgttccttctgatttacgctagctacgccctggcgttctggtatggctctaccctggtgatctctaaggagtacactatcgggaatgcaatgacagtgttcttttctattcttatcggagctttcagcgtggggcaggctgcgccctgtatcgatgccttcgccaacgcccgaggcgccgcttatgtgatttttgatattatcgacaacaacccgaagatcgatagtttctcagagagaggacacaaacccgatagcatcaagggaaatctcgagttcaacgacgtgcacttttcctacccgagccgggccaacgtcaaaatcctaaagggtctgaacctgaaggtgcagagcgggcagacagtggccctggtgggctcctccgggtgcggcaaaagcaccaccgtccagctcattcaaaggctgtacgatcccgatgaaggcacgattaacattgacgggcaggatatacgcaactttaacgtgaattatctgcgcgagattatcggggtcgtgagccaggagccggtgctattctcaactaccattgccgagaatatctgctatggtaggggcaatgtgaccatggacgaaattaaaaaagccgtgaaagaggctaatgcttacgagttcattatgaaacttccacagaagttcgacaccttggtcggcgagagaggcgcccagctgtcaggcggccaaaagcagcgtatcgccattgccagagctttggtccgcaatcctaagatcctactgctggacgaggctacaagcgctctggacactgagtctgaggccgaggtgcaggcagccctggataaagcgcgcgaaggcagaaccaccattgtgatcgcccaccggttgagcacggtccggaatgccgacgtgattgctggctttgaagatggggtaatcgtcgaacaaggatcgcattctgagctgatgaaaaaagagggagtctatttcaagctggttaatatgcagacaagtggtagccagatccagtctgaggagtttgagttgaacgacgaaaaggccgccaccaggatggcccccaatggttggaagagcagacttttccgccatagcacgcaaaagaacctgaagaattcacagatgtgccaaaaatccctggatgttgaaaccgatggactggaagccaacgttccacccgtgtctttcctgaaggtgcttaaactgaacaagaccgaatggccatacttcgtggtggggaccgtatgtgctattgcgaacggcggccttcagcccgccttcagcgtgatcttctccgaaatcattgccatctttgggcctggcgacgacgccgtcaaacagcagaagtgcaatatctttagcctgatcttcctcttcctcggcatcataagctttttcaccttcttcctgcaggggtttacctttggcaaagccggcgagatcctcacaaggcggctcagatcaatggcattcaaagctatgctgaggcaggatatgagctggtttgacgatcataaaaactcgacgggcgctttgagtacacgcctcgctaccgatgccgcacaagtacagggagcaacggggacgagactggccctgatagctcagaatattgccaatttaggtaccggtatcatcataagctttatctacggctggcagctgactctgcttctgctggcagttgttcccatcatcgctgttagcgggatcgtggaaatgaagttgctggctgggaacgcgaagagagacaagaaggaattggaagctgcagggaaaatcgccacagaagccattgagaacattaggacagtcgttagtctcacccaagagcggaaattcgagtctatgtacgtggagaagctgtacggcccttaccgaaatagtgttcagaaggctcacatatatgggatcaccttcagtataagccaggcttttatgtacttctcttacgccggctgctttcgatttggtgcttacctcatagttaacggccacatgcgcttccgggatgtgatcctggtgttctccgcaattgtgttcggagctgtggcgctcgggcacgcgtcctcatttgcacctgactatgccaaggcaaaactgtccgctgcacacttatttatgctgttcgagcggcagcccctcatagactcatatagtgaagaaggtctgaaacccgataagttcgagggaaatatcactttcaatgaagtcgtgtttaattatcctacccgggccaacgtgcccgtgctgcaggggcttagccttgaggtcaaaaaggggcagaccctggcgttggtgggctcgagtgggtgcggaaagagcaccgtggtgcagctgctcgagcgcttttacgaccccctcgccgggactgtctttgtggattttggcttccagcttttggacgggcaggaagccaaaaagctcaatgtgcaatggctgcgagcccaattgggtatcgtatctcaagagccaattctgttcgactgctccattgccgaaaacattgcctacggggacaactcccgtgttgtctctcaagatgaaattgtcagtgcagctaaagctgccaacatccatccgttcatagagacgctacctcacaagtatgagactcgggtgggtgacaagggcacgcagctgtccggtgggcagaaacagcgcatcgctatcgcaagagcacttatcaggcagccccaaatactcctcctggatgaggccactagtgcactcgatactgagtctgagaaggtcgtgcaagaggctctggataaggcccgggaagggcgcacctgtatagtcatcgcacatcgcctgagtacgattcaaaacgcggaccttatcgtcgtcttccagaatggccgagtcaaggagcatggaactcatcagcagttgctcgctcagaaggggatctatttctctatggtgagtgtccaggcagggacacagaatctc

SEQ ID NO: 7633 - DNA, 3858 bp, Artificial Sequence
  Description of Artificial Sequence: Synthetic coding sequence
atggatctggaagctgctaaaaacggcacagcttggaggcctacctctgcagagggcgatttcgaactgggcatatcctccaaacaaaaaagaaagaagaccaaaacagtaaaaatgataggggtgttgaccctgtttcggtactccgactggcaggataaactgttcatgagtctcggtacaatcatggcgattgcccatggatctggactgccgctaatgatgatcgtatttggagagatgacggataagtttgtcgatactgcgggaaacttctcattccctgttaacttctccctctcattgttgaatcctggcaagatattggaagaagagatgactaggtacgcctactactattctggcctgggcgcaggtgtgctggtagctgcatacattcaggtgtcgttttggaccctggctgcgggcagacaaatcagaaagatccgacagaaatttttccacgcgatactgcgccaggaaattgggtggtttgatattaacgacactaccgaactgaacacccgccttacagatgatatttccaaaatcagcgaaggtattggagacaaggttggcatgttttttcaggcagtcgcgactttctttgccgggtttattgtcgggttcattagaggctggaagctgactcttgtgattatggccataagcccaattttggggctttccgccgccgtgtgggcgaaaatcctgtccgcattctctgacaaggagttagccgcttatgcgaaagccggcgccgtcgccgaagaagccctaggtgctatcaggaccgtaattgcctttggcggtcagaacaaggagctggagcgataccagaagcatctcgagaatgctaaagaaattggaatcaagaaggccatttcagccaacatcagcatggggatcgctttcctactgatctatgcctcctacgctctagcattctggtatgggtcaacactcgtgatcagcaaggagtacacaattgggaacgccatgacagttttcttttcaatcttaattggggcattttctgtcggtcaggccgctccctgcatagacgcattcgcaaacgctcgaggggccgcctacgttatcttcgatataatcgataacaaccccaaaatcgacagtttctcggagcgtgggcataagccagactccatcaaggggaatctagagtttaacgacgtgcacttctcttatcctagcagggccaacgtcaaaattctgaaggggctgaacctgaaggtgcagtccggccagaccgtggcactcgttgggtcatcaggttgcggcaagagtaccacagtgcagctgattcagcgtctgtacgaccccgacgaaggaaccataaatatagatgggcaggatatacggaacttcaatgtaaattacctccgagagattataggagtagtgtcacaagagccggtcctcttttccaccacaatcgctgagaatatttgttacgggaggggaaatgtcacaatggatgaaatcaaaaaggcggtgaaggaagccaacgcatacgagtttataatgaagttgccccagaaatttgacactctcgtgggagaacgaggagcacagttgagtgggggccaaaagcagagaattgcaatcgccagggcacttgtacgcaatcctaaaattctgctactggacgaagctacctctgctctggacacggaatcagaagctgaggtacaagcagccctggataaggcccgcgaagggcgaacaaccatcgtgatcgcacacaggctgtccacagtgcgtaacgccgacgttatcgctggctttgaagatggggtcattgtggaacagggttcacattccgaattgatgaaaaaggaaggagtctactttaaactggtaaacatgcagaccagtggttcccaaatacagtctgaggaattcgaattaaatgatgagaaggccgctacacgaatggcccccaacggatggaaaagcaggctattccgccactctactcaaaaaaatctgaaaaatagccagatgtgccagaaatccctggatgtggaaaccgatggtttggaggcaaatgtgccacctgtgagcttcctgaaggtcctcaaactgaacaaaacggaatggccatacttcgtcgtggggaccgtctgtgccattgctaatggtggcctacaaccagcgttctccgtgatttttagtgagattatagcgatcttcgggccaggcgacgacgccgtcaaacagcagaagtgtaatatattctccctgatttttcttttcctgggaatcattagcttcttcacgttctttcttcagggcttcactttcggcaaggccggggagatcctcacacgaaggttaagatccatggcttttaaggcaatgttaagacaggacatgtcttggttcgacgaccacaagaatagcacaggggctctgagtacaaggttagccactgacgctgctcaagtccaaggggccacaggcactcgactggcgctaattgcgcagaacatcgcaaatctcgggaccggtatcataatttcttttatatacggttggcagctgactctgctgttgctggctgtggtccccataatcgccgtgtccggtattgtcgaaatgaaactgttggccggaaacgctaagcgagacaaaaaagagctagaagcggccgggaaaattgccacggaagcgattgaaaatattagaaccgtcgtgtctctgactcaagagcgcaaatttgagagtatgtatgtggaaaaactttacggaccctatagaaacagtgtccagaaagcacacatttacgggatcacattttccatttcccaggcctttatgtacttcagctacgctgggtgcttcaggttcggcgcttatttaattgttaacgggcacatgagattcagggacgttattttagtgttctccgcgatcgtctttggcgctgttgccttgggccatgcctcatccttcgcccccgactacgcgaaggcgaaactatctgcggcccatctgtttatgctgtttgagcgtcagcccctgattgactcctattccgaggagggactgaaacccgataaattcgaaggcaacatcaccttcaacgaagtcgtgtttaattatcctacgagagccaacgtgccggtgctgcagggcctgagcctggaagtcaagaaaggacaaacacttgccctggtcgggagcagcggctgtggcaagtctaccgtcgtgcagcttttggagcgattctatgatccccttgcaggaacagtattcgtggatttcggcttccagttgctcgatggccaagaagcaaaaaaattgaacgtgcaatggctacgagctcaacttggtatcgtgtcccaggagccgattctcttcgattgtagtatcgcagaaaacatcgcttatggcgacaactcacgagttgtatcacaggacgaaatcgtcagcgcagctaaggctgccaatatccacccatttatcgagaccctaccacacaagtatgaaacccgggtcggtgacaaggggactcagctgtctggggggcagaaacaacgcatcgcgattgccagagcgctgatacgtcagcctcaaatcctgcttctggatgaggcaacttctgcgctggataccgaatccgagaaagtggtgcaggaagccctggacaaggcaagagaaggccgaacatgcatcgtgatagctcacaggctcagcaccatccaaaatgccgatctgattgtggtttttcaaaatggccgggtgaaggagcatggcacgcatcaacagctgttggctcagaaaggcatctacttcagcatggtgtccgttcaggctggaacccagaattta

SEQ ID NO: 7634 - DNA, 3858 bp, Artificial Sequence
  Description of Artificial Sequence: Synthetic coding sequence
atggacctggaagccgccaaaaatggaactgcctggcgccccacttctgcagaaggggactttgaactggggatttctagtaaacagaaacggaaaaagactaagacagtcaaaatgataggagttctcactttgtttaggtacagtgattggcaggataaactgtttatgtcccttgggacaatcatggctatcgctcacggaagtgggctacccctaatgatgatcgtgttcggggagatgactgataaattcgtggatactgccgggaacttttcatttcccgtgaacttctctctttcattactaaaccctggaaaaatcctcgaggaggaaatgactcgctatgcctactactattcggggctcggagctggggtgctcgtggctgcttatatacaggtgtcattttggacactcgccgcagggcggcagatccgcaaaattagacagaaatttttccacgcaattttgcgacaggagatcgggtggtttgatataaacgatacaactgaactgaatacacgcctcacagatgatatatccaaaatctcagaagggatcggggataaggtgggaatgttcttccaggccgtcgccacttttttcgcagggttcatcgtcgggttcatcaggggatggaaacttacattagtcataatggccatctcaccaatacttgggctctctgccgcggtatgggccaaaatcctctcggcgttctctgacaaggaacttgctgcatatgccaaagctggggccgtagctgaggaagctttaggagctatccggactgtgatcgcatttggaggacagaacaaagagttggagcgatatcagaaacatctcgaaaatgccaaggaaatcggaatcaaaaaagctatctccgcaaatatctccatggggatcgcattcctgttaatatatgcaagttatgccttagccttctggtatggatctacattagtgatttccaaagaatatacaattggaaacgctatgacggtgttcttttccatcctgatcggggctttctcagtggggcaggccgccccttgtatcgatgcctttgctaacgcccgcggggccgcttacgtgatattcgatatcatcgataataatccgaaaatcgattctttcagtgaaaggggacacaaaccagatagtatcaagggaaatttggagttcaacgacgtgcactttagttacccatcaagggctaacgtaaaaattctcaaggggcttaacctcaaagttcagtctgggcaaactgtggcactcgttgggagttctggatgcggaaaatcaactactgtgcagctcatacagcgactctacgacccagatgagggaacaatcaatattgatgggcaagatatccggaacttcaatgtgaactatctgcgagaaataatcggggttgtctctcaggaacctgtcttattcagtactacaatcgccgaaaatatctgttatgggagggggaacgtgacaatggatgaaatcaaaaaggcagtgaaagaagctaatgcttacgagtttataatgaaactgcctcagaaattcgacactcttgtgggagaaaggggggcccagctatcaggagggcaaaagcagcgaatcgcaatagctagagccctagtgaggaacccaaaaatactcctactagatgaagccacatcagcgttggatacagaatcagaggcggaagtacaggctgctctcgataaagcccgggaaggaagaactacaatcgtgatcgctcacagattgtccacagttcggaatgccgatgtcatagcagggttcgaagatggagtcatcgtcgaacagggatcccattcagagctaatgaaaaaagaaggggtttattttaaacttgtcaatatgcagacttctgggtcacagatccagtcagaagaattcgaactgaatgatgaaaaagccgctacacgcatggccccaaatgggtggaaatcgagactgttccgacattcaactcaaaaaaatcttaaaaattcgcagatgtgtcagaaatctctagatgtcgaaacagatgggctcgaagctaatgtgccccctgttagttttcttaaagtcttaaagctgaacaaaactgaatggccctacttcgtagtcggaacagtctgcgctatcgctaatggaggacttcagccagctttttctgttatcttctccgaaataatagctatatttgggcccggggatgatgctgttaaacagcagaaatgtaatatcttttctctcatctttcttttcttaggaattataagtttcttcacattctttctccaggggttcacttttgggaaagctggagagatactaactcgccgactgaggagtatggccttcaaagctatgctccggcaggatatgtcctggttcgatgatcacaaaaactcaactggagctctatcaacacgcctcgcaactgatgctgcgcaggtccagggggctactggaacaaggctcgctctcatcgcacagaacatcgctaatttgggaacagggattatcatatcctttatctatgggtggcagcttacactattgttacttgccgtggtacctataatagctgtttccgggattgtggaaatgaaactgctcgccggaaacgcaaagagggataaaaaggaactcgaagccgcgggaaaaatcgcaactgaagctattgaaaatatacgcactgtagtgtctctgacacaggaacgcaaattcgaatccatgtatgttgaaaaactctacgggccatacaggaacagtgtccaaaaagcccatatttatggaattacattctcaatctctcaggcctttatgtacttctcatatgctggatgttttcgctttggagcatatctaatcgttaacggacacatgagattccgggacgtcatcttggtgttttctgctatcgtgtttggggccgtggctctggggcacgcctcctcctttgcacctgattatgccaaagctaaactctccgccgcacatctctttatgctatttgaaagacagcccctcatcgactcttactctgaagaaggactcaaacccgataaatttgaaggaaatataacatttaacgaggtcgtattcaattatccaacaagggctaacgtaccagtactccagggactatcccttgaagttaaaaaggggcagacacttgctttggtggggtcttccgggtgcggaaaaagtacagtggtgcaactccttgaaagattctatgatcctctagctggaacagtgtttgtcgattttgggttccagctcctggatggacaggaagccaaaaaacttaacgtacagtggctccgcgctcagctcggaatcgtatcacaggaaccaatccttttcgattgttccatcgctgaaaacattgcctatggggacaattcgagagtggtgtcccaggatgaaatagtgtccgcagccaaagctgccaatatacaccctttcatcgaaacactgccacataaatatgaaacaagagtcggggataagggaacacagttgtcaggaggacagaaacagaggatagctatcgccagagccctcattagacagccacagatcctgcttctagatgaagcaacaagtgccctagatacagaatcggaaaaagtcgtgcaagaagccctggataaagctcgggagggaagaacatgcatagtcatcgctcatcgcctatccacgatccagaacgctgatttaattgtggtgttccagaacgggcgagttaaagaacacggaacacaccagcaactcttggcacagaaagggatttatttctccatggtgtcggttcaggcagggactcagaacctt

SEQ ID NO: 7635 - DNA, 3858 bp, Artificial Sequence
  Description of Artificial Sequence: Synthetic coding sequence
atggacctcgaagcagccaaaaacggtacagcctggcggcctacgagcgctgaaggggatttcgaactagggatctctagcaaacagaagcggaagaaaacaaaaaccgtgaaaatgataggcgtgcttacactttttaggtactctgactggcaagacaagctattcatgtcgctgggaacaataatggcaatcgcacatggcagcggactgcctctgatgatgattgtcttcggcgagatgactgataaattcgtggatactgcgggcaatttctcatttcctgttaacttcagtctgagcctcctaaacccaggtaaaattctcgaagaggaaatgactaggtacgcatactattatagtggcctcggagctggggtgctcgtagctgcctacattcaggtgagtttctggactctagccgccgggcgccagatccgaaagattagacagaagttctttcatgcgattctgcggcaagaaattgggtggttcgatattaatgacactaccgagctaaacacaagactcaccgacgacattagcaaaatctccgagggaattggtgataaagttggaatgttctttcaggccgttgcaacctttttcgcgggatttatcgtgggtttcattcgtggttggaaactcacccttgtgattatggctatatcccctattcttgggctgtccgcggcggtgtgggcaaagatcttgagtgcgttttcagacaaggagctggctgcctacgcaaaggcaggggcagtcgcggaggaggccctcggtgcaataaggacagtgatcgcattcggtggtcaaaacaaagagttggagaggtatcagaaacacctggaaaatgctaaggagattggaataaagaaggcaatatctgccaacatcagcatggggatcgcctttctcctgatctacgcatcctatgcattagccttctggtacggctccaccctagtgatttccaaggagtacactattggcaacgcaatgaccgtgttcttttctatacttatcggtgcctttagtgtggggcaggccgccccctgcatcgacgctttcgccaatgcacgcggcgccgcttacgtgatttttgatataatcgacaacaatcccaaaattgactccttcagcgagagaggccacaaacccgactctatcaaagggaacctcgagtttaacgatgtgcacttttcctacccttctcgcgccaacgtgaagatactgaaagggctgaatctgaaggttcagtccggccagacagtggcacttgtgggttctagcggatgcgggaagtccaccactgttcagcttattcagcgactgtatgaccctgatgagggcacaatcaacattgacggtcaggacatcaggaattttaacgtcaattatctcagggagatcatcggggtggtgtctcaggagcccgtcttgtttagcacaacgattgccgagaacatctgctatgggcggggcaacgtgactatggatgaaattaagaaagctgttaaagaggctaacgcctatgagttcatcatgaaacttccgcagaagttcgacactttagtgggggaacggggcgctcagctgtccggcggtcagaagcagcgcattgcaattgcccgcgccctggtgaggaatccaaagattttgctcctggatgaagctacatcagctctggataccgagagtgaagcagaagtgcaagctgctcttgataaggccagggaaggccgcacaaccatcgtgatcgcccatcgcttgagcactgttaggaacgctgatgttattgccggcttcgaggatggggtgatcgtagaacaaggctcacacagtgagttaatgaagaaagagggggtctactttaagctagtgaacatgcagacaagcgggtcccagatccagagtgaagagttcgagcttaacgacgagaaggcagcaacacgcatggcgcctaatggttggaagagccgactcttcaggcactcaacccagaagaatctcaaaaactcccagatgtgccaaaagtctctcgacgtcgagacagatggcttggaggccaacgtaccaccagttagttttctgaaggtgctcaaactgaataaaaccgagtggccatattttgtggtgggaaccgtctgcgcaatagccaatgggggcctgcaaccagcattttccgttattttctcggagatcatagcaatctttggccccggtgacgatgcagtgaaacagcagaaatgcaatatcttcagcttaatcttcctgtttctcgggataattagcttttttacattctttttgcaggggttcacttttggtaaagccggggaaatcctgacgcgccgtctccgtagcatggcatttaaagccatgttaagacaggacatgagttggtttgacgaccataagaattccaccggggccctttcaactaggttggctactgatgcagctcaggtgcagggtgcaactggtacgagactggcgctgattgctcagaacatagcaaatcttggaactgggataataatttccttcatttacggatggcagttaactctgctccttctggctgttgtgccgatcattgcagtgagtggaatcgtggagatgaaactactggctggtaatgcgaagagggataagaaagaactcgaggcagcgggcaagatagcaactgaggcaatagagaatatcagaaccgttgtgagtcttacccaggaaaggaaatttgagagcatgtatgtggaaaagctgtacgggccttacaggaacagcgtacagaaggcgcacatctatggtatcacattttctattagccaagctttcatgtattttagctatgcaggatgtttccgtttcggggcatacttgatcgttaatggtcatatgcgattcagggatgtgatccttgttttttccgctatcgtgttcggtgcagttgctctggggcatgcaagctcattcgcccctgattatgcgaaagctaaactgtcggctgcccacctgttcatgctgttcgagcgccagcccctgatcgactcctattccgaggaagggctgaagccagataagttcgagggcaacattacattcaacgaggtggtatttaactatcccacccgggccaacgtgccagtgctccaaggcctgtcactggaagtgaaaaaggggcagactctggcactcgtggggagctccggctgcggaaagagtaccgtcgtgcaactcctggagcggttctatgacccattggccggaacagtcttcgtggatttcggcttccagcttctcgatgggcaggaggctaagaaactgaatgtacaatggctgagggctcagctcggtattgtcagccaagagccaatcctcttcgactgctctattgctgaaaatatcgcttatggggataattcacgggtggtgagtcaggatgagattgtatccgccgccaaagccgcaaatattcaccccttcattgagacccttcctcataaatatgaaacccgagttggggacaaaggcactcagctgagcggcgggcaaaaacaacggatcgctatcgctagagccctaataagacagcctcagattctacttttagacgaggctacaagcgccttggacactgagagcgagaaagtagtgcaggaagctctcgacaaggcgagagagggacgaacctgcatagtgatcgcccatagactgtcaaccatccagaacgctgatcttattgtggtgttccaaaacggcagagtgaaggaacatggaacacatcagcagcttttggcccaaaaaggaatctatttctcaatggtgagcgtgcaggctggaacccagaatctg

SEQ ID NO: 7636 - DNA, 3858 bp, Artificial Sequence
  Description of Artificial Sequence: Synthetic coding sequence
atggatcttgaggcagccaagaacggcaccgcctggcggcctacaagtgcggaaggggatttcgaactcggcatcagctcaaagcagaaacgtaaaaagactaagactgttaaaatgatcggagtgctgactctcttcaggtactccgattggcaggataagctattcatgtccctgggaaccatcatggctatcgcgcacggatctggtctaccgctgatgatgattgtcttcggggagatgaccgataagtttgtggacaccgcaggaaacttctctttccctgtgaacttttccctgtctcttcttaacccaggaaagatccttgaagaagagatgacaaggtacgcttactattatagcggcctcggagcaggcgtcttagtggctgcatatatccaagtcagcttttggaccctggccgctgggcgccaaattaggaaaatcaggcagaagtttttccacgcaatccttcgccaggaaattggatggtttgatataaatgacaccaccgagctcaacacgaggctcacagatgacatcagcaagatcagtgagggtataggcgataaggtcggaatgttcttccaggcagtcgctacattctttgcaggtttcatcgtgggttttatacgcggctggaaactcacacttgtgattatggcgattagcccaatcttgggactcagcgctgcggtgtgggctaaaatcttgagcgcttttagtgataaagagttggccgcgtatgccaaagccggcgcggtagcggaggaagctcttggagctatcagaaccgtgattgcgttcggaggccaaaacaaagaactggagagatatcagaaacacctggaaaatgcaaaagaaatcggaattaagaaagccatctccgctaatatctcaatggggattgccttcctcctgatttacgctagctacgctcttgccttttggtacggaagcacacttgtcatctctaaggaatacactatcggcaatgccatgacggttttttttagcattctcatcggagcttttagcgttgggcaggccgctccatgtattgacgccttcgccaacgcgcgcggtgcagcttacgtcatcttcgatatcattgacaacaatcctaagatcgatagcttcagcgaacgcggtcacaagccagactccataaaaggcaacctggagtttaatgatgttcatttctcatatccttctcgggccaatgtaaaaatcttgaaaggcctcaacctgaaggtgcaaagcgggcaaactgtggccctggtcggctcctcaggctgtggaaaatcaaccaccgtgcaactgattcaaagactgtacgatccagatgagggaaccattaacatagatgggcaggacatccggaacttcaacgttaactacctgcgggagatcatcggtgtggtgtcacaggagccggtcctcttcagcacaacaatcgcagagaacatttgctatggaagaggaaacgtaaccatggatgagattaaaaaagctgtgaaggaagcaaatgcttacgagtttatcatgaaactgcctcagaaattcgatacactggtaggcgagcgtggcgcccaactgtccggtggccaaaagcagaggatcgcgatcgctcgtgcactggtgagaaatcctaagatcctgcttctggatgaggcaaccagcgccctggacacagagagtgaagcggaagtacaggctgccctagacaaagctcgggagggaaggaccaccattgtgattgcgcaccgcctttcgactgttagaaatgctgatgtgattgcaggattcgaagacggagtcatcgtggaacaggggtctcattctgaactgatgaaaaaggaaggcgtctactttaagcttgttaatatgcagacttcaggttcacaaatccaaagcgaggagttcgagctcaacgatgaaaaggccgcaacaagaatggcacccaatggctggaagtcgagactttttcggcattctacccagaaaaacctgaagaactctcagatgtgccaaaaaagtctcgatgtggagactgatggccttgaggctaacgtgccacccgtctcctttctgaaggtcctgaaactgaacaagacagagtggccatattttgttgtcgggactgtatgcgcaatcgccaacggcggtctgcaaccagctttcagcgtcatcttcagcgaaattattgccatttttggtccaggcgacgatgccgtcaagcagcagaaatgcaacatcttttcactcatttttctctttctgggaataatttcatttttcacattctttctgcaagggttcaccttcggaaaggctggagaaatccttacgagaaggttaagatcaatggcatttaaggcgatgttgcgacaagatatgagctggtttgatgaccacaagaacagcactggcgctctttccacccggctggctaccgatgccgcccaagtacaaggcgcaactggaacaaggctggccctgattgcacagaatatcgccaacttaggaacaggcataatcatcagcttcatttacggctggcaactgacgctgctccttctggctgtggtgccgattatcgcggttagtggaatagtggagatgaagctattggccgggaacgccaaaagggacaaaaaggaactggaagccgcaggaaaaattgccaccgaggccatagaaaacattcgaactgttgtatcgttaactcaagaacgcaaatttgagtcaatgtacgtggagaaactgtacggtccctatcgtaactccgtgcagaaagcacatatatacggaattacttttagcataagtcaagcattcatgtacttttcttatgccgggtgtttcagattcggagcctatcttatcgtaaatggccatatgagattcagagatgtgatcttagtgttttctgccatcgtgttcggcgctgtagctcttggccacgcctcctccttcgctcctgattatgccaaggctaagttatccgctgctcacctgtttatgctgttcgagagacagccacttatcgatagctactcagaggagggacttaaaccagataaattcgagggaaatatcacatttaacgaagttgtgttcaactaccccacaagggctaatgtaccagtgcttcagggcctgtcactggaggtaaaaaagggccagaccctggctctcgtcggcagttcaggatgcggaaagagcaccgtcgtccaattactggagaggttctacgaccccttggctggcacggtatttgtggattttggctttcagctcctggatggacaggaggctaaaaagctgaacgttcagtggctccgcgcacagcttggaatcgtgagtcaggaacccatcttatttgactgttccatcgcagagaacattgcatatggggataactcgcgggtggtgtcacaggacgagatagtgtcagctgctaaagctgctaacatccacccgtttattgagacactcccacataagtatgaaaccagggtcggcgacaagggtacccagctgagtggagggcaaaaacagagaattgctattgctcgtgctctcatcaggcagccccagatcctgctgctggacgaggctacttcagcgctggacactgagtctgaaaaagtggtgcaagaggcgttagacaaggcaagagaggggcggacctgtattgtgatcgcacacaggttgtctaccatccaaaacgctgaccttattgtcgtctttcaaaatgggagagtcaaggaacacggcacacatcagcaacttcttgcccaaaaaggaatctacttttctatggtgtctgtgcaggcaggtacacagaactta

SEQ ID NO: 7637 - DNA, 3858 bp, Artificial Sequence
  Description of Artificial Sequence: Synthetic coding sequence
atggatttggaagctgcaaaaaatggtacggcctggagaccaacttcagccgaaggagatttcgaacttggtatttcgtctaaacaaaaaagaaaaaaaactaaaaccgttaaaatgattggagttcttacactttttcgatatagtgattggcaagataaacttttcatgagtcttggtacaataatggctattgctcatggttctggacttccattaatgatgatagtctttggagagatgacagataaatttgttgatacagctggaaatttcagttttccagttaattttagtctttctttactaaacccaggtaaaattcttgaagaagaaatgactagatatgcttattattatagtggattaggagcaggagttttggtagcagcttatatacaagtttcattttggacattggctgctggacgacaaattagaaaaattagacaaaaattttttcatgctattcttagacaggagataggatggttcgacataaatgatacaacagaactaaatacaagacttactgatgatatttcaaagatttcagaaggaattggagataaagttggaatgtttttccaagctgttgctacattttttgctggatttatagttggatttattagaggatggaaattaactttagttataatggctatttcaccaattttaggtttatcagctgctgtctgggcaaaaatattaagtgcattcagtgacaaagagctcgcagcatacgctaaagctggagctgttgccgaggaggctttgggagctatacgtactgttattgcatttggaggacaaaataaagagcttgaacgttatcaaaagcatcttgagaacgctaaagaaattgggattaaaaaagcaatttcagcaaatatttcaatgggtattgcttttcttttaatttatgcttcatatgcattagctttttggtatggaagtactcttgttatttctaaggaatatactattggaaatgcaatgactgtttttttcagtatacttattggagcattttcagttggacaagctgctccttgtattgacgcttttgcaaatgcaagaggagcagcttatgtcatttttgatataatagataacaatccaaagattgatagtttttcagaacgagggcataaaccagattcaattaagggtaatttagaatttaatgatgttcatttttcatatccatcacgtgctaatgttaaaatattaaaaggtttaaatctaaaggttcaatctggacaaacagtagcattagttggatcttcaggatgtggaaaatcaactacagttcagcttattcaaagattatatgatccagacgaaggaacaattaatattgatggacaagacattagaaattttaatgttaactatttaagagaaataattggggttgtttcacaagaaccagttttattctcaacaactattgctgaaaatatttgttatggacgagggaacgttacaatggatgaaattaaaaaagcagtcaaggaagcaaatgcatatgaatttattatgaagttaccacaaaaatttgatacattagttggagaaagaggtgctcaattatcaggaggacaaaaacaaagaattgcaattgctagagcacttgtaagaaatccaaaaattcttctattagacgaagctacaagtgcacttgatactgaatcagaagctgaagttcaagcagctttggataaagctagagaaggacgaacaactatagttattgcacatagattatctacagttcgaaacgctgatgttattgcaggtttcgaagatggtgttattgttgaacaaggatctcatagcgaacttatgaaaaaggagggagtatattttaaattggtaaatatgcaaacttcaggatctcaaattcaatctgaagaatttgaattaaatgatgaaaaagcagcaactagaatggcacctaatggatggaaatcaagactttttagacattctacacaaaaaaatttgaaaaattctcaaatgtgtcaaaaatcactcgatgtagaaacagacggattagaagcaaatgtaccaccagtttcatttcttaaagtattgaagctaaacaaaactgaatggccatattttgttgttggaacagtttgtgcaatagctaatggaggacttcaacctgcattttcagtaattttttcagaaattattgctatcttcggaccaggtgatgatgctgttaagcaacaaaaatgtaatattttcagtttaatttttctatttttaggaattatttcattttttacattttttttgcaaggatttacattcggaaaagctggtgaaatattgacaagaagattaagatcgatggcttttaaagcaatgttgagacaagatatgtcttggtttgatgatcataaaaattcgacaggtgcattatctacacgtttagcaacagatgcagcacaagttcaaggagcaacaggaacaagattagcattaattgctcaaaatattgcaaatttaggaacaggaattattattagttttatttatggttggcaattaactttattacttcttgcagtagtcccaattatagcagtttctgggattgtagaaatgaagttacttgctggaaatgcaaaaagagacaaaaaggaacttgaagctgctggaaaaattgctaccgaagcaatagaaaatattagaactgttgtttcacttacacaagaaagaaagttcgaatcaatgtatgtagaaaaattatatggtccatatagaaatagtgtacaaaaggcacatatttatggaattacattttcaatttcacaagcattcatgtattttagttatgcaggatgttttagatttggtgcttatttaatcgttaacggtcatatgcgttttagagatgttattttagttttctcagctattgtttttggagctgttgcattaggacatgcatcatcgtttgccccagattatgctaaagcaaaattaagtgcagcacatttatttatgctttttgaacgacaaccattaattgatagttattcagaagaaggacttaagccagacaaatttgaaggaaatattactttcaacgaagttgtttttaattatccaacaagagctaatgttccagtattacaaggattatctcttgaagtaaaaaaaggacaaacattagcccttgtaggatcaagtggatgtggaaaatctactgttgttcaattattagaaagattttatgatccattagctggaacagtttttgttgatttcggtttccaattacttgacggacaagaagcaaaaaaacttaatgttcaatggttacgagcacaattaggtattgtaagtcaagaaccaattcttttcgattgttcaattgctgaaaatattgcttatggagataatagtagagttgtatcacaagatgaaattgtttcagctgctaaagcagccaatattcatccatttattgaaactcttccacataaatatgaaacgagagttggtgacaaaggtacacaattatcaggaggacaaaaacaaagaattgcaatagcaagggctcttattagacaacctcaaattttattattagatgaagcaacaagtgctttagatacagaaagtgaaaaagttgttcaagaagctttagacaaagcacgtgaaggtagaacttgtattgttatagctcatcgtttatcaactatacaaaatgcagatttaatcgtcgtttttcaaaacggtagagttaaagaacatggtactcatcaacaattattagctcaaaaaggaatttatttcagtatggtttctgtacaagccggtactcaaaattta

SEQ ID NO: 7638 - DNA, 3858 bp, Artificial Sequence
  Description of Artificial Sequence: Synthetic coding sequence
atggacttggaagccgcaaaaaacggaactgcctggcgcccgactagcgccgagggcgactttgaactcggaatctcatccaagcaaaaacgcaagaaaaccaagaccgttaagatgatcggtgtgctgaccctgttccgctactcggattggcaggacaaactctttatgtcgctgggaactattatggcaatcgcccacggatccggactgccgctgatgatgatcgtgtttggcgaaatgaccgacaagttcgtggataccgcgggcaacttctcattcccggtcaatttcagcctctcgctgctcaacccaggcaagatcctggaggaagagatgactcgctacgcctactactattccggactcggggctggagtgctcgtggcagcttacattcaagtctccttttggacccttgcagcaggacggcagatccgcaaaatccggcagaaattcttccacgcgatcctgcggcaggagatcggatggttcgacatcaacgacactaccgagctgaataccaggctgactgatgacatctccaagatcagcgaaggaatcggcgacaaggtcgggatgttcttccaggcggtggctacttttttcgcaggttttatcgtgggcttcatccgtggctggaagctgactttggtgatcatggccatctcacccatccttggcctttccgctgcagtgtgggccaagatcttgtcggcgttctcggataaagagctggcggcgtacgcaaaggccggcgccgtggcggaggaggcgctcggcgccatccgcaccgtgatcgccttcggagggcaaaacaaggagctcgagagataccagaagcatctggagaacgccaaagagatcggcatcaagaaagcaatctcagccaacatctcgatgggcatcgctttcctgctcatctacgcttcgtacgcccttgctttctggtacggctccaccctggtgataagcaaagagtatactatcggtaatgcgatgactgtctttttctcgatcctgatcggagcgttctccgtcggacaggcggcaccgtgcatcgacgcgtttgcgaacgctaggggcgctgcctacgtgatctttgacatcatcgataacaacccaaagatagattcgtttagcgaacgcggacacaagccagactcaatcaagggaaacctggagtttaatgacgtgcacttctcctacccatcacgggccaacgtgaagatcctcaagggactcaatttgaaagtccaatccggacagaccgtggcgctcgtcggatccagcggatgtggaaagtcgactactgtccagcttatccagcgcctttacgacccagacgaaggaactatcaacatcgacggccaggatatccgcaatttcaacgtgaattacctcagggagatcatcggagtcgtctcccaggaacccgtgctcttctccacgactattgcggagaacatttgctatggccgcggaaacgtgactatggacgaaatcaagaaggcagtgaaagaggcgaacgcgtacgaattcatcatgaaactgcctcagaaattcgacactttggtgggcgaacggggtgcacaactttcgggaggccagaaacagcggatcgcgatagcgcgtgcgctggtcagaaacccgaaaatcttgttgttggacgaggcgacgtcggcgctggatactgaatccgaggctgaggtgcaagctgcactggataaagcacgggaaggccgcactaccatcgtcatcgcccaccgcctttccaccgtgcgcaacgccgatgtgatcgccggattcgaggacggagtgatcgtggaacaaggatcgcattcagagctcatgaagaaagaaggggtgtacttcaagctggtgaatatgcagacctccgggtcccaaatccaatcggaagagttcgaattgaacgatgaaaaggcggcgaccagaatggccccgaacggatggaagtcccggctgttccgccactccacccagaagaatctcaagaacagccagatgtgtcaaaaatcgctggacgttgaaactgatggcctggaagctaacgtgccgccagtgtcatttctgaaggtcttgaagctgaataagaccgagtggccctacttcgtggtggggactgtgtgcgcaatcgcgaacggaggattgcagccagccttcagcgtgattttcagcgagatcatcgcaattttcggacctggagatgatgccgtgaagcagcagaaatgcaatatcttctcgctgatttttctctttcttggcattatctcgtttttcaccttcttcctccaaggtttcaccttcggaaaagcgggcgaaatcctcacgagacgcctgcgctcaatggcgttcaaggcgatgctgagacaggacatgtcttggtttgacgatcataagaatagcaccggggcgctgtcgaccaggctcgccaccgatgcggcccaagtccagggagcaactggaacccggctggcgctgatcgcacagaacattgccaacctcggcactgggatcatcatctcctttatctacggttggcaactgactcttctgctcttggccgtcgttcccatcatcgcggtgagcggcatcgtggaaatgaagctcctcgccggaaacgctaaaagggataagaaggaactggaagccgcgggtaagatcgcaactgaggccatcgaaaacatccgcactgtggtgtcgctgacccaagaacggaagttcgagtcaatgtacgtcgagaagctctacggtccttaccggaactcggtgcagaaggcgcacatctacggaatcactttcagcatcagccaagccttcatgtacttcagctacgccggatgctttagattcggagcgtacctcatcgtgaatggccacatgcggttcagagacgtgatcctggtgttctcggccatcgtattcggggctgtggcactgggacacgcctcctcatttgccccagactacgcaaaggcgaaactgagtgcggcacatttgttcatgctcttcgaaaggcagccgttgatagatagctactcagaagagggactgaagccagataagttcgaaggaaatatcactttcaacgaagttgtctttaactacccgaccagagcaaacgtgccagtcctccaaggactctccctcgaagtgaagaaggggcagaccctcgcactggtgggttcctccggttgcggtaagtcgaccgtcgtgcaactgttggagcgcttctacgatcccctggccggaactgtgttcgtcgatttcggatttcaactgctggatggacaagaagctaagaagctcaacgtccaatggctgcgagcccaactcggaatcgtgtcgcaagaaccaatcctctttgactgctccattgccgagaacattgcttacggtgataactcccgcgttgtgtcccaggacgaaatcgtgtcagccgccaaggcggccaacattcatccgtttatcgaaaccctgccgcacaagtacgaaacccgcgtcggagataaagggacccagctctctggagggcagaagcaaaggatcgccatcgcgcgcgccctcatccgtcagccgcaaattctgctgctggacgaggctacttccgctctggacaccgaaagcgagaaagtggtccaagaagcgctggacaaggcgcgggaaggaagaacgtgcatcgtgatcgcacatcgcctgtcgactattcaaaacgccgatctgatcgtggttttccagaatggaagggtcaaagagcatggaacccatcaacaactcttggcacaaaagggcatttacttctccatggtttcagtccaggctggaacccaaaacctg

SEQ ID NO: 7639 - DNA, 3858 bp, Artificial Sequence
  Description of Artificial Sequence: Synthetic coding sequence
atggaccttgaggctgctaagaatgggacagcatggcggcccacctcagctgagggtgactttgagttggggatcagttcaaaacaaaaacgcaagaaaactaagactgtgaagatgattggcgttttgacattgttccgttattcggactggcaggacaaactgtttatgtccctcgggactataatggcgattgcgcacggctctggcttgccattgatgatgatcgtctttggggaaatgactgacaagttcgttgacaccgcaggcaatttttcttttcccgtaaacttttcactatcccttctgaatccaggaaagatactcgaagaagaaatgacgcggtacgcctattactatagcgggcttggagcgggcgtgttagtggcagcctacattcaggtgtcgttctggacccttgccgcaggccggcagataagaaagatacgtcagaagttctttcatgccatactcagacaggagatcggctggttcgacataaacgatacaaccgagttgaacactagactaacggacgacatttcgaaaatatctgaggggattggtgataaggttggcatgtttttccaggcagtggccacattctttgctggttttatagtgggattcatcagggggtggaaattgaccctcgtaatcatggccatttctccaattctgggcctttctgctgccgtgtgggcaaagatcctgagtgcattttccgacaaggaattagccgcttatgccaaggccggcgccgtggcagaagaggcactgggggcaatccgcacagttattgcgttcggcggccagaataaggaactcgagcgctatcagaagcatcttgagaacgccaaggagataggtatcaaaaaggccatatcagccaacatttccatgggaatagcctttctgctgatctatgcctcctacgcgttagctttttggtacggttccacgctggtgatcagtaaggagtatactataggaaatgcgatgacagtgttttttagcattctgattggcgcgttctccgtggggcaggccgctccctgcattgatgctttcgctaatgccagaggagcggcatacgtaattttcgacatcattgacaataaccctaagattgatagcttctctgagagaggacataaaccggactcaattaagggcaatctggagtttaatgacgtgcatttctcctaccccagtcgggccaacgttaaaatcttgaaggggctgaacctgaaggtgcagagcggacaaacagtagcactggtggggagctctggttgtggcaaatcaaccaccgtccagctgattcagaggctgtatgatcctgatgagggcacgattaacatagatggtcaagatatccggaattttaacgtgaactacctccgagaaataataggtgtggtgagccaagagccagtgctcttttcgaccacaattgctgagaacatttgctacgggcggggtaatgtgactatggatgaaataaagaaggccgtgaaggaggcaaatgcgtatgaattcattatgaagctgccgcagaagtttgacactctggtgggcgagcgcggggctcaactctccggggggcagaaacagaggatcgcaatcgccagagcgttagtgcggaacccgaagatactcctgcttgatgaagctacatccgcattggatactgaatccgaggcagaagtgcaggctgctttggataaggccagagaaggtcggaccaccatagtaatcgcacacaggctcagcactgtgcggaatgctgacgtgattgccggattcgaggatggcgtgatagtggaacagggatcacattccgagctgatgaaaaaggaaggtgtttactttaagttagtgaatatgcagacttccggaagtcagattcagtctgaagagttcgagctgaacgacgagaaagccgccacacgcatggcccccaacggctggaaatcgcgcctcttcaggcattctacacagaaaaatttaaaaaatagccaaatgtgccagaaatccctggatgtggaaacggacggcctggaggctaacgtcccgcccgtttcttttttaaaagtccttaagctgaataaaacagaatggccttattttgtagtgggtacggtttgcgctattgcgaatggagggctccaaccagctttttcagtgatatttagtgagattatcgcgatatttggccccggcgacgatgctgtgaaacagcagaaatgtaatatcttttccctgatcttcttgttcctgggcatcatctcgttttttacattcttcctacagggcttcaccttcggtaaggccggcgaaatccttactaggagattacgcagtatggcattcaaagctatgctccggcaggatatgagctggtttgacgatcacaaaaactccacgggcgccctatccacccgcctggcaaccgatgctgctcaagtgcaaggcgctacaggcacaaggctggcccttattgcccagaacatcgccaacctgggaaccggcataataatatcttttatttacggttggcagttgaccctgttactgctggctgttgtgccaatcattgccgtctcagggatcgtcgagatgaagctgctggcaggcaatgcgaagcgcgataagaaggaacttgaagcagccggtaagatagctacagaggctattgagaacatcaggaccgtcgtttcccttacgcaggaacggaaattcgagtctatgtacgtagagaagctgtatgggccgtacagaaattcggtccaaaaggcccacatctacggaatcaccttctcgatctcacaggctttcatgtatttttcatatgccggctgttttcggtttggggcatatctaatcgtgaacgggcacatgagattccgggacgtaatactcgtattctcagcgattgtgttcggcgcggttgcactgggtcacgcgtcttcgttcgctccggattatgccaaggctaagctatccgcggcccatttatttatgctgtttgagcgccagccactcattgacagttactccgaagaggggcttaaacccgataagtttgagggcaatataacattcaacgaagtagttttcaactacccaacacgggcaaatgttcccgttctacaggggctgtcgctggaagtaaagaaaggccagacgctggctctggtcggctcctccggttgtggaaagtccacggtggtacagttactagagagattttatgacccattggctggaaccgtatttgtggacttcggctttcagctgttggacgggcaggaagctaaaaagttgaatgtccagtggcttagggcacaactcgggatagtgtcgcaagaaccaatactcttcgactgttcaatagcagagaacattgcttatggcgataatagtcgggtggtctcccaagatgaaatcgtgtccgcagcaaaagccgcaaatattcacccttttatcgagaccctgccccacaagtacgagactagggttggcgacaaaggcacccagctgagtggaggccagaagcagagaatagctattgctagggccctgataaggcagccacagattttgctgctggacgaggcaacttcggccttggatacggagtcagagaaggtggtccaggaagcattggacaaggcgcgggaggggagaacctgcatcgtcatcgcccacagactgagcaccatccaaaatgcggatctcattgtcgtctttcagaacgggcgggttaaggaacacgggacccatcaacagctgctcgcacagaaaggcatatatttttctatggtgagcgtacaggcgggaacccagaacttg

SEQ ID NO: 7640 - DNA, 3858 bp, Artificial Sequence
  Description of Artificial Sequence: Synthetic coding sequence
atggatctggaggccgctaagaatggcacggcctggcgacccacgtccgcggagggagactttgagctgggaatctccagtaagcagaaacgcaaaaagaccaaaacagtgaagatgatcggcgttcttaccctcttccgctactcagattggcaggacaagctgtttatgtctctggggaccataatggccatagcacacggatctggcttgcccctcatgatgatcgtttttggagaaatgactgataaattcgtggacaccgctggtaactttagtttccctgtcaattttagcctgtctttgcttaaccccggaaagatcctggaggaagagatgacacggtacgcttattactacagcggtctgggagcaggagtgttggtcgcagcctacatccaggtctccttctggactttggcagcaggacggcaaatcagaaagatacggcaaaaattttttcatgccatccttcggcaggagatcgggtggttcgacattaacgatacaactgagctgaacacgcgattgaccgacgacatctctaagattagtgagggcatcggcgataaggtaggaatgttcttccaggccgtcgcaacattcttcgcagggttcatcgtgggattcatccgaggctggaagctcaccctggtgattatggcaattagtccaatactgggtctctccgcagctgtgtgggctaaaattctgagtgccttttcagacaaggaacttgcggcttatgccaaggctggagctgtggccgaggaggcgctgggcgccatccgcaccgtgatcgctttcgggggacagaacaaggagctggaacgatatcaaaagcatctggagaacgcaaaggagattgggatcaagaaggcaatttcagccaacatatcaatgggcattgccttcctgctgatatacgcgtcctatgcactggccttctggtacggcagcacattggtcatctcaaaggagtatacaatagggaacgcgatgaccgtgtttttttccatcttgattggggccttcagcgttggccaggccgccccgtgcatcgatgcctttgctaacgcccgaggagctgcatatgtgattttcgatatcattgacaataatcccaagatcgatagctttagcgaacgcggacataagccagattctatcaagggcaacctggagttcaacgatgtgcattttagttacccaagtcgcgctaatgtgaagatcctgaagggtctcaatttgaaggtccagtccggacagacagttgccctggttggatctagcggatgtggcaagtccaccactgttcagctgatccagagactgtacgaccctgacgaaggaacaattaacattgacgggcaagacatcagaaacttcaacgtgaactacctgcgcgagattatcggagtggtgtcacaggaacccgtgttgtttagcactaccatagcggagaacatttgctatgggagaggcaatgtgactatggatgaaatcaaaaaggccgtgaaggaagctaacgcctacgaatttatcatgaagcttccccagaagttcgatacgctcgtcggtgagcgcggagcacagctgtcaggcgggcagaagcagagaatcgcgatcgctcgagctctcgttagaaacccaaaaatattgctgctggacgaggctaccagcgccttggacaccgagtccgaggctgaagtgcaggctgcgttggataaggcacgggagggccgcaccacgatcgttattgcacaccgcctgtctaccgtcaggaatgcagacgttattgctggctttgaagatggagtcatagtggaacaagggtcccactcagaacttatgaagaaagagggagtctatttcaagctggtcaatatgcagacgtccgggtcacagatccaaagcgaagagttcgaattgaacgacgaaaaagccgccacacgcatggcccctaatggctggaagagcaggctcttcagacattctacacaaaagaatctgaagaatagccagatgtgtcaaaaaagtctggatgtggagacggacggcctcgaagccaacgtgcctccagtctcattcttgaaggtcctcaaattgaacaaaacagaatggccctacttcgttgtgggcacagtatgtgcaatcgcaaacggcggtctgcagcccgcattttctgtaatattctcagagattattgctatattcggaccaggcgacgatgccgtgaaacaacagaagtgcaacattttttctctgatctttctctttttgggtatcatttcatttttcaccttttttctgcaagggtttacgttcggaaaggccggggagattctgacaaggaggctgagatccatggccttcaaggctatgctcaggcaggatatgagctggtttgacgaccataagaattctaccggggccctttctaccagactcgccactgatgctgcacaggtccagggcgctacgggtacgcgactcgcactcatagcccagaacattgctaatctgggaacaggtatcatcatttccttcatctatggctggcagcttacactcctgctgctggctgtggttccaatcatcgccgtgtcaggaatcgtggagatgaagctgctggccggaaatgcaaagcgcgataaaaaagaactggaggcagccggcaaaatcgcaaccgaagcaattgagaacatccgcacagtcgtatcactcacgcaggaaaggaagttcgaatcaatgtacgtcgaaaaactgtacggcccatatcggaatagtgtgcagaaggctcatatttatggcattacattcagtatttcccaggctttcatgtatttctcctatgcagggtgcttccgctttggggcttacctgatagtcaatgggcacatgcggttccgagatgtgatcctggttttctcagccattgttttcggcgctgtcgcacttgggcacgcctcctccttcgctcccgattacgccaaggccaaactgagcgccgcccacttgtttatgctgtttgaacgccagccattgatcgatagctatagtgaagagggcttgaagcctgacaagttcgaggggaatattactttcaatgaggtagtgttcaattatcctactagagccaatgtgccagtactgcaaggcctgagtctggaggtcaaaaaaggccagacccttgcattggtggggtcctccggatgtggcaaatctactgtggtgcagcttttggagcgcttttacgaccccctggctggaactgtgttcgtggacttcggcttccaactgctggatggccaggaagccaaaaaactgaatgtgcagtggctgcgggctcagctcggcatagttagccaagagccgatccttttcgactgttctatcgcggaaaatatcgcatacggcgacaattctcgagtggtgtctcaggacgaaatcgtgtcagctgctaaggccgccaatatccacccctttatcgaaacactgccacacaagtatgagaccagggtgggggataaagggacccaactttccggcggccagaagcaaaggattgccatcgcccgggcgctgattcgccaaccgcagattctgttgctggatgaggccacaagcgcccttgacactgaatcagagaaggtcgtgcaggaggcactcgacaaggctcgggaggggaggacctgtatcgtgatcgctcatcgcctgagcaccattcagaatgcagatctcatagtcgttttccagaatggccgagtcaaagaacacggaacgcatcagcaactgttggctcaaaaaggcatatactttagtatggtcagcgtgcaggcaggaactcagaacctg

SEQ ID NO: 7641 - DNA, 3858 bp, Artificial Sequence
  Description of Artificial Sequence: Synthetic coding sequence
atggatctggaagcagcaaagaacggtaccgcctggcgccctacctccgcggaaggggattttgaattgggcatctcgtctaagcagaagaggaaaaagaccaaaactgtcaagatgatcggagtgctgaccctgttccggtactcagactggcaggataagctgttcatgtcacttggtaccatcatggccatcgcccacggatccggactcccactcatgatgatcgtgtttggagagatgaccgacaagtttgtggatacggccggaaacttttctttcccggtgaatttctccctgtccctgctcaatcccggaaagatcctcgaggaggagatgacccgctacgcctactattacagcggcctgggtgccggagtgctcgtggccgcttacatccaagtctcgttctggactctcgcagcaggacggcaaatccgtaaaatccgacagaaattcttccatgcaatcctccggcaggaaatcggttggttcgacattaacgatacgactgaactgaatacccgcctgacggatgacatctctaagattagcgagggtatcggcgataaggtgggaatgttctttcaagctgtggcgaccttcttcgctggcttcatcgtgggattcatcaggggctggaagctgactctggtgatcatggcaatctccccgatcctgggcctgtcagcggctgtctgggctaagatactgtcggccttctccgacaaggaactcgcagcatacgccaaagcgggcgccgttgctgaagaagcccttggcgccattcgcacggtgatcgcctttggaggccaaaacaaagaactggagagataccaaaaacaccttgaaaatgccaaggagatcggcatcaagaaggcaatctctgccaatatcagcatgggtatcgcgtttttgctgatttacgcgtcctatgcgctggcgttctggtacgggtccaccctcgtgatcagcaaggaatacaccatcggaaacgccatgactgtgttcttctccatcttgattggagccttctccgtggggcaggccgccccgtgcatcgatgctttcgcgaacgctcggggagctgcgtatgtcatctttgacatcatcgacaacaaccctaagattgactcgttctcggaaagaggacacaagcccgactccatcaagggcaatctcgagttcaacgatgtgcacttctcgtacccttcccgcgccaacgtgaagatactcaagggccttaacctcaaggtgcagtcgggccagaccgtcgccctcgtgggaagcagcggttgtggaaagtctaccaccgtccaactcatccagcgcctgtacgacccagacgagggcaccatcaacattgatgggcaggacatcaggaacttcaatgtgaattacctgcgcgagatcatcggggtggtgtcacaggaacccgtgttgttcagcactactatcgccgaaaacatctgctacggacggggaaatgtcacgatggacgagatcaagaaggccgtgaaggaggcaaatgcttacgagtttatcatgaagctgcctcagaaattcgacactttggtcggcgaacggggcgcccagctctcggggggacaaaagcagaggattgcaatcgcacgcgcgctggtgaggaacccgaagatcctgctcctggacgaagcaacctcagcacttgataccgaatccgaagccgaagtgcaggcggcattggataaagcaagggaaggaagaactactattgtgattgcccatcgactgtcgaccgtgaggaacgccgacgtgatcgcaggattcgaggacggagtcatcgtcgaacaggggtcccattcggagttgatgaagaaggagggagtgtacttcaaacttgtcaacatgcagacgtccgggtcgcagatccagtcggaagagtttgagctcaatgacgagaaggcggcgactcggatggccccaaatggatggaaatcgcggcttttccgccactccactcaaaagaacctcaagaactcacaaatgtgccagaaatccctcgacgtggaaactgacggacttgaggccaacgtccctcctgtctcgtttctgaaggtcctgaagttgaacaaaactgagtggccgtatttcgttgtcggcaccgtttgtgctatcgcaaatggggggctccaaccggccttctcggtgatcttctcagagatcatcgcaattttcggacctggcgatgatgcagtgaaacaacaaaagtgcaatatcttctcactgattttcctcttcctcggcataatctcattcttcactttctttctgcaagggtttactttcggtaaggcgggcgaaatcctcactcgcagactgcgcagcatggcctttaaggccatgcttcgacaggatatgtcgtggttcgatgaccataagaactcgactggagcgctgagcacccgcctcgctacggacgctgcccaggttcagggtgcgaccggcacccggcttgcgcttatcgcccagaacatcgcgaacctgggtaccggaattatcatcagcttcatctacggctggcaattgacgttgctcctgctggctgtggttccgatcattgccgtgagcggaatcgtggagatgaagctgttggccggaaacgcgaagcgggacaaaaaggaactggaggccgcaggaaaaatcgccaccgaagcaatcgaaaacatcaggaccgtcgtgagcctgacgcaggagcgcaaattcgaatccatgtatgtcgagaagctgtatggaccctaccgaaattcagtgcagaaggcacacatttacggaatcactttcagcatttcccaagcgtttatgtacttttcatacgctggatgtttccgctttggagcctacctgattgttaacggacatatgaggttccgggacgtgatcttggtgttctcagctatcgtgttcggcgctgttgcactgggacatgcgagcagcttcgcccccgactacgccaaagcaaaactgtcggcggctcacctcttcatgctgttcgaacgccaaccgctgatcgattcatactctgaggaagggttgaaacccgacaaattcgagggaaatatcaccttcaatgaggtcgtctttaactacccgactcgggcgaacgtccccgttctgcaaggcctctccctcgaggtcaagaaggggcaaactctggctctggttggaagctccggatgcggcaaatcgaccgtggtccaactccttgagcgcttttacgatccactggctgggaccgtgtttgtggacttcggctttcagctcttggacgggcaggaggcaaagaaacttaatgtgcagtggctgagggctcagctcggtatcgtgagccaggaaccgatcctctttgattgctcaatcgcagagaacatcgcgtacggagacaactcccgcgtggtgtcacaagacgagattgtgtccgccgccaaggcagctaacatccacccgttcatcgaaaccctcccacacaagtacgaaacgcgcgttggtgataagggtactcagctgtctgggggacagaagcagcgtatcgccattgcgcgcgccctgatccggcagccacaaattctgctgctggatgaggccacttcagccctggatactgagagcgagaaggtggtgcaggaggccctggacaaagcgagagaaggccggacctgtatcgtcattgcccaccggttgtcgactatccagaacgccgatctgatcgtcgtgttccaaaatgggcgggtcaaagaacacggaacgcatcagcaactgcttgcccaaaaaggaatctacttctcgatggtgtccgtgcaagcaggcacgcagaatctg

SEQ ID NO: 7642 - DNA, 3858 bp, Artificial Sequence
  Description of Artificial Sequence: Synthetic coding sequence
atggatctggaagccgcaaagaatgggactgcatggcgcccaacgagtgcggagggcgacttcgaactcggtatctcgtcgaagcaaaagcggaaaaagactaagaccgtgaaaatgatcggagtgctgaccctcttccgctactcagactggcaggacaagctctttatgtcgctgggaactataatggcaatcgctcacggatccggtctgccgttgatgatgatcgttttcggcgaaatgacggataagttcgtggacaccgcggggaatttctcctttcccgtgaacttttcactctcgctcctcaatccaggaaagatcctggaagaagagatgacgcgctacgcgtactactactctggactgggcgccggtgtgctggtcgccgcatacatccaggtgtccttctggactctggcagccggacggcagatccgcaaaattcggcagaaattcttccatgccatcctccggcaggaaattggatggttcgacatcaacgataccactgagctgaacacccgcctgactgatgatatctcaaagatttcggaaggaatcggggacaaagtgggcatgttttttcaggctgtggctactttcttcgccgggtttatcgtggggtttatcaggggttggaaattgacgcttgttatcatggcgatctcgccgattttgggactgtcggccgccgtgtgggcgaaaatcctgtctgcgttttccgacaaagaactcgccgcgtacgcaaaggcaggggctgtcgcagaagaggcactcggagcgatccgcacggtgatcgctttcggtggacagaataaagagctggaaaggtatcagaaacatctcgagaatgctaaggaaattggaataaagaaggctatcagcgccaatatcagcatgggaatcgcctttctcttgatctacgcctcgtacgcactggccttctggtacggatcgaccctcgtcatctccaaggagtataccatcggcaatgccatgaccgtgttcttctcgattctgattggagccttctcggtcggtcaggcggccccttgcatcgacgccttcgcaaacgccagaggcgcagcgtacgtgatcttcgacattattgataacaacccgaagattgacagcttctccgagaggggtcacaaaccggattcaatcaagggcaatctggaattcaacgacgtgcacttttcgtacccgtcacgagccaacgtcaagattcttaaaggcctcaatctgaaagtgcagtctggacagactgttgctctggtcggctcgtcaggatgtgggaaaagcactaccgtgcaactgatccaacggctctacgacccggacgaagggaccattaacatagacgggcaggacatccgcaactttaacgtcaattacctgcgcgagattattggggtggtgagtcaggagccagtgctgttctccaccaccatcgcggaaaacatctgctatggacggggcaatgtgaccatggatgaaatcaaaaaggccgtgaaggaagcgaacgcctacgagttcatcatgaagctccctcaaaagttcgacactctcgtgggtgaacggggtgcacagttgagcggagggcaaaagcaacggatcgccatcgcgagggctctggttcgcaaccctaaaatcctgctgctggatgaggctacgtcagcgttggacaccgagtcggaagctgaggtccaagccgccctggacaaggcccgggagggacgaaccactatcgtgatcgcacatcggctgtccaccgtgcgaaacgccgacgtgatcgccggattcgaggacggcgtgatcgtggagcagggctcccactccgaattgatgaaaaaggaaggcgtgtactttaaactcgtgaacatgcagacctccgggtcccagatccagagcgaagagttcgagctcaatgatgagaaggccgccactagaatggcaccaaacggatggaagtcccggcttttcagacactcaactcaaaagaacctcaaaaactcccagatgtgccaaaaatcactggacgtggaaactgatggacttgaagccaacgtgcccccggtgtcattcctcaaggtgctcaaactgaacaagaccgaatggccatacttcgtggtgggcacggtgtgcgctatcgcgaatggaggccttcagccggctttctccgtcattttcagcgaaatcatcgccatcttcggaccaggtgatgacgccgtcaagcagcaaaaatgtaatatcttctctctcatcttcctgttccttgggataatctccttctttactttctttctgcagggcttcaccttcggaaaggcgggagaaatcttgactcggcggctcagatcaatggccttcaaagcgatgctgcggcaagatatgtcctggttcgatgaccacaagaactccaccggtgcactctctaccagactcgctaccgacgcggcccaggttcagggggccaccggaacgagactcgcgctcattgctcaaaacatcgcgaacctcggcaccggcattatcatctccttcatttacggatggcaacttactctcctgttgttggctgtcgtgccaatcatcgcggtgtcaggtattgtcgagatgaaactgctcgccggaaacgccaaaagagacaagaaggaacttgaggcggcgggaaaaatcgccaccgaagcgatagagaatatccggaccgtagtgtccctgacccaagaacgcaagtttgaatcaatgtacgtggagaaactgtacggcccgtatagaaatagcgttcaaaaggctcatatctacggaatcaccttttcgatctcccaggcgttcatgtacttctcctacgcaggttgctttcggttcggagcgtaccttatcgtgaatggacatatgcgctttagagacgtgatcttggtcttttccgctatcgtgttcggagccgtcgcgcttggacacgcctcatccttcgcccctgactacgcgaaggcgaagttgagcgcggcgcacctgttcatgctcttcgagagacagccgctgatcgattcgtactcggaggagggactgaagcccgacaagttcgaaggtaacatcaccttcaacgaggtcgttttcaactaccctacgagagccaacgtcccagtcctccaaggactttcgttggaagtcaaaaagggccagactttggccctcgtgggcagctctggctgcggcaagtcgacggtcgtgcagctgctggaaaggttctatgaccccctggcgggaaccgtttttgtggatttcggtttccagctcctcgacgggcaagaggccaagaaactgaacgttcaatggctgagagcgcagctgggcatcgtgtcacaagagccaatcctcttcgattgcagcatcgccgagaacatcgcctacggggacaacagccgcgtggtgtcacaggacgagatcgtctcggccgcgaaagccgccaacatccacccgttcatcgaaaccctgcctcacaagtatgaaactagagtgggagacaagggaactcagttgagcggcggtcagaagcagcgcattgccatcgccagggcgctgatccgccagccgcaaattctgttgcttgacgaagccacctcggctctcgacaccgaatcggagaaagtggtgcaggaagcgctcgacaaggccagagaagggagaacctgtattgtgatcgctcataggctcagcacgatccagaatgccgatctgatcgtggtgttccaaaatggacgcgtcaaggagcatgggacccaccaacagcttctggcccaaaaagggatatacttcagcatggtgagcgtgcaagcgggaactcagaacctg

SEQ ID NO: 7643 - DNA, 3858 bp, Artificial Sequence
  Description of Artificial Sequence: Synthetic coding sequence
atggatcttgaggcagccaaaaacggaacagcatggcgccccacctccgcagagggggactttgagcttggaatttcatctaagcagaaaagaaagaaaaccaaaacggtgaagatgatcggtgttctgaccctcttcagatattcagattggcaggataagctctttatgtctctgggcaccattatggccatcgcccacgggtcagggctgccccttatgatgattgtcttcggcgaaatgacagacaaatttgtggacaccgctgggaacttcagcttccctgtcaacttctctttgagcctccttaatccgggcaagatcctggaggaggagatgactcgatacgcatactactactcggggttgggagcgggcgtactggtagcggcctatatccaggtgtccttctggacactcgccgccggccgccaaattaggaagatccgccagaagttcttccatgcgatcctgagacaggagattggttggttcgacataaacgacactaccgagttgaacacccggttaacagacgacatatcgaagatctccgaaggcatcggagacaaggtaggtatgttttttcaggccgttgctacgttcttcgcgggctttattgttggcttcatccgagggtggaaactcacactggtgatcatggcgattagccctatcttagggctctctgcagccgtctgggcaaagattctgtccgccttttcagataaggaactggccgcttatgctaaggccggggccgtcgccgaggaggccctgggtgcaattaggaccgtgattgcttttgggggtcagaataaggagctcgagagataccagaaacatcttgagaatgctaaggaaatcggtattaagaaggcgattagcgccaacatctcaatggggattgctttcttactgatttatgctagctatgccctggccttttggtatgggtcaaccctggtcatatccaaggagtacacaatcggcaacgccatgacggtgttcttctcgatcttaataggggcttttagtgtcggccaagctgccccatgtatcgatgcatttgcgaatgcacggggcgccgcctacgtcatttttgatataatcgacaacaatcctaaaattgacagtttcagtgaacgcggacataaaccggatagcatcaagggtaatttggaattcaatgatgttcatttctcttatccctcccgtgccaatgttaagatactaaaaggccttaacttgaaggtgcagtctgggcaaactgtggctctggtcgggagttccggatgcggcaagtctaccacagtgcaacttatccaacggctgtacgatccagacgagggtaccataaatattgacggccaggacattaggaatttcaacgtgaactatctgagggaaattataggcgtggtctcacaggaaccagttttgttcagcacgactatcgcagagaacatatgttatggccgcggcaacgttactatggatgaaatcaagaaggctgtgaaggaagcaaatgcctatgagtttatcatgaagctcccccagaagtttgatactctcgtcggtgaacgaggagctcaactgtcgggcggccagaagcaaagaatcgctattgctcgtgctttggttaggaatcctaagatcctccttctcgatgaggccacatctgccctagacacggagtctgaagcggaagtgcaagctgctctagataaggcccgtgagggccggaccactatagtcattgctcacaggctctctacagtccgcaacgccgatgtgattgccggcttcgaagacggcgtgattgtggaacagggatcccacagcgagctcatgaagaaggagggggtgtacttcaagctagtgaatatgcagactagcggctctcagatccagtccgaggagtttgagctaaacgacgagaaagctgcaacacgaatggcgcctaatgggtggaagtcccgcctttttcgccacagcacacagaagaacctcaaaaactcgcagatgtgccaaaaaagcttggacgtcgagaccgatggactggaggccaatgtgccacccgtgtccttcctgaaggtgctgaagcttaataagacggagtggccttattttgtggtaggtacagtgtgcgctatcgccaacggcgggcttcaaccagccttctctgtgattttctccgaaattattgccatcttcggaccgggcgacgatgccgtgaagcaacagaagtgtaacattttcagtctaatcttcctgttccttggcataatttctttctttacgttcttcctgcaggggtttacgtttggcaaggccggtgaaatcctgacgcggagattgaggtcaatggcctttaaggccatgctgaggcaggatatgtcttggtttgacgaccacaaaaactcaacaggcgccctcagcaccagactcgctacagacgcagcccaggtgcagggggcaaccggtactcggctggcactgattgcccagaatatcgctaatctgggaaccggaattatcatctctttcatctacggatggcaacttactttactgcttctcgccgtcgtgcccattatcgctgtaagcggcattgtggaaatgaaacttctagcaggaaatgcgaagcgcgataagaaagaactggaggcagctgggaaaattgctaccgaggctatcgagaacattcggacagtcgtgtcactcacacaggagagaaaattcgaaagtatgtacgtagagaagttgtacggaccttaccggaactcagtacagaaggctcatatctacggcatcacattttccatcagccaggctttcatgtacttctcatacgctggctgctttaggttcggagcctacttgattgtgaacggtcacatgcggttccgcgatgtcatacttgtgttctccgccattgtattcggggcagtggcactgggtcacgccagcagcttcgccccagactacgcgaaggccaaattgtctgccgcccacttgttcatgctatttgaaaggcagccgcttatagactcgtattccgaagagggcctaaaacctgataaattcgagggtaacatcactttcaacgaggtcgtgtttaactatcccacacgcgccaacgtgccggtgctgcaagggctcagcctggaggttaagaaggggcagacactcgcgcttgttggctcctccggctgcggaaagtcaactgtggtccagctccttgaaagattctacgatcccctcgctggcaccgtgttcgttgatttcggatttcaactcttggacgggcaggaagcgaagaagcttaacgtgcagtggttgcgagcccagctgggcattgtcagccaggagcccatcctctttgactgctctatcgccgaaaatatcgcgtacggcgataactcacgcgtggttagccaggatgagatcgtctccgctgctaaggcggccaacatacatccgttcatagagacactcccacataagtatgaaacccgcgtgggcgataaaggtacacagctgagcggaggccagaagcagcggatcgcaatagcccgagcgctgattagacaaccccaaatcctattgctggacgaggccacgtctgccctcgatacagaatcagagaaggtggtgcaggaggctttagacaaagcccgcgagggccgtacgtgcatcgtgatcgcacacagactgtcgacgattcagaatgctgatctgatcgtagtgttccagaatggtcgggtcaaggaacatgggacccatcagcaacttctggcacaaaagggcatctacttctccatggtgtctgtccaggccggaacccaaaatctc

SEQ ID NO: 7644 - DNA, 3858 bp, Artificial Sequence
  Description of Artificial Sequence: Synthetic coding sequence
atggatctcgaggccgcaaaaaacggaacagcctggcgaccaacctcagctgaaggcgacttcgagctaggtatctcctcaaagcaaaaaaggaagaagacaaagaccgtcaaaatgatcggcgtactgaccctcttcagatacagcgactggcaggataagttgttcatgtcactcgggactatcatggcaatcgcacacggatcaggcctccctctgatgatgattgtgtttggagaaatgacagacaagtttgttgatactgccggtaacttttcttttcctgtcaacttttccctcagcctgttaaaccccggaaagattctggaagaggagatgaccaggtacgcttactattactcaggcctgggtgctggagtactggtggccgcttatatacaagtgtctttttggacactcgccgcaggccgacagatacgcaaaataagacagaagttcttccacgcgattctgcgccaggagatcggctggttcgacatcaatgacactaccgaactgaataccaggctcactgatgatatcagcaaaatcagtgaaggaataggagataaggtgggtatgttttttcaggctgttgcgactttctttgcgggattcatagtgggatttatacgcggttggaaattgaccctggttatcatggccattagccccatcctgggactatcggcggcagtttgggctaagattctgagcgccttcagtgacaaggagctcgccgcgtacgccaaggctggcgctgtggccgaggaggcgttgggagcaatcagaacggtaatcgcttttggcgggcagaataaggagctggaacggtatcagaagcacctggaaaatgctaaggagatcggcatcaagaaggctatctctgcaaatatcagcatggggatcgcctttctgctcatttatgcctcttatgcgctggccttctggtacgggtcaacactggtcatttctaaagaatatacaattgggaacgctatgaccgtcttttttagcattctcatcggagcttttagtgtgggtcaggccgctccctgcatcgacgcttttgccaatgctagaggagctgcctacgtcatcttcgacatcatcgacaataaccctaaaatcgacagcttcagcgaacggggccataaacctgactccatcaagggcaacctcgagttcaacgacgtccatttttcctacccatctagagctaacgtgaaaatcctgaaggggctcaacttgaaggtccagtccggccagactgtggccttggttggctctagtggctgtggcaagagtactaccgtgcagctcatacaacgcctctacgatccagacgagggcacaatcaacatcgatggacaggacatcagaaacttcaacgtgaactatcttcgcgagatcatcggcgtggtaagccaggagccagtgctctttagcacaactatagcagagaacatctgctatgggaggggcaacgtgactatggatgagatcaaaaaagccgtaaaggaagctaatgcttacgagtttatcatgaagctccctcaaaagttcgatactttggttggagagagaggagcccagctttccggcggacagaagcaacgaatcgccatcgcaagggcccttgtgagaaatccaaagatcctgttactggacgaggcaaccagtgcactcgataccgagagcgaagccgaagtccaagctgctcttgacaaagctcgtgaaggaaggaccaccatcgttatcgcacaccggctgtctactgtccggaacgccgacgtgatcgcaggctttgaggatggagtcattgtggaacaggggagccacagcgagctgatgaaaaaggagggagtgtattttaagctcgttaacatgcagacatccgggtctcagatccaaagcgaagagttcgaactgaatgatgagaaggccgctacccgaatggcacctaatggctggaagagccgactctttagacatagcacacaaaagaaccttaaaaacagccaaatgtgccagaagtccctggatgtggaaaccgacgggcttgaggcaaacgtgccacctgtgtcattcctgaaggtcctgaaactgaacaagacggagtggccatatttcgtcgtgggcacagtctgtgcgatcgcaaacggtggcttgcagcccgcttttagcgtcatttttagcgagatcatagcaatctttggccccggagatgacgcagttaaacagcagaagtgcaacattttctccctcattttcctcttcctgggtatcatcagcttctttacattcttcctgcagggattcacattcggaaaagcaggggaaatcctgactagacgattacgcagcatggctttcaaagctatgttgagacaagacatgtcatggtttgatgatcacaagaattccaccggggctctgagcacaagattggcgaccgacgctgcccaggtgcagggagccaccgggactagattggcactcatcgcccagaatatagccaacctcgggactggaattattatatcattcatttatggctggcaacttacccttcttttgctggcggtggtgcctattattgccgtgagcggaatcgtggaaatgaaacttctcgctggcaacgcaaaaagggacaagaaggagctggaggctgcgggaaaaatcgccaccgaggccatagagaacatccgtaccgtggttagtcttacacaagaacggaaattcgaatccatgtatgtagagaaactctatgggccttatcggaatagcgtgcaaaaggcgcatatctacggcataacttttagtatctctcaggcgtttatgtatttctcctacgctggatgcttccgatttggcgcctacctaatcgtgaacggccacatgcggttcagggacgttatacttgtgttctcagccatcgtcttcggagccgtggcccttggccacgcttcgtccttcgcgccggactatgctaaggcaaaactgtctgctgcgcatctcttcatgctctttgaacgccagcctctgatcgacagctacagtgaagagggcctgaaaccagataagttcgagggaaacattacatttaatgaagtggtctttaactaccccactcgggctaacgtgccagtcctacaaggattgtcgctggaagtcaaaaaaggacaaactctcgctctcgtcggcagttcgggatgcggcaagtcaacagtcgtgcagttgcttgaaagattctacgatccactggccggaaccgtgtttgtggattttgggttccaattgctcgacggacaggaggcaaaaaagctcaatgtgcaatggctgcgcgctcaactgggcatagtcagccaggagcctatcttattcgactgcagcatcgctgagaacatcgcatacggtgacaacagcagggtcgttagtcaggatgaaatagtgtctgccgctaaggctgctaacattcacccttttattgaaactctgccacacaaatacgaaacacgagtcggggataagggtacacaactgagcggtggtcaaaaacagcgaatcgccattgcccgcgccctcatcaggcaaccccaaatcttgctgcttgacgaagctacaagtgcgcttgacaccgagtccgagaaagtagtccaagaggccctggacaaggcaagagaaggaagaacctgtatcgttatcgcccacaggctctcaacaatacagaacgctgacctgattgttgtttttcagaatggaagggtcaaggaacatggcacgcaccaacagctgctggcacaaaaaggaatttatttcagcatggtgagcgttcaagccggaacccagaacctg

SEQ ID NO: 7645 - DNA, 3858 bp, Artificial Sequence
  Description of Artificial Sequence: Synthetic coding sequence
atggaccttgaagcggcgaaaaacgggaccgcctggaggccgacgagcgccgagggagacttcgaactcggcatctcttccaaacagaagcggaaaaagaccaaaaccgtcaagatgatcggcgtcctcaccctcttccggtattcggactggcaagataagctgttcatgtccctgggcactatcatggcaattgcgcacgggtcagggctgcctctgatgatgatcgtgttcggagaaatgaccgataagttcgtagataccgcaggaaacttctcgttcccggtcaacttctccctttcgctcctgaacccgggaaagatcctggaggaggaaatgacccggtacgcgtattactactcgggactgggggcaggcgtgctcgtggccgcttacatccaggtgtctttctggactttggctgcgggacggcagatccgcaaaattcgccagaagttcttccacgccatcctgcgccaggaaattggatggtttgacatcaatgacaccaccgaattgaacactcggctgactgatgacatctccaagatctcggaagggatcggagataaagtcggaatgttcttccaagccgtagcgactttctttgcaggcttcatcgtgggattcattcgcggatggaagctcacccttgtcatcatggccatcagccccattcttggcttgagcgcggcggtgtgggcaaaaattctctccgcgttctcagataaagagctcgctgcctacgcaaaggccggagctgtggcagaggaggcactcggtgcaatccgcactgtgatcgcctttggagggcagaacaaggaactggaacggtaccagaagcacctcgaaaacgccaaggaaatcgggattaagaaagccatctcagccaatatcagtatgggtatcgccttcttgctgatctacgcctcctacgctctcgctttttggtacggttcgaccctcgtgatctcaaaggaatacactatcggcaatgccatgactgtgttcttctcgatacttattggagcttttagcgtgggacaggcggcgccatgcattgacgcattcgccaacgcccggggagctgcttacgtgattttcgatatcatcgataacaacccgaagatcgactcattctcagagcgcggtcacaagcctgactccatcaaaggtaacctcgagtttaatgacgtccactttagctaccccagcagagccaacgtgaagatcctgaagggactgaacctcaaagtgcagagcggacaaactgtggcgctggttggttcctcgggctgcggtaaaagcaccaccgtgcaactgatccagagactttatgatccggacgaggggaccatcaatatcgacggtcaggacatccgaaatttcaatgtgaattacctgcgggagatcatcggtgtggtgtcccaggagccggtcctgttttccactacgatcgctgagaacatctgctacggtagaggaaatgtcactatggacgagattaagaaggcggttaaagaagccaatgcgtacgaattcattatgaagctcccacaaaagttcgacactttggtgggagagagaggagcgcaactgagcgggggccaaaagcaaaggattgctatcgcccgcgccctcgtgcgaaacccaaagatccttctgctggatgaagcgacttccgctttggataccgaatccgaggcggaggtgcaggccgccctcgataaggcgagagaaggaaggaccacgatagtgatcgcacatcgcctgtcgactgtccggaatgcagacgttatagcaggatttgaggacggagtcatcgtggagcagggctcccactcggaactgatgaagaaagagggcgtctacttcaaactggtcaacatgcaaacctcgggctcccagattcagtcagaggaattcgaactcaacgatgaaaaagcggctacccggatggcaccaaatggctggaaatcaagactgtttcgccatagcacgcagaagaatctgaaaaattcacagatgtgtcagaagtcactggacgtggaaactgatgggttggaagccaacgtcccaccggtgtccttcctgaaggtgttgaagctgaacaaaactgagtggccgtacttcgtggtgggcaccgtgtgcgctatcgccaacggcggtctgcaaccggccttctcggtgatcttctcagaaatcatcgccatcttcggaccaggagacgacgcggtgaagcagcagaagtgtaacatcttctcgcttatcttcctgttccttggcatcatctcttttttcaccttcttcctgcagggatttaccttcggcaaggcaggagagatccttacccggcgcttgcggtcgatggcctttaaagccatgttgagacaggacatgagctggtttgatgatcacaaaaattccactggagccctctccaccagacttgctactgacgcggcccaggtgcagggcgccaccggcacccgcctggcgctgatcgcccagaatatcgcaaatttgggaacgggaatcatcatctcattcatctacggctggcagctcactctgttgctcctcgccgtggtgccaatcatcgctgtctcgggaatcgtggaaatgaagctgctggccggcaacgcgaagagagacaagaaagagctggaggctgccggtaagatcgcaactgaagccatcgagaacatccgcaccgtggtcagtctgactcaagagaggaagttcgaatcgatgtacgtggaaaagctctacggaccgtaccggaacagcgtgcaaaaggcccatatatacggaatcactttttctatctcccaggcgttcatgtacttcagctacgccggttgctttcggttcggagcatacctgatcgtgaatggacacatgcgcttccgggacgtcatcctggtcttttcggccattgtctttggggcagtcgctctcggacacgcaagctcgtttgcgcccgactacgccaaggccaaactgtcggctgctcatctgtttatgctgttcgaacgccaaccgctcatcgacagttattcggaggaagggctgaagccggacaaatttgagggaaacatcaccttcaacgaagtggtgttcaactaccctactcgggcgaacgtccctgttttgcaaggactgtcgctggaagtgaagaaggggcaaaccctcgcgctggtgggatcctcggggtgcggaaagtccacggtcgtgcagctgctggagcgcttctacgatcctctggctgggactgttttcgtcgatttcggctttcagctgcttgacgggcaggaggcgaaaaagctgaatgtccagtggctgcgtgcccagctcggaatcgtctcccaagaacctatcctcttcgattgtagcatcgccgaaaacatcgcgtacggagataactcacgcgtggtgtcgcaggatgaaattgtgagcgcagccaaggcagctaatattcatccattcatcgaaaccctgccccataagtacgagactagagtgggcgacaagggaacgcagctgtccggcggccagaagcagaggattgccatcgcacgcgcactgatcaggcagccgcagatcctcctccttgatgaagcaacctcagccctcgacactgagagcgaaaaggtggtccaagaagccctggacaaggcgcgcgaaggtcgaacttgcattgtgattgcccatcgcctgagcaccatccaaaacgccgacctcatcgtcgtgttccaaaacggaagagtgaaggagcacggaacgcaccagcaactgctggcacaaaagggaatctacttctcaatggttagcgtgcaagccggaacccaaaacctc

SEQ ID NO: 7646 - DNA, 3858 bp, Artificial Sequence
  Description of Artificial Sequence: Synthetic coding sequence
atggatctcgaagccgccaagaatggtaccgcatggcgcccgacttccgcagagggtgactttgaactgggtatttccagcaagcaaaagcggaagaagactaagaccgtcaagatgataggggttctgaccctgtttcgctatagcgactggcaagacaagctgttcatgtcgttaggaaccattatggccatcgcgcatggcagtgggctcccccttatgatgattgttttcggggaaatgaccgacaaatttgtggataccgccggcaactttagtttcccggtgaacttttctctgtccctactcaatcctggtaagatcctcgaggaagaaatgaccaggtatgcctactactattcgggactgggggcgggtgttttagtagcggcatatatccaggtgagtttttggactttggctgccggtcgacagatacgtaaaattagacagaagttctttcacgctatcctccgccaggaaattggctggtttgacatcaatgacaccacagaattgaatacccgtctgactgacgacatttcgaaaatcagtgagggcattggtgataaggttggtatgttctttcaagcggtcgctactttctttgcgggtttcatcgtcgggttcatacgtggatggaagctaacgttggttatcatggccatctctcctatcttgggtctgtccgcggcggtatgggctaagatcctgtctgcgttcagcgacaaggagctggccgcttatgcgaaggccggcgcagtcgccgaggaggcacttggcgctattcgcaccgtgattgcctttggaggtcaaaacaaagagctcgagcggtatcaaaagcatcttgagaacgcgaaggaaattggaattaaaaaagctatctcggcaaatattagcatgggtatcgcctttttgttgatttatgcctcttatgccctggccttctggtatggcagcaccctggtgatcagcaaagagtatactatcggcaacgctatgactgtttttttcagcattttgataggagccttctctgtgggtcaggcagccccatgcattgacgcctttgcaaacgcacggggtgcggcgtatgtgatctttgacatcatcgataacaacccaaagatcgacagcttttctgaaaggggccataagccagacagcatcaagggtaacttggaattcaacgatgtccacttcagctatccatcccgcgcgaatgttaagattctcaagggtctgaacctgaaggtgcaatctggacagactgtcgcacttgtcggtagtagcggctgtgggaagtctaccaccgtgcaattaattcagcgcctgtatgatcccgatgagggcaccattaacattgacggtcaggacatacgtaacttcaacgtgaactacctccgcgaaataattggagtcgtgtctcaggagccggtcctgttcagcacgactattgctgagaacatttgctacggccggggtaatgttactatggacgagatcaagaaggctgttaaggaggcgaacgcatatgagttcatcatgaaattgcctcaaaaatttgatactctggttggggagcgtggtgcgcagttgtccggaggtcagaaacaacgaattgctatcgcccgtgcgctcgtcaggaatccgaaaatcctattgctcgatgaggcgacctccgcactcgacaccgagagcgaagcggaggtccaagcggcactggacaaagcacgcgaaggtcggacgaccatcgtcattgcccatcgactgtcaacggtccgcaacgctgatgtgatagctggatttgaggacggcgttatagttgagcagggttcccatagcgagcttatgaaaaaagaaggcgtgtatttcaaactggttaacatgcaaacctctggcagtcaaatccaaagcgaagagtttgaactgaatgacgaaaaggccgcgacccgtatggcgcctaatggttggaaatctagactgttcagacatagtacgcagaagaatctgaaaaactctcagatgtgccagaagagcttggacgttgagacggacgggctggaagctaatgttcctccggtgtcatttctgaaagtcctgaagctgaacaagacggagtggccttatttcgttgtaggcacggtgtgtgcgattgcgaacggcggtctgcagccggccttcagcgtcatcttttcggagataatagctatcttcgggccgggtgacgacgcagtgaagcaacagaagtgcaatattttctccctgatcttcctgttcctgggcatcatttcattctttactttttttcttcaagggtttaccttcggcaaagcaggcgagatcctgacccgtcgcctgcggagcatggcgttcaaggcgatgctacggcaggacatgtcctggttcgacgaccacaaaaacagcaccggcgccctgagcacccgcctggctaccgatgccgctcaggttcaaggagccacgggaacccggcttgccttgattgcccagaacatcgcaaacctgggtaccggtattattatttcatttatatatgggtggcagttgaccttgctgctgctggcggtcgtaccaatcatagcagtctctggtatagtcgagatgaaactgttagccggaaacgctaagagggacaagaaagaactcgaggccgccggaaaaatcgcaacggaggcaattgagaacatccgcactgtcgtttctctaacgcaggagcgtaaattcgaatcaatgtatgtggagaagctgtacggtccttacagaaacagtgtccagaaagcgcacatttatggcattacattttcgatctcccaggcgtttatgtatttctcctatgcaggttgttttcgcttcggcgcttacctgatagttaacggccacatgaggtttcgcgatgttattctcgtgttctcagcgatcgtatttggagcagttgcattgggacatgcaagcagcttcgcgccggactacgccaaagctaagctcagtgctgcgcacttatttatgctgttcgagcggcagccgctgattgacagctactccgaggaaggcctgaagccagataaatttgaaggcaatatcacattcaacgaagtggtgtttaactacccgacgcgcgccaacgtcccagttctgcagggcttgtctctggaggtgaaaaaaggtcaaactctcgcgcttgtaggaagctctggatgcggtaagagcaccgtggttcaactgctggagcggttctatgacccgctcgccgggacagtatttgtggatttcgggtttcagctgctggacgggcaagaggcaaagaagcttaacgtgcagtggctacgggctcagctgggcattgttagtcaggagcctattttatttgattgctccatcgccgagaatatagcttatggcgataattccagggttgtgagtcaggatgagattgtgtctgcggcaaaggccgctaacattcatccttttattgaaactctcccgcacaaatatgaaacgcgggtcggtgataaaggcacccagctgtccggtggtcaaaaacagcggattgctattgcgcgcgcgttgatcagacagccgcagatcttgttgctggatgaggctacgtcagcgctggacacagaaagcgagaaggtggtacaagaagcattggacaaggcgcgcgagggccgcacatgtatcgtgattgcacaccgtctgtccactattcagaacgcagacctcatcgttgtgttccagaatggtcgggtaaaagagcatggtacccatcagcagctgctggcccagaagggtatttacttcagcatggttagcgtgcaggcgggcacccaaaatctg

SEQ ID NO: 7647 - DNA, 3858 bp, Artificial Sequence
  Description of Artificial Sequence: Synthetic coding sequence
atggatctcgaggcagcaaagaacggaactgcatggcggccaacgtctgcagaaggcgactttgagctcggcatctcaagcaagcaaaaacggaaaaagactaagaccgtcaaaatgattggagtgctcactctgtttcggtacagcgactggcaggataagctgtttatgtcactcggtactatcatggccattgcacatggatcaggacttccgctcatgatgatagtgttcggtgaaatgactgataagttcgtagataccgccgggaacttttcatttcccgtcaatttctcgctctcactgcttaatccaggtaagatactggaagaggagatgactaggtatgcatactactacagcggccttggggccggagtccttgtggccgcatacattcaggtgtcattttggaccctcgcagctggcaggcaaatccggaagatcagacagaagtttttccatgcgatcctgaggcaggaaatcggttggttcgacataaacgatactaccgagcttaacacccggttgacggatgacatttcgaagatttcagaaggaatcggggataaggtgggcatgtttttccaagctgtcgcgacgttcttcgcaggcttcatcgtgggatttatccgcgggtggaagttgaccctggtgatcatggcgatctcacctatacttggactgtcagcagcagtctgggccaagatcctgagcgctttttcagataaggaactcgcggcttacgcaaaagctggcgcggtggcggaggaagcattgggcgctattcgaaccgtcatagcctttggaggccaaaacaaggaactcgaacgctaccagaaacatcttgaaaacgctaaggaaattggtatcaagaaggccattagcgcaaacatttccatgggaattgcctttctcctgatatacgcctcgtacgctctggccttttggtacggttcaactctggtgatttccaaagaatacactatcggcaatgcgatgaccgtgttcttttcaatacttattggagcattttcagtgggacaagcggctccgtgtatcgatgcattcgccaacgcgcggggggcggcatacgtcatcttcgacattatcgataacaaccctaagatagattcattctccgaaagaggtcataagccagactccattaagggaaacttggaattcaatgatgtgcatttttcctacccgtcccgcgccaatgtgaagatccttaaaggtctgaaccttaaggtgcaatcgggacagaccgtggctcttgtgggttcgtcgggttgcggaaagtccactaccgtgcaactgattcaacgactttacgatcctgacgaaggaacgatcaacattgatggtcaggacattagaaactttaatgtgaattatcttcgcgagataataggcgtcgtctcacaagaaccagtgcttttttcgaccaccatagccgaaaacatatgctacggcagagggaatgttacgatggatgaaatcaagaaggcagttaaggaggcaaacgcatacgagttcatcatgaaactgccccaaaagtttgataccctcgttggagaacgtggagctcaactcagcggtggtcagaaacagagaatagcgattgcaagagcactggtgcggaatccaaagattctgctgcttgacgaggctacttccgcacttgataccgaatctgaggccgaagtccaagcagcccttgataaggccagggaagggcgcactaccattgtgatcgcgcatcggctttcaactgtgagaaacgccgatgtgatcgccggatttgaggatggtgtgatcgtcgaacaaggtagccatagtgaacttatgaaaaaagaaggcgtgtactttaagctcgtcaacatgcagacttcaggatctcagattcaatcggaagagtttgaactgaacgatgaaaaggccgcaaccaggatggcccccaacggatggaagtcgcgtctgtttaggcactctacccaaaagaatctgaagaacagccagatgtgtcaaaaatcacttgatgtcgaaactgacggcctcgaagcgaacgtcccgccggtgtcgtttctgaaggtcctcaaactgaataagacggaatggccgtattttgtggtcgggaccgtgtgtgccattgcgaacggaggcctgcagcctgctttttcagtcattttcagcgagattattgcgatcttcggccctggtgatgatgcagtgaaacaacaaaaatgcaacattttcagcctgatttttctttttctcggaattatctcgtttttcaccttttttctgcagggatttactttcggaaaagctggagaaatactcaccagacgactgagaagcatggcatttaaggcaatgcttcgtcaagacatgtcgtggtttgatgatcataagaactcaaccggagcactctcgactaggctcgcaaccgatgcggcacaagttcaaggtgcaaccgggactcgtttggcccttatagcacaaaacatagcaaaccttgggactggaatcattatctcattcatctacggttggcaactcactttgctgctgttggccgtggtgcccattattgccgtgtccggtatagtggaaatgaagctgctggctgggaacgcaaaaagagacaagaaggaacttgaggccgcgggaaagattgcaacggaagctatcgaaaacattcggaccgtggtgagcctgacccaggagcgcaagtttgaatcgatgtacgtggagaagttgtacggcccctacaggaacagcgtccagaaggcccacatttacggaattactttttcgatttcacaggcgtttatgtacttctcgtacgccggttgtttccgcttcggagcatacctcatcgtgaacggacatatgaggtttcgggacgttattctggtgttttccgcaattgtgtttggagccgtggctctgggacatgcatcgtcctttgcccctgactacgctaaggcaaagttgtccgcagcccatctgtttatgctgtttgaaagacaaccacttattgattcgtactcggaagaaggtctgaaacctgacaagttcgaaggcaacatcacttttaacgaggtggtgttcaactacccgaccagagctaacgttccagtgcttcaaggactttcgctggaggtgaagaagggacagaccctggccctcgttggttccagcggatgtggtaagtcgaccgtggtgcaacttctggagagattctatgaccccctcgccgggactgtctttgtggacttcggatttcagttgctggacggacaggaagcgaagaagctgaacgtgcagtggctcagagcacaactgggcatagtctcccaggaaccaatcttgtttgactgctccatcgcagagaatatcgcatacggggataactccagggtggtgtctcaagatgagatagtctccgcagcaaaagcagctaacattcatccctttattgagactctccctcacaagtacgagactcgcgtgggagacaaggggacccaattgtcgggcggacagaagcaaaggatcgcaatcgctagggctctgatccgacaacctcaaatactgctgctcgatgaggcgacgtccgccctcgacactgaatcggaaaaggttgtgcaagaagcacttgataaggcacgcgaaggtcggacctgtattgtgattgcccatcgactgtccactattcagaatgcagatcttattgtcgtgtttcagaacggtagggtgaaagagcacggtacccatcagcagctgttggcacagaagggaatctacttttcgatggtttcggtgcaggcgggaacccagaatctt

SEQ ID NO: 7648 - DNA, 3858 bp, Artificial Sequence
  Description of Artificial Sequence: Synthetic coding sequence
atggacttggaggccgcgaagaacggcaccgcgtggcggcccacgagtgccgagggggactttgagctcggcatcagctccaaacagaagcgcaagaagacgaagaccgttaagatgattggtgttctcaccctgttccgctactcggactggcaggataagctgttcatgtcactaggcacaatcatggccatcgcgcacgggtccggattgccgctaatgatgatcgtgtttggcgagatgaccgataagtttgttgataccgccggcaacttcagctttcctgttaacttctccctcagcctcctgaatccgggcaagatccttgaggaggagatgacccgctatgcgtactactactctggcctcggagctggagttttagtggcagcctacatccaagtgtccttctggactctcgctgctggacgccagatccggaagatccggcagaagttcttccacgcaattttgcgtcaagagatcggttggttcgatatcaatgacacgacagagctgaacacccgcctgaccgatgatatttctaagatctcggaggggatcggtgacaaggtgggcatgttcttccaagcggtggctaccttcttcgcgggtttcatcgtagggttcatccgcggttggaagttgacgctagtgattatggctatctcgccaattttgggactgtccgccgctgtgtgggccaagatcctgagcgccttctccgataaggagctggcagcttatgcaaaggccggtgcggtggcagaggaggctctgggagccattcgtacggtcatagccttcggcggccagaacaaggagctcgagaggtaccaaaagcacctggagaacgccaaagagatcggcatcaaaaaggctatcagcgcaaacatttccatgggcatcgcatttctcctgatttatgcttcttacgcgcttgccttctggtatggctccacccttgtgattagtaaggagtacaccattgggaatgccatgaccgtcttcttttcgattctgatcggtgcattctccgtcggtcaagccgcgccctgcattgatgccttcgcgaatgcccgtggtgccgcatacgttatttttgacatcattgataacaaccctaagatcgattccttcagcgagcgtggtcacaaaccggattctatcaagggcaacctcgaattcaatgatgtccacttctcataccccagtcgcgctaacgttaagatcttgaagggcttgaatttaaaggtgcagagtggccagaccgtcgctcttgttggctcatccggctgcggtaaatccaccaccgttcaactgattcagcggctgtacgatcccgatgagggcacaatcaacatcgatggccaagacatccgaaactttaacgtcaactacctccgggagatcatcggcgtcgtcagccaggagccggtcctgtttagcaccaccattgccgagaatatatgctacggccgcggcaacgtgactatggatgagatcaaaaaggctgtgaaggaggcaaatgcctacgagttcattatgaagctgccgcagaagttcgataccctggtcggtgagcgcggcgcgcagctttctggtggtcagaagcaacgtattgccatagctcgagcgctcgtgcgcaatccgaagatcctgctcttggacgaggccacgtctgctctggacacggaaagcgaagccgaggtccaagcggcccttgacaaggctagagagggtcgcactacaatcgttattgcccacaggctcagtaccgtgcgaaatgctgatgtcattgccggattcgaggacggtgtgatcgtcgagcagggatcacacagcgagctcatgaagaaggagggagtgtactttaaactggttaacatgcaaaccagcggcagccaaatccaatccgaagagttcgagctaaacgacgagaaggccgccacccgtatggcacccaacggatggaaaagccgcctctttcgacactcgacccagaagaacctcaagaattcccagatgtgccagaaatccctcgatgtcgagacggacggcctcgaggccaacgtccctccggtcagcttcttgaaggtcttgaaattgaacaagacagaatggccctacttcgtcgtggggacggtctgcgccatcgcgaacggcgggttgcaaccggcattcagtgtcatcttctccgaaatcattgccatttttggcccgggtgatgacgccgtaaagcagcagaagtgcaacatttttagcctcatcttcctttttttgggaatcatatcgttctttacattcttcttgcaggggttcactttcggcaaagcgggcgagattcttacccggagactgcgctctatggcatttaaggctatgcttcgtcaagacatgtcctggtttgacgaccacaagaatagcaccggagccttgtccacccgtttggccactgatgccgctcaagtgcaaggagcgacaggaacccgtctggccctcatcgcccagaacatcgcaaatctgggcacaggtatcattatctctttcatttacgggtggcagctgacgctcctacttttggccgtcgtgcctattattgcagtctctggtatcgttgagatgaagcttcttgccggcaatgcaaagcgagacaagaaggagctcgaagccgccggaaagatagctaccgaagccatcgagaacatccgcaccgtggtctctctcacccaggaaagaaagtttgaatcgatgtacgttgagaagctttatggcccttatagaaactccgtccagaaggctcacatttatggcatcactttctccatctcgcaagcattcatgtacttttcctacgccggctgctttcgcttcggcgcctatcttatcgtcaacggccacatgagattccgcgacgttatcctggtgttcagtgccatcgtgtttggggccgttgccctgggacatgcttcctccttcgcgcctgattacgcgaaggcaaagctgtcagctgctcatcttttcatgttgtttgaacgccagcctctgattgactcctactccgaggagggccttaagccggacaagttcgaaggtaacatcacctttaacgaggttgtctttaactatcccacgcgagccaacgtgcctgtgctccagggactcagcctggaggtcaagaagggccagaccttggcccttgtgggttcctcgggatgcgggaagagcactgttgtgcagttgctggagcgtttttacgatccgcttgctggtaccgtcttcgttgacttcggcttccagctccttgacggtcaggaggcaaaaaagctgaacgttcagtggttgagggcccagcttggcatcgtgagccaggagccgatcctgtttgattgttccattgcagaaaacatcgcttacggcgataacagccgtgttgtctcccaggacgagatcgtctctgcggccaaggccgctaacatacacccttttatcgagacactcccccacaagtacgagacccgagtcggcgataagggcacccaactttcgggtggccagaagcagcgcatcgccatcgcccgcgcactaatcaggcaaccacagattttactgctggatgaggctaccagtgctctcgatacggagagcgagaaggttgtacaggaggcactggacaaggctagggaaggccgcacctgcattgtgattgcgcaccgcctgtccaccatccaaaacgcagatcttatagttgttttccaaaatggccgcgttaaggagcacggcacgcatcagcagttgctggcccaaaagggcatctatttctcgatggtcagcgttcaggcgggtacccagaacctc

SEQ ID NO: 7649 - DNA, 3858 bp, Artificial Sequence
  Description of Artificial Sequence: Synthetic coding sequence
atggatctggaagcagccaagaatggaactgcgtggaggcccacctcggctgaaggcgattttgagctgggcatctcgtcgaagcagaaacgcaagaaaaccaagactgtgaaaatgattggcgtgcttactctcttcagatactccgactggcaagacaagctgttcatgtcactgggtaccattatggcaatcgcacacgggtcaggattgccacttatgatgatagtttttggggagatgactgacaagttcgtcgacacggctggaaatttctcgtttccagtgaacttctcactctcactgctgaatcccggaaaaatcctcgaagaagagatgacgcgctacgcctactactacagcgggctgggagctggagtcctcgtggccgcctacatacaagtgtcattctggaccctggccgcgggacggcaaatcaggaagattcgacaaaagttctttcacgctatccttcgccaagaaattggatggttcgacattaatgacacgactgagctgaatactcgccttaccgacgacatctcgaagataagtgaaggcattggagacaaggtcggaatgttcttccaggctgtggcaaccttcttcgccggattcatcgtcggatttatccggggatggaaactgaccctcgtgatcatggccatttcgcctatcctcggactctccgctgccgtgtgggcaaaaatcctgtccgccttctcagataaagaactggctgcgtatgctaaagcaggcgcggtggcggaggaggcactgggagcgatcaggactgtcatagcgttcggagggcagaacaaagaattggagaggtaccagaagcatcttgaaaacgcgaaagagatcggaatcaaaaaggctatcagcgccaacataagcatgggaattgccttcctgctcatctacgcttcgtatgcactggcattctggtacggctcgacgctggtgatctcgaaggaatacaccatcgggaatgccatgaccgtgtttttctccatcctgattggagcgttttcggtgggccaagcggccccgtgtatcgacgcattcgctaatgcacgcggcgcggcctacgttatctttgatatcatcgacaataacccgaagatcgactcgttctcggagagagggcacaagcccgactcgatcaaaggaaacctcgagtttaacgatgtccacttctcgtacccttcaagagcaaatgtcaaaatcctgaaggggctgaacctgaaggtgcagagcgggcagaccgtggcgttggtgggctcatccggctgtgggaagtctacgactgtgcagctcatccagcggctgtacgatccggacgaagggaccatcaatatcgacggacaggatatccgcaatttcaacgtgaactacctgcgggaaatcattggagtggtcagccaagagccggtgctgttttcgaccactatcgcggaaaacatctgctacggacgcggtaacgtcactatggatgagattaagaaagcggtcaaggaagcaaatgcctacgagttcatcatgaagctgccacagaagttcgacactttggtgggcgagcgcggggcacaacttagtggaggtcagaagcagcggatcgcaatcgcccgcgcgctcgtgagaaatcccaaaatcctgttgctcgacgaggcaacctccgccctggatacggagtccgaagccgaggttcaggctgccctcgacaaggcgcgcgagggccgcactaccatcgtgatcgcacacagactctccaccgtgaggaacgccgatgtgatcgcaggcttcgaggatggagtgatcgtggaacagggcagccactccgaactgatgaagaaggaaggtgtgtacttcaagttggtgaatatgcaaacctcaggatcacaaatccagtccgaagagttcgaactgaacgacgaaaaggccgccacgcggatggccccaaacggatggaaaagccgcctgttcaggcattccactcagaagaacctgaagaacagccagatgtgtcaaaagtcattggatgttgagacggacggcctcgaagccaacgtgccgcctgtgtcgttcttgaaagtgctcaaactgaataagactgaatggccgtacttcgtggtcggaactgtctgcgctatcgccaacggcgggttgcagccggcgtttagcgttatcttttcggagatcatcgcgatatttggccccggcgatgacgcagtgaagcagcaaaagtgcaacatcttctcccttatctttctgttcctcggaatcatctccttcttcactttcttcctgcagggcttcaccttcggcaaagctggcgaaatcttgacccggcggttgcggtccatggccttcaaagcgatgctgagacaggacatgtcatggttcgatgatcacaagaatagcaccggtgcactgtcaacccgcctggcaactgatgctgcccaggtgcaaggagcgaccggcactcgccttgccctcatcgcacagaacatcgccaacctgggtaccggaatcattatctcattcatatacggctggcagctcaccctgctgctgctggcagtggtgccaatcatcgcggtgagcggaatcgtggaaatgaagctgctggctgggaacgctaagcgcgacaaaaaagaacttgaggccgctggtaagatcgcgaccgaggcaatcgaaaacatccggaccgtcgtcagtctgactcaggagagaaagtttgaatcgatgtacgtggaaaaactctatggaccgtacaggaattcggtccagaaggcccacatctacggaatcactttctccatctcccaggctttcatgtacttctcatacgccggatgctttaggtttggagcctaccttatagtgaacggtcatatgcgtttccgggatgttattctggtgttctcagcaatagtgtttggggccgtagcgctggggcatgcgagctcttttgccccagactatgccaaggccaagttgtccgccgcccatctgtttatgctcttcgaaagacaacctctcattgactcttactccgaggaagggttgaagcccgataagtttgaaggaaatatcaccttcaatgaagtggtgttcaactacccgacccgagcgaacgtcccggtcctgcagggcctgtcgctggaagtcaagaaggggcagactctggctctggtgggatcatctggttgcggaaaatcaacggtggtgcaactgctggagcgattctacgacccacttgcaggaactgtgttcgtcgacttcggatttcaactgctggacggacaagaggccaagaagctcaacgtccagtggcttagagcacaattgggcatcgtgagccaggagccaatcctgttcgactgttctatcgccgagaacatcgcttacggcgataactccagggtcgtgtcccaggatgagatcgttagcgccgctaaagccgccaacattcatcctttcatcgaaactctgccgcacaagtacgaaaccagagtgggagacaagggaactcagctcagcggtggacagaagcaacggatcgccattgcccgggcgcttatcagacagccgcaaatcctcctccttgatgaagccacttcagctctggacactgagtcagagaaggtggtgcaggaagcacttgataaggctcgcgaaggccgcacttgtatcgtcattgcccaccgtctcagtaccatccagaacgccgaccttatcgtcgtctttcaaaatggacgggtcaaagaacacggcacccatcagcaactcctcgcccagaagggaatctacttctcgatggtgtcggtacaagctggtacccaaaacctg

SEQ ID NO: 7650 - DNA, 3858 bp, Artificial Sequence
  Description of Artificial Sequence: Synthetic coding sequence
atggatttggaagctgccaagaacggtaccgcatggcgccccacgtccgcggaaggagactttgaacttggtatctccagcaagcaaaaacgcaagaaaaccaagactgtgaagatgatcggtgtccttactcttttccgttactcggattggcaggataaactctttatgtcattgggtactattatggcaatcgcacacggctctggacttcccctgatgatgatagtctttggggaaatgaccgataagtttgtggataccgctggtaacttttcgttccccgtgaactttagcctctcgctgctcaaccctggcaaaattctggaggaggaaatgaccagatatgcctactattacagcggactgggagcaggtgtcctggtggcggcatacattcaagtgtccttttggactctcgccgcggggaggcaaatccgcaagataagacaaaagttctttcatgccattctgcgacaggaaatcgggtggtttgatatcaatgatacgaccgaacttaataccagattgaccgacgatatttccaaaatctcagagggcattggtgacaaggtagggatgttttttcaagccgtcgcaaccttttttgcaggttttatcgtgggatttatcagaggctggaaacttactttggtgattatggccatttcaccaattctcggtctgtcggcagcagtttgggcaaagatcctgtcggctttttcggataaggaactggcagcttacgcaaaagcaggcgccgtggcagaagaagcgctcggagcaatcaggactgtcatcgcatttggtggacagaataaggagctcgaacgctaccagaagcatctcgaaaatgccaaggaaatcggaattaagaaggcaatttcggcaaacatctcgatgggaattgcatttctgctcatttacgcatcgtacgctctggcattctggtacggatccaccctggtgatctcaaaggaatacaccataggcaacgccatgaccgtctttttctcgattcttatcggagcattttcagtggggcaggcagcaccctgtatagatgcttttgccaacgcaagaggagcagcttacgtgatttttgacattatcgacaataaccctaagattgactcctttagcgaaagaggtcataagccagactccatcaagggcaacctcgaattcaatgatgtgcacttttcctacccctcacgcgctaatgtcaagattctcaagggactgaatttgaaggtccaatccggccagacggtggctttggtcggttcctcgggttgtggaaagtcaaccactgtgcagcttatccaaagactttacgatcctgacgaaggtactattaacattgatgggcaggacatcagaaacttcaacgtgaactacttgcgcgaaatcataggtgttgtgtcgcaagaacccgtcctttttagcactaccatcgctgaaaacatatgctacggacgtggtaacgtcactatggacgagatcaaaaaagccgtgaaggaagccaatgcctacgagtttatcatgaagctgccgcagaaatttgatactttggtgggggaacggggcgcacagctgtcaggcggtcaaaagcaaaggatagccatcgcaagggctcttgtgcggaatcctaagatccttcttctcgacgaggcaacgtcggccctcgacaccgaaagcgaagcagaagtgcaggcagcactggacaaagcccgggaagggcggactactatagtgatagctcaccgcctgtcgactgtgcggaatgcggatgtgatcgcaggattcgaggatggtgtgattgtcgaacagggtagccatagcgaactgatgaagaaggagggtgtgtacttcaagctggtgaatatgcagacttcaggcagtcagattcagtccgaggaatttgagctcaacgatgagaaagcggccaccaggatggcacctaatggttggaagtccagacttttcagacactccacccagaagaatctcaagaattcgcaaatgtgtcaaaagtcgcttgatgtcgagacggacggacttgaagcaaatgtgcctcctgtctctttccttaaagttctcaaactgaataagaccgagtggccatactttgtggtcgggactgtgtgcgcaattgcaaatgggggtttgcagccggcattttcggtcatcttttcggaaatcattgcaatctttggacccggagatgatgcggtgaagcagcaaaagtgtaacatcttctccctcatatttctgtttctgggaataatcagctttttcacgttttttctgcaaggctttacttttggtaaggccggagagatcctcactcgacgcttgcggtccatggcgtttaaagcaatgctcagacaggatatgtcctggttcgatgatcataagaatagcactggtgccctttccaccaggttggcaactgacgctgcgcaggtgcaaggagcaaccggaacccgcctcgcactgatagcccaaaacattgccaatctggggactgggattatcatttccttcatctacggatggcaacttaccctgctcctgcttgcagtggtccctattatcgccgtgtccggaattgtggagatgaaacttctcgcaggaaacgccaagcgcgataagaaagagctggaagcggcaggaaagatcgcaaccgaagcgattgagaacatccggaccgtggtcagccttacccaagagaggaagtttgagtcgatgtacgtggagaaactgtacggtccataccgaaacagcgtgcaaaaggcacatatctacggaatcacgttttcaatctcgcaagcattcatgtacttctcgtacgcaggctgttttagattcggagcatacctgatcgtgaacggacatatgcggtttcgtgatgtcattcttgtcttttcagcgattgtgtttggtgccgttgccctgggccatgcgtcgtcctttgcaccagattacgcaaaggcaaaactttcggcagcacacctgttcatgctctttgaacgacagccactgatagattcgtattcggaggaaggccttaagcccgataagttcgaaggtaatatcacttttaacgaggtggtctttaactatcctactagagctaatgtccctgttctgcaaggtctgagcctggaagtgaagaaggggcagaccctggcactggtgggatcgagcgggtgcggaaagtcaacggtggtgcagctgctggaaaggttctacgatcccctcgcaggtactgtctttgtcgactttggatttcagctgctcgatggccaggaagcgaaaaaacttaacgtccagtggctcagggcacaacttggcatagttagccaggaacccatcctttttgattgttcaattgcagaaaacatcgcatacggcgacaacagccgggtggtgtcacaagatgaaattgtgtcagcggcaaaggcagcaaacatacatccatttatcgaaactctgccacataagtacgagactagagtgggtgataagggtacccaactttcaggtggccagaagcaaagaatcgctattgcaagagcactcattaggcagccccagattttgctgttggacgaagcaacttctgcacttgatactgaaagcgaaaaggtggtgcaagaagcccttgacaaggccagggaggggcgcacttgtatcgtaattgcacatagactgtcaaccatccagaacgcagatctgattgtcgtgtttcagaatggaagagtgaaagaacatgggacccatcaacaacttctcgcccagaagggtatctacttttcaatggtgtcggtgcaggcaggaacgcaaaacctt

SEQ ID NO: 7651 - DNA, 3858 bp, Artificial Sequence
  Description of Artificial Sequence: Synthetic coding sequence
atggatctagaggccgcaaagaacggtaccgcgtggcgaccaactagcgctgagggagacttcgaactgggaatctcctctaaacagaaacggaagaaaaccaagaccgttaaaatgattggcgtgctcacattgtttcggtactctgactggcaggacaaactttttatgtcactgggaaccattatggccattgctcatggatcgggcctgccactaatgatgatcgtgtttggggagatgaccgataagtttgtcgatacagccggtaatttttcttttccagtcaattttagcctgtctcttttgaaccctggcaagatcctggaagaggagatgacccgatacgcctattactattccggattgggcgccggtgtgctggtagcagcctacatccaggtttccttctggactttggcagccggaaggcagattcggaaaatccgccagaaatttttccacgcgatcctcagacaggagattggatggtttgatattaatgataccacggaactcaatactagactgactgatgatatttccaaaatatccgagggcattggcgataaagtgggaatgttttttcaggcggttgccactttttttgcagggtttatagttggtttcatccgcggatggaagctgacgcttgtaattatggctatctccccgatcttggggctcagcgctgccgtgtgggctaagatcctgtctgctttttcagataaagagctggccgcttacgccaaagcaggagcagtcgcagaggaggctttgggtgcaattaggacagtgatagctttcggaggtcagaataaggaactagaaaggtaccagaagcatcttgagaacgctaaggagatcggtataaaaaaagctatatccgcaaacattagtatgggaatagctttcctcctgatttacgcaagctatgcgctggctttttggtatggctcaactctcgtaatctccaaagaatataccataggcaacgctatgaccgtgtttttcagcattctgatcggagcttttagtgttggccaagctgcaccctgtattgatgccttcgcgaatgctcgtggggccgcatatgtgatctttgacattatagacaataatcctaagattgactctttcagtgaacgcggacacaaacccgattccatcaagggtaatctcgaattcaacgatgtacactttagctacccaagccgcgcgaacgtgaaaatcttaaaaggccttaacctgaaagtgcagtctggtcaaacagtcgctctggtcggcagctctggatgtggcaaatcaactaccgtgcaactaattcagaggctgtatgaccctgacgagggaacaattaacattgacggccaggacatcaggaacttcaatgtcaattacttgcgtgaaataataggtgtcgtttcacaggagcccgtgcttttctcgacaactatcgctgagaacatctgttatggcagaggaaatgtgacgatggatgagatcaagaaggctgtcaaggaagcaaatgcatacgagttcatcatgaagctccctcaaaaattcgatactctggtgggcgagaggggtgcccagctgagcgggggtcagaagcagaggatagccatcgctagggctctcgtccggaaccctaagattctcctgctcgatgaagccactagcgctctcgacactgaatcggaggccgaggtccaggcagctctggacaaggcccgtgaaggcaggaccactatagtgatcgcccaccgcctgagcaccgtccggaacgcagacgtaatcgccggctttgaggacggtgttatcgtggagcagggtagtcattccgagctgatgaaaaaggagggggtttactttaagttagtgaatatgcagacctctggctctcaaattcagagtgaggagtttgaattaaacgacgaaaaagccgcaacaagaatggctcccaatggatggaaatccaggctgttcaggcactccacccagaagaacctaaagaatagccaaatgtgtcaaaagagcctggatgtggaaactgatgggttagaagccaacgtgccacccgtttctttcttaaaggtgctgaagctcaataagaccgaatggccatactttgtcgtgggtacggtctgcgctattgccaacggaggcctgcagccagcctttagtgtcatcttctccgagattattgccatctttggaccaggggacgatgcggtcaagcagcagaaatgtaacattttctcgctgattttcctgttcctgggcattatctccttcttcacattcttcctgcagggttttactttcggcaaagcgggggagattctgacccgcaggctacgttcaatggccttcaaagcaatgctcaggcaggatatgagttggttcgatgaccacaaaaatagtactggagcactttccacgaggctggctactgacgccgctcaggtacaaggtgctaccggaacccggctcgctctcattgctcagaacatagcaaatctcggcactgggatcatcatcagtttcatttacgggtggcaattgacactgctgctgcttgcggtcgtgcccattattgctgtgagcgggattgtcgagatgaaactgctggccgggaatgctaagcgggacaaaaaggagttggaagccgccggtaagatcgcaactgaggctattgaaaacatcaggacagtggtgtccttgacccaggaacggaaatttgaaagtatgtacgtggagaagctctacggcccatatcggaactctgttcagaaggcacatatctatggtattacctttagtatttcgcaggcctttatgtacttttcctatgcaggctgtttccggtttggggcctatctgatcgtgaatggacacatgcgtttcagagacgtgatcctggtcttctctgccatcgttttcggggcagtggccctgggtcacgcaagctcattcgcccccgattatgccaaagccaaattgtccgccgctcacctgttcatgctgtttgagcgtcagccactgatcgacagctactcagaggagggtctgaagcccgataagttcgaaggtaacatcacattcaacgaggttgtgttcaattatcccacccgggctaacgtacctgtgctgcaggggctctcccttgaggtgaaaaagggacagacgctggccctggtcggcagcagtggatgtggcaagtctaccgtagtgcagctactcgaacgcttttacgatcctttggccgggactgtgttcgtggactttggctttcagctactggacggccaagaagccaagaagcttaatgtccagtggctgagagctcaactgggtattgtgagtcaggagcccattctttttgactgtagcatagccgaaaatatcgcctatggagacaactcaagggtagtgagccaggacgaaatagtctcagcggcaaaggctgcgaacattcacccatttatagaaacgctgccccataagtatgaaactagggtgggcgacaagggcacccagttatctggcggacagaagcagcgcatcgcgattgcgagagcgttgatccgtcaaccacagattcttctcctggatgaggccacttctgcccttgatactgaaagtgaaaaggtggtccaggaggccctggacaaggcccgcgagggtcgaacttgtatcgttatagcccatcggctgagcaccatccagaatgccgacctcatagttgtgttccagaacggtagggtaaaggaacacgggacacatcagcaattgctcgcacagaaaggtatttacttttctatggtcagtgtgcaagccggtacacagaatttg

SEQ ID NO: 7652 - DNA, 3858 bp, Artificial Sequence
  Description of Artificial Sequence: Synthetic coding sequence
atggacctggaagccgcaaagaacggtaccgcatggagacctacttccgctgaaggcgacttcgagctgggtatctcaagtaaacagaaaagaaagaagaccaaaacagttaagatgataggcgttctgacacttttcaggtacagcgattggcaggacaaactcttcatgtctctgggcaccatcatggctattgctcacgggtcaggcttgcccctcatgatgatagtgttcggggagatgacagataaatttgtcgacaccgctgggaatttcagcttccctgtgaacttcagcctatcattgctgaatcctggcaagatcctggaagaggagatgactaggtatgcatactactattctggacttggagccggggtactggtggccgcttacattcaggtgagcttctggacgctggccgccggcagacagatcagaaaaatccgccaaaaattttttcacgccattctcagacaggagatagggtggtttgacataaacgatacaaccgagctcaatacaagactgactgacgatatctcgaaaatttctgaaggcattggggataaggtaggcatgtttttccaggcagttgccaccttcttcgccggattcatcgtgggcttcatccgcggctggaagttgactctcgtgattatggccatctcgccaattctgggactttcagccgccgtgtgggcaaaaatcttaagtgcattcagcgacaaggagctggctgcatacgccaaggcaggtgccgtcgcggaagaggccctgggagccattaggactgtgatcgccttcggaggccaaaacaaggaactcgagcgttatcagaagcacctggaaaacgccaaggagatcggcatcaagaaggcaatctcagcgaatataagcatgggcatcgcattcctattaatctatgcctcgtatgctttagccttttggtatgggagcactctggtcatttctaaggaatacactataggtaatgcgatgactgtgttcttcagcattctgattggggcgttttcggtaggacaagcggctccctgtattgacgcttttgctaacgcaaggggtgcagcctacgttattttcgacatcatcgacaataatccaaagatcgactccttctcagagagggggcacaagcccgattctattaaggggaatttggagtttaacgacgtgcattttagctatccgtcaagagcaaatgtcaagattctgaaaggcctcaacctcaaagtgcaatccggacagaccgttgcgttggtagggtcgtcggggtgtggaaagtccaccactgtgcagcttatccagcggctgtatgatcctgacgagggtacaatcaatattgacgggcaagacattaggaatttcaatgttaattacctgcgagagattatcggcgtcgtatctcaggaaccggtactgttctccacaacaatagcagaaaacatctgctacgggcgcgggaacgtgactatggatgagattaaaaaagcagttaaggaagccaatgcctatgaattcattatgaagttaccacagaaatttgatacgttggtaggagaaagaggcgcccagttatctggcgggcagaagcaacgcatagccattgcccgcgcccttgttcgaaatccaaagattctgttgctggatgaggctacctctgccttagataccgagtcggaggccgaagtacaagcagcgctcgataaggcacgagagggcaggacgacgatcgttattgcccaccggttgtccaccgttaggaatgctgatgtcattgccggctttgaagacggggtcattgttgagcagggctctcactcagaacttatgaaaaaagagggagtgtacttcaaactggtgaacatgcaaacttcaggaagccagattcagagcgaggaattcgagctgaacgatgaaaaggccgcaaccagaatggcccccaatggctggaagtccaggctttttagacactcaacccagaagaatctgaagaactcccagatgtgccaaaagagtctggatgtggagaccgacgggttagaagccaatgtccctccagtgtcatttttgaaggtgttgaagctgaacaaaaccgaatggccctattttgtcgtgggcacagtctgcgcgattgctaatgggggcctacagcccgcattttccgtgatattcagcgagataattgccatatttggccctggtgacgatgccgtgaaacagcaaaagtgtaatatattttcactaatattcctgtttcttgggattatctccttctttacattctttttgcaggggtttacgtttggtaaagcaggcgaaattctgactagacgccttaggagcatggcgttcaaggcgatgttgagacaggatatgtcctggttcgacgaccacaaaaattccaccggtgcactgagcacaaggctggccaccgatgccgcgcaggttcagggcgcaacaggaaccagactggctctaattgcccagaacatcgccaatttagggaccggcattatcatatccttcatatatgggtggcagttaactctattgcttttggctgtggtgcctattatagccgtgtctggcattgttgagatgaagctgctagccggaaacgccaaacgggacaaaaaggaacttgaggcggctgggaagatcgctacagaggctattgagaacataaggacagtggtgtcgcttactcaggagcgcaagttcgaatcaatgtacgtggagaaattgtatgggccttacagaaactctgtgcagaaagcccacatctatgggatcacttttagcatcagtcaggctttcatgtacttctcgtatgccggttgctttcgctttggggcctatctgatcgtcaatggtcatatgagattcagggatgttatcctggtcttctcagcgatcgtgtttggagcagtggccttgggtcatgcttcttctttcgcaccagactacgccaaagctaagttgagtgctgcgcatctgtttatgttattcgagaggcaacccctgattgacagctattctgaagaaggcttgaaacctgataaattcgaggggaatatcacattcaacgaggtggtgttcaactaccccacacgcgcaaatgtacccgtcttgcaaggtctgtcactcgaggttaaaaagggacaaacgctcgccctggtgggctcaagtggctgtggcaagagtacggtggtacagctgttggagaggttctacgatcccctagcaggaactgtgttcgtggacttcggatttcagcttctagacggccaggaggctaaaaagctcaatgtgcagtggctgagggcacagctgggaattgtctcacaagaacctatcctgttcgactgtagcattgctgagaacatagcctacggagacaattcgcgcgtggtatcccaggacgagattgtgagcgccgcaaaagccgccaacattcaccccttcatcgagacgcttccgcataaatacgagacgcgtgttggggataaggggacgcagctgagcggcggccagaaacaacggattgcaatcgcaagagccctgatacggcagccccagattctgctgcttgacgaggccacttctgctcttgatactgaatcagagaaggtggttcaggaggcgctggacaaggcgcgtgagggaaggacttgcattgtgatcgcccaccgcctgtctactatccagaatgcagacctgattgtggtcttccagaatggccgggtgaaggagcacggtacccaccagcagctcctggcccagaagggcatttacttttcaatggtttccgtgcaggccgggacacagaatctg

SEQ ID NO: 7653 - DNA, 3858 bp, Artificial Sequence
  Description of Artificial Sequence: Synthetic coding sequence
atggacttggaggctgcaaagaatgggactgcttggaggccgacatccgccgaaggggactttgagctgggaataagctctaagcagaaaaggaagaaaactaagactgtgaagatgatcggcgtgttaaccctgttcagatactccgactggcaggacaagttattcatgtcactggggacaattatggctatcgcacatgggtcaggcttgccactgatgatgattgttttcggggaaatgactgataaatttgtggacactgccgggaacttttcttttcctgtcaatttctcgctcagccttcttaatcccggcaaaatcctcgaggaggagatgacacggtatgcctattattatagcggactgggggccggggtgctagtggccgcctatatccaggtatcattctggacacttgcagctggccgtcaaatccgcaagatacggcaaaagtttttccacgctatattgaggcaggagataggatggttcgatattaacgacactactgaactgaacaccagactgacagatgatatctccaagatcagcgagggtatcggcgataaggtgggcatgtttttccaggctgtggcaactttcttcgccgggttcatagtcgggtttatcagaggctggaagcttaccctcgtcatcatggccatctctcccatactcggtctctccgcagcggtgtgggccaagatactgagtgcgttctccgataaagagctcgcagcctacgctaaagctggagcggtagccgaagaagcattgggagcaatccgcaccgtgatagccttcggaggacagaacaaagagttagagcgctaccagaagcacttggaaaacgccaaggagatcgggatcaagaaggcaatttccgctaacatatctatgggcatcgcttttctgctgatttatgcttcctacgcattggcattttggtatggcagtacgcttgtgatctccaaagagtacaccataggtaacgccatgactgtgttctttagtatcctgataggggccttttcagtaggtcaggccgcaccgtgtatagatgcatttgcaaacgcccgcggcgctgcgtatgtgatattcgatatcattgacaacaaccctaagattgattcattctcggagagaggacacaaaccggattcgatcaaagggaatcttgagttcaacgatgtgcattttagttatccatctcgggccaacgtgaaaattctcaagggtctcaacctgaaagttcagtccggccagacagtggcactggtgggcagcagcggctgtggcaaatccactacagtgcagctgatccaaagactttatgaccccgatgaaggcactatcaatattgacggtcaggacattcggaactttaacgtaaattatttgcgtgagatcattggagtggtgtcgcaggagcccgtgctcttctccactacaatagcagaaaatatatgttatggaaggggtaacgtgaccatggacgagataaagaaggccgttaaggaagccaatgcatatgagttcataatgaagttaccacagaagttcgacacgctggtcggagagcggggagcacagctgtccggtggacagaagcagaggatcgcgatcgcgcgagcactggttcgtaaccctaaaatcctgctcctggatgaagccacatcagcactcgataccgaatccgaggccgaggtgcaggctgcattggacaaggcgagagaaggaagaactacaatcgtcatagcacaccgccttagcaccgtccgcaacgccgatgttatcgccgggtttgaagatggtgtgatcgtggagcagggtagccacagcgagttgatgaagaaagaaggtgtgtactttaaactggtgaacatgcagacatccggcagccagatacagtcagaggaattcgagctgaacgatgagaaagccgcgactcgcatggcacctaacgggtggaagtcaagactgttcaggcactccactcagaaaaaccttaaaaatagccagatgtgtcaaaagtccttggatgttgaaacagacggcttagaggctaacgtgcccccagtgtctttcctgaaagtacttaagctgaataagacggaatggccgtatttcgtggtcggcaccgtatgtgccatagctaacggaggcctccagccagcattctctgtgatcttcagcgaaataatcgctattttcggcccaggggacgatgcggtgaagcaacagaaatgcaacatcttttccctgatcttcctgtttctggggataatttctttcttcactttcttcctgcaggggttcaccttcgggaaggccggggagatcctgacccgcagactgagaagcatggcttttaaagccatgttgcgccaagatatgtcgtggttcgatgatcacaaaaacagtactggggcgctgagtacgaggctggccacggacgctgcccaggtgcaaggggccactggaacaaggctggcactgatagctcagaatatagcaaatctgggaaccggaataatcatttccttcatatacggatggcagcttacattattgcttctcgctgtggtgcccatcatcgccgtttccggtatcgtcgaaatgaaattgctcgcagggaacgcaaaaagagacaaaaaagaattggaagctgctggaaagatcgctacagaagccatcgagaatataagaacagtggtatcactgacccaggagaggaagttcgagtctatgtatgtcgaaaaactctacggcccataccggaactccgttcagaaagctcacatctacggaataacattttctattagtcaagcttttatgtacttttcctacgcaggctgcttccgctttggcgcttatctgatagttaacggccatatgcgatttcgtgacgtgatcttggttttttccgccattgtattcggggcagtagccctcggccacgccagttccttcgcaccagactacgctaaagctaaactaagcgcagcccatctattcatgttgtttgagcggcagccactgatagattcttactctgaggaaggcctgaagcctgacaagtttgagggtaatattaccttcaatgaggtggtctttaactaccctactcgagcaaacgtgcctgtcttgcagggactgtcactggaggtgaagaaaggccagaccctagccctcgttgggtcctctggctgcggcaagtccacagtggttcaactgctggaacggttttacgaccctcttgccggtacagtattcgtcgatttcggcttccaactcttggatgggcaggaggcaaagaagttgaacgtccagtggttgcgggcacagttagggatagtgtcacaggagcctattctcttcgactgctcaatcgccgagaacatcgcttacggggacaattccagagtagtgagccaggatgaaattgtgtctgccgcaaaagcagccaacatccatccctttatcgaaaccttgccacacaagtatgagactagggttggggacaagggcacccagctctccggcggacagaagcagcgcatagccatcgcaagagcactcatcaggcagccccagatcctgttgctggatgaggccacttccgctctggacacagaatcagagaaagtcgtgcaggaggcactcgacaaggctcgggaaggacgaacgtgtatagttatcgctcatagactgtctacgatccagaatgctgacctgattgttgtctttcagaatggacgagtaaaggagcacgggacacaccaacagttgctcgcccagaagggaatctacttctcaatggtgagcgtccaggccgggacacagaatctc

SEQ ID NO: 7654 - DNA, 3858 bp, Artificial Sequence
  Description of Artificial Sequence: Synthetic coding sequence
atggacctcgaggccgctaagaatggtaccgcctggcgccccacttcggccgagggggacttcgagcttggaataagcagcaagcagaaacgcaagaaaactaagaccgtgaagatgattggcgttctgacactattccgttactcagattggcaagacaaattgttcatgtctctgggaacaatcatggccatcgcccatggcagcggcctgcctttgatgatgatcgtgtttggagaaatgacggacaagtttgtcgataccgccggtaatttcagctttccggtgaatttttctctcagtctgctaaaccccgggaaaatcctggaggaggagatgacccgctacgcatactactactcgggactgggggcaggtgttctcgtggccgcttacatccaggtgtctttctggactctggccgcaggcaggcagataagaaaaatacgacaaaaattcttccacgccatacttcgccaggagataggatggttcgatataaacgacaccactgagctgaatacccggctgacagatgacatcagcaagatctctgagggcatcggcgataaagttggcatgttcttccaggcagtcgctactttcttcgcgggctttatcgtgggcttcattcgaggatggaaactgacgctcgtcattatggcaattagtccgattctgggattgtccgccgccgtgtgggcaaaaatcctttcagcattcagtgataaggagctcgccgcatacgccaaggccggtgcagtggctgaagaggccttgggcgccattcgcacagtgatcgcttttggtggccagaacaaggagttggagagatatcagaagcatctggagaatgctaaggagataggaattaagaaggccatcagcgctaacatatcaatgggcatcgcttttcttctaatctatgcctcttatgcgctggccttctggtacggatccactctggtcatctcgaaggagtacacgattggaaacgccatgacggtgttctttagtatcctaatcggagccttctccgttggccaggcggcgccgtgcatagacgctttcgccaatgctcgcggtgccgcctacgttatttttgacatcatcgacaacaatcctaaaatcgattcattctctgaacgtggccataaacccgatagcatcaagggtaacctggaattcaatgatgttcatttctcgtatcctagccgcgccaacgtcaaaatacttaagggtctgaacctgaaggtgcagagtggccaaacggtggccctcgtgggcagtagcggctgtggtaagtcgacaacggtacagctcattcagcgactgtatgatcccgatgaaggaacgatcaacatagacggccaggatatacgcaattttaacgtaaattatctgcgtgaaataatcggcgtcgtgagccaagaaccagttctgttcagcacgacgatcgccgagaatatttgttatggccggggtaacgtgacgatggatgaaataaagaaggcggtgaaggaagccaatgcttatgaattcattatgaaactgccacagaaatttgacacgctggtcggtgagcgaggtgcgcagctaagcggcggacagaaacagcggatcgccatcgcacgagcattggtgcgcaacccgaaaattctgctgctggacgaggcaacctcggccctcgataccgagtctgaggcagaggtccaggcggccctggataaggccagagagggtcgcacaaccattgtgatcgcgcatcgtctctcgactgtgcgtaatgcggatgtgattgccggatttgaagacggtgttattgtagagcaaggttcccacagcgagctgatgaaaaaagaaggtgtgtacttcaagctagttaacatgcaaactagcggctcacagattcagtcggaggagtttgagctgaacgacgaaaaggcggccactcgtatggctccgaatggctggaagagccgcctgtttcgccattccacacagaaaaatctgaagaacagtcaaatgtgccagaaatccttggacgtagagacggatggactggaggcgaacgttccgccagtgagcttcctgaaggtccttaaattaaacaagaccgagtggccctatttcgtagtcggcaccgtgtgcgctatcgccaatggcggcctgcagccggctttttccgtgatcttctccgaaatcatcgccatatttggccccggtgatgacgccgtcaagcagcagaaatgcaacatattttctctgattttcttattcttggggataatcagcttcttcactttctttcttcagggcttcaccttcggcaaggctggcgagatattgactcgacgcctccgtagtatggccttcaaagctatgttgaggcaagatatgagctggttcgatgatcacaagaactcgacgggcgccctctccactcgactggccacggacgccgcccaggtccagggcgcaacgggaactcgactggcgttgattgcccagaatattgccaatttaggaaccggcataatcattagcttcatttacggttggcagctgaccctgttgctgcttgctgtggtccccattatcgcggtatcgggcattgttgagatgaagcttcttgccggaaacgcgaagcgcgacaaaaaggaactggaggcagcgggcaagatcgcgacagaggccattgaaaacattagaacagttgtttcgctcacccaagagagaaagtttgaatccatgtacgtcgagaaactttatggcccgtacaggaattcggtgcaaaaggcccatatctatggcattacattttcgattagtcaagcgtttatgtacttttcatacgctggttgttttcgtttcggtgcctaccttatcgtcaacggtcacatgaggttcagggatgtgatcttggtgttctcagcaatagtcttcggcgccgttgccttgggacacgcttccagctttgctcccgattatgccaaggctaagctgtctgccgcccacctcttcatgctttttgaacgccagccactgattgattcctactcagaagagggccttaagccagataaatttgagggaaatataacgttcaatgaggtggtgtttaactatccgacgcgcgccaatgtcccggtgctgcagggtctgtcccttgaggtaaagaagggccagaccctcgccttggtgggcagttcgggttgcgggaagagcaccgtcgtacaattgctggagcgcttctacgatcccttggccggcacggtgtttgtggacttcggctttcaactgctagatggtcaagaggcaaagaagcttaatgtgcaatggctgcgtgctcagctcggaattgtgtctcaggagccgatcctgtttgactgctcaattgccgagaatatcgcctacggcgataatagccgagtggtgtcgcaggacgagattgtgtccgctgccaaggctgcgaatattcacccctttatcgaaacgctgccccataaatatgagacaagagtcggagataagggcacgcaactatcaggcggccagaaacagcgcatcgctatcgcgagagctctgatccgccaacctcaaatcctgctgctggacgaggcgacctccgccttggatacagagtccgagaaagtcgtgcaggaggccttggataaggcacgagagggccgcacgtgcatagtgatcgcacaccgactatccaccatccagaatgccgaccttattgttgtcttccagaatggtcgcgtcaaggagcatggtacccaccagcagttgctggctcaaaagggaatctacttttctatggtgtccgtacaggctggtacacagaatctt

SEQ ID NO: 7655 - DNA, 3858 bp, Artificial Sequence
  Description of Artificial Sequence: Synthetic coding sequence
atggatctggaagcggcaaagaatggcactgcatggaggccaacttccgcagaaggtgactttgaacttgggatttccagcaagcaaaaacgcaaaaagaccaagactgtcaagatgataggtgttctcaccctgtttagatattcagattggcaagacaaactctttatgtcactcgggactatcatggccatagcccatggttccggtctgccactgatgatgattgtgtttggagaaatgaccgacaaattcgtcgacacggctggaaacttttcctttcctgtcaatttctctctctctctgttgaacccaggcaaaatcctcgaagaagagatgactcgatacgcatactactacagcggccttggggctggcgtcctggtcgccgcatacatccaagtgtcgttctggaccctggcggcaggacgtcaaattcgaaagattcgtcaaaagttctttcatgctattctcagacaggaaatcggatggtttgatatcaacgacacgaccgaactcaataccagacttactgatgatatttcgaagatttcggagggcataggagataaggtgggaatgttttttcaagcggtcgcaaccttttttgctgggttcatcgtaggctttattcgcggatggaaactcactcttgtgataatggccatttcacctatactggggctgtccgctgcagtctgggctaagatactgtcggcattctcagacaaggaactcgcagcctacgcgaaggcaggtgctgtggcagaagaggccctgggtgcaattaggaccgtcattgcatttggtggtcagaacaaagagctcgaaagataccaaaagcatctggagaacgcaaaagagattggaatcaaaaaggcaatttcggcaaacatatcaatgggaattgcattcctgcttatctacgcatcgtacgcgctggctttttggtacgggagcactttggtgatttcgaaggagtataccattggaaacgcgatgaccgtattctttagtattctgataggtgctttctccgtcggtcaggctgccccttgtattgacgcatttgcaaacgcgaggggcgccgcatacgtgatctttgatatcattgacaataaccctaagatcgactccttcagcgagaggggacacaaacctgattccattaaagggaatctggaattcaatgatgtgcatttttcttacccgtcgcgagcaaacgtgaagattctgaaaggactgaatcttaaagtgcaaagcggacaaaccgtggccctcgtcggatcgagcggctgcggaaaatctaccactgtgcaactgattcaacggctgtacgatccggatgagggaacgatcaatatcgacggccaggacattcgcaatttcaacgtgaactacctgcgggagatcatcggtgtagtctcacaagaacccgtgctgttcagtaccactattgcggagaatatctgctacggaagagggaatgtgaccatggacgaaatcaagaaggcagtgaaggaagctaacgcatatgagttcatcatgaagctccctcaaaagtttgatacccttgtcggtgaaagaggtgcccagctgtcgggtgggcagaagcagagaatcgcaatcgcccgagcgcttgtgagaaaccctaagattcttcttcttgatgaggcaaccagcgccctcgacaccgagtcggaagcagaagtccaagccgcattggacaaggcgcgcgaggggcggactactatcgtgattgcacaccggctttctactgtacgcaacgccgatgtgatcgcaggttttgaagatggcgtgattgtggaacaaggaagccactccgaacttatgaagaaagagggagtgtactttaaactggtgaacatgcagacttcggggtcacaaattcagtcggaggaatttgaactgaacgacgaaaaagcagcgactagaatggcgcccaatggatggaaatccagacttttccggcattccacccagaagaatctgaagaactcccagatgtgtcaaaaatcgcttgatgttgaaactgatggtcttgaagccaatgtgccacctgtctcctttttgaaagtgctcaagctcaacaaaaccgaatggccatactttgtagtcggcaccgtgtgtgcgattgcaaacggaggccttcagcccgcattttcggttatcttctccgagataatcgcgattttcggccccggtgacgatgcagtgaagcagcagaagtgcaacatcttttcgcttatcttcttgtttttggggataatcagctttttcacctttttcctgcagggctttactttcggtaaggccggggaaatccttacccgacgtttgcggtcgatggcctttaaagcgatgctgcgccaagacatgtcctggtttgatgaccacaagaattcgactggagcactctcaactagactcgctactgatgccgcacaggtccaaggggccactggaaccagactcgcgctgatcgcgcagaatattgcaaatcttggaacgggcatcatcatttccttcatctacggttggcagcttacgctcctgttgctcgcagtggtgcctattatcgccgtgtcgggaatcgtcgaaatgaagctgctggcagggaatgctaagcgggataagaaagaactggaagccgcaggaaagatagcaaccgaagcgatagagaatatcagaaccgtcgtcagccttacccaagaacgcaagtttgagtccatgtacgtggaaaaactttacggaccttatcgcaacagcgttcagaaggcacatatctatggaataacttttagcatttcacaggcctttatgtacttttcctacgcaggatgttttaggttcggcgcctaccttattgtgaacggtcatatgcggttccgcgatgtgatacttgtgttcagcgctattgtgtttggcgcagtggcactgggacatgcgagcagttttgcacccgactacgcaaaggcaaagctgagcgcggcacatctgttcatgctgttcgaacgtcagcccctgatagattcctactcggaggaaggccttaagcctgataagtttgaagggaacattacttttaacgaagtcgttttcaactaccctacccgcgctaacgtaccagttcttcagggtctgtcactggaagtgaagaaggggcaaactctcgcattggtcggaagctcggggtgtggaaagagtactgtggttcaactgcttgagagattttacgacccacttgctggaaccgtgtttgtggattttggtttccaactgctggatggtcaggaggccaagaaacttaacgtgcagtggctccgggcacaactcggtattgtctcccaagaaccgattctgtttgactgctcaattgcagagaacattgcatacggtgataacagcagagtggtgtcccaggatgagattgtgagcgcagcaaaggcggctaacattcacccattcattgagactcttccgcataagtacgagactcgagtgggtgataagggaacccaactttcgggaggtcagaagcaacgcattgctattgcaagggcactgatcaggcaaccacaaatactgctgctggacgaagcaacgtcagctctcgatacggaatccgagaaggtggtgcaagaagcactggataaggcacgggaaggaaggacgtgtatcgtgatcgcccatcggctttcaaccattcaaaatgcagatcttatagttgtgtttcaaaacggcagagtgaaggaacacgggactcaccaacagcttcttgcccagaagggtatatacttttcgatggtcagcgtgcaagccgggacccagaacctc

SEQ ID NO: 7656 - DNA, 3858 bp, Artificial Sequence; identical to SEQ ID NO: 7577
  Description of Artificial Sequence: Synthetic coding sequence

SEQ ID NO: 7657 - DNA, 3858 bp, Artificial Sequence
  Description of Artificial Sequence: Synthetic coding sequence
atggacctggaggcggcgaagaacggaactgcctggaggcccacctcggcagaaggcgacttcgaactgggcatctcgagcaagcagaagagaaagaaaaccaagaccgtgaagatgataggagttctcaccctgttcagatacagcgattggcaagacaagctgttcatgtcgctgggaactatcatggcaatcgctcatggatcaggacttcctctcatgatgatcgtctttggagagatgaccgataaattcgtggacaccgctggcaacttctcgtttccagtgaatttctcattgagcctgttgaacccaggaaagatcctcgaagaggaaatgaccaggtacgcgtactattactcgggactgggagcaggcgtgctggtggccgcctacatccaggtatccttttggactctggctgccgggcgtcagattagaaaaatccgacagaaattcttccacgctatcctgcgtcaggaaattggctggttcgacatcaatgacactactgagctgaataccagactgactgacgacatcagcaagatctcagaaggtattggcgataaggtcggcatgttcttccaggctgtggcgaccttctttgcaggcttcattgtcggttttatcagaggatggaagttgactctggtgatcatggctatcagcccgattcttggactgtccgcggcggtgtgggccaagatccttagcgcattttcggacaaggaacttgccgcgtacgctaaggcgggagccgtggcagaagaagcactgggagcgatccgcaccgttattgcgttcggcggacagaataaggaactggaaaggtaccaaaagcatctggagaacgcaaaggaaatcggaatcaaaaaggcaatctccgccaacatctccatgggaatcgcattccttttgatctacgcgtcatacgctcttgctttctggtacggttcaaccctcgtgatctcaaaagagtacaccatcgggaacgctatgactgtgttcttctcgatactcatcggagcttttagcgtgggacaagctgccccttgcatcgacgcctttgccaacgcacgaggtgccgcttacgtcatcttcgacatcatcgacaataacccgaagattgattccttcagcgagcggggccataaaccggattctatcaaaggaaacctggagttcaatgacgtacacttttcctatccgtcgcgcgctaatgtgaagatcctgaaggggctcaacctgaaggtgcagtcgggtcagaccgtggccctcgttggatcctcggggtgtggaaaatcaactaccgtgcagctgatccagaggctgtacgacccggatgaaggcacgattaacatcgacggccaggacatccgcaacttcaatgtgaattacctgcgcgagatcatcggagtggtgtcgcaagaaccggtgctgttctcaactactatcgcggagaacatctgctacggccgcggtaatgtcacgatggacgagatcaaaaaagcagtgaaagaagccaacgcatacgagttcatcatgaaactgccacaaaagtttgataccctggtcggggaacggggcgcacaactgtcaggaggacaaaagcaacgcatcgcgattgccagagcgttggtgcggaacccgaagatcctcctgctggatgaagccaccagcgcgctcgacaccgaatccgaagccgaagtgcaggcggccctggataaagcccgggaggggcgaactaccatcgtgatcgcccaccgcctttccactgtgcggaacgcggatgtcatcgctgggttcgaagacggcgttatcgtggaacagggatcccactccgaactgatgaagaaagagggtgtctacttcaagttggtgaatatgcagacgtcaggatcacaaatccaatccgaggagtttgaactgaatgacgaaaaagccgccactagaatggcgcccaacggctggaagtctcggctcttcaggcacagcacccaaaagaaccttaagaactcgcagatgtgccagaagagcttggatgtcgaaactgatggcctcgaagctaacgtaccgccggtgagcttcctgaaggttctgaaactgaacaagactgaatggccttacttcgtggtggggactgtctgcgcaatcgctaacggtggcctccagccggcttttagcgtcattttctctgaaatcattgccatcttcggcccgggagatgatgccgtgaagcaacagaaatgtaatatcttctccttgatcttcctcttcctcggcattatatcgttcttcactttcttcctccagggatttacctttggtaaagcgggcgagatcctcactcggcgcctccggtccatggcgttcaaggcaatgttgcggcaagatatgtcatggttcgacgatcacaagaattccacgggcgctctgagtactcgccttgcgactgacgcagcacaggtgcagggcgccaccggcacccggttggcgctcattgcacaaaacattgcaaacctgggaacgggcatcatcatctccttcatctacggatggcagcttactctgctgctgctggcagtcgtgccaattattgccgtctcagggatcgtcgagatgaagctcctcgcgggaaatgcgaagcgggataagaaggagctggaggcagcgggaaagatcgcaaccgaggctatcgaaaacatccgaactgtggtgtccctgacccaagaacggaaatttgagtcaatgtacgtggagaagctgtacggcccataccgcaattcggtgcaaaaagcccacatttacggtatcaccttctcaatctcccaagccttcatgtattttagttacgccggatgtttccgcttcggagcctatttgatcgttaacggacatatgagattccgcgacgtgatcctcgtcttctccgccatcgtgttcggggcagtggcacttgggcacgccagctcgttcgcacctgactacgccaaggcgaagctgtccgctgcccatctgttcatgctgttcgagaggcagccactcatcgactcctactcggaggaagggttgaaaccagacaagtttgagggtaatatcacgtttaacgaagtcgtgtttaactacccgacccgggcgaacgtgcctgtgctgcaaggactgtcactcgaagtcaaaaagggtcagactctggcgctggtgggaagctcagggtgcggaaagtcgactgtggtccaacttcttgaacgcttctacgaccccctggctgggaccgtcttcgtggattttggattccagctgttggatggacaggaggcaaagaagctcaacgtgcagtggttgcgggcccagctcggaattgtgtcgcaggagcccattttgttcgattgctctatcgctgagaatattgcatatggggacaactcaagggtggtatctcaggatgagattgtgagcgcggccaaggccgcaaatatacacccgtttatcgaaactctccctcataagtacgaaacgcgtgtgggagataagggcacgcagctcagtggaggacagaagcagagaatcgccattgccagagccctgatccggcagccacaaatcttgctgcttgacgaagcgaccagcgcgcttgacactgagtccgaaaaggtcgtccaggaggctctcgacaaagctcgtgaaggtcggacctgcattgtgatcgcccatcgcctctcgaccatccagaatgccgacctgatcgtggtcttccagaacggcagggttaaggaacacggaacccaccagcaacttctcgcccaaaaaggaatatacttttccatggtcagcgtccaagccggaacccaaaacctg

SEQ ID NO: 7658 - DNA, 3858 bp, Artificial Sequence
  Description of Artificial Sequence: Synthetic coding sequence
atggacctggaggccgctaaaaatggaacggcctggcgccccacctcagcagagggcgatttcgagctaggtatcagcagcaagcaaaaaagaaagaagactaagacggtgaaaatgataggcgtgctgacactgtttcggtactctgattggcaggataaactgtttatgagtctaggaacaataatggccattgcacacggttcaggtttgcccttgatgatgattgtgttcggcgagatgaccgataagttcgtggatacggctgggaactttagcttccctgtcaactttagtctcagcctgctcaaccctggaaagatattagaagaggaaatgactcggtacgcctattattattccggcctaggtgctggagtgcttgtcgctgcttatattcaggtcagtttttggactctggccgccggtaggcaaatccgaaaaatccggcagaaattcttccacgcaattcttcggcaggagatcggttggtttgacataaacgatacaactgagttgaataccaggctgaccgacgacatctccaagatctctgaaggcatcggagacaaggttggcatgttcttccaggctgtagccacattctttgccggctttatcgtgggattcatccggggctggaaactcaccctcgttattatggccatctccccaatcctgggactgtccgctgcggtctgggctaaaatccttagcgcattttccgataaggaactggcagcatacgcaaaggccggcgccgtagctgaggaagcgcttggggccatcaggaccgtgatcgcctttggaggccaaaacaaagagctggaacgttatcagaagcatctggagaacgctaaagagataggaattaaaaaggccatctcagccaatatctctatgggtattgcgtttctgctgatatacgcgtcctacgcgttagctttttggtatggctcaactctcgttatttccaaggaatatacaatcggcaacgcgatgaccgtctttttttctatactcataggagcctttagcgtgggtcaagctgcaccctgcatcgacgccttcgctaacgcccggggtgcggcgtacgtgatatttgacatcatcgacaataatccaaaaatagactccttctcagaaaggggacataagcccgacagtataaagggtaacctcgaattcaacgatgtgcacttctcatatccttctcgagccaatgtgaagattttgaagggcctgaatttgaaggttcagtcaggtcagacagtggcactggtggggtctagcgggtgcggaaagtccactaccgtgcagttaattcaaaggctgtacgaccctgatgagggaacgatcaatattgatggccaggacatccgcaattttaatgtgaactatttacgcgaaataataggagtggtgtcacaagagccagtgctgttttccaccaccatcgccgaaaacatatgctatggcagggggaatgtgacaatggatgaaattaagaaagcagtgaaagaggctaatgcctatgagttcatcatgaaactacctcagaaatttgacaccttagtcggagagcgaggtgcacagctcagcggggggcagaaacagcggatagcaatcgcaagggccctggtccgcaatccgaagatcttattgctggatgaggctactagtgctctggataccgagtctgaagccgaagtgcaggcagctctcgataaggctcgggaaggacgcacgactattgtaatcgctcatcggctttcaactgtgaggaacgccgacgtcatagccggttttgaggacggggtaatagtagagcagggcagtcactctgaacttatgaagaaggagggggtctatttcaagctggtgaatatgcagacctcaggtagtcagattcagagcgaagaatttgaactgaacgacgaaaaagccgcaacccgtatggcaccgaatggatggaaatcacggctgttcagacactccacacagaagaatctcaagaacagccagatgtgccagaagtcactcgacgtcgagacagatggcctggaggctaatgtgccgcctgtatcattccttaaggtactcaaactcaataagaccgagtggccttatttcgtggtgggcactgtttgcgcgatcgctaacggaggcctgcagcctgctttcagtgtcattttctcagaaattatagccatcttcggccctggagacgacgctgtcaagcagcagaagtgcaatatttttagcttgatttttctgttcctgggaatcatcagcttttttacttttttcctgcaaggctttactttcggtaaggccggcgaaatcctcacccggaggttacgttcaatggcatttaaagccatgttgagacaggatatgtcttggtttgatgatcacaagaatagcacgggggctctctctacacgtcttgcaaccgacgcggcccaagtgcagggtgctacagggacgcgcttggctctgatcgcacagaatatagcaaacctgggaactgggattattatctcatttatctatggatggcagttgaccctcctgctacttgctgtggtccctatcatcgctgtctcagggatagtggagatgaaacttttagcgggcaatgctaaaagagacaagaaggaacttgaggccgctggcaaaatcgctaccgaggcgatagaaaacatccggactgtggtgtctctcacacaagagcgcaaatttgagtctatgtacgtggaaaaactttacggaccttatagaaactcagtccagaaggctcatatctatggcatcacgttttcaatctcacaggcgtttatgtatttctcttatgccggatgcttcagatttggagcctatttgattgtgaacgggcacatgagattcagagacgtaatcttagtattctctgcgattgtatttggggcagtggccttggggcacgcttcctccttcgcccccgactatgctaaagctaaactttccgctgctcatctgttcatgttgtttgaaaggcaacctctgattgacagttactctgaagagggattaaagcctgacaagttcgagggtaacatcacttttaacgaggtggtgttcaattaccctactagggccaacgtgccggtgttacaggggctatccctggaagtgaagaaagggcagactttggctctggtgggttcttctggatgcggcaagtcaacggtggtccagctgctggagcgcttttatgatccactggccggaaccgtgttcgtcgactttgggtttcagctgctggacggacaagaggctaagaagttgaatgtgcagtggcttagggcgcagctcggcatcgtatctcaggaacccatactgtttgactgttccattgccgaaaacattgcgtacggcgacaatagtcgggtggtgtctcaggacgaaatcgtatctgccgcgaaagccgccaatattcatccctttattgaaactctgccacataagtatgagacccgagttggcgataagggaacgcagctgagcggggggcaaaagcagagaattgccattgcaagagctctgattcggcagcctcagatcttattgttggatgaagccacaagcgctttagacacagaatcggagaaggtggtacaggaggctctggacaaggctcgcgaaggcaggacatgcattgtgatcgcccatcgcctgagcacgatccaaaatgcagacctgatcgtggtttttcaaaacggcagggttaaggaacatggcacgcaccagcaactcctggcccagaagggcatttacttcagcatggtaagtgttcaggccggaactcaaaatctc

SEQ ID NO: 7659 - DNA, 3858 bp, Artificial Sequence
  Description of Artificial Sequence: Synthetic coding sequence
atggatctggaagccgctaagaatggtaccgcatggcgacctacttccgccgaaggtgattttgaactgggcattagctccaaacaaaaacgaaaaaagaccaagacggtcaagatgattggagtgctcaccctgtttcgctactcggattggcaggataagctgttcatgtctctcgggaccatcatggcaatcgcacatggttccggactgccccttatgatgattgtttttggggaaatgactgataagtttgttgacactgcaggaaacttttcgttcccggtcaacttctccctgtcgcttcttaatcctggtaagattcttgaagaagagatgacccggtacgcgtactactacagtggcctgggagcaggggtgcttgtggcagcatacatccaggtgtcgttctggactcttgccgccggcagacagattagaaagattaggcaaaagtttttccatgcaatcctgcggcaggagattggatggtttgacattaatgataccactgaacttaacaccagactgactgatgatatctccaagattagcgaggggataggggacaaagtgggcatgttcttccaggcagtggcaaccttttttgcaggttttatcgtgggctttattcgagggtggaaactcacccttgtgattatggccatttcacctattcttggcttgtcggcggcggtctgggccaaaatactgtcggctttttcagacaaagaactcgccgcctacgccaaagcaggggcagtcgccgaagaagcgctgggagccattcgtactgtgatcgctttcggtggacagaataaggagctcgaacgataccaaaaacatcttgaaaacgctaaggaaattggaatcaaaaaagcaatctccgccaacatttcgatgggaattgcattcctgctgatttacgcaagctacgcactggctttttggtacggtagcactcttgtcatctcaaaggaatacactataggaaatgcaatgactgtgtttttctcgattcttattggtgccttttccgtgggacaagcagcaccctgtatcgatgcgtttgcaaatgctcgcggcgcagcttacgtgatctttgacataatagataacaaccccaagatcgattccttttcagaaagaggtcataaacctgatagcatcaaaggtaaccttgagttcaatgatgtgcatttctcgtacccgtcacgtgcgaacgtaaagatactcaagggtctgaatctgaaggtgcaatctgggcaaactgtggcccttgtggggtctagcggttgtggcaagagcaccactgtgcaactgatacaaagactgtacgatcctgatgagggcacgatcaatattgacgggcaggacatccggaactttaacgtgaactaccttagagaaatcattggagtggtgagccaggaaccagtactgttctccactaccattgcagaaaacatttgttacgggcgcggaaatgtgaccatggatgagattaagaaggccgtcaaggaagcaaacgcgtacgagttcattatgaagctgccgcaaaagtttgatactcttgtcggcgagaggggtgcccaactcagtggtggacaaaagcagcgtattgcaatagcacgggcgctcgtgcgaaatcccaagatcttgctgctcgatgaggcaacttcggccttggataccgaatcggaagcggaagtccaggccgctctcgacaaggccagagagggcagaactaccatcgtcatcgcacacagactgtcgactgtgagaaatgcagatgtgatagctggatttgaagatggagttattgtggagcaaggatcacatagtgagcttatgaaaaaggaaggagtctactttaagctcgttaacatgcaaacctcaggatctcaaattcagtcagaagagtttgaacttaatgacgaaaaggcggccacgaggatggcaccaaatggatggaagtccaggttgtttcgtcattcgacccaaaagaacttgaagaactcgcagatgtgccagaagtcgctggacgtggagactgacgggctggaagcaaacgtgccgccagtgtcgtttctcaaggtgctcaaactcaataagactgagtggccttactttgtggttggaactgtgtgcgcaattgcaaacggtgggctccaacctgcattcagcgtcatattctcggaaatcatagccatctttggtccaggtgacgatgcagtgaagcaacagaagtgtaatatcttttcgctgatttttcttttcctgggcatcattagcttctttaccttttttcttcaaggctttacctttggaaaagcaggtgaaatcttgacgcggagactgaggtccatggcatttaaggcaatgctccgccaggacatgtcgtggtttgatgatcacaagaatagcaccggagcactttctacccggctggccacggatgccgcgcaagtgcagggggcaaccggaactcgcttggctctgattgcccagaacattgcaaatctgggaacgggcatcattatctcgttcatttacgggtggcaacttacccttctgctgctcgcggtagtgccaatcatcgcagtcagtggaatagtggaaatgaagctgctcgcaggcaacgcaaaacgggacaaaaaagaactggaagcagctggcaagatcgcgactgaagcgatagagaatattcgaaccgtggtgtcactcactcaggaaaggaaattcgagagcatgtacgtggaaaagttgtacggaccctatagaaacagcgtgcaaaaggcacacatatacggcatcaccttctccatttcacaggcttttatgtatttctcctacgcgggttgttttcgcttcggtgcctaccttatcgtcaacgggcacatgcgtttcagggacgtcatcctcgtcttttccgccattgtgtttggagcagtggcactcggacacgcctcctcgtttgcacctgattacgctaaggctaagctgtccgcagctcaccttttcatgctttttgaacgccaaccactgatagattcctactctgaggagggtcttaagccagacaagttcgagggaaacattaccttcaacgaagtcgtctttaactatccgactcgcgccaacgtgccagttctgcagggtttgagcctggaagtgaagaagggccaaaccctcgcgctggtgggttccagcggttgcggaaaatccaccgttgtccaactgctcgagcgcttttacgacccactggccggaactgttttcgtcgactttggatttcagctgctggatggtcaagaagcgaagaagttgaacgtgcagtggctgcgggctcaacttggaattgtgagtcaagaacccattcttttcgactgctccatagcagagaacatcgcctacggagataactcgagagtggtgtcacaggatgagatcgtcagcgcggccaaagcggctaacatacatcctttcattgaaacccttcctcacaagtacgagactcgggtgggggataaaggaacgcaattgtccgggggacaaaaacaaaggattgccattgcgagagcacttatcaggcagcctcaaatcctgctcttggacgaggcaacgtccgccctggacaccgaatcagaaaaggtggtgcaggaagcacttgataaagcaagagagggtagaacctgtattgtgattgcccatcgccttagcaccattcaaaacgcggacctgattgtcgtgtttcaaaatggaagggtcaaagaacatgggactcatcagcaactgcttgcccagaaggggatctatttctcaatggtatccgttcaggcaggcacgcagaacctt

SEQ ID NO: 7660 - DNA, 660 bp, Artificial Sequence
  Description of Artificial Sequence: Synthetic coding sequence
atgggagtgcggcaccctccctgcagccacaggcttctggcagtgtgtgccctggtgtcactcgcgactgcggccctcctggtcaacccgggagtcgttgttcgcatcagccaaaagggtttggactatgcgtcccaacaggggacggcagctctccagaaggagctgaagcgaatcaaaattccggattactcggactcattcaagatcaaacatcttggaaaaggacattactcgttctacagtatggacattagagaatttcaactgccaagcagtcagattagtatggtgccgaacgtcggtctgaagttctccatctcaaacgctaatatcaagatctctggaaaatggaaagcccagaagcggttcctcaagatgagcggcaatttcgatttgagcatagagggcatgagcataagcgcagacttgaagctgggtagcaacccaactagcggcaagccgactatcaccgcctcgtcatgctcttcgcatatcaattccgttcacgtgcacatctccaaatcgaaggtgggatggttgatccagctgttccacaaaaagatcgaatcagctctgcgcaacaagatgaattctcaagtgtgcgagaaggtcaccaactccgtgtcgagcgaactgcagccatactttcagaccttg

SEQ ID NO: 7661 - DNA, 660 bp, Artificial Sequence
  Description of Artificial Sequence: Synthetic coding sequence
atgggagtaaggcatccaccttgctcccatcggttactcgccgtgtgcgctctggtcagcctggctacagcagccctgttggtcaacccgggagtggttgtgaggatctcgcaaaagggcctggattacgctagccaacagggcaccgctgctctgcagaaggaactcaaaaggatcaaaatccctgactacagtgactcttttaaaatcaagcacctgggcaaaggccattacagcttttactccatggacatcagggaatttcagctccctagctctcaaatcagcatggtgccaaacgtaggtctgaagttttctatcagcaatgctaatattaaaatctctggaaaatggaaagctcagaaacgcttccttaagatgagcggcaacttcgatctgagcattgagggaatgtccatcagcgccgatcttaaattgggaagcaaccctacaagtggcaagccaacaatcacagccagcagttgctcatcccatatcaacagcgtgcatgttcacatcagcaaatctaaggtgggatggctaatacagctttttcacaagaagatcgaatctgcattacgcaataaaatgaatagtcaggtttgcgagaaggttaccaactctgtcagcagcgagctgcagccttacttccagacactt

SEQ ID NO: 7662 - DNA, 660 bp, Artificial Sequence
  Description of Artificial Sequence: Synthetic coding sequence
atgggggtacgtcatccaccatgtagccatagactgcttgcagtctgcgcactcgtgtcgctggcgactgcagctctgcttgttaaccctggtgtggtggtccgtattagccaaaaaggattggactacgccagtcaacagggcaccgcagcactccagaaagaacttaagagaattaagataccagattactcagactcatttaagataaagcaccttggcaagggtcattactcgttttactcaatggatattcgcgaatttcaactgccctcgtcgcagatctccatggtccctaacgtgggtcttaagttttcgatttcgaacgccaatatcaagattagcgggaagtggaaggctcaaaaaaggtttctcaaaatgtctgggaatttcgatctttctatcgaagggatgagcatttcagcagatctgaaacttggatcgaaccccacgtccggtaagcctaccataaccgccagcagctgttcctcgcatatcaactcagtccacgtgcacatttccaagtcaaaggtgggttggcttattcaattgttccataagaaaatagagtccgcactccgaaacaagatgaattcccaggtatgtgagaaggtgaccaattccgtgtcctcggaactccagccttactttcagactctg

SEQ ID NO: 7663 - DNA, 660 bp, Artificial Sequence
  Description of Artificial Sequence: Synthetic coding sequence
atgggcgtacgacacccgccctgctctcaccgcctcctggcagtgtgcgctttggtgtccttagctacagctgccttgctggtaaacccaggtgtggtggtgaggatcagtcaaaagggcctggactatgctagccaacaaggcacagctgccctgcagaaggagttgaaaagaatcaagattccagactacagcgatagctttaagatcaaacacctgggcaaaggccactatagcttttacagcatggacataagggaattccagctgccttctagtcagattagcatggtgcccaatgtgggcctgaaatttagtattagtaatgcaaacattaaaattagcggtaagtggaaggcacaaaagcgcttcctcaagatgtctggtaactttgacttgtctatcgaggggatgagtattagtgctgacctcaagctcgggagcaaccccactagcgggaaacccacgatcaccgcttcctcgtgcagctcacacataaacagcgtccacgtgcacatttcaaaatccaaggttggctggctgatccagctatttcataaaaagatagaaagtgctctccgcaataagatgaactctcaggtttgcgagaaagtgaccaatagtgtgagctccgagttgcaaccctactttcagaccttg

SEQ ID NO: 7664 - DNA, 660 bp, Artificial Sequence
  Description of Artificial Sequence: Synthetic coding sequence
atgggtgtgcgacaccctccctgtagccataggctgcttgcggtctgtgcactggtatcgctcgccacggcggctttactggtgaaccctggagtggtagtgcgaatctctcagaaggggctggactacgcctctcagcaagggaccgctgccctgcaaaaagagttaaagcgaatcaagattcccgactacagcgattccttcaaaatcaaacacctagggaaaggccactactccttctactccatggacatcagagagtttcagctcccatctagtcagatttcaatggtgcctaacgtgggactcaagttctcgattagtaacgccaacatcaaaatctccggaaagtggaaagctcagaaaagattccttaagatgagtggaaactttgacctctcaatcgaggggatgtccatttctgccgacttgaagctgggatctaatcccacatccggcaagcctactattacggcgtccagctgctcctcacacattaactccgtgcatgtgcacatctcgaagagcaaggttggctggttgatccaactcttccataagaagattgagtccgctctaagaaacaagatgaacagtcaagtttgcgaaaaagttacaaatagcgtaagctccgaactgcagccttactttcagactctt

SEQ ID NO: 7665 - DNA, 660 bp, Artificial Sequence
  Description of Artificial Sequence: Synthetic coding sequence
atgggtgttcgacatccgccgtgttcgcatcgattattagcggtatgtgcgttagtatcgctagcgacggcggcgctactagtaaatccgggtgtagttgtacgtatatcgcaaaaaggtttagattatgcgtcgcaacaaggtacggcggcgttacaaaaagaactaaaacgaataaaaataccggattattcggattcgtttaaaataaaacatttaggtaaaggtcattattcgttttattcgatggatatacgtgaatttcaactaccgtcgtcgcaaatatcgatggtaccgaatgttggtttaaaattttcgatatcgaatgcgaatataaaaatatcgggtaaatggaaagcgcaaaaacgttttttaaaaatgtcgggtaattttgatctatcgatagaaggtatgtcgatatcggcggatctaaaattaggttcgaatccgacgtcgggtaaaccgacgataacggcgtcgtcgtgttcgtcgcatataaattcggtacatgttcatatatcgaaatcgaaagttggttggctaatacaattatttcataaaaaaatagaatcggcgttacgaaataaaatgaattcgcaagtatgtgaaaaagtaacgaattcggtttcgtcggaattacaaccgtattttcaaacgcta

SEQ ID NO: 7666 - DNA, 660 bp, Artificial Sequence
  Description of Artificial Sequence: Synthetic coding sequence
atgggagtccgacatccaccatgcagccacagactgcttgcggtgtgcgctctcgtctcgctagctacggcagccctcctggtcaaccctggggtggtcgtgcgaatcagccaaaagggtttggactacgcttctcagcaggggaccgctgcgcttcagaaggagctgaagcgaatcaaaatcccagattacagcgatagcttcaagatcaaacatctcggaaaggggcactacagtttctactctatggacatccgagagttccaactccctagctcacaaatatcaatggtgcccaacgtaggtcttaagttctctatcagtaacgccaacattaagatctccggaaaatggaaggcccaaaaacgatttctcaaaatgagcggcaattttgacttgtcaatcgagggaatgagtatatctgccgacctgaagctcggatccaatccaacttcaggcaagccaaccatcactgcatcgagttgttcgagccatattaacagtgttcacgttcacatctctaagtctaaagtcggctggctcatccagctgtttcacaagaagattgaatctgccctaaggaacaaaatgaactcacaagtctgcgagaaggtcaccaacagcgtaagcagcgaactgcagccatattttcagacgctg

SEQ ID NO: 7667 - DNA, 660 bp, Artificial Sequence
  Description of Artificial Sequence: Synthetic coding sequence
atgggggtgcgtcacccaccgtgctctcacagacttttggcagtgtgcgcactcgtgtccttagccacagctgcgctccttgtgaacccaggcgtggttgtgagaatctcacagaagggactggactatgctagccaacagggcacagctgctctgcagaaggagcttaaaagaattaagataccggactactctgattcctttaagataaagcatctaggtaaaggccactactctttctatagtatggatattcgtgagttccagctcccgtcttctcagatctccatggtcccaaacgtggggttaaaatttagcatctcaaatgccaacatcaagatcagcggcaaatggaaggcccaaaagcgctttctgaaaatgtcgggcaacttcgatctatctatcgagggcatgtcgatcagcgccgacctcaaactggggtccaatccaactagcggcaagccgactatcacagcgagttcctgcagtagccatatcaatagcgtgcatgtgcacattagcaaatccaaagtgggatggctgattcagctgttccacaagaagatcgagagcgccctgaggaataaaatgaattcacaggtctgcgagaaggtcactaacagcgttagttctgagctacagccttacttccagacgctc

SEQ ID NO: 7668 - DNA, 660 bp, Artificial Sequence
  Description of Artificial Sequence: Synthetic coding sequence
atgggcgtgagacatccaccctgctctcaccgtctgctcgccgtttgcgccctcgtttcactggctactgcggcactgcttgtgaatccaggtgtggtggtccgcatctctcagaagggactggactacgcgagccagcagggcaccgctgcactgcagaaagaactcaagaggatcaagataccggattacagtgacagtttcaagataaaacaccttggcaaggggcattactccttttatagcatggacattcgtgagttccagctcccttcctctcagataagcatggtacccaatgtcggcctcaagttctctatctccaatgcaaacattaagatatctggtaaatggaaggcccagaagaggttcctgaaaatgagtggaaactttgacttgagcatagagggtatgagtattagcgcggatctgaagctgggaagcaatcccacctcaggaaagcccaccataaccgctagctcatgtagcagccacattaactctgttcacgtacatatctcaaaatctaaagtggggtggctgatccagctttttcacaaaaagattgagagcgctcttcgcaataaaatgaactctcaggtatgcgagaaagtgacaaactcagtgtcctctgaactccagccttatttccagacattg

SEQ ID NO: 7669 - DNA, 660 bp, Artificial Sequence
  Description of Artificial Sequence: Synthetic coding sequence
atgggagtacgacatcctccatgcagccaccggttgctggctgtttgcgcacttgtgtccttggccacggctgcactcctggtaaacccgggcgtggttgtacgcatcagccaaaaaggcctggactacgcgagtcagcagggcacggcagctcttcagaaagaactgaagcgtatcaaaatccccgactacagcgacagctttaaaattaagcatctgggaaagggacattattcgttctactcaatggatatccgggagttccagctcccgtcctcccagattagcatggttcctaatgttggcctgaagttcagcattagcaatgctaacatcaagatttccggcaaatggaaagcacagaagaggtttctcaagatgtctggtaactttgatctgagcattgagggtatgtccatctcggcagatctgaaactcgggtctaacccaacctcaggtaagccaacgattaccgcatcctcctgtagctcccatattaactctgtgcatgtgcatataagtaagagcaaggttggatggctaatccagctatttcataagaagatagaatccgccttgcggaacaagatgaattctcaggtgtgcgagaaggtcacaaactctgtgtcctccgaactccagccgtacttccagacactg

SEQ ID NO: 7670 - DNA, 660 bp, Artificial Sequence
  Description of Artificial Sequence: Synthetic coding sequence
atgggagtgcgccatccaccatgcagccatagacttctcgctgtgtgcgctttggtaagcctggccactgctgccctgctggtgaacccaggagtggttgttaggatttcacagaagggactggattacgcctctcagcagggtacagctgccctgcagaaagaactgaaaagaatcaagatcccagactacagtgacagctttaagatcaagcacctgggaaagggacactactccttctattctatggatattcgcgaattccagctgccttcttctcaaatttctatggtgcctaacgtcggccttaagttttccatcagtaatgctaacatcaaaatctctggaaaatggaaggctcagaagcgtttcctgaaaatgtccggcaactttgatctcagcattgagggtatgagtattagtgcagacctcaagcttggctccaatccaaccagcggcaagccaactatcacagctagtagctgctccagtcatattaactccgtccacgtgcatatttccaagtccaaagtgggttggctgatccagctgttccacaagaagatcgaatccgctctgcgcaacaaaatgaacagccaagtgtgcgaaaaggtgacaaactcagttagctccgagctgcaaccatactttcagaccctg

SEQ ID NO: 7671 - DNA, 660 bp, Artificial Sequence
  Description of Artificial Sequence: Synthetic coding sequence
atgggagtccgacatcctccttgttcacacagacttctcgcagtatgtgctctcgttagcctcgctacggcagccttactggtcaacccaggcgtagtagttaggatctctcagaagggcctggattatgccagccagcagggaactgcggctttgcagaaagagcttaaacggattaagatcccagactattctgactcttttaagattaagcacttgggaaagggccactactccttttatagtatggacatccgagagtttcagttgccgagcagccaaatatcaatggtaccgaacgtgggcttaaagttcagcatctctaatgctaatattaagatatccggaaagtggaaggcccagaaacggtttctgaagatgtcgggcaacttcgacctgtccatcgaagggatgtctatatcagccgatttgaagctgggatcaaatccgaccagtggcaagcccaccatcaccgcctcctcctgttccagccacatcaatagcgttcatgtgcatatcagcaagtctaaggtgggttggctcattcagttgtttcataagaaaattgagtccgccttgcgcaataagatgaatagtcaggtctgtgagaaagtgaccaactccgtttccagtgaactacagccatacttccagaccctc

SEQ ID NO: 7672 - DNA, 660 bp, Artificial Sequence
  Description of Artificial Sequence: Synthetic coding sequence
atgggtgtgagacatcctccgtgctctcataggctgctggctgtgtgcgcactggttagcctggcaaccgcggcacttcttgttaacccgggggtagtggtccggatttctcaaaaaggcctggactatgcgagtcagcaagggacagccgcacttcaaaaggaattgaaacgaataaaaataccggattactccgacagttttaaaatcaagcacctgggcaaggggcactacagtttttacagtatggacatccgggaattccagcttcccagtagccagatttcaatggtgcccaatgtgggcctgaaattctcaatcagcaacgccaacataaagattagtggaaaatggaaggcacagaagcgtttcctgaaaatgagtgggaatttcgacttatcgattgaaggcatgtccatttcagctgatctcaaactgggaagcaaccctacatctggaaagcccaccatcactgccagtagctgcagtagccacataaattctgtccatgtacacatttcgaaaagcaaagtaggctggctgatccagctttttcacaagaaaatcgaatcagccctcaggaacaagatgaacagtcaggtctgtgagaaggtgacaaactctgtttcctcggagctgcaaccctatttccagaccctc

SEQ ID NO: 7673 - DNA, 660 bp, Artificial Sequence
  Description of Artificial Sequence: Synthetic coding sequence
atgggcgtccgccatccgccctgttctcaccggttacttgcagtttgtgcattggtgtctctagccacagcggcacttctggtcaaccctggggtcgtggtccgcattagccagaagggcttggactacgcatcacagcaggggacagccgccctccagaaggagctgaagagaataaagatacccgattatagcgatagctttaagatcaaacacttgggtaaggggcattactctttctatagtatggacatccgagagttccagctcccgtctagccagatctcgatggtgccaaacgttgggctgaagttttcaatttcaaacgccaatattaagatttctggaaaatggaaggcgcagaagcgtttcttgaagatgagcgggaacttcgacttgtccatagagggaatgtctatctccgccgatttgaagttgggcagcaaccccacaagcgggaagccaaccattactgcctcatcctgctccagccatattaacagcgtgcacgtgcacatcagcaaaagcaaggtaggctggctcatccagctcttccataagaagattgagtctgcgctcagaaataagatgaactcccaggtgtgcgagaaggttaccaattccgtgagtagcgagctccagccctacttccagaccttg

SEQ ID NO: 7674 - DNA, 660 bp, Artificial Sequence
  Description of Artificial Sequence: Synthetic coding sequence
atgggtgttcgccacccaccctgcagccacaggcttcttgccgtatgcgcgctcgtgtctcttgctactgctgctttgctggtaaatcccggcgttgtggttaggatttcacagaaggggttagactacgcctctcagcagggcacagccgccctacagaaggagcttaaacggattaagatcccagattatagtgacagttttaagatcaaacatcttggcaaaggccactatagtttctactccatggatattcgggaattccagctgccatcttctcaaatctctatggttcctaatgtgggcctgaagttctcaatctcaaatgccaacatcaaaatttcgggtaagtggaaggcccagaagcgcttcctgaaaatgtctgggaactttgacctgagcatcgaaggaatgagcatcagcgccgatctgaaactgggcagtaatcccacgtcaggaaagccaacgatcacagcatcctcctgctcaagtcatattaattcagtgcacgtccacatttccaaatcaaaagtcggctggctgatccaactcttccacaagaagattgagtccgccttgagaaataaaatgaactctcaggtgtgcgagaaggtgactaattcagtgtcctcagagcttcaaccatactttcaaacgctt

SEQ ID NO: 7675 - DNA, 660 bp, Artificial Sequence
  Description of Artificial Sequence: Synthetic coding sequence
atgggagtgagacaccctccgtgctcccatcgcctccttgcggtgtgcgctctggtgagcttggccactgccgctctccttgtgaacccgggagtggtggttcggatctcacaaaaaggcctcgactacgcctcacagcaaggcaccgccgccctgcaaaaagaacttaaacggatcaagatcccggattatagcgacagcttcaagattaaacacctgggcaagggacattactcgttctactcaatggacattagggagttccaactcccgtccagccagatctcaatggtgccgaacgtgggactcaagttttccatctctaacgccaacatcaagatttcggggaagtggaaagcccagaagcgcttcctgaagatgtctggaaatttcgacctgtcaattgaaggcatgagcatctcggctgatctcaagctggggtcgaatcctacctcgggtaagcctaccatcactgccagctcgtgctcgtcgcatatcaactcggtccacgttcatatttcgaaaagcaaggtgggctggctgatccagctgtttcataagaaaattgaatcagcgctgaggaacaagatgaatagccaggtctgcgagaaggtgaccaattccgtgtcctcagaactccagccttactttcagaccctg

SEQ ID NO: 7676 - DNA, 660 bp, Artificial Sequence
  Description of Artificial Sequence: Synthetic coding sequence
atgggagtgcgacatcccccttgttcccacaggcttctggctgtgtgcgccctcgtttctctggccaccgccgctctccttgtgaatccaggtgtggttgtcaggattagtcagaaaggtctggattacgcttcacagcagggaacagccgcactgcagaaggaattgaagagaatcaaaatacccgactatagtgattcattcaaaatcaaacacctggggaagggacactattctttctactcaatggatattcgcgaattccaacttccatcaagccagatcagcatggttcccaacgtgggcctcaaattctccattagtaacgctaacatcaaaatcagtggaaagtggaaggcccagaagaggttcctcaaaatgtccgggaatttcgacctcagcatcgaagggatgtcaattagtgccgacctgaagctgggaagcaacccaacaagcggaaagcctaccattacagcatcttcatgcagctcacacatcaactctgtgcacgtccacattagcaaatcaaaggtgggctggttgatacagctttttcataagaaaattgagagcgccctgcggaacaaaatgaattcccaagtctgcgaaaaggtgaccaattctgtgtccagcgaactccagccctacttccagactctg

SEQ ID NO: 7677 - DNA, 660 bp, Artificial Sequence
  Description of Artificial Sequence: Synthetic coding sequence
atgggggtccggcacccgccctgcagtcatcgcctgctcgccgtgtgcgctcttgtctccctcgcaaccgcagccctgctggtgaatccgggcgtcgtggtcagaatcagccagaaaggactcgactatgcctcccaacaaggtacggcggcgttgcagaaggagctcaagcggatcaagatcccagactactcagattcatttaagattaagcacctcggaaaaggtcactactcgttctacagcatggatatcagagaattccagttgccgtcgagccagatctcgatggtcccgaatgtgggcctgaaattctccatcagcaacgcaaacatcaaaatttcgggaaagtggaaggcccagaagaggtttctgaagatgagcggaaacttcgacctctcaattgaaggcatgagcatctccgcggacttgaaactgggatctaaccctacctcggggaagcctaccatcactgcctcctcgtgttcaagccatataaactcggttcacgtgcatatctccaagtcaaaggtgggatggctgatccaactgttccacaagaagatcgagtcagctctgcgcaataagatgaactcgcaggtgtgcgagaaagtgactaattccgtgtcgtccgaactgcaaccatacttccagactctt

SEQ ID NO: 7678 - DNA, 660 bp, Artificial Sequence
  Description of Artificial Sequence: Synthetic coding sequence
atgggcgtaagacatccaccgtgctcacatagactcctagctgtttgtgctttggtgtccttagccactgccgccttgttagtaaaccccggggtggtggtcagaatctcacagaaggggctcgactatgccagccaacagggaacggccgccctgcagaaggagctgaagagaattaagattcccgattacagcgattccttcaaaatcaagcacttgggaaagggacattattccttctatagcatggacattcgcgagttccagctgcctagctcacagatttcgatggtccccaacgtggggctaaagtttagtatctctaatgccaacatcaagataagtggaaagtggaaggcacagaagcgttttcttaagatgtctggcaacttcgacctgtccattgagggcatgtccatctcagcagatctgaaactaggttcaaacccaacctctggcaagccaactatcactgcctccagctgttcgtcacatatcaactcagtccacgtgcatattagtaaatcaaaagttggatggctcattcagctctttcataaaaagatcgaatccgccctgaggaacaaaatgaactcccaagtgtgcgagaaagtgaccaactccgtcagtagtgaactgcagccttactttcaaaccctt

SEQ ID NO: 7679 - DNA, 660 bp, Artificial Sequence
  Description of Artificial Sequence: Synthetic coding sequence
atgggggttcggcaccctccatgttcacataggcttcttgccgtgtgcgcgttggtgagccttgctaccgccgcattgctggtgaatccaggtgtcgtcgtcagaatctcccagaaggggcttgactacgcatcgcagcaaggtacggcagcgctccagaaggagctgaaacgtattaagatccctgattacagcgatagcttcaagataaagcacctcggaaagggacattattcgttttactccatggatatccgcgaatttcagctgccaagttcacagatttcgatggtgccaaacgtgggccttaagttttccatctcaaatgccaacattaagatttcgggtaagtggaaggcccagaaaagattcctgaagatgtcgggaaatttcgatctgtcaattgaaggcatgtccatttcggcagatctgaagctcggatcgaatcctacctcgggaaaacctaccattaccgcttcgagctgttccagccatatcaattccgtccatgtgcacatcagcaagtccaaggtgggctggctgattcagcttttccataagaagatagaatcggcactcagaaataagatgaactcgcaggtgtgtgaaaaagtgaccaactccgtctcctcggagctgcagccttactttcaaaccctg

SEQ ID NO: 7680 - DNA, 660 bp, Artificial Sequence
  Description of Artificial Sequence: Synthetic coding sequence
atgggagtacgacatccgccttgtagccatagattactggctgtgtgtgcgcttgtgagccttgccacagccgctttactagttaatcccggcgttgtcgttcggatctcccaaaaagggctcgattatgcgagccaacaaggcactgccgccttacagaaggagctgaaacgaatcaaaatccctgattattctgattcatttaagattaaacatctcggtaaaggacattatagcttttattctatggatattagagaatttcaacttccgtctagccaaatcagcatggtgcctaatgtcgggctgaagttttcgattagtaacgcgaacattaaaatctcaggaaagtggaaagcccagaagagatttttgaaaatgtcaggcaactttgatctaagcatcgagggaatgtcaattagcgccgaccttaaattaggcagtaatccgacgtccgggaaaccgacaattaccgcatccagctgttcctcgcatattaattctgtccatgtacacatttcgaaatctaaggtaggatggctgatccagctcttccataaaaaaatcgaaagtgcgttacggaataagatgaattcgcaggtgtgtgaaaaagttacaaactccgtcagtagcgagcttcagccttattttcaaacccta

SEQ ID NO: 7681 - DNA, 660 bp, Artificial Sequence
  Description of Artificial Sequence: Synthetic coding sequence
atgggcgttaggcatccaccatgtagccacagacttctggccgtatgcgccttggtgtcactggccactgctgcattgttggtcaatccaggtgtagtagttcgcatctctcaaaaaggactggactatgcttcacaacagggaacagccgcacttcagaaggagttgaagagaatcaagatcccagactactctgactctttcaagatcaagcatctgggcaagggtcattactccttttactccatggatattagagagtttcaactgccaagctcacagatttctatggtacccaacgtgggccttaagttttctatatcaaacgccaacattaagatttccggcaagtggaaggctcagaagcgcttcttgaagatgtctggtaactttgatctgtccatcgaaggcatgtctatcagcgccgatctcaagctgggaagcaaccccaccagcggaaaaccaactatcacggcgtcctcttgttctagtcacatcaactccgtacacgtgcatatctctaaaagtaaggttggctggttgatccagctgttccacaaaaaaatcgagtctgccctccgcaataagatgaatagccaagtatgtgagaaagtcacgaactcagtgtcttccgagttgcaaccatacttccagaccctg

SEQ ID NO: 7682 - DNA, 660 bp, Artificial Sequence
  Description of Artificial Sequence: Synthetic coding sequence
atgggcgtcagacacccaccttgttcgcacaggttgctggccgtgtgtgccctggtgagccttgctaccgctgcccttcttgtaaaccccggagtcgtggtgcgaatctcccaaaaaggcctcgattacgcatcccaacaaggtacggcagcacttcagaaagaactgaagcggattaagattcctgattactcagattcctttaagattaagcatcttggcaaggggcattattccttttactccatggacatcagagaatttcaactgccctcgtcccaaattagcatggtgccgaatgtgggcttgaaattcagcatatctaacgcaaacatcaagatcagcggtaaatggaaggcgcagaaacgatttttgaaaatgagcggtaacttcgacctgtcgattgagggtatgtcaataagcgcggatctgaaacttgggtccaacccaacctctgggaagcctactattactgcatcgtcatgctcatctcacataaacagtgtccatgtgcacatttccaaatccaaggtgggatggctgatacagctcttccataagaagatagagtcggcactgcggaacaagatgaactcgcaggtgtgtgagaaagtgacgaactccgtttcgtccgagttgcagccatactttcagaccctg

SEQ ID NO: 7683 - DNA, 660 bp, Artificial Sequence
  Description of Artificial Sequence: Synthetic coding sequence
atgggtgtgcggcaccctccttgctctcatcgcctgctggcagtctgcgccttagtatccctggcgaccgctgcgctgctcgtgaacccaggtgtcgtggtcagaattagtcagaaggggctggactacgcatcgcagcaggggaccgcagcactgcagaaggaacttaagcgtatcaagattccagattattccgattccttcaaaatcaagcacctcgggaaaggtcactatagcttttactcaatggatattagggaatttcagctgccgtcaagccagattagcatggtgcctaacgtgggcctcaaattctcgattagcaacgccaacataaagataagcggcaagtggaaagcacagaaacgttttctcaaaatgagcggcaacttcgacttaagcatcgaaggcatgagtatttctgctgacctcaagctgggctccaacccaactagtggcaaaccgaccatcaccgcctcctcatgctcaagtcacattaactcggtgcatgtccatatatctaaaagtaaggtcggctggctgatacaattattccacaagaagatagagtctgcgctgcgtaataaaatgaactcccaagtgtgcgagaaagtgaccaactcagtgtcttccgaactacagccttacttccagaccctt

SEQ ID NO: 7684 - DNA, 660 bp, Artificial Sequence
  Description of Artificial Sequence: Synthetic coding sequence
atgggcgtccgtcatcccccctgcagccatcgactgctggcagtgtgtgccctggtcagtctcgcaaccgccgcactgcttgtgaacccaggggtggtggtcagaatcagccaaaaagggctcgactacgcttcgcagcaaggcaccgcagcactgcagaaggagcttaaaaggataaagataccagactactccgattcgtttaagatcaagcacctgggcaaaggacattattctttttacagtatggatataagagaatttcagctcccttcatcacaaatctcgatggtgccaaacgtgggtcttaagtttagcatctcaaatgccaatatcaaaatctccggtaaatggaaagctcaaaagagattcttgaagatgtccgggaacttcgatctgagcattgaaggcatgtcgatttccgcggatctcaagctcggttcgaaccccacgagcggaaagcccaccatcactgcctcttcatgctcgtcgcatatcaacagtgtgcatgtccacatttcaaagtcgaaggtcggatggctgattcaattgtttcacaagaaaattgagtccgcactccgcaacaagatgaattcgcaagtgtgtgaaaaagtgacgaactccgtctccagcgagttgcagccttacttccaaaccctt

SEQ ID NO: 7685 - DNA, 660 bp, Artificial Sequence
  Description of Artificial Sequence: Synthetic coding sequence
atgggagtgcgccacccgccttgctcccacaggctgctcgccgtgtgcgcactggtatccctcgcaactgctgctctgttggtgaatccgggagtggtggtccgcattagccaaaaaggcctcgactatgcctcccaacaggggacggccgccctgcagaaagagctgaagcggatcaaaattccggactactcggattcgttcaagatcaagcacctgggtaaaggccattactcattttactcaatggacatccgcgaattccagctgccgtcctcgcagatatccatggtccccaatgtcggactgaagttctcaatctcgaacgcgaacatcaaaatctcaggtaaatggaaggctcagaagcggttccttaagatgtcaggaaacttcgacttgtccatcgaaggaatgagcattagtgccgatctgaagctggggtcgaacccaactagcggcaagcctaccatcactgcatccagctgctcaagccacatcaactcagtacatgtgcacatatcgaagagcaaggtcggatggctgatccaactctttcataagaaaatcgaatcggcgttgagaaataagatgaattcgcaggtgtgtgagaaggtgaccaacagcgttagcagtgagctccaaccatactttcagaccctc

SEQ ID NO: 7686 - DNA, 660 bp, Artificial Sequence
  Description of Artificial Sequence: Synthetic coding sequence
atgggtgtccgtcaccccccttgttcacataggcttctggcagtgtgcgcccttgtgtcgcttgcaaccgcagcactgctcgtcaaccccggtgtcgtggtgcgcatctcccagaagggcttggactatgcatcgcaacaaggaaccgcggctctgcagaaagaactgaagcgcattaagatccccgattactccgattcattcaagatcaaacatctcggtaagggacactacagcttttactccatggatattagggaattccagctcccttcgtctcaaatttctatggtgccaaacgtcggacttaagttttcgatttcgaacgcgaacattaagatttcggggaagtggaaggcacagaaacgatttctgaagatgtctggtaactttgacctctcaatcgagggaatgtcgattagcgcagatcttaaacttggcagcaatcctacttcaggtaagccaaccataaccgcgagctcctgttcctcacacattaactccgtccacgtacatattagcaagtcaaaagtgggctggctcatccagctgtttcacaagaaaatagaatccgcacttcgaaacaagatgaactcacaagtctgtgaaaaggtcacgaacagcgtgagctcggagcttcagccatacttccaaactctg

SEQ ID NO: 7687 - DNA, 660 bp, Artificial Sequence
  Description of Artificial Sequence: Synthetic coding sequence
atgggagtgagacacccgccctgttcccacagactgctggctgtttgcgctttggtgtccctcgccaccgctgcgttgctggtgaacccgggagtggtggtgagaatcagccagaaaggcctggactacgcctcacagcagggcacggccgcgctgcagaaggaactgaagagaatcaagatcccagactactcggactcttttaagatcaagcatctgggcaaaggccattattccttctactccatggatatccgagaatttcagctcccgtcctcccagatctccatggtcccgaacgtcggcctcaagttctcgatttcaaacgccaacatcaaaatctcaggaaagtggaaagcccagaagcgcttcctgaagatgtccggtaacttcgacctctccatcgaaggaatgtctatcagcgcagacctcaagttgggatcgaatccaactagcggaaaaccgactatcactgcatcctcatgctcctcccatatcaactccgtgcacgtccacatctccaagtcgaaggtgggatggcttattcagctgttccacaagaagattgaaagcgccctgcgcaataagatgaatagccaggtctgcgagaaagtgactaactcagtctcgagcgagcttcagccgtactttcaaacgctc

SEQ ID NO: 7688 - DNA, 660 bp, Artificial Sequence
  Description of Artificial Sequence: Synthetic coding sequence
atgggagtgaggcaccccccatgctcacaccgtctgttggctgtgtgtgcattagtgtccttagccacagctgctctgctggtgaaccctggcgtggtagtgagaatatcacagaagggcctcgattatgcgtcgcagcaaggtaccgccgctctccagaaagaactgaaacgcatcaaaatccccgattactccgatagttttaaaatcaaacatctgggcaaagggcactattccttctattcgatggacataagagagtttcagctcccctcatctcagattagtatggtgccaaatgtgggccttaagtttagcatctctaatgccaatatcaagatatctggcaaatggaaagcccagaaacggttcctcaaaatgtcaggaaatttcgacttgtctatcgaaggtatgtccatctctgctgacttgaagctgggctctaatcccacctctggaaaaccaacaattacggctagctcatgcagttcccacatcaattctgtgcacgtgcacatctctaagtcaaaagttggttggttgatacagctgttccataagaaaattgagtctgccctgcggaacaaaatgaactcacaggtctgcgaaaaggttaccaacagcgtcagctctgaactgcagccgtatttccagacactc

SEQ ID NO: 7689 - DNA, 660 bp, Artificial Sequence
  Description of Artificial Sequence: Synthetic coding sequence
atgggtgtgaggcaccctccttgctcgcatcggcttctggccgtgtgcgccctcgtgtcactggcaactgcagcacttctcgtcaacccaggagtcgtcgtgcggattagccaaaagggtctggattacgcatcgcaacagggtacggcagcgttgcagaaggaacttaagcggatcaagatacctgactacagcgattcattcaaaatcaaacatctcggtaagggacattacagcttttactcaatggatattagagagtttcagctcccatcctcgcagatatccatggtgcctaatgtgggccttaagttcagcatttccaacgccaacataaagatctcaggaaagtggaaggcacaaaagcggttcctgaaaatgagcggcaactttgatctttccatcgaagggatgtcgatttccgctgacctgaagctgggctcaaaccctacttcaggaaaacctactattacggcctcatcctgttccagccacattaactccgtgcatgtccatatatcgaagtctaaggtgggatggctgattcagctttttcataagaagattgagtcagcattgcgaaacaagatgaactcgcaggtgtgtgaaaaggtgaccaactccgtctcatccgaattgcagccatactttcaaactctg

SEQ ID NO: 7690 - DNA, 660 bp, Artificial Sequence
  Description of Artificial Sequence: Synthetic coding sequence
atgggagtccgccaccctccctgctctcatcgcctgcttgcagtgtgcgccctcgtctcactggccacagcagcccttttggttaaccctggcgtggttgttcgcatttcccaaaaggggctagattacgcgtcacaacagggaactgccgcgctccagaaggagctcaaacggatcaaaatcccagattactccgattctttcaaaataaagcacctgggcaaaggacattacagtttttactctatggacattagagaattccagcttccttcttctcagattagcatggtgcctaacgtgggattgaagttctccatatctaacgccaacatcaagatttctgggaagtggaaagcccaaaagcgctttctcaagatgtcaggaaacttcgacctgtccattgagggcatgtccattagtgcagacctgaaactggggagcaatcctacatcaggaaagcctaccatcacagctagtagctgttcatcacacataaactccgtgcacgtccacatctctaagtctaaagtgggttggctcatccagctgttccacaaaaaaatagaaagcgctctgcgaaacaaaatgaactctcaagtgtgcgagaaagtgactaacagtgtgtcaagcgagctgcagccctacttccagactctt

SEQ ID NO: 7691 - DNA, 660 bp, Artificial Sequence
  Description of Artificial Sequence: Synthetic coding sequence
atgggagtgcggcatcccccttgtagccatcggctgctggccgtctgtgccctggtatcgctcgctactgcagccctgcttgtcaatcccggcgtcgtcgtgagaataagccagaagggtttggattatgcgagtcagcagggcaccgccgctttgcagaaggagctgaaaaggataaagatccctgattacagcgattcctttaagattaaacatctcggcaagggccactactctttttacagcatggacatccgggagttccaactgcccagctcacaaatctctatggtacctaatgttggcttaaaatttagtatttccaacgccaatataaagatcagtggtaaatggaaagcccagaaacggtttctaaaaatgtcaggaaattttgatctgtccattgaaggcatgtcaatatctgctgatttgaaactgggttcaaaccccacaagcggaaagccaaccatcacggctagttcatgttcctctcacattaattccgtgcatgttcacatctccaagagcaaagttggatggcttatacagcttttccataagaagatcgagagcgccttacggaataaaatgaattctcaggtttgcgaaaaagtgacgaattctgtctcttctgagctgcagccttacttccagacacta

SEQ ID NO: 7692 - DNA, 660 bp, Artificial Sequence
  Description of Artificial Sequence: Synthetic coding sequence
atgggtgtgcgacatcctccatgcagccacaggctgctggcggtctgtgccctggtgtcgctggccaccgctgctctgcttgtaaacccaggcgtggttgttcgcatctcccaaaaaggtctcgactacgccagccagcagggtaccgcagcgctgcagaaggagctgaagcggatcaagatcccagattactccgacagttttaagatcaagcacttgggtaaaggacactacagcttctattcaatggatattagagaattccagctgccaagctcccaaatctcgatggtgcctaacgtggggctcaaattctccatttccaacgccaacatcaagatctctggtaaatggaaagcgcagaagcgcttcctaaagatgagcgggaatttcgatttgagcatcgaaggtatgagtataagcgcggatttgaagctgggcagcaacccgaccagcggtaaaccgacgattactgcttctagctgcagtagtcatatcaacagcgttcacgttcacatctctaagagtaaggtaggttggctgattcaattgttccacaagaagatcgagagcgccctgcgtaacaaaatgaacagccaagtttgtgagaaggtgaccaacagcgtgagttccgagttgcagccctactttcaaacccta

SEQ ID NO: 7693 - DNA, 660 bp, Artificial Sequence
  Description of Artificial Sequence: Synthetic coding sequence
atgggggtccggcaccccccatgcagccatcgcctgctggccgtctgtgcactggtcagcttggctacagctgccctcctggtcaatccgggagtggtggtgaggattagccagaaaggattggattacgcctcgcagcagggcaccgcggctcttcagaaagagttgaagagaatcaagattcctgattactcagattcctttaaaattaaacacctcggaaaaggacattactcgttttactccatggatattcgcgaatttcaattgccaagctcacagattagcatggtacccaacgtcgggcttaagttcagcatcagcaatgcaaacataaagatctccggcaagtggaaggcccagaagcgctttctaaaaatgagtggcaactttgacttaagtatcgaaggcatgagcattagtgccgatctgaaactgggcagtaatcccacctccggcaaacccaccattactgccagtagctgttcttctcacattaactccgtccatgtccacatctctaaatcaaaagtcggttggctcattcagcttttccataaaaagatcgagagcgcactgaggaacaaaatgaactcacaggtttgtgaaaaggtcacaaatagcgtgtccagtgaattgcagccctactttcagaccctg

SEQ ID NO: 7694 - DNA, 660 bp, Artificial Sequence
  Description of Artificial Sequence: Synthetic coding sequence
atgggtgtgcgccatccgccgtgttcgcatcggctgctcgctgtctgtgcgctcgtctcactggcaacggctgcgctcctggtcaaccccggcgttgtggtccggatctcgcaaaagggtctggattacgcctcgcagcagggtactgcagccctgcaaaaagagctgaagaggataaagatcccagattattccgatagcttcaagatcaagcacctggggaaagggcattactcgttctacagtatggacatccgcgaattccagcttccgtcgtcgcagatctccatggtgccaaacgtgggactcaagttctcaatctccaacgcaaacatcaagatctcgggcaagtggaaagcacagaagagattcttgaagatgtcgggaaacttcgacttgtcaattgaaggaatgtctatctcggccgacttgaagctgggcagcaacccaaccagcggaaagccaactatcacggcctcatcctgctcgagccacattaactccgtgcatgtgcacatctctaagtctaaggtgggatggctgatccagctgtttcataagaaaatcgaatcagcgttgcgcaataagatgaacagccaggtttgcgaaaaagtgactaacagcgtctcgtccgaattgcagccttatttccaaaccctg

SEQ ID NO: 7695 - DNA, 660 bp, Artificial Sequence
  Description of Artificial Sequence: Synthetic coding sequence
atgggggtgcgccacccaccctgctcccaccggcttctggcggtgtgcgccctggtgtcactcgcgaccgcggccttgctcgtgaatcccggagtggtggtgcgcatctcgcagaaaggcctggactacgccagccagcagggaaccgccgcgttgcagaaggaactgaagcggatcaagatccctgactacagcgactcgttcaagattaaacacctcggaaagggacactattcgttctactcgatggatatccgggagttccaactgccatcctcacagatctccatggtgccgaacgtcggtctgaaattctcaatctcgaacgcaaacatcaagatcagcggcaagtggaaagcacagaagcgcttcctcaagatgtcgggcaattttgacctttctatcgaaggaatgtcgatctcggcggaccttaagctgggatccaatcccacctcaggcaagcccactatcactgctagctcctgctcatcgcacattaactcagtccatgtccacatctccaagtcgaaggtgggatggctgattcagctgttccataagaagatcgagtcggccctgcggaacaagatgaactcccaagtctgtgaaaaagtgactaattcagtgagctccgaactgcagccgtacttccaaactctt

SEQ ID NO: 7696 - DNA, 660 bp, Artificial Sequence
  Description of Artificial Sequence: Synthetic coding sequence
atgggcgtccgccatccgccatgttcgcaccggctgctggcggtgtgcgccctcgtgtcactggcaaccgcggcactgctggtgaacccaggagtggtcgtcaggatctcgcagaagggtttggactacgccagccagcaaggcaccgccgcattgcaaaaggaacttaaacgcatcaagattcccgattactccgacagctttaagattaaacatctgggaaaggggcattactcgttttactcgatggatattcgggagtttcaacttccatcttcgcaaatttcaatggttcctaacgtgggcctgaagttttcgatcagcaacgcgaacattaagatctcgggaaaatggaaggcacagaagcgttttctgaaaatgtcagggaactttgacctgtcgatcgagggaatgtcgatttcggccgatcttaaactgggtagcaacccaacttcaggtaagcccactatcactgcctcttcatgttcctcccacattaacagcgtgcatgtgcatatttccaagagcaaggtgggttggctcattcaactgtttcataagaagatcgaatccgccctgcggaacaagatgaattcccaagtctgtgaaaaggtgactaacagtgtgtcctccgaactccaaccatacttccaaaccctt

SEQ ID NO: 7697 - DNA, 660 bp, Artificial Sequence
  Description of Artificial Sequence: Synthetic coding sequence
atgggtgtgaggcacccaccttgctctcaccggcttctcgcagtgtgtgcacttgtcagcctggcaacggctgccctgcttgtgaaccctggtgtcgtggtgagaatttcgcaaaagggcctggattatgcaagccaacagggaaccgctgcgcttcaaaaggagctgaaacggatcaagattcctgactattcagattcgttcaaaatcaaacacttgggcaaggggcattacagcttttactcgatggatatcagagagttccaacttccctcgtcgcagatttcgatggtccccaatgtggggctcaagttttctatttcaaatgccaacataaagatttcgggcaagtggaaagcacaaaagcgctttcttaagatgtccggtaacttcgacctgagcatagaaggcatgtcaatctcggccgatttgaagctgggatcaaaccccacttcgggtaaacctaccataaccgcaagcagctgttcgtcccatatcaatagcgtgcacgtgcatatctcaaaaagcaaggtcggctggctcattcaactttttcataagaaaattgaatccgccctccgaaacaagatgaactctcaagtctgcgaaaaggtgactaactcggtttccagcgaactgcagccatactttcaaactctt

SEQ ID NO: 7698 - DNA, 660 bp, Artificial Sequence
  Description of Artificial Sequence: Synthetic coding sequence
atgggcgttaggcatcccccgtgttcccatagactcctggccgtgtgcgctctggtcagccttgctactgccgctcttcttgtaaatcccggcgtggtggtcaggatctcacagaagggcctggactacgcgtcccaacagggcacagccgcgctccagaaggagctgaaaaggatcaagattcctgactatagcgactcattcaagattaaacaccttggcaaaggccattatagcttttattcgatggacatcagggagtttcagttgccctccagccaaatctccatggtgcctaatgttggactgaaattcagtatatctaatgctaacattaaaatcagtggaaagtggaaggcacagaaaagattcctgaagatgtccggaaacttcgatctgtccattgagggtatgagcatttccgcggacttgaagttaggatccaacccaaccagtggcaaaccgaccatcaccgcgtcttcctgcagcagccacatcaactcggttcacgttcacatctccaaatctaaggtcgggtggctgattcagttatttcataaaaaaatcgaaagtgctctaagaaataaaatgaactcccaggtgtgtgagaaagtaactaactcggtgagtagtgaactgcagccgtatttccagactctg

SEQ ID NO: 7699 - DNA, 660 bp, Artificial Sequence
  Description of Artificial Sequence: Synthetic coding sequence
atgggagtccgccacccaccttgtagccaccgcctgctggccgtgtgcgcccttgtcagcctggcaactgcggccctcctcgtgaatccgggtgtagtggtgcgcatttcccaaaagggcctggactacgcaagccaacagggaacggccgctctgcagaaggagctcaagcggatcaaaatcccagactattctgacagcttcaaaatcaagcacctcgggaaagggcattacagcttctatagcatggatatccgcgagttccagctgccgtcaagccagatcagcatggtgcccaacgtgggcctgaagttttccatctctaacgcgaacattaagatcagtggtaagtggaaagcgcaaaagcgctttctgaagatgtcaggaaacttcgatctctccatcgaaggtatgtcgatctccgctgacctgaagctcggatctaacccgacctcaggcaagcctacgatcaccgcctcgtcatgttcgtcgcatatcaacagcgtgcatgtccacatttccaagtcgaaggtgggttggctcatccagttgttccacaaaaagatcgaatccgcgctcagaaacaagatgaattcgcaggtttgcgagaaggtgactaattccgtttcgtcggaactccagccgtacttccagactttg

SEQ ID NO: 7700 - DNA, 660 bp, Artificial Sequence
  Description of Artificial Sequence: Synthetic coding sequence
atgggcgttcgccacccaccgtgttctcatcggctgctggcagtgtgcgcccttgtgtccctggcaaccgctgcccttttggtgaaccctggcgtggtggtccggatttcgcagaagggattggattacgcttcgcaacagggtaccgcagccctccagaaggaactgaagaggatcaagattcctgattactccgatagctttaagatcaagcatctgggaaaggggcactactctttttactcaatggacattagggaatttcaactcccaagctcacagatttccatggtgccgaacgtgggattgaaattcagcatatccaatgcgaatatcaagatttcgggtaagtggaaggcacagaagcgctttcttaagatgagcggtaactttgatctgagcattgaaggaatgagcatttcagctgacctcaagttgggttcaaatcctactagcggcaaacccacgattactgcatcctcctgttcctcacatatcaacagcgtccatgtgcacatctcaaagagcaaagtcggttggttgattcaacttttccacaagaaaatcgagtccgcattgagaaataagatgaactcccaagtctgtgagaaagtaactaactccgtgtcgtcagaacttcaaccttactttcagactctt

SEQ ID NO: 7701 - DNA, 660 bp, Artificial Sequence
  Description of Artificial Sequence: Synthetic coding sequence
atgggggtacggcaccccccatgtagtcatagactcctcgccgtctgtgctctagtttctcttgccactgctgccctcctagtgaatcctggagtcgttgtccggatatctcagaaaggacttgattatgcatcccagcaggggacagcagctctccagaaggaactaaaacggatcaaaatacccgattactctgattcattcaaaatcaaacatctgggaaaaggacactattctttttactctatggacattcgagaattccagctaccctcatcacagatctcaatggtcccaaacgttggattaaaatttagtatcagtaacgctaacataaaaataagtgggaaatggaaagcacagaaacggttcctcaaaatgtccgggaactttgatctctccatcgaagggatgtccatcagtgctgatctcaaactaggatccaatcctacttctggaaaacctacaataacagcttcttcctgcagttcacacataaattccgtccacgtgcacatcagtaaatcaaaggtagggtggctcattcagctgtttcacaaaaaaatagaatcagctcttcgaaacaaaatgaattcccaggtatgtgagaaagtcactaacagtgtgtcttctgagctacagccatatttccagacactg

SEQ ID NO: 7702 - DNA, 660 bp, Artificial Sequence
  Description of Artificial Sequence: Synthetic coding sequence
atgggtgtgcgacaccccccctgcagtcacagactcctggccgtgtgtgcacttgtgtccttagccacggcagcactactggtcaacccaggggtggtcgtgcggatctcccaaaaaggccttgattacgctagtcaacagggcactgctgctcttcagaaggagctgaaaagaataaaaatcccggattattccgactcattcaagatcaaacatcttggaaagggacactattctttttattcaatggacatacgggagtttcagctgccgagctcccagatttccatggtgcctaatgtcggcctcaagttcagtattagcaacgcaaacattaagatctctgggaagtggaaagctcaaaaacgcttcctgaagatgagcgggaattttgaccttagcattgagggtatgagtatctcagccgacttgaaactaggttccaatcccacttctggcaaacctacgatcacagcctcctcttgctcgtcccacattaattctgtgcacgtgcacatctctaagagcaaagtgggatggctgatccagttgttccataagaagatcgagtctgctctgagaaacaagatgaactcccaggtgtgcgagaaagtcacaaattccgtaagcagcgaactgcagccttatttccagaccctt

SEQ ID NO: 7703 - DNA, 660 bp, Artificial Sequence
  Description of Artificial Sequence: Synthetic coding sequence
atgggggtgcgacacccaccctgctcgcacaggcttctcgcagtgtgtgctttggtcagtctggccactgctgctctgttggttaatcccggggtggtggtcaggatatcccaaaaagggctcgattatgctagtcagcagggaactgccgcactgcagaaagaattaaaaagaataaagattccagattattctgattccttcaaaatcaaacatctcggaaaagggcactattccttttactcaatggacataagggaatttcagctcccctcatcacagatctcgatggtgcctaatgttggattaaaattttctatttcaaatgctaatataaaaataagtggaaaatggaaagctcagaaacggtttctcaaaatgtctgggaattttgatctatctatagaagggatgagtatatccgccgatcttaaactaggatctaaccctacttctggaaaacccacaatcactgcctcctcttgtagttcacatatcaacagtgtccacgtacacatatccaaatccaaagtaggatggttaatccagctctttcataaaaagatcgaatctgcccttcgaaataaaatgaactctcaggtgtgtgaaaaagtcacaaatagtgtgagttcagaactccaaccctattttcagactctg

SEQ ID NO: 7704 - DNA, 660 bp, Artificial Sequence
  Description of Artificial Sequence: Synthetic coding sequence
atgggagtgcgccacccgccttgctcgcacaggctgttggcagtatgtgctctggtgtcattggctactgctgccctgctggtgaatcccggagtcgtggtgcgaatttcgcaaaaggggcttgactacgccagtcagcagggaaccgcggcactccaaaaagagctgaagcggattaagatcccggactactcagattcgttcaaaatcaagcatttgggcaaaggccactactccttctactccatggatatcagagaattccagctcccaagctcgcagatttctatggttccgaacgtcggcctgaagttttcgatcagcaatgctaacatcaagatctcagggaagtggaaggcccagaagcgcttcctcaagatgtctggtaacttcgacctctcgatcgagggaatgtccattagcgccgatctcaagctgggatcaaatcctacgtccggtaaaccaactatcaccgcatcttcatgttcatcgcacatcaattccgtgcacgtgcatatctcgaagtccaaagttggttggctcattcagcttttccataagaagatcgagtccgcgttgcgtaacaagatgaactcccaagtctgtgaaaaggtgactaactctgtcagctccgaacttcagccgtactttcaaaccctg

SEQ ID NO: 7705 - DNA, 660 bp, Artificial Sequence
  Description of Artificial Sequence: Synthetic coding sequence
atgggagtgagacatcctccatgttcccatagacttcttgcagtgtgtgcactggtttcgttggcaaccgccgcactgcttgtgaacccgggtgtggtggtgaggatctcccagaaggggctcgattacgcgagccagcaaggtactgcagcgcttcaaaaggaacttaagcgcattaagattccggattacagcgattcctttaagatcaaacaccttggtaagggacattacagcttttactcgatggatataagagaatttcagctgccctcatcccaaatatcgatggtgcctaatgtcgggctgaagttttccatttcgaacgcaaacatcaagatttcggggaaatggaaggcacaaaagagatttctcaaaatgtccggaaatttcgatttgagcatcgagggaatgtcaatcagcgcagatctgaagttgggatccaatccaacttccgggaagcctactataaccgcatcatcgtgctcgtcccatatcaactcggtgcatgtgcatatctcgaagtccaaagtgggctggctgattcaactgtttcacaaaaagattgaaagcgcattgagaaacaagatgaactcgcaggtgtgtgagaaggtgacgaacagcgtctcgagcgaactgcaaccctactttcagaccctg

SEQ ID NO: 7706 - DNA, 660 bp, Artificial Sequence
  Description of Artificial Sequence: Synthetic coding sequence
atgggagtcagacaccccccttgttcacacaggctcctggcagtctgtgctctggtaagcctggccaccgccgccttactggtgaacccaggggttgtggtgagaatctcacagaaagggttggattatgcctcgcagcagggaaccgcagcacttcaaaaggagttgaaacgaattaaaattccagattacagcgactccttcaaaatcaagcaccttggtaagggacattattcattctattctatggacatccgagaatttcagttgccaagtagccagatctccatggtccccaatgttggacttaagttcagcattagcaatgcgaacatcaaaataagcgggaagtggaaggctcaaaagcgattcctcaaaatgagtggcaacttcgacctgtcgatcgagggtatgagcatatccgctgatctaaaattgggctctaatcccactagcggtaaacctactattaccgcaagttcctgctcatcccatatcaattcagtgcacgttcacatatcaaagtctaaagtcggctggctcattcagctgttccataagaagatagaaagcgcactgcgtaataagatgaattcgcaggtgtgcgagaaagtcacaaactcagtgtctagtgaattgcagccgtatttccaaacactg

SEQ ID NO: 7707 - DNA, 660 bp, Artificial Sequence
  Description of Artificial Sequence: Synthetic coding sequence
atgggagtgagacacccaccgtgtagtcaccgacttcttgctgtctgtgctttggtttcactggccacagcagctctgttagtcaatcctggagttgttgtaagaatttcacaaaaaggacttgactatgcatcccagcagggaacagctgcccttcaaaaggaattgaaacggattaaaattccagattactcagattcgtttaaaattaaacatcttgggaaaggacattatagtttttatagtatggatatccgagagtttcaattaccatcgagtcaaattagcatggttccaaatgttggattgaaattcagtatctcaaacgccaatatcaaaatctccgggaaatggaaagctcaaaaaagattcctcaaaatgtcgggaaacttcgatttgagtattgagggtatgtcaatttcagcagatctcaaattggggagtaatccaactagtggcaagccaactatcacggcgtcctcttgttcgtcccacattaatagtgttcatgttcatatttccaaaagcaaggtgggatggctcatccaactgttccataaaaaaattgaatcagccctgcgtaataaaatgaacagtcaggtatgcgagaaagttacgaattcggtctcttctgaattgcaaccctatttccagactctc

SEQ ID NO: 7708 - DNA, 660 bp, Artificial Sequence
  Description of Artificial Sequence: Synthetic coding sequence
atgggcgtgaggcaccctccatgctcccaccgactgctagctgtgtgcgccctagtttcgctggcaaccgctgccctgctggtgaatcccggtgtggtggttaggattagtcaaaaagggctagactacgcttctcagcaaggtactgcggccctgcagaaagagttgaaacggattaagatcccagactacagcgattcttttaagataaaacacttgggaaaaggccattactccttttactctatggatattagggagtttcagcttccctcgtcccagatcagcatggtgccaaacgtgggactcaagttttcgatcagtaacgccaacatcaagatcagtggcaaatggaaggctcagaaacggtttctgaaaatgtcggggaattttgatctcagtattgagggcatgagcattagcgctgacctcaagcttgggtctaatcccacaagtgggaaacccactatcacagcatctagctgcagttcccatatcaactccgtgcatgttcacatatccaagtctaaggtggggtggctgattcagttgttccacaaaaaaattgaatccgctctgcggaacaagatgaactcccaggtgtgcgagaaagttactaatagtgtgtcttccgagctgcaaccatattttcagactctg

SEQ ID NO: 7709 - DNA, 660 bp, Artificial Sequence
  Description of Artificial Sequence: Synthetic coding sequence
atgggcgttcggcacccgccttgcagccatcgcttgttggccgtgtgcgcactggtgtccctggctactgcagcactgctggtgaacccaggcgtcgttgtgcggatctcacagaagggactggactacgcttcccagcaggggactgcagcccttcagaaagaactgaaacgaataaagatacctgactattccgacagctttaagatcaagcacctgggaaagggacactactcgttctacagcatggatatccgcgagttccagttgccctcgtctcaaatcagcatggtgcccaatgtgggactgaagttctcgatttcaaacgccaacatcaaaatctccgggaagtggaaagctcaaaagcggttccttaagatgtcgggaaacttcgacctctcaatcgaaggcatgtcgatctccgcggatctgaaactcggatctaacccgacctcaggcaagccgactatcaccgcctcatcgtgttctagccacatcaatagtgtgcacgtccatatttctaaatcgaaggtgggctggcttatccagctgttccacaagaagattgagtcggccctgcgcaataagatgaatagccaagtgtgcgaaaaggtgacgaattccgtgtcctcggaactgcagccgtactttcagactctg

SEQ ID NO: 7710 - DNA, 660 bp, Artificial Sequence
  Description of Artificial Sequence: Synthetic coding sequence
atgggagttaggcaccctccgtgctcacaccgcctcctcgccgtgtgcgctctggtgtcactggcgaccgctgccctcctcgtgaacccgggcgtggtggtccgcatcagccagaagggactggactatgcctcacaacagggcactgcggccctgcagaaggaactgaaacggatcaaaatcccggactactcggacagcttcaagatcaaacacctgggaaagggacactactcgttctacagcatggatattagagagtttcaactcccgtcgagccaaatctccatggtcccgaacgtgggtctgaaattctctatctccaacgccaacatcaagatcagcggaaaatggaaggctcagaaacggttcctgaagatgtcaggcaatttcgacctgagcattgaaggaatgagcatttccgcggatctcaagctcggaagcaatccgacctccggcaagccgactattaccgcatcgagctgctcgtctcatatcaattcagtgcacgtgcatatctcgaagtcaaaagtcggttggctcatccaactcttccataagaagattgaatcagcgctgagaaacaagatgaacagccaagtctgcgaaaaggtcaccaactcggtttccagcgagctgcagccatacttccagaccctc

SEQ ID NO: 7711 - DNA, 660 bp, Artificial Sequence
  Description of Artificial Sequence: Synthetic coding sequence
atgggcgtgcgccaccccccctgcagccacagactcttagccgtttgcgccctcgtctcgctagcgacagccgccctcctggtcaaccccggagtggtcgtgcgcatttctcaaaagggcctcgattatgcgtcacagcaaggaacagccgcacttcagaaggaattgaagaggattaagatcccggattatagtgattccttcaagatcaagcacctgggcaagggccactacagtttttactcgatggacattcgcgagttccaactgccatcgagtcaaattagtatggtgccaaacgtcggactgaagttctccatcagcaatgcgaatataaagatctcgggcaaatggaaggctcagaagcgcttcctcaagatgtcgggcaactttgacctttcgatcgaagggatgagcatttcggctgacctgaagctaggttccaacccaacgagtggaaagccgacaatcaccgccagtagctgtagtagccacatcaatagcgttcacgtccatatatccaagtcaaaggtcggttggttaatccaactgtttcacaagaagattgagtcagccctccgcaacaagatgaactcgcaagtgtgtgagaaggtgaccaacagtgttagttctgagctgcaaccatactttcaaacgctg

SEQ ID NO: 7712 - DNA, 660 bp, Artificial Sequence
  Description of Artificial Sequence: Synthetic coding sequence
atgggagtgcgtcaccctccatgcagccatcggctgctggcagtgtgcgcgttggtgtcacttgcaacggcagcactgcttgtgaaccccggagtggtcgttaggatttcccagaagggccttgactacgcctcgcagcaaggtaccgcagcacttcaaaaggagctcaagcggattaagattcctgattacagtgactcttttaagattaaacaccttggaaaaggtcactactcgttttactccatggatatccgtgaatttcaacttccttcgtcccagatttccatggtgcctaacgtgggccttaagttttcgatatccaacgcgaacattaagatttcagggaagtggaaggctcagaagagatttcttaagatgagcggaaacttcgacctgtccatcgaaggcatgagtatttcggcagaccttaagctcgggtcaaatccaacttctggtaaaccaactattaccgcctcgtcctgttcatcgcatatcaactcggtccatgtccatatctccaaatcaaaagtcggctggctgatccaactctttcacaagaagatcgaatcagccctgagaaacaagatgaactcgcaagtgtgcgagaaggttactaattcagtgtcatcagaattgcagccatactttcaaaccctt

SEQ ID NO: 7713 - DNA, 660 bp, Artificial Sequence
  Description of Artificial Sequence: Synthetic coding sequence
atgggtgtgagacaccctccctgctcacatagacttcttgcagtctgtgcactcgtgtcgctcgccaccgccgcccttctggtcaatcccggtgtggtggtgcgcatcagccaaaagggacttgattacgcaagccagcagggcactgcagcacttcaaaaagaactgaagagaattaagattccggactattccgattcattcaagataaagcatctcggtaagggtcattattcattctactcaatggatatccgagaattccaacttccttcctcccaaatcagcatggtgccaaacgtcggcctgaagttcagcatcagcaacgcaaacatcaagatatctggtaagtggaaagctcaaaagcggttcctcaagatgagcggaaacttcgacctgagcatcgagggaatgtccatttcggcggatctgaaactgggatccaatccaacctcaggcaaacctaccataaccgcgtcctcgtgctcaagccacatcaattcggtgcacgttcatatctccaaatcaaaagtgggttggctgatccaactttttcataagaaaattgagtcggcgttgcgaaataagatgaactcccaggtctgcgagaaagtgactaactccgtgtcatcagaactccagccatacttccagactctg

SEQ ID NO: 7714 - DNA, 660 bp, Artificial Sequence
  Description of Artificial Sequence: Synthetic coding sequence
atgggagtgcgccacccgccatgcagccaccggctgttggctgtgtgcgccctggtgtccctggccactgccgcccttctggtgaacccaggagtcgtggtcagaatctcccaaaagggcctggattacgcttcacagcaaggcaccgcagccctgcagaaagagctgaaaagaataaagatcccggattacagcgactcgtttaagattaaacacttgggaaagggtcattattccttctactccatggacattcgcgaatttcagcttccctcgagccaaatctctatggtgcctaacgtgggtcttaagttctcgatctccaacgcgaacatcaagatttcgggcaagtggaaggcccaaaaacgcttcctcaagatgtcgggaaacttcgatctctcgatcgaaggaatgtcgatctctgcagacctgaagctggggtccaacccgacttcggggaagccgacgattaccgcgagctcctgttcttctcatatcaattcagtacatgtccacatctcaaagtctaaggtcggatggctcatccaactcttccacaagaaaatcgagtcggcgctgcgcaacaaaatgaattcacaggtttgcgagaaggtgaccaattcggtgtcctccgaactccagccctacttccagactctg

SEQ ID NO: 7715 - DNA, 660 bp, Artificial Sequence
  Description of Artificial Sequence: Synthetic coding sequence
atgggagtgaggcatccgccttgttcgcatcggcttctcgcggtctgcgcgctcgtctccctggctaccgccgctctgctggttaaccccggcgtggtggtcagaatttctcagaagggcctggattacgcgtcccaacaaggcacggccgctctccagaaggaactcaaacggatcaagatcccagactactcagattcctttaagatcaagcacctgggcaagggtcactactcattttacagcatggatatccgcgagttccagttgccttcatcgcaaatctcaatggtcccgaatgtcggcctgaaattctcgatcagcaacgcaaatatcaagatctcagggaaatggaaggcccagaagcgctttctcaaaatgtcaggcaatttcgacctgtccatcgaggggatgtccatctcagcggacctgaaactcggatccaacccaacctcaggcaaaccgaccatcactgcttcctcgtgcagcagccacataaactctgtgcatgtccatatttcgaagtcgaaggtggggtggttgatccagctgttccacaagaagattgagtctgcccttcgcaacaagatgaactcccaagtgtgcgaaaaggtgactaattctgtgagcagcgaactgcagccctatttccaaactttg

SEQ ID NO: 7716 - DNA, 660 bp, Artificial Sequence
  Description of Artificial Sequence: Synthetic coding sequence
atgggagttcggcaccccccctgtagccacaggctgctggccgtgtgtgcccttgtgtctttagccaccgccgcgctgctcgtgaaccctggcgtggtggtgcgcataagccagaagggactagattacgcatctcagcaagggactgctgccctgcagaaggagctcaagcgtatcaagatccctgactatagcgacagttttaagattaaacatctagggaaaggtcactactcattctactctatggatattcgtgaatttcagctgccttcttctcaaatctctatggttccaaacgtggggttgaagtttagcatctcaaacgcgaacattaagatatcaggaaagtggaaagcccagaagcgatttctgaagatgtcagggaactttgatctgagtatcgagggcatgagtatttcagcggacctgaaattgggcagcaaccctacctcaggaaagccaaccatcacggcgagttcgtgtagtagccacatcaattcggtacacgtccacataagtaaatccaaggtcggttggttgattcagttgttccataaaaaaatagagagtgcactgaggaacaagatgaatagccaagtctgtgaaaaagtcactaatagtgtgtcttccgagctgcaaccctacttccagacactc

SEQ ID NO: 7717 - DNA, 660 bp, Artificial Sequence
  Description of Artificial Sequence: Synthetic coding sequence
atgggagtcagacatccaccatgttcccacagattgcttgcggtgtgtgccctggtgtcacttgctaccgccgcacttctcgtaaatcctggtgtggtcgtgcgtataagccagaaaggcttggactacgcatcacaacaggggacggcagctctgcaaaaagagctgaagaggataaagattcccgattacagcgactcctttaagatcaaacatcttggtaagggacattattccttctacagcatggacatccgggaatttcaactcccctcgtcgcaaatttccatggtgccgaacgtgggactgaagttctcgatttccaacgctaacatcaagatttccggtaaatggaaggcacaaaaacgcttccttaagatgtccgggaattttgacctgagcattgagggaatgtcgatttcggccgacctcaaacttgggagcaaccctacctccggtaagccgaccattaccgcgtcgtcatgctcttcacatatcaacagcgtgcatgtgcacatttcgaagtcgaaggtcgggtggcttatccagttgtttcacaaaaagattgaatctgcactgcggaacaaaatgaattcgcaggtctgtgaaaaggtgactaattctgtttcttcggaacttcaaccttacttccagacgctt

SEQ ID NO: 7718 - DNA, 660 bp, Artificial Sequence
  Description of Artificial Sequence: Synthetic coding sequence
atgggagtcagacatcctccatgctcacatcgactgcttgcagtctgcgccttggtgtcccttgcaaccgcagccctgttggtgaaccccggagtggtggtccgaatatcgcaaaaagggctggattacgcgtcgcaacagggtaccgccgcgcttcagaaagagcttaagaggatcaaaatccctgattactcggattcgtttaagataaaacacctgggcaaaggtcattactcgttctactctatggacattagggaattccaactgccctcgagccaaatctcgatggtgcctaacgtgggacttaagttttccatctctaatgcaaacattaagatttcgggaaagtggaaggcacagaaacggtttctgaagatgtcaggcaattttgatctctcgattgaagggatgtccatatcagcagacctcaagctgggctccaacccaactagcggaaagccaactattacggcaagctcgtgtagctcacatatcaactcggtccatgtgcacataagcaagagcaaggtgggttggttgatccagctgtttcacaagaaaatcgaaagcgcgcttaggaacaagatgaattctcaagtttgtgagaaagttactaattcagtgagcagcgaactgcagccttatttccaaaccctc

SEQ ID NO: 7719 - DNA, 660 bp, Artificial Sequence
  Description of Artificial Sequence: Synthetic coding sequence
atgggagtgaggcatcctccctgctcccataggctcctggcagtctgcgcgctggtgagcctggcaactgcagcactccttgtgaaccctggtgtcgtcgtgcggatttcacagaagggtctggattacgcatcacaacagggtaccgccgcacttcaaaaagaactgaagagaatcaagattcctgattactccgattcgttcaagattaagcatcttggtaagggacactatagcttctactcaatggatatcagggaatttcaactcccctcgtcccaaatctcgatggtgccgaacgtgggtctgaagttctctatctcgaatgcaaacatcaagatatctggtaagtggaaggcgcagaagcgctttcttaagatgtcgggaaactttgaccttagcattgaaggaatgtccatctcggcagacctcaaattgggatcgaatccaacctccggaaaaccgaccatcacggcctccagctgtagctcacacattaactctgtccatgtgcatatctccaagtcaaaagtgggttggctcatccagctctttcataagaagatcgaatcggcacttagaaacaaaatgaacagccaagtgtgcgagaaagtcactaattccgtgtcgagcgaactgcaaccctactttcagactctg

SEQ ID NO: 7720 - DNA, 660 bp, Artificial Sequence
  Description of Artificial Sequence: Synthetic coding sequence
atgggagtgaggcatccaccttgtagtcatagactgctggctgtttgcgctctcgttagtttggcaactgctgctctcctggtgaaccctggagttgtggttcggatttctcagaaggggttggactacgcttcacagcaggggaccgccgcactgcagaaggagctgaaaaggatcaaaatccccgactattccgactccttcaaaataaaacacctcgggaagggacactattcattttactccatggacatcagggagttccaactgccaagtagccaaatcagtatggtcccaaatgtcgggctgaagttttccatctctaatgccaatatcaagatcagcggaaagtggaaggcccagaaacggtttctcaaaatgtctggaaactttgacttgtcaatcgaaggaatgtcaatcagcgctgatctcaaattggggtcaaatccgacctccggaaagccaacgatcacagcatcttcctgctctagtcacataaactctgttcacgtacacataagcaaatctaaagtcggctggcttattcagctgttccacaaaaagatcgaaagcgccctccgaaacaagatgaactctcaggtctgcgagaaggtgaccaattccgtttctagcgagttgcagccctactttcaaaccttg

SEQ ID NO: 7721 - DNA, 660 bp, Artificial Sequence
  Description of Artificial Sequence: Synthetic coding sequence
atgggagtgcgccaccctccctgcagccacagactactggcagtttgtgcactggtgtctctggctactgcagcgcttcttgtaaaccccggtgtcgtggtacggatctcccagaagggcctcgactacgcttctcagcaggggaccgcagcgttacaaaaagagctcaaaagaattaaaatcccggactattcagattccttcaagattaaacatctggggaaggggcactatagcttctattccatggatatacgcgaatttcagttgccctccagtcaaatcagtatggtgcctaatgtcgggctgaagttcagcatatcgaatgcaaatatcaaaatatctggcaagtggaaggctcaaaaaagattcctaaagatgtccggaaactttgatttgtctatagaagggatgtcaatatcagcggatctgaaactcggctcaaaccccacatctggtaagcctaccatcactgcgagctcatgttccagccacatcaattcagtacatgtccatatctccaagagcaaagtcggttggttaattcagttgtttcacaagaaaattgagtcagctttgcgcaataaaatgaacagtcaggtgtgtgagaaggtcacaaactcagtgtccagtgaactccagccttacttccagacactc

SEQ ID NO: 7722 - DNA, 660 bp, Artificial Sequence
  Description of Artificial Sequence: Synthetic coding sequence
atgggcgtccgccaccccccctgtagccatcggctgctggcggtgtgcgccctggtgtccctcgctaccgcggccttgctggttaatcctggagtggttgtaaggatctctcagaagggactggactatgcgtcacagcaaggcacagcagccctgcagaaggaactgaagaggattaagatccccgactacagtgattcctttaagataaaacacttgggcaagggacactattccttttacagcatggatattcgggaatttcagctgccttcctctcagattagcatggtgcccaacgtggggctaaagttttctatcagtaatgcaaatatcaaaataagcggaaaatggaaggcccagaagcggttcttgaagatgtccgggaattttgatctcagtattgagggaatgagcatttccgccgacctgaagctgggcagtaatcccacatcaggcaagcctaccataacggctagtagctgttcctctcacataaatagtgtccacgtgcacatatctaagagcaaggtcgggtggttgattcagctgtttcataagaagatcgagtcggctcttcgtaacaagatgaactcacaggtgtgtgaaaaagtcactaatagcgtgagctccgaactacagccctacttccagacgtta

SEQ ID NO: 7723 - DNA, 660 bp, Artificial Sequence
  Description of Artificial Sequence: Synthetic coding sequence
atgggtgttcgccaccctccttgcagtcacaggctcctggctgtgtgcgccctcgtgagcttggctactgctgccttgttggtcaaccccggagtggtggttaggatttcccaaaagggactggactacgcctcccaacagggaaccgcagctcttcaaaaggaactgaagcgcatcaaaattcccgactatagcgattccttcaagattaaacacctggggaagggccactattctttctattctatggatatccgagagttccaactgccttcctctcagatttcaatggttcctaatgtcggacttaaattttccatcagcaatgccaacatcaaaattagcggtaagtggaaggcccaaaagagatttctcaagatgagcggtaactttgacctctctattgaaggcatgtcaatctccgccgatttgaagctcggatctaatcctacctctgggaaacctacaattactgcaagcagttgctcctcccacataaacagtgttcacgtgcacataagtaagagtaaggtaggatggttgatccagctgttccataaaaaaatcgaaagtgccctgcgaaataagatgaactcccaggtgtgtgagaaagtgaccaacagcgtcagctccgaactccagccttacttccaaaccctt

SEQ ID NO: 7724 - DNA, 660 bp, Artificial Sequence
  Description of Artificial Sequence: Synthetic coding sequence
atgggggtgcgccatccaccctgtagccaccggctgctagccgtttgcgcacttgtaagtttggcaactgctgcactcttagtgaacccaggggtggtggtaagaatatcccagaaaggactggactacgcgagtcagcagggaacggccgcgttgcaaaaagaattgaagagaatcaagattcctgattactccgacagcttcaaaattaaacatctgggaaaaggtcactactccttttattccatggatatcagggaatttcagcttccgtctagtcagatctccatggtcccaaatgtgggacttaagttcagtatctctaacgccaacatcaagatctctggcaaatggaaggcccagaagcgcttcctaaaaatgagcggaaacttcgacctgagtatagaaggcatgagcatatcagctgacctgaagctgggatcgaatccaacctctggcaagcccaccataaccgccagtagctgctctagtcacattaattcggtgcatgtgcacattagcaagtccaaggtggggtggcttatacagctgttccacaaaaaaatcgaaagtgccctgagaaataagatgaatagccaggtgtgcgagaaggtgaccaattccgtttcttcagagctgcagccttatttccagacattg

SEQ ID NO: 7725 - DNA, 660 bp, Artificial Sequence
  Description of Artificial Sequence: Synthetic coding sequence
atgggggtgcggcatcctccgtgctcgcatcggctcctggcagtgtgtgccctggtgtcactggcgacggcggccctcctggtgaacccgggagttgtagtgcgcatctcccagaagggcctggattacgctagccaacaggggaccgccgcgctccagaaggaactcaaacggattaagattccagattacagcgatagtttcaagattaagcatctgggaaagggccactattcattctactctatggacatcagagaatttcaactcccgagttcacagatctcgatggtgccaaatgtcggtctgaagttttcaatcagcaacgcgaacattaagatcagcggaaagtggaaggcgcagaagcgattcttgaagatgagcggaaacttcgacctgtcaatcgagggtatgtccatctccgccgatctcaagctcggatcgaatccaactagtggcaaaccgactatcaccgcttcgtcatgctcctcgcacatcaactcggtgcacgtccatatttcgaagtccaaggtcggatggttgatccagctgtttcacaagaaaatcgagtcggcactccgcaacaaaatgaattctcaagtgtgtgaaaaggtcaccaattccgtgagctcggagctccaaccgtacttccaaaccttg

SEQ ID NO: 7726 - DNA, 660 bp, Artificial Sequence
  Description of Artificial Sequence: Synthetic coding sequence
atgggagtcaggcaccctccctgttcccaccgcttgcttgcagtgtgtgctctggtgagcctcgcaaccgcagcccttctcgtgaaccccggcgtcgttgtaaggatcagtcagaagggattagattacgcatctcagcaaggcactgccgcccttcagaaggagctgaagaggattaagatcccggactactctgatagctttaaaattaaacacctgggtaagggtcattactcattttactctatggacatccgggaatttcagctcccgagttcacaaatttccatggtgcctaacgtaggattgaagttttctattagcaatgcgaacatcaaaatttcgggcaagtggaaagcccagaagcgctttctgaagatgtccggcaactttgatctcagtatcgaagggatgtcaatttcagctgatctaaaattagggagcaacccgacaagcggcaagccgaccattacagcaagcagttgcagtagtcacatcaattccgtccacgttcacataagtaaatccaaagtgggctggttgatccagttgttccacaagaagatagagagtgctcttagaaataagatgaacagccaggtctgcgagaaagtgacaaattccgtgagctccgagctgcaaccttacttccagactctg

SEQ ID NO: 7727 - DNA, 660 bp, Artificial Sequence
  Description of Artificial Sequence: Synthetic coding sequence
atgggcgtgcgccaccccccctgctctcaccggcttcttgcggtgtgtgccttagtcagcctagccacagcagcactgctggtgaaccctggggtggtagtgcggatctcacagaaagggctagactacgcaagccagcaggggaccgccgctttacagaaggagctcaagagaattaaaatccccgactattcagactcctttaagataaaacatctgggaaaagggcattactctttttattccatggacattcgtgaattccagctgcccagttcccagatctcaatggtgcccaacgtgggactgaagttcagcatctctaacgccaatatcaagataagtggcaagtggaaagcccagaaaagattcctgaagatgagcggtaatttcgatctttccatcgaggggatgtcaatcagcgcggatttgaaactcgggtctaaccccactagtggcaagcctacgatcacggcgtctagttgtagttcccatattaatagcgttcatgtgcatatctccaagtccaaagtgggctggttgatccaactcttccataaaaagatcgagtccgcactcaggaataaaatgaatagccaggtctgcgagaaggtaacgaactcagtgtcttcggaactgcagccctactttcagacactc

SEQ ID NO: 7728 - DNA, 660 bp, Artificial Sequence
  Description of Artificial Sequence: Synthetic coding sequence
atgggtgtcagacatccaccgtgtagccacagacttctggctgtgtgcgcactcgtgtcactggcgacggctgctctgctcgtgaaccctggagttgttgtgcgcatcagccaaaagggacttgattacgcaagtcagcaaggcaccgcagcgctccagaaggagctgaagcggataaagatcccagactattctgactcattcaagattaagcacctaggaaaaggtcactatagtttctactccatggacatccgggaatttcagctgccttcctcccagatctcaatggtaccaaacgttggattgaagttctcgatcagcaacgccaacataaaaataagcggaaaatggaaagcacagaagagattcctgaaaatgtccggcaatttcgacctcagcatcgaaggaatgagtatctctgcggatttgaagcttggaagcaaccctactagtggaaaacctactatcacggcaagtagctgttcaagccatatcaattccgtccacgttcacatttcaaaaagcaaggtaggatggttgatccagcttttccacaaaaaaattgagtctgcattgagaaacaaaatgaacagccaagtttgcgagaaggtgaccaactctgtcagcagtgagctgcagccatacttccagacattg

SEQ ID NO: 7729 - DNA, 660 bp, Artificial Sequence
  Description of Artificial Sequence: Synthetic coding sequence
atgggtgtgagacaccctccctgctcacaccgcctgctggcagtgtgtgcgttggtgtccctggcaactgcagcactcctggtaaaccccggcgtagtcgtgcggatttcacaaaagggacttgattacgcatcccagcaaggtaccgccgcccttcagaaggaacttaagcggataaagataccagattatagcgactcatttaagattaaacatcttgggaaaggacattactcattttactcaatggacataagggaattccagcttccgtcgtcgcaaatttcgatggtgccaaacgtgggactcaagttttctatttcgaacgctaatatcaaaatctcgggtaagtggaaggctcaaaaaagatttctcaagatgtcgggtaactttgatttgtcaattgaggggatgagtatctcggcggatttgaaactcgggtcaaatccaactagcggcaagcctactatcaccgcatcttcctgttcatcccacatcaactcggtccatgttcatatatcgaagtccaaagtcggatggctcattcaacttttccacaagaagatcgaaagtgcactcaggaataagatgaacagccaggtctgcgaaaaggtgacgaacagcgtctcgagcgagcttcagccttacttccaaaccctt

SEQ ID NO: 7730 - DNA, 660 bp, Artificial Sequence
  Description of Artificial Sequence: Synthetic coding sequence
atgggtgtcagacacccgccatgctcacacaggttacttgctgtctgtgcactcgtttcgttggcaacagccgctttattagtgaaccctggtgtcgtggtcaggatttctcaaaaaggcctggattatgcttctcagcaaggaactgctgccttgcaaaaggaacttaagagaatcaagatcccggattactctgattctttcaaaatcaaacacctaggtaaaggtcattactctttctactccatggatatcagagaatttcagcttcccagttcccaaatttcaatggttccaaatgtgggccttaaattctccatttcaaatgctaatattaaaatcagtggcaaatggaaggcacaaaagagattcctcaagatgtcaggtaacttcgacctttcaatagagggcatgagcattagcgcagatttgaaattaggtagtaaccctacctccgggaagccaactatcacagcttcctcgtgctcttctcatataaactctgttcacgttcatatatctaagagcaaggttggttggctcatccaattattccataaaaaaattgagtcagctctcaggaacaagatgaactcacaagtgtgtgaaaaagttacgaatagcgtgtcatcagaacttcaaccatattttcagactctt

SEQ ID NO: 7731 - DNA, 660 bp, Artificial Sequence
  Description of Artificial Sequence: Synthetic coding sequence
atgggagtgcgtcaccccccttgtagccaccgattgctggctgtctgcgccctggtttcgcttgctacagcagcgttgctggtgaaccctggcgtggtggtgaggatcagccaaaagggtttggattacgcgtcgcagcaaggtactgcggctctacagaaggagctcaagcgtatcaagatccccgactactccgactcgttcaagatcaagcatctggggaagggtcactacagtttttactccatggacatccgtgagttccagctgcccagcagtcaaatctcgatggtcccgaacgtcggccttaagttttccatttctaacgccaacattaagatttccggtaagtggaaggcccagaagcggttcctgaagatgtccggtaacttcgatctgagtatcgagggtatgtctatctcggcagacctcaagctcggttccaaccccacttccggcaagcctacaatcaccgccagctcatgcagctcgcatatcaacagcgtccacgtccatatctccaagtctaaagtcgggtggctcattcaactgttccacaagaagatcgagtccgccctgcggaacaagatgaacagccaagtgtgtgagaaggttactaactccgtcagcagcgagctgcagccctacttccaaaccctc

SEQ ID NO: 7732 - DNA, 660 bp, Artificial Sequence
  Description of Artificial Sequence: Synthetic coding sequence
atgggcgtacggcatcctccatgctctcatagactcctagctgtctgtgcgttggtgagcctagccaccgctgcccttttggtaaatcctggcgttgtagtgaggattagccagaagggcctcgattatgccagtcagcagggtaccgccgcactgcagaaagagctgaagagaattaaaattcccgactacagcgattcttttaaaatcaaacacctgggcaagggtcactactctttctatagcatggacattcgggagtttcaactcccctcctcccagatttccatggtacccaatgtgggtctgaagttttccattagtaatgccaacataaaaatatctggcaagtggaaggctcagaaacgcttcctgaaaatgtccggaaactttgacttgtctattgaaggcatgtcaatcagcgccgatctgaaacttgggtctaacccaacatcaggcaaacccacgatcacagcctctagttgctccagtcacataaactccgtgcatgtccatatcagcaagagcaaagtcggatggctcatacagttgttccacaaaaaaattgagtccgctctgcgtaataaaatgaacagtcaggtttgcgagaaagtgaccaattccgtgagctctgaactgcagccttactttcaaactctg

SEQ ID NO: 7733 - DNA, 660 bp, Artificial Sequence
  Description of Artificial Sequence: Synthetic coding sequence
atgggcgtccgccatcccccgtgctcacatcgcctcctcgccgtctgtgctctcgtttcgcttgcaaccgccgcactcctcgttaatccaggagtggtcgtgagaatctcacagaagggcctggattacgcgtcgcagcaaggcactgccgcgctgcagaaggaactgaagagaatcaagatcccggattactccgacagctttaagatcaagcatctggggaagggacattatagcttctactctatggatatccgcgaattccaactgccgtccagccagatctcaatggtgccaaacgtgggactgaagttttccatatccaacgcgaacattaagatctcggggaagtggaaagcacagaaacggtttctgaagatgagcggaaacttcgacttgtccatcgagggaatgtcgatcagcgccgacctgaagttgggaagcaatccaaccagcggtaagccaacgatcaccgcgagctcgtgctcgagccatatcaattcggtccacgtccacatttcgaagtcaaaggtgggatggctgattcaactcttccacaagaagatcgagtcggccctgcgcaacaagatgaattcgcaagtttgcgaaaaggtgaccaattcggtgtcctccgaactccagccttactttcaaactctg

SEQ ID NO: 7734 - DNA, 660 bp, Artificial Sequence
  Description of Artificial Sequence: Synthetic coding sequence
atgggagtaagacacccaccatgtagtcatagattattagcagtttgtgcattagtttctttagctactgcagcattattagttaatccaggagtagttgtaagaatctcacaaaaaggtcttgactatgcatctcaacaaggtacagcagcacttcaaaaagaattgaaacgtattaaaattccagattatagtgattctttcaagattaaacatttaggaaaaggacattatagtttttatagtatggatattcgtgaattccaattaccttcatcacagatttcaatggttcctaatgttgggttaaaattctcaatttcaaacgcaaatattaagatttctggtaaatggaaggcacaaaaaagatttttaaaaatgagtggaaattttgatttaagtattgaaggtatgtctatctcagcagatttaaagttgggaagtaatccaacttcagggaaacctacaattacagcaagttcatgtagtagtcatattaatagtgttcatgtacatatatctaaatcaaaagttgggtggttaattcaattatttcataagaaaattgaaagtgcattgagaaataaaatgaattcacaagtttgtgagaaagttactaatagtgtaagttcagaattacaaccatattttcaaacttta

SEQ ID NO: 7735 - DNA, 660 bp, Artificial Sequence
  Description of Artificial Sequence: Synthetic coding sequence
atgggtgtgcgccatccaccctgtagccatcgactcctggctgtttgcgcactcgtgtccctggcaactgcagcgctcttggtcaatcccggagtcgtggtgaggatctcacagaaagggctggactacgcatcgcaacagggcaccgccgccctccagaaggaactgaagagaatcaaaataccagattatagcgattcgttcaagattaagcatctcggaaagggacattacagcttctacagcatggatatccgtgagttccaacttcccagctcgcaaataagcatggtcccaaacgttggactgaaattctctatttcaaatgcaaacattaagatcagcggaaagtggaaggctcaaaagcgctttctgaaaatgtccggtaacttcgatctgtccatcgaaggaatgtccatttcagctgatctgaagctgggctcgaacccaacgtccggaaagcctaccattactgcatcgtcgtgctcctcccatatcaactccgtgcatgtccatatctcgaagagcaaggtgggttggctgattcaactgttccataagaaaatagaatcggcgcttcgcaacaaaatgaattcccaggtctgtgaaaaagtgactaactcggtatcctccgagcttcaaccttactttcaaaccctt

SEQ ID NO: 7736 - DNA, 660 bp, Artificial Sequence
  Description of Artificial Sequence: Synthetic coding sequence
atgggagtgagacaccccccatgttcccaccggctccttgctgtttgtgcacttgtgagcctcgctactgcagcacttcttgtgaaccctggagttgtggtgagaatttcgcagaagggcttggattacgcctcacagcagggcacagcagctttacagaaagagctgaaacgcatcaagattccggattattctgacagtttcaagatcaagcacctggggaaagggcattattccttttattccatggacatccgcgagttccagctgccatctagccagatcagcatggtgcctaacgtgggcctgaagttttcaatttctaatgcaaacatcaagatctcgggaaaatggaaggcgcagaagcggtttctgaagatgtccggaaactttgacctttctattgaaggaatgagcatttccgccgacctgaaattgggaagcaatcccacatcaggcaagccaactattacggcctcatcgtgttccagtcacattaactccgtccacgtacacatctccaaatctaaggtcggatggttgattcagctcttccataaaaagattgaatcggccttgcggaataagatgaatagccaggtgtgtgagaaggtaacaaactccgtgagtagtgagctgcagccttactttcagactctg

SEQ ID NO: 7737 - DNA, 660 bp, Artificial Sequence
  Description of Artificial Sequence: Synthetic coding sequence
atgggagtgagacatcctccctgctcgcatagactgctggcagtgtgcgcccttgtgtccctggccactgccgccctgctggtgaaccccggggtggttgtgagaatctcacagaagggcctcgattacgcgtcccagcagggaaccgccgccctccagaaggagctgaaacggattaagatcccggactactcagactcgtttaagattaagcacttgggtaaaggacattactccttttactctatggacatccgggagttccagcttccatcgtcacagatcagcatggtgccgaatgtgggcttgaaattcagtatctcgaacgccaacatcaagatcagcgggaagtggaaagcacagaagcgttttctgaaaatgtcaggaaacttcgacctgtccatcgagggcatgtccatctcggcggatctcaagctgggctccaacccgacttcgggtaagccgaccatcactgcttcgtcgtgctcatcccacatcaattccgtgcacgtccacatttcaaaatctaaggttggatggcttatacaactgttccacaagaaaattgagtcagccctgcggaataagatgaatagccaggtgtgtgaaaaagtgactaattcagtctcctcagaactgcaaccatacttccaaacgctg

SEQ ID NO: 7738 - DNA, 660 bp, Artificial Sequence
  Description of Artificial Sequence: Synthetic coding sequence
atgggcgtgcgccacccgccatgcagccatcgcttgctggctgtgtgtgcgctggtgtcactggccactgccgccctgttggtgaatcctggagtggtggtgcgcatatcgcagaagggcctcgattacgcgagccagcagggcaccgcagctttgcaaaaggaactgaagagaatcaaaattccggactattccgattcattcaaaatcaaacatctggggaaaggccattactccttttactccatggatatcagagaattccaactcccgagctcacagatcagcatggtcccaaacgtcggcctgaagtttagcatttcgaatgcgaacatcaagatctcaggaaaatggaaagcgcaaaagcgcttcctcaaaatgtcgggtaacttcgacctttctattgaaggtatgtcaatctcggcggatctgaagctggggtctaatccgactagcggaaagcctacgatcaccgcgtcgtcctgcagctcccacattaacagtgtccatgtgcacatcagcaagtccaaagtgggatggcttatccaactcttccacaagaagatcgagtccgctctgaggaacaagatgaattcccaagtgtgtgaaaaggtcactaattccgtgtcatccgaactgcaaccgtactttcaaacgctc

SEQ ID NO: 7739 - DNA, 660 bp, Artificial Sequence
  Description of Artificial Sequence: Synthetic coding sequence
atgggcgtgcgccacccaccatgcagtcatagactgctcgcagtgtgtgcactggtatctcttgcgactgccgcactgctcgtcaaccccggcgtagttgtgagaattagccaaaagggactagactacgccagccagcagggaacagcagcgctccagaaggaattgaaaagaatcaagattcctgattattcagacagtttcaagattaaacacctgggcaaggggcactattctttttactctatggatatccgagaattccagctcccctcctcccaaatctccatggtacctaacgtcggtttgaagttctcaatcagcaacgccaacattaagatttccggaaaatggaaggcacagaaacgatttttaaaaatgtccggcaactttgacctgtctatcgagggtatgtcaatcagtgcagatctgaagctgggatcaaaccccacaagcggtaaaccaaccatcactgcatcctcatgtagctcccatattaactcagtgcacgtgcatatttctaagtctaaagtgggttggctgatacaactcttccacaagaaaatcgagtccgcacttagaaacaagatgaactctcaggtgtgtgagaaggtgacaaactccgtttcctccgagctccagccctatttccagactctt

SEQ ID NO: 7740 - DNA, 660 bp, Artificial Sequence
  Description of Artificial Sequence: Synthetic coding sequence
atgggagtacgccacccaccgtgcagtcaccggcttctggcggtgtgcgctctggttagcctagcgactgccgctctcctcgttaacccaggtgtggtcgtccgcatttctcaaaagggactggattacgctagccagcaaggaacggctgcattacaaaaggaactgaagcggatcaagattcccgattacagtgatagtttcaaaattaagcacttaggtaaaggacattatagtttttatagtatggacatccgcgagttccagctgccttcaagccaaatttccatggtgcctaacgtgggcctcaagttcagcatatcgaacgctaacatcaaaatcagtggcaagtggaaagcccaaaaacgtttcctgaagatgtccggtaatttcgatttaagtattgagggcatgtcaatttcagcagatcttaagttaggttccaatccaacaagcggcaaaccaactattacagcgagctcgtgtagctctcatataaactcagttcacgtgcacatatctaaaagcaaggttggttggctgatccagctgtttcataaaaagattgagagcgcactgaggaataagatgaacagtcaagtgtgtgagaaagtaactaattcagtctctagcgagcttcagccatactttcaaaccctc

SEQ ID NO: 7741 - DNA, 660 bp, Artificial Sequence; identical to SEQ ID NO: 7667
  Description of Artificial Sequence: Synthetic coding sequence

SEQ ID NO: 7742 - DNA, 660 bp, Artificial Sequence
  Description of Artificial Sequence: Synthetic coding sequence
atgggcgtgcgtcatccaccctgttcccaccgcctcctggccgtgtgtgccttggtatctctggcaactgccgcactgctggtgaacccaggcgtggttgttcggatatctcagaagggactggattatgccagccaacagggcaccgccgccctgcaaaaggagctcaagaggattaagatcccagattattctgactcttttaagatcaagcatcttgggaagggacattactccttttactccatggacatacgcgagttccagcttcctagctcacagatctctatggttcctaacgttggcttaaaattcagtatctccaacgctaacattaagatcagcggcaagtggaaagcccagaaacgttttctgaaaatgtctgggaacttcgatttgtccatcgaggggatgtccatctctgcagacctaaagctgggttccaaccctacatctggtaaaccaaccatcaccgcttcaagctgctcttctcacattaatagtgtacacgtgcacatttccaaaagcaaagtcggttggctgattcagctgttccataaaaagattgaatctgctcttaggaataagatgaacagccaggtctgtgagaaagtcactaatagcgtcagctccgaactacagccctattttcagactctt

SEQ ID NO: 7743 - DNA, 660 bp, Artificial Sequence
  Description of Artificial Sequence: Synthetic coding sequence
atgggtgtgaggcacccaccctgctctcatcgtctcctggctgtgtgcgcacttgtgtccctcgcaaccgcagcccttctggtgaaccctggcgtcgtggtcagaatctcacaaaaagggttggactatgcctcccagcaaggcaccgctgcactgcagaaagagttaaaaaggattaagattccggactatagcgattcctttaaaatcaagcatttggggaaggggcactatagtttctacagtatggacattcgggaattccagctgcctagttcccagattagtatggtgccaaacgtgggacttaagttctctattagcaacgcaaatatcaagattagcggcaaatggaaggcacagaagagatttctaaaaatgtccggcaatttcgatctgtcaatagaaggcatgagcatctctgctgacctcaagcttggatctaaccccacttctggtaagccaacaatcacagcctccagttgctcgagccacattaattcggtgcatgttcacatatccaaaagcaaagtcggatggctaatccagctgtttcacaagaagatcgaaagcgcccttaggaacaagatgaactctcaggtgtgtgagaaggtcaccaattcggtgtcttccgagttacaaccatacttccagactttg

SEQ ID NO: 7744 - DNA, 660 bp, Artificial Sequence
  Description of Artificial Sequence: Synthetic coding sequence
atgggggtacgtcatccgccttgttcgcaccgtttgctcgctgtgtgcgcgttagtgtcccttgctacagcggctctcctcgtcaaccccggcgttgtggtacggatctcccagaagggcctggactatgcctcccaacaaggcacagccgcccttcagaaagaacttaagcgaatcaagattcccgactactcggactcgtttaagataaagcatcttggaaaagggcattattctttctactcaatggatattcgtgagttccaactcccgagctcacagatttcgatggtccctaacgtcggcttgaagtttagtattagcaacgcgaatatcaagatctctgggaagtggaaggctcagaagcgattcctcaagatgtccggtaacttcgacctgtctattgagggcatgtccatttctgcggacctcaaattgggttctaaccctacttccggtaagccgacaattactgcttcttcttgctcatctcacattaattcggttcacgtccatatctctaagtctaaggtcggttggctgatccagttattccataaaaagatagagtcagctttgcgaaataagatgaattcccaagtgtgtgagaaagtaacgaattccgtttcaagcgagctccagccttatttccagacactg

SEQ ID NO: 7745 - DNA, 660 bp, Artificial Sequence
  Description of Artificial Sequence: Synthetic coding sequence
atgggagtccgccatccgccatgttcacataggcttctggccgtctgcgcactggtgtcgcttgcgaccgcggctctcctggtgaatcccggggtggtcgtgagaatctcacagaagggcctcgactacgcttcacaacaaggcaccgccgccttgcagaaggaactgaagagaataaagattccggactactctgactcgttcaagatcaaacaccttggtaaaggacactattccttctacagtatggacatccgcgaattccaactgcctagcagccagatctccatggtgccgaacgttggtctgaaattctccatctcgaacgccaacatcaaaatctcgggaaaatggaaggcgcagaagcggtttctgaagatgtctggaaatttcgatctcagtatcgaaggcatgtccatcagcgccgatttgaagctgggctcgaaccctacctcgggaaagccgactatcactgcaagttcttgcagcagtcatattaactccgttcacgtgcacatttcaaaaagcaaagtgggatggctgattcagctgttccacaaaaagatcgagtccgccctccggaacaagatgaactcccaggtttgcgagaaggtgacgaattccgtatcgagcgagctccaaccatactttcagactctc

SEQ ID NO: 7746 - DNA, 660 bp, Artificial Sequence
  Description of Artificial Sequence: Synthetic coding sequence
atgggagtgcgccacccaccatgctcgcatcggctgctcgctgtgtgcgcactggtcagcctcgccacggctgccctcctcgtgaaccccggagtggtggtgcgcatctcccagaaaggactggactacgcatcccagcagggcaccgccgcactgcagaaagagctgaagaggattaagattcctgactactcggatagtttcaagatcaagcacctgggcaagggtcactattcgttttactcaatggacatccgggagttccagctgccttcgtcgcaaatctccatggtgccaaatgtggggctgaaattcagcattagcaacgccaatatcaagatctccggaaagtggaaggcccagaagcggtttctcaaaatgagcgggaatttcgatctgtcgatcgaaggaatgtccatatccgctgacctcaaactggggtccaacccaacttcgggaaaaccgacgatcactgcctcctcgtgttcgtcccacatcaactcggtccacgtgcatatctccaaatccaaggtgggttggctgatccagctttttcataagaagatcgaaagcgcactgcgcaacaaaatgaactcccaggtgtgcgaaaaggtaaccaattccgtgagcagcgaattgcagccgtacttccagaccctt

SEQ ID NO: 7747 - DNA, 1446 bp, Artificial Sequence
  Description of Artificial Sequence: Synthetic coding sequence
atggacgaaggcatcccgcacctgcaggaacgacagctgttggagcatcgggatttcatcggactggactactcgtcactgtacatgtgcaagccgaaacggtccatgaagcgcgacgataccaaagacacttacaagctgccacaccgcttgatcgaaaagaaacgccgcgaccgcatcaatgaatgcatcgcacagctcaaagatttgcttccggaacacctgaagctgacgactcttggacatctggaaaaggcggtggtgctcgaacttaccctgaagcatctcaaagcactgactgccctcactgaacagcagcaccagaagatcatcgccctccagaacggagagaggtcccttaagtcgccaatccagtcggatctggatgcttttcactccggcttccagacttgcgcgaaggaggtcctgcagtatctgtcaaggttcgaatcatggaccccacgcgaacccaggtgcgtgcaactcattaatcatctgcatgcggtcgccacccagttcctgcctacgccgcaactccttacccagcaggtgccgctgtcgaagggaaccggcgctccctcagcggcgggatcggcagctgccccgtgcctggagcgggcgggacagaagctggagcccctcgcatactgtgtcccagttattcagcgcacccaaccgagcgctgaattggcggcagaaaatgacactgatactgattcgggatacgggggagaagccgaagcccgcccagacagggaaaagggtaaaggagccggagcatctcgggtgaccatcaagcaagaaccgcccggagaggactcccctgcccccaagcggatgaagctcgattcgcggggcggtggctcaggaggcggacccgggggaggtgcggccgccgctgcggcagcgctcctcggaccggatccggcggcagccgccgcactcctgcgtcctgatgcagcactgctctccagcctggtcgcttttggaggaggaggtggagccccgttcccacagcctgccgcggccgccgcgccgttttgcctgccgttctgcttcctcagcccctccgccgccgccgcctacgtccagcccttcctggataagtccgggctggaaaagtacctgtacccggcagccgcagccgcgccattcccattgttgtaccctggaatcccggcgccagcagcagcagcggctgcagcggctgcggccgcggcggctgcagctgccttcccgtgtttgtcaagcgtgttgagccctccaccggagaaggcaggggctgcggcagctactctcctgccacatgaggtcgcaccattgggagctccccatcctcaacatccgcatgggcgcactcatctcccttttgcgggaccacgggagcccggaaaccccgagtcgtcggcccaggaagatccatcacagcctggcaaggaagcgcct

SEQ ID NO: 7748 - DNA, 1446 bp, Artificial Sequence
  Description of Artificial Sequence: Synthetic coding sequence
atggacgagggtattccccaccttcaggaacgccaattgcttgaacatagagacttcatcggactcgattacagcagtctctacatgtgtaagcccaagcggtcgatgaaacgcgatgatactaaggatacgtataagctgccccatcggctgatagagaaaaagcggagggaccgcatcaacgagtgtatcgcacaactgaaggatctgctccccgagcatctcaaactgactaccctgggacacctggaaaaagcggtggtgcttgagctcaccttgaagcatctgaaggctctgacggccctcactgaacagcagcaccagaagattatcgccctgcaaaatggagagcgctcgctgaagtcaccgatccagtcagacctcgacgccttccactcaggattccaaacctgcgccaaggaggtcctgcagtacttgtccagattcgaatcgtggaccccgcgcgagccgagatgcgtccagctgatcaaccacctgcatgccgtggcaactcagttcctgccgaccccgcagttgctcactcagcaagtgccactgagcaagggaaccggagcgccgtccgctgctggctcggcagcggccccgtgcttggaacgggccggtcaaaagttggaaccattggcgtactgcgtgcccgtcattcagcgtacccagccaagcgctgagctcgctgcggaaaatgataccgatactgactctggatacggtggggaggcagaagcccgccccgatcgggagaagggaaagggggcgggagcgtcgagggtgactatcaagcaagagcctccgggtgaggactcccctgccccaaagagaatgaagctggactccaggggaggagggtccggagggggaccgggagggggagcagcagccgccgcagcagcattgctgggaccggacccggccgccgccgcggctctgttgcgaccagacgcagcactcctcagcagcttggtggcttttggcggcggtggaggggctccattccctcaaccggcagcggcggccgctccgttttgcctgccgttctgcttcctgtctccatcggcggcagcagcttacgttcagccgttcctcgacaaatccggactcgaaaagtacctgtacccggccgcagctgccgcaccattccctttgctctaccccggaatccccgcaccggccgctgctgcggccgcggcagcggcagctgcagcagcggcggctgcgttcccttgcctctcctcggtgctgtccccgccgccggaaaaggctggagccgcagccgcaactctgctgccgcatgaggttgcccctctgggggccccgcacccccaacatccacacggtaggacccatctgccgttcgcaggaccacgcgaacctggaaacccggaaagctcggcgcaggaagatccctcgcagccaggaaaggaggcacct

SEQ ID NO: 7749 - DNA, 1446 bp, Artificial Sequence
  Description of Artificial Sequence: Synthetic coding sequence
atggatgagggaatcccgcatctccaggaacggcagcttctggagcaccgggacttcatcggcctggactacagctccctgtacatgtgcaagccaaagagatcaatgaaacgcgatgacaccaaggacacctacaaactgccacacagactgatcgaaaagaaacgccgagatcgaatcaacgagtgcatcgcacaactgaaggacctgctgcctgagcacctgaaactcactaccttgggacatctggaaaaggccgtggtgctggagctgactttgaagcatctgaaggcattgaccgcactgactgaacagcaacaccagaagattatcgcactgcagaacggagaaagatcgctgaagtcgcccatccaatcggacctggatgcgttccacagcggattccagacctgcgcgaaggaggtgctgcaatacttgtcgcgcttcgagtcatggaccccacgcgagccgagatgcgtgcaactgatcaaccatctgcatgccgtggcaacccagtttctcccgactccgcagctgctgacgcaacaggttccgctgtcgaaggggacgggagccccgtcagctgcgggatcggccgcggccccatgtctcgaacgcgccgggcagaaattggaacctctcgcttactgcgtgccagtgatccagcgcactcagccatccgctgagctcgcggcagaaaatgatactgatactgactccggatacggtggagaggctgaagcaagacctgatcgcgaaaagggaaagggcgctggcgcgagccgcgtgactatcaagcaagaaccgccaggggaggactcaccggcccccaagcggatgaaacttgattcgcggggaggtggatccggaggcggtccaggcggaggcgccgcggcagcagctgccgcactgctgggaccagacccagcggcggcagccgctctgttgcgcccggacgccgccctgctgtccagcctcgtcgccttcggcggtggaggaggcgcaccatttccacaacctgctgctgcagccgcgccgttctgcctccctttttgctttttgtcgccctcggctgccgcggcctacgtccagccgttcctcgataagtcgggactggagaaatatctgtaccctgcggcagcggcggccccttttcctctgctctaccctggcatccccgcaccggcagcagcagcggctgcggcagccgcggccgccgccgctgcggcggcgttcccttgtctgtcgtcagtgctgtcgccccctccagagaaagcaggggcggcggcggcgactttgcttccgcacgaagtggccccgctcggagcacctcacccgcagcacccccatggcagaactcacctcccatttgccggaccgagagagcccggaaaccctgaatcgagcgcacaggaagatccatcgcagccggggaaggaggcgcca

SEQ ID NO: 7750 - DNA, 1446 bp, Artificial Sequence
  Description of Artificial Sequence: Synthetic coding sequence
atggatgaggggataccacatctgcaggaacgacaactgctggagcatagagattttattggactcgactacagctcgctctacatgtgtaaacctaaaagaagcatgaagagagatgacacgaaagacacatacaagttgccccatagactcatcgagaagaaacggagagaccggatcaacgaatgtattgctcagctgaaagacctactgcctgagcatttgaaactgaccacattgggccatctagagaaggcagtagtgttggagctaacgctaaaacacctgaaggccctaacagccctcaccgaacagcaacatcagaagatcattgcgcttcaaaatggcgagcggtctctcaaatctccaatacagagcgatctggacgcatttcactctggcttccaaacctgtgctaaggaagtactgcagtatctcagccggttcgagtcttggactcctcgcgaacctcgatgcgtgcagctgatcaaccacctgcacgcggtcgccactcaatttctccctacgcctcaactattgacacaacaggtcccgctctcaaaggggactggagctccatcagccgcgggttctgccgccgctccatgtctcgaacgcgcagggcagaaacttgaacccctggcatactgtgttccagtgatacagagaacgcagccctctgcggaactggcggccgagaacgatactgacactgattctggctatggcggtgaagcagaagcacgtcctgaccgtgagaaggggaagggcgctggcgcatcacgtgttacaatcaagcaagagccacccggtgaggactcccctgcaccaaagcgaatgaaattagactcgagaggcggaggcagcggcggcggcccaggtggaggggccgcggctgctgccgccgcgctcctggggccagatcccgctgccgccgcggccttgctgcgcccagacgccgccctgctgagcagtctagttgcttttggcggggggggaggtgctccgttcccccaacctgctgcggcagctgcccctttttgtttaccattctgcttcctgtcgccgtcagccgccgcagcatacgtccagccattcttagacaagtccggcctcgagaagtatctgtacccagccgccgctgccgctccatttccccttctctacccaggcatcccggcgcccgctgcagccgctgcggccgcagctgccgccgccgcagcagcagccgccttcccatgcctgagttcagtgctgtcccccccccccgagaaggcaggagcagcggccgcaacgcttcttccccatgaagtggcccctttaggagccccacacccacagcaccctcacggcagaacacacctgccgtttgctgggccgcgggagccaggaaatcccgagagtagcgcccaggaggaccctagccaacccggcaaagaagccccc

SEQ ID NO: 7751 - DNA, 1446 bp, Artificial Sequence
  Description of Artificial Sequence: Synthetic coding sequence
atggacgaaggtattcctcacttgcaagagcgtcagttgctagaacacagggactttattggactggattattcatccctgtatatgtgtaagcctaaaagatccatgaagcgcgacgacactaaagatacatacaagttacctcatagactcattgagaagaagcggagagatcgaattaacgagtgcatagctcaactcaaggacctacttcctgaacacctgaagctgacaactctgggccacctggaaaaagccgtggtgttagaactcacactgaagcatctgaaagctctgacggccctgacagagcagcagcaccagaaaattatcgcgctgcagaacggagagcgaagtctgaagtctcccatacagagtgacctcgatgccttccattcaggattccagacctgtgcaaaggaagtactgcaatacctgtcgcggttcgagtcctggacaccccgtgaaccgaggtgcgtgcagctgatcaatcacctgcatgcagttgccacgcagtttctccccaccccgcagctgctgacacagcaggtgccactcagcaagggcaccggtgcaccctcagccgccggcagtgctgctgccccgtgcttagaacgcgctgggcaaaaattagagccgcttgcctactgcgttcctgttattcagcgtactcagcccagcgccgagctcgccgccgaaaacgatactgacaccgatagcggatatgggggtgaagctgaggccagaccagatagagagaaagggaaaggggctggagcatccagagtaaccatcaaacaagagccacctggagaagattcacccgccccgaagagaatgaagttagatagtaggggaggcgggtctggaggaggtccaggcggcggcgcggccgcggcggcagctgcactcctgggtcctgatccggccgctgctgcagcactgttacggccagatgccgccctgctgagcagcctagtggctttcggaggtgggggcggcgccccattcccccagccagccgccgcagccgctccattctgtctcccattttgttttctgtcacccagcgccgcagccgcttacgttcagcctttcctggacaaatccgggttggaaaagtatctttatccagcagcagccgccgccccattccccttgctgtaccctggtattcccgcccccgccgcagccgcggccgccgccgccgctgcggcggctgcggctgccgcgttcccctgcctaagcagtgtgttatcccccccgcctgagaaggcgggggccgcagccgcaactcttctccctcacgaggtagcccccctaggagccccacacccccagcaccctcatgggcgaacacacctgccttttgccggcccccgcgagcccgggaatcctgaatcatctgcacaggaggatccgtcacagccaggaaaggaggctcct

SEQ ID NO: 7752 - DNA, 1446 bp, Artificial Sequence
  Description of Artificial Sequence: Synthetic coding sequence
atggacgaggggattccccatctgcaggagagacagctgctcgagcatcgggattttataggcctcgactactcctcgctgtatatgtgcaaacctaaacgttccatgaaacgagatgacactaaagatacatacaaattgcctcaccgattgatcgagaagaagcgaagggatcgcattaacgagtgtatcgcccagctgaaggacctgttgcccgaacatctgaagcttactacgctcggtcacctggagaaggcagttgtgctggagctaaccctcaagcaccttaaggccttgacagctctgactgagcagcagcaccaaaagatcattgccctgcagaatggcgaaaggtccctcaaaagcccaatccagagtgacctcgatgctttccactctggctttcagacttgtgccaaggaagtgctgcagtatctttcccgctttgagtcttggacccctagagaaccgcgctgcgtgcagctgataaaccacttacatgccgtagccacccagtttctgccaaccccccagctgctcacccagcaagtgccattgtcgaaaggtacgggggcacctagcgctgcggggtcagcggccgcgccttgtctggagagagccggacagaagctagagcccttggcgtactgcgtgcctgttatccagcgcacacagcctagcgccgaacttgcagcagaaaacgatactgacacggacagcgggtacggcggggaagcagaggcgcggccagaccgggagaagggaaagggcgccggggcctctagggtcacaatcaagcaggagcccccaggcgaggactccccagcaccaaaacggatgaagcttgactcacggggcggaggcagcggcggaggtcctggcggaggcgctgccgctgccgccgcggctctgctggggccagaccccgccgccgcagctgccctgctccgacccgacgccgccttgctgagttctctggtcgccttcggaggcggcggtggggcccccttcccccaaccagcagccgcagctgcgccattctgcctacctttctgcttcctcagccctagtgcagccgctgcctatgtgcagccttttctcgacaagagtgggctggagaagtacctttacccggctgccgctgctgccccttttccattgctgtatccagggatccctgcacctgcagcagccgcagcagcagcggccgccgcggccgcagccgccgctgcttttccatgcttgtccagcgttcttagcccacctcctgagaaggcaggcgctgccgctgcaacactgttgccccatgaggtcgctccactgggggcgcctcaccctcagcacccccatggccgaacacatttaccatttgccggcccccgggagcctggcaatccagagtcaagcgcccaggaggaccccagccaaccgggcaaagaagctcct

SEQ ID NO: 7753 - DNA, 1446 bp, Artificial Sequence
  Description of Artificial Sequence: Synthetic coding sequence
atggacgaagggatcccacaccttcaggaaagacagctacttgagcatagggatttcataggcctggactacagttcactgtacatgtgcaagccaaaaaggtctatgaagcgcgacgataccaaggacacttacaagctgccacaccgactgatcgaaaaaaaacggagggaccggatcaacgagtgtatagctcagttgaaagatctgctcccggaacacctgaagctcaccacacttggccatttggaaaaggctgtggtgctagaacttaccctgaagcacttgaaagcactgacggccttgactgagcagcaacatcagaaaatcatcgcccttcagaatggggaacgaagtctcaaatcacctattcagtccgatttggacgctttccattccggattccagacgtgcgcaaaggaagtactgcagtacctaagcaggtttgaatcctggactccacgggagccccgatgtgtgcagctaatcaaccatctccacgccgtggctactcagtttctgcctacaccacagttacttacccagcaggtgcctctctctaagggcacaggtgctcccagtgcagccggctccgctgccgctccctgtctggagcgtgcgggccagaagctggagccattagcttactgtgtcccggtcatccagcgaacccagccctccgcggagctcgcagcagagaatgatacagacacagacagtgggtacggcggggaagcagaagctcgccccgatcgggaaaagggtaagggagcaggcgcaagcagagtcacaataaagcaggaaccaccaggggaagactcaccggcccctaaacgcatgaagctagactctcggggcggagggtctggagggggccctggcgggggcgctgctgccgctgctgccgcactgctggggcccgatcccgctgctgcagccgccctattgcgcccggatgcagctctcctgagcagcttggtggcattcgggggcggcgggggggcaccctttccacagcctgctgccgcggccgcacctttttgtctcccattctgcttcctgtcgcccagtgccgctgctgcctatgtgcagccattcctcgataaaagtggcctggagaagtacctctaccccgctgctgccgccgctccgtttcccctgctttatcctggaattcccgcccctgcagcggcagcggccgccgccgctgctgctgccgcagccgcggccgcgtttccttgcttgtctagtgtgcttagtccaccccctgagaaggctggcgccgcagctgccaccttattgccccacgaggtcgcgcccctcggtgcacctcatcctcaacatcctcatggcagaacccatcttccgttcgccgggccaagggagcctggcaatccagaatcatccgctcaggaggatccatcccagccgggcaaggaggctcct

SEQ ID NO: 7754 - DNA, 1446 bp, Artificial Sequence
  Description of Artificial Sequence: Synthetic coding sequence
atggatgaaggtataccgcatttacaagaacgacaattactagaacatcgtgattttataggtttagattattcgtcgctatatatgtgtaaaccgaaacgatcgatgaaacgtgatgatacgaaagatacgtataaactaccgcatcgactaatagaaaaaaaacgtcgagatcgaataaatgaatgtatagcgcaactaaaagatttactaccggaacatttaaaattaacgacgttaggtcatttagaaaaagcggtagtattagaactaacgctaaaacatttaaaagcgctaacggcgttaacggaacaacaacatcaaaaaataatagcgctacaaaatggtgaacgatcgttaaaatcgccgatacaatcggatttagatgcgtttcattcgggttttcaaacgtgtgcgaaagaagttttacaatatttatcgcgttttgaatcgtggacgccgcgtgaaccgcgatgtgttcaactaataaatcatctacatgcggttgcgacgcaatttttaccgacgccgcaactattaacgcaacaagtaccgttatcgaaaggtacgggtgcgccgtcggcggcgggttcggcggcggcgccgtgtctagaacgagcgggtcaaaaactagaaccgctagcgtattgtgttccggttatacaacgaacgcaaccgtcggcggaattagcggcggaaaatgatacggatacggattcgggttatggtggtgaagcggaagcgcgtccggatcgtgaaaaaggtaaaggtgcgggtgcgtcgcgtgtaacgataaaacaagaaccgccgggtgaagattcgccggcgccgaaacgaatgaaattagattcgcgtggtggtggttcgggtggtggtccgggtggtggtgcggcggcggcggcggcggcgttattaggtccggatccggcggcggcggcggcgttactacgaccggatgcggcgttattatcgtcgttagttgcgtttggtggtggtggtggtgcgccgtttccgcaaccggcggcggcggcggcgccgttttgtttaccgttttgttttttatcgccgtcggcggcggcggcgtatgtacaaccgtttttagataaatcgggtttagaaaaatatttatatccggcggcggcggcggcgccgtttccgctactatatccgggtataccggcgccggcggcggcggcggcggcggcggcggcggcggcggcggcggcggcggcgtttccgtgtctatcgtcggttttatcgccgccgccggaaaaagcgggtgcggcggcggcgacgttactaccgcatgaagtagcgccgctaggtgcgccgcatccgcaacatccgcatggtcgtacgcatctaccgtttgcgggtccgcgtgaaccgggtaatccggaatcgtcggcgcaagaagatccgtcgcaaccgggtaaagaagcgccg

SEQ ID NO: 7755 - DNA, 1446 bp, Artificial Sequence
  Description of Artificial Sequence: Synthetic coding sequence
atggacgaaggaataccacatctccaggagcgccagttgctggagcatcgggacttcatcggtttggattacagttcgctgtacatgtgtaagcctaagcgaagcatgaagcgcgatgacaccaaagacacttacaaactgccccaccgtcttattgaaaagaaacgaagagatcgcatcaacgaatgcatcgcgcagctgaaagacttgctcccagaacatcttaagctcaccactctgggtcacctggagaaggcggtggtgctcgagctcactctgaaacacctgaaggccctgacggccctgactgaacaacagcaccaaaagatcatcgcactccaaaatggagagagatcccttaagtctccgatccagtccgacctggatgcgtttcacagcggcttccagacttgcgccaaggaggtgctccagtatctctcccgcttcgaaagctggactccgcgtgaacctcggtgcgtccagctcattaaccatctgcacgcggtcgccacgcagttcctgccaactccgcaactgctgacccaacaggtgccactctctaagggaacgggagcaccttcggcggcagggagcgcagccgccccatgcctcgagagggctgggcagaagctcgaacctcttgcgtactgtgtccctgtgatccaacggacccaaccatccgcggagctggcggccgaaaacgacaccgataccgattcgggttacggaggagaagccgaagcccggcccgacagagaaaaaggcaagggggccggagcttcacgggtgactatcaagcaggaacctccaggtgaagattcgcctgcgcctaaaagaatgaaattggactcgagaggaggcggatcgggaggcggacccggaggaggcgctgcggcggccgcagcagctctgctcggccccgacccggcagcagctgccgcccttctgcgcccagacgctgctctgctctctagcctcgtggcgtttggaggcggaggaggggcgccgttcccgcaaccagccgccgctgcagcaccgttctgcctgccgttttgcttcctgtccccgagtgcggcagccgcctacgtgcagccgttcctcgataagtcgggcctggagaagtacctgtacccagcggcagcagccgcgccattcccgctcctgtaccctggtatcccagcccctgctgcggctgcggcggcagccgcagctgccgctgcagccgctgctgcttttccgtgtctgagctcagttcttagcccaccacctgagaaggcgggcgctgcagcagccaccctgttgccgcacgaagtcgcacccctgggagcgccgcacccccagcatcctcacggccggacccatcttccgttcgccggtccgcgagaaccgggaaatcccgagtcgtcggcacaagaggaccccagccagcctggaaaggaagcacca

SEQ ID NO: 7756 - DNA, 1446 bp, Artificial Sequence
  Description of Artificial Sequence: Synthetic coding sequence
atggatgaaggtatcccccacctgcaggaaagacagctgctggagcatcgggacttcattgggctggactattcttctctgtacatgtgcaagccaaaacgctccatgaaacgtgacgataccaaggatacctacaaactccctcatcgactcattgaaaaaaaacgtcgagataggattaacgagtgcattgcgcagctgaaagacctcctgccagagcacctgaaattgaccaccctgggccacttggaaaaagctgtggtccttgagctcacacttaaacacctgaaggccctaaccgcgctgacagaacagcaacaccagaaaattatcgcactgcagaacggggagcggtctctgaagtcacccatccagagcgacctggatgcatttcactccggatttcagacatgcgccaaggaggtgctgcagtacttatctcgtttcgagagctggacaccgcgtgagcctaggtgcgttcagttgattaaccacctccacgccgtcgccacgcagttcctgccgacgccccagttgctgactcagcaagttcctctgtcaaaagggactggcgccccttccgccgctggctccgccgctgccccctgtttggagcgtgcaggtcagaagctggagccactcgcctattgcgttcctgtgatacagcgcacccaaccgtctgccgagctggccgccgaaaacgatacagacaccgatagcggatatggtggagaggcagaggcacgccctgaccgagagaagggaaagggcgcaggagctagtcgtgtcaccattaagcaggaaccacctggtgaggactcccccgctccaaaacggatgaagctggactcgagaggaggcggatcaggtgggggcccgggcggtggagcggccgccgctgctgccgccttactgggcccggatcctgcagccgcggcagcacttctgcgccctgacgctgccctgctaagctcccttgtcgccttcggcggcggaggaggagctccttttcctcagcccgccgcagccgccgctccattctgtctcccgttttgctttttgtcaccatccgcagccgccgcatacgtccagcctttcctggataagagtgggctcgagaaatatctttatcccgccgcagccgccgcacccttccccttgctctatccagggatccctgcgcctgccgccgccgctgctgccgcggctgcggctgcagccgcagcagccgcctttccgtgtctgtcatccgtgctgtcacctcctccagagaaggctggtgccgccgctgccacactgctgccccacgaggtagcaccacttggagctccccaccctcaacacccacacggaagaacgcatttaccgtttgcgggacctcgcgagcccggcaaccccgagagctcagcacaggaggatccctcccagccagggaaggaagcccca

SEQ ID NO: 7757 - DNA, 1446 bp, Artificial Sequence
  Description of Artificial Sequence: Synthetic coding sequence
atggacgaagggatccctcatctccaggagcgccagttactggagcatagggatttcatcggtctagactattcatccttgtacatgtgcaagcctaagcgctccatgaaacgcgatgacacgaaggacacttacaagttgccacatcgactgatcgaaaagaagagaagagataggatcaacgaatgcattgctcagctcaaagacctcttgccagagcacctgaaactgactactctgggacacctggagaaggcagtggtcttggaactcacacttaagcacctcaaggccctgacggccttaactgaacaacaacaccagaaaatcatcgccctccaaaatggcgaaaggtcccttaagtccccaattcagtctgatctggatgcatttcactcaggctttcagacatgcgccaaggaagtgcttcagtatcttagtcggtttgaatcgtggactcctagagagcctcgctgtgtgcagctcatcaatcacctgcatgccgtggctacacaattcttgccaacccctcagctgctgacgcagcaggtacccctctccaaaggaaccggagctccatctgctgccgggtcggcagccgccccatgtttggaaagggcagggcagaaactggagcccctggcctactgcgtgcccgtcatccagcgaacccaaccgagtgccgagcttgcagctgagaacgatactgataccgactcagggtacgggggagaagcagaagcaaggccggaccgcgagaaaggaaagggtgccggagcgagcagagtgactatcaagcaagaaccgcccggagaggatagccctgcgcccaagcgcatgaaactggactcgcggggcggcgggagtggtgggggaccaggggggggagctgctgcagccgcagctgcactgctggggcccgaccctgccgccgctgccgcactgttgagacctgacgctgccctattaagcagtctggtggcctttggcggtgggggaggggctccttttccccaacccgccgcagcagccgcccctttctgcctaccattttgcttcctgagtcctagtgccgccgccgcctatgtgcagcccttcctagataagagcggcctggaaaagtatctgtatcctgccgccgcagcagctcctttccctcttctgtaccccggtatccccgctcccgctgctgcagccgcagcagcggcggctgcggctgcggccgcagcagcctttccttgtctgtcctctgtactgtctcctccaccggagaaggccggtgcagccgcagcaaccttattgccgcacgaggtagcccctttaggggcccctcacccccaacacccacatggtcgaacacacctgccattcgcggggcccagagagcctggcaatcccgagtcttcagcccaggaggatccatctcaaccggggaaggaagcacct

SEQ ID NO: 7758 - DNA, 1446 bp, Artificial Sequence
  Description of Artificial Sequence: Synthetic coding sequence
atggacgagggaatcccgcacctgcaagagcggcaactgcttgagcaccgtgattttattggcctcgactattccagcctgtatatgtgcaaacctaagcggtcaatgaaaagggacgacactaaagatacatacaagctaccacacagattgatagagaagaaaaggcgggatcggattaatgaatgcatcgcccagctgaaggacctgcttccggaacacctgaagctcaccaccctgggacaccttgagaaagctgtcgtgctcgagctaaccttgaaacatctgaaagccttaacagctctgacagagcagcagcatcaaaaaatcatcgcactccagaatggtgagcgctccctgaagtcccccatccagagtgatctggatgcctttcattctggatttcaaacatgtgctaaggaggtgctgcaatacctgtccagattcgaatcctggactccccgcgagcccaggtgtgtacagttgatcaaccatctgcacgcggtcgcaactcagtttctcccgactcctcaactcttgacacagcaggttcccctgtccaagggaaccggcgcgccaagcgccgccgggtccgccgctgcaccatgtctggagagggctggccagaaacttgaacctttggcgtactgtgtgcctgtaattcagagaactcagccaagcgccgaactggctgcggagaatgacaccgatacggacagcgggtatggaggcgaagctgaagcccggcccgatcgcgaaaaagggaagggggcaggcgcttcccgcgtaactattaagcaggaacctcctggagaggacagccctgcccccaaacgcatgaagttggactcgagagggggcggatccggtggaggccctggcggtggtgccgccgccgctgctgcggctctattaggacccgatccagcagcggccgcagctctacttcggccagatgccgccctcctctcatctttagtggcttttgggggagggggtggtgccccgtttccgcaaccagctgctgctgccgccccattctgtcttcccttctgctttttgtctcccagcgcagccgccgcatatgtgcagcctttcctagataaatcgggtctggagaaatatctataccccgccgccgcggcagcgccgttccctctgttataccctgggatcccagctccagctgccgccgctgctgcagcggccgcggcagccgctgcggcggcagctttcccctgcctgtcctccgtgctatcaccccctcctgaaaaggccggcgcggctgctgcaaccctgttaccacacgaagttgcccccctgggggcaccccatccccaacatcctcacgggcgtacccacctgccctttgccggacctcgggaaccaggaaacccagaaagctctgcgcaggaagatccatcacaacccgggaaagaagcccca

SEQ ID NO: 7759 - DNA, 1446 bp, Artificial Sequence
  Description of Artificial Sequence: Synthetic coding sequence
atggacgaaggaatcccccacctccaggaaaggcaattgctcgaacaccgggacttcattggactggactactcatccctgtacatgtgtaaacccaagcggtcgatgaagcgcgacgacactaaagacacgtataaactgccccatcggctgatcgaaaagaagcgcagggaccgcatcaatgaatgtatcgcgcagctcaaggacctcttgcccgagcacctgaagctgaccacgctgggccatctggaaaaggccgtggtcctggaattgactctgaagcacctcaaggccctcactgcactgaccgagcagcagcatcagaaaatcattgctctgcagaatggagaaaggtcactcaagtcgccaatccagtccgaccttgacgctttccactccggctttcaaacgtgtgctaaggaagtgcttcagtacctgtcccgcttcgagtcctggactccgcgagaaccgaggtgcgtgcagctgatcaaccacctgcacgcagtcgccactcaattcctgcctacccctcaactcctcactcagcaggtccccctgtccaagggaaccggagcgccgtcggccgccggaagcgccgcagcgccatgtctggaaagagccggtcaaaagttggaacctctcgcctactgtgtgccagtgatccagcggactcagccctcggctgaactggctgccgaaaatgacaccgacacggattcgggttacggaggcgaagctgaagcaagaccggatcgcgaaaagggcaaaggtgcgggcgcatcccgggtgaccattaagcaagagccgccgggagaggactcaccggcaccaaagcgcatgaagctcgactcccgcggaggcgggtcgggtggcggcccgggcggaggagccgcagccgcagcggctgcgctcctcggaccagaccctgcagcagccgctgcccttctgcggccggatgcggctctgctgtcgtcactggtcgcgttcggaggtggagggggagcgccatttcctcagccagctgcggccgctgctccgttctgcctcccattctgcttcctctcgcccagcgccgcggccgcatacgtccagccgttcctggacaagtcaggactggagaaatacctgtacccggccgctgcagccgctccatttccgcttctgtacccaggaatcccagcgccggcggcagccgccgccgcggctgccgctgccgcagcagcagccgcagccttcccgtgcctgtcaagcgtgctgtcccctcccccggagaaagctggcgccgctgccgcgactctgctccctcatgaagtggcccccctcggagcgcctcaccctcagcacccccatggccggactcatctcccattcgcaggtccccgggaaccggggaacccggagtcgtcagctcaggaagatccaagccaaccaggaaaggaagcccca

SEQ ID NO: 7760 - DNA, 1446 bp, Artificial Sequence
  Description of Artificial Sequence: Synthetic coding sequence
atggatgaaggaattccacatttacaagaaagacaacttcttgaacatcgagatttcattggattagactattcatcattatatatgtgtaaaccaaagcgtagtatgaagcgagatgatactaaagatacatataagttaccacatagattaatagaaaaaaaacgtagagatcgtattaacgaatgtattgctcaattaaaggatttacttccagaacatttaaagttaacaacattaggacatttagaaaaagccgtagtgcttgaattaactttgaaacatttaaaagcacttacggctcttacagaacaacaacatcaaaaaattatagctttacaaaacggggaaagatcacttaaatctccaattcaaagtgatttagatgcattccattcaggttttcaaacttgtgctaaagaagttcttcaatatctttcaagatttgaatcatggactccaagagagccaagatgtgttcaattaattaatcatttacatgcagttgctacacaatttttgccaactccacaattgttaactcagcaagttccattaagtaaaggtacaggagctccatcagcagcaggatcagctgctgcaccatgtcttgaacgagcaggacaaaaattggaaccattagcatactgtgttcctgtaattcaaagaacacaaccatcggctgaattagctgcagaaaatgatacagatacagatagtggttatggtggtgaggctgaagcaagaccagatagagaaaaaggaaaaggtgctggagcaagtcgagtaacaattaaacaagaaccaccaggagaagatagtcctgcaccaaaaagaatgaaattagattcacgtggaggaggatctggaggagggccaggaggtggagctgcagcagcagctgctgcacttcttgggccagatccagctgcagctgcagctttattaagaccagatgcagcacttctttcttctcttgtagcttttggtggaggaggaggagcaccatttcctcaaccagctgcagcagctgctccattttgccttccattctgttttttatcaccatccgctgccgcagcttatgttcaaccttttcttgataaatctggattagaaaaatatttatatccagctgctgcagcagctcctttcccattattgtatcctggaattccagcaccagctgctgctgcagcagcagctgcagcagctgccgcagcagcagctgcttttccatgtctaagttctgtattatctccaccaccagaaaaagcaggagcagcagctgctacattacttccacatgaggttgcaccattaggagctccacatccacaacatccacacggtagaactcacttaccatttgcaggaccaagagaaccaggaaacccagaaagttcagcacaagaagatccatcgcaaccaggtaaagaagctcca

SEQ ID NO: 7761 - DNA, 1446 bp, Artificial Sequence
  Description of Artificial Sequence: Synthetic coding sequence
atggacgaaggtattccccatttacaggagagacagctgctggagcaccgggattttatagggctagattactcttctctgtacatgtgtaagcccaagcgctcaatgaaacgtgacgacaccaaagacacctataagcttcctcatagactcatcgaaaaaaaaagacgtgatcggatcaatgaatgcattgcccaactgaaggatttgctgccagaacacctgaaactgaccactctagggcacctggagaaagctgttgtcctcgagctcacactgaagcatctgaaggccctaaccgcactgaccgagcagcagcaccagaagattatcgcacttcagaacggcgagagaagtctcaagtcacccatccaatcagatctcgacgccttccacagtggcttccagacctgtgcaaaagaggttctccagtatcttagtagatttgaatcttggacccctcgagaacctcgatgcgtacaactcatcaaccacctccacgccgtggcaacccagttcctgcctaccccccaactgctcacccagcaagtgcccctgagcaaaggcacaggggctccgagcgctgctggcagtgccgccgcgccttgcctcgaaagggcaggccagaagttagagcctctcgcctactgtgttcccgtcattcagcgcacccagccttccgcagaattggccgcagagaatgataccgatacggactcgggatacggcggtgaggccgaggccagacctgaccgggaaaaagggaagggcgccggggcgagccgggtgacgattaagcaggagcctccaggagaggatagcccggcccctaagaggatgaaacttgatagcagaggcggcggcagcgggggtggaccagggggcggcgcagccgctgccgcagcagccctgcttggcccagatcccgcagctgcagccgcgctcctccggccagatgccgctctactttcttctttggtcgctttcggggggggtggtggtgcacctttccctcagcctgctgccgctgccgctcccttctgtctgcccttttgtttcctttcacctagcgcggcagcggcttatgtgcaaccatttctcgacaaatccgggctagaaaagtacctgtaccccgctgctgctgccgctccatttccactgctgtaccctggcattccagctccagctgcagcagccgccgccgctgctgccgccgcagccgctgcagctgcgtttccatgtctttcttccgtcctttcccctccacccgagaaagctggagctgcagccgcgacactgctcccacacgaggtagctccactgggggcaccacaccctcagcacccacacggtcgcacacatctaccatttgccggtcctcgagagccaggaaacccggagagttccgctcaggaggacccgtcccagccaggcaaagaagcccct

SEQ ID NO: 7762 - DNA, 1446 bp, Artificial Sequence
  Description of Artificial Sequence: Synthetic coding sequence
atggacgagggaataccacatttgcaagaacgccagcttctggaacatcgcgacttcatcggacttgactacagcagcctgtacatgtgtaagccaaagcgctccatgaaaagagatgacacgaaagatacttacaagctgccccataggctgattgagaaaaagagaagggatcgcattaacgagtgtatcgctcagctcaaagatttgctcccggagcaccttaagctcactacgctcggacatcttgaaaaagcagtggtgctggaacttactctgaagcatctgaaggccctcactgcacttactgaacagcaacaccagaaaatcattgcactccaaaatggcgaacgatccctcaaatcccctattcaaagcgaccttgatgcgtttcactcaggatttcaaacctgtgcaaaggaagttctccaatacctgtctcgcttcgagtcctggacgccaagagagccacgttgtgtgcaactgattaatcaccttcacgcggtcgcaacccaatttctgcctactccccaacttctgacccagcaagtgccattgtccaagggtaccggtgcgccttcagccgctgggtcggcagcagcaccatgccttgaaagagcaggacagaaactcgaacctctcgcctactgtgtgcctgtcatccagcggacccagccgagcgcagaattggcagccgaaaacgatacggacaccgattccggatatggcggtgaagcagaagcacgcccggatagagagaagggaaagggagcaggtgcttcgagggttaccattaagcaggagcctcctggtgaggacagcccagcacctaagcggatgaagctggattctaggggaggagggtccggaggaggaccagggggaggagcagctgctgccgccgcggcgcttctggggcctgatcctgcggctgcagcggcgttgctgaggccagatgcagcgcttctgtcctcactcgtggcgttcggaggaggcgggggcgccccgtttcctcaacccgcggcggctgcggcacctttctgtctgccattttgcttcctgtcgccgtcggccgcagccgcatacgtgcaaccatttcttgacaagtcagggcttgaaaagtacctttaccctgcggcggccgcagccccatttccactcctttaccccggaataccagcgcccgccgcagctgctgcggcagccgcagcggcagcagccgccgcagcagccttcccttgcctttcgtcggtgctttcacccccgccagaaaaggcaggcgcagctgcagcaactctgctgccacatgaggtggcacctttgggagccccacacccacagcatcctcatggcaggactcatttgccttttgctgggccgcgggaacctggcaacccggaaagctcggcgcaagaggatcctagccagcccggcaaagaggcaccc

SEQ ID NO: 7763 - DNA, 1446 bp, Artificial Sequence
  Description of Artificial Sequence: Synthetic coding sequence
atggacgagggtattccccacctccaggagcgtcagctgttggaacatcgggattttatcggcctcgactacagctctttgtatatgtgcaaaccgaaaaggtccatgaagcgggatgacacgaaagatacgtacaaactgccacataggctgatcgagaagaaaagaagagaccgaattaatgaatgtatcgctcagctgaaagacttgctgcctgaacacctcaagctgaccactttgggccaccttgagaaggccgttgtgctggaactgaccctgaagcatctgaaggctctgacagctttaaccgagcagcagcaccaaaaaatcattgctctccagaatggcgaacgttccctgaagtctcccattcagtctgacctcgacgcttttcactcgggtttccagacatgtgcaaaggaggtgttgcagtatttatcaaggttcgaatcctggacccccagagaaccacgctgcgtgcagcttattaatcacctacacgctgtggcgacacagttcctacctaccccacagctgttaacacagcaggtgccactatccaaaggcacaggcgcacccagcgctgcggggagtgccgctgctccgtgcctggagcgagctggtcagaaactggaacctcttgcttactgtgtgcctgttatccaaagaacccagccatccgctgaactggctgccgaaaacgataccgataccgattctggctacggcggtgaagctgaggccaggcccgacagggagaagggcaaaggggccggggcctctcgcgtaaccatcaagcaggaacccccaggcgaggattcacctgcccctaagaggatgaagttggattccaggggcggaggctcaggcggcggacccggtggcggtgccgcggccgctgcagccgccctgctgggacccgaccctgcagcagccgccgcacttctgcggcctgacgccgctctactttcaagtctggtggcttttggcggaggcggaggtgcaccatttccccaacccgcagccgctgcggcacccttctgtctgcctttctgtttcctaagtccgtcggcggccgcagcgtatgtacaaccctttctggataagtccgggttagagaaatatctgtacccagccgctgccgcagctcccttcccgctgctgtaccccgggattccggcaccagccgctgccgcagcagcagcagccgctgcggccgctgccgccgcagccttcccatgcctgagctccgttttgagtcctcctcctgaaaaagcaggtgctgcagccgctaccctcctaccccatgaggtagcccctctgggggcccctcacccacagcacccgcatggcagaacgcacctgccttttgcggggcccagggaacctgggaaccccgagagtagtgcccaggaagatccctctcagccgggaaaagaagcccca

SEQ ID NO: 7764 - DNA, 1446 bp, Artificial Sequence
  Description of Artificial Sequence: Synthetic coding sequence
atggatgaaggcatcccacacctgcaagagcggcaactccttgagcatagagactttatcggactcgactatagctcgctttacatgtgtaaacccaagagatcaatgaagagagacgataccaaggacacttacaaactgccccatcggctgatcgaaaagaagcgcagggatcggatcaatgagtgtattgcccagttgaaggatcttctccccgaacatttgaaacttactaccctgggccacttggaaaaagcagtggtgctggaacttaccctgaaacatctgaaagcccttactgctcttactgaacaacaacaccagaagattatcgccctgcaaaatggtgaaagatctctgaagagccccatccagtcggatctcgatgcatttcactcgggttttcaaacttgtgcaaaggaggttcttcagtacctttcccggtttgagtcttggactccacgggagcctcgctgtgtgcaactgataaatcaccttcatgcggtcgctacccaattcctccctaccccacagctgcttacccagcaagtgccactgtcgaagggaactggggctccctcagccgctggatccgcggcagcgccatgtcttgaacgagcaggtcaaaagctcgagcctcttgcatactgcgtgccagtcattcaaaggactcaaccgagcgcagagcttgcagctgagaacgacaccgatactgatagcggatacggcggagaagccgaggccaggccagatagagaaaagggcaagggagcaggtgcctcgagggtcacgattaagcaggaaccaccaggagaggattccccggcaccaaagagaatgaaactcgattcaaggggcggagggtccggtggaggcccgggtggaggagcagcagcagccgcggcagcactgctggggcctgatcctgccgcagcagccgccctcctccgccccgacgccgcactgctgtcctcgctggtcgcgtttgggggaggaggtggcgccccttttcctcagcctgcggcagcagcggccccattctgtctccctttttgctttctgtccccaagtgcagcggcagcatacgtgcagccatttctcgataaaagcggactcgagaaatacctctacccagccgcagcagcagcaccgtttccacttctttacccgggtattccagcacccgcggcggcagcagctgcagcggctgccgcagcggccgccgctgctgcttttccgtgcctgagcagcgtgctttcgcctcctccagagaaagcaggagccgcggcggctaccctgctgccacatgaggtcgcaccactcggtgcccctcaccctcaacacccccacgggcgcactcatctgccttttgctggcccaagagaaccgggcaaccctgagagctcggctcaagaggacccatcgcagcccgggaaggaagcgcca

SEQ ID NO: 7765 - DNA, 1446 bp, Artificial Sequence
  Description of Artificial Sequence: Synthetic coding sequence
atggacgaaggaatcccgcaccttcaggaaaggcagctgctggagcaccgggatttcataggcctggactactcgagcctgtatatgtgtaagcccaagcgctctatgaagcgcgatgacactaaggacacctacaagctgcctcaccgcctcatcgagaaaaagcgccgtgaccgcattaatgaatgcatcgcccagcttaaggatctgctcccagagcacctcaagctcaccactctgggtcatctggaaaaggccgtggtcttggaactgacgctgaagcatctcaaagccctgaccgccttgaccgaacaacaacatcagaagatcattgcgcttcaaaatggcgaaagatcactgaaatcgccgattcaatcggatctggacgcctttcactctggtttccagacgtgcgcaaaagaagtgctgcagtacctgtcacggttcgaatcgtggactcctcgcgagcctcgctgtgtgcaacttatcaaccacctgcacgccgtggctactcagttcttgccgacccctcagctcctcacccaacaggtgcccctgtcgaaaggaactggcgcgccaagcgcagccggaagcgcggcagccccatgtctcgaaagagccggccaaaagctggaaccgctcgcctactgcgtgcctgtcatccagcggacccagccttcagctgagctcgctgcggagaatgacaccgacactgactccggttatggaggagaggccgaagcacgaccagacagagaaaagggcaagggcgctggagcctcccgcgtcaccataaagcaggaaccgcctggagaggactcgcccgcccctaagagaatgaaactcgattcccgcggaggcgggtcaggcggcggtccgggaggaggagccgctgcggctgcggcagccttgttgggaccagatccggcagctgctgcagctctgctgcgaccagacgcggcactgctcagctccttggtggcgttcggaggaggaggcggcgcaccgttcccgcaacctgcagcggcggctgcgccgttctgcctgccgttttgcttcctctcaccttccgccgcggccgcgtacgttcaaccttttctggataaatcgggacttgaaaagtatctgtacccggcggcggcggccgcaccttttccgctgctttacccgggcatcccggcgcccgccgccgcggcagcggctgccgccgctgctgcagcggccgcggcagctttcccatgcttgtcctcggtcctgagcccaccgccggagaaggccggggcagcggcagcaaccctgctgcctcacgaagtggccccgctgggagcaccgcacccacagcaccctcatggacggacccacctgccttttgccggcccccgggagcctggaaaccccgaatccagcgctcaggaagatccgtcccagccgggaaaggaggcgccg

SEQ ID NO: 7766 - DNA, 1446 bp, Artificial Sequence
  Description of Artificial Sequence: Synthetic coding sequence
atggacgagggcatcccacacctgcaagagcggcaactgcttgaacatagagattttatcggtttggattattcatctttgtacatgtgtaaaccaaagagatctatgaaacgtgatgatactaaggacacatacaagctgcctcatcgcttgatcgaaaaaaagcgcagggataggataaacgagtgtatcgcccagctaaaggacctcctgcctgaacacctaaagttgaccacgcttggccacctcgagaaggccgtggttctagaactaaccttgaagcaccttaaggccttgacggcactcacagaacaacagcaccagaaaatcatcgccttacagaatggggaaaggtctttgaagtcaccaattcagtctgatctagacgcgtttcactcaggctttcagacatgtgccaaggaagtgttacagtatttgagcagatttgaaagctggaccccccgagagccccgatgcgttcagctgatcaatcatttgcacgctgtggccacccagtttttacccacaccccagctgctgacccaacaagtacctctctccaaagggaccggagcccctagcgcggccgggtccgcagccgcaccttgcctggagcgagcagggcagaagctggagccactcgcatattgtgtaccagtaatccaaagaacccagcccagcgctgaattagcggcagaaaatgacacggatacagatagcggttatggaggagaggccgaagctagacctgaccgggaaaagggcaagggagcaggcgccagcagggtaacgattaaacaggagcctcctggagaggatagcccagccccgaaacgaatgaagctggacagtagaggcggagggagcggagggggccccggtgggggtgccgccgccgccgccgctgcgctgctcgggcctgatcctgctgccgcagctgcattgctgaggcctgacgctgcgctgctgagttcgctggtagctttcggtgggggaggaggagcgcctttccctcaaccagccgccgccgcagcacctttttgccttcccttttgttttctgagcccttcagccgccgcagcctacgtccagcctttcctggacaaaagtggcctggagaaatatttgtatccagccgctgccgctgcgccgtttccgctactgtaccctggaatccctgctccagctgccgcggctgccgctgcggccgcggctgcggctgccgccgcagcctttccctgtcttagctctgtccttagccctccacctgaaaaagctggagctgccgcagccaccttgctccctcacgaggttgctccactcggcgccccgcacccacagcaccctcatgggaggactcaccttcctttcgccggcccacgggagcccggcaatccagaaagttctgcccaggaagacccgtcacaacctggcaaggaggccccc

SEQ ID NO: 7767 - DNA, 1446 bp, Artificial Sequence
  Description of Artificial Sequence: Synthetic coding sequence
atggatgagggtatcccccacctccaggagaggcagctcctggaacatcgtgatttcattggactggattatagttctctgtatatgtgcaaaccaaagagatccatgaaacgcgacgacaccaaagatacatacaagcttcctcatcgcctgattgaaaagaagagacgcgacagaatcaacgaatgtatcgcccagctcaaagatctgctccccgagcacctcaaactgaccactttgggccatcttgagaaagctgtcgttctcgagctgacccttaaacatctgaaggcccttacagccctcaccgaacagcagcaccagaagatcatcgcccttcagaatggtgaaagatccctgaaaagcccaatccaaagtgacctggacgctttccactccggcttccaaacctgtgcaaaggaggtcctccagtacctctccaggtttgagagttggacaccacgcgagccacgttgtgttcagctcataaaccacttgcatgccgtagctacccagttcttgcctacccctcagctcctgacccagcaggttccactgtctaagggaacaggtgcaccaagcgctgcaggttctgccgccgccccctgcttggaacgtgcaggccagaagctcgagcccttggcttattgtgtgcctgttattcaacgtacccagcctagcgcagagctcgcagccgaaaacgacacagacactgattctggttacggtggcgaggccgaagcccgcccagacagagagaagggaaagggtgcaggcgctagtagggttactatcaaacaagagccacctggagaggactcccccgctcctaagaggatgaagctggatagcaggggaggcggttctggaggtggccctggtggcggcgcagccgctgcagccgccgctctgcttggccccgaccccgccgcagcagccgctcttttgcgtccagatgctgccctgctttcctccttggtcgctttcggtggaggaggtggagcaccattcccccagccagctgccgccgctgcccccttttgcctgccattctgctttctgtctccatctgcagcagctgcatatgtgcaaccattccttgacaaaagtggtctggagaagtatttgtaccccgccgccgcagccgctcctttccccctcctctatcccggaatacccgcaccagctgcagccgctgccgctgctgctgctgccgccgccgcagctgccgcctttccttgtctctcctccgtcctgtcacccccacccgagaaggccggtgctgctgccgctaccctgcttcctcacgaggtcgcacccttgggtgctcctcacccacagcacccacacggcagaacccatcttccttttgctggaccaagggagcccggcaaccctgagtcaagcgcacaagaggatccttctcagccaggaaaagaggcaccc

SEQ ID NO: 7768 - DNA, 1446 bp, Artificial Sequence
  Description of Artificial Sequence: Synthetic coding sequence
atggatgagggaatcccccacctgcaagagagacagctccttgaacatcgcgattttatagggctggattattcttctctatatatgtgcaaaccaaaacggtctatgaaaagggatgatactaaagatacttacaaactccctcataggttgatagaaaaaaaacgacgcgatcgcataaatgaatgcatcgctcagctcaaagatttactacctgaacacctcaaactcactactcttgggcaccttgaaaaagccgtggtcctggaactgactctaaaacacctcaaagctcttacagccttaactgaacagcagcatcagaaaatcatcgccctccagaatggagagagaagtcttaaatctcccattcagagtgacctggatgcgtttcattccgggtttcagacttgcgcaaaagaagtcctccaatacctttctcggttcgagagttggacaccacgagaacctaggtgtgtccagcttataaatcatctccacgctgttgccacacagttcctacccactccccagctcctaacacaacaggtcccattatctaaaggaacaggagccccctcagctgccggaagtgcagccgcaccatgtctcgaaagagccggacagaaactcgaaccactggcctattgtgtccccgtcattcagagaacacagccaagtgctgaactggctgcagaaaacgatactgatactgattctggatatgggggggaagccgaagcccgacccgatcgggaaaaagggaaaggagcaggagccagtagggtcactataaaacaagagccaccaggggaagacagtccagcccctaaaaggatgaaactcgattcaagaggaggagggtcaggagggggacctggaggaggagctgctgccgccgcagcagctctcctaggacccgatcccgcggctgccgcagcccttctacgacccgatgccgctctactgtccagtctcgtggcattcggaggaggagggggggcaccctttccacaacccgcagccgcggccgcccctttttgtctccccttttgcttcctctccccatcagcagccgccgcctatgtacagccattcctagataaatctggactagaaaagtatctataccctgctgcagccgctgctccctttcctctcctttatccaggaatacccgcccccgcagcggcagctgctgccgcagccgcagccgccgccgccgctgccgctttcccatgtttatcttctgtgttgtccccccccccagaaaaagcaggggctgcagccgctacattactaccccatgaagtcgcgccacttggggctccacaccctcagcatccacacggaaggacacacctaccatttgcggggccccgggaacctggaaacccagagtcctcagctcaggaagatccgtcccaacctgggaaagaagcccct

SEQ ID NO: 7769 - DNA, 1446 bp, Artificial Sequence
  Description of Artificial Sequence: Synthetic coding sequence
atggatgaaggcattccccatttgcaggagaggcagctgcttgagcatcgcgacttcataggactggactacagttcactgtacatgtgtaaaccaaagcgctctatgaaaagagatgatacaaaggatacgtataaacttccacacagactgatcgagaagaagaggcgcgaccgcataaatgaatgtattgcccaacttaaggatctgttgcctgaacatctgaagttgacgaccctgggacatcttgagaaagctgtggtccttgagttgactctgaagcatctgaaagcgctcaccgcactgacagaacagcaacatcagaaaatcatcgccctgcagaatggggagaggagtttgaagagtcccatccagtccgatcttgacgcgtttcactctggtttccagacgtgcgcaaaggaagtgctccagtatcttagcagatttgagtcttggactccaagagaacccaggtgcgtacagctcatcaatcacctgcatgctgtggccacacagtttctccctacacctcaactgttgacgcagcaggtgcccctgtccaaaggaacgggggctccctccgcggccggaagcgcggccgctccttgtctggaaagggcgggacagaagttggaacctctcgcttactgtgtgccagtaatccagagaacccagccctccgcagagcttgctgcagaaaacgataccgacactgatagcgggtatggcggagaagccgaggcaaggcctgaccgggagaaaggtaaaggtgcaggtgccagcagggtgactataaagcaggaacctcctggagaggacagccctgcaccaaagagaatgaaactcgacagtcgggggggcggcagtgggggtggacccggagggggtgccgcagctgccgctgctgctctgcttggccctgatccggccgccgccgcagctctgttgcggcctgatgccgctttgcttagttccctcgtcgcctttggaggcggagggggagctcccttcccacagcctgctgccgccgctgctccattctgcctcccattctgttttttgtctcccagcgcggccgccgcctacgtgcagccattcctggataagtcaggactcgagaagtacctgtatccggcggctgctgcggctcccttcccgcttttgtaccctggtatacccgcaccagcagccgccgctgctgctgcggccgctgccgccgctgccgcggcagcctttccttgcttgtcaagtgtgctttcaccgccaccagaaaaggccggtgccgcagccgcgacactgctgcctcacgaagtggcgccactgggagctccccaccctcagcacccacacggacggacacatctgccctttgctgggccgcgagaacctgggaaccccgaatcttctgctcaagaggacccttcacagccaggcaaggaagcccca

SEQ ID NO: 7770 - DNA, 1446 bp, Artificial Sequence
  Description of Artificial Sequence: Synthetic coding sequence
atggatgaggggattccgcatcttcaagaaaggcagctccttgagcacagagatttcatcggcttggactactcatcgctgtacatgtgcaagccgaaacgcagcatgaagcgggacgataccaaggatacttacaagctcccgcacaggctgattgagaagaagcgaagggatcgcatcaacgaatgtatcgctcagcttaaggacctgctcccagaacacctgaagctcacgactctcggccacctcgaaaaggctgtcgtgctcgagcttaccctcaaacatctgaaggccctcaccgcccttactgagcagcagcaccagaaaatcatcgccctccagaatggtgaacgctctctgaagagccctattcagtcagacctcgatgcctttcactctggattccagacctgtgctaaggaggtgctccaatatctctcccgcttcgaatcctggaccccgcgcgaaccgcggtgtgtccaactcatcaatcacctgcacgcagtggcgacgcagttcctgccaaccccgcagctgctgactcaacaggtcccgctgtccaagggaaccggagcgccgtcggcagcaggatcagccgccgcgccgtgcctcgaaagggccggtcagaagctcgagcctctggcgtactgcgtgcctgtgatccagcgcacccagccctcagcagaactcgcggctgaaaacgatactgataccgactccggatacggaggggaagcagaggccagacctgaccgcgaaaagggaaagggcgctggcgcatcccgggtgactatcaagcaggagccgcctggcgaagattcaccagctcctaaacgtatgaaactggactcgcgcggaggcggctcgggaggaggaccgggaggcggagctgcagctgctgccgccgctctgctgggaccagacccggcagcagccgctgctctgctccggccggacgcagcactcctgtcgtcgttggtggcattcggaggaggcgggggagcgccattcccacagcccgcggctgcagcggcgcccttttgtttgcctttctgctttttgtcgccgagcgcggcagccgcttacgtgcaaccctttctggacaaatcgggcttggagaagtacctgtacccagccgcagctgcagccccatttccgctcctctacccaggaatcccagctccggccgctgcggctgccgcagccgccgcggccgccgccgctgccgccgccttcccgtgtctcagctcggtcctgtcgcctccaccagagaaagccggagccgcagcagcgaccctcctgcctcacgaggtggcgccactgggggcccctcatccgcaacatccacatggccggacccatctgccgttcgctgggcccagagagccagggaacccggaaagctccgcccaggaggacccttcgcagcccggaaaggaagcgccc

SEQ ID NO: 7771 - DNA, 1446 bp, Artificial Sequence
  Description of Artificial Sequence: Synthetic coding sequence
atggatgagggtatccctcatcttcaggaacggcagctccttgaacaccgtgatttcatcggtctggattactcctcgctgtacatgtgcaagcctaagaggtccatgaagcgggacgacacgaaggatacgtacaagctcccccatcgccttattgagaaaaaacgtcgtgataggatcaacgaatgtatcgcacaactcaaggaccttctgccagagcacctcaagctgactactcttgggcatctcgagaaagccgttgtcctcgagctgactttgaaacatcttaaagcactgactgccctcaccgaacagcagcatcaaaagatcattgctctgcaaaacggagaacgctcgctgaagtcaccaatccaatctgatctcgatgcatttcatagcggatttcagacctgtgctaaagaggtgctccagtatctctcaagattcgagtcgtggaccccccgcgaaccgcgttgtgtgcagctgatcaaccatcttcatgccgtcgcaacccaattcctgccaaccccacagctcctgacccaacaggttcctctttcaaaggggactggtgcaccctctgctgccgggtcagcagctgcaccttgtctggaacgcgcaggacaaaagctggaacctctggcttattgtgtgcccgtgattcaaaggacccagccctccgccgagctggcggcagaaaatgatactgataccgacagcggatacggaggtgaggcggaagcacggccagaccgggaaaaaggtaagggcgcaggagcgagcagggtcactatcaagcaagaacctcctggagaagatagccccgcccctaagagaatgaagctggactccagaggcggaggttccggaggcgggcccggtggaggtgccgcagcagccgcggcagccctgctgggcccagaccctgcggcagcggcagcgctgcttagacctgatgcagcacttctgagctccttggtcgcatttggcggtggtggcggtgcccccttccctcagccagcagccgcagcggcaccattctgtctgcccttctgcttcctgtccccatctgccgcggcggcttacgtgcaaccttttcttgataagtctggactcgagaaatacctctacccagcggcagcggctgccccatttccactcctctacccgggaatcccagctcctgcggcagctgcggcagcagcggctgcagcggcagccgcagccgccgcatttccgtgcctttcatcggtgctgtcgccccctcctgaaaaggctggagcagcagcagcgactttgctccctcacgaggtggcacctctgggtgcccctcatccccaacatcctcatggcagaactcacttgccattcgctggaccaagagaaccgggaaatccagagtcgtcggcgcaggaagatccaagccagccaggaaaggaagcgcct

SEQ ID NO: 7772 - DNA, 1446 bp, Artificial Sequence
  Description of Artificial Sequence: Synthetic coding sequence
atggatgaagggattccccacctgcaggaacgccagctgcttgaacatagagatttcatcggattggattacagtagtctgtacatgtgcaagccgaagcgctccatgaaaagggatgatacaaaggacacctataagctcccccatcgtctgattgaaaagaagcgccgggatagaatcaatgagtgcattgcccagctgaaggatctgctccccgaacatctcaagttgaccacactcggacatctcgagaaggcggtcgttcttgaactgacactgaagcaccttaaagcgctgacggcactgacagagcaacagcaccagaaaattatcgccctgcagaacggtgagagatcccttaaaagtcccattcagtctgatctagatgcctttcacagtggcttccagacatgcgctaaagaggtgctccaatacttgtcgagattcgaaagttggaccccccgggaaccccgctgcgtccaattgatcaatcatcttcacgccgtggctactcagtttctgcctaccccacagcttctgacacagcaggttccactgtccaagggcacaggcgccccatccgcagccggaagcgccgctgccccctgtttggagagagccggacagaaactcgagcccctggcttactgtgtgcccgtaatacagagaacacagccttctgccgaactggccgctgagaatgatactgacacagatagcggctacggcggtgaggccgaagcgcgccccgacagagagaagggaaagggcgctggcgcctctagggtgaccatcaaacaagagccgcccggagaggactctcctgctccgaagagaatgaaactcgattcacgcggcggcggcagcggtggcggccccggcggtggagcggctgcagccgccgccgccttgctcggtccagatcctgctgcagcagccgccctgctgcgaccagatgctgctctgttgtcgtctctcgttgcttttgggggcggcgggggagccccctttcctcagcctgctgctgctgcggccccgttttgtctgcctttttgcttcctcagcccaagcgccgctgctgcatacgtgcagccgttcttggataaaagcggactagagaaatatctgtatcccgcagctgccgctgcacccttccccctcctctaccctggtatcccggcacctgccgcagccgccgccgctgctgctgccgcagctgctgcagccgccgcatttccgtgtttgtcaagcgttttaagcccccctcctgagaaagccggcgctgctgcagctacgcttctgcctcatgaggtcgcaccgcttggtgcaccccatccacaacacccccacggtaggacccatctgcctttcgccggccccagggagccaggaaaccctgaaagtagcgcacaggaagacccaagccagcctggcaaagaggcaccc

SEQ ID NO: 7773 - DNA, 1446 bp, Artificial Sequence
  Description of Artificial Sequence: Synthetic coding sequence
atggacgagggtattccccacctgcaggaacggcagttgttagaacaccgggattttatcggcttggattatagttcactttatatgtgcaaaccaaaacgaagcatgaaaagggacgacactaaggacacttacaaactaccgcatcggctcattgaaaagaaacgccgagaccggatcaacgagtgtatagctcagttgaaggacttactgccagaacatctcaagctgacaaccttaggccacctagaaaaagcagtcgttcttgaactgactttgaagcatctcaaggcccttaccgccttaacggagcaacaacatcagaagatcattgctctccagaatggagaaagaagcctgaaaagtccaatccagagcgatctggatgctttccactcgggcttccagacctgcgcaaaggaggtactccagtatttgtcgaggtttgaaagctggactccgcgagagcccaggtgtgtgcagctaattaaccatctgcatgccgtagcaacccagttcttgccgacaccacagcttttaacgcagcaggtccccctgtccaagggaacgggagcgccctcggcagctggcagcgccgccgctccctgtctcgagagggccggccagaaactggagcctctcgcctattgcgtgccggtgatacaacgcacacagccatcagcagagctggccgccgaaaatgataccgatacagatagcggctatgggggagaggcagaggctcggcctgacagagagaagggcaaaggggcaggcgcatcaagggtgacgatcaagcaggagcctcctggggaagactcccccgcaccaaaaaggatgaaactcgactcacggggcggaggctcagggggcggaccgggtggcggcgccgccgctgcggccgccgccctgcttgggcctgaccccgcagctgctgctgcccttctgagaccagacgcagccctcctatccagtctcgtggccttcgggggcggtgggggggcacctttcccccagcctgccgctgctgctgccccattctgcctgccgttttgttttttgtcaccctcagcggcagctgcctacgtgcaaccttttctggacaaatccgggctggagaaatacctgtatccagctgctgccgccgcacctttccctcttctctatccaggtatccctgcccccgcagctgccgccgcggccgcagctgctgcagcagctgccgctgctgccttcccctgtctttcttcagtgctgtctccacccccggagaaagcaggagccgcagccgccactctgttgcctcatgaggttgcccctcttggcgcgccacacccccagcacccacacggacgtactcacctgcctttcgccggcccaagagaaccaggtaaccctgagtcttcggcacaagaagacccttctcaacccggaaaggaggctcca

SEQ ID NO: 7774 - DNA, 1446 bp, Artificial Sequence
  Description of Artificial Sequence: Synthetic coding sequence
atggacgagggtatccctcatctgcaggagaggcagctccttgagcacagagactttattggtctagactacagctctctgtatatgtgtaaacccaagagatcaatgaagagagatgatactaaggatacatacaaactgccgcataggcttatcgagaaaaaaaggcgagacagaatcaacgaatgcattgctcagcttaaagacttactgcccgaacacttaaagctgacgacccttggacatcttgaaaaagcagtggttctcgagttgaccctgaagcatcttaaggctctgaccgcgctgacagaacaacagcatcaaaaaatcatcgcactgcagaatggtgaacgttccctgaaatcacccatccagtccgatttggacgcatttcatagcggctttcagacctgcgctaaagaggtcttacagtatctgtctcggtttgaaagttggacaccgagagagcctaggtgtgtacagttaattaatcatctgcatgcggttgccacgcagttcctccctaccccacagctcctcacccagcaagtcccgctcagtaaaggcaccggggccccgtccgccgcaggttctgcagctgcgccctgccttgagagagccggccagaagcttgaacctttggcctactgtgtgccagtaattcagagaacccagccctcagccgagctggctgccgagaacgacaccgacactgattcgggatacggcggcgaggccgaagctcgcccagatagggagaagggaaagggcgctggtgcatctagggtcaccatcaagcaggaaccccctggtgaagactcacctgctccgaagagaatgaaactggactcccgcggtgggggctctgggggcggcccagggggaggagccgccgctgccgctgcagccctcctaggcccagatccagccgccgcagccgcactgctcaggccagatgctgcactcctgtctagcctagttgcattcgggggcgggggcggagctccattcccacagcccgccgctgcggccgcacctttctgcttacctttctgtttcctatctccttcagcagccgcagcctacgtccagcctttcctggataagagcggcctagagaagtacctgtatcccgccgccgcagctgcccccttccctctgttgtaccctggtatcccagcccccgcagcggcagccgcagcggcagctgctgccgctgcagccgcggcagcttttccctgtctttcgtcagtactcagccccccgcccgagaaggctggcgctgccgctgcaacgcttctgccacatgaagtcgcgccactaggcgcaccgcaccctcagcacccccatgggcgaacacacctgccatttgcaggccctcgagagcctggcaacccggagtcgagtgcccaggaagatccctcccagccgggaaaggaggcaccc

SEQ ID NO: 7775 - DNA, 1446 bp, Artificial Sequence
  Description of Artificial Sequence: Synthetic coding sequence
atggacgaaggaattccacatctgcaggagcgacagctgcttgaacatagagactttatcgggctggactacagctccctgtacatgtgtaaaccgaaacgctcgatgaagagagatgatactaaggacacttacaaactgcctcacaggctgattgagaagaaacggcgcgatcgcattaatgagtgtatagcacaactgaaggatcttctgccagagcatctcaagctgaccacccttggacatctcgagaaggcagtggtgttggagctcacgctgaagcacctgaaggcactgacggcactgactgaacagcagcaccagaagattatcgcattgcaaaatggagaacggagtctcaaaagccctattcaatcagatctcgacgcattccattctggttttcaaacctgcgccaaagaagtcctgcagtacctttcaagatttgaatcatggacccccagagagcctcgctgtgtgcaacttatcaaccacttgcatgccgtggccactcagttccttcctaccccgcagttgcttactcagcaagtgcctctgagcaaaggaaccggtgccccctccgcagcaggaagcgcagcggcaccctgcctggagcgtgcaggacaaaaacttgaaccactggcatactgtgtgccggtcatacaaaggacccaaccttccgccgagcttgcagcagaaaacgatactgacactgattcgggttacggaggcgaagccgaagcaagacccgatcgagaaaagggcaagggagcaggagcgagtcgagtcaccattaagcaggaacctcctggagaggattcgcctgcaccaaagaggatgaagctggactcgcggggtggagggtccgggggaggccccggcggaggggcagccgctgctgcagcggcacttctgggccctgatccagcagcagccgctgcacttcttcggccagatgccgcactccttagtagtcttgttgcatttggtggtggcgggggagccccttttccacaacctgcggcagcggcagctccgttctgtctccctttttgcttcctttccccttccgcggctgccgcctatgtgcaacctttccttgacaaatcaggtctggaaaagtacctctacccagcggcggcagctgcaccatttccacttctttaccccgggatcccagcgccagctgcggcggctgcagcggccgcagctgccgcggctgctgcagctgcgttcccatgtctctcatcggtcttgtcgcccccaccagagaaggcaggcgcggcggcggcaacgctgctgcctcacgaagtggccccacttggcgcgccacacccccagcatcctcatggtcgcactcatctgccgtttgcaggacccagggagccaggtaacccggaatcctcggcacaggaagatccctcacaacctggaaaagaagcaccg

SEQ ID NO: 7776 - DNA, 1446 bp, Artificial Sequence
  Description of Artificial Sequence: Synthetic coding sequence
atggacgagggtattccccatctgcaagagcggcagctgctggaacaccgggactttatcggcctcgactactcaagcctgtacatgtgcaagcctaagcgctccatgaagagagacgacactaaggacacctacaaactcccgcataggcttatcgaaaagaagcggagagatagaatcaatgagtgcatagcccagctgaaggatcttttgcctgagcacctcaagctcaccactcttggacatctggaaaaggctgtggtgctggaactgaccctcaagcatctgaaggccttgactgcactcactgaacagcaacatcagaaaatcatcgctctccagaacggagaaagatcactcaaatcgcctatccagagcgatctggatgcgttccactccggattccagacttgtgcaaaggaggtcctgcaatacctttctcggtttgagtcttggacccctcgggagccacgatgcgtgcagctgatcaaccaccttcacgccgtggctactcaattcttgcctaccccacagctgctgactcaacaggtcccgctgtcgaagggaaccggcgcgccctccgcggcaggctcggccgccgccccctgcttggagcgcgcgggtcagaaacttgaaccgctcgcatactgtgtccctgtgatccaaaggacccagccgtctgccgaactggccgctgaaaacgacactgataccgacagcggatacgggggtgaggcggaagccagaccagatagagaaaagggtaagggagccggcgcgtcccgcgtcacgatcaaacaggagccgcccggagaagatagcccggcgcccaagcggatgaaactggattcccgcggcgggggctcgggaggaggaccgggcggcggcgccgctgccgcggcggccgcactgctgggaccagaccctgcagcggcggccgcgctcttgcggccggacgccgcgctgctttcctctttggttgctttcggaggaggagggggtgccccgttcccgcaaccggcggcggcagccgccccattctgtctccccttttgtttcctttccccgtccgccgcggccgcatacgtgcaacctttcctggacaagtcaggtctggaaaagtatctgtacccagctgccgctgcagcccctttcccgcttctctaccccggcatcccggcacccgcagccgcagcagccgctgcagcagccgcggcggcagctgcagccgcgttcccgtgcctgtcgtccgtgctgagcccgccaccagagaaagccggtgctgccgctgctactctgctgccgcacgaagtggcccctctgggtgccccccacccccagcacccacatgggcgcacgcacttgcctttcgcgggaccgagggaaccgggaaatccggagtcgagcgcccaggaggacccttcgcaaccaggaaaagaagccccc

SEQ ID NO: 7777 - DNA, 1446 bp, Artificial Sequence
  Description of Artificial Sequence: Synthetic coding sequence
atggacgagggcatccctcatttacaggagaggcagctcctcgaacacagggacttcatcggcctagactatagttccctctacatgtgtaagcccaaacgcagcatgaaacgtgacgacaccaaggacacatacaaactaccccaccgccttatcgagaaaaagcggagagacaggatcaacgaatgtatcgcccagctgaaggacctccttccagaacacttgaaactgaccacccttgggcatctggagaaagccgtggtgctcgaactgacccttaaacacctgaaagcgctcaccgcactgactgagcagcagcaccagaaaataatcgcccttcagaatggagagaggtctctgaaaagtcccatccaaagtgacctggatgcattccactccgggttccaaacctgcgcgaaagaagtcctgcagtacctgagcaggttcgaaagttggactccaagggaacctcggtgcgtgcagcttatcaaccacttgcacgccgtggccacccaatttctgccaacccctcaactactcacgcagcaagtccccctttccaagggcactggggctccatctgcggctgggagtgccgccgctccatgtctggaacgcgctggacagaaactggagcccctagcttattgtgtgccggtcatccagcggacccagccgagcgcggagctggctgctgagaacgatacagacacagacagcggttacgggggtgaggccgaggcacggccagaccgggagaagggcaagggcgctggggcttccagggtcacaataaaacaggaaccacccggagaagactccccagccccgaaaagaatgaagctggacagtagaggcggaggatccggcggcgggcctgggggcggcgcggctgctgccgcagcagcactccttgggcctgatcccgctgctgcagcagccctcctacggcctgacgcagctctgctgagcagtctcgttgcctttggaggcgggggaggggccccctttcctcagcctgccgccgccgccgcgcccttctgcctgccattctgctttttaagcccatcggcagccgctgcctacgtgcagccattcctggataagtctggcctggaaaaatacttgtaccccgccgcagctgccgctccatttcccctgctgtatcccggaatccctgcacccgccgccgctgccgccgccgccgcagccgcagcggccgctgccgcagcctttccttgcctttcgtcagtgttatcacctcctcctgaaaaggctggtgccgcagctgcgacactgctgcctcatgaagtcgcccctcttggtgctccacaccctcaacacccgcatgggaggactcacctgccgttcgcgggaccacgtgagccaggcaatccggagagctcagctcaggaggatccctcccaaccgggcaaggaggcccct

SEQ ID NO: 7778 - DNA, 1446 bp, Artificial Sequence
  Description of Artificial Sequence: Synthetic coding sequence
atggacgaaggaatcccgcacctgcaagaacgtcagctcctggagcacagggactttatcggactggactacagcagcctttacatgtgcaagccaaaacgctccatgaaacgggatgataccaaagacacctacaagctcccgcatcggctcattgagaaaaaacggcgcgaccgaatcaatgagtgtatcgcgcagctgaaagacctcctgccggaacatctgaagctgacgaccctgggacacctggagaaagcagtcgtgctggaactgactctgaagcaccttaaggcactgaccgctctcaccgaacaacagcatcagaaaatcattgcgctgcagaacggagaacgctcgctgaagagccccatccagtcggacctggacgcctttcactcgggattccagacctgcgccaaggaggtgctgcaatacctgtccagatttgaatcatggaccccgcgagaacccaggtgtgtgcagctgatcaaccaccttcacgctgtggccactcaattcctcccgacgcctcagctgctcactcaacaggtcccgttgagcaaggggaccggagccccgagcgcagccggctcagccgctgcgccgtgcctggagcgcgcaggccaaaaactggaacccctggcttactgcgtaccggtcatccagaggactcaaccgtccgccgaactggccgcagagaacgacaccgataccgactcgggatatggaggcgaagcggaagcccgacccgatcgcgagaagggaaaaggagccggagcctcccgcgtgactatcaagcaagagccgccgggggaagattcaccggctcccaagagaatgaagctggactccagaggtggaggatcgggcggaggacctggcggcggtgctgccgccgcggcagctgctctgctggggccggaccccgcagcagcggcggcgctgctgcggccggacgccgccctgctgtcaagtttggtggcgttcgggggtggaggaggagcaccattcccgcaaccagctgctgccgcggcaccattctgtctgccgttctgctttttgtccccgagcgcggcggccgcatacgttcagccgtttctcgacaagtccggcctggaaaagtacctgtacccagctgccgcagcggcgccttttcctctgctgtacccgggaatcccggcgcccgcagcagcagctgcggcagcagcagcggccgccgcagccgccgcagctttcccttgtctctcatcagtgctcagccctccaccggagaaagccggagcggcggccgccactctgctgccccatgaagtggccccgttgggcgccccacatccacagcaccctcacggccggacgcacttgccgttcgccggaccacgtgagccgggaaatccagaatcgtccgcccaggaggacccttcgcagcctggaaaggaagcccca

SEQ ID NO: 7779 - DNA, 1446 bp, Artificial Sequence
  Description of Artificial Sequence: Synthetic coding sequence
atggatgagggcataccgcacctgcaagaaagacagctcttggagcatcgagatttcatcggtcttgactatagcagcttgtacatgtgtaaacctaagcgcagcatgaaacgggacgacacaaaggatacatacaaactgccccacaggttgatcgagaagaagcggcgcgatagaattaacgagtgcatcgctcagctgaaagacctcctgcctgaacaccttaaactcacaaccctcggtcatctcgaaaaggctgtagttctggagcttacactgaagcacctgaaagccttgaccgcactcaccgagcagcagcaccagaagattatcgccctgcagaacggggaaagatctctgaagtcccccatccagagcgacctggacgcatttcactccggttttcagacttgtgccaaggaggtgctgcaatatctctcaagattcgagagttggacacctagagaaccaaggtgcgtccagctcattaaccaccttcatgccgttgctactcagttcctcccaactccacaattgctgacacagcaagtaccacttagcaaagggacaggagccccatctgctgcagggagcgcggcagctccatgcctggaaagagccggacaaaaactggaacctctcgcttactgtgtccccgtcatacaacgcacccagccatcagccgagcttgctgccgaaaacgacaccgataccgatagcggttacggaggcgaagccgaggcacgcccagatagggagaaaggcaagggagctggcgccagtcgcgtcactatcaagcaggagccgccaggggaggattcacccgccccaaagcggatgaaactcgacagtcgggggggaggatctggaggaggacctggcggaggggcagccgcagccgctgctgcgttactcggaccagatcccgctgccgctgctgcactcctccggcctgacgctgcccttctgagttccctggtcgcttttggcggcggaggaggcgccccatttccgcaacctgctgccgcggcagcccccttttgccttcccttttgctttttaagtccctccgctgctgccgcgtacgtacaaccatttttggacaaatcgggactggaaaaatacctgtacccggctgccgcagctgctcctttccctctcctttacccgggaatacctgcccccgcagctgccgctgctgccgctgcggctgctgccgctgccgccgctgctttcccctgtttgtctagcgtcttatcccctccccccgaaaaagctggcgccgcagcggcaaccctgctgcctcatgaggtggctccccttggagccccacacccacagcacccccatggcaggacccaccttccttttgccgggccgagagagccaggtaaccctgagtcctcagctcaggaggatcctagtcagccaggaaaggaggctccg

SEQ ID NO: 7780 - DNA, 1446 bp, Artificial Sequence
  Description of Artificial Sequence: Synthetic coding sequence
atggacgagggcatcccacatttacaagagcgtcagcttctggagcatcgcgacttcattgggctggattattcctctctctatatgtgtaagcccaagagatcaatgaaacgtgacgacacaaaggatacatacaaattacctcatcgcctgatcgagaaaaagcgtagggaccggatcaacgaatgcatcgcacagttgaaggatcttctgccggagcacctaaagcttactacccttggtcacctcgagaaggcggtggtgttggagttgacactgaagcatctcaaagcgctaactgctttaacagagcaacagcatcaaaaaatcatagcgctgcaaaatggagagcgatccctgaagagccctattcagtcagatctagatgcttttcattccggtttccaaacctgcgcaaaagaggtgttgcaatatttgtctcgtttcgagtcttggactccgagggagccacggtgcgtacaattgattaaccaccttcacgccgtcgctacgcagttcttgccgaccccgcagctattgactcagcaagtgccactgtccaaaggaaccggtgctccttccgcggcgggtagtgccgccgctccctgccttgaacgcgccggacagaaattggagcctctcgcctattgcgtgccggtcatacagcgtacccagccgtctgcagagctggcagcagaaaacgacaccgatactgattctggttacggcggcgaagcagaggcccgtcctgatcgagaaaagggtaaaggtgctggggcgagccgggtgaccatcaaacaggaacctcctggggaggattctccggccccgaagcgcatgaaactggactcgaggggtggtggtagcggtggcggccctggcgggggggcagcagcagcagccgccgcgttactcgggccagatcctgctgccgctgccgcgctgctacgacccgatgccgccctcctctcaagtctagtagccttcggaggaggagggggggcgccgttcccacagcctgctgctgctgcagctccgttttgccttccattttgctttctttccccttcagctgctgcagcatacgttcaaccgttcctagacaagagcggacttgagaagtatctctatccggctgcagccgcagctcccttccctcttctttaccctggaattccagcccccgcagctgctgccgccgcggccgcagctgcagcagctgccgccgccgcttttccttgcctgagctcggttcttagccccccgccggaaaaggccggtgctgcagccgcaacgctgctgccccatgaggttgcaccgctaggggcgcctcatccacaacatcctcacggacgtacacatttgcccttcgcaggtccccgagagcccggcaatcctgaatcgtctgcccaagaggatccttctcaaccggggaaagaggccccc

SEQ ID NO: 7781 - DNA, 1446 bp, Artificial Sequence; identical to SEQ ID NO: 7756
  Description of Artificial Sequence: Synthetic coding sequence

SEQ ID NO: 7782 - DNA, 1446 bp, Artificial Sequence
  Description of Artificial Sequence: Synthetic coding sequence
atggatgagggcatacctcacctgcaggaaaggcaacttctcgagcatagggacttcattggactggactactccagcttatacatgtgtaagcctaagaggtccatgaagcgggatgatacaaaggatacttacaagctaccacaccgcctaatagagaagaaacggcgggataggatcaatgagtgcatcgcccaattgaaggacctcctgcctgaacaccttaagctcactaccttggggcacctggaaaaggcagtggtgctcgagctcaccctcaagcacctgaaagcactgactgcgctcacagagcagcaacatcaaaagataatagccctgcagaacggtgagcgttctctcaagtcacctatccagtctgatctggatgcgtttcacagcgggttccagacatgtgccaaagaggtgctgcagtatctgtcccgttttgagtcctggacccctcgggagccccggtgcgttcagctgatcaatcaccttcacgccgtagccacccagttcctgcccaccccccagctgctaacgcagcaagtgcccctatccaaagggacaggtgctccctctgctgcaggttctgctgcggccccctgtcttgaacgggctggtcagaaactcgagccgctggcctactgcgtgcccgtcatccagcggacccaaccatctgcggaactcgccgctgaaaatgacacagataccgattccgggtacggtggcgaagctgaagcgagaccagatcgggaaaaaggcaaaggtgccggagcctccagagtgacaattaaacaggagcctccgggtgaggacagcccggccccaaagagaatgaagctagatagcagaggaggcgggtctggaggcggacctggaggaggcgccgccgctgcagctgctgcgctcctggggcctgaccctgctgccgccgctgcactgctgcgaccggacgccgccctactaagttcccttgtggccttcgggggaggcggaggagcgccgttccctcagccagcggccgccgctgcccctttttgccttccgttttgcttccttagcccgtctgcggccgcagcttacgtacaaccatttctcgataagtctgggctggaaaagtatctgtatcctgctgcagccgccgcccctttccccctgctctaccctggcatccccgccccggccgccgcagctgccgctgccgccgctgctgctgcagcagccgctgcattcccctgcctgagtagcgtgttgtccccacctcccgagaaagctggagccgcagcggcgaccctcctgccccatgaggttgctccactcggagctccccacccacagcacccccacggcaggactcacctgcctttcgcaggacccagagaacccgggaaccccgagagctctgcccaggaggatccctcgcagcccggcaaggaggcacct

SEQ ID NO: 7783 - DNA, 1446 bp, Artificial Sequence
  Description of Artificial Sequence: Synthetic coding sequence
atggacgaaggaattccacatcttcaggagcggcagttgctggagcacagggacttcatcggattggattactcttccctctacatgtgcaaaccgaagagatccatgaagcgggatgacaccaaggatacttacaaactccctcacagactgatcgaaaagaagaggcgagacaggatcaacgaatgcatcgctcaactgaaggacctgctgcctgaacacctgaagctgactactctcgggcatttggagaaagctgtcgtgctggagctgaccctgaagcatctgaaggctctgaccgcactgactgagcagcaacatcagaagatcatcgctttgcagaacggagaacgatctctgaaatcgccaatccaatcggatctcgacgcgttccactcgggattccaaacttgcgccaaagaggtgctgcagtacctgtcccggttcgagtcgtggaccccgcgggaacctagatgcgtgcagcttatcaatcaccttcacgctgtggccacgcaattcttgccgactccgcagttgctcactcagcaggtgccgctgtccaaggggaccggtgctccgtccgcagccggtagcgccgcggccccatgtctggagcgcgcaggacagaaactcgagcctctcgcgtactgcgtgccggttatccagcggacccagccatccgccgaactcgccgcagaaaacgataccgataccgatagcggctacggtggggaagcggaggctagaccggatcgggaaaagggcaagggagcgggcgccagccgcgtgaccatcaagcaagaaccaccgggagaggattcccctgctccgaaacggatgaaactcgattcaagaggcgggggatcaggaggaggaccaggaggaggcgcggccgcagctgctgcagcattgttgggaccggatccggcagcggcggcggcactgcttcggcctgacgccgcgctgctgtcgtcgctcgtggcgttcggcggtggagggggtgccccgtttccgcagccggcagctgcggctgcaccgttttgcctgcctttctgctttctgtcgccatccgcagccgcagcctacgtgcaacccttcctggacaagtcgggactggaaaagtacttgtacccggccgccgcggcagcgccgttccccctgctgtacccgggaatcccagcgcccgccgccgcagcggccgcggcggcagcggccgcagcagctgccgcagctttcccatgcctgtccagcgtgctgtccccaccgccggagaaggcgggagctgcagccgcgaccctgctcccgcatgaagttgcacctctcggtgcacctcatccccagcatccacacggacggactcatctgccatttgctggacctcgggaaccaggcaatccggaatcaagcgcgcaggaggacccgtcccagcccggaaaagaagcacca

SEQ ID NO: 7784 - DNA, 1446 bp, Artificial Sequence
  Description of Artificial Sequence: Synthetic coding sequence
atggatgaagggattccgcatctccaagagcggcagctgctggagcatagggattttataggactcgactactccagtctatatatgtgcaagccaaaacgtagcatgaagcgtgatgacaccaaagatacctataagcttcctcaccgcctgatcgaaaagaagcgtcgagaccggatcaatgagtgcatcgcacagttgaaagatttgctgcccgagcacctgaaactgactaccctagggcatttggaaaaggcagtggtcctggagctgactttgaagcacctaaaagcattgacggcactgaccgagcagcaacaccagaagattattgctctgcagaatggtgagcggagcctcaagtctcccattcagagcgacctcgacgctttccattcagggtttcagacctgcgcgaaggaggtgctgcagtatctgtctaggtttgaatcttggacaccacgcgaacctcgctgcgttcaattgattaatcatttgcatgcggttgccacccagttccttcctacaccgcaactactgacacagcaggttccactctcgaaaggtactggtgctccgagcgcagccggctcggccgctgccccctgcttggaaagagctggccagaaacttgaacccctggcctactgtgtgcctgtcatccaacggacccagccctctgcagagctggccgccgaaaatgataccgacaccgattctggttacggtggtgaagccgaagcccgcccggatcgggagaaggggaagggcgctggcgcaagccgcgtgactatcaaacaagagccccctggggaagattctccagctcccaagagaatgaaactggactctaggggcggcggatctgggggcggacccggagggggagccgccgccgctgcagccgcactgctgggcccagaccctgcagcagcggcggcactgctgaggccggacgcagccctgctctcttcattggttgcttttggaggtggcgggggagcaccattcccacagcccgcggctgctgcagcccctttctgtttgccattctgtttcctctcacctagcgccgccgccgcatacgtgcaaccttttttggataagagcggcttggaaaagtatctatacccggccgcagccgcggccccattccctctcctctaccctggaattcccgccccagccgcggctgccgctgccgcggcagctgctgccgcagctgccgctgcattcccttgcctgtcgtctgttttgtcgccgccacccgagaaagccggagccgccgctgcaactttgctcccccacgaggtggccccacttggagcaccgcatccgcaacaccctcacggcagaacgcatctgcccttcgccggtccgagagaaccgggtaatccagagagctcagcacaggaagacccgtctcaaccagggaaggaggcccct

SEQ ID NO: 7785 - DNA, 1446 bp, Artificial Sequence
  Description of Artificial Sequence: Synthetic coding sequence
atggacgaagggataccacatctgcaggaaagacagctccttgagcacagagactttattggtctggattatagctcgctctacatgtgtaagcctaagcggtccatgaagagagatgatactaaggacacctacaagctccctcacaggctcatcgagaaaaaacgccgtgaccggattaacgaatgtatcgcacaactgaaagatctcctccccgaacacctgaagctgaccaccttggggcacctggaaaaggcagtggtgctggagcttactcttaaacatcttaaggcactgaccgcacttaccgagcaacaacatcaaaagataattgcccttcagaatggggaaagaagccttaagagccctattcaatcggacctggatgcattccattcgggattccagacctgtgcgaaggaagtcctgcaatacctttcgagattcgagtcgtggaccccacgagaacctcgctgtgtccaactgatcaaccatctgcacgcggtcgcaactcagtttcttcctacccctcagctgctgacccaacaggtgcctctctccaaagggaccggagcaccctccgctgcggggtcggcagcagcaccgtgtcttgaacgggcaggacagaaacttgaacctctcgcatactgcgtgcctgtgatccaacgaacgcaaccttctgctgaactggccgcagaaaacgataccgacaccgattcgggatacggcggcgaagccgaggcaagaccagatagggaaaagggcaagggtgccggtgcctccagggtgaccattaaacaggaaccaccaggagaggattcgcctgcccctaagcggatgaaacttgattccaggggagggggatcgggaggtggaccaggaggcggggccgcggcggcggccgcagccttgctcggtccagatccagcggctgctgcggccctcctgcgccccgacgcagccctgctgagctcactggtggcatttgggggagggggtggtgcaccattcccacagcccgccgctgcagcagcgcccttctgtctcccattctgttttctctcaccttcggcagccgcagcatacgtgcaaccttttctggataagtcgggacttgaaaagtacctttaccccgcagccgccgcggcgccattccctctgctgtaccctggtattcctgcgccagccgcagcggcagcagcggctgcagcggccgccgcagccgcagctgcatttccttgtctgtcctcagtgctgtcaccaccacccgagaaggctggggccgcagccgcgacgcttctgcctcatgaagtggccccactgggggcaccacatccgcaacatccccatggaaggacccatctcccgtttgcagggcccagggagcctggaaaccctgaatcgtcggcacaagaagatccaagccagcccggtaaagaagcacct

SEQ ID NO: 7786 - DNA, 1446 bp, Artificial Sequence
  Description of Artificial Sequence: Synthetic coding sequence
atggatgagggtataccacatcttcaagaaagacaactcctcgaacacagagacttcatcgggctggactactcatccctgtacatgtgtaagcccaagcgctcgatgaagagagatgatactaaggatacctacaagctgccccatcgacttattgagaaaaagcggagagacagaattaacgagtgtattgcacaacttaaggatctcctgccagaacatcttaaactcaccaccctggggcacctcgaaaaagcagtggtgctggagcttactctcaaacacctcaaggcactgactgcacttaccgagcagcagcatcaaaagattatagcgcttcaaaatggagagagatcgctcaagtcgcctattcagtccgatcttgatgcctttcacagtggctttcagacttgtgcgaaggaagttctgcaatacctgtccaggtttgaatcatggaccccgcgggaaccaagatgtgtgcagctcatcaaccatctccacgccgtggcaacccaattccttcctactcctcaacttctgactcagcaagtcccactctcgaagggaactggagcaccatcggcagctggatccgcagccgcaccctgtcttgagcgggcgggtcaaaaactcgagcccctcgcatactgtgtcccggtgatccaacgcacccaaccatcagctgaactggctgccgaaaacgacactgatactgacagcggttacggaggtgaggcagaagctcggccagacagagaaaagggaaagggggcgggggcatcccgagtcaccattaagcaggaaccacccggcgaagattcaccggcccctaagagaatgaaacttgattcgcgcggaggaggatccggcggaggaccaggtggcggagccgctgctgcggcagcggccctgcttggcccagaccctgcagccgccgcagcgcttcttcgtcctgacgccgcactcctctcctcgctcgtggcctttggtggtggcggtggcgcaccttttccacagcctgccgcagcggcagcaccgttctgtctccctttttgctttctgagcccgtcagcggccgcagcatacgtgcagccatttctcgataagtcgggactggaaaagtacctttaccctgccgctgcagccgcccctttccctctgctgtatccggggataccagcgccagcggcagcagcagccgccgccgctgccgccgcagcagccgcagctgctttcccttgtctttcgtccgtgctgtcaccaccaccggagaaggcaggagcggcggccgctactcttctgccccatgaggtcgcaccactgggagcaccgcatccacagcatccccatggtcggacccacctgccatttgcagggccacgtgaaccaggtaatccagaatcgtcggctcaggaagatccttcacaaccaggtaaggaagcacct

SEQ ID NO: 7787 - DNA, 1446 bp, Artificial Sequence
  Description of Artificial Sequence: Synthetic coding sequence
atggacgaaggtattccacatttgcaggaacgccagttgctcgaacatagagatttcattggattggattattctagtctgtacatgtgcaaaccaaagaggtcgatgaagcgagatgatactaaggacacttacaagttgcctcataggttgatcgaaaaaaagagacgggatcgaattaacgaatgtatcgcacaattgaaggatttgttaccagaacatctcaagctaacgactctgggacacttagagaaggcagttgtgttggagcttacactaaaacacctgaaagccttgactgcactcactgagcaacaacaccagaaaattattgctcttcagaatggagaacgatcgcttaaatccccaatccaatcagatcttgatgcttttcactcgggattccaaacatgtgcaaaagaggttctccaatatctttcgagattcgagtcatggactccgagagaaccgagatgtgtgcaacttattaatcacctgcatgcagtagctacacaatttctgccgactccgcaacttcttacacaacaagtccccctctccaagggaacaggagcaccatcggcggctgggagtgcggcagcaccctgtctagagcgagccggacagaagctggagccacttgcctattgtgtgccagttattcaacgaactcaaccatctgctgaattggcagcggagaatgataccgacactgatagtggatacggaggcgaagcggaagcacgtcctgaccgagaaaagggaaagggagcgggagcctcacgagtcaccatcaagcaggaaccgcctggtgaggatagtccagctccaaaacgtatgaagttggactcaagaggaggaggatcgggagggggacctggaggaggagcagcagcagcagctgcagccttattggggccagacccggctgctgcggctgcactgctgcgtccagacgcggccttattgagtagcttggttgcattcggtggaggtggaggagccccatttccgcaaccagccgctgctgccgccccattctgcttacccttttgctttctgagtccatccgcggcagctgcttacgttcaacctttcttggacaaaagtggtctagaaaaatatctgtacccggccgcagcggcagctcctttcccgttactctacccaggcattccagcaccagctgctgccgcggctgcagcagctgcagccgctgctgctgctgcagcctttccctgtctctccagtgttttatcacccccgccagaaaaagcaggtgcagcagcagcaactttgcttcctcatgaagtagccccactcggtgctccacacccacaacatccacatgggagaacgcatcttccttttgctggtccacgggaaccaggaaacccagaatcctcagcccaagaggatccgtcgcaaccaggaaaagaagctcca

SEQ ID NO: 7788 - DNA, 1446 bp, Artificial Sequence
  Description of Artificial Sequence: Synthetic coding sequence
atggacgagggaattccacatctgcaggagcgacagctgctcgagcaccgggacttcatcggacttgattactcgtcactttacatgtgtaagcctaagaggagtatgaaaagggatgacactaaggacacctacaagctcccgcaccgtcttatagaaaagaagagaagagacagaattaacgagtgtatcgcacaactgaaggatctccttcccgaacaccttaagctgactaccctggggcatctcgaaaaggctgtggtccttgaactcactcttaagcatctcaaggccctgactgctctgacggagcagcaacatcagaagattattgcgcttcaaaatggagaacggtcattgaagtcacctattcaatcggatcttgatgctttccattccgggtttcagacctgcgctaaagaagtccttcagtatctgtcgcgatttgaatcgtggactccaagagaacccagatgtgtgcagctcattaatcatctccatgccgtggcaacccagtttctgcccactccacagttgctcactcagcaggtgcctttgtcgaagggaactggtgcgccatctgcggcgggatccgctgcggctccgtgcctggaacgcgcaggacaaaagctggaacctctcgcgtactgtgtgcctgtgatacagagaacccaaccatccgccgaacttgcagcagaaaacgacacggatactgacagcggttacggtggggaagctgaggctcgcccggacagggagaagggtaagggtgcgggcgcaagccgggtcacgatcaaacaagaacctccaggggaggattcacctgcacctaaacggatgaaactggattcgaggggtgggggatcaggcggaggtccgggtggaggcgctgcagcagcggcggcagcgctgcttggaccggatccagcggctgcggcagcactcttgaggcctgatgccgcacttctgtcctcactggtggctttcggtggtggtggaggagccccgtttccacagccggcggcagccgcggcacctttttgtctcccattctgctttctgtcgccttccgccgccgccgcctacgtgcaaccgtttttggataaaagcggacttgagaagtacctctaccctgcagcagctgccgccccatttcctcttctgtaccctggaatcccagcaccagcggcggctgcagctgcggctgctgcggcagcggccgccgcggcagcctttccttgtttgagctcggtcctttcaccccctccggagaaagcaggagcagcagcagcgacccttttgccccatgaggtggcacctctgggagcaccacacccccaacatcctcacggacgtacgcaccttccatttgccggcccccgcgagccaggcaaccctgaatcctcggcacaagaagatccttcccagcccggtaaagaagcccct

SEQ ID NO: 7789 - DNA, 1446 bp, Artificial Sequence
  Description of Artificial Sequence: Synthetic coding sequence
atggacgagggcattcctcacctgcaggagaggcagctcttggagcaccgcgactttatcggtttggactactcctctctgtacatgtgtaaaccgaaaaggagtatgaagcgcgacgacacgaaggatacctacaagttgcctcataggcttatcgaaaagaagaggagagacaggatcaatgagtgcatagcccaactgaaggatctgctccccgagcacctgaagcttactaccctcggtcaccttgaaaaggccgtcgtcctggaattgaccctgaaacatctgaaggcattgacagctcttacagagcagcagcaccagaaaatcattgcgctccaaaacggtgagaggtccctgaaatctcctattcagtccgatctcgatgccttccactctggttttcaaacctgcgccaaggaggttttgcaatatttgagccgctttgagtcctggactccccgcgagccccgctgcgtacagttgatcaatcatctgcacgccgtcgccactcagtttctgcctacgccccagctccttacgcagcaagtccccctctccaagggcactggagctcccagtgccgctggaagtgccgcagccccttgcctggagagagccggacaaaagttggagccacttgcatactgcgtgccagtgattcagaggacgcagccctccgccgagctggcggctgagaatgacaccgacactgactccggatacggtggtgaagccgaagcccgccctgacagagagaaaggcaagggagccggagctagccgcgttactattaagcaagaacctcccggtgaggacagtccagctcctaagaggatgaaattggattcacgcggcggtggatccggtggcggaccaggcggcggcgctgcagccgccgccgccgcgctgctgggtccagatccggccgccgcggccgcactgctgaggcccgacgctgccttgctgtcttctttggttgcctttggaggaggtggtggcgcaccgttcccgcagccagcggcggccgccgcaccattctgtctgccattctgttttctctctccaagtgccgccgctgcctacgtacaaccctttctggataaatccggcctggaaaagtacctctaccctgctgcagcagcagcaccattcccactcctctatcccggaattcctgctccagccgcagctgccgccgcggctgcagcggcggctgcagccgcggctgcctttccctgcctgtcatccgtgctgtctccgcctccggaaaaggctggtgctgccgccgctaccctcctcccacacgaggttgccccgcttggagcgccacaccctcaacatccccatggaagaactcatctccctttcgcgggaccaagggagcccggcaacccagagagttccgcgcaggaggaccccagccaaccaggaaaggaggccccc

SEQ ID NO: 7790 - DNA, 1446 bp, Artificial Sequence
  Description of Artificial Sequence: Synthetic coding sequence
atggatgaaggaatacctcatctgcaggaaagacagttgttggaacaccgggattttatcggtctcgattactcctccctgtacatgtgtaagcccaaaaggtctatgaagcgcgatgataccaaggacacatataagctacctcacagactgatcgagaaaaagcgccgtgacaggatcaacgaatgcatcgcccagcttaaggacctgttgcccgaacacttgaaattaaccactcttggccatctggagaaggcagtggtgctagagctgacactcaagcatctgaaggcactaactgctttgaccgagcagcaacatcagaaaattatcgctctgcagaatggcgagcggagcctgaagagtcccatccagtctgacttggacgccttccatagcggtttccagacctgcgctaaagaagtgctgcagtacttatctcggttcgaatcgtggacgcccagagagccgcgctgtgtccagcttattaaccacttgcacgcagttgcgactcagtttttgcccacccctcagctgctgactcagcaggttcctctgagtaaaggaactggtgctcctagtgcagctggctccgctgccgccccatgcttggaacgggcagggcaaaagcttgagcccctggcctactgtgtgccagttatccaacgaacacagccgtctgctgagttggccgcggaaaatgacacggataccgactccggctatggtggggaagccgaggcaaggccagatcgggagaaagggaagggggcaggcgcatctagagtaacgatcaagcaagagcctccaggggaggatagcccagcacccaaacggatgaaattagactcacggggaggcggatccggaggaggcccaggtggtggtgccgcggcagctgctgctgccctactgggcccagacccggcggccgctgccgccctgttgaggcccgatgctgccttgctctcaagtctggtggcatttggagggggaggcggcgctcctttccctcaacccgcagcagctgctgcacctttctgcctgccattttgcttcttatctccctcagcagctgcggcctacgttcagcccttcctggacaagagtggccttgagaagtatctgtaccctgcagccgccgccgctccctttcctctgctttatcccggcattccagcccctgctgcagccgccgccgctgccgctgctgctgccgcagctgcggcagccttcccttgcctgtccagtgtccttagtcctccacctgagaaggcgggcgcggctgcggctactctactgcctcatgaggtggcgcccctcggcgcacctcacccccagcatcctcacggacgcactcacctgccatttgccggcccccgtgagccaggtaacccagaatcctctgcacaggaggacccaagccagccaggtaaggaagcccca

SEQ ID NO: 7791 - DNA, 1446 bp, Artificial Sequence
  Description of Artificial Sequence: Synthetic coding sequence
atggacgaaggcattcctcatctgcaagagaggcagctgctggaacatcgagattttattggactcgattactcttctctctacatgtgtaaacctaaacggtctatgaaaagagatgacacaaaggacacctacaaactgccacatcgtctaattgaaaagaaacggagagatagaatcaacgagtgtatcgcccagcttaaagatcttctccccgagcacttgaaactcacaaccttaggccacctggagaaggcagtggtgctggaactcacactgaaacatctgaaagcactgacagcactgactgagcaacaacatcagaagatcatcgcgttacagaacggtgagcggtcacttaaatctcccatccagtccgatcttgacgccttccactcagggttccagacttgcgccaaagaagtgcttcagtatctgagccgctttgaaagttggaccccccgggagccaaggtgtgtccagctcattaaccacctccatgctgtggccactcagtttctaccaaccccccagttgctgacacagcaggtccctctatcaaagggcacgggtgccccgagcgctgccgggtctgcggccgccccctgtcttgagcgggcaggtcaaaaactggagccgctagcctactgcgtcccagttatccagcgaacccaaccttccgccgagctggccgcagaaaatgacaccgacacagatagtggctatggtggcgaggccgaagcccggccagacagagagaagggaaagggtgctggcgcatctcgagtgacgatcaagcaggaaccaccgggagaggactcgcccgctcctaaaaggatgaagcttgattctagagggggcggctctggaggaggcccgggcgggggtgccgccgcggctgccgcagccttgctcgggccagacccggccgccgctgccgctctcctgaggcctgacgccgccctcttatcttccctggtggcgttcggtggcggtggtggtgccccctttccacagcctgccgcagccgctgctcccttctgtctcccattctgcttcctctcaccttcggctgctgccgcgtacgtacagccatttctggacaagtcggggctggaaaaatatctgtaccccgcggcagctgctgcccctttccctctcttataccctggaatacccgctccggctgcggctgcagctgcagcagctgctgcggccgctgctgctgctgcctttccttgccttagttcggtgctgagcccccctccagagaaagctggagccgccgccgctacactcctgccgcatgaggtggcacccctgggagcaccgcacccgcagcatccacacgggagaacacatctgccattcgcgggcccaagggaacctgggaatccagagagctcggcccaggaagatccctctcagcccgggaaggaagccccc

SEQ ID NO: 7792 - DNA, 1446 bp, Artificial Sequence
  Description of Artificial Sequence: Synthetic coding sequence
atggacgaagggattccgcatcttcaggaaagacagctgctggagcaccgcgactttatcggcttggattactccagtctgtatatgtgcaagcccaaacggtcgatgaagagagatgacactaaagatacttacaagttgcctcataggcttattgaaaagaagcgacgcgatcgtattaacgagtgcatcgcacaactgaaggatctgctgcctgaacatctgaaactcaccactcttggacacctcgaaaaggctgtggttctggagttgactcttaagcatctgaaggcccttaccgcactcactgaacagcaacatcaaaagataatagctcttcagaatggggaacgctccctgaaatcacctatccagtccgaccttgatgctttccattccggttttcagacttgtgcgaaggaagttcttcaataccttagcaggttcgagagctggacgcccagagaacctaggtgtgtgcaactgataaatcacctgcacgcagtcgcaacccaattcctgccaactccccagctccttactcagcaggtgcctttgtccaagggaacgggggctccttcggcagccggatccgctgccgcaccttgtctggagcgcgctggacaaaaacttgagccactggcatactgtgtgcctgtgatacaacgaacccaaccatctgcggaacttgcagcggagaacgataccgacactgactccggctacggcggtgaagccgaggcccggccggatagagaaaagggaaaaggagcaggcgcaagccgggtgaccattaagcaagaacctcccggagaggattcgccagcccctaaaaggatgaaattggattcccgtgggggaggatctgggggtggaccaggaggaggagcggcggcagccgccgcggctctcctgggaccagatcctgccgctgcagctgcgctgcttcggcccgacgcagctcttcttagctcgctggtggccttcggaggcggaggaggtgcaccgtttcctcagccagcggcggccgcagcacctttttgtctgcctttttgttttctctcgccgtcggcagcagcggcatacgtgcaaccattccttgacaagtcgggactcgaaaagtacttgtaccccgcggccgctgcggccccatttcctctcctctaccccggcatccccgcaccagcagctgccgcggccgccgcggcagcagcagccgcagctgctgctgctttcccatgtctttcttcagtccttagcccgccacctgagaaggcaggtgcagccgcagccaccctgcttcctcacgaggtcgcaccgctcggggccccacacccacaacatccccatggacgcacccatctgccttttgcagggccccgcgagcctggaaatccagaatcatcagctcaagaagatccgagtcaacctggcaaagaagcaccc

SEQ ID NO: 7793 - DNA, 1446 bp, Artificial Sequence
  Description of Artificial Sequence: Synthetic coding sequence
atggacgaaggcatcccgcatctgcaggagcggcagcttctcgaacaccgggatttcatcggcctggattattcgagcctgtatatgtgcaagcctaagcgctcgatgaaaagggacgatactaaagacacttacaagctcccccaccggctcattgaaaagaagcggcgtgatcgcatcaatgaatgtatcgctcagctgaaggatttgctgccagaacaccttaagctgactactctgggacacttggagaaagccgtggtcctggaactcactctgaaacacctcaaagcactgacggcgctgacggagcagcagcatcagaaaatcattgcactgcagaacggagagagatcgctcaagtcaccgatccagtcggacttggacgcatttcattcgggcttccaaacctgcgccaaggaagtgttgcaatacttgtcaaggttcgaatcctggactcctcgggagccgagatgcgtgcagctgattaaccatttgcatgcagtggcaactcagtttctgcctacccctcaactcttgacgcaacaagtgccgctgtccaaaggtaccggggccccgagcgcggcgggtagcgcggcagccccgtgccttgagcgcgccggccaaaaactggagccattggcgtactgtgtcccggtgatccagcggacccagccgtcggcggaactggcagctgaaaacgacaccgacaccgattcgggatacgggggagaagccgaagccaggccggaccgcgaaaaggggaagggtgctggggcctcccgcgtgactataaagcaagaacctccgggcgaggactcaccagcacctaagcgcatgaagctggattcgcgaggcggggggagcggagggggacctgggggcggggctgcagccgctgcggcagccctgctcggtccagacccagccgcggccgcagccctgctgcggccagatgctgctctcctgtcatcactcgtcgctttcgggggaggaggaggggccccattcccgcagccagcagcggcagccgctccattctgcctgcctttctgcttcctgagcccttcggctgcggctgcatacgtacagcccttccttgataagtcaggactggagaagtacctgtatcctgcagcagcagcagcgccatttccgctgttgtaccccggaatcccagcaccggccgccgctgccgccgctgctgccgcggccgctgcagcagcggccgcatttccatgtctcagctccgtgctctccccgccgccggaaaaggcaggagccgctgccgcaaccctgttgccccacgaagtcgcgccgctcggagcaccgcacccccaacacccgcatggacggacccaccttccgttcgcggggccccgggagccaggaaacccagagtcatctgcgcaggaggacccttcccaaccaggaaaggaagcccca

SEQ ID NO: 7794 - DNA, 1446 bp, Artificial Sequence
  Description of Artificial Sequence: Synthetic coding sequence
atggacgaggggatcccacatctccaggagagacagctgttggagcacagggactttatcggtttggattactcgtcactctacatgtgtaagcctaaaagatcgatgaagagggatgataccaaagatacctacaagctgccgcacagactcatcgaaaagaaacgtcgagatagaatcaatgaatgcattgcgcaactgaaggatctcttgcctgaacatcttaagctcacgacccttggccacctggagaaggcagtcgtgcttgaacttactcttaaacaccttaaggcactcaccgcactgactgaacaacagcaccaaaagataattgcgctgcagaacggtgaacgatcacttaagagcccaatacagtcggatctggacgcattccactcgggatttcaaacctgtgctaaagaggtgttgcagtatctttcccggtttgagtcatggactcctcgtgaaccaagatgcgtgcagcttatcaatcacctgcatgcggtcgcaactcagtttttgccgactcctcagctcctgactcaacaagttcccctttccaagggaactggcgcaccttcggcagcaggttcagcagcagcaccttgtcttgaacgagcagggcaaaagctcgagcctctcgcttattgtgtgccagtgattcagcgaacccagccttcagctgagttggcagcagaaaacgataccgacaccgattcgggatatggtggtgaagccgaagcacgcccagatagggagaaggggaagggggcaggagcgtcccgagtcaccattaagcaagaaccacctggtgaagattcgccagcaccaaagcgcatgaagctcgactcccggggtggaggttcgggtggcggacctggcggtggtgcagccgccgccgcggcagccctccttggaccagacccggccgctgcggctgcgcttctgaggcctgacgcagcactcctgtcctcactggtggcatttggcggagggggaggagcaccctttcctcagccagccgctgccgccgcccctttttgtctgcctttctgcttccttagtccctcagcggcggcagcctacgtgcaaccctttcttgataaatcgggtcttgaaaagtacctttaccctgccgccgcagcggcaccatttcccctgctgtacccaggtattccagcaccggcagccgctgcggccgcggcagcggccgcagcagctgccgctgcagcgtttccatgcctttcctccgtgctttccccacctccggagaaggctggagcagccgcggcaaccctcctgccacatgaagtggcccccctcggtgcaccacatccgcagcatcctcatggtcggactcatctccctttcgcaggtccacgggaaccgggtaacccggaatcgtctgctcaggaggacccttcacaacccggcaaagaagcaccg

SEQ ID NO: 7795 - DNA, 1446 bp, Artificial Sequence
  Description of Artificial Sequence: Synthetic coding sequence
atggatgagggaattcctcatttacaagagcggcagctgttagagcaccgcgacttcatcggactcgattacagttcattgtatatgtgcaagccaaaacgatccatgaagcgcgatgatactaaggacacgtacaagctcccccaccggctaatcgaaaaaaagaggagagatcgtataaatgagtgcattgcccaattgaaggacttgttgcctgagcaccttaaattaactacactgggacaccttgagaaggccgtggtactggagctgacgctaaagcacctgaaggcactgaccgccctgactgagcagcaacatcagaagataatcgcgctccagaatggcgagcggagcctcaagtcccccatccagagtgacctggatgccttccatagtggttttcagacctgcgcaaaggaggtgctgcaatatctgagccgcttcgaatcctggacgcccagagagccacgttgcgttcagcttatcaaccacctgcacgcagtggccacgcaattccttccgaccccgcagcttctgactcaacaggtccccctgtccaagggcacaggtgccccatccgctgctggctccgctgcagctccctgcctggagcgcgccggccagaagctggaaccgctggcgtattgcgtgcccgtgatccagcggacccagccgagcgctgagctggctgccgagaatgataccgatacagattcgggctatggtggtgaagcggaggctagacccgatagagagaagggcaagggagcaggagcttcgcgggttaccataaagcaggagcctcccggcgaggactctccagcgccgaagaggatgaaacttgattcccgcggcggcggcagcgggggcgggccaggaggaggcgccgctgccgctgcggctgccttactgggccccgatccagccgctgctgccgcactcctacgtccggacgccgctctgctgagctccttggttgcctttggtggaggaggcggcgcccctttccctcagcctgccgcagctgccgcccccttctgcctgccgttttgttttctgagcccctctgctgctgccgcgtacgtacagccctttttagataagagcggactggagaaatacctgtaccctgctgctgcggcggctccgttccccctcctgtacccggggataccagcccctgccgcagcggcggcagcggcggccgccgcagccgctgccgcggcggccttcccctgcctctcctccgtgctgagcccgcctccggaaaaggccggagccgcagctgcaacacttttgccccatgaggttgccccccttggtgctccgcatccccagcaccctcatggccgcacccatctccccttcgccggcccccgtgaaccgggcaaccccgagtcgtcggcgcaagaggacccaagccaaccaggaaaggaagcaccc

SEQ ID NO: 7796 - DNA, 1446 bp, Artificial Sequence
  Description of Artificial Sequence: Synthetic coding sequence
atggatgaaggtatcccgcatctgcaggagcgtcagctcctggaacaccgcgatttcatcggccttgactactcgtccctctacatgtgcaagcccaagcgttctatgaagagagatgatactaaggacacttataagcttccgcaccgcctcatcgagaaaaagcgccgtgaccgtatcaacgagtgcatcgcccaattgaaagatctactacccgagcacctgaagctcaccactctgggccatttggagaaggctgttgtgctcgagttgaccctaaagcaccttaaggccctcaccgcccttacggaacaacagcatcagaagatcatcgctctacagaacggtgagcgctccctaaagtcccccattcagtcggatcttgacgctttccattccggcttccaaacgtgtgctaaagaggttttgcagtatctgtcccgatttgagtcttggactccacgcgagccgcgttgcgtccagttgataaaccacctacatgcggttgccactcagtttcttcccactccacaactgctcacccaacaggttccgctcagcaagggtaccggcgccccgagtgctgcgggctccgccgccgctccctgtttagaacgcgcgggtcagaaactcgagccactcgcgtactgcgttccggtgatccagcgcactcagccgtccgctgagctggcggctgagaacgacaccgataccgacagtggatatggaggtgaggcagaggcccgtcccgaccgggagaagggaaagggagcgggtgccagcagagttacgattaagcaggagcctcccggtgaggattccccggctcccaagcgtatgaagctcgacagccgtggcggcggttcgggcggaggtcccggaggcggagcagcagccgcagccgcagccctgctggggccggatccggcggctgcagccgccttgctccgtcccgatgccgcgctgctgtcgtctctcgtggcttttggcggtgggggcggggctcccttcccccagcccgctgccgctgccgctccgttctgtctacctttctgcttcttgtctcccagtgccgcggcagcctacgtacaacctttcctggacaaatccgggctggaaaagtatttgtaccccgctgccgctgcggccccgttccccctgctgtaccctggaattccggcacccgccgcggcagcagctgccgcagcggccgctgccgcggctgctgccgccttcccctgtctgagctcagtgttgagcccgcccccggagaaggctggtgctgccgccgccaccctgctgccgcacgaggtcgcccccctgggagccccccatccccagcacccccacggtcgaacccacctacccttcgcaggtcctcgcgagcctgggaaccctgagtcaagcgcgcaggaggatccctcccagcccggcaaggaggcacct

SEQ ID NO: 7797 - DNA, 1446 bp, Artificial Sequence
  Description of Artificial Sequence: Synthetic coding sequence
atggacgaaggaatcccacacctacaggaacggcagttgctcgagcaccgagactttattggattagactactccagcctgtatatgtgtaagccaaagcggtccatgaaacgggatgacacaaaggacacatataagttacctcacaggctgatcgagaaaaagcgcagggatcgtatcaacgagtgcatcgcacagctcaaagacctgttacccgaacatctcaagctaacaaccctgggacatctggaaaaggctgtagtcctcgagttgacgctgaagcacctcaaggcactgacagccctcacggaacagcagcatcagaaaatcatcgctctccaaaacggagagcggagtttaaagagtccgatccagagcgacctggatgcctttcatagtggttttcagacatgcgcgaaggaggtcctgcagtacctgtccaggtttgaatcatggaccccccgggaaccacggtgtgtgcagctcattaaccatctgcatgccgtggctacacagttcctccccaccccacaactgctgacccagcaggttccccttagtaagggcactggcgctccaagtgcggcaggcagcgccgccgctccttgcttagagcgcgctggccagaagttagagcccctggcatactgcgtcccggtgattcagcgcacacagccatctgctgagttggcggctgagaacgacacggataccgattcgggatatggtggtgaagccgaagcaagacccgacagggaaaaaggaaagggagctggcgcgtcccgcgttaccattaaacaagaacccccgggagaggactctcccgcacccaagcggatgaaattagactcacgaggcggagggtccggaggcggtccaggaggaggagccgccgcagccgcggctgccctgctgggtccagatcctgctgcagccgcggctctgctgcgacccgacgcagctttgttgagtagcctcgtggctttcggggggggtggcggagccccatttccacagccagcggccgccgccgccccattctgtctcccgttttgctttctctcgccctcagccgctgcagcttatgtccaaccattcctggataagagtggcctcgagaaatacctttacccagccgcagcagccgcgcctttcccgctgctgtaccccggcatcccagcccctgctgctgcagccgccgctgcagccgcggccgccgccgctgccgcagcatttccatgcctcagttcggtcctctccccacctccagagaaggccggagccgctgcggctactctgctgccgcatgaggtggcaccgctgggagccccacatccccagcacccacacggtagaacacatctgccgttcgctggcccccgggagcctgggaaccccgagtcctcagcccaagaggacccatcccagcctggaaaggaggctcct

SEQ ID NO: 7798 - DNA, 1446 bp, Artificial Sequence
  Description of Artificial Sequence: Synthetic coding sequence
atggatgaagggatcccccatctccaggaacgccagctcttagaacatcgggatttcattggactggattactcttccctgtacatgtgcaaaccaaaacggtcaatgaaaagagatgatacaaaagatacatataaactcccccatcggctgatcgaaaaaaaaaggagagacagaatcaatgaatgcatcgctcagcttaaagatctactcccagaacaccttaaactcactacactgggacacttggaaaaagcggtagtgttggagttaactctcaaacatttgaaagctctgactgccctcactgaacagcagcaccagaagattatcgctttacagaacggagagcgctctcttaaatcaccaattcagagtgacctggatgccttccattctggattccagacgtgcgctaaagaagttcttcagtatttgtccagattcgaatcatggacacctagggaaccaaggtgtgttcaactgataaatcacctccacgctgtagccactcagttccttcccactcctcagctcctgacacagcaggtcccccttagtaaaggaactggggccccctctgcggcaggaagtgctgctgcaccttgcttagaacgggccgggcagaaactggaaccactcgcctactgtgtacctgtcatacagaggacacagccttcggctgaattagccgcggaaaatgatactgatactgattccggatacgggggggaggccgaagccaggcctgacagggaaaaaggaaaaggggcaggggcctcccgcgtcactattaagcaagaaccacccggagaagattctcccgcacctaagcggatgaagctagatagtcgcggagggggaagtggaggagggcctgggggaggagccgctgccgcggccgccgccctcctcgggccagatccagctgctgcagcggccctactgcggcccgacgctgcactgctttcgtccctggtcgccttcggaggaggggggggagctccctttccccagcccgccgcagccgcagcccctttctgccttccattctgttttctatcaccatctgctgcagcagcttacgtgcagcctttcttagataaatctggactcgagaaatacctctaccccgcagccgccgctgcccccttccctctgctctatcccggaatacctgcccctgctgcagcagctgcagctgccgctgctgcagccgcagctgctgcagctttcccctgtctcagttcagtcctgtccccaccccccgaaaaagcaggagcagccgcagccactctgctgccccatgaggtagctccccttggagccccccaccctcagcacccccacgggcgaactcatctgccttttgccgggcccagggagccaggaaaccctgagtcatctgcacaggaggatccatctcagcctggaaaagaagctcct

SEQ ID NO: 7799 - DNA, 1446 bp, Artificial Sequence
  Description of Artificial Sequence: Synthetic coding sequence
atggatgagggaataccacacctacaggagcgccagctcctcgagcaccgagattttattggcctggattactcctccctatatatgtgtaaaccgaagcggtctatgaaacgcgacgatactaaagatacatacaaattgccccataggcttatcgaaaaaaaacggcgcgaccgaattaatgaatgtatagcccaattgaaggacctgctgcccgaacacctgaaattaactacactgggacatctcgaaaaggctgtggttcttgagttgactctgaagcacctgaaggctcttactgcactgactgagcagcagcatcagaagataatagctttgcaaaacggagagcgcagtttgaagtcccccatccagagcgacctcgatgcgttccacagtggttttcagacgtgcgctaaagaggtcctgcagtacttgtccagatttgagagctggacaccacgtgaaccgcgctgcgttcagctgattaatcatttgcatgcagtagctactcagtttctgccgacacctcagctcctgactcagcaggtgccattgagcaaaggcaccggcgcgcctagtgccgccggtagtgcagccgcaccttgtttggagagagcaggccaaaagctggaacccctcgcctattgcgtaccagtgatccaacgcacgcagccctcagctgaactggccgcagaaaacgataccgacaccgatagcggctatggcggggaggcagaggcgaggcctgaccgcgaaaagggtaagggcgccggtgcctccagagtgaccatcaagcaggagcctcccggcgaagacagcccagcccctaagcgaatgaaactggatagccgaggaggcgggtctggcggcggccccggcggtggagccgcagcagccgccgcagcgctcctaggaccggatcccgctgcggctgccgccctcctgcgtccagacgctgctttactgagctcactggtcgctttcgggggaggtgggggcgcacctttccctcaaccagctgctgccgcagcgcccttttgtctccccttttgctttctgtcaccctctgccgctgcagcatacgtgcagccgttcctcgataagtcaggccttgaaaagtatctctatcccgccgctgcggccgcaccatttcctcttctgtaccctggaatccccgctcctgccgccgcggcagcggccgctgccgcagccgccgccgccgcagcagccttcccatgtctctcctcagtactttcacctccgcctgagaaagccggggccgctgccgcaacattactcccccacgaagttgcacctctgggagcccctcatcctcagcacccccacgggaggacgcaccttccctttgccgggcctcgcgaacctggtaacccagagtccagtgcacaggaggaccctagccagcccggcaaggaagcgccc

SEQ ID NO: 7800 - DNA, 1446 bp, Artificial Sequence
  Description of Artificial Sequence: Synthetic coding sequence
atggacgagggaatacctcatttgcaggaaaggcagctgttggagcatcgggatttcatagggctggactacagctctctgtatatgtgcaagcctaaacgtagtatgaagcgagatgataccaaggatacctacaaactaccgcaccggctgatcgagaagaagcggagggaccgcattaacgagtgcatagctcagctgaaggatctgctgcctgagcatctgaagctgactacgctcggtcacttggagaaggcagtggtgctggagctcacactgaagcacctcaaagctttgactgctctgaccgagcagcagcatcagaagatcatcgccctgcagaatggcgagcgcagcctgaagagcccaattcagagcgacctcgacgctttccacagcggtttccaaacttgcgccaaagaggtcctgcaatatctatctcgctttgaaagctggacgccccgcgagcctcgctgcgtacagctaatcaaccatctgcacgcagttgccactcagtttctaccgaccccccagctcttgacccagcaggtaccactgagcaagggcactggcgctccgtctgcggcaggaagcgccgctgccccatgcttggaacgggccggtcagaaactggaaccgttggcctactgcgtgcccgtaatacagagaacccagccatctgccgaactggccgccgaaaacgacaccgatactgactccggatacggaggcgaggccgaagctaggccagaccgtgaaaaaggcaaaggagcgggggcttctagggtgacgatcaaacaagagcccccaggggaggattcccccgcgccgaagaggatgaagttggactcaaggggaggaggatccgggggaggacctggtggcggagccgccgctgcagctgccgccctgctgggacccgacccagctgccgccgccgctctgctgagacccgacgccgctctgttaagttcattagtcgcatttggaggcgggggcggggcaccatttccccagccagctgccgccgccgctcctttctgtttgccattttgttttcttagccctagcgctgctgcggcttacgtgcagccattcctggacaagagcggtttggagaagtacctgtaccctgctgccgcagcggccccctttccactgctgtacccaggtatacccgctcccgctgccgccgctgccgccgctgcagccgccgctgcagctgcagccgcatttccctgcctctccagcgtcctgtcccccccacccgagaaagctggagccgcagcggccacactgctccctcatgaagtggcaccactaggcgccccccatccccagcacccccacggcaggacgcacttgccattcgccgggccacgtgaaccaggcaacccagagagtagtgcccaagaagatcctagccagcccggaaaggaagcacct

SEQ ID NO: 7801 - DNA, 1446 bp, Artificial Sequence
  Description of Artificial Sequence: Synthetic coding sequence
atggacgaaggcattcctcacctgcaagagcggcaacttcttgaacaccgcgattttatcgggctcgattactcttcactttatatgtgcaaacccaaaagatctatgaaaagggatgatacaaaagatacctataagctgccacatagattaatcgagaagaaaagaagagacagaattaatgaatgcattgctcagctgaaggatttattgccagaacaccttaaactaacaacactcgggcatcttgagaaggcagtggttttagagcttactcttaagcacttaaaggctcttaccgccctgacagaacaacagcaccagaagattattgcacttcaaaatggcgaacgtagtcttaagtccccaattcaatcagatttagatgctttccactcaggctttcagacatgcgccaaagaggtgctccaatatctcagccgcttcgaatcatggacccctcgcgaacctaggtgtgtgcagctcatcaaccaccttcacgctgttgctacccaattcttgccaacgccccagttattgacccaacaagttccattatcaaagggcactggcgccccttccgctgctgggtccgctgctgcgccctgtctggagcgcgcgggtcagaaattagagccacttgcatattgtgtacccgttatacaaagaacacagccttccgccgagttggctgcggagaatgatacagatacagattccggctatgggggagaggctgaggctcgccctgacagggaaaaaggtaagggtgctggtgcgagcagggttacaattaagcaggagccaccaggggaggattctccagcccctaaacgtatgaagctagacagcaggggtggtgggtcaggggggggcccaggaggcggcgcagcagccgcagcagcagcattgcttgggccagatccggcggctgcagctgctctattgcgtccggacgctgccttgctctctagccttgttgcttttggtggcggtggtggtgcccctttcccacagcctgccgcggctgctgctcccttctgtttgccattttgctttttatcaccatctgctgcagctgcatatgtccagccattcctggataaaagtggattggagaagtacttataccccgcggctgcagccgctcctttcccacttttgtatcctggcattcctgcacctgccgctgccgctgcagcggcagctgccgcggctgcagctgcagcggcgttcccgtgtttaagtagtgtattgtctcctcctcctgagaaagctggagcagctgctgctacactacttccgcacgaggtggcacctcttggagctcctcaccctcaacacccacacggaaggacccatctaccattcgctggcccaagagagcctggaaatccagagtcgtcagctcaagaggatccgagccaacccggtaaagaggcacct

SEQ ID NO: 7802 - DNA, 1446 bp, Artificial Sequence
  Description of Artificial Sequence: Synthetic coding sequence
atggatgaaggcattccacacctgcaagaaagacaacttctcgaacatagagacttcattgggctggactactcttctctgtacatgtgtaagcctaagcgctcaatgaagcgcgatgataccaaggatacgtacaaactgccgcacagactcattgaaaagaagaggcgggacagaatcaacgaatgtatcgcacaacttaaggatctgctgccagagcacctgaagctgactactctggggcatcttgaaaaggccgtggtcctcgaactcacccttaagcatctcaaggccctcaccgccctgactgaacaacaacatcaaaagattatcgcactgcagaacggtgaaagatcgcttaaatcccctattcaaagtgatcttgacgcattccactccggtttccagacttgtgcaaaggaggtgcttcaatacctgagcaggttcgaatcttggaccccacgcgagcctcggtgcgtccaactgataaatcacctgcatgcggtggcgacccagtttctgcccactccacagctcctcacccaacaggtgcctctttcgaaagggaccggagcaccatcagccgcgggaagcgcggcagcaccatgccttgaacgagcggggcagaagctggaaccacttgcatactgtgtccctgtgatccagagaactcaaccatcagccgagctcgcagcagagaacgataccgacactgactcagggtacggaggagaggccgaagcacgtcctgatcgggagaagggcaagggagccggagcatcacgcgtgacgattaaacaggagccacctggtgaagattcgcctgcgccaaagagaatgaagctggactccaggggaggcggatcagggggtggtccaggaggtggggctgcggcggccgctgccgcactgcttggacctgatccggcggcagccgccgcgcttctgcgtcccgatgcagccctgctttcatcgctcgtggctttcgggggtgggggaggtgcaccattccctcagcccgcagcagctgcagctcctttctgtctgccattttgtttcctgtcgcctagcgcggctgcagcgtacgtgcaacctttccttgacaagtcggggctcgagaagtacctctatcctgctgccgccgccgctccttttccacttctgtacccaggaattcccgccccagccgcagccgctgccgccgcagcagcagcagcggccgcggcagctgcatttccctgtcttagctcagtgctgtccccaccccctgagaaagcgggagcggccgcagcaacccttcttccccatgaagtggcaccattgggcgcaccacatccccaacaccctcacggacgcacccatcttcctttcgcaggtccgagagaaccaggtaaccctgagtcgtccgcccaggaagatccctcgcagccaggaaaggaagcacca

SEQ ID NO: 7803 - DNA, 1446 bp, Artificial Sequence
  Description of Artificial Sequence: Synthetic coding sequence
atggacgagggcattcctcatctgcaggagcgacagctgctggagcatcgggatttcattggtctggattacagtagcctttacatgtgcaaaccaaagagatccatgaaacgagacgatacaaaggatacttataaactgcctcaccgcctgattgagaagaagcgaagagatcgcattaatgagtgcatcgctcagttgaaggatcttctccccgagcatcttaagctgacaacactgggccacctcgagaaagccgtcgtgcttgagttgactctgaaacacctcaaagcccttaccgcactgaccgaacagcaacaccagaaaataattgcacttcaaaacggagaaaggtccctgaagagccctattcaaagcgaccttgacgcttttcacagtggcttccagacttgcgccaaggaagtgctgcaatatctttctcgcttcgaatcatggacacctagggagccgaggtgcgtccagttaatcaatcatctgcatgccgtggcaacacagtttctccctacaccccagttgcttactcagcaggtacctctctctaagggaaccggcgccccatctgccgccgggtcagcagccgctccgtgtttggaacgcgcaggccaaaagttggagcctttggcttattgcgtcccagtgatccaaaggacacagccttctgcggaactggccgccgaaaatgataccgacactgacagtggttacggcggcgaagctgaagctaggcccgatagggagaagggaaaaggtgcaggcgcatcccgcgtgaccatcaaacaagagccaccaggcgaggatagcccagcgcctaaacgcatgaaattggactctagaggcggcggaagcggcgggggtcccggggggggggccgcggccgctgctgcagcacttctgggccctgaccccgcggcggccgccgcgttgttgaggcccgatgccgctctgctgagcagcctggtcgcttttgggggcggaggaggtgctcctttccctcaacctgctgctgcggcagcccctttttgcctgcctttctgctttctgagcccctcagctgctgcagcatacgtgcaaccatttctggacaaaagcggactcgagaaatacctgtaccctgcggccgccgccgctccctttcctttactgtacccaggtatcccagcaccggcagcggcggctgccgccgccgctgcagccgctgccgcagctgcagcgtttccttgtctgtcctccgtgttgtccccaccaccagagaaagcaggagccgcagccgccacactcctcccccatgaagtagcccctctgggggccccccacccccagcacccgcacggcaggacccaccttccattcgccggtcctagggagccgggaaatcctgaatcctctgcacaggaggatccttcccaacccggtaaagaggccccc

SEQ ID NO: 7804 - DNA, 1446 bp, Artificial Sequence
  Description of Artificial Sequence: Synthetic coding sequence
atggatgagggaatcccccatctgcaggaacggcagctcctcgaacaccgagactttatcggtctggattactcgtcactgtacatgtgcaagccgaagcggtcgatgaaacgggacgacaccaaagacacctacaagctgcctcatcgccttatcgaaaagaaacgccgcgaccggatcaacgagtgcatcgcccagctgaaggatctcctgcctgagcacctgaaactcactactctgggacatctggaaaaggctgtggtgttggaacttactctgaagcacctcaaggcgctgactgcgttgactgaacagcaacaccaaaagattatcgccctgcaaaacggagaaagatcgctgaaatccccaatacagtccgacctggatgcgttccattcaggattccagacttgtgccaaggaagtgctccagtacctgagccgcttcgagtcatggactccgagagaaccacggtgtgtccagctcatcaaccaccttcatgctgtcgccactcaattcctgcccactccacaactccttacccagcaggtgccactctccaagggaactggtgcgccatccgccgccggatccgccgcggctccatgccttgagagagccggacaaaagttggaaccactggcatactgcgtcccggtgatccagcgcacccaacccagcgcggagctcgcagccgaaaacgacacggacacggacagcggctacggaggtgaggccgaagccaggccggatcgggaaaaaggaaagggagcgggagcgtcaagagtgacgatcaagcaagaacctcccggtgaagatagcccggccccgaagcggatgaagctggactcgcgcggcggaggaagcggtggaggacccgggggcggtgcggcagcagccgctgcagcactcttgggaccagatccggcggccgcggctgcactcctgcggccggacgccgccctgttgtcgagcctcgtggcgttcggagggggcggaggtgcgccgtttccgcaacctgcggccgccgctgcaccgttctgcctgccattctgttttctttcgccatcagccgcggcggcatacgttcaaccattcctggataaatcggggctggagaaatacctgtatcctgccgccgccgccgcgccgttccctttgctgtacccgggcatccctgctcccgcagcggccgcagccgcagcggcagcggcggcggctgccgcggcggccttcccttgtctttcatccgtgctgtcaccgccgcctgagaaggccggagctgcggccgccaccctcctgccgcatgaggtcgcaccgctgggcgcccctcacccacagcaccctcacggaagaacccatcttcctttcgccggaccgcgggaaccggggaacccggaatcatcggcacaggaggaccctagccaaccggggaaggaggcaccg

SEQ ID NO: 7805 - DNA, 1446 bp, Artificial Sequence
  Description of Artificial Sequence: Synthetic coding sequence
atggacgaaggaatcccgcacctgcaggaacggcagctcctggaacatcgcgactttatcgggctggactactccagcctgtacatgtgcaagcctaaacgcagtatgaagagggacgataccaaggatacttacaaactgccacaccggctcatcgagaaaaagaggagagacagaatcaacgaatgtatcgcacagttgaaggaccttctgccggaacacctgaaactcaccactttgggtcacctcgaaaaggccgtcgtgctcgagttgaccctcaaacaccttaaggctctgactgccctcaccgaacaacagcatcagaagatcatcgcactgcagaacggagagcggagcctcaagtccccgattcagtccgatctggacgcttttcattcgggatttcagacctgtgctaaggaagtgcttcaatacctgtccagattcgagtcctggaccccaagagaaccgcgctgcgtgcaacttatcaaccaccttcatgccgtggctacccaattcctgcccacgccgcagctgctgacccagcaagtccccctgtcgaagggaacgggagcaccctccgccgcaggttccgctgcggcaccgtgtctcgagcgggctggacaaaagctggaacccctggcttactgcgtcccagtgatccaacgcacgcagccatcagccgaactcgctgcggagaacgacactgatactgactcgggatacggcggcgaagccgaagctagaccggacagagaaaagggaaagggcgctggagcttcacgcgtcaccatcaagcaagagccaccgggagaagattccccggccccgaagcgcatgaaacttgattcacgcggtggagggtctggaggaggacctgggggaggggcagccgcagcagccgccgcattgctgggacctgatcctgctgctgccgccgcactgctgcggccggacgcggcactgctctcttcacttgtggctttcggaggaggcggaggagcaccattcccgcaacccgccgcggccgccgcccctttctgtctgcctttttgcttcctgagcccaagcgcggcggctgcgtacgtgcaaccgttccttgacaagtcaggactcgaaaagtacctctacccggctgcggcagctgcgccgttcccactgctgtacccgggtatcccggccccggccgccgctgcggcggccgcagcggccgccgcggctgccgccgcggcctttccgtgtctgagcagcgtgctcagccccccacccgaaaaggccggcgcggcggcggcaactctgctgccccacgaggtggccccactcggagcgccgcaccctcagcatccgcatggaaggacccacctgccatttgctgggccacgggaaccgggaaaccctgaatcctcggcacaggaggatccgtcgcaacccggaaaagaagcccca

SEQ ID NO: 7806 - DNA, 1446 bp, Artificial Sequence
  Description of Artificial Sequence: Synthetic coding sequence
atggatgaaggaattcctcacctgcaagagagacagcttctggaacatagggactttatcggtctggactactcgagtctctacatgtgtaaaccaaagcgatcgatgaagagagatgacaccaaggatacttacaaacttcctcatcggctgattgagaagaaacggagagacagaatcaacgagtgtattgcacaattgaaggatctgctcccggaacatctgaagctgactactttgggacatctcgaaaaggcagtggtcctcgaacttaccctcaagcatctcaaggcgctgaccgccctgaccgaacagcagcatcagaagataatcgctcttcagaatggagaaagatccctgaaatcgcccattcaatcggatctcgatgcattccactccggatttcagacttgcgcaaaagaagttctccagtaccttagccggtttgaatcgtggaccccacgcgaacccagatgcgtgcagcttatcaatcacctgcacgcagtggcaactcagtttcttccaaccccccagcttttgactcagcaagtgccccttagcaaagggacgggagcaccctccgccgctggatcagcagcagcgccgtgtctggaaagagcagggcaaaagctggaaccactggcatactgcgtgccagtaattcagcgcacccaaccctccgctgaacttgcagctgaaaacgataccgacaccgattcgggatacggcggtgaagcagaggcaaggccggacagggaaaaaggaaaaggtgctggggcctcgagagtgactataaagcaggagcctccaggggaagattcaccagcccctaaaaggatgaaacttgattctcgtggaggcggttcaggaggtggacctggcggtggggctgcagctgcggcagccgcacttcttgggcctgatcctgcggcagctgcagcactgctgcgacctgacgcagctcttctgtctagccttgtcgccttcggcggcggaggcggagcacctttccctcaacctgcggccgccgcagcacctttttgtctgcccttttgcttcctgagcccaagcgcggcggcagcatacgtgcagccattccttgataaaagcggtcttgagaagtacttgtaccccgcagcggcggcggcgccatttcctcttctgtacccagggatcccagcccctgcagccgctgcggcggctgcagcagcagccgcagcagccgccgctgcatttccttgccttagctcagttttgtccccacctcctgagaaggcaggagccgcagcggcgacccttctgcctcatgaggtggcccctcttggggctcctcacccgcagcatcctcacggaaggactcacctcccatttgcaggtccaagggaaccaggcaaccctgaatcgtccgcccaagaggacccatcgcaaccgggcaaggaagcaccc

SEQ ID NO: 7807 - DNA, 1446 bp, Artificial Sequence
  Description of Artificial Sequence: Synthetic coding sequence
atggacgaagggatccctcacttgcaggagcgacagttgctcgagcaccgagatttcataggcttagattattcgtccctgtacatgtgcaaacccaaacgaagcatgaagagggacgataccaaggatacatataagcttccccaccgactgattgaaaaaaagagaagagacagaattaacgagtgtattgcccagcttaaggacctgctgcctgagcacttgaagcttactacactggggcatctcgagaaagctgtggttctagagttgacattgaaacacctgaaagctctaacggctctgacggagcagcaacaccagaagataatcgccctccaaaatggcgagcgatcattgaagagccctatccaatctgacctggatgcatttcattccgggtttcagacctgcgctaaggaggttttgcagtaccttagccgattcgagtcttggactccccgcgaaccacggtgcgtgcaactcatcaatcatctgcatgccgtggccacccagtttttgcccacacctcagcttctgacgcagcaagtcccactgtctaaaggcaccggcgccccttccgctgccgggtctgctgctgccccctgccttgaaagggccgggcagaagctggaaccactggcctattgcgtgccagtgattcagagaacccagcctagcgctgagctcgcggcagaaaatgacacggacacggatagcgggtatgggggcgaagccgaagccaggccagatagagagaagggaaagggtgccggcgcatcaagagttactatcaaacaggaacctcctggggaagactccccagctccaaagcgaatgaaactggattccagaggagggggatcaggcggaggcccaggaggaggcgccgctgcggcagcagcagcactcttgggaccagaccctgcagcggcagccgccctgctgagaccagatgcagcactgctgtcatctttggtcgcattcggcgggggggggggagcgccttttcctcagcctgcggcagcggccgcacctttctgcctgcctttctgcttcttaagcccctccgccgcggcagcctacgtccaacctttcttggataagtctggacttgagaagtacctataccctgcggcggcggccgctccattccctttgctctatcccggcatacccgcccccgccgctgccgcagctgctgccgcggctgctgcagcggcggctgcggcttttccatgtcttagctcagttctgtctccaccccctgaaaaagctggagcggccgccgcaaccttactgccccacgaggtagcgccactcggagccccccatcctcagcacccgcatgggcggactcacctaccatttgctggtcctagggagccagggaaccccgaaagtagtgcccaggaagaccccagccagccaggcaaagaggccccc

SEQ ID NO: 7808 - DNA, 1446 bp, Artificial Sequence
  Description of Artificial Sequence: Synthetic coding sequence
atggatgaaggaatccctcacttacaagagagacagctgctggaacacagagattttataggcctggactattcctctctgtatatgtgtaagcctaagcgttcaatgaagcgggacgacactaaagatacatacaaactgcctcaccggttgatagagaagaagagaagagacaggatcaacgagtgtattgcccaattgaaggatctgcttccggaacatctcaaactgaccactctgggacacctcgagaaagctgtggtgttagagttaacgctaaagcacctcaaagcactcacagctctgaccgaacagcagcatcagaagatcatagcgctccagaatggcgagcggtctctcaaaagcccaatacaatccgatctggacgcattccactccggctttcaaacctgtgcaaaagaggttctccaatacctgagccgattcgaatcttggacccctcgagagcctaggtgcgtgcaactgatcaatcaccttcacgccgttgcaacccaattcctaccgacgccacagctactcacacagcaggttcccctgtccaaggggaccggtgcacctagcgccgctgggtccgctgctgccccctgcctcgagagggccggacagaagttggaaccgttggcgtactgtgtgcccgttatccaacgcacgcagcctagcgccgaattagctgccgaaaacgacacagataccgactcgggctacggaggcgaggcagaagcccgacccgatcgggaaaagggaaagggcgctggggccagccgggtgacaataaagcaagaacctcccggagaagactcccccgcaccaaagcgaatgaaattggactctaggggaggcgggtctggtgggggcccaggaggcggcgccgccgccgccgctgccgctctgttggggcccgaccccgcagctgccgctgcacttctccgtccagacgccgcgctgctctcttccctagtggcattcggtgggggtggaggagcgccctttccccaacctgccgcagctgccgcacccttctgtctgccattctgtttcctgtccccatcagccgccgccgcctatgtgcaacccttcctcgacaagagtgggctggaaaaatacctgtacccagcagccgctgccgcaccatttcccctgctgtaccccgggatacctgcgccggcagctgcagcagctgccgcagcggccgccgctgctgcagcagcggcctttccatgtttatccagcgtgcttagccccccgcccgaaaaagctggagccgctgctgctacgctgctgccccacgaagtagcaccactaggcgcccctcatcctcagcaccctcatgggcgtactcatttacccttcgcgggaccccgcgaaccgggcaacccagaaagctccgcgcaggaagaccctagccagcccggaaaagaggcgcct

SEQ ID NO: 7809 - DNA, 1446 bp, Artificial Sequence
  Description of Artificial Sequence: Synthetic coding sequence
atggacgaaggcatcccccacctgcaggagcggcagctcctggagcaccgggacttcatcggtctggactactcgagcctgtacatgtgtaagccgaagcggtccatgaagagagacgataccaaggatacttacaaactgccacaccggctgattgaaaagaagaggagagatcgcatcaacgagtgcatcgcccagctgaaagatctcttgccagaacatctgaaattgactaccctcggacatctggaaaaagcggtggtgctggaactgaccttgaagcacctgaaggcgctcaccgcgctgaccgagcagcagcatcagaagatcatcgctttgcagaatggcgaacggtcacttaaatccccgatccaaagcgatctggacgcatttcactctggcttccagacctgcgccaaagaggtgctccagtacctcagccggtttgagtcatggaccccccgagaaccgaggtgcgtccaactgatcaaccatcttcacgccgtggcaacccagttcctcccgacgccgcagttgctgactcaacaagtgccgttgtcgaagggaactggggcaccttccgcagccggctcggccgccgccccatgcctggaacgcgcgggacagaagctcgagccattggcatactgtgtgcctgtcatccagcggactcagccatcggcggaactggcagccgaaaacgacactgatactgacagcggatacggtggggaagcggaggctcgcccggaccgggaaaaggggaagggagcgggagctagccgcgtcactatcaaacaggaaccaccgggggaggatagcccagcaccaaagcggatgaaacttgacagccgcgggggtggcagcgggggagggccgggtggaggcgccgcagcggcagccgcagcactgctggggccagatcctgctgcggcggcagcccttctgcgcccggacgccgccctgctgtcgtcccttgtggcatttggaggagggggaggggcaccattcccgcagcctgccgccgctgcagccccgttctgcctgccgttttgcttcctgtcgccttccgcggcggctgcgtacgtccagccgttcctggacaagtcaggattggagaagtacctgtacccagccgccgccgccgcaccgtttcccctgctctaccctggcataccagccccagcagcggcagcagcagccgcggcggcggccgcagccgctgctgcggcctttccttgtctcagctcggtgttgagcccgcccccggaaaaggccggggcggcagctgccaccctgctgcctcacgaagtggcaccattgggtgcgccacatccgcagcatccccacggacgcacgcatctgccgtttgcgggaccgagagagccgggcaatcccgaatcatcggctcaagaggacccttcgcagcctggaaaggaggccccg

SEQ ID NO: 7810 - DNA, 1446 bp, Artificial Sequence
  Description of Artificial Sequence: Synthetic coding sequence
atggatgagggcatcccgcacttgcaagagcgccaactgctcgagcatcgagatttcatcggcctggactatagcagcttgtacatgtgtaagcctaaacgctcaatgaagcgggacgataccaaagacacttacaagctcccgcacagattgatcgaaaagaagagaagagacagaatcaatgaatgcatagcacagctcaaggacctgctgccggaacacctgaagctgactaccctcggacacctggaaaaggcggtggtcctggaactcacccttaagcatcttaaggccctgactgccctgactgagcagcaacatcaaaagattatcgcgctgcagaatggagagcgctcccttaaaagcccaatccagagcgatctcgacgctttccactcaggatttcagacctgcgcgaaagaggtgcttcagtacctctcgagattcgagagctggaccccgcgcgaacctcgctgcgtccaactcatcaatcatttgcatgcagtggccacgcaatttcttccgaccccgcagctcctgacccaacaggtgccactgagcaagggcactggcgcaccttcagcggcaggatccgcggccgcaccttgcctggaaagagcaggacagaagctggaaccattggcctactgcgtcccagttatccagcgcactcaaccctccgccgagcttgccgctgagaatgataccgacactgatagcggatacggtggagaggctgaagccagacctgaccgggaaaaaggaaagggagcgggggcttcaagggtgactatcaaacaggaaccgccaggggaggacagccctgcacctaagcgaatgaagctggactcgcggggcggcggatcggggggcggacccggagggggagccgcggctgccgccgccgctctgctgggccccgatcccgccgcagcagctgcactgctcagacccgatgccgcgttgctttcttcgctcgtcgcatttggaggtggaggcggggccccatttccacagcctgctgctgccgcagcacccttctgcctgccattctgttttcttagccctagtgcagcggccgcgtacgttcagccctttctcgacaagtcaggactggagaaatacctgtacccggcggctgcagcagctccatttccactcctgtacccgggcatcccggcccctgcagcggctgcggctgccgcggctgcagctgccgcagctgccgccgcgttcccgtgcctctccagcgtgctgtcaccgccgccggaaaaggccggagccgccgctgccaccctgctgcctcacgaggtggccccgctgggagccccacacccgcagcacccgcacggacggacccacctcccgttcgccggtccgcgcgagccggggaatccggaaagctccgcgcaagaggacccatcacagccaggtaaagaagctccg

SEQ ID NO: 7811 - DNA, 1446 bp, Artificial Sequence
  Description of Artificial Sequence: Synthetic coding sequence
atggatgaaggtatcccacatctccaagaacgacaactgctcgagcatagggactttatcgggcttgattacagctcgctgtacatgtgcaagccaaagagatccatgaagcgcgacgatacgaaggatacgtataagctgccgcacaggctgatagaaaagaaacggcgcgatcgtataaacgaatgtattgcccagcttaaggacctcttgcccgagcacctgaagttgaccacgttgggccatttggaaaaggcagtcgtccttgaactcaccctgaaacatctcaaagcgctcactgcgcttaccgaacaacaacaccagaaaatcattgcgctccagaacggtgagcgatccctcaaatcccctattcaatcagacctggatgcatttcattcagggtttcaaacttgtgcgaaggaggtgcttcagtacttgtcacgcttcgaaagctggaccccacgagaacccaggtgtgtgcaactgatcaaccatctgcatgccgtcgccactcaattcctgcctacccctcaattgcttacccaacaggtgccactttcgaagggaactggagctccctcggcggccggctccgccgctgcaccatgtctggaaagggcaggccagaagctcgagccgctcgcttactgtgtgcctgtcattcagcggacccagcccagcgcagagctcgctgcagagaacgacactgataccgattcaggatacggtggtgaagcagaggcacggcccgatagagagaaaggaaagggagcaggcgcaagtagagtgaccattaagcaggaacctccaggagaagatagccctgcccctaagagaatgaaactggattcgaggggaggaggctcgggtggcgggcctgggggaggagcagcggctgcagctgccgctctgcttgggccggaccctgccgcagctgcagcgcttctgaggccggatgcagcacttcttagctccttggtggcatttggtggtgggggaggtgctccgtttccgcagccagcagccgcagcagccccattttgcttgcccttctgttttctgtcaccgagcgcggccgccgcatatgttcagcctttccttgataagtctgggcttgagaagtacctgtacccggctgccgcagcagcacctttccccttgctgtacccgggaattccagcacccgccgcagcggctgcggccgcggctgccgctgccgcagcggcggcagcatttccatgcctttcttcagtgttgtcaccacctcctgaaaaggcgggtgccgcagccgcaacgcttctgccccacgaagtggctccacttggagcacctcacccacaacatccacacggccggactcacctcccttttgcaggccccagggaacctggaaatccggaaagctccgcacaggaggatccatctcaaccgggaaaagaagcacct

SEQ ID NO: 7812 - DNA, 1446 bp, Artificial Sequence
  Description of Artificial Sequence: Synthetic coding sequence
atggacgagggcatcccccatcttcaggaaaggcagctcctggaacaccgtgattttataggacttgactactctagtctgtacatgtgcaaacctaaacggtctatgaagagagacgacactaaagacacatacaagctgccccataggctaatcgagaagaaaaggcgggacaggatcaacgaatgtatcgcacaactcaaagacctcctccccgaacacctcaagctgacgaccctgggacaccttgagaaggccgtcgtgcttgagttaactctgaagcatttgaaggccctgacggccctgacagagcagcagcaccagaagataattgctctgcagaatggggagagatcactcaagagtcctatccagtctgacctggacgcctttcattcaggattccagacgtgtgcaaaggaggttctgcagtacctgtccaggtttgagtcttggacaccacgcgagccccgttgtgttcagttaatcaaccacctccacgcagttgcgacacaattcttgccaacgccccaactgctgacgcaacaggtgcccctaagcaagggaacaggagctccatcagctgccggctctgctgctgcaccctgcctcgaacgtgcagggcagaagcttgagccactcgcgtactgcgtccctgtgattcagcggactcagcctagcgccgagctggctgccgagaacgataccgacaccgacagcggatatggcggcgaggccgaggcgcgacccgaccgcgagaagggtaagggggccggcgcgagtagggttactatcaaacaggagccccccggggaggattctcctgcccccaagcgcatgaagctggactcacggggaggcggcagcgggggcggcccaggggggggggcggccgccgcggccgccgcactgcttggccctgacccggctgccgccgccgcacttctgcggcccgacgccgccctgctttctagcctcgtggcatttgggggtggaggaggcgccccatttccacagccagccgcagcagccgcgccattctgccttcctttttgcttcctctccccttctgcagctgcagcgtacgtgcagccctttctggataagtcaggtcttgagaaatatctgtaccccgccgccgctgccgcgccattcccactgttataccccgggattcccgcacccgctgctgctgccgcagcagcagctgcggcggctgccgccgccgcggccttcccctgcctctcttccgtactgtcgccccctccagagaaggccggcgcagctgcagcgaccctgctccctcacgaggtcgcgcccctcggtgcccctcatccgcagcacccacatggacgcactcacctcccctttgctggccctcgcgaacccggaaatcctgagagcagtgctcaagaggacccctctcaaccaggcaaagaagcgcct

SEQ ID NO: 7813 - DNA, 1446 bp, Artificial Sequence
  Description of Artificial Sequence: Synthetic coding sequence
atggacgagggcatcccacacctacaagaacggcagctgttggaacatagggatttcattggtctggactacagcagtctgtacatgtgcaaacccaaacgttcaatgaagcgcgatgacactaaggatacatacaagctgccacaccgcctcatcgagaagaagagacgggatcggatcaatgagtgcattgcacagttgaaggatctgctgcccgagcacctgaaactcactactttaggtcatctagaaaaggcagtggtgttagaactgactctgaaacatctgaaagctttaactgcactgaccgagcagcagcaccaaaaaatcatcgctctgcagaacggagagcgctccctgaagtcaccaatccaatccgacctagacgctttccattccggcttccagacctgtgctaaggaggtgctgcaatatttgtcccggttcgaaagttggactcctagagaaccacggtgcgtccagttaataaatcacctgcacgctgtggctacccagttcctgcccactccacaactgctgacacagcaggttccactgtctaaagggaccggcgccccctctgcagccggcagtgctgcagcaccatgtttagagcgggcaggccagaagctagagccactggcatactgcgtgcctgttattcagcgcactcaaccatctgctgagctagccgctgagaatgatactgacacagactctgggtacggcggtgaagcagaagcccgccccgatagagagaaaggcaaaggcgccggcgcttcccgcgtgactatcaaacaggagcctcctggtgaagacagccccgcaccaaaacgaatgaagcttgatagtcgtggcggcggatctggagggggcccaggggggggcgcagctgctgctgcagcagcactgctaggccccgatccagctgctgccgctgctctactgcggccagatgctgccctgctgtccagcctggtggctttcggaggggggggcggcgccccattccctcaaccagccgctgccgccgcccccttctgtcttcctttctgcttcctaagcccatccgctgccgccgcttatgttcagcccttcctggataagagcggtctggaaaagtacctgtaccctgcagcagcagccgctccatttccactgctgtatcctgggattcctgcacccgccgctgctgctgccgccgccgccgctgccgcagccgccgccgctgctttcccctgcctctcttctgttctgtcccccccacccgagaaagcaggcgctgctgcagctacccttctgcctcatgaagtcgccccattaggagcaccacacccccagcatccacacggaaggactcaccttcccttcgccggcccccgtgagccaggaaatccagaaagctctgcacaggaggatccctcccaacctgggaaagaggcaccc

SEQ ID NO: 7814 - DNA, 1446 bp, Artificial Sequence
  Description of Artificial Sequence: Synthetic coding sequence
atggacgaaggaatcccgcacctgcaagaacgccagttgctggagcacagagacttcatcggactcgactacagctcgctgtacatgtgtaaaccgaaacgttccatgaagagagatgacacgaaggatacctataagctgccgcaccgcctgatcgaaaagaagcgccgcgaccgcataaatgagtgcatcgctcagcttaaggacttgctgccggaacatctgaaattgactactctgggccacctggagaaggcggtggtgctcgagctgactcttaaacaccttaaggcactgaccgcactgacggaacaacagcaccagaagattattgcattgcagaacggagaacggtcgctgaagtcaccgatccagtcggacctggacgcatttcatagcgggttccagacctgcgcaaaggaagttctccagtacctgagtcgtttcgaatcatggacgccgcgcgagccaaggtgcgtgcaattgatcaaccatctgcatgcagtcgctacccagtttttgcctacccctcaactgctgacccagcaggtgcccctctccaagggaactggagcccctagcgctgcaggctcagcggctgccccatgcctcgagcgagctggacaaaagctggagccgctggcgtactgcgtcccagtgatccagagaactcaaccctccgcagagctggcggcggaaaacgacaccgacaccgactcgggatacggcggtgaggccgaggcccggccggaccgggaaaagggtaaaggggcaggggcttcgcgcgtgaccatcaaacaggaacctccgggagaagatagccccgcgcccaagagaatgaaactcgattccagaggcggaggatcgggtgggggcccaggaggaggagccgcggccgccgcggctgcactgctcggaccggatcctgccgccgcagcggctttgttgaggccggatgctgccttgctttctagcctggtggcctttggtggaggaggtggcgccccgttcccgcagccggcagccgctgctgcaccgttctgtctccccttctgtttcctgtcaccatcggctgcggccgcttacgtccaaccgttcttggacaagtcgggacttgaaaagtacctttacccagcggccgcggcagcgccgttcccccttctttacccaggcatcccagcgccggccgccgcagccgccgccgccgcggcagcagccgcagccgcagcagcctttccgtgcctgtcctcagtgttgtccccaccaccagagaaggccggggcagcggccgcaacgctgcttccacatgaggtcgcgccacttggcgctccccacccacagcacccgcacggccgcacgcatctcccattcgcgggaccaagggaaccagggaacccggaatcctcagcgcaggaggatcccagccagccaggcaaggaggcaccc

SEQ ID NO: 7815 - DNA, 1446 bp, Artificial Sequence
  Description of Artificial Sequence: Synthetic coding sequence
atggacgagggcattccgcatcttcaggagaggcagctgctagagcatagggattttattggactcgactattcaagcctttacatgtgcaaaccaaagcgcagcatgaagcgggatgataccaaggacacttacaagctgccacaccgcttgatcgaaaagaagaggcgcgaccggatcaatgagtgcatcgcacaattgaaggatctgctgccagaacacctgaagctgactactctgggacatctggagaaggcggtggtgctggaactgacgcttaaacatctcaaggccttgacggccctcactgagcaacagcaccagaagattattgctcttcagaacggagaaaggtctcttaaatcccccatccagagcgacctggacgcctttcactcgggatttcagacttgtgctaaggaagtgttacagtatctttcgcgctttgaatcttggacgccgagagaaccgcggtgcgtccaattgataaatcacctgcacgcggtggcaacacagtttttgccaactccacagctattgactcagcaggtgcctctttcaaaagggactggtgcacccagcgccgccggtagtgctgcggcaccttgtctagagcgagcgggtcaaaaattggagccacttgcgtactgcgttcccgtaattcagcgcacgcaaccttcagcagagctggccgcagaaaacgacaccgacacagactcagggtacgggggtgaggctgaggcacgcccagaccgggagaagggaaaaggcgcaggtgcatctcgcgtaaccataaaacaagaaccccccggtgaagactcaccagccccaaaaagaatgaaattggacagcagggggggtggctcagggggcggccccggaggcggtgccgccgcagccgcagctgcacttctaggacctgaccccgcagcagccgccgctttgcttagacctgatgccgcattgctgtctagcttggtggcattcggcggtggcgggggggctccattcccgcaacccgccgcagctgcggcacctttttgtttgccattctgtttcctctcgccgagtgctgcagccgcatacgttcagcctttcctggataaatcagggctggagaagtacttgtatcccgcggccgcggcagccccattcccactgctttaccctggcattcctgccccagccgccgccgccgccgccgctgcagcagctgcagctgctgctgcggccttcccctgtctatcatctgtgctctcaccaccacccgaaaaggctggagcagccgccgccactcttctgccacacgaggttgctcctctaggggctccacaccctcagcatcctcacgggaggacccacttgccattcgccgggccgcgcgagccagggaaccccgagtcctctgcacaagaagatccctcacagccgggcaaagaagctccg

SEQ ID NO: 7816 - DNA, 1446 bp, Artificial Sequence
  Description of Artificial Sequence: Synthetic coding sequence
atggacgaaggaattccgcacctccaggaacgtcagctgctcgaacatcgggatttcatcgggttggactactcttcgctttacatgtgtaaacctaagagaagcatgaagagggatgatacgaaagatacctacaagctgcctcatcgccttattgagaaaaagagaagagacaggattaatgaatgcatagcacaactgaaggatcttctgcctgaacaccttaaactcacgaccctgggccatctcgagaaggcagtcgtgcttgaattgacccttaagcaccttaaggcacttactgcacttactgaacagcaacatcaaaagatcattgcattgcagaacggcgagcggtcgctgaaatcgcctattcaatctgacttggacgcgtttcattccggttttcaaacctgtgccaaagaggttctccaatacctgtcgagattcgagagctggactcccagagaacccaggtgtgtccagttgatcaaccatcttcacgctgtagcgactcaatttctgccaacgccacagcttctgacccagcaggtccctcttagcaagggtaccggagcacccagcgcagcaggatccgccgccgccccttgcctggaaagggcgggccaaaaacttgagcccctggcatattgtgtgccagtgatccaacgcacgcaaccctcagcagaactggcggcggaaaatgatactgatactgattcaggatacggaggtgaggcggaggcgcgcccggaccgggaaaagggtaaaggagcgggtgcatccagggtcactattaagcaggaaccacctggggaggattcacctgcaccgaagagaatgaagctggattcccggggtggcggttccgggggaggaccagggggaggagcagctgcagccgcggcagcacttcttggaccggatccagctgccgcggccgcacttctcagacctgatgccgcactcttgtcatctctggttgcatttggcggtgggggcggggccccgttcccacagccagccgccgctgcagcacctttttgcctccccttctgttttcttagtccaagcgccgccgccgcatacgtccaaccttttctggacaagtcggggctcgaaaagtacttgtaccccgcagcagccgcagcccccttcccgctgctctaccccggaatccctgcaccagctgcagcagcagctgcggcggccgcagccgccgcggctgccgctgcattcccttgtctgagctccgtgctttcgcccccgccagagaaggcaggagctgccgccgcgaccttgcttccacacgaagtggctccactgggtgcgcctcacccgcagcatccacatggccgtactcatctcccttttgcgggacctcgagaacctggcaaccctgaatcgtcggcacaagaggaccctagccaaccaggcaaggaagcccct

SEQ ID NO: 7817 - DNA, 1446 bp, Artificial Sequence
  Description of Artificial Sequence: Synthetic coding sequence
atggatgagggaattccacacctgcaggagcgacaactgctggaacacagggactttatcggactcgattactcctcactgtatatgtgcaagcctaaacgctctatgaagcgcgatgataccaaagatacatataaactgcctcaccgcctgatcgaaaaaaaacgcagagaccgcatcaacgagtgcatcgcccagctgaaagatttgctccctgaacatctcaaactgaccacactgggtcacttggagaaggccgtggtgctggaactgaccttgaagcacttgaaagccctcacagcactgacagagcagcagcaccaaaagataatcgccttgcagaacggggagagaagtctgaagagtccgattcagtctgacctggatgccttccattcaggatttcagacatgtgccaaggaggtcctgcagtatctgtccagattcgagagttggaccccccgcgaaccacgctgtgtgcagctcatcaaccacctgcatgccgtggccacccagtttctccctacacctcaacttttgacacagcaagtcccgttgtcaaaagggactggggctccgtccgccgctgggtcagctgcggcaccatgtctggaacgagccgggcagaagctggagcccctggcttattgcgtgcccgttatccagcgaacacaacccagtgcagaactggccgccgaaaacgataccgacactgactccggttacggcggcgaagccgaagccagacccgatagagagaagggtaagggagcaggagcctcccgggtcacaattaagcaggagccacccggcgaagactctccagcccctaagcgaatgaaactggactctcgcggcggagggtccggcggcggcccaggcgggggcgccgctgcggcagcagctgccttgctcggtcccgatccggctgccgccgctgcccttctgagacctgacgctgccctgttgtcctccttggtggcgtttggcggcggtggcggggcacccttcccacagccggcggccgcagcagcgcccttctgcctccctttctgctttctgagcccaagtgcggcagcagcttacgttcaacccttcctcgataaaagtggtctcgaaaagtatctgtatcctgccgctgccgcagctccatttccattgctgtaccctggcatccctgcacccgctgccgcggcggccgctgctgccgccgctgccgccgcagcggccgcctttccgtgcctgtcatccgtgttgtccccacctccagaaaaagccggcgccgccgcagccaccctcctcccgcatgaggtggctccactgggagcaccccatccgcagcacccccacggcaggacacatttgccatttgccggcccccgggagccgggtaatccggaatcatctgcacaggaggaccctagtcagcccggtaaggaagcccca

SEQ ID NO: 7818 - DNA, 1446 bp, Artificial Sequence
  Description of Artificial Sequence: Synthetic coding sequence
atggatgagggtatccctcatctgcaggagcgacagctcctggagcatagagacttcatcggcctagactatagtagtctgtatatgtgtaagcccaagcggtcaatgaagcgggatgatactaaggatacttacaagctgcctcacagactaattgaaaaaaagcggagggatagaattaacgaatgtattgcccagttgaaggacctgctcccggagcatcttaagctcactactctgggccatttggagaaggcggtggtgttggagttgacactcaagcaccttaaggcgctgaccgcacttacagaacagcagcaccaaaaaatcattgccttacagaacggggaacggtctctaaagagccccattcagtctgacctggatgccttccacagcggatttcaaacgtgcgccaaggaggttctgcaataccttagcagattcgagtcatggacgccgcgtgaacctcgctgcgtacaacttattaaccatcttcacgcggtggccacccagtttctgcccacaccccagctgctcacacagcaagtgccactgagcaaaggaactggcgcccccagcgctgccgggtctgcggctgcaccttgcctcgagcgtgcgggacagaagctggagccactggcctactgtgtcccagtgattcagaggacacagccatcagcagagttggccgcagaaaacgacactgatacggactctggatacggcggagaggctgaggcccgccccgatcgggagaagggtaagggcgctggcgcgagccgagtaaccatcaagcaggaacctcctggcgaggattcccccgcacctaaaaggatgaaacttgacagtcgcggcggaggctccggggggggccctgggggtggggctgcagccgccgccgccgctctgctgggcccagaccctgcagccgcggctgcattgctccgccccgacgccgcgctactgtcatcgctggtggcctttggcgggggcggtggcgctcctttcccccagccagctgctgctgccgctccattctgtctgccgttttgttttttaagcccgagcgccgcggccgcttacgtgcagccttttctggacaagtcaggactggaaaaatacttgtaccctgcagccgccgccgcaccatttcctctgctctaccccggtatcccggcaccggccgccgcggccgcagcagccgcggcagctgcagccgcggctgccgcattcccttgtctatcttccgttctgagcccccctccggagaaggctggtgctgccgcagccacactcttgcctcacgaagtggctcccctgggagccccccaccctcaacaccctcacggcagaacgcacctgccgttcgcgggtccaagggagcctggcaaccctgaatccagcgcgcaagaagacccctctcagcccggcaaagaggcgcct

SEQ ID NO: 7819 - DNA, 1446 bp, Artificial Sequence
  Description of Artificial Sequence: Synthetic coding sequence
atggatgagggtatacctcatctccaagaacgccaactgctcgaacacagggactttatcggtctggattactcaagcctttacatgtgtaagcctaagagatctatgaaacgagatgacactaaagatacttacaaactgcctcacaggcttattgaaaagaaacggcgggacagaatcaacgagtgtatagctcaactcaaagatctccttcctgagcacctcaaacttaccacccttgggcacctggagaaggcagtggtgttggaacttactcttaagcatttgaaggcattgaccgcacttactgagcaacaacaccaaaagattattgctctgcaaaatggagaacgtagtcttaagtcgcctattcaatcggatctggatgcctttcactcggggtttcagacttgcgcaaaagaagtgctgcagtacctttcgcggttcgaatcttggactcccagagaacctagatgcgtgcaactgattaaccatctccatgcagtcgcaacccagttcctgcccaccccacagctgctcacgcagcaagtaccgctctcgaagggtaccggcgcaccctcggcagcaggttcagctgcagcaccgtgcctggagcgcgccggacaaaaactggagccacttgcctactgcgtccctgtcatacaacggacccagccatccgcagaattggcagcagagaacgatacggataccgacagcggatacggtggcgaggcagaagcgcgtccagatagggaaaagggcaagggtgcaggagcatcgagagtcactattaagcaagaacccccgggtgaagattcgccagccccaaagaggatgaaattggactcccggggtgggggatcgggcggaggaccaggtggtggagcggcggcggcagcggcagcattgctgggcccggacccagcagcggctgcagcgttgcttagaccagatgcggccctgctttcctctctggtcgcatttggtggaggaggaggggcaccatttccacagccagccgctgcggcagctcctttctgtctgccgttttgctttttgtccccctcagcagcagcagcatacgtgcaaccattcctggataagtcagggctggaaaagtatctttacccggcagccgccgcagctccattccccctgctctaccctgggattcctgcccctgcagcggccgccgccgcggcagccgcagccgccgcggctgcagcagccttcccctgtctttcaagcgttctctcaccaccgccagaaaaggcgggggcagcagccgcaacccttcttcctcatgaggtggcacctcttggagcaccgcatccccagcatccgcatggaagaactcatctcccatttgcaggtcctagagagcctggtaatcctgagtcgtccgcacaggaggatccatcgcagccggggaaggaggcccca

SEQ ID NO: 7820 - DNA, 1446 bp, Artificial Sequence
  Description of Artificial Sequence: Synthetic coding sequence
atggacgagggtatccctcatcttcaggagaggcagttactggaacatcgggacttcattggtctggactactcatccctctacatgtgtaagcctaaacggagcatgaaaagagatgatacgaaagatacatacaagctgccacaccggttgatcgagaagaagaggagagacagaatcaacgaatgcatcgcacagctgaaagacctattgccagagcatctaaagctgaccactctgggtcatctcgagaaggcagtagtgcttgagctgaccctaaaacatctcaaggctctgactgcgttaacggagcagcaacaccagaaaattatcgcgctgcagaatggggagaggtcattgaagtctcctatccagagcgaccttgacgcttttcacagtgggttccagacatgtgccaaagaagtcctgcagtacctctctcggtttgagagttggacaccaagagaacctcgttgcgtccagttaattaaccatctgcacgccgtggccactcagttccttcccacaccccagctgttgacacagcaggttccacttagtaagggtacaggcgcgccttccgccgcagggtcagccgccgccccctgtctggagcgcgccgggcaaaagctggaacctctcgcgtattgcgtgccagtcattcagaggacccagcctagcgctgagctagcagcggaaaacgacacagacaccgatagtggctacggaggggaggcagaggctaggcccgaccgcgagaaaggaaaaggcgccggagcctctcgggtcacgataaaacaggaaccacccggtgaggactccccagccccgaaaagaatgaaactcgattctcggggtggcgggagtggtggaggccccggcgggggggccgctgcggcagccgctgcactactgggccctgaccccgccgctgcagccgcactgcttcggcccgacgctgcgctgttatcttctctggttgcatttgggggcggcggtggggctccttttccccagccagccgctgctgccgcccctttttgcctgccattttgcttcctgagtccttctgcagctgcagcctatgtgcaaccattccttgacaagtcaggactcgagaaatacctgtatcccgctgccgctgctgcaccatttccactgttataccctggcataccagcacctgccgctgcggccgccgctgcggcggccgccgccgctgcggcggctgcatttccatgcctaagcagtgttttatctcctcctcccgaaaaagctggggccgccgccgcaactttgctgccccatgaagtcgctccacttggggccccacaccctcagcatccgcatggtcggacccatctgcctttcgctggtccccgcgaacccgggaaccccgaatcctctgcccaggaagatccgagtcagcctggaaaagaggcgccc

SEQ ID NO: 7821 - DNA, 1446 bp, Artificial Sequence
  Description of Artificial Sequence: Synthetic coding sequence
atggacgagggaatcccacatctgcaggaaagacaactgcttgagcatcgcgactttatcgggctggactactcctcgttgtacatgtgtaaacctaaaaggagcatgaagcgggatgataccaaggatacctataaacttccccataggctcatcgaaaagaagagacgtgataggattaatgagtgcattgcacagctgaaggacctcctgcccgagcaccttaaacttactaccctggggcatctggaaaaagccgtcgttcttgagttgactttgaagcaccttaaagctctgaccgcactcactgaacaacagcaccagaagatcattgcactgcagaatggagaacggtcccttaagtccccaatacagtccgacctggatgcatttcactcaggattccaaacttgcgcaaaggaagtcctccaatacctctcacgcttcgagtcgtggactcctcgagaaccccggtgtgtgcaactcattaaccatctgcacgcggtggcaactcagttcctcccaaccccacaactgcttacccaacaagtgcccttgtcaaagggtaccggtgcaccatctgccgccggctcggcagcggcaccatgtttggagcgagctgggcaaaagttggagcctcttgcgtactgcgttcctgtgattcaaagaactcaacccagcgccgaactggccgcagagaacgatacggacacggacagcggctatggaggcgaagccgaagcaagacccgacagagagaaaggtaagggtgcaggagcctcccgagttaccattaaacaggaaccacctggagaagattcgccagcaccaaagagaatgaaactggatagccggggcggagggtccggaggaggtcccggagggggcgcagcggcggcagccgcggcactgttggggccggatcccgcagccgcagcagctctccttaggcccgatgcagctctcctctcttccttggtagcatttggcggtggcggcggagcccctttcccgcagcccgcggcagcagcagcacctttctgccttcctttttgttttctgtccccaagcgccgcggcagcgtacgtccagccctttctcgataagtcgggacttgaaaagtacctgtaccctgcggcggccgcagcaccatttccacttctctacccaggtatccctgccccagctgccgccgccgccgctgctgccgccgcagcggccgccgcggccgcatttccatgtctgtcctcagtgctgtccccaccgcctgagaaggccggagccgctgccgcaacgcttcttccgcatgaagtcgccccacttggcgcccctcatccacagcaccctcatggtaggacgcatctgccatttgcagggcccagagaaccaggcaaccctgaaagctccgcacaagaagatccaagccagccaggaaaggaagcacct

SEQ ID NO: 7822 - DNA, 1446 bp, Artificial Sequence
  Description of Artificial Sequence: Synthetic coding sequence
atggacgaaggaatcccccaccttcaagagcgccagctgctggaacatcgggacttcattggcctcgactacagcagcctgtacatgtgcaagcccaagcggagcatgaaacgggatgatacgaaggatacctacaagctgccacatcgactgatcgagaagaagcggcgtgaccgaatcaatgagtgcatcgcacagttgaaagatcttttgccggaacatttgaagctgaccaccctggggcatctggaaaaagcggtcgtgctggaactgaccctgaagcacctgaaggccctcaccgctctgactgaacagcaacatcaaaagattatcgccctccagaacggcgagaggagcctgaagtcgccaatccaatcagaccttgacgccttccactcgggatttcagacctgtgccaaagaggtgcttcagtacctgtcgcgtttcgagtcctggaccccgagagaaccgcggtgtgttcagctgattaaccacttgcacgcagtcgccactcaatttctcccgactccacagctgcttactcagcaggtgcctctttcaaaaggaactggagccccgtcggccgccggctccgcagccgccccgtgtctggaaagagctggccaaaagctcgagcctctggcgtactgcgtgccggtcatccagcggacccagccctccgcagaacttgcggctgagaacgatacggacaccgactcgggatacggtggggaagccgaagcgcggcctgacagagaaaagggcaagggagcgggtgcgtcacgggtgaccatcaagcaagaaccgccaggagaagattcaccagcgcccaagagaatgaagctggatagcagagggggcggatccggcggcgggccaggaggaggagctgcggcggctgcggccgcgctcctgggtccggatccagcagcagctgcggcgctgctgaggcctgatgcggccctcctgagctccttggtagctttcgggggtggtggaggtgcaccgtttccacaaccagcggccgcggcagcgccgttctgccttccattctgcttcctgtccccgtcagccgccgcggcttatgtgcagccctttttggacaaatccggcctggagaagtacttgtaccctgcggccgccgctgcgccgtttccactcctgtacccaggaatcccagccccggcagctgcagcggctgccgccgccgcagccgctgctgcagcggccgctttcccgtgcttgtcctccgtgctgtcaccgccgccggagaaggctggagctgccgcagcgacgctgctgccccacgaggtggcaccgctgggcgcacctcatccgcagcacccgcatggacgcacccacctgcccttcgcgggaccaagagagcccggcaatccagagagctcggcgcaggaagacccgtcacaacccggaaaggaagctccg

SEQ ID NO: 7823 - DNA, 1446 bp, Artificial Sequence
  Description of Artificial Sequence: Synthetic coding sequence
atggacgaaggcatcccacacctgcaggagaggcagcttctcgagcatagagacttcatcggactggattactcgtccctgtacatgtgcaagcccaagcggtcgatgaaacgggacgataccaaggatacgtacaaactgccgcatagactcatcgagaagaagcggagagatcggatcaatgaatgcatcgcccagttgaaggatctgctgcctgagcatctcaagctcactacgctgggccacctggaaaaggcggtggtcctggagctcaccctgaagcacctgaaagccctcactgccctgaccgaacaacagcaccagaaaatcatcgcgctgcaaaacggagaacggtcacttaaatcccccatccagagcgacctggacgccttccactctggctttcagacctgtgcaaaagaagtgctccagtacctgagcagattcgagtcatggactccgcgcgaaccacgctgcgtgcaattgattaatcacctccacgccgtggccactcagttcctccctactccacagctcctgacccagcaggtgcccttgagcaaaggaactggcgccccgtcggccgctggtagcgctgccgcaccgtgcctcgaacgggcaggacaaaagctcgagcccctggcctactgtgtccctgttatccaacgcacccagccatcagcggaacttgccgccgaaaacgacaccgacactgactccggatacggtggcgaagcagaagctcgcccggatcgcgaaaagggaaagggcgcgggagcctcgcgcgtgaccattaaacaagagcctccaggggaggattccccggcgccaaagaggatgaagctcgactctaggggcggtggcagcggaggagggccggggggaggtgccgctgctgccgcagcagccctgttgggaccagaccccgcggcggcggccgcattgcttcgacctgacgccgccctgctgtcgtcgctggtcgccttcggaggaggaggcggggcaccgttccctcaacctgccgctgcggcggccccgttctgccttccgttctgctttctgtcaccgtcagcagccgccgcctacgtgcagcccttcctggacaagtccggtctggaaaagtacctgtacccggccgcggcagccgcacctttccctcttctgtatcccggaattcctgctccagccgcagccgctgctgctgctgcagctgcggcggcagcggcggccgcgtttccgtgtctgtcctccgtcctttcgcccccgccagaaaaggcgggagcagctgccgcaactctcctcccgcatgaggtggcacctctgggagcaccgcatccgcaacacccgcatgggcgcacccacctcccatttgcgggaccacgtgagccgggcaacccggagtccagcgcgcaagaggatccgtcgcagccagggaaggaagctccg

SEQ ID NO: 7824 - DNA, 1446 bp, Artificial Sequence
  Description of Artificial Sequence: Synthetic coding sequence
atggatgagggcattccccacttgcaagaacgccagttgttggaacatcgggattttattggcctggactattcttcactttatatgtgcaagccaaaaagatccatgaagagagacgacactaaggacacttacaaactgccacacagattgattgagaagaagcggcgggatcgcatcaatgagtgcatcgcccagctcaaggacctcctccccgagcatctgaaactgaccaccctaggacacctcgaaaaagctgtggtcctagaactcaccctgaaacacctgaaagccctgacagcgctgaccgagcagcagcaccagaaaataatagctcttcagaatggcgaacggagtctcaagtctccaattcagtctgacctggatgctttccattccggatttcagacatgtgctaaggaggtgttacagtacctgtccagattcgagtcctggaccccgcgggaaccgcgatgtgtccaactgatcaaccacctgcacgccgtcgcgacccagttcctgcctaccccacagttgctcacgcagcaagtgcccctttcgaagggaaccggtgcaccgagcgctgctgggagcgctgccgcaccctgtctagaacgcgcgggccagaagctagagcccctggcatattgcgtgccagtcatccagcgaacacagccctctgccgaactcgccgccgaaaatgatacggacactgatagtggatatgggggggaggccgaagcaaggcccgacagagaaaagggcaaaggcgctggggcctctagggtaactatcaagcaggagccgccaggagaggatagcccagcccccaagaggatgaagctagattcccggggaggaggctctggcggcgggcccggcggcggggctgcggccgccgcagccgctttacttggtcccgatcctgccgccgcggccgcccttctgcgtccagacgccgccttgctcagctccctggtagcctttggtggagggggtggtgcgccatttccgcagccagcggccgctgccgcccctttttgcctgcctttctgctttctctccccaagtgccgccgctgcatatgtacagcccttcctagataaatccggactggagaagtacctttatccggccgcagcagccgccccctttcctctactctatcctggcatcccagcaccagccgccgcggccgccgccgcagccgcggccgccgccgctgccgccgcctttccctgtctttcctcagtcttatctccacctcccgaaaaggcgggagctgcagctgctaccttgctaccccatgaggtggcccccttaggcgcaccacatccccaacaccctcatggacgcacacatcttccattcgccgggcccagggagccggggaacccagagagcagcgcccaggaggaccccagccaacccgggaaggaagctccc

SEQ ID NO: 7825 - DNA, 1446 bp, Artificial Sequence
  Description of Artificial Sequence: Synthetic coding sequence
atggacgaagggattcctcatctccaagagcgccagcttctggaacacagggacttcatcggacttgattactccagcctctacatgtgcaagccgaagcgatccatgaaacgggacgatactaaggatacctacaagctcccacaccgcctgattgagaagaaaaggagagacagaatcaacgagtgtattgcgcagcttaaggacctgctgccagaacatttgaagctgactactctgggacatcttgaaaaagcagtggtgctggagcttacgctcaaacacctcaaggctctgaccgcactgaccgaacagcaacatcaaaagatcattgcattgcaaaacggtgaaagatctctcaagtcgcctatccaaagcgacctggatgcattccattcgggtttccaaacgtgtgcgaaagaggtgcttcaatacttgtcacgcttcgaatcgtggacccccagagaaccgcgttgcgtccaattgatcaatcatctccatgcagtcgccacccagtttcttcctacgcctcagcttctgacccagcaggtccccttgtcaaagggcaccggcgccccttcagctgccggatcagcagctgcaccttgtttggaaagggcaggacagaaactggaaccgctggcctactgtgtcccagtgattcagcggacccagccttccgcagagcttgccgccgagaatgacaccgatactgattcgggctacggtggcgaagccgaagcacggccagatcgcgagaaaggaaagggtgcgggagcctccagagtgactattaagcaggaaccgcccggggaagattcacccgcaccaaagcggatgaagctcgattccaggggcggtggtagcgggggcggacccggaggaggtgcggccgcagcagcagctgccctgctcgggccagatcctgcggcggcagccgcacttctgcggccagacgccgcccttctgtcgagccttgttgcatttggaggcgggggaggcgcgccttttcctcagcccgctgcagccgcggcacctttttgtctgcccttttgtttcctctccccaagcgcggcagccgcctacgtgcagcctttcctcgataagagcggactcgagaaatatctttacccagcagcggctgcagccccttttccacttttgtacccaggtatccctgcgcccgcagccgccgcggcagctgcggcggctgctgcggcagcggcagcggcctttccttgcctgtcgtcggtgttgtctcctccaccggaaaaagcgggagcagctgcagcgactctcttgcctcacgaggtggcccctttgggtgcaccacacccgcaacacccacatggacgaactcatctccctttcgccggaccaagagaacccggaaatccggaatcaagcgcacaagaggatccatcacagcccgggaaggaagcccct

SEQ ID NO: 7826 - DNA, 1446 bp, Artificial Sequence
  Description of Artificial Sequence: Synthetic coding sequence
atggacgagggcattcctcatctgcaggaacggcaattactcgagcacagagactttattggtctcgactacagctctttgtacatgtgcaagccgaagaggtccatgaagcgcgacgatacgaaagatacctataagctgccacaccgtctaattgaaaaaaaacgacgcgataggattaatgagtgtattgctcagttgaaagacttactgcctgagcacctgaaactgactacgctgggccacctggagaaagccgttgtgctggagttgaccctgaaacacctcaaagcgctgacggccctgaccgaacagcagcaccagaaaattatcgcactccagaatggcgaacgctccctgaagtcaccgatacaaagcgatctggacgccttccatagcgggttccagacttgcgccaaggaagtgctgcagtacctgagcagatttgaatcgtggaccccccgcgaacctcgctgcgttcaactgatcaatcaccttcacgcagtggctactcagttcttaccaacgccgcaactgctgacccaacaggtcccgctcagcaagggtactggcgccccaagtgcggcaggtagcgccgccgcgccgtgcctcgaacgggctggtcagaaactggaaccgctggcatattgcgtcccagttattcagagaactcagccgagcgctgaactggccgctgagaatgacactgacactgatagcggttatggtggagaggcggaggcgcgcccagatcgcgaaaaaggtaaaggtgcgggagcgtcacgcgtgaccattaaacaggaacctcccggggaggatagcccagcgccaaaacgtatgaagctggactccaggggcggcggatctggaggtggcccgggtggaggtgcagccgcagcggcggcggctctgctgggcccagatcctgcagctgctgccgccctgctgcgccctgacgcagctctgctgagctcactggtcgcatttggcgggggtgggggtgcaccttttccacagcctgcagcggcagcggcccccttctgcctgcctttttgctttctgagcccaagcgccgctgcagcgtatgtacagccgtttctggacaagtccgggctggagaaatatctctatccagcggcggccgcggctccatttccactgctgtacccaggaatcccagcgccagccgccgctgccgccgccgcggcggcagctgccgctgccgcagcagccttcccgtgtttgtctagcgtgctgtcacctccgccagagaaggctggtgccgctgctgcgacgctcctgcctcacgaagttgcgcctctgggcgcgccacaccctcagcatccgcatggtaggacccatctgccattcgcaggtccgcgagaaccaggtaacccggaatccagcgcgcaagaagatcctagccagcccggtaaagaagctcca

SEQ ID NO: 7827 - DNA, 1446 bp, Artificial Sequence
  Description of Artificial Sequence: Synthetic coding sequence
atggatgaggggatccctcacttgcaggagcggcagctgcttgagcatcgagactttatcggcctggactacagcagcctttacatgtgcaaacctaagcgatccatgaagagggacgatactaaggatacctataagctgccacataggctcatcgaaaaaaagcgcagagaccggattaatgaatgcattgcccaactcaaggacctgctccccgagcacttgaaactgactacacttggacacctggagaaagctgtggtgctcgaactgactttgaagcatctgaaagcactgacagccctgaccgaacagcagcaccagaaaattattgctctccagaacggtgagcgcagcctcaaatccccaattcagtccgacctcgacgccttccattcagggtttcagacatgtgccaaggaagtgttgcagtacctgagccggtttgagtcttggacccccagagaaccccgctgcgtccagctgatcaatcacctccacgcagtcgccacccaattcctgcccaccccccagttgttgacccagcaagtgccattgtcaaaaggcacaggagccccgagtgccgccgggagcgcagccgcgccttgcctggagcgagcaggacaaaagctggagccactggcctattgtgtacctgtgatccagcgaacccagcccagtgctgagctggctgccgaaaatgatactgatacagacagcggctacggaggagaagccgaagcacggcctgaccgagagaagggaaagggcgctggggccagtcgggtgactattaaacaggagccaccgggtgaggactctccagcacctaagagaatgaagctcgattctcggggagggggcagcggcggcggcccgggcgggggggctgccgccgcagcggccgctctcctggggcctgaccctgctgcggccgccgccctgctccgcccagacgctgctcttctgtcttccctcgtggccttcggaggcggaggaggagcaccttttcctcaacctgctgcggctgccgcgccattctgcctccctttctgttttctgtcacccagcgcagcggcagcctatgtccaacccttcctggataagtccggcctcgaaaagtacctgtacccagccgcggctgccgcgccctttccgctcttgtatcccggcatacctgcccccgctgcagcagcagctgccgccgcagcggctgcggcggctgccgccgcttttccctgcttgtcaagcgtcttgtctcccccccctgaaaaggctggagcagccgccgctaccctgctgccgcatgaggtcgcacccctgggggctcctcatcctcagcacccacacggccgaacacatttgcctttcgccgggccacgggaaccgggcaatcccgagagcagtgcccaggaggacccgtcacagcctggtaaggaagctccc

SEQ ID NO: 7828 - DNA, 1446 bp, Artificial Sequence
  Description of Artificial Sequence: Synthetic coding sequence
atggatgagggaataccacatctccaagaaagacagctcctggaacaccgggactttattggtctggattacagttccctttacatgtgtaagccaaaacgctcaatgaagcgagacgacacaaaggacacttataagttgccacacaggctgatcgagaagaagcgaagagacagaatcaatgaatgcatcgcgcagttaaaggatttattgcccgagcatcttaagctcaccacactgggacatcttgaaaaagccgttgtgctcgagctgaccctcaaacatctgaaagccctaaccgcactgaccgagcaacaacaccaaaaaatcattgcactgcagaacggagaacgctcactcaagtctcccatacaaagcgacttggatgcgtttcacagcggcttccagacctgcgccaaggaagtcctccagtacctgtccaggttcgaaagttggactccacgcgaacccaggtgtgtacagctgataaatcacttgcatgccgtggccactcagtttcttcccacccctcagttgctgactcagcaagtgcccctatccaaaggtaccggagctcctagcgccgccggatcagcggcagccccctgtctggaaagagctggccagaagttggagccgcttgcctattgcgtaccagtcatccagcggacgcagccatccgcagaattagctgccgagaacgacacagacacagactctggctatggtggcgaggccgaagcccgacccgaccgcgagaaaggcaaaggggcaggcgcatctagagttaccattaagcaggagcctcccggcgaagacagtcctgctcccaaacgcatgaaactcgactccagggggggggggtcgggtgggggtccaggaggaggagccgctgcagcggcggccgctttattgggtccggaccccgccgcggccgctgctctgctgcgacctgatgctgctctgctgagctctcttgtggccttcgggggaggaggcggtgcccctttcccccagcccgccgcagcggctgcccctttttgcctgcccttctgcttcttgtcaccgtccgcggctgcggcctacgttcagcctttccttgataaatcagggctggagaaatacctctacccggccgcagcagccgcaccattccctctgttatatcccggaatccccgcaccagcagccgctgccgccgccgccgcagcagctgcagccgccgcagccgcgttcccgtgtcttagcagtgtgctgagccctcctcctgagaaggcgggagcagcagccgcgactctcctgccacacgaggtggctcccctgggtgctccgcatccccagcacccccacggaaggactcacttgccatttgccggcccacgcgagccaggcaatcccgaatcctctgcacaggaggacccttcacaaccgggaaaagaggccccc

SEQ ID NO: 7829 - DNA, 1446 bp, Artificial Sequence
  Description of Artificial Sequence: Synthetic coding sequence
atggatgagggcatcccgcatctgcaggaacgccaacttttagaacatagagattttattgggttggattattcaagcctgtatatgtgtaaaccaaaaagaagcatgaaacgggatgacacgaaagatacatataaacttccacacagacttatagagaagaaacggcgtgaccgtatcaacgaatgtattgcccagttgaaagatcttctcccggaacatctgaaattaaccacgttgggccatctggaaaaggcggtcgtgctagaattaacgctcaaacatctaaaggcgctgactgcattgacagagcagcagcatcagaaaattattgctctgcaaaacggcgagcggtcgctaaaatcacccattcagtcagacctggatgcgtttcattcaggcttccaaacttgtgcaaaagaagtccttcagtatctttcccgttttgaatcatggacaccgagagaaccacgctgtgttcagctgatcaaccatttgcatgcagtagcgacacaatttcttcctacgccgcaactgttgacgcagcaggtgcctttatctaaaggtacgggagcaccatcagccgcaggatcggctgcagctccctgcctggagcgtgcgggacagaaacttgaaccgctggcatactgcgtgccagtcattcagcgtacacagccgtctgccgaattggctgccgaaaatgatacggacacagattctggttatggaggcgaagcggaagcccgacctgatcgcgagaaaggaaaaggagccggtgcgtcaagagtaactatcaaacaggaaccacctggggaagattctccagcccctaaaaggatgaaattggattcaagaggtggcgggtccggcggaggccctggcggcggggctgcggcagcagcagccgcattactgggaccggacccggcagcagcagcggcactccttcggccggatgcggcactactttcctcacttgtggccttcggtggtggtggcggggcaccttttccacaacccgctgctgctgctgcaccgttttgcttgccgttttgctttctgtccccaagtgcagcggctgcctatgtacagccatttcttgataagtcaggacttgagaagtatttgtatccggctgcggcggccgccccttttccgttactttatccgggcattccagctccagcagcagcggccgcagccgcggcggcagccgcggctgccgcagccgcctttccgtgtctgtcaagtgtcttgtccccgcctccagaaaaagcgggtgctgcggccgctactctcttgccgcacgaagtcgcgccgttaggagcccctcatcctcagcatccgcatggcagaacccaccttccgtttgctgggccgagagaaccgggcaaccccgaatctagcgcgcaagaagacccgagtcagccagggaaagaagcgccg

SEQ ID NO: 7830 - DNA, 1446 bp, Artificial Sequence
  Description of Artificial Sequence: Synthetic coding sequence
atggacgaagggatcccgcacctccaggagcgccaattgttggagcacagggactttatcggtctggactactcgtcactgtatatgtgtaaaccgaagcggagcatgaagcgggacgataccaaggatacctacaagctcccccacagactgatcgaaaagaaacgccgggacagaatcaacgaatgcattgctcaactgaaggaccttctgccggaacacctgaaactgaccactctcggccacctcgaaaaggccgtggtgcttgaactcaccctgaagcatctgaaagcactcaccgcgctgaccgagcagcagcatcagaaaatcatcgccctgcaaaatggagagagaagcctgaaaagcccaatccaaagcgatctggatgccttccatagcgggttccaaacctgcgcgaaggaagtgctccagtacctttcgcgcttcgaatcatggaccccgcgcgaaccacgctgcgtccagctcatcaaccacttgcacgcggtcgcgacgcaatttcttcccaccccgcaactcctgactcagcaggtgccgctgtcgaaagggacgggagccccctcggccgcgggctcggccgctgcgccttgcctggaacgggcgggacaaaaactcgagccgctggcgtattgcgtcccagtgatccagagaacccaaccgtcagcggaactggccgcagagaacgacactgacactgacagcggatacggcggagaagcggaagctcggccggatagagaaaagggaaagggagcaggagctagcagggtcaccattaagcaagagccgccaggcgaagattcacctgcccctaagcgcatgaagctggattcgcgcggaggagggtccggaggagggcctgggggaggagcagcagcagccgctgcagctctcctgggaccagacccggccgcagccgcagctctgctccgaccggacgccgccctcctgtccagcctggtcgctttcggagggggcggaggcgctccgttcccccagcctgctgctgctgcagctccgttctgcttgccattttgctttctcagcccgtcggccgccgccgcttacgttcaaccgttccttgataaatcggggctggagaagtacctctatccagcggcagcggctgcaccgttcccactcctgtaccctgggatcccggctccagccgcagcagctgccgccgcagcggctgccgctgcggcagctgcagcattcccttgtctgtcctcggtcctctccccgccgccggagaaggccggagccgcggcggccactctgctgccgcacgaagtcgccccattgggcgcaccgcatccgcagcaccctcatggacgcactcatctgccttttgccgggccgcgggagccgggcaacccggagagcagcgctcaggaagatccatctcagcctggaaaggaggcgcct

SEQ ID NO: 7831 - DNA, 1446 bp, Artificial Sequence
  Description of Artificial Sequence: Synthetic coding sequence
atggacgaggggatcccccatctccaggagagacagctgctcgagcaccgcgacttcatcgggctggactactccagtctttatatgtgtaagcccaaaaggtccatgaagagagatgataccaaggatacttataaactgccccatcggctgattgaaaagaagaggcgggatagaattaatgaatgcatcgctcagctgaaggacctacttccagagcacctgaaacttacgaccctgggtcatctcgaaaaagccgtggtacttgagctgacactgaagcacctcaaagccctgactgcactcactgagcagcagcatcagaaaatcatcgcactccagaacggcgagaggtcactcaagtcccccatccagagtgacctggatgcgtttcactccggattccagacgtgtgctaaagaagtcctacagtatttgtcacgattcgaatcctggaccccccgagagcctcggtgcgtacaactcattaaccacctgcatgcagtggcaacccagtttctgcccactcctcaactgctgacacagcaagtgccactgtccaagggcaccggtgcaccctcggccgctggcagcgccgcagcgccttgtcttgagagggccggacagaaactcgaacctctcgcttattgcgtccctgtgatccagcggacccaacccagcgccgaattagctgcagaaaacgatacagacacagactcagggtatggcggtgaggctgaagctaggccggatagggagaagggaaaaggcgctggggcttcacgggtcactatcaagcaggaaccacctggagaggacagtcccgctcctaaacgcatgaagttagattctcgggggggcggctcggggggagggcctgggggcggggccgcggcggccgccgcagccctgctcggacctgatccggctgccgcggctgccctgcttagacctgatgcagcgctgctgtcttcactcgtcgcattcggaggcggcggcggtgccccctttccacagccagcagccgctgctgcaccattctgcctgcctttttgttttctgtcacccagcgctgccgccgcctatgtgcagccttttctggataagtccgggctggagaagtatttgtacccggctgccgcagctgcaccattcccactcctctatcctgggatacctgcgcctgccgccgccgccgcagcagccgccgcagccgccgctgctgccgccgctttcccctgcctttctagtgtgctgtccccacctccagagaaggccggcgccgcagcagccacattgctgcctcatgaagtggcgcccctgggcgcaccccatccacagcatccacacgggcgaacccacttgccctttgcggggcctagagagccagggaatccagagagctccgcccaggaggatcccagccagcccggaaaggaagcaccc

SEQ ID NO: 7832 - DNA, 1446 bp, Artificial Sequence
  Description of Artificial Sequence: Synthetic coding sequence
atggatgaaggtattccgcaccttcaggaaagacagttgctcgagcatcgggactttatcggccttgattattcctcactgtacatgtgtaagccaaagaggagcatgaaaagagatgacaccaaggacacctacaagctccctcatcgactgatcgaaaagaagcgtagagatcgcatcaacgagtgtattgcacagcttaaagatctcctgcccgagcaccttaaactcaccacgcttggacatcttgaaaaggcagtggtgttggagctgactcttaagcatctgaaggcacttaccgcccttactgaacaacagcaccagaaaatcatagccctccaaaacggagaaagaagcctgaaatcccccatacagtctgacctggacgcattccattccgggtttcaaacctgcgcgaaggaagtcctgcagtacctgtcgagattcgaatcgtggactcctcgcgaaccgagatgtgtgcagcttatcaatcatctgcacgcagttgcaacccagtttctccctactccacagctgcttacccagcaagtgcccctttcgaagggcaccggggccccttccgcggctggatcggccgcagccccttgtcttgagagagcgggacaaaaactggaacctctcgcctactgtgtgcccgtcattcagcgcacgcagcccagtgccgaactcgcagcagaaaacgacaccgatactgactcgggctacggaggagaagcagaggcccggcctgatagggaaaaaggaaagggagctggagcaagcagggtcactattaagcaagaaccccctggcgaggattccccagcaccaaaaagaatgaaactggactcacgtggagggggttccggaggtggacccggaggcggagcagctgccgcagcggcagccctcctcgggccagaccctgccgccgccgccgctctgcttcgcccagatgccgctcttttgtcctcgttggtggcgttcggtggaggaggtggcgctccttttccacaacccgccgcggccgcagcgccattctgtttgccgttctgttttctgtccccttccgctgcagcagcctacgtccaaccattcctggacaaatccggtcttgagaaatacctttaccctgcggcagcggccgctccattcccactcttgtaccctggcattccagctccggcagccgctgccgccgcagcggcggctgcagcggccgcggctgccgcatttccatgtctgagctctgtcctgtcgcctcctcctgaaaaagcaggagcagccgcagcgaccctgcttcctcatgaagttgcaccactgggcgccccacacccccaacatccgcatggtcgaacccaccttccatttgccggaccacgcgaacctggcaatcctgaatcctccgcacaagaagatcctagccaaccagggaaggaagccccc

SEQ ID NO: 7833 - DNA, 1446 bp, Artificial Sequence
  Description of Artificial Sequence: Synthetic coding sequence
atggatgaggggatccctcatctgcaggagcggcagttgctggagcatagagacttcataggcctggattacagcagtctgtacatgtgtaagccaaagagatcaatgaagagagacgacaccaaagatacttacaagctgcctcacaggctaattgagaagaagcgccgtgatagaattaatgagtgcatcgctcagctaaaagatttgctccccgaacacctcaagctcacaaccctggggcatttagaaaaagcggtggtccttgagctcacactgaagcatcttaaggctctgaccgccttgactgaacagcagcaccagaagattatcgctttgcagaacggagagcgttccctgaagtctcctatacaaagtgacctggatgcattccacagcgggtttcagacttgtgctaaggaggtgttgcagtacttgagccgcttcgagtcttggacccctcgcgagcctcgatgcgtgcagctaatcaaccacctacatgccgtggctacacagttcctaccaactccccaacttctcacccagcaggtacctctcagcaaagggactggcgccccctcagctgccggctccgccgctgccccctgcctggagcgggcaggacagaaactggagccactggcttactgtgtgcccgtaatccagcgaacacagccctccgcggaactcgcagctgaaaatgacacagataccgactctggatacgggggcgaagctgaggcacgtcccgacagggaaaaaggcaagggggcaggagcctcccgggttactattaaacaagagccacctggagaggattcgcctgcgcccaagcgaatgaagctagattcccgtggtggcggcagcgggggcggacccggcgggggagccgccgccgctgccgccgctttgctggggccggatccagcagcggcagccgcactgcttcgcccagacgctgctcttctgagcagtctcgtggcctttgggggcggcggcggcgccccatttcctcagcctgctgccgctgctgcgccattttgcctgccattctgctttctcagtcccagcgcagctgctgcctatgtccagccgtttctcgacaagtccggattagagaagtacctttaccctgctgcagcggctgctcctttcccactgctatacccgggcatcccagcgccggccgccgccgccgccgcggctgctgcggctgcagcagctgctgctgccttcccatgcctctccagcgtcctgagtcctcccccagagaaggccggagctgcagccgcaacgctgttaccgcacgaagtagcaccccttggcgcgccccatccacagcacccgcacggccggacccaccttcccttcgctggtccccgagagccgggaaacccggaaagtagtgcacaagaagatccatcacagccgggcaaagaggcgcca

SEQ ID NO: 7834 - DNA, 1188 bp, Artificial Sequence
  Description of Artificial Sequence: Synthetic coding sequence
atggtcgcaggaaccaggtgtctgctcgcactgctgctgccccaggtgcttctcggcggcgcagcgggtttggtccctgaactgggtcggagaaagttcgccgcagcctcctcaggtcgcccatcgtcccaaccatcagatgaagtgcttagcgagtttgaactccggttgttgtcaatgttcggactgaaacagcgccccacccctagcagagatgcagtcgtgccaccttacatgcttgatctttataggcgtcactctggtcaacctggctccccagcacccgaccatcgcttggagcgggctgcatcaagagcgaacaccgtccggagcttccatcacgaagaatcacttgaagaactgcctgaaacctctggaaagactaccaggagattcttctttaatctgtcgtcaattccaaccgaagagtttatcacttctgcagagcttcaggtgtttcgtgaacaaatgcaagacgcacttggtaacaactcatcgtttcaccatcggattaacatttacgagatcattaagcctgcaactgcaaacagcaagtttcctgtgacccggcttctcgacactcgactggtgaaccaaaatgcctcccgatgggagtcgtttgacgtgactccagcagtcatgaggtggactgcacagggacacgcaaatcatggatttgtggtcgaggtggcacatcttgaagaaaaacagggcgtgtccaagaggcatgtcagaatctccaggtcgcttcatcaggacgaacattcatggtcccaaatacgtccactgctcgttacctttggtcacgacggtaagggtcacccccttcacaaaagagagaagagacaagcaaaacataaacagcgaaagagacttaagtcgtcgtgtaaaagacacccactttacgtggacttttcagacgtcggctggaacgattggattgttgccccgccaggttaccatgcattctactgccatggagagtgcccttttccactcgcagaccatcttaactccaccaatcatgcaattgtgcagactttggtgaattcggtgaattccaagatacccaaagcctgctgtgttcctaccgaactctcggccatctccatgttgtatctcgatgagaacgaaaaggtggtgctcaagaactaccaagatatggtggtggagggctgcggctgtcga

SEQ ID NO: 7835 - DNA, 1188 bp, Artificial Sequence
  Description of Artificial Sequence: Synthetic coding sequence
atggtcgctggaacgcgctgcctgcttgcgcttctgttgccacaggtcttgctcgggggcgctgcggggctcgtgcctgagctggggcggcgcaaattcgcagcggcctcatcgggtaggcccagcagccaaccgagtgatgaggttctttccgaattcgagctgagactcctctcgatgttcggcctgaagcaaagacccactccttcccgcgacgccgtggttcccccttacatgctggatttgtacaggcggcattccggtcaaccagggagtccagctcctgaccaccgcctggagcgtgccgcctcccgggcaaatactgtgcgcagtttccatcacgaagagagtctggaagagcttcccgaaaccagcggaaaaaccacaaggcgattttttttcaacctgtccagtattccaaccgaggagtttatcacctcggccgagctgcaagtcttccgagagcaaatgcaagacgccctaggcaataactcctccttccaccatagaatcaacatttatgagattattaaacccgccactgcaaactccaagttccctgtcactcggctgctggatacacgcctcgtgaatcagaatgcaagcaggtgggaaagctttgatgtgacaccggccgtgatgagatggacagcccaaggccacgctaaccatggttttgttgtcgaggtggctcacctagaagagaagcagggtgtgagcaagagacacgttcgaattagccgtagtctccatcaggacgagcattcctggagccagatacggccacttctagtgacgtttggccacgatggcaagggccacccactgcacaagagagagaaacgacaggccaagcataagcagcggaaacggttaaagagtagctgcaagcggcatccactgtatgttgacttcagtgatgtaggttggaacgactggatcgtggctccacccggataccacgccttctactgtcatggggagtgcccgttcccactagccgaccatctgaactccacaaatcatgccattgtgcagaccctcgtaaactcggtcaatagcaagatccccaaggcatgttgcgtgccgacggaactctcggcaatttccatgctttacctggatgaaaatgaaaaggtggtgctcaagaactaccaggacatggtcgtggaaggatgcggctgcagg

SEQ ID NO: 7836 - DNA, 1188 bp, Artificial Sequence
  Description of Artificial Sequence: Synthetic coding sequence
atggtcgcgggcactagatgccttcttgcactgcttctgcctcaggttctgttggggggagcagccggtcttgtgcccgaacttggtcggaggaaatttgccgcagcgagctccggtcgtccttcgagccaacctagcgacgaggtcctctccgagtttgaactgcggctcctgtccatgttcggtctgaagcaacggcccaccccatcgagagatgctgtggtgcctccatacatgcttgacctttacagacggcattcgggacagcctggttcgcctgcccctgatcatcggctggagcgtgcagcttcccgcgcaaacactgtgagatcatttcatcacgaagagtcgctggaggaactcccggaaacctcgggaaagaccacccggaggtttttctttaatctttccagcattcctactgaagagttcatcactagcgccgagctgcaggtctttcgggaacagatgcaggacgccctggggaataactccagctttcatcatcggattaacatttacgagatcattaaacctgctactgcaaatagcaagttcccagtgacccgactgcttgacactcgtcttgtcaaccagaatgcgtcaagatgggagtcatttgatgtgacccctgcagtcatgcgttggaccgcacagggacatgccaaccacggattcgtggtggaagtcgcccacctggaggaaaaacagggtgtgtcgaagaggcatgtgagaatttcacgttccctgcaccaggatgaacacagctggagccaaattagaccactcctggtgacgtttggccacgacggtaaaggacaccctctccataagcgcgagaagagacaagcaaaacataagcaacgtaagcgtctgaagtcctcgtgcaagagacatcccctttatgtggatttttcggatgttggctggaacgactggatcgtggcgccacccgggtaccatgcgttctattgccacggtgagtgcccattccccctggcagatcacctcaactcaacgaaccatgcaattgtccaaaccctggtgaattccgtcaatagtaagataccaaaggcatgttgtgtgccaaccgaactgagcgccatttccatgttgtacctcgatgaaaatgagaaggtggtcctgaagaactatcaagatatggtggtggagggttgcggctgtaga

SEQ ID NO: 7837 - DNA, 1188 bp, Artificial Sequence
  Description of Artificial Sequence: Synthetic coding sequence
atggtggccggaactaggtgtctgctcgcacttttgttaccacaggtcctccttgggggagcggccgggctggtccctgagcttgggaggagaaaattcgctgcagcctcttcaggaaggccctcctctcagccatctgatgaagttttgtcagaattcgaacttagactgctttctatgttcggactaaaacagcgcccaacaccctctcgcgatgcggttgttcctccatacatgctagacctgtaccgacggcactcagggcagcctggatctcccgcccccgatcacaggcttgagcgggcagcatcccgggccaatactgttagaagttttcatcatgaagaatcactggaagaactacctgaaacttcagggaaaacaacaagaaggtttttcttcaatctaagttccatccctactgaagaatttataacatcggctgaactgcaggtgtttcgagaacagatgcaggatgccttagggaacaactccagtttccaccaccggattaatatatatgaaatcatcaaaccagccacagcaaattccaaattccctgtgacaaggctactggatacaagacttgtgaatcaaaatgcttcccgctgggagtcctttgacgtaacacctgcagtgatgaggtggacagctcagggacatgctaaccatgggttcgtcgtcgaagttgcgcatctagaagaaaaacagggagtttcaaagcggcatgtccggatctctagatcccttcatcaggatgaacattcatggtctcaaataaggcctctacttgtgacatttgggcatgatgggaaaggacaccctttgcacaagcgcgaaaaaaggcaggccaagcacaaacaaaggaaacgcctgaaatctagttgtaaaagacatcccttatatgtagacttctccgacgtggggtggaatgactggatagtggccccacccgggtatcatgctttctattgtcatggagaatgccctttccccctggcagatcatcttaattctactaaccatgctatagtgcaaacactcgtgaattcagtcaattccaagatccccaaagcttgctgcgtgccaacagaattgagtgcaatttctatgctgtaccttgatgaaaacgaaaaagtggttctcaagaactatcaggacatggttgtcgagggatgtggatgtcga

SEQ ID NO: 7838 - DNA, 1188 bp, Artificial Sequence
  Description of Artificial Sequence: Synthetic coding sequence
atggttgccggaacccggtgcttgttggcactgctgctgccacaggtcctcctcggtggcgcggcgggactggtcccggaacttggaagaagaaagtttgccgccgcgtcgtcggggcggcccagctcgcagccgtcggacgaagtgctctccgaattcgagctgaggctcctcagcatgttcggacttaaacagcgccccactccgtccagggacgctgtggtgccgccgtatatgctggatctgtaccgccgccacagcggtcaacctggaagcccggctccagaccatcgcctggaaagagcggcctcccgcgccaacacggtccggagcttccaccacgaagagtccctggaggaacttcccgaaacctcgggaaagaccaccagacgctttttcttcaacctgtcgtcaatcccgaccgaggaattcatcacttcagcggagctgcaggtgttcagagagcagatgcaggacgcgctcggaaacaattcgtccttccaccaccgcatcaacatctacgagattatcaaaccggcaacggctaactcaaagttccccgtgacccgcctgctggatacccggctggtgaaccagaatgcgagccggtgggaatcgttcgatgtcactcccgccgtgatgcgctggactgcacagggtcatgccaaccacgggttcgtggtcgaggtggcccatctcgaggagaaacagggcgtctcgaagcgccacgtgcggattagccgctccctgcaccaagacgaacactcgtggtcacaaatcagaccgctgctcgtgaccttcggacacgacggcaagggccatcctctccacaaacgcgaaaagcgccaggctaagcacaaacagagaaaaaggctgaaatcctcctgtaagcgccatccattgtacgtggatttctccgacgtgggctggaacgactggatcgtcgctccaccgggataccatgccttctactgccacggagaatgcccattcccgctggccgaccacctgaactccacgaatcatgctatcgtgcagactctggtgaactcggttaattccaagatccctaaggcttgttgcgtgccaaccgaactgtcggcgatctccatgctgtatctggatgaaaacgaaaaagtcgtgctgaagaactaccaagatatggtggtcgaaggttgcggatgcaga

SEQ ID NO: 7839 - DNA, 1188 bp, Artificial Sequence
  Description of Artificial Sequence: Synthetic coding sequence
atggtagccggaaccaggtgtttgcttgcattgctcctgccacaggtgctgctggggggggccgccggactggtgccagaattgggtcgtcggaaattcgccgctgcgtcatccggccgcccatcctctcagccatctgacgaggtgctctctgaatttgagctccggctgttgtcaatgtttgggttgaagcagcgacccaccccaagtagggatgctgtggtgcccccctatatgctggacctgtatcggaggcatagtgggcagccggggtcccccgcccctgaccaccggcttgaacgcgccgcaagccgcgccaatacggttcgaagtttccaccacgaggagagcctggaggaactgcctgagacctctggtaagaccacgaggcgtttcttcttcaatttgtcttccatccctacggaagaattcattaccagtgctgagctgcaggttttcagggaacagatgcaggacgctctgggtaataattctagtttccaccaccgaattaatatatatgagattataaagcctgccaccgccaattctaagtttccagtcactcgcttgttggatactaggctcgttaaccagaatgcctcacggtgggaatcgtttgatgtgaccccggcggtaatgcgttggaccgcacaagggcacgcgaatcatggctttgtggttgaggtggctcacctggaggaaaaacaaggtgtgtccaaacgccacgtgcggatctcacggtccttgcaccaggatgaacactcctggtcgcagatccgcccactgcttgtgaccttcggacacgatggcaaaggccacccgctgcataaaagagaaaaacgacaggcaaagcacaagcaacggaaacgcctcaaaagttcatgcaaacggcatccgctttatgtggatttttctgatgtcggctggaatgactggatcgtggccccccccggctatcacgccttctattgtcatggtgaatgcccctttccgctcgctgaccacttgaattccacaaaccatgctatcgttcagaccctggtcaacagcgtgaacagtaaaatccccaaggcgtgctgtgtaccaacagagctgtccgccattagcatgctgtacctagatgaaaacgagaaggtcgtgttgaaaaattaccaagacatggttgtggaagggtgtggatgtcga

SEQ ID NO: 7840 - DNA, 1188 bp, Artificial Sequence
  Description of Artificial Sequence: Synthetic coding sequence
atggtcgcaggaaccaggtgtcttttggccctgttgcttccacaagtgctgttgggaggtgcagccggactggtcccggagctcggccgccggaagttcgcagctgcttcttcagggcggccgtcgtcacagccttcagatgaggtcctcagcgaatttgagctccggctgctgtccatgtttggtctgaagcagcggccgactccgtcacgggacgccgtggtgccaccatacatgctggacctctaccgcagacacagcggacagcctggatcaccagccccggaccaccgcctcgaacgggccgcctcgcgcgccaacactgtccggtcgttccatcacgaagagtcgctcgaagaactgccggaaacttcaggcaagactactcgcagattcttcttcaatctgagcagcatccctactgaagaattcatcacctctgcggagcttcaggtattcagagaacagatgcaggacgccctggggaacaacagctccttccatcaccgcatcaatatctacgaaatcatcaaaccggccaccgcgaactcgaagttcccggtgacccgcctgctcgatacccgcctggtcaaccaaaacgcatcccggtgggaatcctttgacgtgactccagcggtgatgcggtggacggcgcagggacacgccaatcacggattcgtcgtcgaagtcgctcatctggaggaaaagcagggcgtgagcaaaaggcatgtccggatctcgcgatcgctccatcaagatgaacattcgtggtcacagatccggccactgctggtgaccttcggccacgacgggaaggggcacccactgcacaagcgggaaaagcgccaggccaagcacaagcaacgcaagagactgaagtcctcgtgcaagcggcatcctctttacgtcgatttctccgatgtgggctggaatgactggatcgtggccccacctggctaccatgccttctattgtcacggagaatgcccattcccactggccgaccatcttaactccacgaaccatgcaatcgtgcaaactttggtcaattccgtgaatagcaagatccccaaggcttgctgtgtgccgaccgaactcagcgccatctcaatgctgtacttggacgagaacgaaaaggtggtgctgaaaaactatcaggacatggtcgtggaaggatgcggctgcaga

SEQ ID NO: 7841 - DNA, 1188 bp, Artificial Sequence
  Description of Artificial Sequence: Synthetic coding sequence
atggtcgctgggacgcgctgtctgttggctctgctcttgccacaggttctactgggtggggccgccggacttgtgcctgaactaggtagaagaaagtttgccgctgcaagcagcggtagacctagctctcaaccatcagacgaggttctctccgagtttgagctgaggctgctgtccatgtttgggctgaaacaaaggcccactccatctcgtgatgccgtggtccctccttacatgctcgacctgtatagaaggcactcaggccagcccgggtctccagcccctgatcaccgtttggaacgagcagcatcccgagcgaatacggtgaggtcattccaccatgaagaatccctggaagaattgcccgagacgtcgggaaagactaccaggcgattttttttcaacttgagctccatccctaccgaggaattcattacgagcgcagaacttcaggtgttcagagaacaaatgcaggatgccctcggcaacaacagtagtttccaccatcgaatcaatatatacgaaatcatcaagccggcgaccgccaactccaagttccctgtcactagacttctcgacacacgtctggtgaaccaaaacgcgagtcgatgggagtcatttgacgtgactcctgccgtgatgaggtggaccgcacaaggccacgctaaccacggcttcgttgtcgaagtcgctcacctggaagaaaagcagggcgtcagtaagagacatgtgaggatatcaaggtctctgcaccaagacgagcactcctggagtcagattcgacccttgttggtgacatttgggcacgacgggaaaggacatccactgcacaaaagggaaaagcgtcaggccaaacacaaacagcgtaaacggttaaaaagttcctgcaagcgacacccactttacgtggacttctctgatgtaggctggaacgactggatcgtggctccgcccgggtaccatgccttctactgccatggggagtgtccgtttcctttggctgaccacctgaactcgacgaatcatgccatcgtccagacactcgtcaattcagtaaactcgaagatccctaaggcatgctgtgtgccaactgagctcagcgcaatcagcatgttgtatctggatgaaaacgaaaaagtggtactgaagaactaccaagacatggtggtggaggggtgcggctgccga

SEQ ID NO: 7842 - DNA, 1188 bp, Artificial Sequence
  Description of Artificial Sequence: Synthetic coding sequence
atggtcgccggcaccaggtgccttcttgccctgttgttgccccaggtgctgctcggaggagcagctggcctggtgccggaactgggaaggcgcaagtttgcagccgcgtcctcggggaggccctcgtcgcagccctcggacgaagtgctctccgaattcgagctccggttgctctcaatgttcgggctgaaacagcggccgaccccctcacgggacgcggtcgtcccgccgtacatgctggacctgtaccgcagacattcgggtcagccaggatccccggccccggatcaccgactggagagggccgcctcgcgcgcaaataccgtgagatcgttccatcacgaagaatcgctggaggagctgccagaaacgagcggtaagaccactcgccggttcttctttaatctttcgtccatcccgaccgaagagtttatcacttcggcagagctgcaagtgttcagagaacaaatgcaagacgccctgggcaataactcgtccttccaccatcggatcaatatctacgagatcattaagcctgcgaccgctaacagcaagtttccggtcacccgtctgttggatacgcgccttgtgaatcaaaacgcgtccagatgggaatcattcgacgtgaccccggctgtgatgagatggaccgcacagggacatgccaatcacggatttgtcgttgaggtggcgcaccttgaggaaaagcagggagtctcgaagcggcatgtgcggatcagcagatcacttcatcaggatgagcatagctggtcccagatcagacctcttctcgtgacttttggacatgatggaaagggacatcctctccacaaaagagaaaaaagacaggccaaacataagcagagaaaacgcctcaaatcgtcttgcaagcgccatccactgtatgttgacttctccgacgtgggctggaatgattggattgtggcgccaccaggctaccacgcattttactgccacggcgaatgcccattccccctcgccgatcacctcaacagcaccaaccacgcaatcgtccagactctcgtgaactccgtgaactcaaagatcccgaaggcctgctgtgtgccaactgaactttccgccatcagcatgctgtacctcgacgagaacgagaaagtggttctgaagaactaccaggatatggtggtcgagggatgcggatgcaga

SEQ ID NO: 7843 - DNA, 1188 bp, Artificial Sequence
  Description of Artificial Sequence: Synthetic coding sequence
atggtggccggaacccgctgtcttctggcactcctgctgcctcaggttcttctgggtggagctgctgggctggtcccagaattgggtcggagaaagtttgcagctgcgtcctctggccgcccgtccagccaaccttccgatgaggtgctttccgaatttgagctgcggctcctgagtatgttcggcctcaaacagcgcccaacaccatctagagatgccgtggtgcctccttacatgctggatctttatagacggcattccgggcagcccgggagtcctgctccagatcatcggctggaaagggccgcctctcgggccaatacagtgcggtcctttcaccacgaggaatccctggaagagcttccagagacctctggtaagaccacacgcagattcttttttaatctgtcctcaatcccaacagaggagtttataacatcagctgagctgcaggtgttccgcgaacaaatgcaggatgccctcggcaacaacagctccttccatcacaggataaatatctacgagataattaaacccgccaccgctaactctaaattcccagtgacgaggctgctggatactagacttgtcaatcaaaatgccagccgatgggagtccttcgacgtgaccccagcggtcatgcgatggactgctcaggggcacgcgaatcacgggttcgttgtggaggtggcccacctcgaagagaagcagggggtcagcaagcgccacgtgcggatctcaagaagcctgcaccaggatgagcacagctggagccagatcagaccattgctcgtcacttttgggcatgatggaaagggccatccactgcacaaaagggagaaacgccaggcaaagcacaaacagcgcaaacggctgaaaagttcttgcaaaagacaccctctgtacgtcgatttcagtgacgtgggctggaatgactggattgtagcgcccccaggttaccacgctttttactgtcatggggagtgccctttccccctcgcagatcatttgaattctacaaaccatgccatcgttcaaactctcgtcaattccgtaaactctaaaatacctaaagcctgctgtgtgccaactgagctctctgctatcagtatgttgtacctcgacgagaacgagaaggtggttctcaagaattatcaggatatggtggtagagggatgtggatgtcgg

SEQ ID NO: 7844 - DNA, 1188 bp, Artificial Sequence
  Description of Artificial Sequence: Synthetic coding sequence
atggttgcaggaacaagatgtttattagctttattacttccacaggttttattaggaggagcagccggacttgtaccagaacttggaagaagaaaatttgctgctgcaagttcagggagaccatcatcacaaccatcagatgaagttctttcagaattcgaattaagacttttatctatgtttggtttaaaacaaagaccaactccatcaagagatgcagtagttccaccatatatgcttgatctttatagaagacattctggacaaccaggaagtccagcaccagatcatagattagagagggccgcatctagagcaaatacagttagatcttttcatcatgaagaatcattagaagaacttccagaaacatcaggaaagaccacaagaagattttttttcaatttatcatcaattccaactgaagaattcataacatctgcagaacttcaagtattcagagaacaaatgcaagatgctttaggaaataattcaagttttcatcatagaatcaatatttatgaaataattaaaccagcaacggcaaattctaaatttccagttactagacttttagatacaagacttgtaaatcaaaatgcatctagatgggaaagttttgatgtaacaccagctgtaatgagatggacagcacaaggtcatgctaatcatggatttgtagtcgaagtagcacatttagaagaaaaacaaggagtttcaaaaagacatgttagaataagtagatctcttcatcaagatgaacattcatggtcacaaattagacctttattagttactttcggtcatgatggtaagggacaccctcttcacaaaagagaaaaaagacaagctaaacataaacaaagaaaaagacttaaatcatcttgtaaaagacatccattatatgttgacttttctgatgttggatggaatgattggattgttgcacctccaggatatcatgcattttattgtcatggagaatgtccatttccacttgctgatcatcttaatagtacaaatcatgcaattgtacaaacacttgttaattctgtaaattcaaagataccaaaagcttgttgtgttccaacggaattaagtgctattagtatgctttatttagacgaaaatgaaaaagttgttcttaagaattatcaagatatggttgttgaaggatgtggatgtaga

SEQ ID NO: 7845 - DNA, 1188 bp, Artificial Sequence
  Description of Artificial Sequence: Synthetic coding sequence
atggtggctggcacgcgctgtctcctggcccttctcctgcctcaggtgttgctgggcggagcggcaggtctggtcccggaactgggacgccgcaaattcgcagccgcgtctagcggcagaccgtcctcccaacctagcgacgaggtgctctcggagtttgaactccgcctgctctccatgttcggacttaagcaaagacccacccccagccgcgacgcagtggtgcctccttacatgcttgatctgtaccggcgccactcggggcaacccggaagcccggccccagatcaccgactcgaacgggccgcgagcagagctaacaccgtccgctccttccaccacgaggagtcactggaagaactcccggaaacgagcggaaaaacgacgaggagatttttcttcaacctgtcgtccatcccaactgaagaattcatcaccagcgcggaactgcaggtgttccgggagcagatgcaagacgcactgggcaacaattcttcgttccaccatagaatcaacatctatgagatcatcaagccagctaccgcgaatagcaagttcccggtgacccgcctgttggatacccggctcgtgaaccagaatgcatcgagatgggagtcgtttgatgtcaccccagctgtgatgcggtggacggctcagggtcatgcgaaccacgggtttgtggtggaggtggcgcacctcgaagagaaacaaggagtctcgaagcggcatgtgcggatctcgaggagcctgcaccaggacgaacattcgtggtcgcaaatccggccactgctggtcaccttcggacacgatggaaagggacatccacttcataagcgcgaaaaacggcaggctaaacacaaacagagaaagaggctcaagtcgagctgcaagcggcatccgctgtacgtcgacttttccgacgttgggtggaatgattggattgtggcgccgccaggataccacgccttctactgccacggagaatgtccgtttccactggcggaccacttgaactcgaccaaccatgcaatcgtgcagaccctcgtgaattcggtgaactctaaaatccctaaagcatgctgcgtgcccaccgagctgtccgcgatctcaatgctgtacctggatgagaacgaaaaagtggtgctgaagaactaccaggatatggtggtagaaggttgcggttgcagg

SEQ ID NO: 7846 - DNA, 1188 bp, Artificial Sequence
  Description of Artificial Sequence: Synthetic coding sequence
atggtagccgggactagatgtctcctcgctctactgctgccccaggtgctgctggggggagccgcagggcttgttcccgagctcgggaggagaaaattcgctgcagcctctagtggacgcccatcctcccagccgtccgatgaagtcttatccgaattcgagctgagactactctcaatgtttgggctgaagcagagacccacaccatctcgagatgccgtagtgcctccctatatgttggacctatataggaggcattcagggcagccaggatctcctgcgcctgatcatcggctcgagagggccgcctcccgggccaacactgtgagatccttccatcacgaagaatcactcgaagaactgcccgaaacttcagggaaaacaactcgaagatttttcttcaatttaagttctatccctactgaagaattcataacatctgcggaacttcaggtctttagggaacaaatgcaagatgcacttgggaacaatagttcctttcatcatagaataaatatatatgaaatcataaaaccagccacagccaactctaagttcccagtgacacggttactagatacacgcttagtgaatcaaaacgcttccaggtgggaaagtttcgacgttacacccgctgttatgaggtggacagcgcagggacatgcaaaccatggattcgtggtcgaagtagcacatctcgaagaaaaacagggggtttctaagagacacgtgaggatctccaggtctctccatcaggatgagcactcctggtcacagataaggcccctgttagtgacatttggacacgatgggaaagggcatccattacacaaaagagaaaaaaggcaggcaaagcataaacagagaaaaagactcaaatcttcttgtaaaagacatcctttgtacgtcgatttttctgatgtggggtggaacgattggatagtggcaccccccgggtatcacgccttctattgccacggggaatgccctttcccattagctgatcatcttaattcaactaaccacgcgattgtacagactctggtgaactccgtcaactccaaaatacctaaagcttgttgtgttcccacagagctatccgccatctccatgctgtatctagatgaaaatgaaaaagttgtgctgaaaaactatcaggatatggtggtggaaggatgcggatgccgg

SEQ ID NO: 7847 - DNA, 1188 bp, Artificial Sequence
  Description of Artificial Sequence: Synthetic coding sequence
atggttgcagggactcgatgtttgcttgcactcctgctaccccaagtactgctgggaggtgctgccggcctggtgccagagttggggaggaggaaatttgctgcggcttccagcgggcgaccatcatcacaaccatctgatgaggttctgtctgagtttgagctcagacttctgtctatgttcggactaaagcagagacctaccccctcccgggacgccgtcgtgcctccctacatgctcgatctctacagacggcactccgggcagcccgggtctccggctcccgaccatcgcctagaacgcgctgcatcacgggcaaacaccgtgcggagttttcaccacgaggagtcacttgaggagctccctgagactagtggtaagaccacacggaggttcttcttcaatctgtcttccattcccactgaggaattcattaccagtgccgaacttcaggtgtttcgcgagcagatgcaggatgccctaggcaataacagttcttttcatcatcgcattaacatctacgaaattattaagccagcgactgccaattctaagtttcccgtcacacgcttgcttgatacaaggctggtgaatcagaatgcatcgcgttgggaatctttcgacgtgacacctgcagtgatgaggtggactgctcagggacacgccaatcacggattcgtagtggaggtcgcgcacttggaggagaagcagggcgttagcaaacggcacgtaaggatcagcagatctctgcaccaggacgaacactcatggtcgcagataagacctctgcttgtaacttttggccacgatggcaaaggacatcccctgcataagcgggagaagcgccaagctaagcacaagcaaaggaagcggctaaagtcttcttgtaaaagacaccctctctatgtcgactttagcgacgtgggctggaacgactggattgtagctcccccaggataccacgccttctactgccacggcgaatgtccatttccactggcagatcatctaaacagcacaaaccacgccattgtgcaaacccttgtcaacagcgtcaactccaagatccccaaggcctgctgcgttccgactgagctgtcagcgattagcatgctgtacctggatgaaaacgagaaggtggtgctgaaaaactaccaggatatggtggtggagggctgtggctgccgc

SEQ ID NO: 7848 - DNA, 1188 bp, Artificial Sequence
  Description of Artificial Sequence: Synthetic coding sequence
atggtcgcgggcactcgatgtttgttggcactgctgctccctcaggtgttgttgggcggtgctgcaggattagttcccgagcttggtcgccgtaagttcgccgcagcatcttctggtcgaccatctagtcaaccgtctgatgaagttcttagtgagttcgagttgcgtctgctgtcgatgttcggactcaagcaacgtccgacgccttctagagacgcagtggtccctccatacatgttggacctgtataggcgtcactctggtcagccaggatcaccggctccagaccaccgtttagaacgtgcagcatctagagcaaatacagttcgatcttttcatcatgaggagtcattagaagagctaccggagacatcaggaaagacgacaagacgattctttttcaatctctcctccatcccaacggaagaatttatcacttctgcagagctccaagtattccgggagcaaatgcaggatgcgctcggtaacaattcgagcttccatcatcgaatcaacatctatgagatcatcaagcctgccacggccaacagtaagtttccagtgacacgcctcctcgatactaggttggtgaaccagaacgccagtcgctgggaatccttcgacgtcacgccagccgttatgcggtggacggcccagggtcacgcaaatcatggtttcgttgtagaggtggcccatcttgaggaaaagcagggagtgtctaagcggcatgtgcgaatcagtcgctctctgcaccaggacgaacatagttggtcacagatcagacccctcttggtgacttttgggcatgatggcaaggggcacccacttcataagcgagaaaagagacaagcgaagcataaacagcgcaaacgactgaagtcaagttgtaagaggcatccgctgtatgttgacttttccgatgtcgggtggaatgactggattgtggcgccgcctggttatcacgccttttattgccacggtgaatgcccgtttccgctcgcggaccaccttaactcaacgaaccatgccattgtccaaacactcgttaactcagttaacagcaagattcctaaggcatgttgcgtcccaactgaactcagtgcgatctctatgctctatctggacgagaatgagaaggttgtgttaaagaattatcaggacatggtggtggaaggttgtggctgccgg

SEQ ID NO: 7849 - DNA, 1188 bp, Artificial Sequence
  Description of Artificial Sequence: Synthetic coding sequence
atggtcgccggtacacgctgcctgctggccctgctgttaccccaggtcctgctgggaggtgcagctggtctggtgcctgagttaggccgaaggaaatttgccgccgcatcaagcggaagaccttctagccagcctagcgatgaggtattatcagaattcgagctaagactgctaagcatgtttggcctaaagcagaggcctactccatcccgcgatgccgttgttccaccatatatgctggatttataccgaagacactccggccagcctggatcccctgcacccgaccacaggctggagcgcgccgcatctcgcgccaacaccgttcggtcttttcatcatgaggagtcactagaagaacttcctgagacttccgggaagaccactcgtcgattcttcttcaatctgtcctcaattccaaccgaggagtttatcacttctgctgaactgcaggtctttcgcgagcagatgcaggatgccctagggaacaacagttcctttcatcaccggatcaatatatatgaaattataaagccagcaacagcaaattctaagttcccagtgaccaggcttctcgatacccggcttgtcaaccagaacgcttcaagatgggaatcctttgatgttacccccgccgtcatgaggtggactgcccaaggccatgcaaaccacgggttcgtggtggaagttgcccacttagaggaaaagcagggggttagcaagcgacacgttcggataagccggagtctgcaccaggacgaacattcttggtcccaaatcaggcctctactggtaacatttggacatgacggcaaagggcacccactgcacaagagagaaaagcgccaggctaagcacaagcaacggaaacgcttaaagagctcttgtaagcgtcatcctctttacgtcgactttagtgatgtcgggtggaacgattggatcgtcgcaccacctggctatcacgctttctactgccatggagagtgcccatttcctctggcagaccatctgaatagcacaaaccatgccattgttcaaaccctggtgaacagcgtgaactcaaaaattcctaaggcttgttgtgttcctactgaactgtccgccattagtatgttgtatctagacgagaatgaaaaagtagtcctgaaaaactaccaggatatggtggtcgagggctgcggttgtagg

SEQ ID NO: 7850 - DNA, 1188 bp, Artificial Sequence
  Description of Artificial Sequence: Synthetic coding sequence
atggtggcgggaacgcgatgtcttttggccttgctgttgccacaggtgctgctgggtggggccgcaggacttgtcccggaactgggccggcggaagtttgcggccgcttcctcgggacggccatccagccagccctctgatgaggtgctgagcgagttcgagctgcgcttgctgtcgatgtttgggttgaagcagcggccaacgccgagccgcgatgcggtggtgccaccttacatgctggacttgtaccgccgccactcggggcaacctggaagccctgcaccagatcacaggttggagagggcggcatcgagggcaaacaccgtgcggtccttccaccatgaggagtccctggaagaactgccagaaacctccggcaaaactacccgacggttcttcttcaacctgtcgtcgattccgactgaagaattcatcacgagcgcagagcttcaggtctttcgcgaacaaatgcaagacgccctcggcaacaactcatcattccaccatagaattaacatctacgaaatcatcaaaccggccaccgccaactcgaagttcccagtcacccggctgctcgatacgaggctcgtcaatcagaatgcgagccgatgggaatcctttgatgtgactccggcagtcatgaggtggactgcgcagggccatgctaatcacgggttcgtagtggaagtggcacaccttgaggagaagcagggagtgtctaagcgacacgtgcggatctcacggtccctccatcaggacgagcatagctggagtcaaatccgccctcttctcgtgaccttcgggcatgacggaaagggccaccctctccacaaacgggaaaagagacaggcgaaacataaacaaagaaagcggcttaagtcctcatgcaaaagacacccgctgtacgtcgatttctccgacgttggctggaatgactggatcgttgcgcctcctggataccacgcattctattgtcatggagaatgcccgtttccgctcgccgaccacctcaactcaactaatcatgccatcgtgcagactctggtcaattctgtgaactccaagatcccgaaagcgtgctgcgtgccgaccgaactgagtgcaatttccatgctgtacctggacgagaacgaaaaagtggtcctgaagaactaccaggacatggtcgtggagggatgcggatgcagg

SEQ ID NO: 7851 - DNA, 1188 bp, Artificial Sequence
  Description of Artificial Sequence: Synthetic coding sequence
atggtggccggaacgagatgccttttggccttactgttgccacaagtgcttttggggggcgcggcaggcttggtcccagagcttgggcggcgtaagttcgctgccgcatcaagcggtcgacccagcagtcagcccagcgacgaggtgctctctgaatttgagctaagactcctctccatgttcggtttaaagcagaggcccactccttcacgggatgctgtggtgccaccatacatgctcgatctgtaccgccggcacagcgggcaacctggctccccagcccctgaccatagactcgagagagccgcaagccgggctaacacggtgaggagcttccatcatgaggaatcacttgaagagctgccagagactagcggaaagaccacaaggcggtttttcttcaacctgtcaagcattccgacggaagagtttataacatctgctgagcttcaggtgttcagggaacaaatgcaggacgccctgggtaacaatagttcgttccatcatcgaattaacatttatgaaatcattaagcccgcaacggctaatagcaagtttccagtgacccggctgctcgataccaggttggtgaatcagaatgcctccaggtgggagtcctttgatgtaactccggctgtgatgcgatggactgcccagggacacgcaaatcacggcttcgtcgtggaggttgcacatcttgaggaaaaacagggcgtatctaagcgccatgtccggatctctcgtagcctgcatcaggatgaacattcttggagtcaaatccgaccgcttttggttacatttggccatgacggaaaggggcaccccctgcataaaagagagaagcgccaggctaaacataaacagcgtaagcgactgaaatctagttgtaagcggcatccattgtacgtggatttttctgacgtgggatggaacgactggatcgtcgcaccccctggatatcatgccttttactgccatggggaatgtccgttcccccttgccgaccatctcaacagcacgaatcatgctatcgtgcagacccttgtcaactccgtcaattcaaaaatcccaaaagcttgttgcgtgcccactgagctgagcgctataagtatgctgtacctggatgagaacgagaaagtcgtgctgaagaattaccaggacatggtcgtggagggatgtgggtgccgg

SEQ ID NO: 7852 - DNA, 1188 bp, Artificial Sequence; identical to SEQ ID NO: 7835
  Description of Artificial Sequence: Synthetic coding sequence

SEQ ID NO: 7853 - DNA, 1188 bp, Artificial Sequence
  Description of Artificial Sequence: Synthetic coding sequence
atggttgcaggcacgagatgcctgctggcactcctgctgccacaggtcctgttgggcggtgcagcaggtttggtcccggagctgggccgacgtaagttcgcggccgcatcaagcgggagaccaagctcccagcctagcgacgaagtactgagtgagtttgaactgcgtttgctgagcatgtttggtctgaaacagcgccctacccctagccgcgacgcagtggtgccaccatatatgctggacctgtataggcgccacagcggccagcctggtagccccgctccagatcatcgactggagcgcgccgcgtctcgcgcgaataccgtgcgcagcttccaccacgaggaatcgttagaggagttgccagaaacttcgggtaagacaactcgtaggttcttttttaacctgtcaagcattcctactgaagaatttattaccagtgccgaactgcaggtgttccgcgaacaaatgcaggacgcgctgggtaataatagctcctttcaccaccggatcaacatttacgagatcattaaacctgcgacggcaaactctaaattcccagtgacacgcttactggacacccgccttgtcaatcagaacgcaagccgctgggaaagcttcgacgttaccccggccgttatgaggtggacggcgcaaggtcatgccaatcacggatttgtggtagaagttgcccacctggaggaaaaacaaggcgtctcgaagcgacatgttaggatttcccgctcgttgcaccaggacgagcactcctggagccaaattaggcctctgctggtcaccttcggtcatgatggtaagggccacccactgcacaagcgcgaaaagaggcaggctaagcataagcagaggaagagactgaagtcaagctgtaaacgccatcctctgtacgtggacttttccgatgtgggctggaatgattggatagtggcgcctcccggttaccacgcgttctactgccacggtgaatgtcccttcccactggctgatcacctcaactcgactaaccatgcgatcgtgcaaactttggtcaactccgtcaacagcaagatcccgaaggcatgttgcgttccaaccgaactgtccgcgatctctatgctatatctggacgagaacgagaaggttgtgttgaaaaattaccaggatatggtcgtggaaggctgtggctgccgc

SEQ ID NO: 7854 - DNA, 1188 bp, Artificial Sequence
  Description of Artificial Sequence: Synthetic coding sequence
atggtggctgggacacggtgtctgctcgcgctgctgctgccccaggtgctgctggggggtgccgcgggattggtgcccgaactcgggcggcgaaagttcgcagccgcgtccagcggacgcccttcatcgcagcccagcgacgaggtgttatcggaattcgaattacgtctgctctctatgtttggattgaaacagcggccaaccccatcacgcgatgccgtggttcctccctacatgctggacttatacagaagacacagtggccagcctgggtcccccgcaccggatcaccgtcttgagagagccgcctcccgggccaatactgtccgatccttccatcatgaggaatcgttagaagaactgcctgaaacttctgggaagacaacacgcagattcttcttcaatctgagcagcatcccaactgaggagttcatcacctctgctgaactgcaggtgtttcgtgagcagatgcaggatgcgctcggcaacaatagcagtttccaccatcggattaacatatatgagatcatcaagcctgccacagcaaactccaagttcccagtgacccggcttctggataccagactcgtgaaccagaacgctagtcgatgggaaagctttgatgtgacgcctgccgtcatgaggtggacagcccagggccatgctaaccacggctttgtcgtcgaggtagctcacctggaggaaaaacaaggcgtgtccaagcgccacgttagaataagccggagcttgcaccaagacgagcatagctggtctcaaatccgcccactactggttacatttggtcacgacgggaaaggtcaccctctgcacaaaagggagaagcggcaggctaagcataagcagcgcaaaagactgaagtcttcctgtaagaggcacccgctttacgtggatttctccgacgtgggatggaacgattggattgtggcacctcccggctatcacgccttctactgtcatggtgagtgcccgtttcccctggctgaccacttaaattcaacaaaccacgctatcgttcagactttggtcaatagcgtgaatagcaaaattccgaaggcctgttgcgtacccacagagctgagcgccatctccatgctgtatctagacgagaacgaaaaagtggtgctcaaaaattatcaggacatggtggtggagggctgcggctgccgg

SEQ ID NO: 7855 - DNA, 1188 bp, Artificial Sequence
  Description of Artificial Sequence: Synthetic coding sequence
atggtggccggaactcggtgccttctggccctgctgctgccacaggtcttgctcggaggcgcggccggactggtgcctgaactggggcggagaaagttcgcggctgcctcgtccggacgcccgagttcgcagcccagcgatgaagtcctgagcgagttcgagctcagactgctgagcatgttcggactcaagcagcggccgaccccaagccgcgacgccgtggtgccgccttacatgctggatctttaccggcgccattccggtcagcctggatcccccgcgccggatcaccggctggagagagccgcttcgcgcgcaaacacggtgcgctcattccaccatgaagagagcctcgaggagcttccggaaacctccggcaagacgaccaggaggttcttcttcaacctctcgtcgatcccaaccgaagaattcatcacgtcggccgaactgcaagtattcagagaacaaatgcaagatgccctggggaacaactcatcgttccaccataggatcaacatttacgagatcataaagccggccactgcaaactcgaaatttccggtaacgcggttgctcgacacccgcctggtgaatcaaaatgcatcgcgctgggagtctttcgacgtgacgccggccgtgatgcgctggaccgcgcaggggcacgctaaccacggattcgtcgtggaagtggcgcacctggaagagaaacagggagtctccaaacgccacgtgaggatctcacggtcacttcaccaggacgagcactcatggtcgcaaatcagaccactgcttgtcacttttggtcatgatggaaagggccatccgctgcataagagagaaaagcgacaagccaaacacaaacagagaaagaggctgaaaagctcatgcaagcgtcacccgctgtatgtggatttctcggacgtgggatggaacgactggatcgtggcaccccccggctaccatgctttttactgccatggcgaatgtccatttccccttgctgaccaccttaactctaccaatcatgcaatcgtccaaactctggtgaattccgtgaatagcaaaattccgaaggcctgctgcgtgccgactgagctgtcagcgatttcaatgctgtaccttgacgaaaatgagaaggtggtgctcaagaactaccaggacatggtggtggagggatgtggatgccgg

SEQ ID NO: 7856 - DNA, 1188 bp, Artificial Sequence
  Description of Artificial Sequence: Synthetic coding sequence
atggtggcaggcacgcggtgcttgctggcactcctgcttccgcaggtgcttctcggaggagcagcggggctggtgccagaacttgggagacgaaagttcgcggcggctagctcgggcagaccttcctcacaaccatccgatgaagtgctctccgaatttgaactccgacttctttccatgtttgggttgaagcaaaggcccaccccctccagggacgccgtggtccctccttatatgctcgatctgtacaggagacactccggacaacccggttccccagcccctgatcatagacttgagcgagcagcaagccgggctaacactgtgcgctcgtttcaccacgaggagtcactcgaagaactgcccgaaacttctggtaagaccaccagaagatttttcttcaacctgtcgtctatacctaccgaagagttcatcacttctgctgaattgcaagtgtttcgtgaacagatgcaagatgcattgggtaacaattcatctttccaccatcgaattaacatatacgaaatcataaagcccgcaactgcaaattccaaatttcctgttactaggttgctcgacactcggcttgtgaatcagaacgcgagccgatgggaaagttttgatgtcacccctgccgtcatgaggtggactgcgcaggggcatgccaatcatggatttgtggtggaagtggcgcatttggaagaaaagcaaggagtctcgaagaggcacgtgagaatatcacgcagcctgcatcaggatgagcattcgtggtcgcaaattcgcccacttctggtgacctttggtcatgatggtaagggccatcccctgcataaacgcgagaaacggcaagctaaacacaagcaaagaaagagacttaagtcatcatgtaaaaggcaccctctgtacgtggactttagcgacgtgggctggaacgattggatcgtggcaccacccggttaccatgctttttactgccatggagagtgtcccttcccacttgccgatcaccttaatagcactaatcatgcaatcgtccagacgttggtcaattccgtgaactcgaagattcctaaggcctgttgcgttccgactgaacttagtgccatttcaatgctgtacctggatgaaaacgagaaagtggtcctgaagaactaccaggatatggtcgtcgaaggatgtgggtgtaga

SEQ ID NO: 7857 - DNA, 1188 bp, Artificial Sequence
  Description of Artificial Sequence: Synthetic coding sequence
atggtcgccggtaccaggtgtctccttgcactgcttcttcctcaagtgctgttggggggagcagcgggccttgtgcctgagctgggtcgcaggaagttcgccgcagcatcgtccggtaggccgtcctcccaacctagcgacgaagtgctgagcgaatttgaattgagattgctttccatgtttggcctcaaacagcggcctactccatcgcgcgacgccgtggtgcccccatacatgctggatctctaccggaggcactcgggacaaccaggatcgccagcgcctgaccatcgccttgagagagcagcatcgagggcgaataccgtgaggagcttccatcacgaggagtccctcgaagaactgcctgaaaccagcgggaaaactaccaggcgttttttctttaacttgtcatcgatcccaactgaggagttcattacgtcagccgaactccaagtgtttcgcgaacagatgcaggacgcactggggaacaattcgtcgtttcaccaccgcattaacatatatgaaatcattaagcccgccactgctaattctaaattccctgtgaccaggcttctggacaccaggctggtcaaccaaaatgcatcgcggtgggagtccttcgatgtcaccccagcagtgatgaggtggaccgcccaaggccatgccaaccatggcttcgtcgtggaggtggcacatctggaggaaaagcagggagtctccaagagacacgtgagaatttcgaggagcctgcaccaagatgagcatagttggtcccagattcgcccccttcttgttacctttggtcacgatggtaagggacacccactccacaaacgagaaaagagacaggcaaaacacaaacagagaaagcggctgaagtcctcgtgtaagcgacatcccctgtacgtggacttttcagatgtcggctggaacgattggatcgtggccccacccggatatcatgcattttactgccatggagaatgcccctttcctcttgcggatcacttgaactcaaccaaccatgccatcgtgcaaactctcgtcaactccgtcaacagcaagatccctaaggcctgttgcgtgcctactgaacttagcgcaatctccatgctgtaccttgacgaaaacgagaaggtggtgctgaagaactaccaagatatggtggtcgaagggtgcggttgccgg

SEQ ID NO: 7858 - DNA, 1188 bp, Artificial Sequence
  Description of Artificial Sequence: Synthetic coding sequence
atggtggcgggtaccagatgccttttggctctgctgcttccccaggttctcctgggtggagctgcgggattggtgccagagctgggccgccggaagtttgcagcagcaagcagtggaaggcctagctctcaaccatcagatgaagtgctttcggagtttgagctgcgcctgctctcgatgtttggcctgaagcaaagacccacccctagccgtgatgccgtcgtgcccccgtacatgttggatttgtatagacgacattccggtcaacccggctcgccagcaccagatcatagactcgagagagcagcctccagagctaacactgtgcggagctttcatcatgaagaatcgctggaagagctcccagaaacttccggaaagaccactaggagatttttcttcaaccttagcagcattcctaccgaagaattcatcacctccgcagaactgcaggtgtttcgggaacaaatgcaagacgcactggggaataactcatcttttcatcaccggatcaatatctatgagatcattaagccagcgactgctaacagtaagtttccagtgaccaggcttcttgatactcgtcttgtgaaccagaacgcatcgaggtgggaatcatttgatgtcactcctgcagtgatgcgttggaccgcacaaggccatgccaaccatggttttgtagtggaagtcgcccatctggaagaaaagcaaggagtgtcgaagcggcatgttcgcatatccagatcgctgcatcaggatgaacactcgtggagccaaatacgtcctctcctggtcactttcggacatgacgggaaaggtcatccacttcacaagcgcgaaaagcgccaagctaaacataaacagagaaagcgtctgaaatcctcatgtaaacgccatcctctctacgtggacttcagcgacgtcggatggaacgattggattgtggctcctccaggataccatgcgttctactgccacggggaatgccctttccctctcgccgatcacctgaacagcactaaccatgcaattgtgcaaactcttgtgaactcagtgaactcaaagatcccgaaagcatgctgcgtgccaaccgaactttcggcaatttccatgctctaccttgacgaaaatgagaaagtggtgcttaagaactatcaggatatggtcgtcgaaggatgcggatgccgg

SEQ ID NO: 7859 - DNA, 1188 bp, Artificial Sequence
  Description of Artificial Sequence: Synthetic coding sequence
atggttgcgggcactcgctgccttctggccttgctgctcccacaggtgctgctcggaggggctgccggtcttgtccctgagttgggcagacggaagttcgcagcggcgtcatcagggcgaccgtcgagccagccatcagacgaggtgctcagcgaattcgaactgagacttctctcaatgttcgggctgaagcagaggccgactccgagccgcgacgctgtggtgccaccgtacatgctggatctctatcggaggcattcgggacagccaggatcgcctgcgcctgaccatagattggagcgggcagcctcccgggccaacactgtgcgctcttttcaccatgaggagagcctcgaggaattgccggaaacctccggtaaaacgaccagacggtttttctttaatctgagctcgatcccgactgaagaattcatcacttccgctgagctgcaagtgtttagagagcaaatgcaagatgccctgggtaacaactccagctttcaccaccgcatcaacatttacgagatcatcaagcctgcgaccgccaattcgaaatttccggtcacccgtctcctggataccaggctcgtaaaccaaaacgcgtctcggtgggaatcatttgacgtgactccggcagtgatgagatggactgcccagggccacgccaaccacggctttgttgtggaagtcgcccatttggaagagaagcaaggagtgtccaagagacacgtgcggatcagcaggtccctccaccaagacgaacactcctggtcgcaaatacgcccgctgctggtgacgttcggacatgatggcaagggacatccgctccacaagagagaaaagcggcaagccaagcataagcagcgcaagagacttaagagctcgtgtaagcgccatccactgtacgtcgattttagcgatgtcggatggaacgattggatcgtggcgcccccgggctaccatgcgttctactgccacggggaatgcccgttcccgctggccgatcatctcaactcgaccaaccatgcgatcgtgcagaccctcgttaattcggtgaacagcaagatcccaaaagcctgctgcgtccccacggagctgagcgctatctcgatgctttatctggatgagaatgagaaagtggtgctgaagaactaccaagacatggtggtggaaggatgcggttgcaga

SEQ ID NO: 7860 - DNA, 1188 bp, Artificial Sequence
  Description of Artificial Sequence: Synthetic coding sequence
atggttgctggcactagatgcttgttggcattgcttttgccgcaggtcctcctcggaggagccgctggattagttccagagctgggccgacgtaaattcgcggccgcttcttcaggaagaccatcatcacagccaagtgatgaagtgttgagtgagtttgaattaagattgcttagtatgttcgggttgaagcagcgccccacgccatctcgtgatgctgtggttcccccatatatgctggatttgtatcgtcgacattcaggacaacctggatctcccgcacctgatcacagacttgagagagctgctagtcgtgctaacacagtgagatctttccaccatgaagaatcacttgaagaattgcctgagacgtctggaaagacaactcgacgattcttcttcaacttgtcatccattcccacagaagaatttatcacatccgctgaactccaagtcttccgcgaacaaatgcaagatgcattaggtaacaactcatcattccatcatagaattaatatttatgaaatcattaaaccggccactgctaacagcaaatttcctgttacaagactcctggatactagactggtcaatcaaaacgcatcccgttgggaatcatttgatgtgacgccagctgtcatgagatggactgctcaagggcatgcaaatcatggttttgtcgtggaagtcgcccacttagaagaaaaacaaggggtgtcgaaacggcatgtcaggatttcaagatcgcttcaccaggatgaacatagttggagccaaataagaccactcctggttacgttcgggcacgatggtaagggacacccattgcacaaaagagaaaaacgccaggcgaagcataaacaacgaaaacgattaaaatcgtcttgtaagagacacccgttgtatgtagatttttcagacgttggctggaatgattggatcgtggctccacctggatatcacgctttctattgccacggagaatgtccatttccattagcggaccacctaaattccacaaaccatgctattgttcaaacattagtaaatagtgtaaattctaaaattccaaaagcatgctgtgtaccgacggaactgagcgctatttcgatgctgtacctggatgagaatgaaaaagttgtgttaaagaattaccaggatatggttgtagagggatgtggatgcaga

SEQ ID NO: 7861 - DNA, 1188 bp, Artificial Sequence
  Description of Artificial Sequence: Synthetic coding sequence
atggtggccggcacccgatgcctcctcgcactgcttctgcctcaagtgctcttggggggtgcagcagggcttgtgccagagcttggccggcgcaagttcgccgcagcctcctcaggaaggccttcgagtcagccaagcgatgaagttctgtctgaatttgaacttcgcctcctgtccatgttcggactgaagcagcggcccacgccatcacgggatgcagtggtccctccatacatgctggatctgtaccgcaggcattcgggccaacctgggtcgccagcaccagatcaccgtctggagcgagcagcctcgcgcgcaaatactgtgcggagctttcaccacgaggagagcctcgaagagcttcctgagacttccggaaaaaccacccgcagattcttctttaacctgagctcaatccccactgaagagtttatcaccagcgccgaactgcaagtgttcagagagcaaatgcaagatgctctgggcaacaactcgagctttcatcatagaatcaacatatatgaaatcataaaacccgccacggccaactcgaagttccccgtgactaggcttctcgacactcgtcttgtcaatcaaaacgcttcccgctgggagagctttgatgtgacccctgccgtgatgagatggactgctcaggggcatgcgaatcatggatttgttgttgaggtcgcacacctggaagagaagcagggcgtgtccaagcgtcacgttcgaatatcgcgcagccttcaccaggacgagcattcgtggtcgcaaatcaggccccttctggtcacgtttggacacgatggaaagggacaccctcttcataagcgagaaaaaaggcaggccaagcataagcaacgaaaacgcctcaaatcatcatgtaagcggcatcctctctacgtggacttcagcgacgtgggctggaacgattggattgtggcacccccaggataccacgcattttactgtcatggagagtgtccttttcctctggcagatcaccttaactcaacgaaccatgccattgtccagactttggtgaacagcgtaaactccaagatcccgaaggcatgttgcgtgccgaccgaactctcggctatctcaatgctttacctcgatgaaaatgagaaggtggtgcttaagaactaccaggacatggtcgtggaagggtgtggttgccgt

SEQ ID NO: 7862 - DNA, 1188 bp, Artificial Sequence
  Description of Artificial Sequence: Synthetic coding sequence
atggtggcggggactcggtgcctcctggcgctgctgctgccccaggtgctgctgggcggggctgccggcttggtgcccgaactcggacgtcgcaagtttgcggccgcttcttccgggcgaccatcaagccaaccttcggacgaggtattaagtgagttcgagctgcggctgttgtccatgttcggacttaagcagaggccaacaccgtcccgcgacgctgtggtgcccccttacatgctggacctctaccgtcgtcattcgggacagccaggctccccggcaccggatcatagactggaacgggctgccagcagagcaaatactgtgcgtagttttcatcacgaggaatcgcttgaagaactccctgagaccagtggaaagactactcgacgctttttttttaacctgagcagtatccctaccgaagagttcatcacctcagccgagctacaggtcttcagggagcagatgcaggacgctttggggaataactctagctttcaccatcggatcaacatttatgagattatcaagccagccaccgccaactctaagtttccagtgacacgactcctcgatacacgattagtgaaccagaatgcgtcaagatgggaatcttttgacgtgacacccgcggtcatgcgctggacagcacaggggcacgcaaaccatggctttgtggtagaagtagcccatctggaagagaaacagggcgtttctaagcgccacgtgaggatttctcggagcctgcatcaggatgaacactcctggtcccagattcggcccttgctggtgacttttggacacgacggtaaaggacaccctcttcataagcgggagaagcgccaagctaagcacaagcagcgtaaacgtctgaaaagttcttgcaagagacatcccttgtacgtggatttctccgatgtgggatggaacgattggatcgtggctccgcccggctatcacgctttttattgtcacggagagtgtcctttccccctagccgaccacctgaattccactaaccacgcaatcgttcagacactggttaattccgtcaacagcaaaattcccaaagcgtgttgtgttccaaccgagctttccgcaatttccatgctgtacctggatgaaaacgagaaagtggtgctaaagaactatcaagacatggtggtggaagggtgcgggtgtcgc

SEQ ID NO: 7863 - DNA, 1188 bp, Artificial Sequence
  Description of Artificial Sequence: Synthetic coding sequence
atggttgcaggaacgcgctgccttctggccctacttctcccacaagtattgcttggaggggcagctggactggttccggagctgggccgacgcaagttcgccgctgcgagttccgggcgcccctctagtcagccctcggatgaggtgctgagcgagtttgagctgcggctgctctcaatgtttgggctgaagcagcggccgaccccttcccgggacgccgtcgttcctccttatatgctggacctgtatcggcggcactccgggcagccaggatctccagccccggaccatcgccttgagcgcgctgcttcacgtgctaacaccgtccgaagcttccatcatgaggagtctctagaagagctccccgaaacctcagggaagacaaccagaaggtttttctttaacttgtccagcatcccaacggaagagttcattacaagcgcggagttgcaagtgtttagagagcagatgcaagacgccctggggaataactcaagttttcaccataggattaatatatatgaaatcatcaagccagcgaccgctaactctaaattccccgtgacccgcttactggatacgaggctggttaaccagaacgcatcaaggtgggagtcctttgacgtgacacctgcagtgatgcgttggaccgcgcagggacatgctaatcatggcttcgtggtggaagttgctcacctggaggagaagcagggggtgtctaagagacatgtgaggatatccaggagcctgcatcaggatgagcactcttggagccagataagacctctgcttgtcacctttgggcacgatgggaagggtcacccccttcacaagcgggagaagcggcaggctaaacacaagcagcgcaagaggctcaagtcttcctgtaaacggcacccattgtatgtggatttcagcgatgttgggtggaacgactggatcgtagcgccccccggatatcacgcattttactgtcatggcgagtgcccttttcctctggcagaccaccttaactctaccaaccatgcaatagtgcagactctggtgaacagcgtcaacagtaagatccccaaggcttgttgcgtcccaacagagctaagcgccatttccatgttgtacctggacgagaatgaaaaagtggtgctcaagaactaccaggacatggtggtggagggctgcgggtgccgg

SEQ ID NO: 7864 - DNA, 1188 bp, Artificial Sequence
  Description of Artificial Sequence: Synthetic coding sequence
atggttgcgggtaccagatgtttgctcgctctcctgcttccgcaggtgctcctgggtggagctgcaggtctggtgcctgaacttggacggaggaagtttgcagcagcctcgtcaggccgaccctcatcccagccatcagatgaagtcttgagcgaattcgaacttcgactgctttccatgttcggcctgaaacaaagaccaaccccttcacgggatgcagtggtgcctccttatatgctggacctgtacagacgccattcgggccaacccggatcaccggcacccgatcaccggctcgagagagctgcgtccagggccaacactgtccgcagctttcaccacgaggagtcgttggaagagcttccggaaacttccggtaagaccacccgacgcttcttctttaacctgtcctcaattccaaccgaggagtttatcacctcagccgaacttcaagtttttcgggaacaaatgcaggacgcccttggaaacaattcatcgtttcaccaccgcatcaacatttacgagataatcaaaccagcaactgcaaactcaaagtttcctgtgaccaggctgctcgatacgcgactggttaatcagaatgcgtcgcgctgggaatccttcgacgtgaccccggcggtgatgcgctggaccgcacaaggacatgccaaccatggttttgtcgtggaggtggcgcacctcgaagagaaacagggcgtcagtaagcggcatgtgaggatttctaggtcgctccatcaagacgagcactcatggtcgcaaattcggccccttctcgtgaccttcggtcacgatggaaaaggacatcctctgcataaacgagaaaaaaggcaggcaaagcacaaacagagaaagaggcttaaatcctcctgcaaaagacatccactgtacgtggatttttcggatgtcggatggaatgattggattgtcgcaccaccagggtaccatgcattttactgccacggcgaatgtccatttccccttgcagatcatcttaactccaccaatcacgccatcgtgcagaccctggtgaattccgtcaactcgaaaatacctaaggcatgctgcgtgcctactgagctgtcggcaattagcatgttgtacctcgatgagaatgaaaaggtcgtgctgaagaattaccaagacatggtggtcgaaggatgtggatgccga

SEQ ID NO: 7865 - DNA, 1188 bp, Artificial Sequence
  Description of Artificial Sequence: Synthetic coding sequence
atggttgcaggcacccgctgtcttttggccctgcttctcccccaggtgctgctgggaggggcggccgggctcgtcccggaactcggtaggcgtaaattcgcagccgcatcaagcggaaggccttcgagccagccgtccgacgaagtcctttcggagttcgagcttagacttctcagcatgtttggacttaaacagcggcccacccctagcagggatgcagtcgtgccaccatacatgcttgacctgtaccgacgtcacagcggtcaacctggttcacccgccccagatcaccggctcgagagggcagcatcgagagcaaacaccgtccgatccttccaccacgaggagtccctggaagaactcccagaaacttcgggtaagacgaccagaagattcttctttaacctcagctccatccctaccgaggagttcattacttccgcggagctgcaggtgttcagagaacagatgcaagatgcacttggcaacaactcatcttttcatcataggattaacatatacgagattatcaaaccagcaaccgcaaactctaagtttcctgtgaccagacttctggataccaggctggtcaaccagaacgcatctcgctgggagtcctttgacgtgacgccagcagtcatgagatggaccgcacagggccatgctaaccatggttttgttgtggaagtggcacatcttgaggaaaagcaaggggtgtcaaaacgccatgtgagaattagcaggtccctgcatcaagatgagcattcatggtcccaaatccgcccattgcttgtcactttcggacatgatgggaaaggtcacccccttcataagcgagaaaagcgccaagcgaaacacaaacagcggaagcgtcttaagagcagctgtaagcggcatccgctttacgttgatttttctgacgtgggttggaacgactggattgttgcaccacctggctaccatgccttttactgtcatggagaatgtccatttcctctggcagatcatcttaactccaccaaccacgccattgtgcagactcttgtcaactcggtgaattcgaagattcctaaggcatgctgtgtgccgaccgaacttagcgctatttccatgctctaccttgatgaaaatgaaaaggtggtgctcaagaactaccaagatatggtcgtggaaggttgcggatgcagg

SEQ ID NO: 7866 - DNA, 1188 bp, Artificial Sequence
  Description of Artificial Sequence: Synthetic coding sequence
atggtggccggcaccagatgcctgctggctctactgcttcctcaggtgctgctgggtggcgcggcagggttggtgcccgagctggggagaagaaagttcgccgccgcctcttccgggcgcccttcctcccagccaagcgacgaggtgctgagtgaatttgagctcaggctgctcagcatgtttggtcttaaacaaagacccactccgagcagagatgcagtcgttccgccatacatgctcgatctatacaggagacacagcggtcaacctggatcgcctgcacccgatcaccgcctcgagagggcggcatcccgggctaatacagtgcggagcttccaccatgaagagtcgctagaggaactgcccgagacttctggtaagaccacgcgaaggttttttttcaacctgtcctccatccctacagaagaatttatcacatcagctgaactacaggtgtttcgggagcagatgcaggatgccctcggcaataatagctcatttcaccaccggatcaatatctacgagattatcaaaccagccaccgccaactctaaatttccagtgactcgcctgttggatacgcggctggtcaatcagaatgcttctaggtgggagtccttcgatgtgactcccgccgtgatgaggtggactgcccagggccacgctaaccatgggttcgttgtcgaagttgcacatctcgaagagaaacaaggagtctccaagagacacgtacgcatcagtcgtagcctacatcaggatgagcactcctggtcgcagattaggcccctgctggtgactttcgggcatgacggaaaggggcatcccctgcataagcgagagaagagacaggctaaacacaagcagcggaaacgattaaagtcttcttgcaagcggcatcctctgtacgtggatttttcagatgtgggctggaacgactggatagtggccccacccggctatcatgcattctattgccacggggagtgtccctttccacttgcagatcatcttaactctactaaccacgctatcgtgcagaccctggtgaactctgtgaattccaagatcccaaaggcctgttgtgtgccaacagaactgtcagcaatctccatgttatacttggatgagaatgagaaagttgttctgaagaactatcaagatatggtggttgaagggtgtgggtgtcgc

SEQ ID NO: 7867 - DNA, 1188 bp, Artificial Sequence
  Description of Artificial Sequence: Synthetic coding sequence
atggtcgcgggcactcggtgcctcttggccctgctgctgccccaagtgctcctgggcggcgcagcgggactcgtgcccgaactgggcagacggaagttcgccgccgcatcgtcgggacgcccatcgtcacagccgtccgatgaggtgttgtcagagttcgaattgcggctgctttccatgttcggactgaagcagcgaccgactccaagccgggacgctgtggtgccgccttacatgttggatctctatcgcagacacagcgggcagccgggtagcccggccccggaccaccggctggaacgcgccgcgtcgcgcgcaaacaccgtgcgcagctttcatcacgaagagtcgctcgaggagctgccagaaacttcgggaaagaccactagacgcttcttcttcaacctcagctcgattccgactgaagaattcatcaccagcgccgaactccaagtgtttagagagcagatgcaagatgctctcggtaacaattccagttttcaccatcgcatcaatatctacgaaattatcaagccggcgactgcgaactcaaagttcccggtcaccaggctgctggacacgaggctggtcaatcagaatgcgtccagatgggagtcttttgatgtgacccctgctgtgatgcggtggaccgctcagggacatgcaaatcatggattcgtcgttgaagtggcccatctcgaagagaagcagggagtgtcaaagaggcatgtcagaatctcccgctcccttcatcaagatgagcactcatggtcacagatccgcccactgctcgtcacctttggacacgatgggaaaggccaccctctgcacaaacgtgagaaacggcaggcaaagcataaacagaggaagcggctgaagtcgtcctgtaaacggcaccccctgtacgtcgacttctccgacgtgggttggaacgactggatcgtggccccaccaggataccacgccttctactgccacggcgaatgccctttcccgcttgctgaccacctgaactcaacgaaccacgccatcgtccaaactcttgtgaattccgtgaactcgaagatcccgaaggcatgctgcgtgcctaccgagctgagcgccattagcatgctgtacctcgacgagaacgaaaaagtggttctgaagaactaccaagacatggtagtggaagggtgtggatgccgc

SEQ ID NO: 7868 - DNA, 1188 bp, Artificial Sequence
  Description of Artificial Sequence: Synthetic coding sequence
atggtggctggaactcggtgcctgctggccctgctgcttccacaggtcctgctcgggggagcggcgggacttgtgccagagcttggacggcgtaagttcgcggctgccagctcaggtcggccttcgtcgcaacccagtgacgaagtcctgtccgaattcgaattgcggctcctctccatgttcggtctgaagcagcgaccgactccgtctcgggacgcggtcgtcccaccttacatgctggacctgtaccggaggcacagcggacaaccaggttcaccggcccctgaccaccggttggagcgggctgcgagccgagctaacactgtgcggtcgtttcatcatgaggagtcgctggaggaactgccagaaacctcaggcaagacgacccgccgcttcttcttcaacctttcgagcatcccgactgaagaattcattacctccgccgaactgcaagtctttcgcgagcagatgcaagacgcgcttgggaacaattcgtcattccaccaccgcatcaacatctacgaaatcatcaagccggcaaccgccaactccaagtttccagtcactcgcctcctggacactcgcctcgtgaatcagaacgcgtcccgctgggagtcattcgacgttactccggcagtgatgagatggactgcccaaggacatgcgaaccacggctttgtggtggaagtcgcccatttggaagaaaagcagggtgtgtcaaaaaggcacgtgcggatctcccggtccctccaccaggacgagcactcgtggtcgcagatcaggccgctgctggtgaccttcgggcatgacggtaaaggccatccgttgcataagagagaaaagcggcaggcaaaacacaagcagcgcaagcgcctgaagtcgtcatgcaagagacacccactttacgtggacttctcagacgtcggatggaacgattggatcgtggcacctccgggctaccacgccttctactgccatggagagtgcccattcccgctggccgaccatttgaacagcactaaccatgcaattgtgcagactctggtcaactcggtgaacagcaagatccccaaggcctgctgcgtgcctacggaactctcagccatctccatgctgtacctcgatgagaatgagaaggtcgtcctgaaaaactaccaggacatggtggttgagggatgtggttgccgc

SEQ ID NO: 7869 - DNA, 1188 bp, Artificial Sequence
  Description of Artificial Sequence: Synthetic coding sequence
atggtggccggaacccggtgcctgttggctctgcttttgccgcaggtcttgctcggaggcgccgccgggttggttccggaactgggacgccgcaagtttgcagcggcctcctcgggtcggccgtcatcccagccgtcagacgaagtgctgtcagagttcgaactgagacttctgtcaatgttcggactcaagcagcgccctacgccttcccgggacgcagtggtgccaccgtacatgctggacctgtacagaagacattccggtcagccgggctctccagccccggaccatcggctggagcgggcagcgagccgtgcgaatacggtgagatcgttccatcacgaggagagcctggaagagctgcctgaaacgtctggtaagactacgcggcggtttttctttaaccttagctccatccccaccgaggagttcatcacctccgcggaactgcaggtgttccgggagcagatgcaagatgcactgggaaacaatagctcgttccaccataggatcaacatttacgaaatcatcaagccagcaactgcgaacagcaagttcccggtgactcgcctgctggacacccggctggtgaatcaaaacgcctctcgctgggagtctttcgacgtgactccggcggtgatgcgctggactgcgcagggacacgcaaatcatggattcgtggtcgaggtggcgcacctcgaggaaaaacagggcgtgtccaagcggcatgtccgtatctcccgctccctgcatcaggatgagcacagctggtcgcagatcagacctctgctcgtgacctttggacatgacgggaagggacaccccctccacaaacgagaaaagcgccaagccaagcacaagcaaagaaaaaggctcaagtcaagctgtaaaaggcatccgctttatgttgatttctcagatgtcgggtggaacgattggatcgtggcccctccgggttaccacgcgttctattgccacggcgaatgtccgttccctctcgcggatcacctcaacagcaccaaccacgccatcgtgcaaactctggtgaattccgttaacagtaaaatcccgaaggcctgctgtgtgccaactgaactgtcggcgatttccatgttgtacctggacgaaaatgagaaggtggtgctgaagaactaccaagatatggtcgtggaggggtgtggatgcaga

SEQ ID NO: 7870 - DNA, 1188 bp, Artificial Sequence
  Description of Artificial Sequence: Synthetic coding sequence
atggtcgcaggaactcgatgtcttctcgccctcctgctgccccaggtgttgctcggcggcgctgcgggactggttccggagttggggcggcggaagttcgcagcggccagcagtggacgaccatcttcccagccaagcgatgaggtgctgagcgagtttgagctgcgccttctgtctatgttcggtctgaagcagcgacccactcccagcagagatgccgtcgtgccgccgtacatgctagatctttaccgtcgccacagtggacaacctggctcccccgcgccagatcatcggctggagcgtgcagcctcgagagcgaacacggtcaggtcttttcaccatgaggagagtctggaagaactgcctgaaacctcaggtaagaccaccagacgctttttttttaacctgagtagcatcccaacagaagagtttattaccagcgctgaacttcaggtgtttcgagagcagatgcaggatgctttaggaaataactccagcttccaccatcgaatcaacatctatgagatcataaagccagctaccgcgaactctaagttccccgtgacccgcttgctcgatacacgcctagtgaaccagaacgcctcccggtgggaatctttcgacgttactccagctgttatgcggtggactgctcagggacatgcaaaccacggattcgtagtcgaggttgcacacctggaagagaagcagggggtgagtaaaaggcacgtccgcatcagccggtctctacaccaggacgaacactcctggtctcaaattcgccctctacttgtgacgtttggccatgacggcaagggtcacccgctgcacaaaagggagaagcgtcaggccaaacataagcagcggaaaaggcttaaatctagctgcaagcgacatccgctttacgtggacttcagcgacgtggggtggaacgattggatagtcgcccctcccggctatcacgcattctactgtcacggggagtgtccgtttccattagctgatcatctgaactccactaaccacgccatagtgcagactctcgttaattccgtgaattctaagattccgaaggcttgttgcgttcccactgagctctctgctatctcaatgttgtacctagatgagaatgaaaaggtggtgcttaaaaactaccaggatatggtggtggaaggttgcggatgtcgc

SEQ ID NO: 7871 - DNA, 1188 bp, Artificial Sequence
  Description of Artificial Sequence: Synthetic coding sequence
atggtggccggaactcggtgtctgctcgcactgcttttgcctcaagtgctgctggggggggccgcaggactagtgcccgaactgggcaggcgaaaattcgccgctgcttctagtggtagaccatcatcacagccttctgacgaagtgttgtctgagttcgaacttagacttctatctatgtttggcttaaagcagcggccaacccctagtcgtgatgcagtggttcccccctatatgctggacctgtatagacgacactcaggccaacctgggtcccctgcaccagaccataggctggaaagagccgctagcagagctaacacagtgcgatcatttcaccatgaggagagtctggaggagctgccggagacttcaggcaagactactcggagatttttctttaatctgagttccattccaacagaggaatttataacttctgctgagttgcaagtctttagagaacagatgcaggacgctctgggcaataacagctcctttcatcaccgaatcaacatttacgagatcatcaaacctgctactgcaaactccaagtttcctgtgaccaggctccttgatacccgactcgtgaaccaaaacgcctcaaggtgggagtctttcgatgtgaccccggccgtgatgcgatggaccgctcagggacacgcaaatcatggtttcgtggtggaggtggcccacctggaagagaagcaaggtgtctccaaacgacacgtgcggatttctcggtcacttcatcaggatgaacactcttggtcccagattagacccctgctggtcacttttggccatgacggaaaggggcaccccttacataagcgagaaaaacggcaagcaaagcataagcagagaaaacgactcaagagctcctgtaagaggcacccgttgtatgtggacttctccgatgtaggctggaatgattggatagttgctccacccggttaccacgctttctactgccacggagagtgccccttcccccttgctgaccacctgaactcaactaatcatgcaatcgtccaaacattggtgaatagcgtcaacagcaagataccaaaagcctgctgcgtcccaacagaactgtctgccataagcatgctctacctggacgagaatgaaaaagtggttctcaaaaattatcaagacatggtcgtggaaggctgtggctgcaga

SEQ ID NO: 7872 - DNA, 1188 bp, Artificial Sequence
  Description of Artificial Sequence: Synthetic coding sequence
atggttgccggtacacgctgtctgttggctctgctgttgccccaggtcctcctaggaggagccgccggattggttcccgaactgggccgtagaaagtttgcggccgcctcttccggtaggcccagcagccagccaagcgatgaagttctgagcgagtttgagcttcgtttgcttagcatgtttggcttgaagcaacggccgaccccttcaagggacgctgtcgtgccaccatacatgttggacttgtaccggaggcatagtggtcaacccgggtccccagcccctgaccatcgtttggaaagggccgcgtcacgcgcaaatacggttcgcagtttccatcacgaggaatcacttgaagagttgcccgagacttctggcaagaccacccggagatttttttttaatctttccagcatcccgaccgaggaattcatcacctccgcagagcttcaggttttccgcgagcagatgcaggacgccctcggaaacaactcctccttccatcaccggatcaacatctacgaaataataaagccggctacagctaacagtaagttcccagtgacccggcttctcgatacacggctggtgaaccaaaatgcttccaggtgggaaagtttcgatgtgactcctgccgtgatgaggtggaccgcacaggggcacgcaaaccacggttttgttgtagaagtggctcatctggaagagaaacagggcgtgtcaaagcggcacgtacggatcagcagatctctgcaccaggacgaacattcatggtctcagatccgcccactactggttacatttgggcacgatggtaagggtcatccacttcataagcgtgagaagaggcaggccaaacacaagcagcggaaaaggctcaaatcatcctgtaagcgtcaccccctctatgtggatttcagcgatgtgggatggaatgactggatagtggcaccccctggctatcatgctttctattgtcatggggaatgtccttttccattagctgaccaccttaattctactaaccacgccatcgtgcaaacattggtgaactcggtcaatagtaagatcccgaaagcttgttgtgtgcccactgagctgagcgccatttccatgctgtatcttgacgaaaacgaaaaagtggtactgaagaactaccaggacatggtcgtggagggctgtgggtgtcgt

SEQ ID NO: 7873 - DNA, 1188 bp, Artificial Sequence
  Description of Artificial Sequence: Synthetic coding sequence
atggtcgcgggaactcgttgcttgctggcactcctgcttcctcaggtcctccttggaggagcagctggtttggtgccagagctgggccggcggaaatttgccgccgcaagctccggacggccttcgtcacaaccctcagatgaagtgctttccgaatttgagttgaggcttctgtcgatgttcggtcttaagcagaggcctaccccttcccgcgatgctgtggtgcctccctacatgctcgacctgtacagacgacattcgggacaaccaggttcacctgcaccagaccaccggcttgaacgcgctgccagccgcgcaaataccgtgcgttcattccatcatgaggaaagcctcgaggagctgccagaaacgagcggtaaaaccacgcggcggtttttctttaacctcagcagcatacccactgaagaattcataaccagcgcagagctgcaagtgtttagggaacaaatgcaggacgctttgggaaacaattcctcgttccatcatagaatcaacatttacgaaatcattaagcctgcaactgccaactcgaaattcccggtgaccagactccttgataccagacttgtgaaccaaaatgcctcccgttgggagagctttgacgtgactcctgccgtcatgaggtggacggcacagggccacgcaaaccatggctttgtggtcgaagtggcgcaccttgaagaaaaacagggagtctcaaagagacacgtgcgaatcagtcggtcactgcatcaggatgagcattcatggagccaaatccgcccactgttggtgacttttggccatgatgggaagggacacccactccataagcgggaaaaacggcaagcaaagcataagcaacgcaaaaggctgaagtcaagctgtaagcgacatcctctttacgtggattttagcgatgtgggatggaatgactggatcgtcgcacctcctggataccatgcattttactgtcatggcgaatgtccattccctcttgcagatcatctcaatagcactaaccacgcaattgtccaaaccctggtgaactccgtgaactcgaaaattccgaaggcatgttgtgtccctaccgaactgtccgcaatttccatgctgtacctggacgaaaacgaaaaggtggttctgaagaactaccaggatatggtggtggaggggtgtggatgtcgg

SEQ ID NO: 7874 - DNA, 1188 bp, Artificial Sequence
  Description of Artificial Sequence: Synthetic coding sequence
atggtcgcagggactaggtgtctcctcgccttgctcctgcctcaagtcctcctgggaggtgcagcaggtctggtgccagaacttgggagaagaaagtttgcagcagcttcctccggacgtccatcaagccaaccctccgatgaagtgcttagcgagtttgaactccgcctgctcagcatgtttggtcttaagcaaaggcctaccccaagcagagatgcagtcgtgccaccttacatgctcgatctgtacagacgccactcgggtcaaccaggttcgcctgcaccagatcacagactcgaaagggcagcctcgcgcgcaaacactgtgcgatcctttcatcatgaggaatctctggaggaactgcctgagactagcggaaagaccacccgtcggtttttctttaacctgtcgtcgattcctactgaggagtttatcacttcggcagaactgcaagtattccgcgaacaaatgcaggatgccctggggaataactcatccttccatcatagaataaacatttacgagattatcaaaccggcaaccgcgaactccaaattcccggtcactaggcttctggatacccgacttgtgaaccagaatgcctcgagatgggagtcattcgacgtgactcctgcagtcatgcgttggactgcgcaaggacatgcaaatcatggttttgtggtggaagttgcacatctggaagagaagcagggagtgtcaaaacgtcatgtgcgcatctccaggtcgctccatcaggacgaacattcatggtcccaaatccggcctcttctggtgaccttcggtcacgacggaaagggacatccactgcacaagcgggaaaaacgacaggcaaaacataaacaacgcaagcgccttaagagctcgtgtaaaagacatccactgtacgtcgatttttcagatgtcggttggaacgattggattgtcgccccaccaggataccacgcattttactgccatggagagtgcccatttcccctggcagatcacctgaactccactaaccatgctattgtgcaaacccttgtcaactcagtgaattcgaagattcctaaggcctgttgtgtgccgactgaactgagcgcgatttcgatgctgtacctcgacgagaacgaaaaggtggtcctgaagaactaccaggatatggtggtcgaaggatgtggatgccgc

SEQ ID NO: 7875 - DNA, 1188 bp, Artificial Sequence
  Description of Artificial Sequence: Synthetic coding sequence
atggtggcaggcaccaggtgtctgcttgcactgctgttgccacaggtcctgctgggaggcgccgccgggcttgtgcccgaacttggacggcggaagtttgcagcagcatcctcgggtcgtccgagcagccaaccttctgatgaagtgctctcggagttcgaactgcgcctcctcagcatgtttggcctgaagcaacgccctactccctcgagagatgctgtggtgccaccttacatgttggatctgtaccggagacactccggacagccaggctctccagcgcctgaccaccggctggagagagcagcctcaagagcaaataccgtgaggtcatttcatcatgaagagagcttggaagaacttccggagacttcaggcaagacgacccgccgcttctttttcaacctttcaagcatcccaactgaggagttcataacgagcgccgaattgcaggtgttcagagaacagatgcaggatgcactgggaaacaactcgagctttcatcatagaattaacatctacgaaatcattaagcctgcaactgcaaatagcaagtttcctgtgactaggctcctcgacactcggctggtcaaccagaatgcaagcagatgggaatccttcgacgtcactccggcagtcatgaggtggaccgcgcaagggcacgctaatcacggattcgtcgtggaagttgctcaccttgaagagaagcaaggggtttcgaagcgtcacgtgagaatttcgagatcgctgcatcaagatgagcattcctggtcacaaattagaccccttcttgtcaccttcggtcatgatggaaagggacaccctttgcacaagcgagagaagaggcaagccaaacataaacagcgcaaacgacttaagagctcgtgtaaacggcatccactttacgtcgattttagcgacgttggatggaatgattggattgtggcacccccgggttaccatgccttttactgtcatggagaatgccccttccccctggcggaccacctcaatagcacgaaccacgctattgtgcagaccttggtgaattcggtgaattcgaagatcccaaaggcatgttgtgtgcctactgaactgtcggccatttcgatgctctatttggatgaaaacgaaaaagtcgtgcttaagaattaccaggacatggtggtcgagggatgtggttgcagg

SEQ ID NO: 7876 - DNA, 1188 bp, Artificial Sequence
  Description of Artificial Sequence: Synthetic coding sequence
atggtcgccggaactaggtgcttgctcgccctcctccttccacaggtcctgctgggaggagcagccggactggtcccagagctgggccgccgcaaattcgccgcggcctcgagcggacgcccatcatcgcagccgtcagacgaagttctctccgaattcgaactgcgcctgctctcgatgttcggactgaaacagcgaccaacgccgtcgagagatgcagtggtgccgccatacatgctcgacctctatagacgacattccggccaacccggcagccctgctccagaccacaggcttgagcgggctgcctccagagcaaataccgtgcgctcgttccaccatgaagagagcctcgaggaactgccagagacgtcagggaaaactacccgccggttcttcttcaacctgtcgtccatcccaactgaagagtttatcaccagcgctgagcttcaggtgtttagagaacaaatgcaggacgcactcggaaataacagctccttccatcatcgcataaacatctacgagatcatcaagcctgccactgccaattccaagtttccggtgaccaggctgctggataccaggctggtgaatcagaacgcctctcggtgggaatctttcgatgtgacccctgccgtcatgagatggactgcgcaaggacacgccaatcatggattcgtggtggaggtggcccatctggaagaaaagcagggtgtctccaagcggcatgtgcgcatctcccggtcgctccaccaagacgaacattcctggtcgcagatccgcccgctgctggtcacctttggacacgatgggaagggacaccctctgcataagcgtgagaaaaggcaggccaagcataaacagagaaagcgcctcaagagcagctgtaaaaggcacccgctgtacgttgacttttccgatgtgggatggaatgactggatcgtcgcgcctccgggctaccatgctttctactgccacggggaatgtccattcccgcttgcggatcatctgaattcgactaaccatgctatagtgcaaactttggttaattcggtgaactcgaagatcccgaaggcgtgttgcgtgccaactgagctgagcgcgatttcaatgctctacttggacgaaaacgagaaggtcgtgctcaaaaactaccaagatatggtggtcgaagggtgtggttgcagg

SEQ ID NO: 7877 - DNA, 1188 bp, Artificial Sequence
  Description of Artificial Sequence: Synthetic coding sequence
atggtggcaggtacaagatgcctactcgcactgttactgccccaagtactgctgggcggagcagctggcctcgtgcctgaacttgggagaagaaaatttgcagcggccagctccggcagaccttctagccagccctctgatgaggttctttccgaattcgaactgcggctcctttctatgttcggccttaagcagcggcccaccccaagcagagatgcagtagtgccgccttacatgttggatctgtataggaggcatagtggacagccaggctcacctgccccagatcataggttagagagagcagctagtcgcgcaaacaccgtcaggtcatttcaccatgaagaatctctggaggaattaccggagacctccggaaagaccaccagacggttcttcttcaacctcagtagcattcccactgaagagttcatcacaagcgctgaactgcaggtttttcgggagcagatgcaggatgccctgggaaacaacagttcattccaccaccggattaacatctacgaaatcatcaaacctgccaccgccaatagtaagtttcccgtgaccaggctgttggatacacgccttgtcaaccaaaacgcatcacggtgggaatcatttgatgtgactcccgctgtcatgagatggactgcccaaggtcatgccaatcatggtttcgtcgtggaggtagcacaccttgaggaaaagcagggagtctctaagaggcacgtgaggatcagcagaagcctccatcaggatgaacatagctggagtcaaattaggccacttctggtgacttttgggcacgacggaaagggccaccccctgcacaagagggagaaaaggcaggcaaaacacaagcagaggaaaaggctgaagagctcatgcaaaagacatccgctttatgtagatttctccgacgtcggatggaacgactggatcgtggcaccgccaggctatcatgcgttctactgccacggtgagtgcccttttccactcgctgaccacctgaatagtactaaccatgccatcgtgcagactctcgtgaatagcgtgaacagcaaaatcccaaaggcctgttgcgtacccaccgaactcagcgcgattagcatgctgtacttagatgaaaatgagaaagttgtactgaaaaactatcaagacatggtggtcgagggatgtggatgccgc

SEQ ID NO: 7878 - DNA, 1188 bp, Artificial Sequence
  Description of Artificial Sequence: Synthetic coding sequence
atggttgctggtacaagatgtctacttgctcttttgttgccacaagttctattgggcggggctgctggccttgttcctgaattggggcgcaggaagtttgcggcagcatcgagcggtcgcccatcttctcagcccagcgatgaggtgttgtccgaatttgaactcagactattgagtatgttcggtttgaagcagaggccaactccatctcgtgatgctgtggtgcccccatacatgttggatctttataggagacacagtggtcagcctggaagcccagctcccgaccataggcttgaacgggccgccagcagggctaatactgtcagatctttccatcacgaagagtcacttgaggaattaccagaaacttcaggcaaaacgacacgaaggtttttctttaatttgtcaagcattccaacagaggaattcatcacgtcagccgagctacaggtattccgcgagcaaatgcaggacgcattgggaaataactcatcgtttcaccacaggatcaacatctatgaaatcatcaagcctgccactgctaactcgaagtttcctgtgacaagacttttggataccagactggtgaatcaaaatgcctcacgctgggaaagtttcgacgtcacccctgctgttatgcgctggacagctcagggccacgctaaccacgggtttgttgtcgaggttgcacatctcgaagagaaacagggtgttagtaaaagacatgtcaggattagtaggtcactccatcaggatgagcactcttggtctcaaatacgccctttactagtgacatttggccatgatggtaagggacacccgcttcataaacgggaaaaaaggcaggctaagcataaacagaggaaacgacttaaatcaagctgcaagaggcatcctttatacgtggattttagtgacgtagggtggaatgattggatcgtagctcctcccggatatcatgctttttactgtcacggcgagtgtccattccctttggctgatcatttgaactccaccaatcatgcaatagtgcagaccctcgttaatagcgttaactcgaaaatcccaaaggcttgttgtgttccaactgagctcagcgccatatcaatgctctatttagacgagaacgaaaaagttgtccttaagaactatcaagacatggtcgttgagggttgcggttgtaga

SEQ ID NO: 7879 - DNA, 1188 bp, Artificial Sequence
  Description of Artificial Sequence: Synthetic coding sequence
atggtcgcaggtaccagatgcttgctggctctgttacttccccaggtactgctcggcggggctgccggactggtgccggagttaggtaggcggaagtttgcagctgcaagctctggtaggcctagctcgcagccctctgacgaggttttgtctgagttcgagctaaggctgcttagtatgtttggactgaaacagcggccgacacctagtagagatgcagtagtgcccccctatatgctggatctgtaccgccgccactctgggcagcctggatcccccgcgccggatcaccgtttagaaagggccgctagccgcgctaacaccgtgaggtctttccatcatgaggagtctctcgaagagctgcccgaaacctcaggcaaaacaacacgacgattctttttcaatctcagcagcatcccaaccgaagagtttattacctctgccgagttgcaagtgttccgcgaacagatgcaggatgctctgggcaataactccagcttccaccatcgtattaatatttatgagattataaaaccggctaccgccaactcgaaatttccggtgacgagactcctggatacccggctggtgaatcagaacgcctcacgctgggaaagcttcgatgtgacccctgctgtgatgagatggaccgctcagggccatgctaaccatgggttcgtggtcgaggtggcacatctcgaggagaagcagggcgtttctaaaagacacgtccggattagcaggtctctgcatcaggacgagcacagttggagccaaatcagacctctgctcgttacgtttgggcatgacggcaaagggcaccctttgcacaagagagaaaagaggcaagctaaacataaacagcggaaacgactcaaatcatcctgcaaacggcatcctctgtacgttgatttcagtgatgtgggatggaacgattggattgtggcacctccagggtatcacgccttctattgccacggcgaatgccctttccctctagccgaccacttaaacagcacgaaccacgccattgtgcagacactggtgaactccgtaaactccaaaatcccaaaagcctgttgtgtcccaacagaactgagcgctatatctatgctctaccttgacgagaatgaaaaggtagttctcaagaactaccaggatatggtagtcgagggatgtggctgcagg

SEQ ID NO: 7880 - DNA, 1188 bp, Artificial Sequence
  Description of Artificial Sequence: Synthetic coding sequence
atggtggccggaactagatgcctgctggcgctgctcctgccccaagtgctcctgggaggtgcagccggactggtgccggaacttggacgacggaaattcgccgccgcctcatcaggccgcccctcaagccagccgtcagatgaagtgctctcggagttcgaattgcgcttgctctcgatgttcgggctcaaacagcggccgaccccttcacgagacgccgtggtgccgccgtacatgctggacctgtaccgtcgccactcaggacagccaggatctcctgcaccggaccatcgccttgaacgagcagcgtctcgcgctaataccgtgcgatcattccaccacgaggaaagccttgaagagctgcctgaaacctccggcaagactaccagacggttcttctttaatctgtcgtccatcccaacggaagaattcatcacgtcggcggaactgcaagttttccgggagcagatgcaggatgctcttggaaataacagctcttttcatcaccggataaacatctacgagatcataaagcctgcaaccgccaactcgaagtttccagtgactagactgctcgacactcggctggtcaaccagaacgcaagccgctgggagtcttttgatgtgaccccggcagtgatgaggtggaccgcgcagggacatgccaaccacggtttcgtggtggaggtcgcacatctcgaggagaaacaaggcgtctccaagcggcacgtccgcatctccagatccttgcaccaagacgaacattcctggtcacagatcaggcccctgcttgtgacgttcggacatgacggtaagggccacccgctccacaaacgcgaaaaaagacaggctaaacacaaacagagaaagcgactcaagtcatcgtgcaagcgccacccactctacgtggatttcagcgatgtgggatggaatgactggatcgtcgcccctccgggctaccatgctttctattgtcacggtgagtgtccatttcccctcgccgatcacctgaactccaccaatcatgccatcgtccagactcttgtgaactctgtcaactccaagattccgaaggcctgctgcgtgccgactgaactgtcggcgatctccatgctgtacctggacgaaaatgagaaggtcgtcctgaaaaactatcaagatatggtggtcgagggttgtggatgcaga

SEQ ID NO: 7881 - DNA, 1188 bp, Artificial Sequence
  Description of Artificial Sequence: Synthetic coding sequence
atggttgcaggcacccgctgtttactcgctctgctactgccccaggttctgcttggaggcgccgcgggcctggtgcctgagctgggccggcggaaatttgctgcagcatcttctggtcggccgtcaagtcagccttccgatgaagtactgtccgaattcgagctcaggctgctaagcatgttcggtctgaaacagcgacccaccccgtctcgtgatgcagtggtgccaccttacatgctcgatctctatcgaagacattctggacagcctggtagtcccgctcctgatcatcggctggaaagggccgctagccgcgccaacactgtgagaagttttcaccacgaagagagccttgaagagttacctgagactagcggcaaaaccacacgtagattttttttcaatttgtctagtatacccacagaggagtttataacctccgcggagctgcaggtgtttagggaacagatgcaggacgctttgggtaacaatagctccttccaccaccgcattaatatttacgaaattatcaaacctgctaccgccaattctaagtttcccgtgacacgattgctggatacacggctggtgaaccagaacgcaagcagatgggaatccttcgatgttacaccagctgtgatgaggtggacggcccagggccacgcaaatcatggcttcgtggtggaggtggcgcatctagaggagaagcaaggagtgtcaaaaaggcacgttaggataagcagatctttacaccaggacgagcactcctggtcccaaataagacctctgttggtgaccttcggccatgacggtaagggacacccattacacaaaagagagaagagacaggcgaagcacaagcagcgcaagagactaaagtcttcgtgtaagcggcaccccttgtatgtggacttcagtgacgtgggctggaatgattggatcgtggctccccccggctaccatgcattctattgccacggtgagtgtccattcccgctggctgaccacctcaactctacaaatcacgctatcgtgcagactttggtgaacagtgtcaatagcaagatcccgaaagcgtgttgtgtcccaaccgagctgtcggcaatatctatgctgtatctagatgagaatgagaaggtggtccttaagaactatcaggatatggtggtcgagggatgtggatgtaga

SEQ ID NO: 7882 - DNA, 1188 bp, Artificial Sequence
  Description of Artificial Sequence: Synthetic coding sequence
atggttgccgggactcggtgcctgcttgcgctgctgctgccgcaagttttgctgggaggtgcggctggactggtgccagaacttggccggcgtaagtttgccgctgcttcgtccggacggccctcttcccagccaagtgatgaggtactcagcgagtttgagctgcggcttctctccatgtttggactgaagcagagaccgacaccctccagagatgcagtagtgccaccgtatatgctggatttgtataggagacatagcgggcagcctggttcacctgcacccgaccaccggctcgaacgggctgcgtcccgcgcgaacacggtccgatcatttcaccacgaggagtctctcgaggaactacccgaaacatcagggaagaccactagacgctttttcttcaacctgagctcgatcccgacggaggaatttatcacatccgctgagcttcaggtatttagggagcaaatgcaggacgccttggggaataactcttcgtttcaccatcgtataaacatctatgagattattaaaccggccacagctaacagtaagtttcctgtgacacgtctgctcgacacgagactggtcaaccagaacgcgtctcggtgggagtcctttgacgtgacaccagcggtgatgcggtggactgcccagggtcacgccaaccatggattcgtggttgaagtggcccacctggaagaaaagcagggagtgtctaaacgccatgtgcgcatttcaaggagcttgcatcaagatgagcattcctggagccagattagacctctgctggttacattcggccacgacggcaagggccatcccctgcacaaacgtgagaaacggcaagctaaacacaaacagcggaagaggctgaagtcgtcatgtaaaagacaccctctctatgttgactttagcgatgtaggttggaacgattggatcgtggcccctcccggctaccatgcgttctattgtcacggtgagtgtccttttcccctggccgaccacctcaactcgactaatcacgcgatcgtgcagaccctggtcaattcagttaatagcaagatacccaaggcttgctgtgttcccaccgagctgtctgccatttctatgctatatctggatgagaatgaaaaggtggtgcttaaaaactaccaggacatggtcgttgaaggctgcggctgtcgg

SEQ ID NO: 7883 - DNA, 1188 bp, Artificial Sequence
  Description of Artificial Sequence: Synthetic coding sequence
atggtcgccggtacaagatgcctcctcgccctcttgctgccacaggtgctcctggggggggctgcagggctggtccctgaactcggtagaaggaagttcgcggctgcgagctccgggagaccgtcctctcaaccgagtgacgaagtgttgtcagagttcgagctgcggctcttgagtatgttcgggttgaagcagaggcccacaccaagccgggatgcagtcgtccccccctatatgttggacctgtataggcgccactcaggtcagccgggctctcctgcccctgatcacagactggagagggcggcctcaagagcgaacactgtcagatcatttcaccatgaggagagtctcgaggagctcccggagactagtggtaagactacaagaaggttttttttcaacttgagcagcatacctacagaggaatttatcacttcagccgagctgcaggtgttcagggagcagatgcaggatgccctgggaaataactcctccttccatcatcggataaacatctacgagataataaaacccgctaccgccaactcaaaatttccggtgacgcgactgcttgatacccgcctcgtgaaccaaaatgcttctcgatgggagtctttcgacgtgacccccgccgtcatgcgatggactgctcaggggcacgcgaatcacggattcgtggtggaggtcgctcatctggaggaaaagcagggagtatccaaaagacacgtgcgcattagtagatccttgcatcaggacgagcacagctggtcccagatcaggccactgctcgtgacgttcggacatgacggaaagggccaccctctgcacaaacgggagaagaggcaggcaaagcacaagcagaggaaacggctgaaatctagttgtaagaggcaccccctgtacgtagatttctcagatgtggggtggaacgactggattgtcgccccacctggatatcacgccttttattgtcatggggaatgccccttccctcttgccgaccacctgaattccacgaaccatgcaatcgtgcagaccttggtgaactccgtcaacagtaagatccctaaggcatgctgtgttcccacggaactgagcgcaatatctatgctgtacttggacgagaacgagaaggtcgtgttgaagaactaccaagatatggtggttgagggttgcggatgtaga

SEQ ID NO: 7884 - DNA, 1188 bp, Artificial Sequence
  Description of Artificial Sequence: Synthetic coding sequence
atggtggccggaaccagatgcctcctggcactcctcctgccccaagtactgctgggaggagcagccggcctggtaccagagctgggccgccgcaagttcgctgcagcctcgagtggtagaccatccagccaaccctcggatgaggtcttgagtgaatttgagctgagactgctgtctatgtttggtctaaaacagcggcctacaccttccagggatgcagtagtgcccccttacatgctcgacctgtatagaagacactcggggcagcccggatctcccgccccggatcaccggctcgagcgcgccgcttccagagccaacaccgtccggtcttttcatcacgaagagtcactggaagagctacccgagacgtctggaaagaccacgcggcgattcttcttcaacttatcttccattcccacggaggagttcattactagcgctgagctgcaggtgtttcgagaacagatgcaggacgctttaggcaacaactcatcttttcatcatcgcatcaacatttacgagattatcaagcccgccactgccaactcgaagtttcccgtgaccagactccttgatacaaggctggtgaaccagaatgcctcaagatgggagagctttgatgtgacaccagccgtaatgcggtggaccgcccagggacatgccaaccatggattcgtggtagaggtggcacacttggaggagaagcagggagtgagcaagagacacgtccgtatctcacgaagtctacaccaggatgagcactcctggagccagataagacccctccttgtgaccttcggccacgatgggaaaggtcatcctcttcacaagcgggaaaaacgacaggcaaaacacaagcagaggaaaaggctgaagtcttcatgtaaaaggcatccgctttatgtcgattttagcgacgtcgggtggaacgactggatcgtggctcctcctggttatcacgccttttactgccacggtgaatgtcccttccctttggccgaccatcttaattccacgaaccatgcaatcgtgcagaccctggtgaactctgtcaactctaagatcccaaaggcctgttgcgtgcccacagaattgtctgctatctcaatgctctacttagacgagaatgagaaagttgtgttgaagaattatcaagatatggtcgtcgaaggctgtggctgccgg

SEQ ID NO: 7885 - DNA, 1188 bp, Artificial Sequence
  Description of Artificial Sequence: Synthetic coding sequence
atggtagcaggaactaggtgcctattagccttattattaccccaggtcctcctaggcggggctgccggcctcgtgccagaactgggacgacgcaaattcgcagcagcatcaagcggcagaccatccagtcagccgtctgacgaggtcctctctgagttcgagctgaggctgctctccatgttcgggctaaagcagcgtcctaccccgtctcgtgatgccgtcgtccctccttacatgctggacctatacagacggcactctggccagcccggcagccctgcccctgatcatcgattagaacgggctgcctcaagggcgaatacagtgaggtctttccatcatgaagaatccctggaagagctaccggagaccagcggaaagactaccagaaggtttttctttaatctgagcagcattcctaccgaggaatttataacaagcgctgaattgcaggttttcagggaacagatgcaagacgctctggggaacaacagctccttccatcatcgaatcaacatatatgagatcataaagccggccactgctaattcaaagttccctgttacgcgactacttgatacacgcctggttaaccagaacgcgtcccgttgggagagcttcgacgtcacaccagccgtgatgcggtggacggcccaaggccacgccaaccacggattcgtagtggaggttgcccatctggaggagaagcagggcgtgtccaaaaggcatgtgaggatctctaggtccttgcaccaggacgagcactcttggtcacagatccgccctctgcttgtgaccttcggacacgatggtaagggtcacccccttcacaagcgcgagaaacgccaggcgaagcataaacagaggaagcgcctgaaatccagctgcaaacgccatcctctttacgtggatttcagcgatgtgggctggaacgactggatcgtggctcctccaggttaccacgcattctattgtcatggggagtgccctttcccccttgcagatcacctgaatagcactaaccatgcaatcgttcagacactagtgaactctgtgaatagcaagatccccaaggcctgctgcgtaccaactgagctgtcggccatctctatgttgtatcttgatgagaacgagaaggtggtgctgaaaaattatcaggatatggtagtggaggggtgtgggtgtcga

SEQ ID NO: 7886 - DNA, 1188 bp, Artificial Sequence
  Description of Artificial Sequence: Synthetic coding sequence
atggtggcgggcactcgctgcctgctggcactgctcctcccacaggtgttgttgggcggcgccgcgggactcgtacccgaactcgggagaaggaagtttgccgccgcctcttcaggccgaccttcttctcagccttcagatgaggtcctgagcgaatttgagttgagactcctgtccatgtttgggctcaagcagaggcctacacccagtcgggacgccgtcgtgccgccctacatgctggacctgtaccgccgccatagcggacagccaggatcccccgcaccagatcacagacttgaacgggctgcgtcaagagcgaacaccgtgcgctcattccaccatgaagagagcctggaagagttgcccgagacctcagggaagaccacccgcaggtttttttttaatctttcaagcattcctacagaagaattcattacaagcgccgagcttcaggtgtttcgggagcagatgcaggacgccctgggcaataatagcagctttcatcaccggataaatatttacgagatcattaaacccgcgacggccaattccaagttccccgtcactagattgctggacactcggcttgttaaccaaaatgcttcaagatgggagagtttcgatgttacccccgccgtgatgaggtggactgcccagggccatgccaatcacggcttcgtagtggaagtggctcacttggaagaaaagcagggtgtcagcaagcgccacgtgaggataagcaggagccttcatcaagacgaacattcttggagtcagattcgccccctcctggtgacgttcggtcatgatggaaagggacatcctctgcataaacgggaaaaacgacaggccaaacacaaacaacggaagcggttgaaaagctcctgtaagcgccatcctttgtatgtggattttagcgacgttgggtggaacgattggattgtcgcgccgccgggctatcacgctttctactgccacggcgaatgcccctttcccctggcagaccacctgaatagcactaaccatgctattgttcaaacgttggtcaacagcgttaatagcaaaataccaaaggcctgttgtgtgcctaccgagttgagcgcaatcagcatgctgtatcttgatgagaacgagaaggttgtcttgaagaattaccaagacatggtagtcgagggttgtgggtgcaga

SEQ ID NO: 7887 - DNA, 1188 bp, Artificial Sequence
  Description of Artificial Sequence: Synthetic coding sequence
atggtggcgggaactcgctgcctgctggctctgcttctgccgcaggtgctgctgggcggcgccgcgggactggtcccggaactggggcgccggaagtttgccgctgcctcgtcggggcgccctagctcccaaccgtcggatgaagtgctttcagaattcgaactcagattgctgagcatgtttggcctgaagcagcggccgaccccttcaagagacgcggttgtcccaccgtacatgcttgatctgtacaggcgccattccggtcaacccggttcaccggccccagaccacaggctggagcgcgccgcctcgagagccaacaccgtcaggtcgttccatcacgaagaatcgctcgaagagctgcctgaaaccagcggaaagaccacccgccggttcttctttaatcttagctctattccgacggaggagttcatcacctcggcagagttgcaggtttttcgagaacaaatgcaggatgccttgggaaacaattcttctttccatcaccgcatcaacatctacgaaatcatcaagcctgcaaccgccaactccaagttccctgtgacgaggctgctggacactcggctcgtgaaccagaacgcaagccggtgggagtcgttcgacgtgactccggctgtgatgcgatggactgctcagggacatgcgaatcacgggttcgtggtggaagtggctcatctggaggagaagcaaggtgtgtccaaacgccacgtgagaatctcgcgctccctgcatcaggacgaacactcctggagccagatccgtccacttctggtgacctttggacacgacggcaaaggtcatccactgcacaaacgtgaaaagcgccaagccaaacacaaacagcgcaagaggcttaagtcctcatgcaagcggcacccgctctatgtggacttcagcgacgtggggtggaatgattggatcgtggcgccgccgggctaccatgctttttactgccacggagaatgtcccttccctctcgctgatcatctgaattcaaccaaccacgccattgttcaaacgctggtcaactcagtcaactcaaaaatcccgaaggcctgctgtgtgcccaccgaattgtccgctattagcatgctttacctcgacgagaatgagaaagtggtccttaagaactaccaggatatggtggtcgagggatgcggctgccgg

SEQ ID NO: 7888 - DNA, 1188 bp, Artificial Sequence
  Description of Artificial Sequence: Synthetic coding sequence
atggtagctggaacccgctgtctcctggctctgttgctgccgcaggttctgctgggcggagctgccggcctggtgcctgagctgggcaggaggaagttcgctgcagcaagcagcggtagaccatcaagtcaaccttctgatgaggtcttgtccgaattcgagctcagattgcttagcatgtttggtttgaagcagagacccacacccagcagagatgcagtggtaccaccatatatgctggatctgtaccgcagacacagtggccaaccaggttctcctgccccagatcataggttggaacgcgccgcgtcccgcgccaacaccgtgcgcagcttccaccacgaggagtctctcgaggagctgcccgagacttccggcaagacgacccgccgcttcttctttaatctgagcagtattccaactgaggagttcatcacaagtgctgagctccaggtatttagggagcaaatgcaagatgctcttggcaacaatagctcctttcatcacagaatcaacatctatgagatcattaaaccggctaccgctaacagcaaattcccggtgactagactccttgacacaagacttgttaatcagaatgcctctagatgggaaagtttcgacgttactccggcggtgatgaggtggaccgctcagggccacgctaaccacggtttcgtcgtcgaagtggcccacctcgaggagaagcagggtgtgtcaaagaggcacgtgaggatatctagaagccttcaccaagacgagcattcttggtcacagatcagaccactgctggttacatttggccacgacggtaagggacaccctttgcataagagggaaaagagacaggccaagcacaagcagagaaagaggctgaagagttcttgtaaaaggcaccccctgtacgtggacttctctgacgtaggatggaacgactggatcgtcgctccacctggttaccacgccttttattgtcacggagaatgtccattccctctggccgaccacttgaactcaacgaaccacgccatcgtgcaaaccctggtaaactccgtgaactctaaaattccaaaggcatgctgcgtcccaacggagctctccgccatctccatgctctacttggacgaaaacgagaaagtcgtactcaagaactatcaagacatggtggtagagggttgcggatgccgc

SEQ ID NO: 7889 - DNA, 1188 bp, Artificial Sequence
  Description of Artificial Sequence: Synthetic coding sequence
atggttgcgggtacgcgttgtttattagcgttattactaccgcaagtattactaggtggtgcggcgggtttagtaccggaactaggtcgtcgaaaatttgcggcggcgtcgtcgggtcgtccgtcgtcgcaaccgtcggatgaagtactatcggaatttgaattacgactactatcgatgtttggtttaaaacaacgtccgacgccgtcgcgagatgcggttgtaccgccgtatatgttagatttatatcgtcgacattcgggtcaaccgggttcgccggcgccggatcatcgattagaacgtgcggcgtcgcgtgcgaatacggttcgatcgtttcatcatgaagaatcgttagaagaattaccggaaacgtcgggtaaaacgacgcgtcgttttttttttaatttatcgtcgataccgacggaagaatttataacgtcggcggaactacaagtatttcgagaacaaatgcaagatgcgttaggtaataattcgtcgtttcatcatcgtataaatatatatgaaataataaaaccggcgacggcgaattcgaaatttccggtaacgcgactattagatacgcgtttagttaatcaaaatgcgtcgcgttgggaatcgtttgatgttacgccggcggtaatgcgttggacggcgcaaggtcatgcgaatcatggttttgtagtagaagtagcgcatctagaagaaaaacaaggtgtatcgaaacgtcatgtacgaatatcgcgatcgttacatcaagatgaacattcgtggtcgcaaatacgtccgttattagttacgtttggtcatgatggtaaaggtcatccgctacataaacgagaaaaacgtcaagcgaaacataaacaacgaaaacgattaaaatcgtcgtgtaaacgtcatccgttatatgtagatttttcggatgttggttggaatgattggatagttgcgccgccgggttatcatgcgttttattgtcatggtgaatgtccgtttccgttagcggatcatttaaattcgacgaatcatgcgatagtacaaacgctagtaaattcggttaattcgaaaataccgaaagcgtgttgtgtaccgacggaactatcggcgatatcgatgctatatctagatgaaaatgaaaaagtagttctaaaaaattatcaagatatggtagttgaaggttgtggttgtcga

SEQ ID NO: 7890 - DNA, 1188 bp, Artificial Sequence
  Description of Artificial Sequence: Synthetic coding sequence
atggtggcaggcaccaggtgtctgctggcactgctccttcctcaggtgcttttgggaggggctgcaggactggtgccggaactcggaagaagaaagtttgcggcagcaagctcaggacgtccgtcctcacaaccttcagatgaagtcctttccgaatttgaactgcggcttctgtcgatgttcggcctgaagcagcggcccactccctccagagacgcagtggtgccaccctacatgttggatctctaccgccgtcatagcggacaaccaggctcgccagcaccggatcacaggctggagagggccgcatctcgtgctaacactgtcagatcgtttcatcatgaagaatcgctggaggagctgcccgaaacttcaggcaagaccacccgacgcttcttcttcaacctgtcctcgatccctacggaggagtttatcacgtcagctgaacttcaggtctttagagaacaaatgcaggacgccctcggaaataactcgagcttccaccatcgcatcaacatctacgagatcattaagcctgcgaccgccaattcgaagttccctgtgactcgactcctcgatactagactcgtgaaccaaaacgcctcgcgatgggaatcgttcgatgtcactcccgcagtgatgagatggaccgcacaaggacatgcaaatcatgggtttgtggtggaagtcgcacatctggaagagaaacaaggcgtctcaaagagacatgtgaggatttcacgctcactgcaccaggatgagcattcctggtcacagatcagacctcttctcgtgacttttggacatgatggaaaaggccacccactgcataaacgggaaaagcgccaagcaaaacataagcaacggaaacggcttaaatccagctgtaagcgccatccgctgtacgtggatttttcagacgtcggctggaacgactggattgtcgcaccccccggataccacgcattttactgccatggtgaatgtcccttccctcttgcggaccatcttaactcaaccaaccacgcaattgtccagaccctcgtgaactcggtgaacagcaaaattcccaaggcgtgctgtgtgcctaccgaactgtccgccatctcaatgctttacctcgatgaaaatgagaaggttgtgctgaagaactatcaagacatggtggtggaagggtgtgggtgccga

SEQ ID NO: 7891 - DNA, 1188 bp, Artificial Sequence
  Description of Artificial Sequence: Synthetic coding sequence
atggtcgcaggaacccgctgcttgctggcgcttttgctcccacaggtgttgctgggaggagcggcgggccttgtgcccgaactgggtcgccgcaagtttgccgcggcctcgtccggaaggccgtcctcacagccttcggacgaagtgctgagcgaattcgaactgagactcctgtccatgtttggcctgaaacaaaggccaacccccagcagggacgccgtggtaccgccttatatgctggatctttaccggcggcactcgggacaaccgggaagccccgcgccagatcatcgcttggaacgcgcggcctccagggcgaatacggtccgctcattccatcacgaagagagcctggaagagctcccggaaacttcgggtaagactacccggcgattctttttcaatctttcgtcaatccctactgaagaattcatcacttcagctgagctgcaggtgttccgggaacagatgcaagacgctctcggcaacaactcgagctttcaccatcgcatcaatatctacgagatcatcaaaccggcaactgcaaattcgaaattcccggtcacccgcctgttggacacccgcctggtcaatcagaacgcaagcagatgggagtccttcgatgtgacgccagccgtgatgcggtggactgctcaggggcatgctaaccacggattcgtcgtcgaggtggcgcacctggaggagaagcagggtgtgagcaagcggcatgtgcgcatatctcgaagcctgcaccaagacgaacattcgtggtcgcaaatcaggccgctgctcgtgactttcggccacgacggaaagggccaccctctgcacaaacgcgaaaaacgccaggcgaagcataagcagagaaagcggctgaagtcctcctgtaagcgacatccactttacgtggacttttcggatgtaggatggaacgactggatcgtggccccaccggggtaccatgccttttactgccacggtgagtgcccgttccccctcgcagatcatttgaactcgaccaaccacgccattgtccaaaccctggtgaattccgtgaactcaaagattcctaaggcttgctgtgtccccaccgaactctcagccatctctatgctctaccttgacgagaacgagaaagtagtgctcaagaactaccaggacatggtcgtggaagggtgcggatgccgt

SEQ ID NO: 7892 - DNA, 1188 bp, Artificial Sequence
  Description of Artificial Sequence: Synthetic coding sequence
atggtcgccggaaccagatgcctcctggcattgcttttgccacaggtcctgctgggaggggctgctggattagttcctgaactgggtcgtcgaaagtttgcggcggcatcctcaggacggcccagctcacagccaagtgatgaggtcctgtctgagtttgagttacgactcttatccatgtttgggcttaagcagaggccaactccatccagggacgcagtagttcctccatacatgcttgacctttacagaagacattcgggccagccaggatctccagcacccgaccataggctggaaagggctgcctccagggcaaacacagtgaggagcttccatcacgaggagtctttggaggagcttccagaaaccagtggtaaaacaactcgtcgtttttttttcaacttatcctccatccctaccgaggagttcataactagtgcagagctccaggtcttccgtgagcagatgcaagatgctcttgggaacaacagctcatttcaccatagaatcaacatatacgagattatcaaacctgcaaccgcgaatagcaaattcccagttaccagactgttggatacccggctcgtgaaccaaaacgcttctaggtgggaaagctttgacgtgacccccgccgtgatgcgctggacagcacaaggacatgccaaccacggattcgttgtggaggtcgcacatcttgaggagaaacagggcgtgagcaagcgtcatgtccggatcagcaggtcactccaccaagacgagcatagctggagccaaatcaggcccctcttagtcacctttggacatgatggaaagggccacccattgcataagcgcgaaaagcgccaggcaaaacacaagcaacgcaaacgtctcaagtcttcttgtaaaaggcaccccctgtatgtcgatttttcggacgtgggatggaacgactggatcgtggcgcctccgggctaccatgcgttctactgtcacggcgaatgtccattccctctcgctgatcacctgaactcaaccaatcatgccattgtccaaacattggtaaactcagtgaactctaagatacccaaggcttgttgtgtccctaccgaactgagtgctatatccatgctatacctggatgagaatgaaaaagtggtgctgaagaactaccaagatatggtcgtcgagggatgcggctgcagg

SEQ ID NO: 7893 - DNA, 1188 bp, Artificial Sequence
  Description of Artificial Sequence: Synthetic coding sequence
atggtagcaggcacccgatgtcttcttgcgctgctgcttccccaggttttgctaggtggggctgcgggcctggtgcctgaactgggcagaagaaaatttgcagccgctagcagcgggagaccaagttcgcaaccctctgatgaagtactatccgaatttgagctacgattgctgtcaatgtttggcttgaagcagcgacccactccttcacgggatgctgtggtcccaccatatatgctggatctttatcgacgacatagtgggcaacccggctcacccgctcccgaccaccgcctagagcgggctgcttcacgagccaacactgtgcgatcctttcaccacgaggagagcctagaggagctgccagagacatcaggcaagactacacggcgttttttctttaatttgtcgtctatccctacagaggaattcataactagcgctgaattgcaggtctttcgcgagcagatgcaagacgcactcggcaataactcatcgttccaccatcgaatcaacatttatgagatcattaaacctgcaaccgccaattctaaatttcccgtcaccagactgttagacacaaggctggtgaatcagaatgctagccgatgggaaagctttgacgttacacctgccgtaatgcgatggacagctcagggtcacgccaaccacggcttcgtggtcgaagtggctcaccttgaagaaaagcagggcgtgagtaagaggcacgtccgcatatcccgttcactacaccaggacgaacattcctggtcccagattcgccctctactggtaactttcgggcacgacgggaaagggcatcccctgcacaaacgagagaaacgccaggcaaagcacaagcagcggaagaggctaaagagctcctgcaagcggcatcccctctatgtggatttctccgatgttgggtggaacgattggatcgtggctccacccgggtaccatgcgttctattgtcatggtgagtgtccctttccactggctgaccacctaaacagcaccaatcacgcgatagtccagacgttagtaaatagcgtgaatagtaagatccctaaggcgtgctgtgtacctacggaattatccgcgatcagcatgttatatctggatgaaaatgagaaagtggttctaaagaattaccaggatatggtggtggagggatgtggatgtcga

SEQ ID NO: 7894 - DNA, 1188 bp, Artificial Sequence
  Description of Artificial Sequence: Synthetic coding sequence
atggtcgccggtacacgatgcttattggctctgctcctgcctcaggtcctcctgggcggggctgccgggctggtgcctgagcttggcaggcggaagttcgcggccgcctctagcggcaggcccagctctcaacccagcgatgaggtgctatctgaatttgagctccgcctgctgtcgatgttcggtctaaaacagaggcccacaccctctagagatgccgttgtgccaccctatatgctcgacctctacagaaggcactctggccagcctggttctcctgctcctgatcaccgtctagagcgagcagcgtctcgcgcaaacaccgttcggtcattccatcatgaggagagcctggaggaactccctgagacctctggaaaaacaacccggcgtttttttttcaatctgtcttcaattcctaccgaagaatttattacaagcgccgagctccaggtcttcagagagcaaatgcaggatgcgttgggaaataactcttccttccatcatcggataaatatatatgagatcattaagccagcaaccgcaaatagcaagtttccagtgacgcgtctcttagatactaggttagtaaaccagaatgcgagccggtgggagtcatttgatgtgacccctgccgtcatgcggtggacagcccaaggtcacgcgaatcacggttttgtggtggaagtggctcacctggaggaaaaacagggcgtgtctaagaggcatgtgcgcattagtcggtctttacatcaggacgagcattcttggtctcaaatacgaccacttcttgtcacctttggacacgatggtaagggtcacccactccataaaagggaaaaacgccaggccaagcacaagcagagaaaacgcctgaaatcctcctgcaagcgacatcccctgtatgttgacttcagtgacgttggctggaacgactggatcgtcgccccccccggctaccatgcgttctactgtcatggagagtgtccgttcccattagctgatcacctcaattccacaaaccacgcgattgtgcaaaccctggtgaacagtgtgaattccaagattccgaaggcttgctgcgtcccaaccgaattgagcgccataagtatgctgtatctcgacgagaatgagaaggtggtcctgaagaactatcaggacatggtggttgagggttgcgggtgtcgc

SEQ ID NO: 7895 - DNA, 1188 bp, Artificial Sequence
  Description of Artificial Sequence: Synthetic coding sequence
atggtcgcaggaacccgatgcctactagccctgctgcttccccaagtccttttgggcggcgctgccggtctggtccccgaactgggcagaaggaaatttgccgcagcaagcagcggaaggccttcatcacagccctctgacgaggtcctgtcagagttcgagctcaggcttttaagtatgttcggactgaagcagcggccgaccccctcaagggacgcggtcgtacctccttacatgctggacctgtaccggcgccattccggtcagcccggaagcccggcacccgaccaccggttggagagagccgcgtctcgagccaacaccgtgaggtccttccatcacgaggaaagtcttgaagagttgccagagacatcagggaagaccaccaggagatttttttttaatctgagctccataccaacagaggaattcatcacctcagccgagctccaggtcttccgcgaacaaatgcaggatgcccttggcaacaattccagttttcaccatcggatcaacatttacgaaatcataaaacccgcaacagccaacagcaagtttcctgtgacacgcctcttagacacacggctagtcaatcagaacgccagtcgctgggagtcgtttgacgtgactcccgcagtgatgcgatggaccgcccaaggtcacgcaaatcatggcttcgtcgtggaggtggcccacctggaggaaaaacagggtgttagtaagagacatgtcaggatctctaggagcctgcaccaggacgaacactcttggagtcagatcaggcctctgttagtgaccttcgggcacgatggcaaagggcacccactccacaaacgcgagaagcggcaggccaagcacaagcagcggaaaagactgaaaagctcgtgtaaacggcaccccctgtatgtggacttctcagatgtgggctggaacgactggatcgtggcaccccccggttaccacgccttctactgtcacggcgagtgtcctttccccctagcggaccatcttaactctacaaatcatgcaatcgtgcagactttggtaaactcagtaaacagtaaaatccctaaagcttgctgtgtccccacagaactctccgcaatatcaatgctgtatctggacgagaacgaaaaagttgtgctgaagaactaccaggacatggtggtggagggttgcggatgccgg

SEQ ID NO: 7896 - DNA, 1188 bp, Artificial Sequence
  Description of Artificial Sequence: Synthetic coding sequence
atggttgccggaacgcggtgcctcctggcgctgctcctgccgcaggtgcttctgggaggagcggctggactggtgccagaactcggacgccgcaaattcgcagcggcaagctcgggaaggccgagcagccagccgtcagacgaggtgctgagcgaattcgaactccgcctcctcagcatgttcggactgaagcagcgccccactccgtcccgggatgccgtggtgccgccttacatgttggacctgtaccgccgtcacagcggacagcctggctcacctgctcctgaccacagacttgaacgcgcagcctcaagggccaatactgtgcgcagcttccaccatgaggaatcactggaagagctcccggaaacttctggcaagacgacccgccgcttctttttcaacctctccagcatcccaactgaagagttcattacctccgccgagctgcaagtctttcgggagcagatgcaggatgccctcggaaacaactcatcgttccaccatcgcatcaacatatacgagatcattaagccagctacggccaactccaaattcccagtcactagactcctcgatacccggctggtcaatcaaaatgccagcaggtgggaatcgtttgatgtgactcccgcagtcatgagatggaccgcgcaaggacatgccaaccatggcttcgtggtcgaagtcgcacacttggaggagaagcaaggagtttctaagagacacgtgcgcatctcacggagcctgcatcaggacgagcattcctggagccaaatccgaccgcttttggtcaccttcgggcatgacggaaagggacacccactgcataaacgggaaaaacggcaggccaagcacaaacagagaaagcgactcaagtcgagctgcaagcggcacccgctttacgtggacttcagcgacgtggggtggaacgattggattgtggcaccgcccggctatcacgcattctactgccatggcgagtgtcctttccctctggctgatcacctgaactctaccaatcacgccatcgttcaaaccctcgtcaactccgtgaactcgaagattcctaaagcctgctgtgtaccgactgaactgagcgccatcagcatgctgtacctcgacgagaacgagaaggtcgtgcttaagaattaccaagatatggtggtggagggatgtgggtgcagg

SEQ ID NO: 7897 - DNA, 1188 bp, Artificial Sequence
  Description of Artificial Sequence: Synthetic coding sequence
atggtcgctggtaccagatgtctgttagctctcctgctcccacaggttcttctgggtggcgcagccggcctggtcccggaactgggacgcagaaagtttgcagcagcctcttccggtaggccgtcttctcaaccttccgacgaggtgctgagcgagtttgaactaagactgctttctatgtttgggctgaaacagaggcccactccgtccagagacgcagtggtgccaccgtatatgctggacctgtacagacgacactcaggacagccgggatccccggcaccggaccataggctcgagagggccgcatctagagccaacaccgtgaggagttttcaccatgaggaaagcctcgaggagctccctgagaccagtggaaaaacaacccgaaggttctttttcaatctctcgagcatcccaactgaagagttcatcacgtccgctgagctgcaggtgtttagggagcaaatgcaggacgccctcggcaataattccagcttccatcatagaattaacatatatgaaattattaagcccgctacagctaatagcaagttcccggttacacgtctcctggacactagattggtgaatcagaacgctagccgctgggagtctttcgacgtaacccccgctgttatgcggtggaccgcccagggccatgctaatcacgggttcgtagtcgaagtggcgcacctcgaggaaaagcagggagtgtctaaacggcacgttagaatctcacgatctttgcaccaggacgagcactcatggtcccagatcaggcccttgttggtgacattcggccacgatgggaagggtcacccactgcacaagcgtgagaaacgacaggccaaacataagcagcggaagagattgaaatcctcgtgcaagagacacccactgtacgtggatttttccgatgtcggctggaacgactggatcgtggccccgccaggttaccacgcattctactgtcacggcgagtgtccgtttccattggccgaccatctaaacagcacgaaccacgctatcgttcaaacactggttaacagtgttaattcaaagattcctaaggcatgctgcgtgcctacggaactttctgcgataagtatgctctatttggatgagaatgaaaaggtggtgctcaagaattatcaggatatggttgtcgagggatgcggttgtagg

SEQ ID NO: 7898 - DNA, 1188 bp, Artificial Sequence
  Description of Artificial Sequence: Synthetic coding sequence
atggtggcaggtacccgctgcctgctggcgttactgttaccccaggtcttgctgggcggggcagccggcctcgtccctgaactgggtcgccgtaaattcgcggccgcaagctccgggagacctagctcccagccctctgacgaagtgctgtcggagtttgaacttaggctcctgtctatgttcggactaaaacagaggcccaccccctctcgtgatgccgtggttccaccttacatgctggacttgtatcgccggcacagcggccagcctgggagtccggccccagatcaccgactggaacgggcggcctcgagggccaacacggtgaggtctttccatcatgaagaaagcctggaggaactgccagaaaccagcgggaagactactcgacggtttttttttaacctgagctctatccccacagaggaatttatcacaagtgctgagttacaagtgtttagggaacaaatgcaagatgcgctcggaaataattctagtttccaccaccgcattaacatttatgaaatcataaagcctgcaacagccaacagcaagtttcctgtgacacgcctgctggatactcgattagtgaatcagaatgcatctagatgggaatcttttgacgtgactcctgctgtgatgcgctggacagctcagggacacgccaatcatgggttcgttgttgaagtcgcacacctggaggaaaaacagggggttagtaaacgccatgtgagaatcagccgctctctgcaccaggatgaacattcctggtctcagatcagacccctactcgtaacctttggccacgacggcaagggtcacccacttcacaaacgcgagaagcggcaggctaaacataagcagaggaaaagacttaaatcctcatgtaagagacatcctctgtatgtggatttctcagatgtggggtggaatgattggattgtagcacctcccggctatcacgcattttactgtcatggcgaatgtcccttcccattggctgatcatctgaacagtacaaatcatgctatcgtgcagaccctggttaatagcgtgaattccaaaatccctaaggcctgctgcgtgccaacagaactgtcagccatcagtatgctatatctggatgagaacgaaaaggttgtgctcaagaattatcaagacatggtcgttgaaggctgcggctgtcgt

SEQ ID NO: 7899 - DNA, 1188 bp, Artificial Sequence
  Description of Artificial Sequence: Synthetic coding sequence
atggtcgctggtaccaggtgtcttctggccttactgctcccacaggtgctactcggtggagcggccgggctagttccggagttggggcggcgaaaatttgccgccgctagttctggaagaccctcatcccagccctccgatgaagtgctctccgaattcgaattgcgcctcttgtccatgttcgggctaaaacagcggccgactcccagccgcgatgctgtggtgccgccctacatgctggacctctaccgacgacattccggacagcccggatccccagccccagaccatagactggagcgagcagcttcaagagcaaataccgttcgttcctttcatcatgaggaatcccttgaggaactcccagaaacttctgggaagacgacaaggcggttttttttcaatctgagtagcattcctacggaggagtttattacttctgctgaactccaagtctttagggagcaaatgcaggatgctctaggcaataatagctcttttcaccatcgcattaatatctacgagattataaaacccgccaccgccaatagtaagtttccagtcacaagactgctggacaccagattggtgaaccagaacgcctcaagatgggaaagctttgatgttacccctgccgtaatgcggtggactgcacagggtcacgcaaaccatggcttcgtcgtcgaggtggctcacctggaagaaaaacaaggggtgtccaaaaggcatgttcggatatcgaggagcctccaccaggacgagcatagttggagccagatcagacctctgttagtgaccttcggccatgacggaaagggccacccactacataagagggagaaacggcaggccaagcataaacagcggaaacgtctcaagtcctcgtgcaagcgccaccccctttatgttgacttttcggacgtcggctggaatgattggattgtcgctcccccgggttaccacgcattctactgtcatggggagtgcccattcccacttgcagaccacctgaatagtacaaatcatgcgattgtgcagacccttgtaaactctgtgaattccaagattccaaaggcctgctgcgtaccaaccgagctgtctgccattagcatgctatatttggatgagaacgaaaaggttgttctgaagaattaccaggacatggttgtggaaggttgtggttgtcgc

SEQ ID NO: 7900 - DNA, 1188 bp, Artificial Sequence
  Description of Artificial Sequence: Synthetic coding sequence
atggttgcgggaaccaggtgcctattagcgctgttgttgcctcaggtgctcctgggaggagccgctgggctggtccctgaactcgggcggcgcaaatttgctgccgcgagctcaggtaggccctcctcacaaccaagtgatgaggtactgtcagagtttgagcttcgattgctgtctatgttcgggttaaaacagcgccccacaccctcccgtgacgcggtggttcctccctacatgctggacttgtatagaaggcattctgggcaaccaggcagcccagctccggatcatcggctcgagcgcgctgcgagccgcgcaaatacagtgcgatctttccatcacgaagagagtttggaagaattacccgagacctctggaaagacaacaagacgtttcttcttcaatctatcgtcaatccctaccgaagagtttattacgtccgcggagttgcaggtatttcgagaacaaatgcaggatgcactcggcaacaactctagcttccatcaccggattaacatttacgaaattatcaagcccgctactgccaactcaaagttccccgtcactcgcttgctagacacgagactggtgaatcagaatgccagccggtgggagtccttcgacgtgacaccagcagtaatgcgctggactgcccaaggccatgcaaatcatggatttgtagtggaagtggcccaccttgaggagaagcagggtgtctccaagagacacgtgcgcatcagcaggagtttgcaccaagatgagcactcttggagccagattagacccctcctagtgacttttggacatgacggcaaaggccacccactgcataagcgggaaaaacgccaagcgaaacacaaacagcggaagcggctgaaaagctcttgcaaacggcaccctctttacgttgactttagcgacgttggatggaacgactggattgttgctccacccggataccacgccttttattgccatggggagtgccccttccccctcgccgaccatctgaattcgacaaaccacgcaattgtgcagaccttggtgaactccgtcaactctaagattcccaaagcatgctgcgtgccaacagagctgtcagccatcagcatgttgtacctggatgagaatgaaaaagtggtgctcaagaattatcaggatatggtcgtggagggctgtgggtgcaga

SEQ ID NO: 7901 - DNA, 1188 bp, Artificial Sequence
  Description of Artificial Sequence: Synthetic coding sequence
atggtagcaggaacccggtgcttgcttgccctgttactgccccaagtccttctgggtggcgctgctgggctagtacctgagttagggcgccggaaattcgcggcggcctcaagcggacggcctagctctcagcccagcgatgaggtgttgagtgagtttgagcttaggctgctgagtatgttcggcttgaaacagcgccccaccccaagcagagatgcggtcgtgccaccttatatgctggatttatacagacgccatagcggacagccgggctctccagcccctgatcacaggctagaacgggccgcatctagggccaataccgtgaggtcatttcaccacgaggaaagccttgaagaattgcctgaaaccagcggcaagaccacgcgccggttctttttcaatctgtccagtatccccactgaagaattcattacctccgcagagcttcaggtgttcagggagcaaatgcaggacgcgctgggtaataattctagcttccatcaccggataaatatctacgaaattatcaaaccggcgactgccaactccaagttccccgtaacccggcttctcgataccagattggtgaatcagaacgcctcccgatgggagagtttcgatgtcacacccgcagttatgcgatggaccgcccagggacacgcgaatcacggtttcgtggttgaagttgcacacttggaagagaaacagggcgtgtctaaaaggcacgtgaggattagtaggagcctgcaccaagatgagcacagctggtctcagataagaccactgttagttaccttcggacatgacggcaagggccaccctctgcacaagcgggaaaaacgacaggctaaacacaagcagcgtaagcggctaaaatcctcttgcaaaaggcatcccctttacgtagatttcagtgatgtgggctggaatgattggatcgttgcacctccgggatatcacgccttttattgccacggggagtgtccttttcctttggcggatcatcttaatagcacgaatcatgcaattgtgcaaactttggttaattcagtcaatagtaaaattccaaaggcatgttgcgtgccaactgagctctctgctattagcatgctgtatctggacgagaatgagaaggtggtgctgaagaactaccaagacatggtggtggagggctgcggatgtcgg

SEQ ID NO: 7902 - DNA, 1188 bp, Artificial Sequence
  Description of Artificial Sequence: Synthetic coding sequence
atggtggccggcacgagatgtctgctcgcattgctcctgcctcaagtcctattaggaggagctgcaggactggtgccagagttgggaaggcgtaagttcgcggcggccagttcaggaaggccttcctctcagcctagtgacgaggtattatctgagtttgaactgcgactgctttccatgttcggattaaaacagagacccaccccttctcgggacgctgtggtaccaccttacatgctggatttgtacaggagacactctgggcagcctggatcacccgcgcccgaccatcgcctggagagggccgcctcccgggcaaacactgtgagaagtttccatcacgaagagagtctcgaagagcttcctgaaacctctggcaagacaaccagaagattcttcttcaacctaagctctattccgactgaagagtttataacttcagccgaattgcaggtgtttagagagcagatgcaggacgcattgggcaataatagtagtttccatcacaggatcaatatatatgagattattaagcccgcaacggcaaacagtaagtttcccgtgacgcgcctgctcgatacaagattggtgaatcagaatgcctctaggtgggaaagcttcgatgtaacgcccgccgtgatgcggtggacagcgcaaggccacgcgaaccacggctttgtcgtcgaggtcgcacacctggaggaaaaacagggagtatcaaaacggcacgtcagaatttcgagatctcttcatcaggacgagcattcatggagtcagattcggcctctgcttgtcacattcggacacgacgggaaaggtcacccattacacaaacgggagaagaggcaggccaagcataagcaacggaagaggctcaagtcctcatgcaaaaggcatcctctttacgtcgatttctcagatgtgggttggaatgactggattgtcgcaccacccggataccacgccttttactgtcacggggaatgccctttccccctggcagatcatctgaactccaccaatcacgccattgtgcagactttagtcaattctgttaactccaagatccctaaagcttgttgtgtgccaactgagttaagtgctatctcaatgttatatttggatgagaatgagaaggtggttctgaagaattaccaggatatggtcgtcgaaggctgtggctgcaga

SEQ ID NO: 7903 - DNA, 1188 bp, Artificial Sequence
  Description of Artificial Sequence: Synthetic coding sequence
atggtggccggtactcggtgcctcctcgccctcctcctcccacaggtgctcttggggggcgcagcaggcctggtgccagagctgggacgcagaaagttcgcggcagcctcgtcaggacggccgagctctcagccttcagacgaggtgctctcggaatttgagttgcggctcctgtcaatgttcggactgaagcaacgaccgaccccctctcgcgatgccgtcgtcccaccgtatatgctggacttgtaccggcggcatagcggacaacctggtagccctgcgccggaccaccgccttgaaagggccgcttcccgcgccaatactgtgaggtcgttccaccacgaagaatcgcttgaggaactgccggaaacttcgggaaagaccaccagaagattcttcttcaatctgagctcgatccccaccgaggagttcatcacgtcagccgagctccaggtgttccgggagcaaatgcaggacgccctgggaaacaactccagcttccaccaccggatcaacatctacgaaatcatcaagccggccaccgctaactctaagttcccggtgaccagactgctggacacgcggttggtcaaccaaaacgcctcgcgctgggaatccttcgacgtgactcccgctgtcatgcgctggactgcccagggacatgcgaatcacgggttcgtcgtggaagttgcccacctcgaggaaaagcagggtgtttcaaagagacacgtgcgcatctcccgctccctgcatcaggatgaacactcctggtcccagatccggcctctgctggtgacctttggtcatgacggaaagggccaccccctccataaaagggaaaagcgccaagcaaaacacaagcaacggaagcggctgaaatcgtcctgcaagaggcatccgctttacgtggatttctcggacgtgggatggaatgattggattgtggccccaccgggctaccatgctttttactgccatggcgagtgtccattccctctcgcagaccacctgaacagcactaatcatgctatcgtgcagacccttgtcaattcggtgaacagcaagatccccaaagcctgctgtgtgcccactgagcttagcgccatctcaatgctctaccttgatgagaacgaaaaagtggtgttgaaaaactaccaagatatggtcgtggaagggtgtggatgccgg

SEQ ID NO: 7904 - DNA, 1188 bp, Artificial Sequence
  Description of Artificial Sequence: Synthetic coding sequence
atggtagccgggacccgctgtctgcttgccctccttcttccacaagtgcttcttggcggagcagcaggacttgtgcctgaattgggaaggagaaagtttgcagcggccagctcgggacgcccaagctcgcagccctcagacgaagtgctttccgaatttgaacttagactcctgtcaatgtttgggctgaaacaaagacctactccttccagggatgcagtcgtgcctccgtacatgctcgacctgtaccgtcgccatagcggccaaccaggaagccctgcccctgatcatcgcctcgagcgcgcagcaagccgagcaaacaccgtgcgatcctttcatcatgaagaatcactggaggaacttcctgaaactagcggtaaaacgaccagacggttctttttcaatcttagtagcattcccactgaggagttcataaccagcgccgaacttcaagtctttcgggagcaaatgcaggatgcattgggaaataactcctcatttcatcaccgcatcaacatttatgagataatcaaacctgccactgcaaactccaagttccctgtgaccagactccttgataccagactggtcaaccagaatgcttcgcgttgggaatcctttgacgtgactccagcagtcatgagatggaccgctcaaggacatgccaaccacgggtttgtggtggaggtcgcgcatctcgaagaaaaacagggtgtgagcaaacgccatgtgcggatctcaagatccctccatcaagatgagcattcatggtcacagatcaggccccttcttgtgacctttggccatgatggtaagggacatccactccacaaaagagaaaagcgccaagcgaagcataagcagaggaagaggctgaaaagctcatgtaagcgacatcctctctacgtggatttttctgacgtgggatggaacgattggatagtggcgccacctggttaccatgctttttactgtcacggagaatgtcctttcccactggctgatcatttgaactccaccaatcatgccatcgtgcagaccctggtgaattccgtgaactcaaagatccccaaggcatgttgcgtgcccaccgaactgtctgccatttcgatgctgtacctcgacgaaaatgaaaaggtggtcctgaaaaactatcaagacatggtcgtcgaaggttgtggatgtagg

SEQ ID NO: 7905 - DNA, 1188 bp, Artificial Sequence
  Description of Artificial Sequence: Synthetic coding sequence
atggtggcaggaactagatgtttgcttgcactgctgttgcctcaggtgctgctcgggggagccgcagggctggtgcctgaacttggccggcggaagtttgcggcagcgtcgtccggtcggccttccagccagccatcagatgaagttctttccgaatttgaattgcgactgctctccatgtttggactcaagcaacggccgactccttcgcgtgacgccgtggtgcctccatacatgctcgacctttacagacgccactcgggacaacctggaagcccggcacctgatcacaggcttgaacgtgcagcatcgagagcaaacaccgtgcgttcattccaccatgaagaaagccttgaagaacttcctgaaacctcagggaaaaccactaggcgcttcttctttaatctgtcctcgatacctaccgaagaattcattactagcgcagaacttcaagtgttcagagagcagatgcaagatgctctgggtaacaattcatcgtttcatcacaggatcaacatttacgagatcatcaagcctgcaactgcaaactcaaagtttcctgtgacgagactgcttgatacgcgccttgtgaaccaaaatgcatctcgctgggaaagtttcgatgtgactccagcggttatgagatggacggcccagggtcatgccaaccacggctttgtcgtggaggtggctcatctcgaagagaagcagggtgtcagcaaacggcatgttagaataagccggagcctgcatcaggatgagcattcgtggtcgcaaatccgtccactgctggtgacctttggccatgacgggaagggacacccacttcataagagggaaaaacggcaagcaaagcacaaacagagaaaaagacttaagtcgtcatgtaagaggcatccactttacgtggacttttcagatgtgggttggaacgactggattgtggcccctcctggttaccatgcattctactgccacggcgaatgtccatttccactcgccgatcatcttaactcaaccaaccacgcgatagtgcagactctggtgaactcggttaactccaagattccaaaggcgtgttgtgtacctactgaacttagcgcaatctccatgctgtacctggacgaaaatgaaaaagtggtgctcaagaattaccaagatatggtggtggagggctgtggttgcagg

SEQ ID NO: 7906 - DNA, 1188 bp, Artificial Sequence
  Description of Artificial Sequence: Synthetic coding sequence
atggtggctggaaccagatgcttgctggccctcctcctcccgcaggtgcttctggggggagcagcaggactggtgccggagctcggacgcaggaagttcgccgcggcatcttcgggacgcccgtcctcccagccttcggatgaggtgttgtccgaattcgaactgagactgctgtccatgttcgggttgaagcagcgccctaccccatcccgggacgctgtggtgccgccttacatgcttgatttgtaccgcaggcacagcggtcagccaggatcacctgcgccggaccataggctggaacgggctgcctcgagagcaaacaccgtgcggagcttccaccatgaagaaagcctggaagagctcccagaaactagcggcaagaccacccgccgattcttcttcaacctgtcatcaatcccgaccgaggaattcatcacttcggcagagctccaggtgtttagagagcagatgcaagacgcactgggcaacaactcttcattccatcatcgcatcaacatctatgaaatcatcaaacctgcgactgccaattcgaagttccccgtgacccgcctccttgacacccggcttgtgaatcaaaacgcttcgcgctgggaatccttcgacgtgaccccggccgtcatgcggtggacggcacaaggacacgctaaccatggattcgtggtcgaagtggcgcacctcgaagaaaagcaaggtgtctcgaagcggcacgtgcgcatctcccgctcacttcaccaagacgagcactcctggagccagataaggcctctgctcgtgacgtttggacatgacgggaagggacatccactgcataagcgggaaaagcgccaagctaagcataagcaaaggaagcgcctgaaatcatcctgcaaacgtcacccgctttacgtggatttctcggatgtgggatggaatgactggatcgtggccccgcctggataccacgcattttactgtcatggagaatgccctttccctctggcagaccatcttaattcaactaaccacgccatcgtccagactctggttaactcggtgaactcgaaaatccccaaagcctgctgtgtgccgacggaattgtcagcgatcagcatgctgtacctggatgagaacgaaaaagtggtgctgaagaattaccaggacatggtggtcgagggctgtggctgccgg

SEQ ID NO: 7907 - DNA, 1188 bp, Artificial Sequence
  Description of Artificial Sequence: Synthetic coding sequence
atggtggccggtactcgctgtttgctggcacttctgctcccccaagtccttctcggaggggcagcaggactcgtgccagagctcggtcgtcgaaagtttgcagcagcatcctcaggcagaccatcatcacagccttcggatgaagtcctctcagaattcgagctcagacttctctcaatgtttggtcttaagcagcggcctactccctcgcgtgatgcagtggtgccaccttacatgctggacctctacaggagacattcaggtcaacccggctcccccgcaccagatcacagacttgagagagcagcatcacgggcaaacacggtccgctcgttccaccatgaagagagcctcgaagaacttccagagacttctggaaagactacccgtcgttttttcttcaatcttagctcgatccctactgaagaattcattacgtcagcagaacttcaagtattcagggaacaaatgcaagacgcccttgggaataactcgtcatttcatcaccgcataaacatttatgagattatcaagccagcaactgccaactctaagtttcctgtgactagactgcttgataccagactggtgaaccagaatgcctcgcggtgggaatcctttgacgtgactccggccgtaatgcggtggaccgctcaaggccatgctaaccatggtttcgtcgtggaagtcgcacatcttgaagagaagcaaggcgtgtcaaaaagacacgttcgcatttcgaggagcctgcatcaggacgaacactcatggtcgcagattaggccccttcttgtgacctttggacatgatggcaaaggccaccctctgcataagcgggaaaagcgccaggccaaacataagcaacgaaaacgactgaagagctcgtgtaagcgacatcctctgtacgtcgacttcagcgatgtgggttggaacgattggatagtggcacctccagggtaccatgcgttctactgccacggagagtgtccatttccattggcggatcaccttaacagcaccaaccatgccattgtgcaaaccctcgtgaattcggtgaattctaaaatcccgaaagcgtgttgtgtgccaaccgaactgtccgccatttctatgctgtacttggatgaaaacgaaaaggttgtcctcaagaactaccaagacatggtggtcgaaggatgtggttgtcgc

SEQ ID NO: 7908 - DNA, 1188 bp, Artificial Sequence
  Description of Artificial Sequence: Synthetic coding sequence
atggtcgcaggcacgaggtgcctgctggcactgctgctcccacaggtcctgctgggtggggcggctggactcgtccctgagctcggccgccggaaattcgcagccgcatcctcgggtcggccgtcctcacaaccaagcgacgaagtgctgagcgaattcgaactgaggctgctttccatgtttggactcaaacagaggccaactccaagtagagacgccgtggtgccgccttacatgctggacctctacagacgccacagcggacagcctggctccccagcccctgaccacagattggagagagccgcctcgagagctaataccgtgagatcgtttcaccatgaagaatccctcgaagagctgccagaaacttcaggcaagactacccgccgcttcttcttcaatctgtccagcatcccgaccgaggaattcatcactagcgccgaattgcaggtctttagggaacagatgcaggacgctctcggaaacaactcgagctttcaccaccgcatcaacatctacgagatcattaagccagccaccgcgaattcaaagttcccggtgactcgactcctggatacccgcttggtcaaccagaacgcttcgagatgggagtccttcgacgtgactccggccgtgatgcgatggactgctcagggacacgccaatcacggtttcgtcgtcgaagtggcacatcttgaagagaagcagggcgtgtcgaaacgacatgtgaggatttcgcggtccctgcatcaggacgaacacagctggtcgcaaatccgcccgctgctggtgaccttcggccatgacgggaaggggcatcccctccacaaacgcgagaaacgacaggccaagcacaagcagaggaagcgcttgaagtcgagctgcaagaggcaccctctgtacgtcgacttctccgacgtgggctggaacgactggattgtggccccgcctggataccatgcgttctactgccatggagaatgcccgtttccactggcggaccacctgaatagcactaaccacgcgatcgtccaaaccctggtcaacagcgtgaatagcaagatcccgaaggcctgctgcgtgcctaccgaactctcggccatttcaatgctctacctggacgaaaacgaaaaggttgtcctgaaaaactaccaagatatggtcgtggagggatgtgggtgtcgc

SEQ ID NO: 7909 - DNA, 1188 bp, Artificial Sequence
  Description of Artificial Sequence: Synthetic coding sequence
atggtggctggcaccagatgcctgctggcgcttcttcttccacaagtcctgttgggaggcgccgccgggctggtcccggagttgggtagacggaaatttgccgcggcgagctcaggccgtccatctagtcaacctagcgacgaagtgctctcagaatttgaactgagactattatcaatgtttggcctgaaacagaggcctaccccgagccgtgacgccgtcgtcccaccgtatatgttggatttgtatcgccgtcattccggtcaacctggctctcctgcgccggaccatcgacttgaacgtgcagcgtcaagggcgaacaccgttaggtcttttcatcatgaagaatctttggaagaactcccagaaacatctggcaagacgactcggcggttcttttttaaccttagctcaattccgactgaggaatttatcacatcggccgagttacaagtatttagagaacagatgcaagacgcgttaggtaataattcatcgtttcatcatcggataaatatctatgaaataatcaagccggctaccgccaattcgaagttcccggtgactaggttattggatacgagactggtcaaccaaaacgcttcacgatgggaaagcttcgacgtaacgcccgcagttatgcgttggacagcgcagggtcatgcaaatcatggctttgttgtggaggtagcgcatttagaagaaaaacaaggcgtctcgaaacgtcatgtgcgcatttccagatcgctgcatcaagacgaacattcatggtcacaaatccgcccgcttttggtcacatttggccatgatggaaaaggccatccacttcataaacgggaaaaacgccaagcaaaacacaaacagcgcaagcggctgaaaagctcttgcaaacgccaccctctctatgtcgattttagcgacgttggatggaatgattggattgtagcgccgcctggttatcatgcattttactgccatggcgaatgcccgtttccgctggcagatcatctgaacagcacaaatcatgcaattgtacaaaccttggtaaattcggtcaatagcaaaatcccaaaagcgtgctgcgtgcctacagaactgagcgcaattagcatgctgtatctcgatgagaacgaaaaagtcgtcttgaaaaattatcaagacatggtagtagagggttgtggatgccgg

SEQ ID NO: 7910 - DNA, 1188 bp, Artificial Sequence
  Description of Artificial Sequence: Synthetic coding sequence
atggttgctggcactcggtgccttcttgcactgcttctaccacaggtcctgcttggcggggccgctggcttagttccagagctcggccgcaggaagtttgcggccgcatcctccggccgaccctcatcgcaaccctccgatgaggtactttcagagtttgaactaagactcctatctatgtttggtctaaaacagcggcctacaccatcacgggatgcagtcgtgcccccatatatgctcgatttgtataggagacactccggacaacctggaagcccggcccccgaccatcggctggagagagccgccagtagagccaacacagtgcggagctttcatcatgaggaaagtctggaggaactgccggagacctcaggtaagacgacccggcggttcttcttcaacctctcttccatccccacggaggaatttataacaagcgcagagctgcaagtctttagagagcagatgcaggacgctctgggtaataattccagctttcatcatagaatcaatatttacgaaattataaaacctgccaccgctaattctaagttccccgtgacaaggctgttagacaccagactggtaaatcagaatgcaagtcgctgggagtcatttgacgtgaccccagccgtgatgagatggacggcacaggggcatgccaatcacggctttgttgtcgaagtggcccacctggaagagaagcagggcgtgtcaaaacgtcacgtgcgcatcagtagaagtctgcaccaggacgaacatagttggagccagatcagacctctcctggtgacatttggacatgacgggaagggacaccccctgcacaagcgcgaaaaacggcaggcaaaacataaacagcgcaagaggttaaagtcgtcctgtaagcggcaccctctctatgtagatttttctgacgttggttggaacgactggatcgtagcgccccccggctaccatgctttttattgccatggggagtgccccttcccactcgctgatcatttgaatagcactaatcacgccatcgttcagaccctggtaaattcagtcaactccaaaatacctaaagcatgctgcgtccccacagaactgagtgcgatttccatgctgtacttggatgaaaatgaaaaggttgtgctgaagaactaccaagacatggtggtggaagggtgtggttgtcgc

SEQ ID NO: 7911 - DNA, 1188 bp, Artificial Sequence
  Description of Artificial Sequence: Synthetic coding sequence
atggtggcagggacccgctgtctgcttgccctgctgcttccccaagtgctgcttggtggtgcagcgggcctcgtgcctgagctggggcgtcggaaatttgcggccgcttcctccgggcgtccttcgtctcaaccaagcgatgaagtcttgtccgaattcgagcttagacttctgagcatgtttggtctgaaacaaaggcctacgccatcgcgtgacgccgtggtgcctccttacatgcttgacttgtaccgcagacacagcggacagcctggaagccctgcgcccgatcatagactggagcgtgctgcatcacgtgccaataccgtgcgatcatttcaccatgaggagtcccttgaagagctgcctgaaaccagcggtaagactactcgccgattctttttcaatctttcttccataccgaccgaagagtttatcactagcgcagaactccaggtattccgggaacaaatgcaagacgcgctcggaaacaactcgtcctttcatcataggatcaacatttacgagattatcaaacccgcaactgcaaactctaaattcccagtaactcgtctgcttgatacccgccttgtgaatcagaacgcctcacgatgggagagctttgacgtcaccccagccgtcatgcggtggactgctcaaggccatgccaatcatggctttgtggtggaagtcgcgcatctggaagaaaagcagggagtttcaaagcggcatgtgagaatatcgaggtcacttcatcaggatgaacatagctggagccaaatccggcctcttctcgtcaccttcggtcacgatggcaagggacatcccctgcataagcgggaaaaacggcaagcaaagcacaagcagcggaagcgtctgaagtcgtcatgcaagaggcacccactctacgtggatttctctgacgtcggctggaatgattggattgtggcaccccctggataccacgcattttactgtcacggagagtgtccttttccgttggcagatcacctgaacagcaccaaccacgcaatcgtgcagactctcgtcaattccgtgaattcaaagattccaaaggcatgttgcgttcctacggaactttccgcaatatcgatgctctatctcgatgaaaacgagaaagtcgtgctcaagaactaccaagacatggtcgtcgaaggatgtgggtgccgg

SEQ ID NO: 7912 - DNA, 1188 bp, Artificial Sequence
  Description of Artificial Sequence: Synthetic coding sequence
atggtggcgggcactcggtgtctcctggcccttctattgccacaggtcctgctgggcggtgcggccggtctagttcccgagctcgggcggcgtaaatttgccgcggcctcttctggccgcccttccagtcagccttccgatgaggtgctgagcgaattcgaactgagacttctgtcaatgttcggcctgaagcagcgcccaacgccttcacgagatgcagttgtacccccctatatgctcgatctgtacagaaggcactcgggtcaacctggctcgcctgccccagaccataggctagagcgggcagcctctcgggcaaatactgtgagaagcttccaccacgaagagtctctagaggagcttccagaaacctccgggaaaaccacacgccggttcttctttaacctcagtagcatccctacagaggaattcatcactagcgcagagctgcaagtgtttcgcgaacaaatgcaagacgctttggggaacaatagcagctttcaccatagaatcaatatatacgaaattattaaacccgctaccgcaaatagtaagtttcctgttacacgcctgctcgatactagactggtaaatcagaacgccagccggtgggagtcctttgacgtcactccggcggtgatgaggtggacagctcaggggcacgccaaccacggttttgtggttgaagtcgcccacttggaagaaaaacaaggagtaagcaaaaggcacgtccgcatatctagaagcctgcaccaggacgaacattcgtggtcccagatccgccccttactggtcacgttcggccacgatggaaaggggcatcccctgcataaacgggaaaagaggcaagcaaaacataaacaacggaagcgacttaaaagtagctgtaagcggcatcctctctacgttgactttagcgacgtgggctggaatgactggatagtggccccaccagggtaccatgcattttactgtcacggcgaatgcccctttcctctggccgaccatttaaacagtaccaatcatgcaattgtgcaaactttggttaactcggttaactcgaaaattcccaaggcctgctgcgtgccaaccgaattgtccgctatctccatgctgtacctcgatgagaatgagaaggtggttcttaaaaactatcaggacatggtcgttgaaggatgcggatgtcgc

SEQ ID NO: 7913 - DNA, 1188 bp, Artificial Sequence
  Description of Artificial Sequence: Synthetic coding sequence
atggttgcgggaactcgctgtttgctggcactgctgctgccgcaggtgctgcttgggggagctgccggactggtgcctgaactcgggagacgcaaatttgccgctgcctcatccgggcgcccttcctcgcaaccctccgatgaagttctctccgagttcgagctccgcctgctgagcatgtttggattgaagcagcggcctaccccctccagagatgctgtcgtcccgccgtacatgctggatctttaccggaggcattcgggccagcctggatccccagcaccagaccaccggctcgaaagggccgccagccgcgcgaatactgtgcggtccttccatcacgaagaatcgcttgaggagctgccagaaactagcggtaagacgactcgcagatttttcttcaacctgtcctctatcccgactgaagaattcatcactagcgctgaactccaggtgttccgcgagcaaatgcaagacgcactgggcaacaattcttccttccatcatcggatcaacatctacgagattatcaagccagcgacggccaactcgaagtttccagtgacgaggctcctggacacccgtctggtgaaccagaacgcgtcgagatgggagagctttgatgtcaccccagccgtcatgagatggacggcgcaggggcatgcaaatcacggattcgtggtggaagtcgcccacctggaagaaaagcagggcgtgagcaagcggcacgtcagaatctcacggtccttgcatcaagacgaacattcatggtcccagatccgcccgctgttggtgaccttcggacatgatgggaagggacatccgcttcacaaaagagaaaagcgccaagcgaaacacaaacaaagaaagagacttaagtcgtcctgcaaaaggcacccgctgtatgtcgacttttcggatgtgggctggaatgattggatcgtcgccccgccgggataccatgcgttctactgccatggtgaatgcccgttccctctcgctgatcacctgaatagcaccaaccacgcgatcgtgcaaactctcgtcaactccgtgaacagcaaaattccgaaagcatgctgcgtccctactgaactttcggcgatttccatgttgtacctggacgagaacgaaaaggtggtgctgaaaaactaccaggacatggtggtggagggttgcggatgcaga

SEQ ID NO: 7914 - DNA, 1188 bp, Artificial Sequence
  Description of Artificial Sequence: Synthetic coding sequence
atggtggccggtaccaggtgcctccttgctctgctcttgccacaggtcctcttgggtggcgcagccggacttgtgcctgagctcggaagacgcaaattcgcagctgccagtagcggacgtccctcctctcagcccagcgacgaggttctgtccgaatttgagctgaggctccttagtatgttcggtttgaagcagaggccaaccccttcaagggacgccgtagtgcccccatatatgctggacctgtatcgccgccatagtggacagccaggaagccccgctcctgatcaccgcctggagagagctgcttctcgtgctaatactgtccgctcctttcaccatgaggaatccttggaagaactgcctgaaacctccggaaaaacaaccagacgcttcttctttaatcttagctccatcccaactgaagagtttatcacttcagctgagttgcaggtgtttcgtgagcagatgcaggatgctctgggaaacaactcaagcttccatcaccgtattaatatttacgagatcataaaaccagcaacagcaaacagtaagttccccgtaacaagactgctggacacccgcctggttaaccagaacgcctctaggtgggagagctttgacgtcacccctgccgtgatgaggtggactgcccaaggacacgcaaaccacggattcgtggtagaggtggctcatctggaagaaaagcaaggcgtgagtaaaagacacgtgaggatcagcaggagcctccaccaagatgagcactcatggtcacagatacgccccctcctcgtcacatttggtcacgatggcaagggccaccctctccacaagagagagaagcgccaggcaaaacacaagcagaggaagaggctgaagagttcctgtaagcgtcatcccctgtatgtggacttttccgatgtcggatggaatgactggatcgtggcccccccaggttaccacgctttttactgtcacggagagtgcccttttcctctcgccgatcacctgaactctaccaatcatgcaattgtccagactctcgtcaactcagtcaatagtaaaattcctaaagcctgctgtgtgcccaccgagttgtccgctatctctatgctgtaccttgacgagaacgagaaggtagtgttgaagaactatcaagacatggttgtcgaaggttgtggttgtagg

SEQ ID NO: 7915 - DNA, 1188 bp, Artificial Sequence
  Description of Artificial Sequence: Synthetic coding sequence
atggtcgctggcacccgctgtcttttggctctgttgctgccgcaggtcctgttaggcggcgccgctgggcttgtgcctgaactgggacggcgtaaatttgccgccgcatcatcagggcggccctcaagccaaccatctgacgaggttctgtcggagtttgaactccggttgttatccatgtttggactgaagcagcgaccaacaccaagcagggacgccgtggtgcccccctatatgctcgatctttatcgtagacacagcggtcaacccggatcaccagcccccgaccacagactggaacgggccgcttcaagggccaacaccgtgcggagcttccaccatgaagaaagcttagaggaactgcctgagacgtccggcaagacgacacggcgatttttctttaatctttccagcattccgacagaggaattcatcacctcggccgaactgcaggtctttagagaacagatgcaggacgcgctggggaataactcctcattccaccatcggatcaatatttacgagataataaaacctgcgactgctaactctaagtttccagtgacccggctactggacacccgactggtcaatcaaaacgccagcagatgggagagtttcgacgtcacccctgctgtcatgcggtggacagcccagggacacgcaaaccacggattcgtcgtcgaagtggcccacctggaagagaagcagggagtctccaaacgccacgtacggataagtcggtccctgcaccaagacgagcacagctggtcgcagattaggccacttctagtaacctttggccacgacggaaaaggacatcctcttcataagcgggagaaaaggcaggctaagcacaagcagagaaagcggttaaaaagctcctgcaaacggcatccactctacgtcgatttttctgatgtgggatggaacgattggattgttgctcccccaggataccacgccttctactgtcatggagaatgcccatttccactcgccgatcacctcaacagcactaatcatgcaatcgtccaaacactggtaaactcggtgaactcaaaaattccaaaggcatgttgtgtgcccactgaactatcagcaataagcatgctctatctggacgagaatgagaaggtcgtgttgaaaaattatcaggatatggtagtggaaggatgtgggtgcagg

SEQ ID NO: 7916 - DNA, 1188 bp, Artificial Sequence
  Description of Artificial Sequence: Synthetic coding sequence
atggtagcaggcactcggtgcctcctggctctcttgctgccacaggtgctgttgggtggtgccgccggtcttgttccagaactggggcgtcgaaagttcgcggctgccagctccggtcggccctctagccagccaagcgacgaagtgctgtcggagtttgagctgcgactgttgtcaatgttcgggctcaagcagcgtcccacaccttcccgtgatgctgtagtgccaccctatatgctggacctctaccgacggcacagtgggcaaccggggagcccagcgcccgatcatcgacttgagagagctgcttctcgcgccaacacagtgaggagtttccaccacgaggaaagcctggaggaactgccagagacatctgggaagaccactagacggttttttttcaatctaagctccatcccaaccgaggagtttatcacatctgcggagcttcaggtattcagggaacagatgcaggatgctcttgggaacaactcctcattccaccaccgaattaacatttacgagataataaagccggctaccgccaactccaagttccctgtgactcgtttgctggatacccgcctggtgaaccagaacgcctcacggtgggagagcttcgacgtgacacctgcggtgatgagatggaccgcccagggtcatgcaaaccacgggttcgtcgtcgaagtggctcacctggaagaaaaacagggggtctctaaacgccatgtccggatatctagaagtctccaccaggacgagcattcctggagccagatccgacctctcctcgtcactttcggccacgacggaaaaggacatccgctgcataagcgggagaaaaggcaagccaagcacaagcagcgcaaaagactgaaatctagctgcaaaagacacccactgtatgtcgatttttccgacgtgggctggaacgactggattgttgctccccccgggtatcatgccttctattgtcacggcgagtgtccgttcccgctcgccgaccacctgaactcaacgaatcatgcgattgtgcagaccctggtgaacagcgtgaattctaaaatccccaaggcgtgttgcgtgccgacggagcttagcgccataagcatgttgtatctggatgaaaatgaaaaggtggttttgaagaactaccaagatatggtggtggaaggctgcggatgccgt

SEQ ID NO: 7917 - DNA, 1188 bp, Artificial Sequence
  Description of Artificial Sequence: Synthetic coding sequence
atggttgccggaacgcggtgtctcctggcgctcctgttgccccaagtgctgctgggaggcgcggctggcctcgttcccgagctcggccgccgcaaattcgctgcggcatccagtggccgccctagcagccagccgtcggatgaggtcctgagcgaattcgaactccgtctgctgagtatgttcggtctgaagcagaggcctactccttcccgagatgctgttgtccctccctacatgctcgatctgtaccgccgtcactccggccagccgggcagccctgcgcccgatcaccgtctcgaacgagccgcttcgcgggccaacaccgtacgtagtttccatcatgaagagagcctggaggagctccccgaaacgtccggcaagacgacccggcgcttcttttttaatctttcctctatccctaccgaggagttcatcaccagcgccgagctccaggtgtttagagaacagatgcaagacgctcttggcaacaactcatcgttccatcaccggattaacatctacgaaattatcaagccagccaccgccaactctaagtttcccgtcactcgcttgctggatacgcgccttgtaaaccagaacgcttcccggtgggagtctttcgacgtcacccctgcagttatgcgctggactgcccaaggacacgccaaccacggcttcgtcgtggaggtcgcccaccttgaggaaaagcagggagtctcaaagcgccacgtgcgtatttcccgtagccttcaccaagatgagcatagctggtctcaaatccgtccacttcttgtgactttcggccatgacggcaagggtcaccctctccataagcgtgagaagcgacaagctaagcacaagcaacgcaaacgcctgaagtcgtcttgcaaaaggcaccccctgtacgtggacttcagtgatgttggctggaatgactggattgtcgctcctcctggttaccatgccttctattgccatggcgagtgcccgttccctcttgctgatcacctcaacagtacgaaccacgccatcgttcagacgctggtgaattcggtcaacagtaagattcccaaggcttgctgcgtccccaccgagctgtctgctatcagcatgctttacctggacgagaatgaaaaggtggtgctgaagaactaccaagacatggtcgtcgagggttgcggttgccga

SEQ ID NO: 7918 - DNA, 1188 bp, Artificial Sequence
  Description of Artificial Sequence: Synthetic coding sequence
atggtggccggaacccgatgcctgttggctttgctattgccacaggtgctgctaggcggtgctgcgggcctggttcctgagctgggccgacgaaaattcgcggcagcctcgtccggacgcccttcgagccagcccagcgacgaggtattgtctgagttcgagttgcgattgctgagtatgttcggccttaaacagcggccaactccaagcagggacgccgttgtgcctccgtacatgttagatctgtacaggcgccattcgggacaacctggctcgccagcccccgaccaccgactggagagggctgcaagccgcgctaataccgtacgttccttccaccacgaggagtcgctggaggaattgcccgagacgagtggaaagaccacgcgcagattcttctttaatctaagctcgattcctaccgaagagttcatcacgtcggcggaattgcaggttttcagggagcaaatgcaggacgcactgggcaataactcgtccttccaccacagaatcaacatctatgagatcatcaaaccagctacggccaattccaagttccccgtgactcggctgctggatacgcgcctggtaaaccagaacgcatccaggtgggagagcttcgatgtcacccccgccgtgatgcgctggactgcacagggccatgctaaccatggcttcgtggtggaagtggcgcacctcgaggagaagcagggggtctccaagagacacgtgcgtatcagtcgttcgctacaccaagatgagcatagctggagtcaaattcgccccttgcttgtcaccttcggccatgatgggaaaggccatccgcttcataagcgtgagaagcgccaggcgaagcacaagcaacgaaaacgccttaaatcttcttgcaagcggcacccgttatacgtcgatttcagtgacgttgggtggaacgattggatagttgccccccccggttatcatgccttctactgccatggagaatgccctttcccgctggcggaccacctgaactcgactaaccacgccatcgtgcagacgcttgtgaattcagttaattcaaagatccctaaggcctgttgcgttccgaccgagttgagtgccatctccatgctctacttggacgagaatgagaaggtggtgcttaagaactaccaggatatggtagtcgagggctgcggttgtcga

SEQ ID NO: 7919 - DNA, 1188 bp, Artificial Sequence
  Description of Artificial Sequence: Synthetic coding sequence
atggtcgcgggcacccgttgcctgctcgcccttctcctacctcaggtgctgctcggtggcgccgcgggcttagtgcctgaactcgggcgaaggaagttcgccgccgcttcgagtgggcgaccaagctcacagccttctgacgaggtgctaagcgagtttgagcttagattgctttcgatgtttggtctgaaacagcgcccaactccgagcagagatgctgtggtacccccctatatgctggacttatatcgaagacattccggacagcccgggtccccggcacccgaccaccgtctagaacgagcagcaagccgcgccaataccgtacgcagctttcatcacgaggagtcattggaagaactgcccgaaacaagtgggaagactactaggaggtttttcttcaatctgagctctatcccgacggaagagtttattacgagtgctgaattacaggtgttccgggagcaaatgcaggatgcacttggcaataattctagcttccaccaccgaattaacatctatgagatcattaaaccagctacagctaatagtaagttccctgtgacgcggctcctggacacacggttggtgaaccagaatgcgtcaaggtgggagagttttgacgtgacgccagctgtgatgaggtggaccgcacagggccacgctaatcacggctttgtcgtggaggtggctcacttggaagagaagcagggtgtgagcaaacgacacgttaggatttctaggtccctacatcaggacgaacactcttggtcacagatcaggccactcttggttacgttcgggcacgatggcaaagggcaccccctgcataagagggaaaaaagacaagccaaacacaaacagcgcaagaggctcaaaagctcctgtaaacgccatcctctttatgtggacttctctgacgtcggatggaatgattggatagtcgcccctccgggttaccacgcattctactgtcacggagagtgccccttcccgctggctgaccacctgaatagtactaatcacgctatcgtacagaccttggtgaactccgttaattcgaagatcccaaaggcatgctgcgttcccacggaattaagcgccatctccatgctctacctggacgagaatgaaaaagtggtcctcaagaactaccaggacatggtcgttgaggggtgtggttgccgc

SEQ ID NO: 7920 - DNA, 1188 bp, Artificial Sequence
  Description of Artificial Sequence: Synthetic coding sequence
atggtcgctggaactcggtgtctcctggcccttcttttgcctcaggtgctcctgggcggggcagcgggacttgtgcccgagcttggcaggagaaagtttgcggcagcctcttcgggccgcccctcaagccagccttcagatgaagtgctttcggaatttgaactgagattgctttctatgttcggtcttaagcaaagaccaaccccatctcgtgatgccgtcgttccaccttacatgcttgatctctaccgtagacacagcggtcaaccagggtcgcctgccccggatcatcgccttgaacgcgccgcaagcagagcgaataccgttcgttcctttcatcatgaagaaagcctcgaagagctccctgaaacttcaggaaagactacgcgacggttctttttcaatctttcatcaattccaacggaagagttcatcactagcgcagagcttcaggtgttcagagaacaaatgcaagacgcactgggaaacaactcgagctttcatcaccgaattaacatttacgagatcatcaagcctgcaaccgccaactcaaaattcccggtcaccaggctcctggatactcggctggtcaatcagaatgcttcgcgatgggaatcgttcgatgtgaccccagcagtcatgcgctggaccgcacaagggcacgctaaccacggctttgtggtggaagtggcacatttggaagagaaacaaggagtgtcaaaacgccatgtcagaatatcccggtcactgcatcaagacgagcattcctggagccagattcggcccctgcttgtgacctttggccacgatgggaagggacatcctctccacaagcgtgaaaagaggcaagcaaagcataagcaacggaagagactgaaaagcagctgcaaaagacaccctctttacgtcgacttttctgatgtgggatggaacgactggattgtggcaccgccaggataccatgcattctactgtcacggagagtgcccatttcctcttgcggatcatttgaactcgactaatcatgcaattgtgcagactctggtgaactcagtcaacagcaagatcccgaaggcatgctgtgtcccaaccgagctgtcggcgatctcaatgctgtacttggacgagaacgaaaaagtggttcttaagaattatcaagatatggtggttgagggttgtggatgtcgg

SEQ ID NO: 7921 - DNA, 1293 bp, Artificial Sequence
  Description of Artificial Sequence: Synthetic coding sequence
atgcatgtgcggagcctgcgggcagcggccccacacagctttgtcgcattgtgggctcccctgtttctactgcggtcagcgcttgcagattttagcctagacaacgaagtccattcctcattcatccaccgcaggctgaggtcacaagagcgacgagaaatgcaaagagaaattctctccattctcggactgccccaccgcccccgcccacacttgcagggaaagcataacagtgctccaatgttcatgcttgacctgtacaacgcgatggccgtggaagaaggaggtggaccaggcggccagggttttagttatccgtacaaggccgtcttctctacgcagggacctccgctcgcaagcctccaggacagtcattttctgaccgatgcagacatggttatgtcattcgtaaatctggtggagcacgataaagaattcttccatccgagataccatcaccgggaattccgattcgacctctccaagattcccgaaggagaggccgtgactgccgcggagttccggatttataaggactatattcgcgaacgatttgacaacgaaacctttcgtatcagtgtgtatcaggtactccaggaacacctggggcgcgagtcagacttatttctattggatagcaggactctgtgggcaagcgaagagggctggttggtgttcgacattaccgcgaccagtaaccactgggtagtgaatcctagacacaacttgggccttcagctaagcgtcgaaacccttgacggacaaagtattaacccaaagctggcgggcctcattggcaggcacgggccacagaataagcagcctttcatggtggctttctttaaggctacagaggttcattttaggtctattcgcagtacgggttccaaacagagaagtcagaaccggtccaaaacacctaagaaccaggaggcactgcgaatggcaaacgtcgccgaaaactctagctctgatcagaggcaagcctgcaagaagcatgagctgtacgtaagttttagagacctgggttggcaggattggatcatagccccagaggggtacgctgcctattactgtgagggagagtgcgcattcccactgaattcttatatgaatgctacgaaccacgcgatagtgcagaccctcgtgcatttcatcaacccagagacggtgccaaagccttgttgcgccccaacccaactgaatgctataagtgtgctgtatttcgatgacagttcgaatgtcatattgaagaaataccggaacatggtggtaagagcctgcgggtgtcac

SEQ ID NO: 7922 - DNA, 1293 bp, Artificial Sequence
  Description of Artificial Sequence: Synthetic coding sequence
atgcatgtccgttcattaagagccgccgcacctcactcatttgtggcactgtgggcccccctctttctgctgcggtctgcacttgctgacttttccttagacaatgaggtccactccagctttatccaccgaagactccgatcccaagaacggcgcgagatgcagagggaaatactcagcattcttggactgcctcacagaccacggccgcacctccagggcaagcacaactccgcccccatgtttatgctggatctgtacaacgctatggccgtcgaggagggaggagggcccggtggtcagggattttcttatccttacaaagctgttttctccacccaagggccgccgctagcctcgctgcaggattctcactttttgaccgatgccgacatggttatgtcttttgtcaatttggtggagcacgacaaggaattttttcatccacgataccaccaccgtgagttccggttcgatttgtcaaagatccctgaaggcgaggctgtaacagccgccgagtttcggatatacaaggactacatccgagaaaggttcgataacgaaactttccgcatttctgtgtatcaggtgctgcaggagcacttggggcgcgagtccgacctgttcctgttagacagtcggactctgtgggcttctgaggaggggtggctggtgttcgacatcaccgccactagcaatcattgggttgtcaatccgcggcataacctcggattgcaactgagtgtggaaactctagacggacagagtattaaccccaagctagctgggctcatcgggagacacggcccacagaacaaacaaccttttatggtggcatttttcaaggccaccgaggtgcatttcaggtccattcgttccaccggcagtaaacagcgatcccaaaatcgcagcaaaaccccgaaaaatcaagaggcgctgcggatggccaatgttgctgaaaattcatctagcgaccaacgccaagcgtgtaagaaacacgagctgtacgtgagttttcgtgacctcggctggcaggattggattatcgcacctgagggctacgccgcctactactgcgaaggcgagtgtgctttcccgctaaactcgtatatgaacgccacaaaccacgcaattgtgcagactctggttcactttatcaaccccgagacagtgccaaagccttgctgtgctcccacgcagctgaatgctatttctgtcctttacttcgatgattcaagcaacgtcatccttaagaagtatagaaatatggtggtgcgggcgtgcggctgccac

SEQ ID NO: 7923 - DNA, 1293 bp, Artificial Sequence
  Description of Artificial Sequence: Synthetic coding sequence
atgcatgtgaggagcctgcgtgctgcggcccctcatagctttgtcgccctgtgggcccctctttttctgttgagatccgctttggctgacttctctctagacaacgaggtgcacagttctttcatccacagaagactaagatcacaggagcgaagggagatgcaaagggaaatcttgtctattctcggactgccacacagacccagaccccacctgcagggtaagcacaattccgcccccatgttcatgctcgatctctataatgctatggcagtggaagaaggaggtgggcctggcggacagggcttctcttacccttataaggcagtattttcgacccagggtccccccctcgcgagccttcaggactctcactttctgactgacgccgacatggtcatgtcttttgtgaatctagtggaacacgacaaagagttcttccatcccagatatcaccatagagaatttcgattcgatctctcaaagatcccggagggcgaagccgtcactgcggccgagtttagaatttacaaggattatattcgggagcgattcgataacgaaacatttcgtatctccgtttaccaggtccttcaggagcatttaggacgggagagcgaccttttcttgctggacagcagaaccctttgggcctctgaggaaggatggttggtgtttgacattacagcgacgtcgaaccactgggtggttaacccaagacacaacctgggcctccagctcagtgtcgagaccctggacggccagagcattaatccgaagctcgctggcctcatcgggaggcacgggccccaaaataagcagccttttatggtcgcgttcttcaaagctaccgaggtgcactttcgaagtatcaggtccacggggtccaagcaaagatctcagaacaggtccaagacaccaaaaaatcaggaggccttgcggatggcgaacgtggctgagaactcctcttccgatcagcgacaggcctgtaagaaacatgaactgtacgtgtcattccgagacctgggatggcaggactggatcattgcaccggagggatatgcagcgtattattgcgaaggagagtgcgccttccctttgaacagctatatgaacgccacaaaccacgctattgtgcagacactcgtccactttattaatcccgagaccgtacctaagccatgttgtgcgccaacgcaattaaacgccatctcagtgctctatttcgatgattcatcaaacgtgatcttgaagaagtacaggaatatggtggtgcgagcatgtggctgccat

SEQ ID NO: 7924 - DNA, 1293 bp, Artificial Sequence
  Description of Artificial Sequence: Synthetic coding sequence
atgcacgtccgttcactgcgcgctgcggccccgcattcttttgtggcactgtgggccccgctttttctgctgaggtccgccttggcagatttcagcctggataacgaagtgcacagctctttcattcaccgccgcctgcgatctcaggaacggcgtgagatgcagcgcgagatcctgagcatcctaggccttccacaccgcccgcgcccgcatttgcaaggtaaacataatagcgccccgatgtttatgctcgatttgtacaacgctatggctgtcgaggagggtggtgggccgggaggccaagggttttcctacccatataaggccgtgttctctacccagggaccgccactggcaagcttgcaggatagccacttcctcacggacgccgatatggtgatgtcttttgtaaatctggttgagcacgataaagagttcttccacccacgttaccaccaccgcgagtttcgatttgacctgtccaagatccctgagggggaggcagtgacggccgctgaatttaggatctataaggattacatccgcgaaaggtttgataacgaaacgttccgcatctccgtctatcaggtcctccaggaacacctgggcagagaaagcgacctttttctgctggacagccggacactgtgggctagcgaagagggctggctggtgttcgatattacggcaacgtccaatcattgggtggtcaacccgcgccacaacttggggctgcaactgtccgtggaaaccctggatggtcagtccattaacccaaaactggctggcctgatcgggaggcatgggcctcagaacaagcagccgttcatggtggcgtttttcaaagccaccgaggtgcactttcgctccatccgatcaactgggtcaaaacagcggtctcaaaaccgctctaagaccccaaaaaaccaagaggctctgcgcatggcaaacgttgccgagaactctagcagcgatcaacgccaggcatgcaagaagcatgagctgtatgtgagctttcgggatctcggctggcaggactggattatagctcccgagggttatgccgcatattattgcgaaggtgagtgcgcctttcccctgaattcctacatgaatgcaaccaatcacgcaatcgtgcagacacttgttcactttattaacccggaaacggtgccgaagccgtgttgtgcgccaactcagctgaacgctatttccgtgctgtacttcgatgattccagcaatgtgattttgaaaaagtaccggaatatggtggtgagagcctgtggttgtcac

SEQ ID NO: 7925 - DNA, 1293 bp, Artificial Sequence
  Description of Artificial Sequence: Synthetic coding sequence
atgcacgtgcggtctctcagagcggctgcaccccactccttcgtggctctctgggcaccccttttcctattaaggtcggcattggctgatttttcattggataatgaagttcactccagctttatccacaggcggctgcgtagtcaagaacggcgggaaatgcagcgagaaattttgtctatcctgggactgcctcacaggcctaggccacacctccaaggcaagcacaactcggcacctatgtttatgctagatctctataacgcaatggccgtagaagagggcggcgggcccggaggacaaggattctcgtacccttataaagccgtcttctccacccagggaccacccctcgcttctcttcaggactctcatttcctaactgatgccgacatggtcatgagcttcgtcaatctggtggaacatgacaaagagttcttccatcccagatatcatcaccgagagttccgcttcgacctgtccaagattcctgaaggcgaagctgtgacagccgcagaattcagaatctataaggattacatacgggagaggtttgacaacgagaccttccgaatcagcgtgtaccaagttcttcaggaacacctggggcgggagtcagacctttttctgctcgactcacgcaccctatgggcgtcggaggaaggctggctggtattcgacatcacagccacatctaatcattgggtggtcaaccccaggcacaatttaggtcttcagttgagcgttgaaactttggatggccagagcattaatcctaaactagcgggactaatcgggcgacatgggccacagaataagcagcccttcatggttgctttcttcaaagcaactgaggtccacttccggtctatccgctcaaccggaagtaaacaacgttcccagaacagatcaaagacgccaaaaaatcaggaggccctccggatggctaatgtggccgagaattccagttctgatcagagacaagcgtgcaaaaaacatgaactgtatgtgagctttagagacctgggttggcaggattggatcattgctcccgagggatatgccgcctactactgcgagggagaatgcgcctttccgttgaattcctatatgaatgccaccaatcacgctattgtccagaccctggtgcactttataaaccccgaaacagtgccaaagccgtgttgtgctcctacacagttgaatgcaatcagcgtcctgtacttcgatgacagttctaacgtgatattgaaaaaataccggaacatggtggtcagggcttgcgggtgtcat

SEQ ID NO: 7926 - DNA, 1293 bp, Artificial Sequence
  Description of Artificial Sequence: Synthetic coding sequence
atgcatgtccggtcactgagggctgccgccccgcattcttttgtggcgctttgggcgccactcttcctccttagaagtgccctggcggacttcagcctggataatgaggtgcactcttccttcatccacaggaggctgcggtcgcaagagcgcagagagatgcaacgggaaatcctctcaatccttgggctgccgcacagaccgcggccccatctgcaagggaagcataatagtgcccccatgttcatgctggacctgtacaacgcaatggccgtggaagaagggggaggcccgggaggacagggattctcgtatccgtacaaagcagtcttttccacccaagggccgcccctcgcctccctgcaggatagccatttcctgaccgacgccgatatggtgatgagcttcgtcaacctggtggagcatgacaaagaattcttccacccacgttaccaccaccgagaattcagattcgacctcagcaagatcccagaaggtgaggccgtgacggcagcagaatttcgaatctacaaggattacatcagagaacgcttcgacaatgaaaccttccgcatctctgtttaccaagtcctccaggaacatttgggccgagagtcggatctgtttttgctcgacagtcggacgctttgggcctcggaggaaggttggctggtgtttgacattactgctacctcgaaccactgggtagtgaacccacgccataacctcggactccagctctcggtggagacgctcgacggacaatccatcaatcctaagctggcaggattgatcggacggcacggtccgcagaacaagcagccgttcatggtcgcgttcttcaaggcgactgaggtccactttcgctcgattcgcagcactggctctaaacagcgctcccagaatcggagcaaaaccccgaagaaccaggaggctctgcgcatggccaacgtggcggaaaactcgtcctcggatcagagacaagcctgtaagaagcacgaactttacgtgtccttccgggacctgggttggcaggactggatcatagctccagaagggtacgcggcatactattgcgaaggagagtgcgcctttccgctgaactcgtacatgaacgcaaccaatcacgcgatcgtgcagactctggtccacttcataaacccagagactgtgcctaaaccttgttgcgctcctacccaactgaacgcgatttccgtgctgtactttgatgattcctcaaatgtcatccttaagaagtaccgcaacatggttgtccgggcctgcggatgccat

SEQ ID NO: 7927 - DNA, 1293 bp, Artificial Sequence
  Description of Artificial Sequence: Synthetic coding sequence
atgcacgtgcgctcacttcgggcagccgcacctcatagcttcgtggccttgtgggcacctctctttctgctgagaagcgcccttgctgatttttcgctggataatgaagtccatagcagctttatccacaggcgactgaggtcgcaggagcggcgtgagatgcaacgcgagattctcagcattcttggcctgcctcatagaccacgtccacacttgcaaggtaagcataactccgcccctatgtttatgttggatctttacaacgcaatggcggtcgaagagggtggtgggcctggcggacagggtttttcgtacccctacaaggccgtgttttcaactcagggaccgcctcttgcgagcctccaggactcgcactttctcaccgatgccgatatggtgatgtcttttgtcaatctcgtggaacacgataaagagtttttccatcctagataccatcacagagaattccggtttgatctttcaaagatcccagaaggtgaagccgtcactgcagcagaatttcgcatatacaaggactatattcgcgaaaggtttgataacgaaactttcagaatctccgtttatcaggtcctgcaagagcacctgggccgagagtcagatctttttcttcttgattccaggaccctgtgggcatccgaagaaggatggctcgtgtttgatattactgcaacgtccaaccattgggttgttaatcctcgacacaacctcggtttgcaacttagcgtcgaaactctggatggccaatccattaaccccaagctggccggactgattggccgccacgggcctcagaacaagcagccattcatggtggcttttttcaaggcaactgaagtgcatttccgttccatcagatcgaccggtagcaagcagagatcgcagaaccgcagtaaaacccctaagaatcaggaagcgcttcgaatggcaaacgtggcagaaaactcctcctcggatcaaagacaagcgtgcaagaagcatgaactttacgtctcgtttagagatctgggatggcaagattggatcattgcgccagagggatacgccgcatactactgtgagggagagtgcgccttcccgttgaacagctacatgaacgcgactaatcatgcaattgtgcagactctggtccactttatcaatccagaaacggtgcccaagccttgttgcgcaccgacccaacttaatgcaatttcggtgctctacttcgatgattctagcaacgtgatcctgaagaagtaccggaacatggtggtgagggcatgtggttgtcat

SEQ ID NO: 7928 - DNA, 1293 bp, Artificial Sequence
  Description of Artificial Sequence: Synthetic coding sequence
atgcacgtgcggtccctgcgcgccgccgccccgcattctttcgtcgccctttgggcccctctgttcctcctgagatcggcactcgctgacttttcgctggacaatgaggtccactcatcattcatccataggaggcttcgctcccaggagcggcgcgagatgcagagagagatcctgtcaatcctgggtctgccccatcgacctcgcccgcacctgcaagggaagcacaattccgcaccgatgtttatgctcgatctgtacaacgcgatggctgtggaggaggggggcggcccaggaggccaaggattcagctacccatacaaggcagtgttttcgacccagggcccgccgctcgcgtcactgcaggattcacattttctgactgacgcggacatggtcatgtccttcgtgaaccttgtggagcacgataaagagtttttccacccgagataccatcaccgcgagtttaggttcgacctgagcaagatcccggagggagaagcggtcaccgcggccgaattccgcatctacaaggactacattcgggagcgcttcgacaatgaaacctttagaatctccgtgtaccaggtgctccaggaacaccttggccgtgaatcagatctcttcctcctcgacagccgcaccttgtgggcttccgaagagggatggctggtgtttgacatcaccgcgacctctaaccattgggtggtgaatcccagacacaaccttgggctccaattgagtgtggaaaccctggatggacaaagcatcaaccctaagctggcgggtctgatcggacgccatggaccgcagaataagcagccattcatggtggccttcttcaaggctactgaggtgcatttccgctccatcagatcgacgggatccaagcagcgctcacagaatcgctcgaaaactccgaagaatcaggaggccctgagaatggcaaatgtcgcagagaactcttcctctgatcagcgccaggcctgcaagaagcatgaactgtacgtgtccttccgcgacctgggttggcaggactggatcatcgcccccgagggatacgcggcctactactgcgaaggcgaatgcgccttcccgctgaatagctacatgaatgcgaccaatcacgcaatcgtccagactctcgtgcatttcatcaacccggaaaccgtcccaaagccttgctgcgctccgactcaactcaacgcgatatcagttctctacttcgatgacagctcaaacgtgatcttgaagaagtaccggaacatggtggtcagagcctgcggctgccac

SEQ ID NO: 7929 - DNA, 1293 bp, Artificial Sequence
  Description of Artificial Sequence: Synthetic coding sequence
atgcacgtgcgaagcttgagggcagccgccccccatagtttcgtggctctctgggcccccctgttcctgctccgctctgccttagctgacttctcgctagataatgaagtgcattcttcattcatccacagacgcctccggagccaagagagacgcgaaatgcaaagggaaatcctgtcaatcttgggattgccacatcgaccgcggccacacctgcaagggaaacataatagcgcaccgatgtttatgctggacctgtataatgccatggccgtcgaggaaggggggggccctgggggccagggattcagttacccgtacaaagccgtcttcagcactcaggggcctccactcgcatctttacaggatagtcatttcctgacggatgccgacatggttatgagcttcgtgaacttggtggagcatgacaaagaattcttccaccctcggtaccaccatcgggagttccggtttgatctgtccaagatccctgagggcgaggccgtaacagccgctgaattccgtatatataaggactatatccgggaacggtttgataatgagactttcaggatttctgtttatcaggtcctccaggagcatctcgggagggaatcagacctgttcttgctagattcgcggaccctgtgggcgagtgaagaaggctggctggtgttcgacatcactgccacgagtaaccattgggttgtcaaccctaggcataacctggggctccaactgagcgtggagactctggacggtcagtccattaatcccaagctcgccggtctcattggccggcacgggccccaaaacaaacagcctttcatggtagctttctttaaggcaaccgaggtgcatttccgctccattcgctccaccggatcgaagcagcgtagccagaatagatcaaagacaccaaagaaccaggaggcccttcgaatggcaaatgtggcggaaaattcatcaagcgatcagagacaggcctgcaagaagcacgaattgtacgtcagcttccgtgatctggggtggcaagattggatcatcgccccagagggctacgctgcctactactgcgaaggggagtgtgctttccctctgaacagttatatgaatgcaacaaaccatgcaattgtgcaaacacttgtccacttcatcaatcctgagaccgtcccaaagccctgttgcgccccaacgcagttaaatgccatctcggtgttgtacttcgacgacagcagcaatgtaatactgaaaaaatatcgcaacatggtggtcagagcctgcggttgccac

SEQ ID NO: 7930 - DNA, 1293 bp, Artificial Sequence
  Description of Artificial Sequence: Synthetic coding sequence
atgcacgtgcgctcgctgcgggccgcggcgccgcactctttcgtggccctgtgggccccattgttccttctgcggtccgcacttgccgatttctccctggacaacgaggtgcattccagcttcatccatcgccggcttaggtcgcaggagaggcgagaaatgcagagggaaatcctgagcatcctgggactccctcacagaccacgcccgcacttgcagggcaagcacaactcagcaccgatgttcatgctcgatctgtacaatgccatggctgtggaggaaggaggaggacctgggggccaaggtttttcctacccatacaaggccgtgttctcaacccagggaccccctctggccagcctgcaggactcccacttcttgaccgatgccgatatggtgatgtccttcgtgaacctggtcgagcacgacaaggagttcttccacccgcggtaccaccatagggaatttcggttcgacctgtcgaagataccggagggagaagctgtaaccgcggcagagttccgcatttacaaggattacattcgggagagattcgacaatgaaactttccggatctcggtgtatcaagtgctgcaggagcacttgggcagggagtcggacctgttcctcctggattcacggacgctttgggcctctgaggaaggatggctggtctttgatatcaccgctaccagtaaccattgggtggtcaatccaagacacaacctcggcctccaactgtcggtggaaacccttgatgggcagtcgatcaaccccaaactggcgggtctgatcggccggcacggcccgcagaataaacagcctttcatggtggcattcttcaaggccaccgaagtccactttcgctcgatcagatcgactgggagcaagcagagaagccagaatcgcagcaaaacgccgaaaaaccaagaagctcttagaatggccaatgtcgcagaaaatagctcgtccgatcagcgccaggcctgtaagaagcatgaactgtacgtcagcttccgggacctcggctggcaggactggatcatcgcgccagagggatacgctgcttactactgcgaaggagaatgtgcgtttccactcaacagctacatgaatgctacgaaccacgccatcgtccaaaccttggtgcactttatcaatccggaaacggtgccaaaaccatgctgtgcccctactcaactgaatgcgatcagcgtgctttactttgacgattcttcgaacgtcatccttaagaagtaccgaaacatggtggtgcgggcgtgcggctgccac

SEQ ID NO: 7931 - DNA, 1293 bp, Artificial Sequence
  Description of Artificial Sequence: Synthetic coding sequence
atgcatgtccgatctctgagagcggcagcaccacattcctttgtcgcactctgggcacctctgtttcttctccgatccgccctggcagactttagtctggacaatgaggtgcactctagtttcattcatcgaaggctccgcagccaagagaggagagagatgcaaagagagattttgtcaatacttgggcttccccatagaccccgaccgcacttgcaaggaaagcataattcagctccgatgtttatgcttgatctttacaatgcaatggcagtggaagaaggaggagggccaggtggtcagggcttctcctacccctataaagcagtgttctcgactcaaggacctcctctcgcgtcactgcaggactcccatttcctcacggatgccgacatggtgatgtcatttgtgaaccttgttgagcatgacaaggagtttttccatccgaggtaccaccaccgagagtttcggttcgatctttccaagatccccgagggcgaagccgtcaccgcagcagaattccgtatttacaaggattacatccgcgaacggttcgataatgaaaccttcagaatctcagtctaccaggtgcttcaggaacacctcggcagagagtccgacctgtttctgctggactcgaggaccctgtgggcgagcgaagagggatggttggtttttgacataactgccacctccaatcactgggtcgtgaacccgagacataacctgggtttgcagctttccgtggagacgttggatggccaatcgataaaccctaagctggccggactgattggcagacatggtcctcaaaacaagcaaccctttatggtcgcatttttcaaggccaccgaagtgcatttccggtcgattagatccactgggtccaaacaaagatcccagaaccggagcaagaccccaaaaaaccaagaagcactgcgaatggcaaatgtggccgaaaattcgtcgtcagatcagagacaggcctgcaaaaagcacgagctctacgtgtcgttccgtgatctcggatggcaggattggattattgcccctgaggggtacgcagcttactactgtgaaggagaatgtgcattccctcttaattcgtacatgaatgccaccaaccatgccattgtgcagactctggtgcatttcataaacccagaaactgtccctaaaccttgctgcgctcctactcagttgaacgctatatccgtcctgtattttgatgacagcagcaatgtgattcttaagaagtacagaaacatggtggtgagggcatgtggctgccat

SEQ ID NO: 7932 - DNA, 1293 bp, Artificial Sequence
  Description of Artificial Sequence: Synthetic coding sequence
atgcacgtgagaagcctccgggcagcagccccccatagcttcgtcgcactctgggcacctcttttcctccttcggtcggctctggcagatttctcccttgacaacgaagtgcattcctcgtttatccatagacgcctcaggtcccaggaacgacgcgaaatgcagcgggaaattctgtccattcttggacttccacatcgtcctcggccacatttgcagggtaaacacaactcagcgccgatgtttatgcttgatctttacaacgcaatggccgtggaagaaggtggcggacctggaggacaagggttcagctacccgtacaaggccgtgttttcgactcagggtcctccattggcatcccttcaagactcccattttcttaccgacgccgatatggtcatgagcttcgtcaacctggttgagcatgataaagagttttttcatccaagataccaccaccgggagtttcgtttcgatctttccaagatccccgaaggtgaggccgtgaccgcagccgaattcagaatatacaaggattacatacgggaacgattcgataacgaaaccttccgcataagcgtctaccaagtcttgcaagaacatttggggcgagaatcagatcttttcctgctggactcccgcaccctttgggccagcgaagaaggttggcttgtgttcgacattacggcaacttcgaatcactgggtggtcaacccaagacacaatctgggactccaactgagcgtggaaactcttgatggacaatcgataaaccccaagctcgccggacttattggtcgacacggcccacaaaacaagcagccttttatggtcgctttctttaaggcgaccgaggtgcactttagatcgattagaagcactggatcaaagcagcgatcacaaaataggtcgaaaactcctaagaatcaggaagcacttcggatggcaaacgtggcggaaaactcctcatccgatcagagacaagcgtgtaagaaacacgaactgtatgtgagcttcagagatctcggatggcaggactggataattgctccagaaggttatgcagcttactactgtgaaggcgaatgtgcattccctcttaacagctacatgaacgcaaccaaccacgccattgtccaaacgctggtgcacttcattaatcccgaaactgtcccaaagccatgctgtgcacccacgcaacttaacgcgatctccgtcctgtactttgacgattcctcaaacgtgattctgaagaaatacagaaacatggtggtgcgcgcatgcgggtgtcac

SEQ ID NO: 7933 - DNA, 1293 bp, Artificial Sequence
  Description of Artificial Sequence: Synthetic coding sequence
atgcatgtacgttcacttagggctgcggcaccacattcttttgtagcattgtgggcaccactttttctacttcgatcagccctcgctgatttttcactggataacgaagtgcactcttcatttatacatagaagacttagatctcaagagcgtcgagaaatgcaacgtgaaatattgagcattcttggattgccacataggccgcgaccgcatttgcaaggcaaacacaattcggcaccaatgtttatgctggatctctataatgcaatggcggtagaggagggaggaggcccaggaggacaaggatttagttatccttataaagcagtcttttcgacgcagggaccaccactggcgagtctccaagattctcattttttaactgatgcagacatggtgatgtcatttgttaatttggtggaacacgataaagaattttttcatccacgatatcatcatcgagagtttagattcgatcttagcaagataccggagggagaagccgttacggctgccgaatttcgaatttataaggattatattcgtgagaggttcgataatgagacgtttcgaatatcagtttaccaagttctccaggagcacttgggaagagagagtgatcttttcctactagattcaagaacactatgggcatcagaagagggctggctggtgtttgatattactgcgacgtctaatcattgggtcgtgaatccgagacataatttaggactccaattaagtgtcgaaacactcgatggacaatccattaatccaaagctcgccggtctcattggacgtcacggaccacagaataaacagccattcatggtcgccttcttcaaagctacggaagttcacttccgatcaattcgttcgacaggatctaagcagcgaagtcaaaatagatccaaaactccgaagaatcaggaggcgttgcgcatggcaaacgtcgcagaaaactctagttcagaccagcgtcaagcatgcaagaaacatgaactgtacgttagctttcgggatttaggctggcaagattggatcattgccccggagggatatgcggcatattactgcgaaggagagtgcgcgtttcctctaaattcatacatgaacgccacaaatcatgcgatagttcaaaccctagtccatttcatcaatcctgagactgtcccaaaaccgtgttgcgctccgactcaactgaatgccatctcagtactttacttcgatgactctagtaatgttatattaaaaaaatatagaaacatggtagttcgtgcatgtggatgccac

SEQ ID NO: 7934 - DNA, 1293 bp, Artificial Sequence
  Description of Artificial Sequence: Synthetic coding sequence
atgcatgttcgatccctgagggctgcagcgccacattcgttcgtggcactctgggcaccgctctttctcctcagatcagcgctggcagacttttcgcttgataacgaggtgcattcatcctttattcatcgtcgcctgaggtcacaggagcgcagagagatgcagagggaaattctgtcaattctgggacttcctcaccgcccacgcccacatctccaagggaagcacaattcagcaccgatgttcatgctcgatctttacaatgcaatggcagtggaagagggaggtggtcccggaggtcagggcttctcctacccttacaaggccgtgttctcgacccaggggccacctcttgcctcgctgcaagattcgcattttctgactgatgcagacatggtcatgtcctttgtgaaccttgtggagcatgataaggaattctttcaccctagataccaccatcgggaatttaggtttgacctttcgaagatacctgagggagaggcggtgaccgcagcagaatttcggatttacaaggattacattagagaacgcttcgacaacgaaacctttagaatttcggtctaccaggtcctgcaagaacaccttggaagagagtcagatctgtttctgttggattcgagaactctttgggcatcggaagaaggctggcttgtctttgacatcacggcaacttccaatcattgggtcgtgaaccccagacacaatctgggattgcaactgtccgtggaaacccttgacgggcagtccattaacccaaagttggcaggactgattggccgccacggaccacagaataagcagccctttatggtggcattctttaaggcgaccgaagtgcattttcgatcaatcagatcgaccggcagcaaacagagatcgcagaatcgtagcaagactccaaagaatcaggaagcactgaggatggcaaacgtcgcagaaaattcctccagcgaccaacgccaggcctgtaagaagcatgaactgtacgtgagtttccgggatctgggttggcaggattggatcatagctccggagggctacgcggcgtactactgcgagggagaatgcgcgtttccacttaattcctacatgaatgcgactaaccacgccatcgtgcagactctggtgcacttcatcaatccagaaaccgtacctaagccatgttgtgctcctactcaactgaatgccatctcagtgctgtacttcgatgactcgtccaacgttattctgaaaaagtatagaaacatggtggtgcgggcatgtgggtgtcat

SEQ ID NO: 7935 - DNA, 1293 bp, Artificial Sequence
  Description of Artificial Sequence: Synthetic coding sequence
atgcacgtcagatctctgagagcggccgcgccgcatagctttgtcgctctttgggcgccgctcttcctgcttcgctctgccctggctgatttttctctcgacaacgaagtccactcatccttcatccaccgcagacttcggtcccaagagcgccgcgaaatgcaacgggaaatcctgtcgatcctcggactgccgcaccgacctcggccccacctccaaggtaagcacaactccgccccgatgttcatgctggacctgtacaacgcgatggcagtcgaggaagggggcggacctggcggtcagggcttttcatacccgtacaaagctgtgtttagcacccagggaccgccactggcctcgctgcaggattcccacttcctcactgatgctgacatggtgatgtcattcgtcaatctcgtggaacacgacaaggaattctttcaccctcgttaccatcatagagaattccgcttcgaccttagcaagatacccgagggagaagccgtcactgccgctgaatttcggatctacaaggattacattagggagcgcttcgacaacgaaacgttcagaatctcggtgtaccaggtgcttcaggagcatctgggacgcgagtccgatctgttcctgcttgactcccgcacgctgtgggcgtcggaggaaggatggctggtgttcgacatcaccgccacgtcgaatcactgggtggtgaacccacggcataacctgggactgcagctgtcggtggaaaccctggacgggcagtctatcaatccaaagctcgcgggactgatcggcagacatggccctcaaaacaaacaaccattcatggtggctttcttcaaggccaccgaagtgcattttcggtctatccggagcactgggtccaagcagaggtcgcagaacaggtcaaagacccctaaaaaccaggaagcgctcagaatggccaacgtggcagagaatagctcgtcggatcagcggcaggcttgcaaaaagcacgagctttacgtttcctttcgcgaccttggatggcaagactggatcattgcaccggaaggctacgcggcatattactgtgaaggggagtgcgccttccctttgaacagctatatgaatgccaccaaccacgctatcgtgcagactttggtgcactttatcaacccagagactgttccgaagccctgctgtgcccctactcaattgaacgcaattagcgtgctctacttcgatgatagctctaatgtcattctcaaaaagtaccggaacatggtggtgcgagcctgcggctgccat

SEQ ID NO: 7936 - DNA, 1293 bp, Artificial Sequence
  Description of Artificial Sequence: Synthetic coding sequence
atgcacgtgcgttccctccgtgctgccgccccccattctttcgtcgctctgtgggctcctcttttcttgctgaggtccgccttggctgacttcagtctcgacaacgaagtccattccagtttcatacatcgccgtctgagatctcaggaacgccgtgaaatgcaacgtgaaattctgtctatcctgggcctgccccatcgtccacgccctcacctccagggaaaacacaacagcgctcccatgttcatgcttgacctttacaatgctatggccgttgaggagggaggaggacccggaggtcagggtttctcctatccatacaaggccgtgttcagcacacagggtccacccctcgctagcctgcaagactcacactttctgactgatgctgatatggtcatgtccttcgtcaacttggtcgaacacgacaaggaattcttccacccaaggtatcatcatagggagtttcgtttcgatttgtccaagatacctgagggagaagccgtcaccgctgccgagttccgcatatataaagactacattagagaacgtttcgacaacgagacattcaggatcagtgtgtatcaggtcctgcaggaacatctgggcagagaaagcgacctgtttctcctcgatagcagaactttgtgggccagcgaagaaggatggctcgtgttcgacatcaccgctacatcaaaccactgggtagtcaaccctcgtcacaacctcggtctgcagctttctgtcgagacactcgacggacagtctatcaaccctaaattggctggactcattggtcgccacggtccacagaacaagcagccattcatggtggctttcttcaaggccacagaggtacattttcgttcaatccgcagtactggttctaaacaacgcagccagaatcgcagcaaaacacctaaaaatcaggaggctctgaggatggccaacgttgccgaaaactcctcttctgaccagaggcaagcttgtaagaaacacgagctctatgttagtttcagagatctgggatggcaggattggatcatcgctcccgagggttatgctgcttactactgcgagggtgagtgcgccttccctctgaatagttacatgaacgctactaatcatgcaatcgttcagaccctggtccatttcataaatcccgaaaccgttcccaagccctgctgtgcccctacacagctcaatgctattagtgtgctctactttgacgacagctccaacgtcattcttaagaaataccgcaatatggtagtgcgtgcatgcggctgtcat

SEQ ID NO: 7937 - DNA, 1293 bp, Artificial Sequence
  Description of Artificial Sequence: Synthetic coding sequence
atgcatgtccgctcgctgcgcgccgcagcgcctcacagctttgtcgccctctgggcacctctttttctgctgaggagcgccctggcagatttttccctcgacaacgaggtgcattcttccttcattcacagaaggctcagatcgcaagaacgaagagagatgcaacgagaaatcctctcgatcctgggactccctcacagacctagaccgcatctgcagggaaagcataacagcgcacctatgttcatgctcgatctctacaacgcaatggcagtggaggaaggaggtgggccaggaggccaaggattttcctacccttacaaggcagtgttcagcacccaaggcccccctctcgcatcgcttcaagatagccacttccttactgatgcagacatggtgatgtcctttgtgaatcttgtggaacacgataaggagtttttccatccacgataccatcatcgggagttcagatttgatctttcaaaaatccctgaaggagaagccgtgaccgctgctgaattccgtatatacaaggattacatccgcgagcgctttgacaatgagacttttcgcattagcgtctaccaagtgctgcaagaacatctgggtagagagtcggaccttttcctgctggattccaggaccttgtgggcaagcgaggaagggtggcttgtgttcgatatcactgcaacttccaaccattgggtcgtcaacccccggcataatcttggcttgcagctttccgtggagacgctcgacggacagagcattaacccgaagttggcgggactgatcggacgacacggaccacagaacaagcagcctttcatggtggcatttttcaaggcaacggaagtccactttaggtccattcgttcaaccggatccaaacaacgctcccagaatagatcgaaaactccgaagaaccaagaggctcttagaatggcaaacgtggcagagaactcctcgtccgatcaacgacaggcttgtaagaaacatgaactgtacgtcagcttccgggaccttggatggcaggattggattatcgcgcccgaaggatacgcggcatactattgtgaaggagagtgtgcctttcctcttaattcatacatgaacgccactaaccacgcaatagtccagactctcgtgcatttcataaaccctgaaactgtcccaaagccttgctgtgcaccaacccaactgaacgcaatctccgtgctttactttgacgactcctccaacgtcatcctgaagaagtaccgaaatatggtcgtgagagcctgtggttgtcac

SEQ ID NO: 7938 - DNA, 1293 bp, Artificial Sequence
  Description of Artificial Sequence: Synthetic coding sequence
atgcatgtgaggagcttgcgggcagcagcgccccactcattcgtggcactgtgggcgcctttgtttttgctccggtcagccctggccgatttctccctcgacaatgaggttcactcctcatttatacatagacgtttacggagtcaggagagacgcgaaatgcagcgcgagatactgtccatccttggactcccacacaggccgcgtccccacctccaagggaagcataactccgctcctatgtttatgctcgatctgtacaacgccatggcagtggaggaaggagggggtcccggagggcagggattctcttatccctataaagctgtgtttagtactcaggggccgcccctcgcgagtctccaagactcccattttttgacagacgctgatatggtaatgagtttcgtgaatctggtcgagcacgacaaggaattcttccacccgcggtatcatcaccgcgagttccgctttgacctgagcaaaatcccggaaggcgaggccgttacagccgctgagttccgtatctataaagactatattagggagcgatttgacaacgaaaccttccgtatttctgtgtatcaggtcctgcaagagcacctgggtagagagtcggacttgttcttactggattcaagaacgctctgggcgtccgaggagggctggctagtattcgatatcacggctactagtaaccattgggttgtgaatccgcggcataacctgggcctgcagctgtctgtggagacattggatggtcagagcatcaatccaaagctagcggggttgatcgggaggcacggaccccagaataaacagccttttatggtagccttttttaaggcgactgaggtccactttcggtctatcaggagcacaggtagcaagcagaggagccagaatagatcaaagacccctaaaaaccaagaagcacttcggatggcgaatgtcgccgaaaattcttccagtgatcaacggcaagcatgcaaaaaacacgagctttacgtcagcttcagagacttggggtggcaggactggatcatcgcccctgaagggtatgctgcctactactgtgagggtgaatgtgctttccctctcaatagctatatgaatgctaccaaccacgctattgtgcaaactctggtgcatttcatcaacccagaaaccgtccctaagccgtgctgcgcccctacccagcttaacgccatctccgttctgtacttcgacgactccagtaacgtaattcttaagaagtacagaaacatggtagtccgagcctgtggttgtcac

SEQ ID NO: 7939 - DNA, 1293 bp, Artificial Sequence
  Description of Artificial Sequence: Synthetic coding sequence
atgcatgtaaggagtcttcgagcggctgctccccactcctttgtcgccctgtgggccccactcttcctactgcggagcgccttggctgatttctcattggacaacgaagtgcactcctcattcatccataggaggcttcgaagtcaagagcgccgagagatgcagagagagatcctgtctatcctggggctgcctcatcggccaaggccgcatctgcagggcaaacataactcagcccccatgtttatgctggatctgtataacgctatggctgtggaagagggaggcggcccaggggggcaagggttttcttacccatacaaagcagtgtttagcactcagggccccccgcttgcctctctacaggattctcattttctaacagatgccgatatggtcatgagctttgtgaacctggtcgagcacgacaaggaattcttccaccctagataccaccaccgcgagttccggttcgatctttctaagattccagaaggggaggccgtaaccgcggcggaattcaggatttataaggactatatacgggaacggttcgacaatgaaacatttaggatcagcgtttaccaagtgctccaagagcatctcggacgggagtccgacctgttcctcctggactctcggactctctgggcctccgaagaaggctggctggtttttgacattaccgctaccagtaatcactgggttgtgaatccgcggcacaatctgggactgcaactgagtgttgaaaccctggatgggcaatcaattaacccaaagctggcgggcctgataggccgccacggacctcagaacaagcagcccttcatggtggcgttcttcaaagcaacagaggtccatttccgctcgatcagaagcaccggtagtaaacaacggagtcaaaatcggtctaaaacccctaaaaatcaggaggccttacgcatggccaatgtggctgagaactcttcgtccgatcagcggcaggcatgtaagaaacacgagctgtacgtttcattccgggatctagggtggcaggattggattatcgctccggagggatatgcggcttattattgcgaaggagaatgcgccttccctctaaattcctacatgaacgctaccaaccacgcaattgtccagaccctggtgcacttcatcaatccagaaacggtgccgaagccttgctgtgctccaacacagctaaacgccatcagcgtgctctatttcgatgatagctctaatgtgattctgaaaaaataccggaacatggtggtccgagcttgcggttgtcac

SEQ ID NO: 7940 - DNA, 1293 bp, Artificial Sequence
  Description of Artificial Sequence: Synthetic coding sequence
atgcacgtgcggtccttgcgcgccgctgctcctcattctttcgtggctttgtgggcacctttatttctcctgcggtcggccttggccgacttcagcctagataatgaggtacattcctcctttatacaccgcagactgagatcacaggagcgccgggaaatgcagagggaaattcttagtatactgggactgccacatcggcctcgcccccacttgcagggaaagcacaacagcgcccctatgtttatgctggatctttataacgccatggcggtcgaagaaggcgggggcccggggggccaggggttttcttacccttacaaggcagtattctcgacccagggtccccccctcgcctctctccaggacagccacttcttgacggatgctgatatggtaatgagctttgttaatctcgtggagcatgataaggagttctttcaccctaggtatcatcatagggagttccgcttcgacttatccaaaattcctgagggagaagccgtaactgccgccgagtttaggatttataaggattatatcagagaacgatttgataacgagacgttccggatctctgtttaccaagtactgcaggaacatttggggagagagtctgatctatttctgctggactccagaacgctgtgggccagcgaagaagggtggttggtattcgatattactgcgacaagcaaccactgggttgtcaaccctaggcacaatctcggtctgcaactttccgtggaaacactggacgggcaaagtatcaatcctaaactagcaggccttattggtcgtcatgggccgcagaacaagcagccattcatggtggcatttttcaaggccacagaggtgcactttagaagtattagaagtacagggagcaagcaaagatctcagaacaggagcaagacaccaaaaaaccaagaggccctgcgaatggctaatgtcgcagaaaactcctcctccgatcaacggcaagcctgtaagaaacacgaactgtatgtttcattcagagaccttggatggcaagattggatcatcgcacctgagggttacgcggcatattactgtgaaggcgagtgtgcttttcctctaaactcatatatgaacgccactaatcacgctattgtccagacacttgtccacttcattaatcccgagactgtgcctaaaccttgctgcgcaccaacccagctgaatgcaattagcgtgctgtattttgacgactccagcaatgttattctgaagaagtatcggaacatggttgtgcgggcatgcggttgccac

SEQ ID NO: 7941 - DNA, 1293 bp, Artificial Sequence
  Description of Artificial Sequence: Synthetic coding sequence
atgcatgtacggagcctgcgggctgccgccccacactccttcgttgccctctgggcgcccttgttcctgttgaggagtgccttggccgacttttccctggataacgaggtacactcttcattcatccaccggcgccttcggagtcaggaaaggcgggagatgcagagagaaatcctgagcatactcggcctcccgcacaggcccagaccacaccttcagggcaagcataattctgccccaatgttcatgttggacctgtacaacgctatggctgtagaagaaggtgggggacccggtgggcaaggattcagttacccttataaagccgtattctctactcaggggcctcccctggcaagcttgcaggacagccatttccttaccgacgcagatatggtgatgagtttcgttaatctggtcgagcacgataaggaatttttccaccccagatatcatcatcgcgagtttagattcgatctgtctaagatcccagagggagaggctgtgacagcagcggaattcagaatttacaaggactatattcgggagcgatttgacaacgaaacgtttaggatctctgtgtatcaagttctgcaagaacatttgggacgcgagtccgatctgttcctgctggactctcgcacactgtgggcttccgaagaggggtggctggtctttgatatcacagccactagcaaccactgggtggtgaatccacggcacaatctgggactgcagctctcagtcgaaactttggatggccaaagcatcaatcccaaactggctgggctgattgggcgacacggcccacaaaataagcaacctttcatggtggcttttttcaaagctaccgaggtacattttagaagcatcagatctactggcagtaagcagagatcccaaaacagaagtaaaacccctaagaatcaggaggcattgcggatggccaatgtggcggagaattcatcatccgaccagcggcaggcgtgcaaaaaacacgaattgtatgtgagtttcagggatcttgggtggcaggactggatcattgctccggagggatatgcagcatattattgcgagggggagtgtgcatttcctctgaatagctatatgaatgcaacaaatcatgccattgtacagaccctcgtccattttattaaccctgagacagtgcctaagccttgttgtgctcctacccagctgaacgccatatctgtgctctacttcgacgacagcagcaacgtgatactgaagaaataccgcaatatggtcgtgcgggcctgtggctgtcat

SEQ ID NO: 7942 - DNA, 1293 bp, Artificial Sequence
  Description of Artificial Sequence: Synthetic coding sequence
atgcacgtaagatctttgcgcgccgcagctccacactcttttgtcgcattgtgggccccactcttcctgctgcgctctgccctcgcagatttcagtctagataacgaggtgcactcctcctttatccaccgccgtctcagatcacaagaacggcgggaaatgcagcgcgaaatcctcagtattctgggtctccctcaccgcccgcgtccccacctgcagggtaaacacaattcagcccctatgtttatgctggacctttataatgccatggctgttgaggagggcggtggtccaggagggcaggggttctcctacccttacaaggcggtgttcagcacgcaggggccacccctggccagcctgcaggactcacactttcttaccgatgcagacatggtgatgagtttcgtaaacctggttgagcatgataaagagtttttccaccctcgttaccatcatcgcgagtttaggtttgatctgagcaagatccctgagggggaggctgttaccgccgcggaattccgaatctacaaagattatattcgggaacgatttgataacgaaacctttcggatttctgtctaccaggttctgcaggagcatctgggccgcgaatctgacctgtttctattggattcacgcaccctgtgggcatcagaagaagggtggctggtcttcgatatcactgccacctccaaccactgggtcgtgaatcccagacataatttgggcctgcagctatccgtggagactttggatggccaatcaatcaaccctaagctggcaggtttgatcggtcgccacggaccccaaaataaacagccatttatggtggctttcttcaaagcgacagaagttcactttcgcagcatccggtcgactgggagcaaacagcgctcacagaataggagcaagacccccaaaaaccaggaggctctgcgcatggccaacgttgcggaaaacagtagcagcgatcagaggcaggcatgcaaaaaacatgagctgtacgtgagcttccgcgatttgggatggcaggactggatcattgccccagaggggtatgctgcttactactgcgagggagagtgtgcctttcctttgaacagttacatgaacgctacgaaccacgctattgtacagaccttggttcacttcatcaatccagaaacggttcctaaaccttgttgtgctcccactcaattgaatgcaataagcgtcctatacttcgacgacagctctaacgtgatcttgaagaaatatcggaatatggtagtgcgcgcatgcggctgccat

SEQ ID NO: 7943 - DNA, 1293 bp, Artificial Sequence
  Description of Artificial Sequence: Synthetic coding sequence
atgcacgtgcgctctctgagggctgccgccccacactcattcgttgctctctgggctccgctctttttgctgcggtcagcactggccgatttttcactggacaacgaggtacactcatctttcatccatcgccgcttgcggtctcaggaacggcgcgaaatgcagcgagagatactgagcattctgggactgcctcaccgcccccggcctcatctgcaaggcaagcataacagcgcccccatgttcatgctggacttgtataatgcgatggctgtcgaagaaggcgggggccccgggggccagggtttttcttacccctataaggcggttttttccacacagggcccacctctggcttcactccaggactctcattttctgactgacgctgacatggtgatgagctttgtgaatctcgtggagcatgacaaggagttctttcacccccgctaccaccaccgggagttccgattcgatctttctaaaatccccgagggagaagcagtgaccgcggccgagttccgcatttataaagattatattagggagcgatttgataacgagacatttagaatctccgtataccaggtactccaagagcacctgggcagggagagcgatctgtttctcctggactccagaacactctgggccagcgaagaaggttggctggtgttcgatataaccgctacatcaaaccactgggtggttaatcccagacacaacctcgggcttcagctgtctgtggagacattggacggacagtccattaaccccaagctggcaggcctgatcgggagacacggcccacagaacaagcagccctttatggtggcttttttcaaagctactgaagtacacttcagatcaatcaggtccacgggaagcaaacagcgatcccagaatcggagcaagaccccgaaaaaccaggaggctcttaggatggccaatgtagccgagaattcttcatccgaccagcgacaggcttgtaagaagcacgagctgtatgtctcctttcgcgatctggggtggcaagattggatcatcgcccctgagggatatgccgcctactattgtgagggggagtgcgcattcccactgaactcctacatgaacgctacaaatcatgccatcgtccagacacttgtgcacttcataaaccctgagacagtgccaaaaccctgttgtgcccccacccagctgaacgcaatttcagtcttgtattttgatgatagttccaatgttatcctgaagaagtacagaaacatggtggttagggcctgtggatgccac

SEQ ID NO: 7944 - DNA, 1293 bp, Artificial Sequence
  Description of Artificial Sequence: Synthetic coding sequence
atgcatgttcgatccctgagagcagctgcgccacacagcttcgtcgctctctgggcgccactgttcttgttgcgctccgctctggcagacttctccttagataacgaggtgcattctagctttatccaccgccgactccgttcgcaggagcgacgcgagatgcagagggagattctatccatcttgggtttgccgcaccgcccgcgcccgcaccttcagggcaagcacaattccgcgccgatgttcatgctggatctttacaatgccatggcggtggaagaaggaggaggtccaggcggccagggattcagttatccctataaagctgttttttcgacccagggacccccactggcgagcctacaggattctcactttctgacggacgctgatatggtcatgagcttcgtcaacttggtcgagcatgataaggaatttttccacccgcggtaccaccatcgtgagtttcgcttcgatttgtcgaagattcctgaaggtgaagccgtgaccgccgccgagtttcgcatttacaaggactacattcgtgagcgtttcgataacgagacattcaggataagcgtgtaccaagtgttgcaggaacatttaggccgcgagagcgatttgttcctgctggacagtcgcaccctatgggcatctgaggagggctggctcgtgttcgatatcaccgcaacaagtaaccactgggttgttaatccgcgccataacctaggactgcaactctccgtcgaaacactagacggccagagcattaacccgaagcttgctggcttgataggacgtcacggacctcaaaataagcagcccttcatggttgctttcttcaaggcgacggaggttcatttccgtagtatccgcagtacgggcagcaagcagcgcagccagaaccgctcgaaaacgccaaagaatcaggaagctttgagaatggcgaatgtcgcggaaaatagtagttcagaccagcgccaagcgtgcaagaagcacgaactgtacgtctcattccgggatttgggttggcaggattggatcattgcaccagagggttatgctgcatactattgcgagggagagtgtgcattcccacttaattcctacatgaacgcaaccaatcacgccatcgtccagacgctggtgcacttcatcaatccagagaccgtgcccaagccgtgttgcgcccccactcaactgaacgctatatccgtgctttactttgatgacagctcgaacgttatccttaagaagtatcgaaatatggtggttagggcatgtggctgccac

SEQ ID NO: 7945 - DNA, 1293 bp, Artificial Sequence
  Description of Artificial Sequence: Synthetic coding sequence
atgcatgtgagatctctgcgggctgcagcccctcactcatttgtcgctctctgggcgccattattcctgctgcgtagcgctctggcggatttttcactggataacgaagttcatagttcttttatacacaggaggctgcggtcacaggagaggagggagatgcaaagggaaatattgagcatactcggcctgcctcacaggccgcgcccccatctacagggaaaacacaatagtgccccaatgtttatgttagacctctacaatgccatggccgttgaagaaggaggtggtcctggtgggcagggtttttcatatccctacaaggcagtgttctccactcagggcccccctctcgcttcactccaggactctcattttctgaccgacgcagatatggtcatgtccttcgttaacttggtggaacatgataaagagttctttcatccacgatatcatcaccgcgagttccgattcgacttatccaaaatccctgagggtgaagccgtaacagctgcggagtttagaatttataaagactacatccgagaacggttcgacaacgagaccttccgtatcagcgtctatcaagtgctccaggaacatcttgggcgagagtcagatctcttcctactcgactctcgcacactgtgggcaagtgaggaggggtggctggtttttgatataacagccacaagtaaccactgggtcgtgaacccgcgtcataaccttggactgcaactctctgtcgaaactctggacggtcagtcaatcaaccccaagctggcaggtctaatcggccggcacgggcctcaaaacaaacaaccctttatggtggcttttttcaaggccaccgaagtgcattttaggtccatcaggagcaccgggtccaagcaaaggtctcagaataggtccaaaacccccaaaaatcaagaggctctcaggatggccaacgtcgctgagaacagcagcagtgaccagcgccaggcttgtaagaagcacgagctctacgtctcttttagagacctgggctggcaggactggatcattgcccctgagggatacgccgcatactattgcgaaggtgagtgtgcgtttccactgaattcgtacatgaacgccacaaatcacgcaatcgtgcaaaccctcgtgcattttataaatcctgagactgtgccaaaaccctgttgcgctcctactcaactgaatgccatttctgtgctctattttgacgactcttctaatgtgattctcaaaaaatataggaatatggtcgtcagggcctgcggatgtcat

SEQ ID NO: 7946 - DNA, 1293 bp, Artificial Sequence
  Description of Artificial Sequence: Synthetic coding sequence
atgcatgtgcggtcgctgcgcgctgccgcaccacactccttcgtggcactctgggctccactcttcctccttcgcagcgccctggcggacttcagccttgacaatgaagtccactcctcctttattcatcggcgcctgagatcacaggaacgacgggaaatgcaacgcgagatcctgtcgatcctcggactgccgcacagacctaggccgcatctgcagggtaagcataacagcgcgccgatgttcatgctcgacctgtacaacgccatggctgtcgaagaggggggaggtccgggtggacaaggattctcgtacccttacaaggcagttttctcgactcagggccccccgctggcttcactccaagattcacacttcctgacggatgccgacatggtcatgtcgttcgttaaccttgtggaacatgataaggagtttttccacccgcgctaccaccaccgggagttcagatttgacctgtccaagattccggagggagaagccgtcactgctgcagaatttagaatctacaaagattacatcagggaaagattcgataatgaaactttcagaatctctgtgtaccaagtgctccaggaacatctcggaagagagagcgacctttttcttctcgactcacgcactctgtgggcgtctgaggaaggatggctggtgttcgacatcaccgcaactagcaatcattgggtggtgaatccgagacacaatcttggactccaactgtccgtcgagactttggatggacaaagcatcaacccgaagctggcaggactgatcggccggcacggccctcagaataaacagccgttcatggtggcgttctttaaggccactgaggtccacttccggagcatccgaagtaccggctcaaagcagcgctcacaaaatcgctccaaaacgcctaagaaccaggaggcacttcggatggccaacgtggccgagaacagcagctccgaccagcgacaggcgtgcaaaaagcatgaactgtacgtgagcttccgtgaccttggttggcaagattggatcatcgcccccgaggggtacgcggcgtactattgcgagggagagtgcgcgtttcctctcaactcatacatgaatgcaactaaccacgccatcgtccagactctggtgcacttcatcaaccctgagacggtgcccaagccgtgctgcgcaccaacgcagctgaacgcaatttccgtcctgtacttcgatgacagctccaacgtgatcctcaagaagtaccgcaatatggtggtccgcgcgtgcggctgccat

SEQ ID NO: 7947 - DNA, 1293 bp, Artificial Sequence
  Description of Artificial Sequence: Synthetic coding sequence
atgcacgtccgcagcctacgagccgccgcccctcactcttttgtcgctctgtgggcgccactgtttctgttgagatccgcactggccgatttctctctagacaacgaggtgcacagttcctttatccacagacgactaagatcccaagaacgacgggaaatgcagcgggaaatcctcagtattttgggtctcccacatcgaccaaggccgcacttgcaagggaagcataacagcgccccaatgtttatgctcgatctctataatgcaatggctgtggaggaaggcgggggtcccggcggccaaggtttctcatatccgtacaaggccgttttcagtacacagggccctcctttggcttccctgcaggattctcacttccttaccgacgccgacatggtgatgagctttgtcaatctcgtcgaacacgataaggagttcttccatcctaggtatcatcatagggaatttcgcttcgacctgtctaaaatcccggaaggagaggcagtgactgccgctgagtttcgcatatacaaggattatatacgggaacggttcgataatgaaacatttcgcataagtgtgtaccaggtgctgcaggagcacctgggacgcgagtctgatctgtttctgctagactcacggacactgtgggctagcgaggagggatggcttgtgttcgatattaccgccacttctaaccactgggtggtgaatccacggcataacctcggattgcagctatctgtggaaacactggacggccaaagtatcaacccaaagctcgcgggactcataggcaggcacggtccacaaaataaacagcctttcatggtggcctttttcaaagccacagaggtgcacttccgtagcattcgtagtaccggaagcaagcagaggtcccagaatcgcagtaaaacccccaaaaaccaggaggccttacgaatggcaaacgtcgctgagaattcatccagtgaccagcgtcaggcttgcaagaagcacgaactatacgtctcctttagagacttaggatggcaggactggataatcgcccctgaggggtatgccgcctattattgtgaaggggagtgcgcttttcccttgaactcatatatgaacgctaccaaccacgctattgtgcagaccctggtgcacttcatcaaccccgaaactgttccaaagccttgttgcgcccctacccagctaaacgcgatatccgttctgtactttgatgactcctccaacgtgattctgaaaaagtaccggaacatggttgtccgggcatgtgggtgccac

SEQ ID NO: 7948 - DNA, 1293 bp, Artificial Sequence
  Description of Artificial Sequence: Synthetic coding sequence
atgcatgtgagatctctgagagcagcggcgccgcactcgttcgtggctctctgggcgccactgtttctcctcaggtcggcgctggccgatttcagcctcgataacgaggtgcactcgtcgttcatccatagacggctgcggtcacaagaacggcgcgaaatgcagagggagatcttgtcaattctcggcctccctcatcggcctcgcccacatctgcaaggaaagcataactccgcaccgatgttcatgctcgatctgtacaacgcgatggcggtcgaggaagggggaggaccgggagggcaaggattttcctacccgtacaaagccgtcttctccactcaaggaccgccccttgcgagcctccaggactcccatttcctgaccgacgccgacatggtgatgtcctttgttaacctcgtggaacatgacaaggaattcttccacccacggtaccaccaccgcgagtttcgcttcgacctgtccaagatcccagaaggtgaggccgtgaccgccgccgaatttcggatttacaaggactacatccgggagaggttcgataacgaaaccttcagaatctccgtgtaccaggtgctgcaagagcatctggggcgggaatccgacttgttcctgctggattcacggaccctgtgggcctccgaagagggatggcttgtctttgacatcactgccacctcaaatcactgggtggtgaatccacgccacaatctgggattgcagttgtccgtggaaaccctcgacggacagtccatcaatcctaaactggccgggctcatcggaaggcacggacctcagaacaaacagccatttatggtggcgtttttcaaagcaaccgaagtccactttagaagcattcgctccaccggatcaaagcagcgtagccagaatagatcgaagactcccaagaatcaggaagctctgaggatggccaatgtcgccgaaaactcgagcagcgaccagcggcaagcatgcaagaaacatgaactttacgtgtccttccgcgacctgggttggcaggactggatcatcgcaccggagggatacgcggcatactactgcgagggcgaatgtgctttcccgttgaattcgtacatgaatgcaaccaatcacgctattgtgcaaactctggttcacttcatcaacccagaaactgtccctaaaccgtgctgcgctccaactcaactgaacgccatctcggtgctctacttcgacgactcctcgaatgtgatcttgaagaaataccgtaatatggtggtccgcgcatgcgggtgccat

SEQ ID NO: 7949 - DNA, 1293 bp, Artificial Sequence
  Description of Artificial Sequence: Synthetic coding sequence
atgcacgtgcggtccctcagagccgcagcgcctcattcgtttgtggctttgtgggcgccgttgttcctcctccggtcagctctggcggatttctcacttgacaacgaggtccactcgtcatttatccaccgcagactgcgctcacaagaaagacgcgaaatgcagcgggaaatcttgtccattttgggccttccgcatcggccccgcccacacctgcaagggaagcacaattccgcacccatgtttatgcttgatctctacaacgctatggcagtggaggaaggcggaggacccggagggcagggattttcgtacccgtacaaagccgtgttctctacgcaaggacctcctctcgcgagcttgcaggactcgcatttcctcactgatgctgatatggtgatgtcgttcgtcaacctggtggaacacgacaaggagttctttcatccccggtaccaccacagggaatttaggtttgatctgtcaaagattccggagggcgaagcagtgactgcggccgaattcagaatttacaaggactacatcagagaaaggttcgacaacgaaacgttccgcatcagcgtttaccaggtccttcaggaacatctgggaagggagagcgacttgtttctgctcgactcacggactctctgggcctccgaagagggttggctggtgttcgatatcactgcaacttcgaaccattgggtggtgaacccaagacacaacctgggcctgcagctctcggtggagactctggacggacagtcaatcaacccgaaactggcagggctgatcggacgacatggacctcagaataagcagccgtttatggtcgcatttttcaaggccactgaagtgcattttcgatccatccgctcgaccggctcgaaacagaggtcccaaaacaggtccaagactccgaagaatcaggaggcccttcgcatggccaacgtcgccgaaaactcgtcctcggaccagagacaggcatgcaaaaaacatgagctgtacgtctcctttcgggatcttggttggcaagactggatcattgcgcctgagggctacgcagcctactactgcgagggagagtgtgccttcccgctcaactcttacatgaacgcgacgaatcacgcgatcgtgcaaactctggtgcacttcattaatccggaaactgtgccgaaaccatgctgcgccccgacgcaactgaacgccattagcgttctctacttcgacgactccagcaacgtgatcctcaagaagtaccggaacatggtggtgagggcttgtggatgtcac

SEQ ID NO: 7950 - DNA, 1293 bp, Artificial Sequence
  Description of Artificial Sequence: Synthetic coding sequence
atgcatgtgcgttcgctgcgcgccgccgccccgcactccttcgtcgctctgtgggccccactctttctcctccgctcggctctggccgacttctcgctcgataacgaagtccactcctcctttatccaccggcgactcaggtcccaggagcggagagagatgcagcgggagattctgtcgatcctcggcctgccacaccggccccgaccgcacctgcagggaaagcacaactcggcccctatgttcatgctggacctgtacaacgctatggccgtcgaagaaggaggcggaccgggcgggcaaggcttttcgtacccttacaaggcggtgttctctactcaaggccctccattggcgtccctgcaggatagccacttcctcaccgacgcggacatggtcatgtcgttcgttaacctggtggagcacgacaaggagttcttccacccccggtaccaccatcgcgaattccggttcgacctgtcgaagatccccgagggcgaagcggtcactgccgcagaattcaggatctacaaagactacatccgcgagcgattcgacaacgagacttttcgcatctcagtgtaccaggtgctgcaagagcatctgggtagagaatcagacctctttttgttggacagccgaaccctttgggcctccgaagaagggtggttggtgttcgacattaccgcaacttccaaccactgggtggtcaatccgcgacataacctgggactgcagctgtccgtggaaactttggacggacagtccatcaacccgaagctcgccggacttatcggtcgccacggtccacagaataagcagcccttcatggtggcgttctttaaggccaccgaggtgcatttcagatccatccggtccaccggcagcaagcagcggtcacaaaacagatctaaaacgccgaaaaaccaggaagccctgaggatggcaaatgtggcggaaaatagctcgtcggatcagagacaagcctgcaagaagcacgagctgtacgtctccttccgggatctcggatggcaagactggatcatagccccggagggatacgcagcctactactgcgagggagagtgcgccttccctctgaactcgtacatgaatgccactaaccatgctattgtgcagaccttggtgcactttatcaatccagaaaccgtgcctaagccatgctgcgccccaactcagctgaacgctatctccgtcctgtacttcgacgactcctcaaacgtgatcctcaaaaagtatcggaacatggtggtgcgcgcttgcgggtgccac

SEQ ID NO: 7951 - DNA, 1293 bp, Artificial Sequence
  Description of Artificial Sequence: Synthetic coding sequence
atgcacgttcgcagcctccgcgctgccgctcctcatagtttcgttgctctctgggccccactgttcctgctgagatctgctctggccgattttagtctggataacgaggtgcacagctccttcattcataggagactgaggagccaggagagaagggaaatgcagagagaaatactgtcaattctgggcttgcctcacaggcctcgcccacacctgcagggcaaacacaatagcgcacctatgttcatgctggatctgtacaacgctatggctgtcgaagagggtggcggcccaggcggccagggattctcctatccatataaggcagtgttcagcacccagggcccccctctggcgtctctgcaagatagccacttcctgacagatgcggacatggtgatgtcatttgttaatctggtcgaacacgacaaggagttctttcatccacgctaccaccatagagaattccgcttcgatctgtctaagattcccgaaggagaagcagtaacagctgcggaattcaggatctacaaggactacatcagggaaaggtttgataatgagacttttaggatatcagtctatcaagtcctgcaggaacaccttggacgcgaatctgatctcttcctgctggacagcaggacactgtgggcaagtgaggagggctggctggtgttcgacataacagcgacctcaaaccattgggttgtgaatcccaggcacaatctcggcctgcagctcagcgtggagacgctcgacggacaatctataaaccctaagctggccggactgatcggacgccacggaccacagaacaagcaaccattcatggtggccttctttaaagctaccgaagtccatttcaggagtatcaggagcacaggtagcaaacaacgcagtcagaacaggtccaagactcctaagaaccaggaagcgttgaggatggctaatgtcgccgagaactcatcatcagaccaacgccaggcctgtaaaaagcacgagctttacgtgtcctttcgcgacctgggatggcaggactggattatcgcacccgaaggctatgctgcatactactgtgaaggtgagtgcgctttccctctgaattcctacatgaacgctactaaccacgccattgtgcagacactggtccacttcattaacccagagaccgtgcccaagccttgttgcgctccaacacaactcaacgccatctccgtcctctacttcgatgattccagcaacgtcatattgaagaaatacagaaacatggtcgtacgcgcttgtggctgccat

SEQ ID NO: 7952 - DNA, 1293 bp, Artificial Sequence
  Description of Artificial Sequence: Synthetic coding sequence
atgcatgtcaggagtctccgggccgccgccccccacagtttcgtagccttgtgggctccactgttcttgcttaggagcgccttggcagatttttccttggataatgaggttcattctagcttcatccatcggaggctgcgctcccaggagcggcgggagatgcaaagagagattttgtcaatcctgggactaccacaccggccaagaccacatctgcagggtaaacataattccgcgccaatgttcatgttggatctatacaacgcaatggcagtggaggagggcggagggcccggaggccagggcttcagctatccatacaaggcggtgttttctacacaggggcctccactggccagtcttcaagattcgcacttcctgacggacgccgatatggtgatgtcttttgtgaaccttgtggaacacgataaggagttttttcacccaagataccaccatagagagtttcggttcgacctgtcgaaaatacctgagggggaagcagtaacagctgctgaatttaggatatacaaggactatattcgtgagcgattcgacaacgagactttccgcatttcagtgtatcaagttctgcaggagcacctaggaagggagtctgacttgttcctgctcgatagccgaactctatgggcttccgaggaaggttggctagtgtttgatattactgccacatcgaatcattgggttgtgaatccccggcacaatttaggactgcagctgtcagtggaaaccctggatggccagtctattaatcctaagttggctggcttgataggcagacatggacctcagaacaaacagcctttcatggtggcttttttcaaggctaccgaggtacacttcagaagcatacgatcgactgggtccaagcaacggtcccagaatagatctaaaacgcctaaaaatcaagaggcactaagaatggccaatgtggccgagaactcctcatccgatcaacgccaggcttgcaagaaacatgagctgtacgttagctttcgagatcttggctggcaggactggataatcgctccagagggatacgccgcctattactgtgagggcgagtgtgctttcccattgaattcttatatgaacgctactaaccacgcgatcgtccaaacactggtccacttcataaatccagaaacggtccccaaaccatgttgcgcgcctacacagcttaatgctatctcagtgctgtacttcgacgacagctcaaatgtgatactgaagaagtaccgcaatatggtagttcgggcctgtggctgccac

SEQ ID NO: 7953 - DNA, 1293 bp, Artificial Sequence
  Description of Artificial Sequence: Synthetic coding sequence
atgcatgtaagatcattacgtgctgctgcaccacattcatttgttgctctttgggctcctttatttttacttagatcagctcttgcagatttctccttagataatgaagtacatagtagtttcattcatagaagattacgttcacaagaaagacgtgagatgcaacgtgaaattctttcaattttaggtcttccacatagaccaagaccacatttacaaggaaaacataattcagcacctatgtttatgttagatctttacaatgctatggctgttgaagaaggtggaggaccagggggacaaggttttagttatccatataaagcagtattctcaacacaaggaccaccactcgcatctttacaagattctcattttttaactgatgcagatatggtcatgtcatttgtaaatttagttgaacatgataaagaatttttccatccaagatatcatcatcgagaattcagatttgatttatcaaagattccagaaggagaagcagttacagctgcagaatttcgtatttataaggattacattcgtgagcgttttgataatgaaacttttaggatatctgtttatcaagttttacaagaacatcttggaagagaatctgatttatttcttcttgattcaaggactttatgggcttctgaagagggatggcttgttttcgatattactgcaacatcgaatcattgggttgtaaatccaagacataatcttggacttcaattgtcagttgaaacgcttgacggacaatcaattaatcctaaattagcaggattaattggtagacatggtccacaaaataaacaaccatttatggttgcattttttaaggctacagaagtacactttagatctattagatccactggaagtaaacaaagatcacaaaatagaagtaaaacacctaagaatcaagaagcattaagaatggcaaatgtagcagagaattctagttccgatcaaagacaagcatgtaaaaagcatgaactttatgtatcttttagagatttaggatggcaagattggattattgctccagaagggtatgcagcttattattgtgagggagaatgtgcatttccattaaattcatatatgaacgctactaatcatgcaattgttcaaacattagttcatttcattaatccagaaactgttcctaaaccatgttgtgcaccaacacaattaaatgcaatttcagttttgtattttgatgatagtagtaatgttatattaaaaaaatatagaaatatggttgttagagcttgtggatgtcat

SEQ ID NO: 7954 - DNA, 1293 bp, Artificial Sequence
  Description of Artificial Sequence: Synthetic coding sequence
atgcatgtgcggtcactgcgtgcagcagcgccacactcgttcgttgccctttgggccccactcttccttcttcggtccgcactggccgacttttctctggataatgaggttcactcatcctttattcataggcgcctgcggtcgcaagaacgtagggagatgcagcgcgaaattctttccatcttggggctgcctcaccgacctcggccccatcttcaaggaaagcacaactcggcccctatgttcatgctggatctttacaatgccatggccgttgaagagggaggcggccccggaggtcagggattttcctacccttacaaggctgtgttttccactcaaggaccaccattggcctcgttgcaggacagccacttcctcactgatgcagacatggtgatgtccttcgtgaatcttgtcgagcatgataaggagttttttcatccaaggtaccaccatagggaattccgctttgatctgtccaagatcccagaaggtgaagcggtgactgcggcagaattccggatttacaaggattacatccgggagcgatttgataacgagacttttcggatcagcgtgtaccaggtgcttcaagaacacctgggtagagagagcgacttgtttctgcttgactcacgtaccctctgggccagtgaggagggttggctggtttttgacataaccgccacttccaaccactgggtggtgaaccctagacacaaccttggactgcagctgtcagtcgagactcttgacggccagtcgatcaaccccaagttggcaggcctgataggtagacatggtcctcaaaacaagcagcctttcatggtggcgttctttaaggccactgaagtgcattttcggagcattcgttctactggctcgaaacaacggtcccagaatagatcgaaaacccctaagaaccaggaagcactccgcatggctaatgtcgcagaaaatagctcatccgaccaacggcaagcatgcaaaaaacatgaactttacgtttctttcagagatctcggatggcaagactggatcattgctcctgaaggatacgcggcatactactgtgagggtgaatgtgcatttccactgaacagctacatgaacgcaactaaccatgcaattgtgcaaaccttggtccatttcataaaccctgaaaccgtccctaagccttgctgcgctccgacccaattgaacgccatctcggtcctgtactttgatgatagctccaacgtgatcctgaagaagtacaggaatatggtggtgagagcatgtggatgtcat

SEQ ID NO: 7955 - DNA, 1293 bp, Artificial Sequence
  Description of Artificial Sequence: Synthetic coding sequence
atgcacgtgaggagccttagagcagcagcacctcactcttttgtggcgctttgggcgcccctgttccttctgcgctcggcactggcggatttttccctggacaacgaagttcacagctccttcatccacagacgcctgagatcacaagagcgcagagagatgcagagagagatcctctcgatactcggtctgccgcataggcctcgcccacatcttcaaggtaagcataacagcgctcccatgtttatgctggatctttacaatgcgatggccgtggaggagggcggaggcccgggtggacaaggattttcgtacccttacaaggccgttttcagcactcaaggacctcctctcgcctcattgcaagattcgcactttcttaccgatgctgatatggtgatgtctttcgtgaaccttgtggagcacgataaggaattctttcacccacgataccatcatcgggaatttcggttcgacctctccaagattccggagggggaggcagtgaccgccgcagaatttagaatttacaaggactacataagagaaaggtttgataacgagactttcagaatctcagtctaccaagtgcttcaagagcatctggggcgggagtcggacctgtttctgctggatagccgtaccctttgggcctcagaggagggttggctcgtgtttgacattaccgccacctcaaaccactgggtggtgaacccaagacataatctgggccttcaactgtcagtcgaaacgctcgacggacaatcgatcaatcccaagctggcaggcctcatcggaaggcacggacctcagaacaaacagccctttatggtggcattcttcaaggcaactgaagtccatttccggtccattcggtcaactggatcgaaacagagaagccaaaatcggtccaagacgccgaagaaccaggaagcactcagaatggcaaacgtggccgaaaactcgtcgtcggatcagagacaagcatgtaaaaagcatgaactgtacgtctcattccgcgacctggggtggcaagactggattattgctcccgaaggttacgcagcatactactgcgagggagaatgcgcgtttcccctcaactcctacatgaatgcaaccaaccatgccattgtgcagaccctggtccatttcatcaatccagaaaccgtgcctaagccttgttgcgcaccgacccagttgaatgccatctccgtgctgtactttgatgacagctcgaacgtgatactgaagaaatacaggaatatggtcgtgagagcatgtggatgccat

SEQ ID NO: 7956 - DNA, 1293 bp, Artificial Sequence
  Description of Artificial Sequence: Synthetic coding sequence
atgcacgttaggagcctgagagctgcggctccacactcttttgtggcattgtgggctcccctgtttctgctgaggtccgcgttggctgacttcagcctggacaatgaggtgcatagttcttttatccaccgccgcctgcggtcgcaagaaaggagagaaatgcagcgagagattctctctattttggggctcccacacagacccaggcctcacttacagggcaaacataacagtgcccccatgtttatgttagatctctacaacgctatggcggtggaggagggcggggggccgggcggccagggcttttcctacccgtacaaggccgtctttagtactcagggcccccccttggcaagccttcaagatagccactttctgactgacgccgacatggttatgagtttcgttaacctggttgaacacgataaggaattttttcacccacgatatcatcaccgagagttccggtttgatctgtctaagattcccgaaggggaagcagtgacagccgctgaatttcgcatctacaaggattatattagggaacgctttgacaacgagacattcaggatttccgtgtatcaggttttgcaggaacatctcggccgcgagagcgacttgttcctcctcgactccagaactttgtgggcttccgaagaggggtggctagtgtttgatatcaccgcaaccagtaaccattgggtcgtgaatccccgacacaacctgggactccaactttcagtcgagacgctcgatgggcagtcaattaacccaaaattggccggcctgatcgggcgccacggccctcaaaacaagcagccatttatggtcgccttctttaaagcaacagaggtacattttagatcaatccggtctacgggttcgaagcagaggtcgcagaaccgaagtaagacccccaagaatcaggaggcgctccggatggcgaatgtggcagagaatagcagcagtgatcaacgtcaggcatgcaaaaagcatgaactgtacgtctcttttcgggatcttgggtggcaggactggataatcgcgcctgaaggttatgccgcatactactgtgagggagaatgcgcatttccattaaattcttatatgaacgcaactaaccacgccattgtccagacactggtccatttcatcaacccagagacagtgccgaagccatgctgtgctcccacccagctcaatgctatttctgtgctttactttgacgattcctcgaacgtgattctgaaaaagtatcgaaacatggtggtgcgggcttgcggctgccac

SEQ ID NO: 7957 - DNA, 1293 bp, Artificial Sequence
  Description of Artificial Sequence: Synthetic coding sequence
atgcatgtacgctccctcagagcggcagccccacatagttttgtggccctatgggctccgctcttcctcctaaggagcgctctggcggatttcagtctcgataacgaagtacattcatccttcatccatcgcaggctgcggtcccaggagcgtagagaaatgcagcgggagattctctccattctcggcctgccccaccggcccaggcctcacctgcagggcaagcacaattctgccccgatgttcatgcttgatttgtacaatgcgatggcggtggaggaggggggtggcccaggcggacagggatttagctatccctacaaggccgtttttagcacccaggggccaccactggctagtctgcaggacagccactttctgactgacgccgatatggtgatgagctttgtaaatctggtagagcacgataaggagttttttcacccccgttaccaccaccgcgagttcagatttgaccttagcaaaatccctgaaggcgaggctgttaccgccgccgaatttcgcatctacaaagactacataagagagcggttcgataatgaaacctttcgcataagcgtatatcaagttctgcaggagcacctgggtcgagaaagcgacctgtttctgctggatagccgtaccctttgggcgagcgaggagggctggctcgtatttgatataactgccacaagtaaccactgggtggtcaatccaaggcacaacctgggccttcagcttagcgtggaaaccctcgatgggcagagcattaatcccaagctcgccggactgattggacgccatggacctcagaacaagcagccattcatggtagctttctttaaggcaaccgaggtacatttcagatctatccgctctactgggtcaaaacagcgttcccagaatcggagcaagacaccaaagaatcaagaggccttacggatggccaacgtagcggagaatagtagttccgaccagcggcaggcatgcaagaagcacgagctgtacgtgagtttccgggaccttggctggcaagattggatcatcgcaccggagggctacgctgcctactattgtgagggagagtgtgcttttccgcttaatagttacatgaacgcgacgaatcacgcaatagtccagaccctcgtgcacttcattaatcccgaaacagtacctaaaccatgctgcgcccccacccagttaaatgccatcagcgtgctctactttgacgattctagcaacgttatcctgaagaagtacagaaacatggtagtgcgggcctgtggctgccac

SEQ ID NO: 7958 - DNA, 1293 bp, Artificial Sequence
  Description of Artificial Sequence: Synthetic coding sequence
atgcatgtgcgatcccttcgcgcagcagcacctcattcctttgtggcactttgggccccactcttcctgctgaggagcgcacttgcagatttctccctcgataatgaagttcactcgtcatttatccatcgcaggctccgttcacaggaaaggcgggagatgcagcgggaaattctgtcaatcctcgggctgcctcatagaccccgtccgcatcttcaaggaaagcacaattccgcacctatgttcatgctggatctgtacaacgccatggcagtggaggaaggaggaggtccgggcggacagggtttttcgtatccatacaaagccgtgttcagcactcaaggtccacctctcgcatcgctccaagactcacattttcttaccgatgcagatatggtgatgtcgttcgtgaatctggtcgagcatgataaggagttttttcatcctcgttaccatcatagagaattccgatttgatctgagcaagatcccggaaggcgaagcagtgactgcagcagagtttagaatctacaaagactacattcgggaaagattcgataatgagacttttcggattagcgtctaccaagtgctccaagaacaccttggaagagagtccgatctgtttcttctcgattcgcgtaccctttgggcgtcggaagaaggatggctggtgtttgatattaccgcaacctcaaaccattgggtggtgaaccctcgccataatcttggactgcagcttagcgttgaaactctcgacggacaaagcatcaaccctaagctcgcaggcctgataggccgccatgggcctcagaacaagcaacctttcatggtggcattctttaaggccactgaggtccattttcgcagcattcggagcactggatcgaagcagagaagccaaaaccgctccaaaacccccaagaaccaagaggcgcttcgaatggctaacgtggctgagaattcgtcctccgaccagcgacaggcctgcaagaagcatgaactgtatgttagctttcgcgacttgggctggcaggactggatcattgcaccagaaggttatgcagcatactactgtgaaggtgaatgtgctttcccactgaattcctacatgaacgcaaccaaccatgcaatagtgcagaccttggttcatttcataaacccggaaactgtgcctaaaccttgctgcgcaccaacgcagctgaatgctatttccgtgctttactttgatgattcgtcaaacgtgatactgaagaagtacaggaatatggttgtgcgcgcctgtgggtgccat

SEQ ID NO: 7959 - DNA, 1293 bp, Artificial Sequence
  Description of Artificial Sequence: Synthetic coding sequence
atgcatgtccggagcctccgggcggccgccccccacagtttcgttgcgctgtgggctcccctcttcctcctgcgcagcgccctggctgatttctcactggacaacgaagtccactctagcttcatccaccgtcgcctgcgtagtcaggagcgccgtgagatgcagagggagattctgtctattctcggattgccccaccgccctaggccccatttgcaggggaaacataattcggcccctatgttcatgctggacctgtacaatgcgatggctgtggaagagggcgggggacccggtggccaaggcttctcttatccctacaaggctgtctttagtacccaggggccccctctggcgagtctccaggacagccactttttgactgatgccgacatggttatgtccttcgtcaacttggttgagcacgataaggagttcttccatccgcgctaccaccatcgcgagttccggttcgatctctctaagatccctgagggcgaggcagtcacggctgccgagttccgcatttacaaggactacatcagggagagattcgataacgagacgttccgaatttcggtctatcaggtcctccaggagcacctgggacgtgagagtgaccttttcctgctggactcccgcactctatgggcctcagaggagggctggctggtatttgatattactgccacctcaaaccactgggtcgtgaatccccggcacaacttgggcctgcagctgtccgtcgaaacgttggacggacagagcatcaatcccaaactcgctggcttgattggccggcacggtccccagaacaagcagcctttcatggtcgccttctttaaagccaccgaggtccacttccgttccatccgtagcaccggctccaagcagcgcagccagaatcgttccaaaaccccgaagaaccaggaggcactacgcatggccaacgtcgctgagaacagttcctccgatcagcggcaggcctgcaagaaacacgagctgtacgtttcatttcgcgatcttgggtggcaagattggattatcgccccagagggttatgctgcctattactgtgagggcgagtgtgcgttccccctcaactcctacatgaacgcaacgaaccatgcaattgttcaaacccttgtccactttattaaccccgagactgtcccaaagccatgctgcgcccctacgcagctgaacgccatctcggtcctgtacttcgatgactcctccaacgtgatcctgaagaagtatcgtaacatggtcgtgcgtgcttgtggatgccac

SEQ ID NO: 7960 - DNA, 1293 bp, Artificial Sequence
  Description of Artificial Sequence: Synthetic coding sequence
atgcatgtcagatccctaagggcggcagcacctcattcttttgtcgctttatgggccccactgttcctcctgaggtccgcgctcgcggatttctccttagacaacgaagttcatagcagctttattcacaggaggctacgcagtcaggaaaggagagaaatgcaaagagagatcctgtctatccttggcctccctcataggccacgtccccatttacagggtaagcataattccgccccaatgttcatgttagacctgtacaacgcaatggcggttgaggaaggcgggggccccggcggccagggtttctcgtatccttacaaagccgtgtttagtactcagggaccgccgctcgcatctctgcaggatagtcacttcctgactgatgccgatatggtgatgtcttttgtcaatctggtggagcacgataaggaatttttccaccctcgctaccaccatagggagttcagatttgatctttcaaaaattcctgaaggcgaagctgtcaccgctgccgaatttcgtatctataaggattacatacgcgaacgattcgacaacgagacttttcgcatttcggtctaccaagtcctacaagaacacttagggagggagtccgacctgttccttctcgactcccgcacgctgtgggctagtgaagagggatggttggttttcgacataaccgccacttccaaccactgggtggttaatccaagacataatcttgggctgcaactttcagttgagactcttgacggccagagcataaatccaaaactcgctgggcttattgggagacacggcccgcagaacaagcagcccttcatggtcgctttctttaaggccacagaggtccactttcggagcatccggtcaacaggttccaaacagaggagtcaaaatcggagtaaaactcccaagaaccaggaggctctcaggatggcgaacgtcgcagaaaacagctcctccgatcagcgacaggcctgcaagaaacacgaattgtatgtttcctttcgggatttggggtggcaggattggattatcgctccagagggatatgctgcctactactgcgaaggagagtgcgctttccccttaaactcctacatgaacgccaccaaccatgcaatagtgcagaccctggttcattttatcaatcctgagacagttcccaagccctgctgcgcgcctacccaactgaatgcaatctccgttttatactttgacgatagcagtaacgtgatcctgaagaagtatcgaaacatggtcgtgcgagcctgcgggtgtcac

SEQ ID NO: 7961 - DNA, 1293 bp, Artificial Sequence
  Description of Artificial Sequence: Synthetic coding sequence
atgcacgtccgatctctcagagcagcagcccctcattcgtttgtcgctctgtgggcgccactgtttttgcttagaagcgcgttagcagacttctccttagataacgaggtccactcttcgtttattcacagaaggctgcgctcgcaagaaagacgggaaatgcaaagagagattctgtctattttggggcttccgcataggccgcggccgcacttacagggcaaacacaacagcgcaccgatgtttatgttagacttgtacaacgctatggcggtggaagaaggcggaggccctggagggcaagggtttagctatccgtataaagcagtcttcagcacccagggacctccgcttgcgtcattacaagacagccacttcctgactgatgccgatatggtgatgtcttttgtcaatctggtggaacacgataaagaattctttcatccacggtaccatcaccgagagttccgttttgatcttagcaaaatccctgagggagaagccgtaacggcagcagaatttagaatttataaggactacatccgggaacgttttgacaatgagacttttaggatttcagtgtatcaggttttacaagagcacttagggagagaatcagatctctttctcctggattcgcgtacactttgggcttcagaagagggctggttggtgttcgatataaccgccacgtctaatcattgggttgtcaatcctcgccataatctgggattacagttgtctgttgaaacgcttgatggccaaagcattaatcctaagttggccggattgattgggcgacacggtccacaaaataagcagccgtttatggttgctttttttaaagcgacagaagttcattttcgaagcataagaagcacgggaagcaaacagcgaagtcagaacagatccaagacgccaaaaaaccaagaggcgttgcgtatggcgaacgttgcagaaaacagctcatctgatcagcgccaagcttgcaaaaagcatgaactctatgtgagctttagagaccttggctggcaggactggattattgcgccggaaggatatgcggcttattactgtgagggcgaatgcgcgtttcctctgaatagttatatgaacgcgacaaatcatgccatcgtgcagacattagtacactttataaatcccgaaacggtcccgaaaccttgctgcgctccaacgcaattaaacgccatatccgttctctatttcgatgattccagcaacgtcatcttaaaaaaataccgcaatatggtcgtgagagcgtgtgggtgccat

SEQ ID NO: 7962 - DNA, 1293 bp, Artificial Sequence
  Description of Artificial Sequence: Synthetic coding sequence
atgcacgtgcgtagcctgagagccgcagcgcctcactcatttgttgcgctttgggcccctctattcctattaagatccgcactggctgatttttctttggataacgaagtccattctagcttcatccataggcgcctccgcagtcaggaacggagggagatgcagagggagattttaagcattctcggtttgcctcaccgaccacgcccccatctccagggaaagcacaactccgcccctatgttcatgctggatctgtataacgcaatggcggtcgaagagggagggggaccagggggccagggcttttcatacccgtacaaagctgttttctccacccaaggcccgccccttgcttccctgcaggactcccattttttgaccgatgccgatatggtcatgtcctttgtgaatctagtggagcacgataaggaattctttcacccccggtaccatcaccgggaattccgattcgacctgagtaaaatccctgaaggagaggcggtgaccgcagccgaattcagaatatacaaggactacatccgagagcgattcgataatgaaaccttccgtatctccgtttatcaggtgctacaggaacaccttggaagagagtctgatctcttcttactggatagccgaacgctttgggccagcgaagaaggctggcttgtcttcgacataaccgctacaagcaatcattgggtggttaatcctcgccataacttggggctgcaacttagcgtggaaacccttgatggccagagcattaaccccaagctggctggccttattggacgacatgggccacagaataaacagccatttatggtcgctttttttaaagccaccgaggtgcacttccgctcgataagaagcacagggtcaaagcagcggtcacagaaccggtcgaagacccctaagaaccaggaagcgctacgcatggcaaatgtcgcggagaatagctcatctgatcaacggcaggcctgtaagaagcacgaactatacgtctcctttcgggatttgggatggcaggattggatcattgcaccagaaggctacgctgcatactactgtgaaggcgagtgtgctttcccgctgaattcatatatgaacgctaccaatcatgcgatagtacagaccctggtgcactttattaacccagagacggtcccaaaaccctgttgtgctcctacacagctgaacgcgattagtgtgttgtatttcgatgatagctctaacgtgatattgaagaagtataggaatatggttgttcgcgcctgcggctgccat

SEQ ID NO: 7963 - DNA, 1293 bp, Artificial Sequence
  Description of Artificial Sequence: Synthetic coding sequence
atgcacgtgcgttcgctgcgggcagcagcgccgcacagctttgtagccctgtgggctccactttttctgctgagaagcgctctggcagatttttcacttgacaacgaagtgcatagctcctttattcataggcgcctgcgaagtcaagagagaagggaaatgcagagagaaattctgagcatcctcggcttgcctcacagaccgcgacctcacctgcaggggaagcataattcagccccgatgtttatgcttgatctctacaatgcaatggcagtggaagaaggcggaggtcctggcggtcaaggtttttcgtacccctacaaggcggtgttttcgactcaaggaccaccgctcgcatctctgcaggattcacattttctgaccgatgcagacatggtgatgtcgtttgtgaatctggtggaacatgacaaggagtttttccatccacggtaccatcatcgagagtttcgctttgatctttcgaaaattccggagggtgaagcagtgactgctgccgaatttaggatatacaaggactatatccgggaaagattcgataacgaaaccttccgtatatcggtctaccaggtcttgcaggaacacttgggacgggaatccgatctgtttcttctcgattccagaaccctctgggcctccgaggaaggatggctggtgtttgacattacggcaacctcgaaccattgggtcgtaaatcccagacataatcttggtctgcaactttctgtggaaacccttgatgggcagtcaattaacccaaagctcgcaggcctcatcggtagacacggacctcagaataaacaacctttcatggtggcatttttcaaagcaaccgaggtgcactttcggtcgatacgcagcaccggttccaaacagcggagccaaaatcgatccaagactcctaaaaaccaagaagccttgaggatggcaaacgtggctgaaaattcgtcgtctgatcaaagacaggcatgtaagaagcatgaactttacgtgagctttcgggatctggggtggcaagactggattatcgcccccgagggttacgctgcctactactgtgaaggggaatgtgcgttccctctgaactcctacatgaatgccacgaaccatgcgatcgtgcagaccctggttcacttcattaacccagaaaccgttccaaagccctgctgcgctccgactcaactgaacgcaatctccgtcctgtattttgatgactcgtcgaacgtcatccttaagaagtaccggaacatggtggtgcgcgcatgtggatgccac

SEQ ID NO: 7964 - DNA, 1293 bp, Artificial Sequence
  Description of Artificial Sequence: Synthetic coding sequence
atgcatgtgaggagcctgagggctgccgctccacactccttcgtcgccctctgggctccactcttccttctcagaagcgctcttgcagatttttctctggacaacgaggtacattctagcttcatacataggaggctgagaagccaagaaagaagagagatgcagagggaaatcctgagcattctgggactgcctcacagaccaagaccccacctccagggcaaacacaatagtgctccgatgttcatgctggacttatacaatgcgatggccgtcgaagaagggggagggccaggcgggcagggatttagctatccttacaaagccgtcttttcaacccaggggccccccctggccagcttgcaggactcccatttcctgaccgatgcagacatggtgatgagttttgtgaatctagtggagcatgacaaggagttcttccaccccagatatcaccaccgggaatttagattcgacctgtctaaaatccctgaaggcgaagcagtcaccgcagcggaatttagaatatacaaggactatatacgggaacgtttcgacaatgagacctttcggatctccgtgtatcaggttctgcaggagcatctggggcgggagtccgacctgttccttctcgatagtcgaacgctctgggcttcagaggaaggatggctggttttcgacatcacagccactagtaaccattgggtggtcaatccgcggcataacctgggcttgcagctcagcgtcgagacattagacgggcagtcaatcaaccccaagctagcggggctcatcgggaggcacgggccacagaataaacagccctttatggtcgccttctttaaggctaccgaggtccatttccgatccattaggagtacaggtagcaagcagcgtagccagaatagaagtaagacccccaagaatcaagaggccctgaggatggcaaatgttgcggaaaacagcagttccgaccagaggcaagcttgtaagaaacacgaattatatgtaagttttcgggacttgggctggcaggactggataattgcccccgaaggctatgcagcctactactgcgaaggcgagtgcgcatttccattgaattcctacatgaatgccaccaatcatgccatcgtgcagactctggtgcactttataaatccagagacggttcccaaaccctgctgcgcacccacacagcttaatgccatcagtgtgctgtacttcgatgactcatctaacgtgatcttgaagaaatatcgaaacatggtggtgagagcctgtggatgtcat

SEQ ID NO: 7965 - DNA, 1293 bp, Artificial Sequence
  Description of Artificial Sequence: Synthetic coding sequence
atgcatgtacggtctctgcgggcagctgcaccgcatagcttcgttgccctctgggcaccactgtttctgctgcgctctgctcttgccgatttctctttggataacgaggttcacagcagttttatccaccgccggttaaggagccaggagcggcgcgaaatgcagagagaaatcctgtctatcctggggctgccccacaggccgcgcccccatctgcagggaaaacataactccgcaccaatgtttatgttggatttgtacaacgcaatggccgttgaagagggcggaggccctgggggccagggctttagctacccctataaagctgtcttttccacacaaggtccaccactggctagcctccaggatagtcactttcttacggacgctgatatggtgatgagcttcgtgaatctggtggagcacgataaggagttctttcaccctaggtaccaccaccgcgagttcagatttgacctgtccaagatccccgaaggagaagcagtgaccgccgctgaatttcgtatctacaaagattacattcgtgaaaggttcgacaacgagacttttcgcatctcagtgtaccaggtcctgcaagagcacctcgggcgggaaagtgatctgtttctgctcgatagcagaactctgtgggcgtcagaagaagggtggcttgtctttgatattaccgctaccagtaaccactgggtcgttaaccctaggcataatctggggttacagctgtccgttgagaccctagacgggcagtcaatcaacccgaaactagctggattgatcggacgccacggaccacaaaataaacagccctttatggtggctttcttcaaggccaccgaggtgcattttcgatcaataaggagcacaggaagtaaacaaagatctcaaaacaggagcaaaacacctaaaaaccaggaggccctgcgtatggccaacgtggctgagaacagtagcagcgatcagcgccaagcttgcaagaagcatgaattgtacgtctccttccgggacttgggctggcaggactggatcatagcaccggaaggctacgctgcctattactgcgaaggagagtgcgcctttcccctgaacagttacatgaatgctacaaaccatgctattgtccagaccttggtgcattttatcaacccagagaccgtgcccaaaccctgttgcgcacctacgcagcttaatgcaatcagcgtactgtactttgatgattcctccaacgtgatccttaaaaagtacagaaacatggtggtcagggcttgcggctgtcac

SEQ ID NO: 7966 - DNA, 1293 bp, Artificial Sequence
  Description of Artificial Sequence: Synthetic coding sequence
atgcatgtccggtcccttcgggctgccgccccacactcttttgtcgctctctgggcgcccctcttcctgttaaggtcagcgctggcagacttctctctggacaacgaggtgcatagtagttttatccacaggaggctgagatcacaagagcggcgggaaatgcagcgcgaaatcctctctattctaggtctgccacacagacccagaccccatcttcagggtaagcataatagcgcacccatgtttatgttagatctgtataacgcaatggcggtcgaggaggggggaggtccaggtggccagggtttcagctacccatataaagccgttttctccacgcaggggcctcccttggcctccttgcaggacagccacttcctcaccgacgctgatatggtgatgtcctttgtaaacctcgtggaacacgacaaggaattctttcacccaagataccaccatcgtgaattcagattcgacctctctaagattccagagggcgaagcggtgacagcagcagagtttcgcatctacaaagactacattcgtgagcggttcgacaacgagactttcagaatctccgtgtatcaagttttgcaggaacatctggggcgggaaagcgatctttttctgcttgattccagaaccctctgggcatcagaggaaggctggctggtcttcgatattacggccacatctaatcattgggtagtcaacccaagacataacctgggcctgcagttgagcgttgagacactggacggccagtccatcaatcctaagctggctggcctaattggaaggcatggcccccagaataaacagcccttcatggtggcgttctttaaggcaactgaagttcacttcagatccatacgctccaccgggtcgaagcagaggtcccagaaccggtccaaaactcctaaaaaccaggaggcgcttagaatggctaatgtggcggagaactcatcttcagatcagcgtcaggcttgcaagaagcatgaactgtatgtttccttccgagacctcggatggcaagactggataatcgcacctgaagggtatgccgcctactattgcgaaggagagtgtgcctttccactaaattcctatatgaacgcgacgaaccacgcgatcgtgcagaccttagtccactttatcaaccccgagacagtaccaaaaccatgttgtgcccccacccagctgaacgccatttccgtgctttatttcgatgattcttccaacgtaatcctgaaaaagtataggaacatggtcgttcgcgcctgtggctgtcac

SEQ ID NO: 7967 - DNA, 1293 bp, Artificial Sequence
  Description of Artificial Sequence: Synthetic coding sequence
atgcatgtacgctcgctcagggcggcagctccacattcttttgttgcattgtgggcacctctgtttctgctgcgctcggccctcgcggatttttcccttgataatgaagtgcatagcagcttcattcatagacgccttcggtcacaggaacggcgggaaatgcagcgcgagattttgtcgattctcggcctgccacacaggccacggccacatctgcaaggaaagcacaacagcgcaccgatgtttatgcttgacctgtacaacgcaatggccgtcgaagaaggcggtggaccaggtgggcaaggtttttcgtacccttacaaggcggtgttctctactcagggacctccactggccagcctgcaagatagtcacttcttgactgatgcagatatggtcatgtcctttgtgaacttggtggaacatgataaggaattcttccaccccaggtatcatcatcgtgaatttcggttcgacctctccaagattcctgaaggggaggcagtgacggcagcagagtttcgcatctacaaggactacataagggaaagatttgacaatgagacgttcaggatcagcgtctatcaggttctgcaagagcatcttggtcgcgagtccgatctcttccttcttgattcccgaaccctctgggcatcggaagaaggatggctcgtgtttgacattaccgccacctcgaaccactgggtggtgaaccccagacacaaccttggccttcagctctcagtcgaaactctcgacggacaaagcattaaccctaaactggcgggcctcattgggcggcatgggccgcagaacaagcaaccatttatggtcgcttttttcaaagcaactgaggtccattttcgatcaatcagaagcaccgggtctaagcaacgcagccaaaatcgatcgaaaactccgaagaaccaggaggctctgcggatggccaacgtcgcagaaaactcgtcgtcggaccagcggcaagcatgtaagaagcatgagttgtacgtgagctttagagatctgggttggcaagattggataatagcgccagaaggatacgccgcatactactgcgagggtgagtgtgcattcccgcttaattcctatatgaacgcaaccaaccatgccatagtgcaaaccctcgttcactttatcaatccggaaactgtcccgaaaccgtgctgcgcccctacgcagcttaatgccatttccgtcctttacttcgatgactcatcaaacgtgatccttaagaaataccgaaatatggtggtccgtgcttgtgggtgtcac

SEQ ID NO: 7968 - DNA, 1293 bp, Artificial Sequence
  Description of Artificial Sequence: Synthetic coding sequence
atgcacgtgaggtcactccgagcagcagcgccgcattcctttgtggcgttgtgggcacctctgtttctgttgcgcagcgccctggcagatttttcgcttgataacgaggtgcactcgtcctttattcatcgccgtcttagaagccaggaacgtagagagatgcaaagagaaattctttccattctcggccttccacacagacctaggccacaccttcaggggaagcacaactcagcacctatgttcatgctcgacctctacaacgcaatggccgtggaagaaggaggtggcccaggggggcaaggattttcatacccatacaaggcggttttctcaacccaaggacctccactcgcgagcctgcaggactcgcattttcttacggatgcagacatggtgatgtcgtttgtcaacctcgtggagcatgataaagaattcttccatcccagataccaccacagggaatttagatttgatctctcaaagatccctgagggtgaagcagtgactgcagcagaatttcgaatttacaaggattacattagggagaggtttgacaatgaaacttttcggatctcggtgtatcaagtgcttcaggaacacctgggcagagaatccgatctctttctgttggattccagaaccctttgggcctcggaagaaggctggctcgtgtttgatatcaccgcaaccagcaatcattgggtcgtgaacccgcggcataatcttggacttcagctgagcgttgaaaccctggatggtcagagcattaatcccaagctggctggtctgatcggaaggcatggtccgcagaataagcaaccatttatggtggcgttcttcaaagccactgaagtgcactttcgttcgattagatcgactggcagcaagcaacgtagccaaaatcgttcaaagacgccgaagaaccaggaagcacttcgtatggcgaacgtggctgagaactcgtcatctgaccaacgccaagcatgtaagaaacacgagttgtacgtctcgttccgggatctcgggtggcaagattggatcattgcaccggagggatacgccgcttactactgtgaaggagaatgtgcattccctctgaacagctacatgaatgcaaccaatcatgcaatcgtgcaaactctggtccactttatcaacccagaaactgtgcctaaaccttgctgcgcacctactcagcttaacgcgatctcagtcctctactttgacgattcctctaacgtcatcttgaagaagtataggaacatggtcgttcgggcatgcggctgtcac

SEQ ID NO: 7969 - DNA, 1293 bp, Artificial Sequence
  Description of Artificial Sequence: Synthetic coding sequence
atgcacgtccgtagcctacgggccgccgcccctcactctttcgtggctttgtgggccccattatttctgcttagaagtgctttggctgacttttcactggataatgaggtccacagctcattcatccatcgcaggttacgtagtcaagagcgtagagagatgcaaagagagattttgtctatcctaggactcccccatcggcccaggccacaccttcagggaaagcataatagcgctccgatgttcatgcttgatttatataacgctatggccgtcgaagaaggtggtgggcccggtgggcagggtttcagttacccgtacaaagctgtgttctctacgcaaggtcccccacttgcttctcttcaggattcacactttctgactgacgctgatatggtaatgagcttcgtgaacttggtggagcatgataaggagtttttccaccccagatatcaccatcgtgagttcaggttcgatttgagcaagattcctgagggagaagctgtgactgcggcagagtttagaatttataaggactacattagggagcgattcgataacgagacctttaggatatcggtttaccaagtcctacaagaacacctcggtagggagagcgatctctttttgttagattccagaactctttgggccagtgaggaaggttggcttgtttttgacattactgccacctctaaccactgggtggttaacccaagacacaatttggggcttcagttgtctgtcgaaactcttgatggacagtcaataaatccgaagcttgctggtcttattgggaggcatggaccccagaacaaacaacccttcatggtcgctttcttcaaagctacagaggtccattttagatcgatcagaagcacaggcagtaaacagcggtcgcagaatcgttctaagacgccaaaaaatcaagaagctcttaggatggcaaatgttgcagagaatagcagctcagaccagagacaagcttgtaagaagcacgaattgtatgtttcatttcgtgatttggggtggcaggattggataattgctccagagggttacgcagcttactactgcgaaggggaatgcgctttccctttaaactcatatatgaacgccacaaaccatgctattgtacaaactctggtacatttcatcaatcctgagacagtaccgaagccatgttgcgcgccaacacaacttaacgcaataagtgttctatatttcgatgatagctccaatgttatactgaaaaaatataggaatatggtagtaagggcctgcgggtgccat

SEQ ID NO: 7970 - DNA, 1293 bp, Artificial Sequence
  Description of Artificial Sequence: Synthetic coding sequence
atgcacgtgagatccctgcgcgccgccgcgccccattcgttcgtggccctctgggccccgctgttcctcctccggtcagcactcgcggatttctcgctggacaacgaggtgcattcttctttcatacacaggaggttgagatcccaggaaaggcgggaaatgcaacgcgaaattctgtccatccttggattgccacaccgccctagaccccatctccaaggaaagcacaactcagctcccatgttcatgcttgatttgtacaacgctatggccgttgaagagggaggaggaccgggaggccagggattttcctacccttacaaggccgtgttctccacccagggtcccccactggcgtcgctccaggactcccatttcctgacggatgcagacatggtgatgtcatttgtgaatctggtggagcacgacaaggagtttttccacccacgctatcatcatcgagaattccgcttcgacctgtcaaagatcccggaaggggaagccgtgactgcggcggagtttaggatctacaaggactacatcagggaaagattcgacaatgagactttccggatcagcgtgtaccaggtgctgcaagagcacctcggcagagaatcagatctgttcctgctggactcccgcaccctctgggcatcggaggagggatggctcgtgttcgacatcactgccacctcgaatcattgggtggtcaacccccgccataacctggggctccaactgtccgtggagactctggatgggcagtcgatcaatccgaagctcgctggactgatcggacgacacggtcctcagaacaagcaaccgttcatggtggctttcttcaaggcaaccgaggtgcactttcgctcgatccggtccaccgggtccaaacagcgctcccagaatagaagcaaaactccgaagaaccaagaagccctgcgcatggccaacgtggcagaaaacagcagcagcgaccagcgccaggcgtgtaaaaagcatgaactgtacgtcagctttcgcgacctgggctggcaggactggattatcgcacccgaaggatacgccgcctactactgcgaaggagaatgcgccttcccgctgaattcctacatgaacgcaactaatcacgccatcgtgcagaccctcgtccacttcatcaatccagaaactgtcccgaaaccgtgttgtgcccctactcaactcaacgccatctcagtgctctatttcgatgactcatcgaatgtcatcctcaagaagtaccggaatatggtggtgagggcgtgcggatgccac

SEQ ID NO: 7971 - DNA, 1293 bp, Artificial Sequence
  Description of Artificial Sequence: Synthetic coding sequence
atgcacgtgcggagcttgcgggctgcggcaccacactctttcgtcgcattatgggcccctctgttcttgctccgaagcgctcttgcagatttctccctcgacaatgaagtccacagttccttcatacaccgcagattgcggagccaggagcggagggaaatgcagagagagatcctcagtatactcggccttcctcataggcccagacctcatctccagggcaaacataattccgcgcctatgtttatgttggatctatacaacgccatggctgttgaggaaggcggagggcctggtggtcaagggttttcatatccgtacaaggccgttttctcaacgcaggggcctcctctggcatcattgcaggactctcacttcttgaccgatgccgacatggtgatgtccttcgtgaacctcgtggagcacgataaagaattcttccatccacgttatcaccatagagagttccgtttcgatctgtcaaagatccctgaaggcgaagccgtgacagctgccgagttccgcatatataaggattatatacgggagagatttgacaatgaaacattccgaatttccgtgtatcaggttcttcaggaacacctgggccgcgaaagtgatctttttctcttggattcacggactctgtgggcctctgaggagggctggctggtgttcgatatcaccgcgacctccaatcattgggtggtcaacccgcgccacaaccttggactgcagttatccgtagagacgcttgacgggcaatccataaaccctaagctggccgggctgattggccggcatggccctcaaaataagcagccttttatggtggctttctttaaagctacagaagttcacttccgctccataagatctactggctccaagcaaaggagccagaatcgatcaaaaacacccaagaaccaggaggccctgcggatggcgaatgtcgccgagaatagctcctctgatcaaaggcaagcctgcaagaaacatgaactgtatgtgagctttagagacctaggatggcaagactggataattgcacctgaggggtatgccgcttattactgcgagggagagtgcgcattcccacttaactcatacatgaacgcaacgaatcacgccatcgttcaaaccctagtccacttcatcaacccagaaaccgtgccgaaaccgtgttgtgcccctacccagctaaatgcgatcagtgtgctgtacttcgatgactcatctaacgttattctcaaaaagtacagaaacatggtggttcgcgcctgtggttgccac

SEQ ID NO: 7972 - DNA, 1293 bp, Artificial Sequence
  Description of Artificial Sequence: Synthetic coding sequence
atgcatgtgcgaagtttgagagccgctgctcctcacagtttcgtggccctgtgggctccactctttctgttgcgtagtgccctcgcagacttctccctggacaacgaggtgcattcttccttcatccacaggaggctgaggagtcaagaaagacgagagatgcagagagaaattttatccatcctcggcctacctcataggccccgaccgcaccttcaggggaagcacaatagcgcccctatgttcatgctcgatctttacaacgccatggcagtggaggaaggaggcggcccgggagggcagggattctcatatccatataaggccgttttctccacacaggggccacccctcgctagccttcaggacagtcactttctgaccgatgccgacatggtgatgtctttcgtgaatcttgtggaacatgacaaagagtttttccatccccgatatcatcaccgtgagttcaggtttgatttgagcaaaatcccagaaggggaggccgtcacagccgctgagtttaggatctataaagactacattagagagaggttcgataacgagacctttcgcatcagtgtgtaccaagtgttacaggagcatttgggtcgagaatccgacctgtttcttcttgacagccgcaccctctgggcctcagaggaaggctggctggtctttgacatcaccgccaccagtaaccactgggtggtgaatcctaggcacaacctgggcctccagttaagcgtggaaacactcgacggacagagtatcaatccaaagcttgccggactaatcgggagacatggtccccagaacaaacagccttttatggtggccttcttcaaggcaaccgaagtccacttcaggagtatccggagtacagggtctaaacagcgtagccagaacaggtccaagactcctaagaatcaggaggccctgcgaatggcaaacgtggcagagaattcctcatcagatcaacggcaggcttgtaaaaaacatgaactgtatgtaagcttccgtgatctggggtggcaagactggatcatagcccccgagggctacgccgcttattattgcgaaggtgaatgcgctttccccttgaattcctacatgaatgccacaaaccacgccatcgtgcagaccttagtgcactttatcaatcccgagacagtgcctaaaccttgctgcgcccctactcagctgaatgcgatttctgtactgtacttcgacgacagcagtaacgtgatactcaagaaatacaggaacatggtggttcgagcttgtgggtgccat

SEQ ID NO: 7973 - DNA, 1293 bp, Artificial Sequence
  Description of Artificial Sequence: Synthetic coding sequence
atgcacgtgagatcgctgagagcggctgcgccccattcgttcgtcgcgctctgggcccccctttttctcctccgctccgcgctcgctgacttctcacttgataatgaagtgcactccagcttcatccatcgccgcttgcggtcacaagaacggagagagatgcaacgcgagattttgtctatcctgggattgccgcacaggcctcggcctcatctgcagggcaaacataattcagcacctatgttcatgttggacctgtacaacgccatggctgtggaggagggcggcggaccggggggtcagggcttctcctacccgtacaaggctgtgttttcgactcagggacccccactcgccagccttcaagactcacatttcctgacggacgcagatatggtcatgtcattcgttaacctcgttgagcacgacaaggaattctttcacccgagataccaccaccgagaatttcgatttgatctgtcgaagattcccgaaggagaggccgtgaccgccgcagagtttagaatctacaaggattacatccgcgaacgctttgataacgaaacctttcgcatctccgtataccaggtgctccaagaacatctggggcgcgaatcggacctgttccttctggacagccggaccctgtgggccagcgaagaaggctggctcgtgttcgacatcacggccacttccaaccattgggtggtcaacccgcgccacaacctggggctccagttgagcgtagaaactctggacggacagagcatcaacccgaaactggccggcctgattggtagacatggtccgcagaataagcaaccattcatggtggccttcttcaaggctactgaagtccactttagatccatccggagtactggatcaaagcaacgcagtcaaaatagatcaaagacccctaaaaaccaggaggcacttcgcatggccaatgtggcggaaaactcaagctcggatcagcggcaggcgtgtaagaaacacgagctttacgtgtcattcagggacctcggttggcaggactggataatcgcgccagagggatacgcggcctactattgcgaaggggagtgtgccttcccactcaactcctatatgaacgccaccaatcatgcaatcgtgcagaccctggtccatttcatcaatccggagacggtgccaaaaccgtgctgcgctcccacccagctgaacgcaatctctgtgctgtacttcgatgactcctcaaacgtgattttgaagaagtaccggaatatggtcgtccgggcttgcggatgccat

SEQ ID NO: 7974 - DNA, 1293 bp, Artificial Sequence
  Description of Artificial Sequence: Synthetic coding sequence
atgcatgtgaggtcgctgcgcgccgccgcgccacacagcttcgtggccctctgggctcccctttttctgctgcggtcggcgttggccgatttcagcctcgacaacgaggtgcactcctcgttcatccatcggcgtctgcgtagccaagagcgcagagagatgcagcgggaaatcctgtcaatcttgggactgccacacagaccgcgccctcatctccagggaaagcacaactcagcgccgatgttcatgctcgatttgtataacgccatggctgtggaggaaggaggaggccccggaggacaagggtttagctacccgtacaaagcagtgttctcgacccaggggccacctctggcctcgctgcaggactcccatttcttgactgacgcagacatggttatgtcgttcgtgaaccttgtggaacacgataaggagttcttccacccaagataccatcaccgcgagttcagattcgacctgtccaaaattccagaaggggaagcggtgactgcggcagagtttcggatctacaaagattacatccgcgaacgcttcgacaatgagactttccggatctccgtctaccaggtccttcaggaacacctggggagagagtcagatttgttcctgctcgattcacggacgctctgggcctcggaagaaggatggctggttttcgatatcactgccacgtccaaccattgggtggtgaacccgagacacaatctgggattgcaattgagtgtcgagacgctggatggtcaatcgattaacccgaagctggcaggcctgatcggacgccatggtccgcagaataagcaaccgttcatggttgcttttttcaaggccaccgaagtacatttccgttcaattcggtcaaccgggagcaagcagcgcagccaaaatcggtctaagaccccgaagaatcaagaagctctgcgcatggctaacgtcgctgaaaatagctcttcggaccagcgccaggcttgcaagaaacacgagctgtatgtgtcatttcgcgaccttggatggcaggactggatcatcgccccagaaggatacgccgcgtactactgcgagggagagtgcgccttcccactgaatagctacatgaatgctaccaaccacgcaatcgtgcaaactctcgtccatttcatcaacccagaaaccgtacccaagccgtgttgtgcccctacccagcttaacgctatctccgtgctgtactttgacgactcgtcaaacgtcattctcaagaaatacagaaacatggtcgtgagagcctgcggatgccac

SEQ ID NO: 7975 - DNA, 1293 bp, Artificial Sequence
  Description of Artificial Sequence: Synthetic coding sequence
atgcatgtgcgctctctgcgggcagcggccccacattccttcgtggcgctttgggcacctctgtttctgctccgatctgctctggcagactttagtctcgacaacgaagtccactcttctttcattcaccgacggctgcgctcccaggaaaggcgggagatgcagagagaaatcctctctattctgggcttgcctcataggccgagacctcacctgcagggaaagcacaactccgcacctatgtttatgctggacttgtataacgcaatggccgtggaggaaggcggtgggccaggtggccagggttttagttatccgtacaaagccgttttcagcactcagggcccccctctggcttccctgcaggacagccactttctgactgacgctgacatggtcatgtcatttgtgaatctggtggaacacgataaggagttttttcatcctagataccatcatcgcgagtttaggttcgatctctcaaagatccccgaaggcgaggccgtcaccgcagctgagttccggatctataaagactacattcgggagcggttcgataacgaaacattccggattagtgtttatcaggtacttcaggagcacctcggccgagagagcgacctgttccttctggatagccgcaccttgtgggcaagcgaagagggttggctcgtgtttgatattaccgcaacttctaaccattgggtggtgaatccaagacacaatctgggtctgcaactgtcagttgagacgctggatggacagagtattaaccctaaactggccggtttgatcggcaggcatgggccccagaataagcagcctttcatggtggcgttctttaaggctacggaagtgcacttccgatcaattagaagcaccggtagtaaacagcgctcccagaatcgctcaaagacccccaaaaatcaggaggcactgcgcatggccaatgtggccgagaacagctcatctgatcagcggcaggcatgtaaaaagcacgaattgtatgtatctttccgagatctcgggtggcaggactggattatagcacccgaaggttacgcagcgtactactgcgaaggcgagtgtgcctttccactgaatagttacatgaacgccactaatcacgccatcgttcagactctggtccatttcataaatcctgaaaccgtgcccaaaccctgttgcgccccaacacaactcaacgctatttccgtgttgtactttgacgactcctctaatgtcatcctgaagaagtatcgaaacatggtcgtgcgggcctgtggatgccat

SEQ ID NO: 7976 - DNA, 1293 bp, Artificial Sequence
  Description of Artificial Sequence: Synthetic coding sequence
atgcacgttaggtccctgagagccgctgcgccacatagttttgttgcattgtgggcacctctgttcctccttaggtcggctttagcagatttctcccttgacaacgaagtccatagtagtttcatccatcgtcgtctacgctcccaggaacgtagggaaatgcagagggagattctttcaattttgggactaccgcatcggccacgcccgcatttgcagggcaaacacaactctgcgcctatgttcatgttggacctgtacaacgcaatggctgtggaggagggtggcggaccgggcggacagggcttttcatacccctacaaggcggttttctccacccaaggccctccattagcatcactgcaagactcccatttcttgaccgatgccgacatggtcatgtcgtttgtaaacctggtggagcatgataaagaattctttcacccacggtaccatcaccgtgagttccgcttcgacctctcaaagattcctgaaggagaggccgtgacagcagcagagtttcgtatttataaagactacatccgggagcgtttcgacaatgaaacgtttagaatctctgtttatcaggttcttcaggagcatctaggtcgggaaagcgatctctttctgttggactcgcgcactctgtgggctagtgaggaaggctggttggtcttcgatatcactgccacttcaaatcactgggtggtcaatccgcgccacaacctcggactccaattgtccgtggagacgctcgacggtcagtccatcaaccctaaactggcaggcttgataggccgccacggaccccagaataagcaaccattcatggttgctttctttaaggccacggaggtacactttcggtctatccgctccaccggatcgaagcagcggagccagaatcgttccaagacccccaagaaccaggaagcgttacgcatggccaatgtcgcagaaaactcatcgagtgatcaacgccaagcgtgtaaaaaacacgaactctacgtatcttttcgggatttgggttggcaggactggatcatcgcaccggagggatacgctgcatactactgtgagggggaatgcgcattccctctcaattcttacatgaatgccactaaccacgctatcgttcaaactttagtgcacttcataaacccggaaacagtccccaaaccgtgctgcgctcccacccagttaaatgctatttccgtcctgtattttgacgatagtagcaatgtcattttaaaaaaataccggaatatggttgtccgcgcatgtgggtgtcac

SEQ ID NO: 7977 - DNA, 1293 bp, Artificial Sequence
  Description of Artificial Sequence: Synthetic coding sequence
atgcatgtgcgctcattgcgcgccgccgcaccacactcatttgtcgctctgtgggccccacttttcttgctgagatctgctttggctgatttcagcttagacaacgaagttcatagcagctttattcaccgcagactgaggagtcaggagagacgcgagatgcagcgcgagattctgagcattctgggactgccacaccgcccaagaccccaccttcagggcaagcataactcagcaccaatgtttatgctggatctttataatgcaatggccgtcgaggaaggcggtggcccaggcggccagggattttcctatccctacaaggcggttttcagtacccagggacctcccttggcttctctgcaggacagccattttctgacagacgccgacatggtaatgtctttcgttaatctggttgagcacgataaagagttctttcacccacgctaccatcaccgcgagttcaggttcgacctgtcaaagatccctgagggtgaggctgtgaccgcggccgagttcagaatctacaaggattatatacgcgagaggtttgataacgagacgtttcgcatctctgtgtatcaggtcttacaggagcacctaggccgggagtctgatctctttctgcttgattcacgtacactctgggcttctgaagaggggtggctggtcttcgacattaccgcaacctctaaccattgggtggtcaaccctcggcacaacctggggttgcagctaagcgttgaaactctggatggacagagtatcaatccaaagttggcgggccttataggccgccacggccctcagaacaaacagcctttcatggtagcttttttcaaggctactgaggtgcactttaggtctattagaagcactggctctaaacagcgtagccagaatcggagcaagacccccaaaaatcaggaggctctgaggatggcaaacgtggccgaaaacagcagcagcgaccagagacaggcctgcaaaaaacacgagttatatgtgtcctttagagacctgggttggcaggactggataatcgcgccagagggctatgcggcctattattgtgaaggagagtgtgcatttcctctcaattcctacatgaacgccactaaccatgccatagtgcaaacactcgttcatttcattaaccccgagaccgtgccaaagccctgctgcgctccaacccagctaaatgctatttcggttttatattttgacgacagttccaatgtgatcctcaaaaaataccggaatatggtagttcgagcctgcggctgccac

SEQ ID NO: 7978 - DNA, 1293 bp, Artificial Sequence
  Description of Artificial Sequence: Synthetic coding sequence
atgcacgtaagaagtctcagagccgccgcaccacactcattcgtggccttatgggccccacttttccttctgcgctccgcactcgccgatttcagcttggacaatgaggtccacagctcgttcattcatcgacggctccgtagtcaggaacgccgcgaaatgcagcgcgaaattctctctatactgggccttccgcaccgtccccgacctcacctacagggcaaacacaacagcgctcccatgtttatgctcgacctatataatgccatggcagtcgaggagggaggcggccctggtggacagggtttctcttatccttacaaagcagttttttctacacagggaccacccctcgcatcactgcaggattcacactttctgactgacgcagacatggtcatgagtttcgtgaatttggtggagcacgacaaggagtttttccacccgcgttaccatcatcgcgagttcagattcgacctgtccaaaattccggagggagaggctgtcaccgccgcagaattccggatctataaagattatatccgagaaaggttcgataatgagaccttccgcatctctgtttaccaggtgctccaggagcacctcgggcgagagtctgacctctttctcttagatagcagaacactctgggcatcggaggaggggtggctggtgtttgatatcactgcgacaagtaaccattgggtcgtgaaccctaggcacaaccttgggcttcagctgtctgtggagaccctggatggacagagcatcaacccaaaacttgccggcctgattggtaggcacggtcctcaaaataagcaaccctttatggtagcattcttcaaggcgacggaagtgcattttcgatccatcaggagtacaggatctaaacagaggagtcagaaccggtcgaagacaccaaaaaaccaggaggctctgcgaatggcgaatgtagccgagaacagcagctccgaccagcgtcaggcatgcaaaaaacacgagctgtacgtaagcttcagggatcttggctggcaggattggattattgcaccagagggctacgctgcttattattgcgaaggcgaatgtgcattccctcttaatagctacatgaatgccacaaaccacgccatcgtgcaaacccttgtgcattttataaatcccgagaccgtgcctaaaccttgctgtgcccctacccagctgaatgcaatctctgtgctgtactttgacgattcatctaatgttattttaaaaaagtacagaaacatggtggtccgcgcttgcgggtgtcat

SEQ ID NO: 7979 - DNA, 1293 bp, Artificial Sequence
  Description of Artificial Sequence: Synthetic coding sequence
atgcatgtgagatcgttgagggctgcagcgcctcattccttcgtggcactctgggcgccactgttcctgttgcgtagcgcgcttgcagatttttcgctcgataatgaggtccattcctcattcatacacaggcgtctccgctcccaagagcgcagagagatgcaacgcgaaattcttagcatcctggggcttccacatcgccccagacctcatctccaggggaagcacaactcagcacctatgtttatgctcgacctctataacgcgatggcggtggaagaaggagggggacctggtggacaaggattttcgtacccttacaaggcggtcttttcaacgcaaggacctccacttgcgtcgcttcaggactcccactttctcactgatgccgacatggtgatgtcgttcgtgaatctcgtggagcatgataaggaattcttccatccccgctaccatcatagagagtttagattcgatcttagcaagatcccagagggagaagcggtgacggccgccgaatttaggatttacaaagactacatcagagaacggttcgataacgagacgtttagaatatccgtgtaccaagtgctgcaggaacatttgggtcgggaatcagatctttttctgctggattcgagaactctttgggcttccgaggaaggatggctggtgtttgatattaccgccacttccaaccactgggtggtgaacccacgtcataatcttggtctgcagctgtcggttgaaaccctggatgggcagtcaatcaatcccaaactggcgggacttataggccggcacggaccacaaaacaagcagccatttatggtggcattctttaaggccactgaagtgcattttaggagcattcgcagcaccggtagcaagcaaagaagccagaaccgatccaaaacccctaagaaccaagaagctctcagaatggccaatgtcgcagagaactcctcatcagatcagcgacaggcttgtaagaagcacgaactgtacgtgtccttccgggacctgggctggcaggactggattatcgccccagaaggctacgcagcgtactactgtgagggagaatgtgcatttccactcaacagctacatgaacgccaccaaccatgctattgtgcaaaccctcgtccacttcataaatccggaaaccgtgccaaagccctgttgtgcacctactcagctgaacgcgattagcgtcctgtactttgatgactcctctaacgtgatcttgaagaaataccgaaacatggtagtccgcgcatgtggatgtcat

SEQ ID NO: 7980 - DNA, 1293 bp, Artificial Sequence
  Description of Artificial Sequence: Synthetic coding sequence
atgcacgttcgctccctccgagccgctgcccctcactccttcgttgctctctgggctcccctttttctgttaaggtctgccctcgctgatttcagcctggataatgaagttcacagctccttcatccacaggcggcttcgatcacaagaacggagggaaatgcaacgagaaatcctctctatcctcggtttgccacacaggccccggccacacctgcagggaaagcacaacagtgcaccaatgtttatgctggacttgtataatgccatggctgtggaagagggaggtgggccaggaggacagggattcagttatccctataaggcagtgttctctacccagggacctcctctagcatccctgcaagactctcactttctgacagacgccgacatggtaatgtcttttgttaacttagtcgaacacgataaggaatttttccaccctcgttaccatcacagggagttcaggtttgatttgagcaagattcccgaaggagaggcagtcacggctgcagagtttcggatttataaggattacatacgcgagagattcgacaacgagacatttcggatcagtgtttaccaggtgctccaggagcatctaggccgagagtcagatttgttccttctggacagccggaccttgtgggcctctgaggaaggatggctcgtcttcgatatcacagcaacctccaaccattgggtggtgaacccccgccacaacttaggattgcagctcagcgtggagactctggacggtcagtccattaaccctaaactcgctgggctgattggccggcacggacctcagaataagcagccgtttatggtcgcgtttttcaaagcaactgaggtgcactttaggtctatccgttcaacaggcagtaagcagcggtcacagaatcgatccaagacacctaagaaccaggaggccctgagaatggccaacgtagcggaaaactcatcctcggaccagcgacaagcatgcaagaaacacgaactatatgtatcgtttagagacctgggatggcaggactggattattgctcccgagggctacgcagcctactattgtgaaggggaatgcgctttccctctcaattcctacatgaatgctactaaccatgcgatcgtgcagacactggtccatttcatcaatccagagaccgtccccaaaccttgttgcgcccctacacagttgaacgcaatctctgttctatactttgatgatagttcgaatgtaattctgaagaagtacaggaacatggtagtgcgggcctgcggctgtcac

SEQ ID NO: 7981 - DNA, 1293 bp, Artificial Sequence
  Description of Artificial Sequence: Synthetic coding sequence
atgcatgtccgttccttgcgtgccgcagcccctcatagtttcgtggctctgtgggctcctctattcctcctcaggtccgctcttgccgacttttctctggacaacgaagtgcacagctctttcatccaccgccgcctgaggtcacaggaacgaagggaaatgcagcgcgagattctttctatacttggattgccccatagacccaggccacatctgcaagggaaacacaactctgccccaatgtttatgctagacctgtacaatgctatggctgtagaagaaggaggaggccccggaggacagggctttagctatccctataaagccgtcttctctacacaggggccccccttggcttcactgcaggactcgcattttcttactgacgccgacatggttatgtccttcgtgaacctggtggagcacgataaagagtttttccaccccaggtaccatcaccgcgaatttagattcgatctgtctaaaatcccagagggagaagccgtaaccgctgccgaattccggatatacaaggattacattagagagcgttttgacaatgaaacatttaggattagtgtctaccaggttctccaggagcacctggggcgcgagagcgacttgttcctgctggactcccggacgctgtgggctagtgaggaaggatggctggttttcgacattaccgccacctctaaccattgggtggtgaatccccggcacaacttgggcctgcagctgagtgtggagaccctggatggtcagagcattaaccccaagctggctggcctcatcggccgccacggccctcaaaacaaacagcccttcatggtagctttttttaaagctaccgaagtgcatttccgaagcataaggagtacgggctctaagcagagaagtcaaaatcggtctaagacacctaagaaccaggaggcactgaggatggccaatgttgctgagaactcgagcagcgatcagcgccaggcatgtaagaaacacgagctgtacgtgagttttcgagatctaggttggcaggattggatcatcgctcccgaaggctatgcagcctattactgtgaaggcgagtgtgcatttccactcaattcatatatgaacgcaacgaaccatgctatcgtacaaacccttgtgcacttcattaacccagagaccgtacccaagccctgctgcgctccaacccagctgaacgccatctccgtcctatattttgatgactcttcaaacgttatcttgaaaaaatacagaaatatggttgtgcgggcctgcggctgccat

SEQ ID NO: 7982 - DNA, 1293 bp, Artificial Sequence
  Description of Artificial Sequence: Synthetic coding sequence
atgcacgtgcggtccctgcgcgctgccgccccgcactcgttcgtcgccctttgggcacctctctttctgttgcggtcggcgctggcagacttctcattggataacgaggtgcacagctcttttatccaccggcgcctgcggagccaggagcgacgggaaatgcagcgggaaatcctgagcatcctgggcctgcctcaccgtcctagaccccatctccaaggaaagcataattcagcacctatgttcatgttggatctctacaatgctatggcggttgaggaaggagggggtcctggcggtcaggggttctcgtacccctacaaggccgttttctccactcaggggccgccgctcgccagtctgcaggactcacacttcctcaccgacgccgacatggtgatgtccttcgtcaacctggtggagcatgacaaggagtttttccatccacgctaccatcatcgggaattccgctttgatctcagcaaaataccagagggagaagccgtcacggcggccgagttcaggatttacaaggactacattcgcgaacgcttcgataacgaaaccttcaggatcagcgtgtaccaggtgctgcaagaacaccttgggcgcgaaagtgacctgttcctgctcgactcccggaccctctgggcatcggaagaggggtggctggtgttcgacataactgcaacttctaatcactgggtcgtgaacccccggcacaatctgggactccagctgtcggtggagacgttggacggccagtcgattaatccaaaactggccggactcatcggacgccatggaccacagaataaacagccgttcatggtcgcgttctttaaagcgactgaagtgcactttaggagcatcagatcaactggtagcaagcagaggtcgcaaaataggtcgaaaaccccgaagaaccaggaggcccttcggatggcaaacgtggcggagaacagcagtagcgatcaacgacaggcctgcaagaagcatgaactgtacgtgtcgttccgggatcttggatggcaagattggatcattgccccggaaggatacgccgcctactactgcgagggagaatgcgcgttcccgttgaactcctatatgaacgcaactaaccacgccattgtccagaccctggtccacttcatcaacccggaaactgtgccgaagccgtgttgcgctccgacccagctgaacgcaatctcggtgctctactttgacgactcatccaacgtcatcctcaagaagtatagaaatatggtggtgcgcgcatgcggctgccat

SEQ ID NO: 7983 - DNA, 1293 bp, Artificial Sequence
  Description of Artificial Sequence: Synthetic coding sequence
atgcacgtcagatccctgagggctgccgctcctcacagcttcgtggcgctgtgggcacctctgtttctcctaagatctgccctggcagacttcagtctggacaatgaggtccacagttcttttatccatcgtcggctccgctcacaagagaggcgggagatgcagagggaaatcctatccatcttgggacttcctcatcggccaagaccacacctccagggcaagcacaacagtgctcctatgttcatgcttgatttgtacaacgctatggccgttgaggaaggcggaggccccggaggtcagggattctcatacccctataaggcagtgtttagcacgcagggcccaccgctcgcctcccttcaggactcccactttctcacagatgctgacatggtgatgagcttcgtaaatctagttgagcatgacaaagagttcttccacccacgctaccaccacagggaattcagatttgacctgtcaaagattcctgagggggaagcagtgactgctgcagagtttcgaatttataaggactatatcagagaacgttttgataatgaaacctttagaatctccgtgtaccaagtgctgcaggagcatctggggcgcgagtccgatctctttctcctcgatagtcggacgctatgggccagtgaggaaggatggcttgtatttgatatcactgcgacgagcaatcactgggtggttaacccgcgccacaatctaggcttacagctgagtgtagagaccctggacggacagagtattaatccgaagctcgcaggcctgataggaagacatggcccgcagaacaagcaacctttcatggtcgcgtttttcaaggccaccgaggtgcacttcagatctatccggtcgacaggatccaaacagaggtcacaaaacaggtccaaaaccccaaaaaaccaggaagccctgcgtatggccaacgttgcggaaaactcgtcctctgaccagcgccaggcttgcaagaaacacgagctgtacgtgagtttcagagacctcggatggcaggactggattattgcgccagagggatatgccgcatattattgcgaaggggagtgtgcttttcccctgaactcgtacatgaacgccacgaatcacgcgattgtccagacactcgttcatttcattaaccccgagaccgtgcccaagccttgctgcgcccctacgcagttaaatgctatttccgtgctgtattttgacgatagtagcaacgtgattctcaaaaagtacagaaacatggtggtccgcgcttgtggatgtcac

SEQ ID NO: 7984 - DNA, 1293 bp, Artificial Sequence
  Description of Artificial Sequence: Synthetic coding sequence
atgcacgtccgatctttgagggccgctgccccccactccttcgtggctctgtgggccccactgttcctgttgcgcagcgccctagcggacttcagtttggacaacgaagtccacagctccttcattcacaggcgacttcggagtcaagagcgtcgcgagatgcagcgggaaatcctgtcaatcctgggcttgccacacaggccacgacctcatctgcaaggcaaacataactctgccccaatgtttatgcttgatctgtacaacgcaatggccgtggaagaggggggtgggcctggcggccaggggtttagctatccctacaaggcagtcttctccacacaggggccacctctggcttcccttcaggacagccattttctgaccgatgctgatatggttatgagttttgtgaatctggtggagcacgacaaggagtttttccatccacggtaccatcacagggaatttcggtttgacctcagcaaaattcccgaaggtgaggccgtaacagcggctgagttccgcatttacaaggactacatcagagaacgatttgacaatgaaaccttcaggatttccgtgtatcaagtcctccaagaacacctcggacgagaatccgacctcttcctgctggattcaaggacactttgggctagcgaagagggctggcttgtgttcgacattactgccacgtccaaccattgggtggttaaccctcggcacaaccttgggcttcagctaagcgtggaaactctggatgggcagagcatcaatcccaagttggctggcctgatcggcaggcatggcccccagaataagcaaccttttatggtagcttttttcaaagccaccgaagtccactttcgttccattcgaagcaccggcagtaagcagagaagccagaatcgatctaagactcctaagaatcaggaggccctgagaatggccaatgtggctgagaactcgagcagcgatcaacgccaagcctgtaaaaaacacgagctatatgtcagctttcgagacctggggtggcaggattggatcattgcaccagagggttatgctgcttactactgcgaaggtgaatgtgcctttccactcaactcctacatgaatgcaaccaatcacgcgattgtccagacactcgtgcattttattaatcctgaaacggtgcccaagccctgctgcgcccccacacagcttaacgcgattagtgttttgtactttgacgacagtagcaatgtaatcctcaaaaagtatcggaacatggtggtgcgcgcctgtgggtgccac

SEQ ID NO: 7985 - DNA, 1293 bp, Artificial Sequence
  Description of Artificial Sequence: Synthetic coding sequence
atgcatgtgcgttctctccgggcagcggctcctcattcattcgtggcactgtgggcccccttgttcctgctgcggtccgctctggctgatttctcactggacaacgaggtgcactcgtcgttcattcatcggcgcctgaggagccaagagcgccgagagatgcagagggaaattctttctatcctgggccttccacaccgccccagacctcacctccaggggaagcataattcagccccgatgtttatgcttgacctctacaacgcgatggcggtggaggagggcgggggcccgggaggacaaggtttcagttacccatacaaggccgtcttttccacccaggggccaccgctcgcatccttgcaggattcacacttcctgactgacgccgatatggtgatgtccttcgtcaatctcgtcgaacatgataaagagttttttcaccccaggtaccaccacagggaatttcggttcgatctctcaaagattccggagggagaagccgtgacggcagccgaattccggatctacaaggattacatccgggagcggtttgacaatgaaactttccggatttcggtgtaccaggtccttcaagaacatctgggccgggaatccgacctgttcttgctcgacagccgcactctgtgggcatccgaggagggatggcttgtgttcgacatcaccgctacctcgaaccactgggtggtgaaccccaggcacaatctgggcctccaactctcggttgaaaccctggatggacagtcaatcaacccgaaactggctggactgatcggcagacacgggccgcagaacaaacagccgttcatggtggcatttttcaaggcaaccgaggtgcatttcagatccatcaggagcactggatccaagcaacgctcgcagaatcggtccaagactcctaaaaaccaggaggcgcttcgcatggctaacgtggcggaaaattcatcctcagatcagcggcaagcgtgcaagaagcacgagctctacgtctccttccgggatctcggatggcaggactggatcatcgcaccagaggggtacgccgcctactattgcgagggagagtgcgcatttcccctgaactcctacatgaatgcgactaaccatgccattgtccagaccttggtccacttcatcaatccggaaactgtccccaagccttgttgcgcgccgacccagctgaacgcaatctccgtgctctacttcgacgattcaagcaacgtcattctcaagaaatatcgcaatatggtggtgagggcatgcggctgccat

SEQ ID NO: 7986 - DNA, 1293 bp, Artificial Sequence
  Description of Artificial Sequence: Synthetic coding sequence
atgcatgtccggtctttgagggctgctgcccctcattcgtttgtcgcactctgggcccctcttttcctgctgcgctcagcacttgctgatttctccctggacaacgaagtgcattcgagctttattcatcgtagactcagatcgcaggagagaagagagatgcagagagaaatcctgtccattctgggactgccacatagacctagaccacaccttcaaggcaaacataattcagcaccgatgtttatgcttgacctttacaatgccatggccgtggaagaagggggaggtcctggggggcaaggattttcgtacccttacaaggctgtgttttcgactcagggccctcccctcgcatcacttcaggactcccatttccttaccgacgccgacatggtcatgtcctttgtgaacctggtggaacatgataaggaattctttcatccccggtaccatcatagagaatttcggttcgatttgtccaaaatacctgagggagaagctgtgaccgctgcagagttcaggatctacaaagattacatacgagagcgtttcgataacgaaacttttcgcattagcgtgtaccaggtgctgcaagaacatctgggaagagagtccgatctgtttctgctggacagcagaactctttgggcatcagaggagggctggcttgtctttgatattactgctacttcgaaccattgggtggtgaatccacgtcacaacctgggtttgcagctgagcgtggaaaccctggatggacagtccatcaacccaaagctcgcaggcctgatagggagacatggaccccagaacaagcagccatttatggtggcattctttaaagcaacggaagtgcactttcgatctattcggagcaccggcagcaagcagcgctcccaaaaccgctcaaagacgcccaagaaccaagaagcactcagaatggccaatgtcgcagagaactcgtcgagcgaccagcgtcaagcatgtaaaaagcacgagctctacgtgtcatttcgcgatctcggatggcaggattggataattgctcctgaaggatacgcagcttattactgtgaaggagaatgcgcctttccgttgaattcgtacatgaatgcaactaatcatgcaattgtgcagactcttgtgcactttatcaacccagagactgtccctaagccatgttgtgcgcctacccagctgaacgctatctccgtcctttactttgatgatagcagcaacgtcattcttaagaagtaccgtaacatggtcgtccgggcatgcggttgccac

SEQ ID NO: 7987 - DNA, 1293 bp, Artificial Sequence
  Description of Artificial Sequence: Synthetic coding sequence
atgcatgtgaggtcactgagggcggccgcgcctcatagctttgtggctctgtgggcacccctgtttttgctccgcagcgcgcttgctgacttttccctggataatgaggtgcacagctccttcattcacaggaggcttcggagccaggagcgccgcgagatgcaaagggaaatcttgtcaattctcggccttccccatcgcccaaggccacatttacagggaaagcataacagcgcccccatgttcatgctcgatctgtataacgccatggctgtcgaggaaggtgggggacccggtggacaaggcttcagttacccatacaaagccgtattcagcacccaggggcctccactggctagcctccaggacagccattttctgactgacgcagacatggtgatgtccttcgtgaaccttgtggagcacgacaaagagttctttcaccctcgatatcaccatagagagttccgcttcgacctgtctaagattccagagggagaagctgtgacagccgccgaattccgaatttacaaggattacattcgagaaaggttcgacaacgagacattccgcatctctgtgtatcaggtgttgcaggagcatctggggcgggagtcagacctctttctgctggattcccgtactctttgggccagtgaggagggatggttagtgttcgatataactgccacatctaatcactgggtggtcaacccccggcataatctgggtctacagctcagtgtggaaactctggacggacaaagtatcaaccctaagctggccggacttatcgggcgccatggcccccagaacaagcagcccttcatggtggcgtttttcaaggcgacagaagtgcatttccgaagcatccgatctaccggttccaaacaaaggagccagaatcggagtaaaaccccgaagaaccaagaagctttgcgaatggcgaacgtggccgagaacagcagttccgaccaaagacaggcctgcaaaaagcacgagctgtacgtgtcatttcgtgacctgggatggcaggattggatcatcgcaccagaaggatatgccgcctattactgtgagggagaatgcgcttttccactgaactcatatatgaacgccactaaccatgcgattgtgcagacactcgtacatttcatcaatcctgaaacagttcccaagccttgttgtgcacccacccaattaaacgccatctccgtcctgtacttcgacgacagctcaaacgtgattctgaagaagtataggaacatggtggtgagagcttgtggttgtcac

SEQ ID NO: 7988 - DNA, 1293 bp, Artificial Sequence
  Description of Artificial Sequence: Synthetic coding sequence
atgcacgttaggtccctcagggccgccgcgccacatagtttcgtggccctctgggcacccctcttcctgctgcggtcagcgctagctgatttttctctcgacaacgaagtccatagctcctttatccaccgacggctccgctcacaggaacgccgggagatgcagcgggagattcttagtatccttggcctgccacaccggcccagaccacacttgcagggtaagcataacagcgcacctatgttcatgcttgacctgtacaatgcgatggccgttgaggaaggagggggaccaggcggccaggggtttagctacccatacaaagccgttttctctacgcagggaccacccctggcttccttgcaagactcacattttctcaccgacgcagatatggtgatgagctttgtgaaccttgtcgaacatgataaagaattttttcaccccaggtaccatcaccgggagttccgcttcgacctgagcaagattcccgaaggagaggctgtcaccgccgcggagtttcgcatctacaaggactacattagggagaggttcgataacgaaacatttagaatctccgtctatcaggttctgcaggaacacttagggagggagagtgacctgttccttctcgatagtagaactctgtgggccagcgaggaaggctggttagtgttcgatattacagccacatccaatcattgggtcgttaacccacgccacaatctgggtctgcagctctctgtggaaaccctggacggccagagcatcaaccctaaactcgctggattgattgggagacacggaccacagaataaacagccttttatggtggccttttttaaagcaactgaagtccacttccgctcaatacggagtaccggatcaaagcagagaagtcagaaccggtctaaaacgcccaagaaccaggaggcactccgaatggctaatgttgctgagaatagcagtagtgaccaacgccaagcctgcaagaaacacgagctctacgtttccttccgggatctgggttggcaggattggatcattgcacctgagggatacgcggcctactactgcgagggggagtgcgcttttccccttaattcatatatgaacgcgaccaatcatgccattgtccagacactcgttcattttattaaccccgagacagtcccaaaaccctgctgcgctcccacccagctgaacgctatctctgtcttgtactttgatgacagctctaatgtgatactgaaaaagtatcgcaatatggtcgttagagcatgtggctgtcac

SEQ ID NO: 7989 - DNA, 1293 bp, Artificial Sequence
  Description of Artificial Sequence: Synthetic coding sequence
atgcacgtgaggtcactgagagcagcagctccccactcatttgtggcactttgggcgccattgtttctgttgcgtagcgcccttgcagatttcagccttgataacgaagtgcattcctcgtttatccatcgtcggctgagatcacaagaaagacgagaaatgcagcgggaaattctttcgattctcggtctgccgcaccgccctagacctcatcttcaaggtaagcataactcggcccctatgtttatgttggatctgtacaatgcgatggccgtcgaggaagggggtggtccgggagggcagggcttttcctacccgtataaggccgtcttttctacccaagggccaccactcgcgtcccttcaagattcgcactttcttacggatgcagacatggtcatgtcgttcgtgaacctcgtggaacatgacaaggagttttttcatcctcgctaccatcatcgcgagttccgatttgatctgtccaaaataccggagggagaagcggtgaccgcagcagagtttcggatctacaaagactacatacgtgaaagatttgacaacgaaaccttcagaatctccgtctaccaggtgctgcaagaacacctcggacgcgaatctgatctttttctcctcgattctcggactctgtgggcttccgaagaagggtggctcgtgttcgacatcacggcaacctcaaatcactgggtggtgaatccccggcacaatctgggactgcagctgtcggtcgaaacgctcgatgggcagtcaatcaatcctaagctggccggcctgataggtcgtcatggacctcaaaacaagcagccatttatggtggcattctttaaggcaactgaagtgcatttcagaagcattagatccaccggaagcaaacaacggtcgcaaaaccgatccaagactccgaaaaatcaggaggctcttcggatggccaacgtggcagaaaactcatcgtcagatcaacgccaggcgtgtaagaagcatgaactttacgtgtccttccgagatctgggttggcaagactggattatcgcaccggagggctatgcagcctactactgcgaaggagagtgtgcttttcctcttaatagctacatgaacgcaaccaatcacgctatagtccagactttggtgcatttcatcaaccccgaaacggtgccaaagccctgttgcgcacctactcaactcaatgccatttcagtcctgtactttgatgattcatccaacgtcattctgaagaagtacaggaacatggtggtcagagcttgtggctgccac

SEQ ID NO: 7990 - DNA, 1293 bp, Artificial Sequence
  Description of Artificial Sequence: Synthetic coding sequence
atgcacgtgcgctcactccgggccgccgccccgcacagcttcgtggcgttgtgggctccactgttcctgctgcgcagtgcgctggctgatttctccctggataacgaggtccactccagcttcattcacagacgcctccggagccaggaacgccgcgagatgcaacgcgagatcctgtccatccttggactgccacatcggccgcgcccgcatttgcaggggaaacacaatagcgctcccatgttcatgctggacctctacaacgcgatggccgtcgaggaaggaggaggacctggaggtcagggattttcctacccatacaaggccgtgttctcgacccagggtccgccactcgcgtccctgcaggattcacacttcctgaccgatgcggatatggtgatgtcttttgtcaacctggtggaacatgacaaggaattcttccacccacgctaccatcacagagaattccggttcgacctctccaagatcccagaaggcgaagccgtgactgccgctgaatttagaatctacaaggactatatccgagaaaggttcgacaacgagacgtttcgcatctcggtctaccaggtccttcaggagcacctggggcgcgagtccgacctcttcctgcttgactcacgtactctgtgggcatcggaggaaggatggctggtctttgacatcactgccaccagcaatcactgggtggtcaacccgcggcacaatcttggattgcaattgtcagtggaaaccctcgacggacaatccatcaaccctaagttggccggtctgatcgggagacatggcccgcagaataagcaaccttttatggtggcatttttcaaagcaactgaagttcacttccggtcgattagatcgactggcagcaagcaaaggtcacagaacagatccaagacccccaagaatcaggaagcactgcggatggccaacgtcgcagagaacagctcatcggaccagaggcaggcttgcaaaaaacatgaactctacgtgtcattccgggatctcggatggcaagattggatcatcgcgccggagggctacgctgcctactattgcgaaggcgagtgtgccttcccgctcaactcgtacatgaatgcgaccaaccacgcaatcgtgcaaactctcgtgcatttcatcaatcctgagacggtgccgaagccttgttgcgcccccacccagctgaacgcaatatcggtgctgtacttcgatgactcgagcaacgttattctgaagaaatacaggaatatggtggtgcgggcgtgcggctgccat

SEQ ID NO: 7991 - DNA, 1293 bp, Artificial Sequence
  Description of Artificial Sequence: Synthetic coding sequence
atgcatgtgcggagtctacgagctgcagcccctcactccttcgtggcattatgggcccccctgttcctgctcaggagtgctcttgcggatttctcgcttgataatgaggtgcattcctcttttatccacagacggctcaggagtcaggaaagacgggaaatgcagagagaaatcctctcaatactcgggcttccgcataggcctcggcctcatctccagggaaaacataattccgccccaatgttcatgttagatctttacaacgctatggccgtcgaagaagggggagggcctggaggacagggattctcctatccctataaagccgttttcagtactcaggggccccccctcgcctctctgcaggactcgcatttcctaactgatgctgatatggtgatgagtttcgtgaatctggttgaacacgataaagaattctttcatccaaggtaccatcaccgcgaattcaggttcgatttatcaaaaatccctgagggagaggcagttacagccgctgagttcaggatctacaaggattacataagggaaaggtttgacaatgaaacgtttcgcatttccgtgtatcaggttctccaggaacatcttggacgggagtcagatctctttttacttgacagtaggactctatgggcatctgaagaagggtggctagtcttcgatataacggcaacatctaatcactgggtagtgaatcctcggcacaacctggggctccagctctctgtagagacattagatgggcagtctataaatcctaaattagccggactgataggaaggcacgggcctcagaacaaacagcctttcatggtcgcatttttcaaagcaactgaagttcactttagatctatcagatcaacagggtccaaacagaggtcccagaaccggtccaagacacctaagaatcaggaggccctgcgcatggccaatgttgcagagaattcctctagtgatcagcgacaggcatgcaaaaaacacgaactctatgtttcctttcgcgacttagggtggcaagactggatcatcgcccctgaaggatacgccgcctattattgtgagggggaatgtgcctttcctctcaattcgtatatgaacgcgactaaccacgccatcgtgcagacactcgtgcactttattaacccagaaactgttcccaaaccctgctgcgcacccacacagctcaacgccatctcggtactctatttcgatgattcctccaacgtgatactgaaaaaatataggaacatggtcgtcagggcatgcgggtgtcac

SEQ ID NO: 7992 - DNA, 1293 bp, Artificial Sequence
  Description of Artificial Sequence: Synthetic coding sequence
atgcacgtgaggtctttgcgggccgccgctccacacagcttcgtggcactttgggcacctctgttcctgctccggtcggccctggcggacttttcattggacaatgaggtgcacagctcgttcatccacagacgcctcagaagccaggaacggagagaaatgcagcgggaaatcctctctatcctgggactcccgcatcggccgcgcccccatctccaggggaagcataacagcgccccgatgtttatgctcgacctgtacaatgccatggccgtggaagaagggggcggacccggcggccaagggttctcgtacccctacaaggccgtgttttcgactcagggaccgccgctcgcttccctgcaggacagtcatttcctcactgacgctgatatggtgatgagctttgtgaatctggtggaacacgataaggagttcttccacccccgctaccatcaccgagagttccgctttgacctctcaaagatcccggagggagaagctgtgaccgcagccgagtttcggatctacaaagattacatccgcgaacggtttgacaacgaaacctttcgcatcagcgtgtaccaagtcctgcaagaacatctgggaagagagtcagacctgttcctgctggacagccggaccctctgggcaagcgaagagggatggttggtgttcgacatcactgcgacctccaaccattgggtggtgaaccctcgccacaatctgggcttgcaactgtccgtggaaaccctggatggacagtcgattaatccaaaacttgccgggttgattggtcgccacggcccacagaacaagcaacctttcatggtggcatttttcaaggcgaccgaagtgcactttaggtccatccgctccactggctccaagcagcgaagccagaatcgctcaaaaactcctaagaaccaggaagcgctgcggatggcaaatgttgcagaaaattcctcgtcggaccaaaggcaggcctgcaagaaacacgaactgtacgtgagcttcagagatttggggtggcaagattggatcattgccccggaaggatacgcggcgtactactgcgaaggcgagtgcgcctttcccctcaactcttacatgaacgccacgaaccacgccatcgtgcagacgcttgtgcatttcatcaaccctgaaactgtcccgaaaccttgctgtgcaccgacccagctcaacgctatctccgtgctgtacttcgatgactcgtccaatgtgatcctcaagaaatacagaaacatggtggtgcgcgcatgtggctgccac

SEQ ID NO: 7993 - DNA, 1293 bp, Artificial Sequence
  Description of Artificial Sequence: Synthetic coding sequence
atgcacgtgcggtcgttgcgcgcagcagcccctcatagctttgtggcattgtgggctccattgttcctcctccgatccgcactcgctgacttctccctcgataacgaagtgcacagtagctttattcaccgccggctgcgctcacaggaacggagggagatgcagcgggagattctctccatcctgggactgccccaccgtccccgcccacatctgcagggcaagcacaactcggcccctatgttcatgcttgacctgtacaacgctatggcagtggaagaggggggtgggcctggcggacaaggattttcgtacccttacaaggctgtgtttagcacccagggtccaccacttgcgtcgcttcaggactcacatttcctcaccgacgctgatatggtgatgtcattcgtgaatctggtggagcatgataaggagttcttccaccccaggtaccaccacagagaattcagattcgatctgtcgaaaataccggagggcgaagccgtgactgccgcggaatttcgcatttacaaagattacatcagagaaaggttcgacaacgaaactttccgcatctcggtataccaggtgttgcaggaacatctgggcagagagtctgacctttttcttctggacagccggaccctgtgggcctccgaggagggatggctggtgttcgacatcaccgccacgtcgaatcactgggtggtgaatcctcgccataatctggggcttcaactgtcggtcgaaaccttggacggtcagtcaattaacccaaaactggccggactcattggtcgccatggacctcaaaacaagcagccctttatggtcgcgttctttaaggcaactgaggtgcattttagatccattcggagcaccggctccaaacagagaagccagaatcggtccaagactcccaagaatcaggaagcgctgcggatggccaatgtggccgagaattcgtcaagcgaccaacgccaggcctgcaaaaagcacgagctctacgtctccttcagagacttgggttggcaggactggatcatcgcaccagagggctacgctgcatactactgtgagggcgagtgcgcctttccgcttaactcatacatgaacgcgaccaatcatgccatcgtccagaccctggtgcactttatcaaccctgaaactgtgcctaaaccgtgctgcgccccgactcagctgaacgccatcagcgttctctacttcgacgattcctccaacgtgatcctcaagaaatatcgcaacatggtcgtcagagcctgcgggtgccac

SEQ ID NO: 7994 - DNA, 1293 bp, Artificial Sequence; identical to SEQ ID NO: 7947
  Description of Artificial Sequence: Synthetic coding sequence

SEQ ID NO: 7995 - DNA, 1293 bp, Artificial Sequence
  Description of Artificial Sequence: Synthetic coding sequence
atgcatgttcgctcgctccgcgccgctgccccgcattcattcgtggcgctctgggcccctctcttcctgctgcgcagcgcgcttgcggacttttccctggataatgaggtgcacagttccttcatccacagacgcctgcgtagccaagaacggcgggaaatgcagcgagagatcctctcaatcctggggctcccacaccggccgcgccctcacctgcaaggcaaacataatagcgctccgatgttcatgctggatctgtataacgccatggctgtggaagaaggaggcggaccgggcggccagggcttctcgtacccatacaaggctgtcttttcaacccaaggtccgccacttgcttcgttgcaagattcacacttcctcaccgacgcggacatggtgatgtctttcgtgaatctcgtggaacacgacaaagagttcttccaccctcggtaccatcatcgtgagttccgctttgacctgtcaaagatcccagaaggagaggcggtgactgcagcagagttcaggatctacaaagattacattcgcgaacggttcgataacgaaactttccgcatctcagtctaccaagtcctgcaggagcacctggggagggaatcggacctgttcctgctcgactccagaaccctctgggcttccgaagaaggatggctggttttcgacattaccgcgactagcaaccattgggtggtcaatcctcgacataatctggggctgcagttgtccgtcgagactttggacggacagtccatcaaccctaaactcgcggggttgatcggtagacacggaccccagaacaaacagccgttcatggtggctttctttaaggcaaccgaggtgcactttaggagcatccggtcgactggatcgaagcagcgtagccagaatcggtccaagaccccgaagaatcaggaggccctgcgtatggctaacgtggccgaaaacagcagctcggatcaacggcaggcatgcaaaaagcatgaattgtacgtgtcgttccgcgacctcggctggcaagactggataatcgcaccagaaggttacgccgcatactactgcgagggagagtgcgcctttccccttaactcctacatgaacgcaaccaatcacgcgattgtgcagacgctcgttcacttcatcaacccggaaaccgtgcccaagccctgttgtgctccgacgcagcttaacgccatttctgttctctattttgacgatagttccaacgttatcctgaagaagtacagaaacatggtggtcagggcctgcggttgccat

SEQ ID NO: 7996 - DNA, 1293 bp, Artificial Sequence
  Description of Artificial Sequence: Synthetic coding sequence
atgcatgtgaggtcgcttcgtgcagccgcacctcattcctttgtggcactttgggcccccctgttccttttgaggtcagcactcgccgatttcagcctggataacgaagtgcattccagcttcatccatagacgactgcggtcccaggaacggcgcgaaatgcagagggaaatcctctcgattctcgggctcccccatcgtcccaggccccaccttcaaggaaagcacaacagcgcgcctatgtttatgctggacttgtacaatgcaatggctgtcgaggaggggggaggacctggagggcaggggtttagctacccctacaaggcagtgttttcgacccagggaccgcctcttgcatcgcttcaagatagccacttcctgaccgacgcagatatggtgatgtcgtttgttaacctcgtcgagcatgataaggagtttttccatcctagataccatcatagggaatttagatttgatctgtccaagattcctgagggtgaggcagtgaccgcggccgaatttcgtatctacaaggattacattcgggaaagatttgataacgaaacttttcgcatctcggtgtaccaggtgcttcaggaacaccttggaagagagtcggatcttttcctgcttgactctcggaccctctgggcatccgaagaaggctggctggtctttgacatcactgccacttctaatcattgggtcgtgaatcctcgccataacctgggccttcagttgtccgtggagacgctggacggacagtccattaatcccaagttggcaggtcttattggacggcatggaccacagaacaaacaaccatttatggtcgcctttttcaaggcgaccgaggtgcactttcgtagcattagatccactggatccaagcagcggtcacaaaatcgctcgaaaacccctaagaaccaggaggcccttagaatggctaacgttgcagagaactcctcgtccgatcagcgccaagcctgtaagaaacatgagctttacgtgtcgttcagggatcttggatggcaagattggatcattgcaccggagggatacgcggcatactactgtgaaggggaatgtgcatttcctctgaattcttacatgaacgcaactaatcatgccattgtgcagaccctggtgcacttcataaacccagagactgtccctaaaccgtgctgcgcccctacccagcttaatgcaatctcggtcctgtactttgatgactcgtcgaatgtgatcctcaagaagtaccgaaacatggtggtgcgcgcatgcggttgtcac

SEQ ID NO: 7997 - DNA, 1293 bp, Artificial Sequence
  Description of Artificial Sequence: Synthetic coding sequence
atgcacgtccggtcgctccgcgccgccgccccgcactccttcgtggctctctgggccccgctgtttctgctgcgctcggccctcgctgacttctcgctggacaacgaggtgcacagctcgtttatccaccgccgcctccggagccaggagcgacgggagatgcagagagagatcctgtcgattctcggactgcctcacaggccgcggccccacttgcaggggaagcataattccgcaccaatgttcatgctggatctctacaatgccatggcagtggaagagggcgggggcccgggaggacaggggttttcctacccatacaaagccgtcttttccactcagggaccacccctggcttcgctgcaagattcgcacttcctgaccgacgcagacatggtgatgtcgttcgtgaatctcgtggaacatgataaggagtttttccacccacggtaccaccatcgcgagtttcggtttgatctttcaaaaatcccggaaggagaagccgtgaccgcagctgaattccgcatctacaaggactacatccgcgagcggttcgacaacgagacgttccggatctctgtgtaccaggtgctgcaggaacacctcggccgcgagtcggatctctttcttttggactcacgcactctgtgggcctcggaagaaggttggctggtgtttgatatcactgcgacttccaatcactgggtggtgaatccacggcacaatctcggactccagctgtccgtggaaaccctcgacggacaatcaattaacccaaagctggcaggtttgattggacggcacggcccacaaaacaagcaaccgttcatggtggcgttcttcaaggccacggaggtccacttccgatccatcaggagcaccgggtccaagcagcggagccagaatagatccaagacccctaagaaccaagaggcgctgcgcatggcgaacgtcgcagagaacagcagcagcgatcagagacaggcatgtaagaagcatgaactctacgtgagctttagagatctgggctggcaagattggatcatcgcgcccgaaggatacgcggcatactactgcgaaggggaatgtgcctttcccctcaattcgtacatgaatgcgacgaaccatgccatagtccaaaccctggtgcacttcatcaaccctgagacggtgccaaagccgtgttgtgccccgacccagctgaacgcaatctccgtcctgtatttcgacgattcctccaacgttatcctgaagaaataccggaatatggtggtccgcgcatgtggctgccat

SEQ ID NO: 7998 - DNA, 1293 bp, Artificial Sequence
  Description of Artificial Sequence: Synthetic coding sequence
atgcatgtgaggtcactgcgcgcagctgctcctcatagcttcgtagcactgtgggcccctctgtttctcttgcgatcggcgttggccgacttcagcctcgataatgaggtccacagttcctttattcaccggagactgaggagccaggagaggcgagaaatgcagagagagatcctgagcatccttggcctccctcataggccccggccgcatctgcagggaaaacacaactccgcacccatgtttatgctggatttgtacaacgctatggccgtggaagagggtgggggacctggagggcagggcttttcttatccctataaagccgttttttcaacccagggtcctccactggcctcactccaggactctcactttttgaccgacgcagatatggtcatgtcttttgtgaacttggtcgaacatgacaaggaattctttcacccccggtaccaccacagagagttcagattcgacttaagcaagatccccgaaggggaagctgtgacagccgcggaatttcgcatctataaggactacataagagaacgattcgataacgagacattccggataagtgtctaccaggttctgcaggaacatctggggcgcgagtcagacttgttcctgctggatagccggaccttatgggcttcagaggaggggtggctggtgttcgatataacggcgacctcgaatcactgggtggtcaacccccgacataacctgggactgcagttatccgtcgagaccctcgacggccagagcataaatccgaagctggccggacttattggcaggcacggtccccagaataagcagcctttcatggtggccttcttcaaggccacagaggtgcacttcaggtctattaggtccactggctccaagcagcggtctcaaaaccgttcaaagacccccaagaatcaggaagccctgaggatggccaatgtggctgaaaacagttctagcgatcagagacaggcatgcaaaaagcacgagctgtatgtttctttccgggacttgggatggcaagattggatcatcgctccagaagggtacgctgcgtactattgcgaaggcgaatgcgcgttcccactcaacagttacatgaacgcaactaatcacgccatcgtacagaccctggtccatttcattaatcctgaaaccgtcccaaagccgtgttgtgcgcctactcagctgaatgctatctcagtcctctattttgatgactcctctaacgtcatcttgaaaaaataccgcaatatggtcgtgagggcatgcgggtgccac

SEQ ID NO: 7999 - DNA, 1293 bp, Artificial Sequence
  Description of Artificial Sequence: Synthetic coding sequence
atgcacgtgcggtcgctccgggcggctgcccctcactcctttgtggccctctgggccccgctgttcttactgcggagcgctctagctgatttttcacttgataacgaagtgcatagcagtttcattcaccgtagactcagatctcaggagagacgagagatgcaacgggaaatcttatccatcttgggccttccccaccgaccaaggcctcacctgcaaggaaagcacaactctgcccccatgtttatgctggatctatataacgccatggctgtagaagagggaggcggcccgggtggccagggcttcagttatccgtacaaggctgtcttctccacgcagggtcctccccttgctagcttgcaggatagccacttcttgacagatgcagatatggtcatgtcatttgtaaacttggttgaacatgacaaagagttctttcatccccgatatcatcatcgggagtttagattcgaccttagcaagatccctgaaggtgaggctgttacagccgcggaatttagaatatacaaggattatattcgcgagaggttcgacaatgagacttttagaatttctgtgtaccaggtactccaggagcacctgggccgcgaaagtgatcttttcctgttagattcaagaacactgtgggcaagcgaagaggggtggttagtctttgatatcacagcgacttctaatcactgggtagtaaatccccgtcacaatctgggcctgcagctttccgtcgagactctcgatgggcagtcaattaatcccaaactcgccggactgataggacgccatgggccgcagaacaagcaacctttcatggtagcattctttaaggctacggaagttcacttccggagtattcgtagcaccggatcgaaacaacgtagccagaaccgatccaagactcctaagaaccaggaggcactcaggatggcaaatgtagctgagaattcatcgtccgatcagaggcaagcctgcaaaaagcacgaactctacgtctcattccgggatctgggatggcaagactggattatcgcccctgaaggctacgccgcatattattgcgagggagagtgcgcgttcccactgaactcatacatgaacgccacaaatcacgctatagtccagacactggtacatttcataaatcccgagaccgtccccaaaccgtgctgtgcaccaacacagttaaacgcaatctctgtgctttacttcgacgattctagtaacgtgatcctgaagaaataccgcaacatggtggtgagagcctgtgggtgtcat

SEQ ID NO: 8000 - DNA, 1293 bp, Artificial Sequence
  Description of Artificial Sequence: Synthetic coding sequence
atgcatgtacgttcgttacgagcggcggcgccgcattcgtttgtagcgctatgggcgccgttatttttattacgatcggcgctagcggatttttcgttagataatgaagttcattcgtcgtttatacatcgacgactacgatcgcaagaacgacgtgaaatgcaacgagaaatattatcgatattaggtttaccgcatcgaccgcgaccgcatttacaaggtaaacataattcggcgccgatgtttatgctagatttatataatgcgatggcggtagaagaaggtggtggtccgggtggtcaaggtttttcgtatccgtataaagcggtattttcgacgcaaggtccgccgctagcgtcgctacaagattcgcattttttaacggatgcggatatggtaatgtcgtttgttaatctagtagaacatgataaagaattttttcatccgcgttatcatcatcgagaatttcgatttgatttatcgaaaataccggaaggtgaagcggtaacggcggcggaatttcgtatatataaagattatatacgtgaacgatttgataatgaaacgtttcgaatatcggtatatcaagtattacaagaacatctaggtcgtgaatcggatttatttctattagattcgcgaacgctatgggcgtcggaagaaggttggctagtttttgatataacggcgacgtcgaatcattgggtagtaaatccgcgacataatttaggtttacaactatcggtagaaacgttagatggtcaatcgataaatccgaaattagcgggtttaataggtcgtcatggtccgcaaaataaacaaccgtttatggtagcgttttttaaagcgacggaagttcattttcgttcgatacgatcgacgggttcgaaacaacgatcgcaaaatcgttcgaaaacgccgaaaaatcaagaagcgctacgtatggcgaatgttgcggaaaattcgtcgtcggatcaacgacaagcgtgtaaaaaacatgaattatatgtatcgtttcgagatttaggttggcaagattggataatagcgccggaaggttatgcggcgtattattgtgaaggtgaatgtgcgtttccgctaaattcgtatatgaatgcgacgaatcatgcgatagtacaaacgttagttcattttataaatccggaaacggttccgaaaccgtgttgtgcgccgacgcaactaaatgcgatatcggttctatattttgatgattcgtcgaatgtaatattaaaaaaatatcgtaatatggttgttcgtgcgtgtggttgtcat

SEQ ID NO: 8001 - DNA, 1293 bp, Artificial Sequence
  Description of Artificial Sequence: Synthetic coding sequence
atgcatgtgcgctctttacgagccgccgctccccatagctttgtcgctctgtgggctcctctgtttctgctgagaagcgctctggctgacttcagtttagacaacgaggtccattcttccttcatccatcgaagactcaggagtcaggaacgtagggaaatgcagagagagattttgtcaatactcggcctgccccaccggccccgtcctcatctgcagggaaagcacaacagtgcccctatgtttatgctggacctgtataacgccatggccgtagaggagggcggaggccctggaggacaaggtttcagctacccttataaggctgtgtttagtacacagggaccaccactggccagtctccaagactctcatttcctgaccgatgcagacatggttatgagctttgttaatttagttgaacatgataaggaattcttccatcctaggtaccaccaccgggagttcaggtttgatctgtctaagatccctgagggcgaggctgttaccgctgctgagttcaggatctataaggactacattcgggagcgcttcgataatgagactttcaggattagtgtgtatcaggtcctgcaggagcatctgggccgtgagagcgacctatttctgctggactccaggaccctgtgggctagtgaggagggctggctcgtgttcgatataaccgctacatctaaccactgggtcgtgaatcccaggcataacctgggcctgcaactcagtgtggagacactggacggccagtccattaatcctaagctggcaggcctgatcgggaggcacggccctcagaacaaacagccatttatggtcgcttttttcaaggctacagaagtgcactttagatccatccgaagcacaggatccaagcagcgaagccagaatcgcagcaagacacccaagaaccaggaggcactgcgtatggccaacgtggccgaaaacagttccagcgatcagcgtcaggcatgtaaaaagcacgaactgtacgtgagtttccgggatctgggctggcaggattggatcattgctcccgaaggatacgccgcttactattgtgagggggagtgcgcttttccgctgaacagttatatgaatgcaaccaaccacgcaatagtccagaccctagtgcactttatcaacccagagacagtgcccaagccctgttgcgccccgacacagctgaacgctatcagcgtcttatacttcgatgattcatctaacgtgatactgaagaagtaccgaaacatggtcgtgagagcctgcggctgtcac

SEQ ID NO: 8002 - DNA, 1293 bp, Artificial Sequence
  Description of Artificial Sequence: Synthetic coding sequence
atgcatgtaaggtctctgcgcgccgcagcccctcattccttcgttgcactatgggcccccctatttctactaagaagtgcgttagctgacttctccctcgacaacgaagtgcattcatcattcatacatagacggctcagatctcaggaacgacgggaaatgcagcgggaaatactctcgatattggggttgccacatcgcccaagaccacacctccaggggaaacacaactccgctcctatgtttatgctcgatctctacaacgcaatggcagtagaagaaggaggaggaccaggaggacagggattctcttatccgtacaaagccgtgttttctacacaggggccacctcttgcgtctctgcaggatagtcatttcctcactgatgccgacatggtgatgtcattcgtaaacctcgttgaacatgataaagaattttttcatccccggtatcatcatagagaatttcggtttgacctgagtaaaatacccgaaggagaggctgtgacagccgccgaattccggatctataaagattatatccgcgaacgtttcgataacgaaacatttcggatatccgtttatcaggtacttcaggaacatctaggaagagaatccgatttattccttctggacagtagaacattatgggcttccgaggaaggatggttagttttcgatataacagcaacatcaaaccattgggtagtaaaccctagacacaacctcgggctacagctgtctgttgaaacacttgatgggcagagtatcaatcccaaattggccgggctgataggacggcatgggccccaaaataaacaaccctttatggttgcattcttcaaagccactgaagtgcatttccggagtatccgctcaactgggtccaaacagagaagtcagaatcggtccaaaacaccaaaaaatcaggaagcattacggatggccaatgtggctgagaattcctcctccgaccaaaggcaggcctgcaagaaacacgaactatatgtctctttcagggatctggggtggcaggattggataatagctcctgaaggatatgccgcttactattgtgaaggagagtgcgcttttcccctcaacagttatatgaacgcaacaaatcacgctattgtgcagacgttagtacactttataaatcctgaaactgtgccaaaaccatgttgtgcccctacacagttgaacgcgatttcagtcctttacttcgatgatagttcgaacgtgatcctcaaaaaatatcggaatatggtcgtgagggcttgcggatgtcat

SEQ ID NO: 8003 - DNA, 1293 bp, Artificial Sequence
  Description of Artificial Sequence: Synthetic coding sequence
atgcacgtgcgatccctgcgcgccgcagcacctcattctttcgtggcactttgggcacccctgtttcttctccgttccgctctggctgatttctcgctcgataacgaagtgcacagcagctttattcaccggaggctccggagtcaagagcgccgggaaatgcaacgggaaattctgtcgatcctcggactgcctcatcgcccaaggcctcatcttcaagggaaacacaatagcgcacctatgtttatgcttgatttgtacaatgcaatggcggtggaagaaggaggcgggcccgggggtcagggattttcctacccatacaaggcggtgttttcgactcagggaccacctctcgcatcactgcaggattcacattttcttaccgatgctgacatggtgatgagctttgtgaatctcgtggagcatgataaggagtttttccatcccaggtaccatcatcgggagttcagatttgacctgtccaagattcccgagggagaggcagtcactgcagcagagtttcgcatctacaaggattacatcagagaacggtttgataacgaaacctttcgaatctcagtctaccaagtcctccaagaacacttgggccgcgaaagcgatctcttcctgctggattccagaactctttgggcgtcagaagaagggtggcttgtgtttgatatcaccgcaacttcaaaccattgggtggtcaacccacgccacaacctgggtctgcaactttccgtggaaacgctggatggtcaatcgatcaacccaaaacttgcgggtctgattggtcgacatggaccacagaataagcagcccttcatggtggcatttttcaaggccaccgaggtgcattttcgttctattagatccactgggtcaaaacaaaggtcgcagaaccgctcaaaaactcctaagaaccaagaggcgctgaggatggcgaatgtcgccgaaaattcatcatccgatcaaagacaggcatgtaagaagcatgagctttacgtgtccttcagagatctgggatggcaagactggataatcgcacccgaaggatacgccgcttactactgtgagggggaatgtgcatttcctctgaacagctatatgaacgcaaccaatcatgccatcgtgcagacgctggtgcatttcatcaatccagaaactgtccccaagccatgctgtgcgccaacgcagcttaacgcaataagcgtcctttactttgacgattcaagcaacgtcatacttaagaagtaccgaaatatggtggtccgagcgtgtggatgtcat

SEQ ID NO: 8004 - DNA, 1293 bp, Artificial Sequence
  Description of Artificial Sequence: Synthetic coding sequence
atgcatgtgagatctctccgagcagcagcgccccacagcttcgtggcactttgggctccgctgttccttctcagatcggcactggcagacttttcgcttgacaacgaagttcattcatccttcatacatcggagacttagaagccaggaacggagggagatgcaacgggaaattctttcgattctgggtttgccgcatcgcccaagaccgcacctgcaaggtaagcataattcagcaccaatgtttatgctggatctctacaacgcgatggcggtggaggaaggcggagggcccggtggacaggggttcagctacccttacaaggccgtcttttcgacccagggaccacccctggcaagcctgcaggattcgcactttctgactgatgctgacatggtcatgtcattcgtgaatcttgtggaacatgataaagaattcttccaccctcggtatcaccatagggaatttaggtttgacctgtcgaagattcccgaaggcgaagccgtgaccgccgcagagtttcggatctacaaagactatatccgtgaacggtttgacaacgaaactttcagaatctcggtgtaccaagtgctgcaggagcaccttggacgggagtcagacctctttcttcttgattcaagaactttgtgggcatccgaggagggctggctggtgtttgatatcactgcgaccagcaatcattgggtggtgaatccgaggcataaccttggcctgcaactctcagtagaaactctggatggtcagtccattaatcccaaacttgcggggcttatcggacgacacggccctcaaaacaagcagccttttatggtggcattctttaaggcgaccgaagtccacttccgttcgatcagatccaccggtagcaagcaacgatcacagaacagaagcaagacccccaaaaaccaggaagccctccgaatggccaacgtggcggaaaattcatcatccgaccaaagacaagcatgcaagaaacatgaactttacgtgtcgttccgggatttgggttggcaagactggatcattgccccagaaggatacgcggcatactactgtgagggagaatgtgcgttcccgcttaactcatacatgaatgcaactaaccatgcaattgtgcagacgctggtccatttcattaacccagaaaccgtgcctaagccttgctgtgcaccaacccagttgaatgcaatctcagtgctctacttcgatgactcgtccaacgtgatccttaagaagtaccgtaacatggtggtgagggcatgtggatgtcac

SEQ ID NO: 8005 - DNA, 1293 bp, Artificial Sequence
  Description of Artificial Sequence: Synthetic coding sequence
atgcacgtgcgctctctccgcgccgccgctccacactcatttgtcgcgctgtgggccccgctgttcctgctgcgctcagctctggcagacttctcgcttgacaatgaagtgcacagcagcttcatccaccgcaggctgaggtcacaggagcggcgtgagatgcagcgcgaaatcctctccattctgggactgcctcaccgcccgcggccccacctccagggtaaacacaacagcgcccctatgttcatgttggacctctacaacgccatggctgtcgaagaaggcggcggtccgggtggccaaggattctcatatccatacaaagccgtgttctccacccagggacctcctctcgcatccctgcaagattcgcacttccttaccgatgcggacatggtgatgagcttcgttaatctggtcgagcacgacaaagaattcttccacccgcggtaccaccatcgggagttccggttcgacctgtcaaagatcccggagggggaagccgtgacggcggcggagtttcgcatctacaaggactacatccgcgaaagattcgacaatgaaacttttcgcatttccgtgtaccaggtcctgcaagaacacctgggccgcgaatcggatctcttcctgctcgatagcagaactctgtgggcatccgaggaaggttggctggtgttcgatatcaccgctacgtccaaccattgggtagtgaatcccaggcacaatcttgggctgcaactgtcggtggaaaccctcgatggccagtccatcaatccgaagttggcaggactgatcggaaggcatggtccgcagaataagcaaccgtttatggtcgcattcttcaaggcgaccgaggtccattttcggtccattcgatcaactgggagcaagcagcgctcccaaaaccgctctaagacgccgaaaaatcaagaggccctgcgcatggcaaatgtggccgagaactcttcatccgaccaaagacaagcctgcaaaaagcacgagctgtacgtgagcttccgcgacctcggatggcaagactggatcattgcaccggagggatacgccgcgtattactgtgaaggagaatgtgcgttccctctgaacagctacatgaatgcgactaaccacgccatcgtgcagactctggtgcactttatcaacccggaaaccgttcctaagccgtgctgcgcgccaacgcagctcaacgcaattagcgtgctctacttcgacgactcatccaacgtgatcctgaaaaagtaccgcaatatggtggtgcgcgcctgcgggtgccat

SEQ ID NO: 8006 - DNA, 1293 bp, Artificial Sequence
  Description of Artificial Sequence: Synthetic coding sequence
atgcatgtacgaagcctccgtgctgccgcgcctcactcattcgtggccttgtgggcgccactgtttttactgcggtcggcactcgccgacttcagcctggacaatgaggtgcattctagtttcatccataggcgcctcaggagccaagagcgacgggagatgcagagggaaattctcagcatcttggggctgcctcatagaccccgccctcatcttcagggcaagcataactcagccccaatgtttatgttggatttgtacaacgctatggccgtagaagaaggcggtggcccaggtggccagggattcagctatccctacaaggctgtattttctacacaggggccccccctcgcttcgctgcaggatagccacttcctgacggatgctgacatggtgatgtcctttgtcaacctggttgaacacgacaaggagttttttcatcctcgctaccatcaccgcgagttcagatttgacctgtcgaagattcccgagggggaggccgtgactgcagctgagtttagaatatataaggactatatcagagagcggttcgacaatgagacctttagaatcagcgtctaccaggttctgcaggaacacctcggccgggaaagcgatctgtttctacttgattcccggaccctctgggcctctgaagaagggtggctcgtttttgacatcaccgctactagtaaccactgggtggtgaaccctaggcacaacctgggactccaacttagcgtagagactctggacggacagtcaatcaacccaaaattggcgggactgataggcaggcatgggccccagaacaaacagccatttatggtcgccttttttaaagccaccgaagtacattttcgatctatccgctcaaccgggtccaagcaaaggtcgcagaataggtctaagacccctaagaaccaggaagcgctccgcatggctaacgtggccgagaactcgtctagcgaccagcgccaggcttgcaaaaagcacgagctctacgtatctttcagggacctcggatggcaggactggatcatcgcccccgaaggctacgccgcttactactgtgaaggtgagtgtgccttccccttaaattcttacatgaacgctaccaatcatgccatcgtccagaccctggtgcacttcattaatcccgagacagtgcctaagccttgctgcgcaccaactcaattgaacgccatctccgtgctctacttcgacgactccagtaacgtgattttaaagaagtatagaaacatggtggttagagcctgcggctgtcat

SEQ ID NO: 8007 - DNA, 1293 bp, Artificial Sequence
  Description of Artificial Sequence: Synthetic coding sequence
atgcacgtgaggtcccttcgcgcggctgctccacacagttttgtggcgctgtgggcacctctttttctgctcaggagtgcacttgccgatttcagcttggataacgaagtgcactccagtttcatccacagaagactgagaagccaagagaggagggagatgcagagggagatcctgtccatcctgggactccctcatcgcccgcgtccccatctgcagggtaagcataactctgctcccatgttcatgctagacctttacaacgccatggccgttgaggaaggaggggggccaggaggacagggcttctcatacccctacaaagcagtgtttagcacccaaggccccccccttgcttcgctgcaggatagccattttctgacagatgctgatatggtcatgtcatttgttaatctggtggagcacgataaagagttcttccaccctcgataccaccaccgagaatttaggtttgatctgagcaagatcccagaaggagaggcagtgacagccgccgaattcaggatctacaaagattatatcagagagcggttcgataatgagacctttaggatcagcgtgtaccaggtcctccaagaacatctggggagggagtcagatctgttcctgctggatagccggaccctctgggcgagcgaagagggatggctggtctttgatatcaccgcgacaagcaatcattgggtggtgaatcctcggcataacctcgggctgcaactgagtgtggaaacactggacggacaaagcatcaacccaaaactggcaggtctgattggccgccacggcccacaaaataagcaacccttcatggtggcatttttcaaagcgaccgaagtacacttcaggagcatccgcagcactggtagtaaacaacgaagccaaaaccggagcaaaacccctaaaaatcaggaagcactgaggatggcaaacgtggccgagaacagcagcagcgaccagcgccaggcctgcaagaaacacgagctgtacgtgtcatttcgtgacctgggatggcaggactggatcatcgcgccagagggatatgctgcatactactgcgaaggagaatgtgcctttcctttgaactcctatatgaacgcaactaaccatgccattgtgcagaccctagtgcatttcatcaaccctgaaacagtgccaaagccatgttgtgcacctacccaactcaacgccataagcgttctgtattttgatgacagttcaaacgttatacttaagaagtacaggaacatggttgttagggcatgcggctgccac

SEQ ID NO: 8008 - DNA, 4500 bp, Artificial Sequence
  Description of Artificial Sequence: Synthetic coding sequence
atgactagaatacttactgcattcaaagtggtgcgcaccctgaaaaccgggttcggctttacgaatgtgacggcacatcaaaagtggaaattctccagacctggtataagactgctgtcggtcaaagcccagactgctcatattgtgttggaggacggtaccaagatgaagggatattcgtttgggcatccaagcagcgtcgcaggtgaagtcgttttcaatactggactgggtggatacccagaagcaatcactgatcctgcgtacaagggtcagattctgaccatggcgaaccccattattggtaacggaggtgctcctgacactacggcactggatgagctgggcctgtcaaagtacctcgaaagcaacggtattaaggtgtccggccttctggtgctcgattacagcaaagactataatcactggttggcaactaagtccctgggccaatggctccaagaagagaaggtgcctgcaatctacggagtggataccagaatgcttaccaagattatacgagataaaggtactatgctgggtaagatagaattcgaaggccagccagtggatttcgtcgatccgaataaacaaaacctgattgctgaagtgagcaccaaagatgtgaaggtgtacggaaagggaaaccctaccaaagtggtggctgtggactgcggcattaagaataacgtgattcggctgctcgtgaagcgaggtgccgaggtacatcttgtcccctggaaccatgacttcactaagatggaatacgatggcatcctgattgcaggtggcccgggcaaccctgccctggccgaacccttgatccagaatgtgcgcaagatactcgaatcggatagaaaggaaccactttttgggatctcgaccggaaacctgattactggattggccgctggggcaaagacctacaagatgtctatggcaaatagaggacaaaaccaacctgtcctgaacattaccaataaacaggcgttcataaccgcacaaaatcatggttacgccctcgacaacactctgccagcgggatggaaacctctgttcgtcaacgtgaatgaccagaccaacgagggtattatgcatgagtcgaagcccttttttgcagtccaatttcatcctgaggtgacgccaggacccattgatactgaataccttttcgactccttcttctcgttgataaagaaggggaaggccactacgatcacttcagtgttgcctaagcccgcactggtggcttctcgggtggaagtctcaaaagtgctgatcctgggctccggcggactgtcaatcggacaagccggtgagttcgattacagcggttcacaagcagtgaaggccatgaaggaagaaaacgtcaaaaccgtgctgatgaacccgaacattgcttctgtgcaaactaatgaagtcggtcttaagcaggcagacaccgtgtacttccttccaattaccccgcaatttgtgaccgaagtgatcaaggccgagcagccggacggactcatccttggcatgggtggtcaaactgcccttaactgtggtgtcgaactgttcaaacgaggggtcctgaaggaatacggcgtgaaggtgcttggaacttcggtggaatccattatggctaccgaagataggcaattgttttccgataaactcaatgaaatcaacgagaaaatcgcaccatcattcgcagtggagtcgatcgaagatgccctgaaggcagctgacaccattggttaccctgtcatgatccgcagcgcatacgcactgggaggcctgggaagcggaatctgtccaaatagagagactcttatggatttgtcgactaaggcatttgcaatgactaatcaaattctggttgaaaagtctgttaccggctggaaggaaattgaatacgaagtggtgagggacgccgatgacaactgcgtcaccgtctgtaatatggaaaacgtggacgcaatgggggtgcatactggtgattcggtggtggtggcaccagcacagaccctgtcgaatgcagagtttcagatgctgcgcagaacttccattaatgtcgtgcgtcatcttggaattgtgggagagtgtaacatacagttcgcactccatcctacttcgatggaatattgtatcattgaggttaacgcaagactgtctcgctcctcggcacttgcgtccaaggcaaccggatacccacttgcattcattgcagcaaagattgcactgggtattccactccccgaaatcaagaacgtcgtctcgggtaagacgtccgcttgctttgagccatctttggattacatggttaccaagataccccggtgggacctggataggtttcacggaacctcgagcagaatcgggagcagcatgaagagcgtgggggaagttatggcaattggtcgtacctttgaagagagctttcaaaaggctctccgcatgtgtcatcctagtattgaaggtttcacccctcgccttccaatgaacaaggaatggccatcaaacctggatcttagaaaggagctgtccgaacctagctcaactcgtatatacgcgatcgcaaaggcaatcgatgacaacatgtcccttgacgagattgagaaacttacctatattgataaatggtttttgtacaagatgagggatatcctcaacatggaaaaaaccctgaagggtctgaattccgaatcgatgaccgaggagacgcttaagcgcgccaaggaaataggcttttccgacaagcagatatcgaagtgccttggtctgaccgaagcacagacccgtgaacttcgtctgaagaaaaacatccacccatgggttaagcaaatcgataccctggcagcggaatacccctcggtgaccaactacctttatgtcacttataacggacaggagcatgatgtcaattttgacgaccatggaatgatggtccttggctgtggaccgtaccacataggcagcagcgtcgaatttgactggtgtgcagtgtcctcaatcagaactctccggcagctggggaaaaagactgtggtggtgaactgtaaccccgagacggtgagcaccgatttcgatgagtgcgataagctctactttgaggaactctcacttgaacgcatcctcgatatctaccatcaggaagcatgcggaggttgcatcatatcagtgggcggccaaatcccaaacaatttggccgtgcccctctacaagaatggagtgaagattatgggcacctcccctctccaaatcgatagggctgaggatagatcgatcttttccgctgtgctggatgagctcaaggtggcccaagcaccctggaaggctgtgaacactcttaatgaagccctggagttcgcgaagagcgtggattacccttgcctgctgcggccgtcttacgtgttgtcgggctcggcgatgaatgtggtgttttctgaggacgagatgaaaaagttccttgaagaggcaactagagtgtcgcaggagcacccggttgtcctgacgaagttcgtcgaaggggcccgggaagtggaaatggacgccgtcggtaaggacggacgggttatttcccatgcaatttccgagcatgtggaagatgccggtgtccactctggggacgcaacccttatgctgccgacccagaccatatcgcaaggcgcaatcgaaaaggtcaaggatgcaacgcgtaaaatcgcaaaagcattcgcaatctccggcccctttaacgtgcagtttctggtcaagggaaatgatgtgctcgtcattgagtgcaatctgagagcatcccggagctttccgttcgtgagcaagacgttgggagtggactttattgacgtggctactaaggtgatgattggagaaaatgtcgacgaaaaacatctccccaccctcgatcatcctattatcccagcggactacgtggcaatcaaggcacctatgttttcctggccacgacttcgggatgcagacccaatcttgaggtgtgagatggcatcgactggggaagttgcttgctttggagagggcatacacactgcgtttcttaaggcaatgttgtccaccggatttaagatcccgcaaaagggtatcctgatcggaatccaacagtcctttcggccacgttttcttggcgtggccgaacaactgcataatgaaggcttcaaactttttgcaaccgaggcgacttccgactggctgaacgccaacaacgtgcctgcaacccctgtggcatggcctagccaggaggggcagaatccaagcctttcatccatccggaagctgatccgcgacggctcaattgacctcgtgattaacttgcctaacaataacacgaaattcgtgcacgataactacgtgatcagaaggactgcagtcgactcaggcattccactcctcactaactttcaggtgactaagttgtttgcagaagcagtgcagaaatcgagaaaggtggattccaaatcactttttcactaccgacaatactccgcaggcaaggcggcg

SEQ ID NO: 8009 - DNA, 4500 bp, Artificial Sequence
  Description of Artificial Sequence: Synthetic coding sequence
atgacccgcatactgaccgcgttcaaagtcgtccggaccctaaagacaggcttcggattcactaacgtgactgctcaccagaaatggaagttctccagaccaggaataagattacttagtgtcaaggctcaaacagcgcatatcgtgcttgaagatggaactaagatgaaaggatatagcttcggtcacccatcctctgtggccggcgaagttgtgttcaacaccggcctaggagggtatcctgaagcaattacagacccagcttacaagggacagatactcacgatggcgaatcccattatcgggaacggcggggcacctgacacaacagccctggacgaactggggttgtcaaagtacctggagtccaacggcatcaaagtctccggcctgctcgtgctcgattacagcaaggattacaatcattggttggcaacgaagtccctaggtcagtggctgcaagaggagaaagtccccgccatatacggcgtggacacacgcatgctgacgaagatcatccgcgacaagggaaccatgttgggtaaaattgagttcgagggccagcctgtcgacttcgtggaccctaataagcaaaacctgatcgctgaagtcagcacaaaagacgtgaaagtttacgggaagggcaatcccaccaaggtcgtggccgtcgattgcggcatcaaaaataacgtcatcagactattggttaagaggggcgccgaggtacatctcgttccctggaaccacgacttcaccaagatggaatacgatggaattctgatcgcgggcggtcctggaaaccccgcactggcagagcctctcatccaaaatgtacggaaaatcttggaaagcgatcgcaaggaaccactgtttggcatttctacagggaacctgattaccggcttagctgctggggcaaaaacttacaagatgtcgatggccaaccgcgggcagaatcaacctgtactgaatattacaaataaacaagcctttattactgcacagaaccatggctatgcgctggacaacaccctccctgctggatggaaaccccttttcgttaacgtgaatgaccaaactaatgagggcatcatgcacgagagcaaaccattcttcgccgtgcagttccatcctgaagtcactcccggacctattgataccgaatatctttttgattcttttttttctcttattaagaaaggaaaagccaccacaatcactagtgtactgcccaagcccgcactagttgcttcacgtgtggaagtgagcaaagtgctgatactcggcagcgggggtctttcaattgggcaggcaggcgaattcgattactcaggctcacaggccgtgaaagctatgaaagaagagaatgtaaagactgttctgatgaaccctaacatagcgtctgtgcagacaaatgaagtgggcctaaaacaagcagatactgtgtatttcctgccaatcactccacagttcgtcacagaagtgatcaaggcggagcagccagacgggctgattctcggaatgggcgggcagaccgccctcaactgcggcgtcgaactctttaagcgtggcgtgttgaaggaatatggcgtgaaagtactgggcaccagtgtggagtctatcatggctaccgaagaccggcaactgttcagcgacaagttgaacgagattaacgagaagatcgcaccatcctttgcagtagaaagcatcgaggacgcactgaaagctgccgataccatcggctaccctgttatgatccgctcagcgtatgctttagggggcctcgggagcggaatctgtccgaacagagagactctgatggacttgtccacaaaggcatttgcaatgactaaccagattctagtagagaagagcgttacaggctggaaagaaatcgagtatgaagtagttcgggacgctgacgacaattgcgtgacagtttgcaatatggagaacgtggacgctatgggcgtacacacaggagattccgtcgttgttgcaccagcccagaccttgagtaatgcagaattccaaatgctgcgaaggacctccatcaacgtggtgaggcatctaggtatagtgggcgagtgtaatattcaatttgctctccatcctacaagtatggagtactgtatcatcgaggttaacgcacggctgagtcgaagcagcgccttggcctccaaagccacaggataccctctcgcctttatcgctgcaaaaattgcgctcgggatcccattgcccgagattaagaatgttgtgtctggcaagacaagtgcgtgttttgagcctagtctggattacatggtcaccaaaatacctcgctgggacttagacagatttcacggcacgagcagccggatcggctcttcaatgaaatcagttggagaggttatggcaatcggacggaccttcgaggaaagcttccaaaaggccttgcgcatgtgccatccgtcaattgagggtttcacccctcgcctcccaatgaataaagaatggcctagcaacctggatttacgaaaagaactgagtgaacccagctcgactcgcatctacgcaatcgctaaggcaatagatgataatatgtctctcgacgagatcgagaagttgacatatatcgataaatggtttctgtacaaaatgagagacatcctaaatatggagaaaacactgaagggactgaactcagagagtatgactgaggagacactgaaacgggctaaggagatcggcttttccgataaacagatatctaaatgtttagggctgaccgaggcgcagactcgtgagctgcgccttaagaagaacatccatccctgggtcaaacagattgacactcttgccgccgagtatccttctgtgactaattacctgtatgtgacctataatgggcaggaacacgacgtcaactttgatgatcacggcatgatggtactggggtgtggaccttatcatattgggagctccgtggaatttgactggtgcgccgtgagcagcattagaactctaaggcagctgggcaagaagaccgtggtcgttaattgtaacccagagaccgtgtcgaccgacttcgatgagtgtgataagttatacttcgaagaattgtccctggagcgcattctcgatatttatcaccaggaggcatgcggggggtgcattatttctgtaggaggacagattcctaacaacctggccgtacctctgtacaagaatggggtcaaaattatggggacatcccccctgcaaatcgatcgcgctgaagacagaagcatattctctgctgtcctggacgagcttaaggtggcccaggctccatggaaggccgtaaacacactgaatgaagctctagaattcgccaaaagcgtagattacccctgtctccttagaccctcctacgttctgtctggctctgcaatgaatgtggtgtttagtgaggacgaaatgaaaaagttcctggaggaagccacaagagtgtctcaggagcacccagtcgttctgacaaagtttgttgaaggcgctcgcgaggttgaaatggatgcagtgggaaaagacggccgagtgattagtcacgccatcagcgagcacgttgaagacgcaggggtgcactccggcgacgcaaccctgatgctgccaactcagaccatctcccagggcgcaatcgaaaaagtcaaggacgcaacaaggaaaatagcaaaggcctttgcaatctcgggaccgttcaacgtccagtttttagtgaaagggaacgatgtcttggtgattgaatgcaatttacgggcgtcgaggagctttccatttgtgtctaagaccttgggagtggactttatagacgtggcaaccaaggtgatgatcggagagaacgtggatgagaagcacttaccgacgctggaccatccaatcatacctgccgactacgtggctatcaaagcgccgatgttttcatggccgcgtctgcgcgacgcagacccgatcctcagatgcgaaatggccagtacaggcgaagtagcttgtttcggcgaaggaatccataccgctttcctaaaggcgatgctgagtacaggcttcaagatccctcagaagggtatacttatagggatccagcaatcctttaggccccgcttcctgggcgttgccgagcagctacacaacgaaggcttcaaactgttcgccactgaggctacatctgattggctgaacgcaaacaacgtgcctgctacccctgtcgcctggccatcccaggagggacaaaatccaagtctcagttccataagaaagttaatacgagacgggtctattgacttggttataaacctgcctaacaataatacgaaattcgttcacgacaattacgtaattcggcgcacagctgtggactccgggattcctctgctaactaatttccaggtgactaagctgtttgccgaggctgtgcagaaaagtagaaaggttgattccaaatcactgttccactaccggcagtactctgcagggaaggccgct

SEQ ID NO: 8010 - DNA, 4500 bp, Artificial Sequence
  Description of Artificial Sequence: Synthetic coding sequence
atgacaagaatcttaaccgcatttaaggtggtgcgaacactgaagactggattcggcttcaccaacgtcactgcacaccagaagtggaaattttctagaccagggattcggctgttgtcagtcaaggctcagaccgcccacatcgtgcttgaggatggaacaaagatgaaggggtactcattcggccacccgagctctgtcgcgggggaggtggtgttcaacactggcctcgggggttatcctgaggctataaccgacccagcttataaggggcagatcctgacaatggctaacccgattattgggaacggcggcgccccagatacgacagccctggacgaactgggcctatcaaagtaccttgagtctaatggcatcaaggtgagcgggttgcttgtgctagattactccaaggattacaaccattggctcgccaccaagtcgctgggccagtggctgcaggaggagaaggtccccgccatctacggcgtagatacccgaatgcttaccaaaatcatacgtgacaaaggcacgatgcttggcaagatcgagtttgaagggcagcctgtggattttgtagatcccaataagcagaacctgatagccgaggtatctactaaggacgtgaaggtgtatggtaaaggcaatcctacaaaagtggttgcggtggattgtggaatcaaaaataacgtgattagactgctcgtgaagcggggtgccgaagtgcatctggtcccctggaaccatgacttcaccaagatggagtacgatggtattttgatcgccggaggccccggcaacccagctctggccgaacccctgattcagaatgtgagaaaaatcctagaaagcgaccgcaaggaacccctgtttggcatatccactgggaacttgattacagggctggcagcaggcgccaagacgtacaagatgtctatggcgaaccgaggccagaatcagcccgtgctgaatatcacaaacaagcaggctttcatcacagctcagaatcacggatacgcattagacaacacactgcccgcaggatggaagccactgttcgtaaatgttaacgatcagactaatgaaggcatcatgcacgagagcaaaccattttttgccgtgcagtttcacccggaggtgactcctggccccatcgatacagaatacttgttcgatagtttcttcagcctgatcaaaaaagggaaggcaacgacaataactagtgttcttcccaagccagccctcgtcgccagtcgagtcgaagtgagcaaagtgctcattcttggatctgggggcctgagtattggccaggccggtgaattcgactattccggtagccaggcagttaaagcgatgaaggaggagaatgtgaaaaccgttctgatgaatcctaacatcgcctccgtgcagaccaatgaggtgggtcttaagcaggctgatacagtgtatttccttccaatcacaccacaattcgtgacagaagtgattaaggccgagcagcccgacggcctgattctaggcatgggcggacaaacagctctcaattgcggcgtggagctgttcaagcgaggcgttctgaaggaatacggcgtgaaagtgctgggcactagtgtcgaatctatcatggccaccgaagatagacagcttttctccgacaagcttaacgaaatcaacgaaaagatcgctccttctttcgccgtcgaaagcattgaggacgccttgaaagccgccgatacaattggctatccagtaatgattaggagcgcttacgcgctaggcggacttggctccgggatctgccccaaccgcgagacgctcatggacctttcaaccaaagccttcgccatgacaaatcagatactcgtggaaaagtctgtgaccggctggaaggaaattgagtacgaggtcgtaagggatgccgatgacaattgcgtgacagtgtgcaacatggagaatgtagacgctatgggagttcatacaggagattcagtggtagtagcgcctgcccagaccctatctaatgctgagttccagatgttgaggcgcacatctatcaatgttgtgagacacctgggaatagtgggagagtgcaacatccagttcgccctgcaccctaccagcatggagtactgtattatcgaagtcaacgcacggctgagccgctcaagcgcgcttgcctctaaggccactggataccccctggccttcattgccgccaaaattgcactcggaatccctctgcccgagattaagaatgtggtctctggcaaaactagtgcatgctttgaaccgagcctggactatatggtgacaaagattccacgctgggacctggaccggttccatggcacctcatcacgcattggttcatctatgaagagcgtcggcgaagttatggccataggcagaacattcgaggagagtttccaaaaggccctgcggatgtgccatccctctatcgaaggcttcaccccccgactgcctatgaacaaggagtggccatctaacctggatcttagaaaagaactgtccgagccatcatcgactaggatatacgcgattgctaaggcaattgatgacaatatgagtctggatgagatagagaagttgacctacatcgacaaatggtttctgtacaagatgcgggatatcctaaatatggagaagacgttaaaaggcttgaactccgagtcaatgacagaagagacccttaagcgggctaaagagataggattttcagacaagcagatcagcaagtgtcttgggctcaccgaagcacagactagggaactccgcctgaagaagaacatacacccttgggttaagcagatcgataccctggctgctgagtatccttcagtaactaattatctgtacgtgacttacaatggccaggaacacgatgtgaacttcgatgaccatggaatgatggttcttgggtgcggcccataccacattggcagtagcgtggagtttgattggtgcgccgtttcttcaatccgaacccttcggcagctgggcaaaaaaacggtggttgtaaactgtaaccccgagactgtttcgactgatttcgatgagtgtgacaagctgtacttcgaggagctgagcttagaacggatcctggatatttatcatcaggaggcctgcggcggatgtattatctcggttggaggacagattcccaacaacctagccgttccattgtataaaaacggggtaaagattatgggtacttcgcccctgcagattgacagggctgaagatagaagcatattctccgcagtgctggacgagctgaaagtggcccaggcaccctggaaggctgtgaacactctgaacgaagccctggagttcgcaaaatctgtggattatccttgcctcctccgaccttcctatgtcctgtctggctcagcaatgaatgtggtgttctctgaggatgagatgaagaaattcctcgaggaagcaacccgtgtcagccaggagcatcctgttgtgctgaccaagttcgtggagggcgctcgagaggtcgagatggacgcagtagggaaggatggcagagtgatcagccatgcgataagcgagcatgtcgaggacgccggggttcacagcggtgacgctactctaatgctgcctacacaaactatatcacagggcgccattgagaaagtgaaggatgcgacacgcaaaatagctaaggcgtttgctatcagtggaccttttaacgttcagtttctggtgaaaggaaacgacgtgctggtaattgagtgtaacctgcgcgcaagcagatcttttcccttcgtatcgaaaacactcggcgtagatttcatcgacgttgcaactaaggtgatgattggggagaatgtggacgagaaacatcttcctacgctggaccatccaattatccccgcagattatgtggctatcaaagctccaatgttttcttggcctcgcttgcgcgatgcagatcccattctgcgttgtgaaatggcctcaactggagaagtcgcctgtttcggcgagggaatccacaccgccttcctgaaagctatgctgtccacaggcttcaaaataccccagaaaggaatcctgatcgggatccagcagtccttccggccccgcttcctgggggttgcagagcagctgcacaacgaaggctttaagctgttcgctacagaagctacctccgactggctgaacgctaataatgtgccagctacgcccgtggcatggccttctcaggagggccagaatccttctctcagctcaatccgtaagctgattcgagatggaagcatcgacctcgtgatcaacctgccaaacaacaacaccaaattcgttcacgataactatgtgatcagacgcactgctgtcgattcaggcatcccactccttacgaactttcaggtcactaagctgttcgcggaggccgtgcagaagtctcgcaaggtcgactcaaagagtctttttcactaccgtcagtatagcgctggaaaggcagca

SEQ ID NO: 8011 - DNA, 4500 bp, Artificial Sequence
  Description of Artificial Sequence: Synthetic coding sequence
atgacccggattcttaccgctttcaaagtcgtgaggacccttaagactgggtttggttttactaacgttactgcacaccagaaatggaagttttcgcgacctggaatcagactgctttcggtgaaggctcaaacggcgcatattgtgcttgaagatggaactaagatgaaaggatactcgtttggacacccttcatcggtggcgggggaggtcgtgttcaacactgggctcggagggtacccggaggctattacggaccctgcatacaagggacaaattcttaccatggcaaacccaatcattggcaacggtggagcacctgacacgaccgcgcttgacgaactcggacttagcaaatacttggaaagcaacggtataaaggtgtctggactgctggtccttgattacagcaaggactacaatcattggctggcgactaagtcccttggacaatggctgcaggaagaaaaggtgccggccatttacggagtggacaccagaatgctgaccaagattattcgggacaaggggaccatgttgggaaagatcgaatttgagggtcaacctgtggatttcgtggatccaaataagcagaacctgattgcagaagtgtcgactaaggatgtaaaggtgtatggtaaaggaaacccaacgaaggtggtggcggtcgactgcggaattaagaataacgtgattcgacttctggtgaaacggggtgcagaagtgcacctggtgccgtggaaccatgatttcaccaagatggagtacgatgggatcctgatcgcaggtggtccaggtaacccagcacttgcagaaccccttatccagaatgtgaggaagatcctcgaaagcgatcgcaaagaaccactgttcgggatctcgactggcaaccttattaccggactcgcagcaggtgcaaaaacctacaagatgtccatggcgaaccgtggacaaaaccaaccagtgctgaacatcaccaacaaacaagcgttcataaccgcccagaaccatggatatgcacttgataatactcttcccgccgggtggaagccccttttcgtgaacgtgaatgatcagactaacgaaggaattatgcatgaatcgaaacctttcttcgcagtgcaatttcacccagaggttactccaggccctattgataccgaatacctctttgactcattcttttcacttatcaagaaaggaaaagccaccactataaccagcgtgcttcctaagcctgccctggtggcgtcacgagtcgaagtgtcgaaagtcttgattctgggatcgggaggactgtccattggacaggccggtgagtttgactactcgggatcgcaggcggtaaaagcgatgaaggaagagaatgtgaaaacggtgcttatgaaccccaacattgcatcggtgcagaccaacgaggttggactgaaacaggccgatactgtgtacttccttccaatcacgccgcagttcgtcactgaggtgattaaagcagaacaacctgatggactcatcctgggcatgggaggccaaactgctctcaactgcggtgtggagctgtttaagcggggtgtgctcaaggaatatggtgtcaaagtgctgggaacgagcgtggagtcaattatggcaactgaggatcggcaactcttttccgataagctgaatgaaatcaacgagaaaatcgccccttcttttgcagttgaatcgattgaagatgctttgaaggcagccgataccatcgggtacccggtcatgattagaagcgcatacgccctgggcggattgggatccggaatatgcccaaatagggagacgctgatggacctcagcacgaaagcatttgcgatgacgaaccagattcttgtggagaagagcgtcactggatggaaggaaattgagtacgaagtcgtgcgggatgcagacgacaattgtgtgaccgtgtgtaacatggagaacgtggacgcaatgggtgtgcatacgggagatagcgtggtggtggcacccgcgcagacgctgtccaacgctgagtttcagatgttgcggcgaacctcgataaatgtggtgcgccatcttggaatagtcggcgaatgcaacatacaatttgccctccatccaactagcatggagtactgcattatcgaagtcaacgccaggttgtcgagatcctccgccctggcatccaaggcaactgggtaccctctcgcattcattgccgcaaaaatcgcgttggggatccctctgccagaaatcaagaatgtggtgtccggcaaaacttccgcttgtttcgaaccatctcttgattacatggtgaccaagattccacgctgggatcttgataggtttcatggtacttcatcgcgcattggatcatcgatgaagagcgttggagaagtgatggcaattggaagaacgttcgaagaatcctttcaaaaggcacttaggatgtgtcatccatccatcgagggattcactccaaggcttcctatgaacaaagaatggccatcgaacttggacctgcgtaaggagctgagcgaaccctcatccacccgcatctacgctatcgccaaggcaatcgacgacaacatgagcttggacgaaattgagaagctgacctatattgacaaatggttcctgtacaagatgagagacattttgaatatggaaaaaactctgaaggggcttaattcagaatcgatgactgaagaaacgctgaaaagagcaaaagaaatcggcttttccgacaagcaaatctccaagtgtctgggacttaccgaggctcaaacccgcgagctgagactgaagaaaaacatccacccttgggtgaaacagattgataccctggccgccgagtacccttcggtcaccaactacctgtacgtgacttacaacggacaagagcacgatgtgaattttgatgaccacggaatgatggtgttgggatgcggcccttaccatatcggctcgtccgtggaatttgactggtgtgctgtgtcctcaattcgaactcttcgtcaactgggtaaaaagaccgtcgtcgtgaactgtaatccagaaactgtcagcaccgatttcgatgaatgtgataagttgtactttgaagagctgtccctggaaagaatccttgacatttaccatcaggaggcatgcggggggtgcatcatctcggtgggaggacagattcccaacaatctggccgtgcctctctacaagaacggcgtcaagattatgggtacctcgccactgcagatcgatcgcgcagaggacagatcaatcttttcggcagtgctggatgaacttaaagtggcccaagccccttggaaagcagtgaatactctgaacgaagcccttgaattcgcaaagtccgtcgattacccctgtttgctgcggccatcctacgtgctcagcggttctgcgatgaatgtggtcttttccgaagatgaaatgaagaagtttctcgaggaagcgacccgagtgtcccaggagcatcctgtcgtgctgaccaagtttgtcgagggtgctcgggaagtggagatggatgcggtcgggaaagacggtagagtgatctcacacgcgatctcggagcacgtggaagatgctggagtgcattcgggcgacgccaccctgatgcttcctacccaaactatttcgcaaggagctatagagaaagttaaagacgcgacccggaagatagccaaggcctttgccatttccggaccctttaatgtccaatttctcgtgaagggcaacgatgtccttgtgattgaatgtaacctgcgcgcaagtagatcatttccttttgtgtccaagactcttggggtggatttcattgatgtggcaactaaggtgatgattggagaaaacgtggatgaaaaacacctgcctaccctcgatcaccctatcattcccgctgattacgtcgccattaaagcgcctatgttttcgtggccccgccttagagacgccgatccaatactccgctgtgaaatggcaagcactggagaggtggcatgcttcggagagggtattcataccgcttttcttaaagcaatgcttagcaccggttttaagatcccacagaaaggcattcttataggcatccagcaatcattccgcccacgattccttggcgtggcagaacagctgcataacgaaggcttcaagctctttgccaccgaagcaacctcagattggcttaacgcaaacaatgtgcctgcgacccctgtggcttggccatcccaggaagggcagaatccctcactgtcatccattcggaagttgatcagagatggctctatcgatctggtgataaaccttcctaacaacaacactaagtttgtccatgacaattatgtgattagacgcactgctgtcgattccggaattccgcttttgactaatttccaagtgaccaaactttttgcagaagcagtccagaagtcgagaaaggtggattcgaagtcgcttttccattaccgtcagtactccgcaggcaaggctgcg

SEQ ID NO: 8012 - DNA, 4500 bp, Artificial Sequence
  Description of Artificial Sequence: Synthetic coding sequence
atgacgaggattctgacggcatttaaggtggtgaggacactgaagaccggatttgggtttacaaacgtgactgcccaccagaagtggaagttttcacggcccggtatcaggttgctgtccgtgaaagcccagacggcacatatcgtcttagaggatggcaccaaaatgaagggatactcttttgggcacccctcttcagtggccggcgaggtggttttcaataccggccttggggggtacccagaggcaattaccgaccccgcgtataagggccagatcttgaccatggcaaatcccattattggcaacgggggggcccctgacaccacggcacttgacgagctggggcttagcaagtacctagaaagcaatggtataaaggtgtccgggctcctcgtcctcgattattctaaggactataatcactggctagccacaaaatcgctaggccaatggctgcaagaagagaaagtgccagccatctacggggtggatacacgcatgctaaccaaaatcatcagagataaagggacaatgctggggaaaatcgagttcgaaggacagccagtcgacttcgtagatcctaacaagcaaaacctaattgccgaagttagcacaaaggatgttaaggtttatggcaagggtaacccaacaaaagtagtcgccgttgactgcggcattaagaataatgttatccgactgctagtgaagcggggtgccgaggtgcacctggtcccctggaaccatgacttcactaagatggagtacgatggaatcctcattgctggcgggcccggcaatccagcattggctgaacccctgattcagaacgtgaggaaaatccttgaatcggacagaaaagagcctttgttcggtatcagcaccggtaacttgattacaggactggcagctggcgccaagacctacaagatgtccatggccaacagaggccaaaaccagccagtgctcaacatcacgaacaagcaagcattcatcacagcgcaaaaccatgggtatgccctggacaacaccttgcccgccgggtggaaaccattatttgttaacgtaaatgatcagaccaatgaggggataatgcatgagtccaagccgttctttgccgttcaattccaccctgaggttacacctggacctatcgacaccgagtatttgtttgatagttttttctcgcttatcaaaaagggcaaggccacaacaattacaagcgtgttacctaagcccgccctggtggcctctagggttgaggtttctaaagtgttgattcttggatcaggcggcctgtccatcgggcaggccggggaatttgactactccggctcacaggcagtgaaggctatgaaggaggaaaatgtcaaaactgtcctaatgaacccaaacatcgctagcgttcaaactaacgaggtgggtctgaagcaggctgacacggtatacttcctccccatcacgccccagttcgtgactgaagtcattaaagctgagcagccagatggcctaatcctcggcatgggtggtcagacggccctgaactgcggggtcgagctcttcaagaggggagtgctcaaagagtatggtgttaaagttctcggaacctctgtcgaaagtatcatggctactgaagacaggcagctgttctcggacaagctgaacgaaattaacgaaaaaattgcgccttcattcgccgtggaaagcatagaagacgcattgaaggcggccgacaccatcggatatccagttatgatcaggtcagcgtatgcgctcggagggttgggtagtgggatttgtcccaatcgcgaaacactaatggacttatcgacaaaagctttcgccatgaccaaccaaattctcgtggagaagagcgtcacaggatggaaagagattgaatacgaagtggtaagggacgcggacgacaactgcgtgacagtgtgcaatatggagaatgttgatgcgatgggagtgcacacaggagattccgtggtggtcgcgcccgcccagacactgtcaaatgccgagtttcaaatgctgcgccgcaccagcatcaatgtggtccgtcatcttggcattgtcggtgaatgcaacatccagtttgccctacatcccacttccatggaatactgcatcattgaggtcaacgcccggctgagcagatcgagtgcacttgccagcaaagccacgggatacccgcttgcttttatagccgccaagatcgcactgggcatcccccttcccgaaataaaaaatgtggtttctgggaaaacgtccgcctgcttcgagccatcacttgactatatggtaaccaagattccaaggtgggacctggacaggttccacggcacatctagtcgtatcgggtctagtatgaagagcgtgggcgaggtcatggctataggacgcacgttcgaagaaagttttcagaaggccctgcgaatgtgccacccttccattgagggatttaccccaagactaccgatgaataaggagtggcctagtaatctggatctgagaaaagagttgtccgagccatcatcaactaggatctacgcaatagccaaagccatagacgacaatatgtcactcgacgagatagagaaactcacttatatagataaatggttcctttataaaatgcgggacattcttaatatggagaaaactctcaagggcttgaacagcgagtccatgactgaggaaaccctcaaacgcgctaaagagataggattctctgacaaacagatcagcaaatgtctgggcttgaccgaggcacagactagggagttgcgcctcaaaaagaacattcatccatgggtgaaacagatagatactctggcagctgagtatccctcagtgacaaattacctttacgtcacctacaacggacaggagcacgacgtgaattttgatgatcacggtatgatggttctgggttgcggaccttatcacattgggagctcagtggaattcgactggtgcgccgtgtcatcgattcgaacacttcgtcagttaggcaagaaaacagtagtcgttaactgtaatccggaaaccgtttctactgatttcgacgagtgcgataaactgtattttgaagagctttccctggagcggatcctggatatctaccaccaggaggcctgtggcggttgtattatatcggttggcggtcagatccccaacaatcttgctgtaccactctataaaaatggggtgaaaataatgggcaccagccccctgcagattgaccgcgcagaggataggtctatcttctctgctgtgcttgatgaactcaaggtcgctcaagcaccttggaaagcagtgaatacgttaaatgaagcgctggagttcgccaagtccgtggactacccttgtcttctgaggccttcatacgtgttgtccggtagcgccatgaacgttgtttttagcgaggacgagatgaaaaaatttctggaggaggctaccagagtgtcccaagaacacccggttgtgttgacgaaattcgtggaaggcgctcgcgaagtggaaatggatgctgtgggaaaggacggaagggtgatcagccacgctatcagcgagcatgtggaagacgctggcgtccattccggtgatgcaactctcatgctgcccacacagactatctcgcaaggcgccatagagaaagtgaaggacgcaaccagaaagatcgctaaagctttcgctatctccggaccttttaatgtgcagttcttggtgaaaggaaacgacgtgttagttatagaatgcaatcttagggcaagccgttctttcccattcgtttcaaagactctgggcgtggacttcatagatgtggctaccaaagtgatgatcggcgaaaatgtggacgagaagcatctgcccacgcttgatcacccaatcataccagctgattatgtcgctatcaaagctccaatgttttcttggccgaggcttagggacgccgatccaatattgagatgcgagatggcaagtactggcgaggtggcatgctttggcgaaggaattcacaccgcattcctgaaagctatgctgagtacaggtttcaagattccccagaagggaattcttattggaatccaacagtcattcaggcctcggttccttggcgtcgcagagcagttacacaacgaggggtttaagctgtttgcaacagaggctacttccgattggctgaacgccaataatgtcccagcgacaccagttgcttggccatcccaggaggggcaaaacccttccctgtcttcaattcggaagcttatcagagatggaagcattgacttagtgatcaacctgccgaataacaacaccaagtttgtgcacgacaactatgtcatacgtcgaacagctgtggattcagggatccctctgctcaccaactttcaagtgaccaagttattcgcagaggcagtccagaagagccgaaaagtggattctaaatcactgtttcactatcgacagtattctgctggcaaggccgca

SEQ ID NO: 8013 - DNA, 4500 bp, Artificial Sequence
  Description of Artificial Sequence: Synthetic coding sequence
atgactcgcatactcacggcttttaaagttgtgcgtacgttgaaaacaggctttggatttactaatgttacagcacatcagaaatggaagttctcaaggccaggaatccggctgttgtcagttaaagcgcaaactgcgcacatagttctcgaagatggcacaaagatgaaaggatatagttttggtcatccctcttcggtggcaggcgaggtagtgtttaacacgggcctggggggatatcctgaggccattacggacccagcgtataaaggccaaatacttaccatggcaaaccctatcatcggaaatgggggagcacctgacacgacggcacttgatgaattaggattaagtaaatacctggaaagcaatgggatcaaagttagcgggttgttggtccttgattattcaaaagattataatcattggttggctacgaaatcccttggacagtggcttcaagaagaaaaagtcccggccatctatggcgtcgatacgcggatgcttacaaaaatcatccgcgacaaaggaacgatgctgggaaagattgaatttgagggccagccagttgattttgtagacccgaataaacaaaatctgattgccgaggtcagtacgaaagatgttaaagtatatggcaaagggaatcctacaaaagtcgtggcggttgactgcggaattaaaaataacgtaatccgccttctagtaaaacggggcgcggaggtacacctggtcccgtggaatcatgattttactaaaatggaatatgatggcattcttattgccggcggacctggcaatccggccttagctgaacctctgatacagaacgttcggaaaattttggaatctgatcgaaaggaaccactgtttggaataagcacgggaaatcttatcactggacttgcagctggtgctaaaacatataaaatgtctatggcgaatcgcggacaaaaccaacctgttttaaatataacaaataagcaagcctttatcacagcacaaaaccatgggtatgctcttgataatacgttaccggcgggttggaagcctctgtttgttaacgttaatgatcagacaaacgagggtataatgcatgaatcgaagccgttttttgcagtacaattccaccccgaagtgaccccgggtccgatcgacaccgagtatttatttgatagcttttttagcctcattaaaaaaggcaaagccacaacgattacaagtgttcttccgaaaccggctctggtggcgagccgggttgaggtaagcaaagtgctgattttgggaagtggaggtttgagcatagggcaggcgggtgaattcgattattcggggtcacaggccgtaaaggcaatgaaagaagagaatgttaaaactgtgcttatgaatccgaatatcgcaagcgtccaaaccaacgaagtaggtctaaaacaggcggacaccgtgtacttcctccctatcacgccgcaatttgtcaccgaagttattaaggctgaacagccggatggacttattttggggatggggggacaaacggctttaaactgcggtgttgaattatttaagcgcggtgtactcaaggagtacggggtgaaagtcctcggcacatccgtggagagcatcatggcgacagaagatcgtcagcttttttctgacaagctgaatgaaattaacgaaaaaatcgccccgtcttttgccgtggaaagcattgaggatgcgcttaaggcagccgatacaatcggctatcctgtcatgatacgtagcgcatatgcactggggggcttagggtcagggatctgtcctaaccgcgaaacattaatggatctgtcaacgaaagccttcgctatgaccaaccagatcctcgtagaaaagagcgttactggctggaaggaaatagaatatgaagtggtgagagatgccgatgataactgtgtgaccgtatgcaatatggagaacgtggacgcaatgggtgtccatacgggcgatagcgttgtagtagctccggctcaaactctttctaatgcagaatttcagatgcttagaagaacatctatcaatgtggttcgtcacttggggattgtaggtgaatgtaatatacaatttgcgttgcatcctacatctatggaatattgtattatcgaagtcaacgcgagactcagcaggtcatcggctctggcaagcaaagctactggatatccgttggcctttattgcagctaaaatcgccttggggattcctctaccggaaattaaaaatgtcgtgtcggggaaaacatctgcctgcttcgagccgtcactcgattatatggttactaaaatccctaggtgggacctggatcggtttcatggaacgtcctcgagaattggaagcagcatgaaatcagttggggaagtcatggctattgggcgaacatttgaagaatcctttcagaaagcactccgcatgtgccatccttcaattgaaggctttaccccgcgacttcctatgaataaggagtggccctcaaacttggaccttagaaaagagctgtcagaaccttcgagtacacgcatttatgcgatcgctaaagcaatcgatgataatatgtctttagatgagatcgaaaaattgacatacatagataagtggttcctttacaaaatgcgtgacatcctgaatatggagaaaaccctgaaaggtttaaattctgaatctatgacggaagaaacccttaaacgtgccaaggagattggctttagcgacaagcagataagtaagtgcctcggattgactgaggcgcagacacgtgagttgaggttaaaaaaaaacattcacccttgggtaaaacaaatagatacacttgcagcagaatatcctagtgtgactaactatctctatgttacgtacaatggacaggaacacgatgtcaattttgatgatcatggcatgatggtattaggctgcggtccgtatcatatcgggtccagcgttgagtttgattggtgtgcagtcagtagcattcgaacgttgcgacaactgggtaagaaaactgtcgtggtcaactgtaatccagaaacagttagcacggattttgacgagtgcgataaactttattttgaagaactgtcgcttgaacggatcttggatatttaccatcaagaagcatgtggcgggtgcattataagtgtggggggccagattcccaacaatcttgcggtacctttgtataaaaatggcgttaaaattatgggcacaagcccactgcagattgatagagctgaagataggtctattttctcagccgttctagacgaattaaaagttgcgcaagcaccctggaaagctgtgaatacattaaatgaagctctggagtttgcaaaatcagtagattacccatgcttattaagaccgtcttacgtcttgtctgggtctgcgatgaatgtagtttttagcgaagatgaaatgaaaaagtttctggaggaagccacacgcgtgtcacaagaacatccggtagtattaacgaaattcgtggagggagcccgcgaagtggagatggatgccgttggcaaggatgggagagtgatatctcatgctatttcggaacacgtggaggacgccggggttcattctggtgatgctaccttaatgctgccgacacagacaatttcacaaggggctatcgagaaagtgaaagatgctacacggaaaatagctaaggcgtttgcgatatctggaccgttcaacgtgcaatttctagtaaaaggaaacgatgttcttgttatcgaatgcaaccttcgtgcctctcgctccttcccgtttgtctcaaaaacgcttggagttgacttcattgatgtagccacaaaagtaatgatcggtgaaaacgttgacgagaaacatttgccaacacttgatcacccgatcataccggccgattatgtggccattaaagcaccgatgttctcttggccgcggctgcgcgatgcggatcctattctacgttgtgaaatggcatcaacaggggaagttgcgtgctttggagagggcattcacacggcatttttaaaagctatgttatcgacagggtttaagattcctcaaaaaggaattcttattggaattcaacagtccttccgtccgagattcctgggagtcgcggaacagcttcataacgaaggttttaaactctttgctacggaggccacgagtgactggcttaacgcgaataacgttccggcgacaccggtagcatggccgtcacaagagggtcagaatccctctctctcttcgatcagaaaacttatcagagacggctcgatcgacctcgttattaacctccctaacaacaatacaaagttcgttcatgacaattatgtaatccggcgcacagcagttgactctggcattcctttactaacgaattttcaagtcacaaaattattcgctgaagcagtacaaaaaagccgtaaagtcgatagcaaatctctttttcattacaggcaatactcagcagggaaagcggcc

SEQ ID NO: 8014 - DNA, 4500 bp, Artificial Sequence
  Description of Artificial Sequence: Synthetic coding sequence
atgacgcggatcttgaccgcctttaaggtggtccggaccttgaaaaccggcttcggattcaccaatgtgacggctcaccaaaagtggaagttctcccgcccaggaatccggctgctctccgtgaaggcccagactgctcacatcgtgctcgaagatggaaccaagatgaagggttactcattcggccacccttcgagcgttgcgggagaggtggtgttcaataccggactcggcggatacccggaagcgatcaccgaccccgcttacaaggggcaaattctcactatggcgaatccgatcatcggtaacggaggagctccggacacgactgcgcttgacgagttgggattgtcgaagtacctcgagtcgaatggaatcaaggtgtccggcctgcttgtgctggattactcaaaggattacaaccactggttggctaccaagtcgttggggcagtggctgcaggaagaaaaggtgccagccatctacggcgtggacactcgcatgttgactaaaatcatccgagacaaggggaccatgctcgggaagatcgagttcgagggtcagcctgtggatttcgtggacccgaacaaacaaaacctcatcgcggaagtgtcaacgaaggatgtcaaggtgtacggaaagggaaatccgactaaggtggtggccgtcgactgcgggatcaagaacaatgtcattagattgttggtgaagcgcggtgctgaggtccatctcgtgccctggaaccatgacttcactaagatggaatacgacggaatcttgattgcgggaggaccgggaaatccggccctggcggaaccactcatccagaacgtgcggaaaatcttggaatcggaccgcaaagagccgctgtttggcatttcgaccggaaacctgatcactggactggccgccggagcaaagacctacaaaatgtcgatggcgaaccgcggtcagaatcagccggtcctgaatatcactaacaagcaggctttcattacggcccaaaaccacggctacgccctggacaacaccctgccggccggctggaagccactgttcgtcaacgtgaatgaccaaactaacgaaggcattatgcacgaatccaagccgttcttcgccgtccaatttcacccggaggtgactccggggccgatcgacactgagtacctcttcgattcgttcttctcgctgatcaagaaaggcaaagccacgaccatcactagcgtgctgccgaagccagctctggtcgcctcgcgcgtcgaggtgtccaaggtcctcatccttggatccggaggactcagtatcggacaggctggcgaattcgactacagcggatcgcaagccgtgaaggcaatgaaagaagagaacgtcaagacggtgcttatgaaccccaacatcgcatccgtgcagaccaacgaagtcgggctgaagcaggccgacaccgtgtacttcctgccaattactccacagtttgtcactgaggtgatcaaggcagagcagccagacggcttgatcctgggaatgggaggccaaaccgcgctgaactgtggtgtggagttgttcaagagaggggtgctgaaggaatacggagtgaaagtgttggggacctccgttgagtccatcatggcgaccgaggaccggcaactcttttcagataagctgaacgaaatcaatgagaagatcgctccgtcgtttgccgttgagtcgattgaggacgctttgaaggcagcagacacgattggatacccagtgatgatcaggtcagcctacgcactcggcggcttgggatccggaatttgtccgaaccgcgagactctcatggacctgagcactaaggcgtttgccatgaccaaccaaattctggtcgaaaagagcgtgactggatggaaggagatcgaatacgaagttgtgcgggacgccgacgataattgcgtgactgtgtgcaacatggaaaacgtcgacgcaatgggagtgcataccggagactccgtggtcgtggctccagcgcaaaccctttcgaacgcagaattccaaatgctgcggcgcaccagcatcaacgtcgtgagacacctgggaatcgtcggggagtgcaacatccaattcgccctgcaccccacttctatggaatactgcatcattgaagtgaatgctagactgtcgcgcagctcggctctggcctcaaaggccactggctacccactggctttcatagctgctaagatcgccctgggaatccctttgcctgaaatcaagaacgtggtgagcggaaagaccagcgcctgcttcgaaccgtccctggactacatggtgactaaaatcccacgctgggacctggacagattccacggtacctctagccgcatcggatcgagcatgaaatccgtgggcgaagtcatggccattggacggaccttcgaagaatcattccaaaaggccctgcgcatgtgtcacccgagtatcgagggatttaccccccggctgccgatgaacaaggagtggccaagcaacctggacctcagaaaggaactttcagaaccttcctccacgagaatctacgcgattgcgaaggctatcgacgacaacatgagccttgatgaaatcgaaaagctcacttacattgacaaatggtttctgtacaaaatgagagacattcttaacatggaaaagactctcaagggactgaatagcgaatcaatgaccgaagagacgctgaagcgggccaaggaaatcggatttagcgacaagcagatcagcaaatgcctgggacttaccgaagcgcagacccgcgaactgcgtctgaaaaagaacatccatccgtgggtgaagcaaatcgacaccctggcagctgagtacccgtcagtgactaactacctgtacgtcacctacaacggacaggaacacgatgtgaacttcgacgaccatggtatgatggtcctcgggtgcggaccttaccacatcggttcgagcgtcgaatttgattggtgcgctgtgtcctccatcaggactctgcggcaactcggaaaaaagactgtggtggtgaattgcaacccggaaacggtgtcaactgacttcgatgagtgcgacaaactgtatttcgaagagctgtcgctggaaaggatcctcgatatctaccatcaagaggcctgtggcggctgcataatctccgtggggggtcagattccgaacaacctggccgtccctctgtataagaatggagtgaagattatggggacttccccgttgcaaatcgaccgcgccgaagatcggtccatcttctcggcggtgctggatgaactgaaagtggcgcaggcgccgtggaaagcggtgaataccctgaatgaagcgttggagttcgccaagtctgtggactacccgtgtctgcttcggccatcttacgttctgtccggctctgctatgaatgtggtattttccgaggacgagatgaaaaagttcctggaagaggctactcgtgtgtcacaggagcaccctgtcgtgctgaccaaattcgtcgagggagcaagggaggtggaaatggacgcggtcggaaaggatggccgggttatttcgcacgccatttccgagcacgttgaggacgctggagtgcattccggagatgccaccctcatgctcccaacccagactatctcccagggagcgatcgaaaaggtgaaggacgccactcgcaagatcgcgaaagcctttgccatctcgggaccgttcaatgtgcaattcctggtgaaggggaacgacgtgctggtcatcgagtgcaatctccgagccagccggtcctttccatttgtgtcaaaaaccctgggagtggactttatcgacgttgccactaaagtcatgattggagaaaatgtggatgaaaaacacctgcccactctggaccacccgattatcccggccgactacgtcgctataaaggctccgatgttttcatggccgagactgagggacgcggacccaatcctgcggtgcgaaatggcgagcacgggtgaggtggcgtgcttcggagaaggcattcatactgccttccttaaagctatgttgtccaccgggttcaaaattccacagaaggggatcctcattggcatccagcagtcgtttcgcccgagattcttgggtgtggccgaacaacttcacaacgagggattcaaactgtttgccactgaagcaacctctgactggctcaatgcgaataacgtgccggctacccctgtggcatggccgtcccaggaaggacaaaacccttcactctcatcaatccgcaaactgatcagagatggctcgatcgacctcgtgatcaacctgcctaacaacaacaccaagttcgtgcatgataactacgtgatcagacgcactgcggtggattcggggatccctctgctgaccaacttccaggtgaccaagctgttcgctgaagcagtgcaaaagagccgaaaagtggattccaagtccctgttccattaccgccagtacagcgctggtaaagcggca

SEQ ID NO: 8015 - DNA, 4500 bp, Artificial Sequence
  Description of Artificial Sequence: Synthetic coding sequence
atgactaggattctgaccgcgtttaaggtcgtcaggactttgaaaactggttttgggttcaccaacgtgactgcacatcaaaaatggaagttttcgcggccaggtatacggctcctttcggttaaggcccagaccgcgcacatcgtgctcgaagatggaactaaaatgaaaggctactcgttcgggcatccatccagcgtcgcaggtgaagtggtgttcaacaccgggctgggaggatatcccgaagcaataactgatcctgcatacaaaggacaaattctcactatggctaaccctataatcggaaatggtggggcaccagatactactgccctggacgaactgggactgtcgaagtaccttgaatcaaacggaatcaaggtgagcgggctgcttgtcctcgactattcgaaagactacaaccactggcttgcaaccaaatccctgggccaatggctgcaagaagagaaggtaccagcaatctacggtgtggacaccaggatgctgaccaaaatcatccgagacaagggcaccatgctcggaaagatcgaatttgaaggacaaccggtcgattttgtcgatcccaacaaacagaatctgattgccgaggtgagcaccaaagacgtgaaggtgtacggaaaaggtaatccaactaaggtggtggcagtggattgtggtattaagaataatgtgattcgtcttttggtgaagagaggggccgaggtccatcttgtgccttggaaccatgacttcactaaaatggagtacgacggaatcctgatagcaggaggccctgggaatcctgcactggcagaacccctcattcagaacgtgagaaagattctcgagagcgatcggaaggaacctctgtttgggattagcaccggtaatctcatcactggactggcagcaggtgccaagacctacaagatgtcgatggccaaccggggccagaaccaacctgtgttgaacattacgaataagcaggcctttatcaccgcacagaaccatggatacgccttggataacaccctgcctgcaggctggaaaccactctttgtgaacgtgaacgatcaaactaatgaaggaattatgcatgagagcaagccattctttgcagtgcagtttcatcctgaagttactccgggacctattgacaccgagtacctgtttgattcctttttctccctcattaagaagggaaaggcgactacgattacctcagttcttcccaagccggcgttggtggcaagccgggtggaggtgtccaaggtgctcattcttggatccggtgggctgtcgattggacaagctggggagtttgactacagcggttcacaagccgtcaaagcaatgaaggaggaaaacgtcaaaacggtgcttatgaaccctaacatcgcatctgtgcaaaccaacgaagtggggctcaaacaagccgacacggtctactttcttcctatcactcctcaattcgtgaccgaagtgatcaaggccgaacagcctgatgggctgattcttggcatgggtggacaaactgcactgaactgtggggtcgagctgttcaaaaggggagtgcttaaagaatacggtgtgaaagtgctgggaacttccgtcgaatcgatcatggcaacggaagatcgccagctgttctccgacaaactgaacgagataaacgagaagatagcaccgagcttcgccgtggaatcaatagaggatgcccttaaggccgcagacactattgggtaccccgtcatgatacggagcgcatacgctttgggtggtctgggatccggtatctgtcctaaccgagaaacccttatggatctgtcaaccaaggcatttgccatgacgaaccaaatcctggtggaaaaatccgtgaccggttggaaggaaattgagtacgaagtcgtgcgggacgctgacgacaactgcgtgaccgtgtgtaatatggaaaacgtcgatgcaatgggagtgcacaccggtgatagcgtggtcgtcgcacccgcccagactctgagcaatgctgaatttcagatgcttcgaagaacttcaattaacgtcgtccgacaccttggtattgtgggcgagtgcaacatacaattcgcattgcatcctacctccatggaatactgcattatcgaagtaaacgcaagactttcgcgatcgtcggcactggcaagcaaggcaaccggataccctctggcgtttatagcagcgaagatcgcgctggggattccactcccagaaatcaaaaacgtggtgtctggtaagacttccgcatgttttgaaccctccctcgattacatggttaccaagattccccgctgggatctggatagattccatgggacgtcctcccgaattgggagttccatgaagtcggttggcgaggtgatggcaataggcaggactttcgaagaatcgttccagaaagcgctgagaatgtgccatccatctatcgagggatttaccccacgattgcctatgaacaaggaatggccttcaaacctggatctccgcaaagagctgtctgagccgtcaagcaccagaatttacgcaatagcgaaggccatcgatgacaatatgtcacttgatgaaattgaaaaacttacttacatcgataaatggtttctgtacaagatgagagacattcttaacatggaaaagactcttaagggactgaactccgaatcgatgaccgaagaaaccctgaagcgggcgaaagaaattgggttctcagacaagcagattagcaaatgcctgggattgactgaggcccagaccagagaactgaggctgaagaagaatatccatccttgggtcaagcaaattgacaccctcgcggccgagtacccctccgtgaccaactatctttacgtgacttacaacggtcaagaacatgacgtgaacttcgacgatcatggaatgatggtgcttggctgcggtccataccatattggttcgagcgtcgagtttgactggtgtgccgtgtcctcaatccgcactctgcgtcagctgggtaaaaagactgtcgtggtgaattgtaatcctgaaactgtgtcgaccgatttcgatgaatgtgacaaactctactttgaagaactgtccttggaaagaattctggatatctaccatcaggaggcctgtggcggctgcatcatttcggtcggtggacaaatacctaacaacctcgcagttccattgtacaagaacggagtcaagattatgggcacctcacctctccagattgaccgggcagaggatcggagcatctttagcgcagtgctggatgaattgaaagtcgcacaagctccatggaaagccgtgaacactctgaatgaggcactggagtttgccaaatcggttgattacccttgtctgcttcgtccttcctatgtgctctcgggttcggcaatgaacgtcgtgttctcggaagatgagatgaagaagttcttggaagaggcaacccgtgtgtcccaagagcatccggtggtgctgactaaattcgtggagggtgcacgggaggtggagatggatgcagtcggaaaggatggacgtgttatttcgcacgcaattagcgaacatgtggaagatgcgggagtccattcgggtgacgccactcttatgctgcctactcagaccatctcgcagggggccatcgagaaggtgaaggacgccactcgaaagattgccaaggcctttgcaatctcaggaccattcaacgtgcagtttctcgtgaaaggcaatgatgtccttgtcattgagtgcaacctgagagcgtcgagatcttttccttttgtgtccaagactcttggagtggactttattgatgtggcaaccaaagtcatgataggtgaaaacgtggacgagaaacatttgcccaccttggaccatcctattatccccgcagattacgtggccatcaaagcgccaatgttttcttggcccagactgcgtgatgcggacccaatattgcgctgcgagatggcatcaactggggaagtggcgtgtttcggagaggggattcataccgcatttcttaaagcaatgctttcgactggttttaagataccacaaaagggaatcctgattggaatccagcaatcatttagaccccgctttcttggggtcgcagagcagctccataatgaagggttcaagctctttgccaccgaggccactagcgattggcttaatgctaacaacgttcctgcaacccctgtcgcctggccctcacaagaagggcaaaacccatccctgtcgtccatcagaaaacttattcgcgacgggagcatagatctggtgataaatctccctaacaacaataccaagtttgtgcatgataactacgtgatcaggcgcaccgccgtggattcaggcattcctctgttgaccaatttccaggtgactaaactctttgccgaagcagtgcaaaagtcgcggaaggtggattcgaagtccctgtttcactaccgtcagtacagcgctggtaaggcagca

SEQ ID NO: 8016 - DNA, 4500 bp, Artificial Sequence
  Description of Artificial Sequence: Synthetic coding sequence
atgacccgaatcttgacagcttttaaggtagtgcgtacacttaagacagggttcgggtttaccaacgtgactgctcaccagaaatggaaattcagtaggccaggaatccgactactttccgttaaggctcagaccgcccacattgtgcttgaggacgggaccaagatgaagggttactcgttcgggcacccttccagtgtggcaggcgaagtggtgttcaatactggactgggtggataccccgaggccatcaccgacccggcttacaagggacaaattctgacaatggctaaccccattattggcaatggcggggcccctgacaccactgcactggatgagcttggactctccaagtacctcgaaagtaacggtattaaggttagcggcctgctggttctcgactacagcaaagactataaccactggctcgctacaaagtccttgggacagtggctacaagaagaaaaggtcccagccatctatggtgtagatacaaggatgttaaccaagatcatacgagataaggggaccatgctggggaagatagaatttgaaggacagcccgtcgactttgtcgatccgaacaagcagaatctgattgccgaagtaagcacaaaggatgtcaaagtgtatggcaaggggaatccaaccaaggtggtggcagtggactgcggcattaagaacaatgttatccgcttgctggtcaaaagaggtgctgaggtgcacctggtaccatggaaccacgactttactaaaatggaatacgacggcatcctaattgcgggcggacccggcaacccggccctggccgagcctctgatacaaaatgtaagaaagatcctggaaagtgataggaaggagccactatttggcatttctactggtaacctgatcacaggccttgctgcaggggcgaaaacatacaaaatgagcatggccaataggggccaaaaccaaccagttttaaacatcaccaacaaacaggcattcataacagcacagaaccatgggtacgcacttgacaacaccctccccgcggggtggaagcctctattcgtcaatgtaaacgatcagaccaacgagggcattatgcacgagagtaagccattctttgctgtgcagtttcatcctgaggtcaccccaggcccaattgacactgagtacctctttgacagcttcttctccttgattaaaaaagggaaagccactacaattacctccgttctacccaagcctgcgctggtcgcttcccgggttgaggtgtccaaggtgctaatccttggatctggtgggctttcaattggccaggctggagagtttgactatagtggcagccaggcggtaaaagctatgaaagaagaaaacgtgaagaccgtcctgatgaacccaaacatcgcttctgtgcagactaacgaggtcggtctgaagcaagcagacactgtctacttcctgccaattaccccccagttcgttaccgaggttattaaggccgaacaacctgacggcctgatactgggcatggggggtcagacagcgcttaattgtggagttgaactgtttaagaggggagttctgaaggaatacggagtgaaggtactgggcacctcggttgagagcattatggctacagaggatagacagcttttctccgacaagttgaacgagatcaacgaaaaaattgctcccagctttgccgtggaaagcatcgaagacgcactgaaagccgcagacacaataggttacccggttatgatcagaagtgcctatgcgctgggaggcctgggcagcggcatttgcccgaacagagaaactctgatggacctctccaccaaagcatttgccatgactaaccagattctagtggagaagtcagtaacgggctggaaggaaatagagtacgaagtcgttagagacgcagacgataactgtgtgacggtgtgcaacatggagaatgttgacgctatgggggtacatacaggggacagtgtggtggtcgcgccagcccagaccctgtctaacgccgaatttcagatgctgaggcggacaagcataaacgtcgtgagacaccttgggattgtgggagaatgcaatatccagttcgccttacaccctacctcaatggagtattgtattatagaagtcaacgctcggctgagtcgctcttcggccctggcttccaaggctaccggataccccttggcattcatcgccgccaagatcgccctgggcattccactcccagagattaagaatgtggttagcggaaagaccagcgcatgcttcgaaccaagtcttgactatatggtgaccaagatacccaggtgggacctcgaccgatttcacggaacttccagtcgaattggcagctccatgaagtccgtcggcgaggtgatggccatcgggcgaacttttgaggagtccttccagaaagcgctcaggatgtgccatccctcaatcgagggttttaccccccggctccccatgaacaaagagtggccaagcaacctggatctcagaaaggaactgagcgaacctagctccaccaggatctatgctatagcaaaggccattgacgacaacatgagcctcgacgaaattgaaaaactcacatacatcgacaagtggtttctttataaaatgcgagatatcctcaacatggaaaaaactctgaaggggttgaattcagagtcaatgactgaagaaacgctcaagcgggccaaagagatcgggttctcagacaagcagataagcaagtgtctgggcttgaccgaagctcagacacgagaactgcgcctgaaaaagaatattcacccctgggtgaaacagatcgatacactggccgcagagtacccatctgtgaccaactacctttacgtgacctataacggccaagaacacgacgtgaactttgacgaccacgggatgatggtgctaggatgtggcccataccatattggcagcagtgtagagttcgactggtgtgcggtgtcaagcatccgtaccctccgacagctcggcaaaaagacagtggtagtaaactgcaatcctgagaccgttagtactgatttcgacgagtgtgataagctgtacttcgaagagctcagcttggaaaggattctggacatctatcaccaggaagcctgcggcgggtgcattatcagcgtaggggggcagatccccaataaccttgctgtgcccctgtacaagaatggggttaagattatgggcacgtcccctctgcagatcgatagagcagaagatcgctccatctttagcgccgtgttagacgaacttaaggtagcccaagcaccctggaaggccgtcaacacgcttaatgaagcactggaatttgccaaaagcgtggattatccatgtctgctacgaccctcttacgttctcagtgggtccgctatgaacgtggtattctccgaggatgagatgaagaagtttctggaagaggcaacaagggtgagtcaagaacatcccgtagtgctgacaaaattcgtcgaaggcgcccgagaggttgagatggatgctgtcggcaaggatggtagagtcatttcccatgctattagtgagcacgtcgaagacgccggggttcacagcggcgacgcaacactgatgcttcccacacagaccatctcccaaggcgcaatcgaaaaggtcaaagacgctaccaggaagatcgccaaggcattcgcaatatcggggccgttcaatgtgcagttcttggtaaagggtaacgacgttctcgtgatcgagtgcaatttgagggcctctcgctcctttccttttgtgagtaagacactgggggtagactttatcgatgtagctactaaggtgatgattggcgagaacgtcgacgagaagcatctgccgaccttggatcatcctatcattcccgcagactatgtggcaattaaggcccccatgttctcatggccacgactgcgcgacgcggaccccatcctgagatgcgaaatggcaagcaccggcgaggtggcttgttttggtgaaggaatccatactgcatttcttaaggccatgctatcaaccggttttaaaatcccacaaaaaggaattctgattggaatccagcagtcatttcgaccccggttcctcggtgtagcagagcagctgcacaacgaagggttcaagctgttcgctaccgaggccacctccgactggttgaatgccaataacgttcctgccactcccgttgcgtggccctcacaggaggggcagaacccatctcttagctctatacgcaaactcattcgagacgggagcattgatctcgtgataaatctgccgaataacaacacaaagttcgtgcacgacaactatgttatccggcgaacagcagttgactccggtatcccactcctgactaattttcaggtgaccaagttgttcgctgaagccgtgcaaaaatcccgaaaggtggactcaaagagcctgtttcattaccgacagtactccgcaggtaaagctgct

SEQ ID NO: 8017 - DNA, 4500 bp, Artificial Sequence
  Description of Artificial Sequence: Synthetic coding sequence
atgaccaggatcctgacggcatttaaggtggtgcgtactctgaaaaccggattcggctttaccaacgtcaccgcacatcaaaagtggaagttttcccgtcctggcattcgcctgcttagcgtgaaagctcaaaccgcccatattgtgctcgaagatggtactaagatgaagggttactcatttggacacccttcttcagtggcaggagaagtcgtgttcaatactggacttggtggctacccagaggcaattactgaccctgcctacaagggtcaaattctgactatggccaacccaattatcggcaacgggggtgcacctgacaccactgcccttgatgagctcggactgtcgaaataccttgaatcaaacggaattaaggtgtcggggcttcttgttttggattatagcaaggactacaaccattggcttgcaactaagtcacttggacaatggcttcaagaggagaaagtgccagccatatatggagtggacactagaatgctgaccaagatcatccgggataaaggaactatgttgggaaagattgaatttgaaggacaaccggtggactttgtggatcctaacaagcaaaaccttattgcagaggtgtcaactaaggatgtcaaggtctacggtaagggtaatcctaccaaggtggtggcagtggactgtggaatcaagaataatgtgatccggcttcttgttaaacgcggagcagaggtgcaccttgtcccttggaatcacgattttaccaagatggagtacgatggaatactgattgcaggagggcctggaaatcccgccctcgcagaacctctgattcaaaacgtgcgaaagattctcgagtctgacagaaaagaaccgctttttggaatatcgactggcaaccttatcaccggtctggccgcaggtgccaagacttacaagatgtccatggcaaaccgaggccaaaaccaaccagtgcttaacataaccaataagcaggcattcattactgcacaaaatcatggttacgccctcgataacactctgcccgcagggtggaagcctcttttcgtgaacgtgaacgatcagaccaatgagggaattatgcatgagagcaagccctttttcgcggtccaatttcatccagaggtcaccccaggacctatcgacactgagtatctttttgattccttcttctcgctgattaagaagggaaaggcaacgactattacttcggtgctgccaaagccagcccttgtggcgagcagggttgaggtttccaaggtccttattctggggtcgggcggcctttctatcggccaagccggagagtttgattattcggggtcgcaggcagtgaaggccatgaaggaagaaaacgtcaagaccgtgcttatgaaccctaacattgcctccgtgcagactaatgaagtcggtctgaaacaggctgatactgtgtactttctcccgatcactccacagtttgttaccgaagtgattaaggccgaacaacctgacggtcttatccttggaatgggaggtcaaacggcgcttaactgcggagtggagcttttcaagagaggagtgctgaaggaatacggggtgaaggtgcttggaacctccgtggaatcgatcatggcaaccgaggataggcaattgttttcggacaagctgaacgaaatcaatgagaaaattgctccctcgttcgccgtggagagcattgaagatgcacttaaagcggctgacaccattgggtacccagtgatgatcagatcggcatacgctcttggtggcctgggatcaggtatttgtcctaacagagaaaccctgatggacctttcgacgaaggcatttgcaatgacgaaccagatcctcgtcgagaagtcggtgactggatggaaggaaattgaatacgaagtggtgcgtgatgcagacgataactgtgtgactgtgtgcaacatggaaaatgtggatgccatgggtgtccataccggagactccgtggtggtagcccccgcccaaaccctgagcaacgctgaattccagatgcttagacgaacttcgattaacgtcgtgaggcatttgggaattgtgggagagtgcaatatccagttcgctctgcatcctaccagcatggaatactgcattattgaagttaacgcccgcctctccaggtccagcgcacttgcaagcaaggccacgggatacccgctggcctttattgcagcaaagattgcacttggaattcctcttcctgaaatcaagaacgtggtgtcgggtaagacttcggcctgttttgagccaagccttgactacatggtcaccaaaatacctagatgggatcttgaccggtttcacgggacttcctcaaggattgggtcgtcgatgaagtccgtgggagaggtgatggcaatcggcagaactttcgaagagtctttccagaaggcactccggatgtgtcatcctagcatcgagggatttactcctaggctccctatgaataaggaatggccatccaacctggacctgcgaaaagaactcagcgaaccttcgagcaccagaatttacgcaattgcaaaagcaatcgatgacaacatgtctcttgacgaaattgagaagctgacgtacattgataagtggtttctctataagatgcgggacattttgaacatggaaaaaacccttaagggactgaactcggagtccatgactgaagagacgcttaagcgggcgaaggaaattggcttttccgacaaacagatttccaaatgtcttggtctgactgaagctcagaccagggagctgcgccttaagaagaatatacatccttgggtgaagcaaattgacacccttgcagcagaatacccatcggtcactaactacctgtacgtcacctataacggtcaggaacacgatgtgaattttgatgaccatggtatgatggtccttggctgtggcccctaccatattggttcatcggttgaatttgattggtgtgcagtgagctcaatacgtaccctgaggcagctcggaaaaaagacggtggtggtgaactgtaatccagaaaccgtgtcaaccgattttgatgaatgtgataaactctactttgaggaattgtcacttgagcggattcttgacatataccatcaagaagcatgcggtggttgtataatctcagtgggagggcaaatcccgaacaatctggcagtgccgctctacaagaacggggtcaagattatggggacgagccctcttcagatagatagggcggaagatagatcgatcttctccgcggtgttggatgagctgaaggtggctcaagcaccttggaaggcagtgaatacgctcaatgaagctcttgagtttgcaaagtcggttgattacccatgtctgctccggccaagctacgtcctttcgggatcggcaatgaatgtcgtctttagcgaagatgagatgaagaagtttctcgaagaagccaccagagtgagccaggaacaccccgtcgtgcttaccaaatttgtcgaaggagcaagggaagtggagatggatgcagtgggcaaggacggacgcgttatatcgcatgcaatttccgagcacgttgaggatgccggtgtgcactcgggcgacgcaacgctgatgcttcctacccagaccatatctcaaggcgccatagaaaaggtgaaagatgccactcgcaagatcgcaaaggcattcgccatatcaggaccctttaatgtccaattcctggtgaagggaaacgacgtcctggtgattgaatgcaacctcagagcaagccggtcctttccattcgtgtcaaagaccctcggagtggatttcattgacgtggctactaaggtcatgatcggtgaaaatgtggacgaaaagcatctgcctaccctggatcaccccatcatacccgcagattacgtggcaatcaaggcacctatgttctcctggccaagacttcgcgatgcagatcctattctgaggtgcgaaatggcctcaactggtgaagtggcttgctttggagaaggcatccatactgcatttcttaaagcaatgctctcgactggtttcaagattccgcagaagggaatccttattggaattcagcagtcatttcgcccaagatttcttggtgtggccgaacagttgcacaatgagggtttcaagctgtttgcaactgaagcgacttccgattggctgaacgccaacaacgttccagcgactccagtggcctggccatcgcaagaaggacaaaacccatcgttgagctccattcggaagctcattcgggacggatcgattgatctggtgatcaacctccctaacaacaacactaagtttgtgcacgataactatgtgatccgcaggaccgccgtggatagcggaattccactcctgactaacttccaggtcaccaaactgttcgccgaagcggtccagaagtcccgtaaggtggatagcaaatcgctctttcactacagacaatactccgcaggaaaggcagca

SEQ ID NO: 8018 - DNA, 4500 bp, Artificial Sequence
  Description of Artificial Sequence: Synthetic coding sequence
atgaccagaattttgaccgcattcaaggtggtccgcaccctcaagactggatttggattcaccaacgtgaccgcgcatcaaaagtggaagttttcccggcccggaatcagactgctgtcagtgaaagcccagacggctcacatcgtcttggaggacggaactaagatgaagggatactccttcggccacccatcctcagtcgcgggagaggtcgtgttcaacacgggacttggagggtaccctgaagctattacggatccagcgtacaaggggcagatcctcactatggctaatccgatcattggaaacggaggcgccccggacaccaccgcgcttgatgagctgggactttcaaagtacctcgagtcaaatgggatcaaagtctccggactgctggtcctggattacagcaaggactacaatcactggctggctactaaatccctgggacagtggctgcaagaagaaaaggtgcccgccatctacggagtggataccaggatgcttactaaaatcatcagggataagggaactatgctgggcaagattgagttcgaaggtcagccggtcgattttgttgatcctaacaagcagaatctcatcgctgaagtgtccaccaaagatgtgaaagtctatggcaagggcaatccaaccaaagttgtcgctgtggattgcggaatcaagaacaatgtgatccggcttctcgttaagcggggcgcggaagtgcacctggtcccgtggaaccacgactttaccaagatggagtatgacggaatcctgattgcggggggcccaggaaacccggccctggccgaaccactgattcagaatgtccggaagattcttgagtcggatcgcaaggaaccattgttcggcatctcgactggtaacctgatcactgggctcgccgcgggggccaaaacttacaagatgtcgatggcaaatcggggacagaaccaaccggtgttgaatatcactaacaagcaggcgtttatcactgcccaaaatcacggatacgccctggacaacactctgccagcgggctggaagcctctgtttgtgaacgtcaacgatcagactaatgagggcattatgcacgaatccaaaccatttttcgccgttcagttccacccggaagtgactccggggccgattgacactgaatacctgttcgacagcttcttcagcctcatcaagaaagggaaggccactaccatcacgtctgtgctccccaagcccgccctggtcgcttcaagggtcgaagtgagcaaggtgttgatactgggctccggtggactgagcatcgggcaggcaggagaatttgattactcggggtcgcaggcagtgaaggcgatgaaagaagagaacgtgaaaacggtgctgatgaacccgaacatcgcctcggtccaaactaatgaggtgggcctgaagcaggccgacaccgtttacttcctcccaatcacccctcaatttgtgaccgaagtcatcaaagctgagcaaccggacggacttattctgggcatgggtggacagaccgccctgaactgcggggtggaacttttcaaacgtggcgtgttgaaagaatacggcgtgaaagtgctgggaacctcggttgaaagcatcatggcaaccgaggaccgccagctgttttcagacaagctcaatgagattaatgagaagatcgcgccgtccttcgcggtggagtccattgaggacgccctcaaagcagcggacactatcggatacccagtgatgatccgatcggcctacgccctgggcgggctgggatcgggaatctgtcctaacagggaaactttgatggatctctctaccaaagcgttcgcaatgaccaaccagatccttgtcgagaagtcagtcactggctggaaggaaatcgaatacgaggtggttcgcgatgccgatgataactgtgtcactgtgtgcaacatggaaaacgtggatgcaatgggagtgcacaccggcgacagcgttgtggtggccccggcccagactctgtctaatgccgagttccaaatgctccgacgaacctccatcaacgtcgtgagacatctgggaatcgtcggcgagtgtaatatccagttcgctcttcatcccactagcatggagtactgcatcatagaggttaatgccaggctgagccggtcgagcgcactggcaagcaaagctaccgggtaccctctggctttcatcgccgccaagatcgccctcggcataccgctccctgaaatcaagaacgtcgtgtccggcaagacttcggcatgcttcgagccttccctggactatatggttactaagattccgcgctgggacctggaccggtttcacggaaccagctcacgcatcggctcgagcatgaagtcagtgggggaagtcatggccatcggacgtactttcgaggaatcgtttcagaaggctcttaggatgtgccatccgagcatcgagggattcactcctcggctgcccatgaataaggagtggccgtctaacttggacttgcggaaggaactctccgaaccgtcgtccacccggatctacgcaatcgcaaaagcgatcgatgacaacatgtcactcgatgaaatcgagaaactcacttacatcgacaaatggttcctctataagatgcgcgacatcctcaatatggaaaagacccttaaaggactgaatagcgagtccatgacggaagagactctcaagcgcgccaaggaaatcggcttctcagacaaacagatctcaaagtgcctcggactgaccgaagctcaaacccgcgagctgagactgaagaagaacattcacccctgggtgaagcagattgacacgttggccgccgaatacccaagcgtcaccaattacctgtacgtgacctataacggccaggaacacgatgtgaacttcgatgaccacggtatgatggtcctgggatgtggaccctatcacatcggtagctcggtggaatttgactggtgcgctgtgtcgtcaatccggaccctcagacagctgggaaagaaaacggtggtggtgaactgtaaccctgaaaccgtctccactgacttcgatgaatgcgacaaactttactttgaagaactgtcgctggagcggatcttggacatctaccatcaagaggcgtgtggaggctgcatcatcagcgtcggtgggcaaattcctaacaatctggctgtcccgctctataagaacggagtcaaaatcatgggaacttctcctctgcagatcgatcgcgcagaggaccggagcatcttcagcgcagtgctggatgaactcaaggtggcccaagctccgtggaaggccgtgaataccctgaacgaggccctcgagttcgcgaagtcggtcgactacccatgcctgcttagaccctcctacgttttgtcaggatcggcgatgaacgtcgtgtttagcgaagatgagatgaagaaattccttgaggaagcgactcgcgtgtcgcaggagcatcctgtggtcctgaccaagttcgtggaaggcgcgcgggaagtcgagatggatgcagtcggaaaagacggaagggtgatttcccacgccatctcagagcacgtggaagatgcgggggtgcactcgggagacgccacgctcatgctgccaacccaaaccatcagccaaggagccatcgaaaaagtcaaggacgcgacccggaagatcgccaaggcatttgcaatcagcggcccttttaacgtgcagttcctggtgaaggggaatgacgtcctggtgattgaatgcaatcttagagcttcacggtcgtttccgttcgtctcgaaaactctgggtgttgactttatcgatgtggcgactaaagtcatgatcggagaaaatgtggacgaaaaacacctccctaccctggaccaccctataatcccagctgactacgtggccatcaaggcgccgatgttttcctggccgagactccgcgatgctgacccgattttgagatgtgagatggcttccaccggagaggtggcctgtttcggagaaggaattcacactgccttcttgaaggcaatgctgtcaaccggattcaagatcccacagaagggcatcctcatcggcatccaacagtcattccgcccgagatttctgggtgtcgctgaacagttgcacaacgagggattcaaactgttcgccaccgaagcaacttccgactggctcaacgccaacaacgtgccggcgacgccggtcgcatggccttcacaagagggccagaacccatcgttgtcctccatccgcaagctgattcgcgacggttctatcgacctcgttatcaacctgccgaacaataacactaaattcgtccatgataactacgtgattcggcggactgccgtcgattcaggcatcccgctgctgaccaatttccaagtcaccaagctgtttgccgaggccgtccagaagagccgcaaggtggactccaagtcgctctttcactaccgacagtactccgctgggaaagccgcc

SEQ ID NO: 8019 - DNA, 4500 bp, Artificial Sequence
  Description of Artificial Sequence: Synthetic coding sequence
atgacacgcattcttacagcgtttaaagtggtgcggactcttaagacaggctttggcttcaccaacgtcacagctcaccagaagtggaagtttagtaggccgggaattaggttgttgtctgtaaaggcccagactgcacacatcgtacttgaggatgggacaaaaatgaaggggtactctttcggacacccttcctccgtggctggcgaagttgtgtttaatactggacttgggggctaccccgaggccataaccgatcctgcttacaaaggccagatattaacgatggccaacccgatcatcggaaacgggggcgcaccagatactaccgcgctcgatgagctgggcctcagtaaatacttggagagcaatggtatcaaagtcagcgggctgctcgttctcgactattccaaagactataaccattggctcgccacaaagtctctcggccagtggctgcaggaagaaaaggtaccagctatatacggagtcgacactagaatgctgacaaaaatcatcagggataagggcaccatgctggggaagattgaattcgaaggacaacctgtggatttcgtggatcccaacaagcagaatctgattgcagaggttagcactaaggatgtgaaggtttacggaaagggcaatcctacaaaggtcgtggctgttgattgtggaatcaagaacaatgttattaggctgctagtgaagaggggagccgaggtacatctggtcccttggaaccacgactttactaagatggaatacgatgggatactgattgccggaggtcctggcaacccagcccttgcggagcccctgatacagaacgtgaggaagattctggagtcggataggaaagagccgctgtttggcatttctacaggcaatttaattaccggactggccgctggcgcaaaaacctacaaaatgtcaatggccaatcggggccagaatcagcccgtactcaacatcaccaataaacaagcttttattaccgctcagaaccatggctacgctctcgataacaccctgcctgccgggtggaaaccactttttgtaaacgttaatgaccagactaatgaaggcattatgcacgaatccaagccattctttgcagtgcaattccacccggaggtcacaccggggccgatcgataccgaatatctattcgactcctttttctcactgattaagaaaggaaaggcgactacaattaccagcgtactcccaaagccagcactcgtggcttcccgggtggaagtgtccaaagtgctaatcttaggatcaggcgggctcagtattggccaagcaggcgaattcgactactcaggtagtcaggcagtgaaagccatgaaggaagaaaatgtaaagaccgtgcttatgaatcctaatatcgcaagtgttcaaacaaacgaggtgggacttaaacaagcagacaccgtgtactttctgcccatcactccgcagttcgtgacggaagtgatcaaagccgagcaaccagatggcctgatcttgggaatgggcggtcagactgctttgaattgtggcgtggagctttttaagaggggcgttctgaaggaatatggggtgaaagtgctagggacaagtgtcgaatccataatggcaaccgaagaccggcagctgttctcagataagcttaacgagattaatgaaaagatcgcgccttctttcgctgtcgagagtatagaggacgccctgaaagcagccgacacaattggttaccccgtgatgatccgatccgcttacgcactcggtggtttaggttcggggatttgtccgaacagggagactctgatggatcttagtactaaagcctttgcgatgacaaaccagatccttgttgagaagtccgtaaccggttggaaggaaatcgaatatgaagtcgtgcgggacgccgacgacaattgcgtgactgtatgtaatatggaaaacgtcgacgctatgggagtgcatactggcgactcggtagtggtggccccggcacagacactttccaatgcagaattccaaatgctccgtagaacatccatcaacgtggttaggcacctcggtattgtcggagagtgcaatatacagtttgcactgcatcctacaagcatggaatactgtatcatcgaggttaatgctagactcagtcggtcttccgcactcgcctcaaaagcaaccggataccctcttgcttttattgcagctaagatcgcgcttgggattcccctgccagaaatcaagaatgtcgtctccggtaagaccagcgcttgttttgaacccagcctagattatatggtcacgaagatcccgcgctgggatctggataggttccacgggacctcttctagaatagggtcctctatgaaatccgtgggagaagtcatggcaatcgggaggaccttcgaggagtccttccaaaaggccttgcgaatgtgtcacccctcaatagaaggatttaccccccggttgccaatgaacaaggagtggccttctaacttagacttgcgtaaggagctgagtgagcccagctcgacaagaatttatgccatcgcaaaggcaatagatgataacatgagtcttgacgagatcgagaagctgacctacatcgataagtggttcctgtacaagatgcgagacatactcaatatggaaaagactctaaaaggccttaactccgaatctatgacggaggagacactgaaacgggccaaagagattggcttttcagataagcagatctccaaatgtctgggactcaccgaggcacagaccagagagctgaggctgaagaaaaacatccacccctgggtgaagcagatagacacattggcagctgagtatccgagcgttactaactatttgtacgttacctataacggacaggagcatgacgtgaatttcgatgatcatggcatgatggtcctcggctgcggaccgtatcatatcggatccagtgtcgagttcgactggtgtgccgtgagcagcattagaacgctcagacagctgggtaagaagaccgtggttgtaaactgcaacccggagacagtctctactgatttcgacgagtgtgacaagctctacttcgaagaattgtcgctggaacggattctagacatttatcaccaagaggcttgtggtggatgtataatctctgtggggggccagatccctaataacctggccgttccactgtacaaaaatggagtgaagataatgggaacatcccccctgcagatcgaccgcgctgaggaccggagtattttttccgccgtgctggacgagttgaaggtcgcccaagcaccttggaaggccgtgaataccctgaatgaggcgctggaattcgccaaatctgtggattatccatgtctcctccgcccctcttacgttctcagcggcagtgccatgaacgtggtctttagcgaggacgaaatgaaaaagttcctagaggaggcaacccgggtgtctcaggagcacccagtggtcctgacaaagttcgtagagggagccagggaagttgagatggatgccgtgggtaaagacgggagagttatttctcacgctattagtgagcacgtagaagatgcaggagtccactccggagatgctacacttatgctgcctacgcaaacgattagtcagggggccatcgaaaaggtgaaggacgccactcggaaaatcgccaaggcatttgcgatcagtgggcctttcaacgtgcagttcctagtgaaggggaatgatgtgttggtgattgagtgcaatctaagggcttctcgcagcttcccgttcgtctcaaaaactcttggagtggatttcattgatgtggcaacaaaggtcatgatcggcgagaatgtcgacgagaaacacttgcctaccctggaccatcctattattccagctgactacgtggctattaaggctcctatgttttcatggccccgcctgagagatgcggatcctatccttcgatgtgaaatggcatcaactggcgaggtagcttgctttggtgaaggcatccatactgccttcctcaaggctatgctgtctaccggtttcaagatcccgcagaagggcatcctgatcgggatccagcagtcttttcgccccagattcctgggcgtcgcggagcagctgcacaatgaaggatttaagctctttgctacagaagctacctctgactggctcaatgccaacaacgtcccagcgacacccgtggcctggcccagccaggagggacagaaccccagtctgagttctatcaggaaactcattcgagacggctccatcgatctcgtcataaacctccctaacaataacactaaattcgtgcatgataactatgtaatccggagaacggcagtcgacagcggaatacctctgctaaccaactttcaagtgacaaagttgttcgccgaggctgtgcaaaagtccaggaaagtagactccaaatcactcttccactatcgtcagtactccgctggcaaggccgcc

SEQ ID NO: 8020 - DNA, 4500 bp, Artificial Sequence
  Description of Artificial Sequence: Synthetic coding sequence
atgaccaggatccttactgctttcaaggtcgttcgcacgctgaaaaccggattcggtttcactaatgtgacggcacaccagaagtggaagttctcgcggcctggcattcgcctcctctccgttaaggcgcagaccgctcacatcgtgctggaagatggaactaagatgaagggatactctttcgggcatccgtcgagcgttgccggcgaagtggtgttcaacactggactcggaggttacccagaagctattactgacccggcgtacaagggacaaatcttgactatggccaacccgataatcggaaacggcggcgcgccagataccaccgcgctggacgaactggggctctccaaatacctcgaaagcaacgggatcaaggtcagcggcctcctggtcctcgactactcgaaggattacaaccattggctggctacgaagtccctggggcagtggctccaagaggaaaaggttcctgcgatctatggagtcgacactcgcatgcttactaagatcatccgggacaaaggcacgatgctggggaaaatcgaatttgaaggccagcccgtggacttcgtggacccaaacaagcagaatcttatcgcggaagtgagcaccaaggacgtgaaggtctacggtaagggaaatcctaccaaggtcgtggcggtcgactgcggaatcaagaataatgtgatccggctcctggtgaaaagaggggccgaagtgcatcttgtcccgtggaaccatgattttacgaagatggaatacgacggaatcctgatcgcaggaggaccaggaaatcctgccctggcggaaccgctcattcaaaacgtgcgcaagattctcgagtcggatcgcaaagaaccacttttcgggatatctaccggcaacctgattactggcctcgccgctggagccaagacttacaagatgtctatggcaaaccggggtcaaaaccagccagtcctgaacatcaccaataagcaggcctttatcaccgcccagaaccacggatacgctctggataatacgctgccggcaggctggaaaccgctgttcgtgaatgtcaatgatcagacgaacgagggaattatgcacgagtccaaacccttctttgcggtgcagttccaccctgaagtgaccccgggaccgatcgacactgagtatttgttcgattcctttttctcccttatcaaaaagggaaaggctaccactattacttccgtcctgccgaagcctgcccttgtggctagcagggtggaagtgagcaaagtgctcatcctgggatcaggaggactttcaatcggacaagcgggtgaattcgactacagcggatcgcaggcggtgaaggctatgaaggaggaaaacgtgaaaactgtgctgatgaatccaaatatcgcttcggtccagaccaacgaggtcggactgaagcaggccgatacggtgtatttcctgcctataacccctcaattcgtgaccgaggtgattaaggccgaacagccggatggactgatcctgggcatgggcggacaaaccgcactcaactgtggagttgaactgttcaagcgcggggttcttaaggaatacggggtgaaagtgcttggtacctcggtggaatcgatcatggcgactgaagataggcagctgttttcagacaaattgaacgagatcaatgagaagatcgcgccctccttcgcggtggaaagcattgaggatgcacttaaggccgcggacactatcggctaccctgtcatgatacgatcagcatatgcccttggaggcctcggtagcggaatctgcccgaacagagaaacgcttatggacctgtccaccaaagccttcgcgatgaccaatcaaatcctcgtggagaaaagcgtcactggttggaaggaaattgagtacgaagtggtgcgcgacgccgacgacaactgcgttacggtgtgcaacatggagaacgtggatgctatgggggtccacaccggagactccgttgtggtcgcgccggctcaaactctgtcgaacgccgaatttcagatgctccgtcgcacctcaatcaatgtggtgaggcatctgggtattgtcggcgaatgtaatatccagttcgccctccacccgacttcaatggagtactgcatcatcgaagtgaacgcgcgcctctcgcggtcgtcagccttggcatccaaggccactggatacccgctggccttcatcgctgcgaagatcgcactcggcatcccactcccagaaatcaagaacgtggtgagcggtaagacttcagcatgcttcgagccctccctggattacatggtcacgaaaatcccgagatgggacctggaccggttccacggcacctcgagcagaatcggttcgagcatgaaatcggtcggcgaggtgatggccatcggaaggacctttgaggagagcttccagaaggccctgcgcatgtgccatccgtcaatcgaagggtttacgccgcggttgccgatgaacaaagagtggccgtcgaacttggatctgagaaaggagctgtcagaaccgtcgtccaccaggatttatgcaatcgcgaaagcgattgacgataacatgtcgttggatgagattgaaaagttgacctacatagacaaatggttcctgtacaagatgcgggacatcctcaacatggaaaagactctcaagggactgaactcggagtccatgactgaggagactctcaaaagagcgaaggaaatcggattctctgacaagcagatctcgaagtgcctgggccttaccgaagcacagactcgggagctgcggctgaagaagaacatccacccttgggtgaagcaaatcgatacgctcgccgctgagtacccttccgtgacgaactacctctacgtgacctataacggccaggaacacgacgtgaattttgatgaccacggaatgatggtgctgggttgcggaccgtaccacatcggctcgagcgtggaattcgactggtgcgccgtgtcgagcatcagaacccttagacagctgggcaaaaagaccgtcgtggtgaactgcaaccccgagactgtctcaactgacttcgatgagtgtgacaaattgtacttcgaagaattgtccctcgagcggattctcgatatctaccaccaggaagcgtgcggaggatgtatcatctccgtcggaggacaaatcccgaataacctggcagtccctctctacaagaacggtgtgaaaatcatgggaacttccccgctgcagatcgaccgggcggaagatcgaagcatcttttccgccgtcctcgacgaactcaaagtcgcccaggccccgtggaaagcagtcaatacgctcaacgaggcactcgaattcgctaaatctgtcgactacccatgtctgctgcgccctagctacgtgctgtcgggttcggccatgaacgttgtgttttcggaagatgagatgaagaaatttctggaggaggcgacccgggtgtcccaagagcatcctgttgtccttaccaagtttgtggaaggtgcaagggaagtggaaatggacgctgtgggcaaggatggccgcgtgatctcacacgcaatctcggagcacgtcgaagatgcaggagtccattcgggggacgccactttgatgctgcccacccagactatctcccaaggcgccattgaaaaggtcaaagatgcgactcgcaagattgccaaggctttcgcaatctcaggaccattcaacgtgcaattcctcgtgaaaggcaatgacgtgctggtgatcgagtgcaatctccgagctagcaggtccttcccgtttgtgtcaaagactcttggagtggatttcatcgacgtggcaacgaaggtgatgatcggagagaatgtggacgaaaagcacctgccgacgctcgaccacccaatcatcccagctgactacgtcgccattaaggcaccaatgttctcatggcctaggctgcgcgacgcggatccgatcctgagatgcgagatggcctccaccggggaggttgcctgtttcggagaaggtatccataccgccttcctcaaggcaatgctgtccacggggttcaagatcccacagaagggcatcctgataggcattcagcaatccttccgcccccggttcctgggcgtggcggagcaattgcataatgaggggttcaagctgttcgctactgaagccacctcagactggctgaacgcgaacaacgtgccggccaccccggtggcttggccatcccaagagggacaaaatccttccctgtcgtcgatcagaaaactgattcgcgatggaagcatcgacctggtgatcaatctgccgaacaacaatacgaagttcgttcacgataactacgtgatccgccggaccgccgtcgactccggcatcccgctgttgaccaattttcaagtgactaagctgtttgcggaggccgtccagaaatcgcgaaaggtcgattccaagtcgctcttccattacaggcagtactcagccggaaaagccgcg

SEQ ID NO: 8021 - DNA, 4500 bp, Artificial Sequence
  Description of Artificial Sequence: Synthetic coding sequence
atgacacgtatactgacagcttttaaggtggtgcggactcttaagaccgggttcggattcaccaatgtgacggcgcatcaaaagtggaagttctccagaccagggatccgcttgctgagtgtgaaagcacagactgcccacatcgtgctggaggacggtacaaagatgaagggttacagttttggacacccgtcctcggtagctggagaagtcgtatttaataccgggctggggggataccccgaggccataacagatcctgcctataaaggccaaatcctgaccatggcaaatccaataattggaaacggcggcgcccccgacacaacggccttagatgagctgggattaagcaagtacctggaatcaaacgggattaaggtgtctggtctcctggttctggactattccaaggattacaatcactggctggccaccaaatcactgggtcagtggctccaggaggaaaaagttcccgcaatctacggagtagacacacgcatgttgaccaagatcatcagggataaaggaaccatgctgggaaaaatcgaattcgagggtcagcccgttgacttcgtcgatcccaacaagcagaacctgattgcagaggtgtcaacaaaggacgtcaaggtgtacgggaagggcaatccgaccaaggtggtcgccgtggactgcggaatcaaaaacaacgtgattcggctgctggttaaaaggggcgccgaagtccatctggtaccgtggaatcatgatttcaccaaaatggagtacgatggcattctaattgccggaggcccgggaaatccagcattagccgagccattgattcagaatgtgcgaaagatcctcgaatctgatagaaaagaaccgctctttggaatatccaccggtaatctcatcaccggactggccgccggcgccaaaacctacaagatgagcatggcgaatcgcggtcagaatcaaccggttctgaatatcacaaacaagcaggcctttatcacggcccagaaccacgggtacgccttggataatacgttgcccgccggctggaagcctctgtttgtcaatgtgaatgaccagaccaacgagggaatcatgcacgagagcaaaccattctttgccgtgcagtttcatcccgaggtgaccccagggccaattgatacggaatacttattcgactctttcttctccctgattaagaaaggaaaggcgacgaccattaccagtgtgctgccaaagccagcgctagtggcatcccgcgttgaagttagtaaagtgctgatcctgggaagtggtgggctgagcattggtcaggccggggagtttgattacagtggctctcaagccgtcaaggccatgaaggaagagaacgtgaagacagtcctgatgaacccaaacatcgcgtcggttcaaacgaatgaggtgggactgaagcaagcagatactgtctatttcctgccaattacaccacaattcgtaacagaagtaattaaggcagaacagcccgacggtttgatcctcggcatgggtgggcagaccgcgctcaactgtggcgtcgaactattcaagcgaggtgtgctgaaagaatatggtgtgaaggtgctggggaccagcgtggagtccattatggccactgaagatcggcagctgttttccgacaagctgaatgagatcaatgagaagatagccccttcgtttgccgtggaatcaatagaggatgctctgaaagccgcggacacaatcggatatccggtgatgatccgctcagcttacgcactcggaggcctcggatcagggatctgcccaaaccgagagactctcatggacctgtctacaaaggcatttgccatgactaaccaaatccttgtggaaaaatccgtcaccggatggaaggagatcgaatacgaggtcgtccgagacgccgatgacaactgcgttaccgtgtgtaacatggagaacgtggatgcaatgggcgtgcacaccggcgactctgtagtcgtggccccagcgcaaactttatcgaacgctgaatttcagatgctcagaaggacctccattaacgtggtcaggcacttaggtattgtcggcgaatgcaacatccagttcgcactccaccccacgagcatggagtactgtatcatagaggtgaacgcccggctctctcgatcctccgcattagcatccaaggccacaggttacccgctggccttcattgccgctaagattgcactcggcatcccgcttccagaaatcaaaaacgtggtgtccgggaagacgtctgcctgtttcgaaccttctttggattatatggtcaccaagatcccacggtgggatctggacaggtttcacggtaccagctcccgaatcgggagctcaatgaaatcggtcggcgaggtgatggctataggccgcacatttgaggagtcttttcagaaggccctcaggatgtgtcatcctagcatcgaaggattcacgccacgtcttcccatgaataaggaatggccgtccaatctagacctgcggaaagagctttccgagccttctagcacacggatctatgccatcgctaaggccatcgatgataacatgtcactagacgaaatcgagaagctcacatacatcgacaagtggttcctttataagatgagagatatcttgaacatggagaaaacgctgaagggactgaacagtgagtcgatgaccgaggaaactctgaagagggccaaggaaatcggcttctctgacaagcagatcagcaaatgcctggggctgacagaggcccagaccagagagctacggctgaaaaagaatatccatccttgggtgaagcagatcgacaccttggcggccgaatacccctctgtgacaaattacctgtacgtgacctacaacggccaggagcacgatgttaatttcgatgaccacggtatgatggtgctgggatgcggaccctatcatatcggcagcagtgttgagtttgactggtgtgccgtatcatcaattcgtacactgagacagctgggaaagaagaccgtggtggtcaactgtaatcctgagaccgtgtcgacagactttgacgagtgtgataaactgtacttcgaggagctcagtctggaacggattctggatatctatcatcaagaggcctgcggaggttgtatcatttctgtcggtggacagattcccaacaatctggctgtgcccctatacaagaacggcgtcaagataatggggacctcccccctgcagatagaccgggccgaagatcggtcgatcttctctgcagtgctggatgagctgaaggtggctcaagcaccttggaaggcagtaaatacccttaacgaggccctcgagtttgccaagtcagtcgactacccatgcctgctgagaccaagctatgtgctgtccggtagcgcaatgaatgtagtctttagcgaagacgagatgaagaagtttctcgaggaagcaacgcgagtgagccaggagcacccagtagtactgactaagttcgttgaaggagcccgcgaggtagagatggacgctgttggaaaggatgggcgggtcatttcgcacgcaatatccgagcatgtcgaggatgcaggcgtgcatagtggagacgcgacactgatgctacccacacagacaatcagccaaggcgctatcgaaaaggtcaaggacgccactaggaaaatcgccaaagcctttgcgatcagtgggcccttcaacgtacagtttctggtcaaaggtaatgacgtcctggtgatcgagtgcaatttgcgtgcatcccgctccttcccctttgtgtctaagaccctcggagtggattttattgacgtagcaacgaaggtgatgatcggagagaacgtggacgaaaaacaccttccaacactggaccacccaatcatccctgccgattacgtggctattaaggctcccatgttttcctggccacgactgcgtgacgccgaccccattttacggtgtgagatggctagcaccggggaggtggcatgtttcggtgagggaattcataccgccttcctgaaggctatgctaagcaccgggttcaagatcccgcaaaagggcattctcattggtatccaacagagctttcgaccacgctttctgggggtggcagaacagttacacaacgaaggattcaagctattcgcgaccgaggctacatctgactggctcaacgccaacaatgtccctgcgaccccagtcgcctggccctcccaggagggccagaatcctagcctctcatctattcgaaagctcattcgagacggctcaattgatttggtgatcaacctgcctaacaacaatactaaatttgtccacgataattatgtgatacgtcgcactgcagtcgacagcggcatccccctgctaacaaatttccaggtgacaaagctctttgcagaagccgtccagaagagccggaaagttgacagcaagagtctctttcattatagacaatacagcgcagggaaagctgct

SEQ ID NO: 8022 - DNA, 4500 bp, Artificial Sequence
  Description of Artificial Sequence: Synthetic coding sequence
atgactcgaatcctcactgccttcaaagtggtgcgcaccttgaaaaccggattcggtttcaccaacgtgaccgcacaccaaaagtggaagttctcaagacccggtatccgcctcctgtccgtgaaagcccagaccgcgcacattgtgctcgaggacggaaccaagatgaaaggatactcgtttgggcacccgtccagcgtcgcaggagaggtcgtgttcaataccgggctcggggggtaccctgaggctatcaccgatccggcatacaaaggtcagatccttaccatggctaaccctatcattggcaacggaggagccccagacactaccgcgctggatgagctgggcctgtcgaagtacttggaatcgaacggtatcaaggtttcaggactccttgtgctggattactcaaaggactacaaccactggctggccactaagtcgctgggacaatggctgcaggaagagaaggtgccggccatctacggggtcgacaccagaatgctcaccaagatcatccgggataaagggaccatgctgggaaaaatcgagttcgaggggcagccggtcgactttgtcgaccccaataagcaaaatctcattgccgaggtgtcaaccaaggacgtgaaagtttacggaaagggaaatccaaccaaagtggtggctgtggactgcggtatcaagaacaacgtgattagactgctggtgaagcggggagccgaagtccacctggtgccttggaaccacgattttaccaagatggaatacgatggaattctgatcgcaggcgggccgggtaaccctgcactggcggagcctctgatccaaaacgtgcgcaagatcctcgaaagcgatcgaaaggaaccactgttcggcatctcgaccgggaacttgatcacgggtctggcggcgggcgctaaaacttacaaaatgtcgatggccaacagaggacagaatcagccggtgctgaacattaccaataagcaggctttcatcactgcccaaaatcacggctacgcgctggacaatactctgccggcaggatggaagccattgtttgttaacgtcaatgatcaaacgaatgaaggcattatgcacgaatccaagcccttcttcgcagtgcaatttcacccagaagtcactccagggccgatagataccgaatacctgttcgactccttcttctcactcatcaaaaagggaaaggccactaccattacctccgtactgccgaaaccggctctggtcgcctcccgcgtggaagtgagcaaagtccttatcctgggatcagggggactgagcattggtcaggcaggagaattcgattactcgggctcgcaggcagtgaaggctatgaaggaggaaaacgtcaagaccgtgctcatgaacccgaatatcgcatcggtgcaaactaatgaagtgggactcaagcaggccgatactgtctacttcctgccgatcaccccccagttcgtgaccgaagtgatcaaggccgaacagccggatggcctgatcctggggatgggaggacaaactgcactgaattgcggagtggaactgttcaaacgcggtgtgctcaaggagtacggagtcaaggttcttgggactagcgtggagtcaatcatggcgactgaggatcggcagctcttctcggataagctcaacgagatcaatgagaagatcgccccttcctttgcagtcgagtcaattgaggacgctctgaaagctgcagatactatcggataccccgtgatgatccggtcagcgtacgcgctgggcggactgggttcgggaatctgtccaaaccgagaaaccctgatggacttgtctactaaggcgttcgccatgaccaaccagatcctcgtggagaaatccgtgaccggatggaaggaaatcgaatacgaagtggtgcgggacgccgacgacaactgtgtgaccgtttgtaacatggaaaatgtggacgctatgggagtgcacacgggggacagcgtcgtcgtggccccagcccagactttgtcgaatgcggaattccagatgctgaggcgcacttcaattaacgtcgtgcgtcatctcggtattgtcggagagtgcaatattcagttcgctctgcaccctacttccatggaatactgcatcatcgaggtgaacgctcgcctgtccaggtccagtgcattggcttccaaggccacgggctacccgctcgccttcatcgcagcaaagatagcccttggcatcccgctgccagagattaagaatgttgtgtcaggtaagactagcgcgtgtttcgaaccatcgctggactacatggtgactaaaatccctcgctgggacctggatcggtttcatggaactagttcgaggattggatcgtccatgaaaagcgtgggtgaggtcatggcaatcggacggactttcgaggagtcctttcaaaaagcgctccgcatgtgccacccgtcaatcgagggctttacgccgagacttccgatgaataaggaatggccgtccaatctcgatctccggaaggaactctctgaacccagctcgactagaatttacgcaatcgctaaggccatcgatgacaacatgtccctggacgagatcgagaaactgacttacatcgacaagtggtttttgtataagatgcgagatatcctgaacatggaaaagaccctcaaaggattgaacagcgagagtatgactgaggagactctcaaacgggccaaggagatcggcttttcggataaacagatctccaagtgtctgggcctcaccgaggcgcaaaccagagaactccggctgaagaagaacatccatccgtgggtgaagcagatcgatactctggccgcagagtacccttcggtgaccaattacctttacgtgacttacaatggacaggaacatgacgtcaacttcgacgaccatggaatgatggtgctgggctgcggcccttatcatatcggaagctccgtggagttcgactggtgcgccgtgagctccatccggactctccgccaactcggaaagaaaactgtggtagtcaactgtaacccggaaactgtgtcgactgacttcgacgaatgtgacaaactgtacttcgaggagctttctttggagagaatcctggacatttatcatcaggaggcatgtgggggatgcattatctcggtggggggacagatcccgaataacctcgcagtcccgctctataagaatggagtcaagatcatgggaacttcgcccctgcaaatcgacagagctgaagatcgctccatcttcagcgcagtgctggacgagctgaaggtggcccaagccccttggaaggcagtaaataccctgaacgaggcccttgagttcgcaaagtccgtggactacccttgcctgttgcggccctcgtacgtcctctcgggcagcgccatgaacgtggtgttctcggaagatgaaatgaagaagttcctggaagaagctaccagagtttcccaggagcacccagtggtgctcacgaagtttgtggagggcgcgcgcgaagtggagatggatgccgtggggaaggatggacgcgtcatttcacatgccatctcagagcatgtggaagatgcaggcgttcactcgggggacgccactctgatgctccctacgcagaccatttctcagggagcgatcgagaaagtcaaagatgcgaccagaaagatcgccaaggcgttcgctatctccggcccgttcaacgtgcagttccttgtgaagggaaacgatgtgctggtgatcgaatgcaacctgcgagcctcacggtcgttcccctttgtgtcaaagacgctgggtgtggacttcatcgatgtggcgaccaaggtcatgattggagaaaacgtggatgagaagcatctcccgaccctcgaccatcctatcattcccgccgattacgttgctattaaggctccgatgttctcgtggccgcgcctgcgggatgccgacccgatcctcagatgcgagatggcctcaaccggagaagtggcgtgcttcggggaagggatccacactgctttcctcaaggccatgctgtccaccgggttcaagattccacagaaagggatccttataggaatccagcaatcgttcagaccaagatttttgggagtggcagaacaactgcataatgagggcttcaagctgtttgccacggaagcgacttcagactggcttaatgccaacaacgtcccggcgactccggtcgcatggccgagccaggaaggccaaaatccttcactgtcatcgatccgcaagctgatcagagatggatcgattgacctggtcatcaatcttccgaacaataacacgaaattcgttcacgacaattacgtgatccggcgcactgccgtggactcgggaatcccgctcctgactaatttccaggtgactaaactgtttgccgaggcagtccaaaagtcgcgtaaggtggatagcaaatccctgttccattaccggcagtacagcgccggaaaggctgct

SEQ ID NO: 8023 - DNA, 4500 bp, Artificial Sequence
  Description of Artificial Sequence: Synthetic coding sequence
atgactcggatcctgaccgcctttaaagtggtgcggacactgaagacgggatttggtttcactaatgtgaccgcacaccagaaatggaaattctctaggcccggcattagactgcttagcgtcaaagctcagacagcccacatcgttctggaagatggcaccaaaatgaaaggctactccttcgggcaccctagctcggtagctggcgaagtggtatttaatacaggactcggaggataccccgaggcgatcaccgatccggcctacaaaggccaaatattaaccatggctaatccaataatcggcaatggcggggctcccgatactaccgcccttgatgagctaggacttagcaagtacctggaatctaatggtatcaaagtgtctgggctcctggtcctggactatagtaaggactacaatcactggctcgcaaccaaatctctcggacagtggctccaggaggagaaggtgcctgccatttacggcgtcgataccaggatgctaacaaagattattagggataaaggcacaatgcttggaaaaatcgagtttgaggggcagccggtagacttcgtggatccgaacaaacaaaacctaattgctgaagtttcaacaaaagacgtcaaagtctatggaaagggcaaccctactaaagtggtggctgtggattgtggcatcaaaaataatgtaatccgattgctggttaagcgcggcgctgaagttcacctcgtgccctggaatcatgattttaccaagatggagtacgacggaatcctgatcgctggtgggcccggcaatcctgcactggccgagcccctgatacaaaatgtgcgaaaaattctagaatcggaccgcaaagagccgctgtttgggattagcactgggaacctgataaccggacttgcagctggggctaagacctataagatgagtatggccaaccgcggacaaaaccaacctgtcctcaacatcacaaataagcaggcatttattaccgcccagaaccacgggtacgctctggacaacaccttgccggccggctggaagccactctttgttaacgtgaacgaccaaacgaacgaaggaatcatgcatgaatctaagccattcttcgcagtgcaattccacccagaagttacacccggcccaatcgataccgaatacttgttcgatagcttctttagcttaatcaagaaggggaaggctaccaccatcacaagcgtattgccgaagcccgcgcttgtggcaagtcgtgtggaggtgagcaaagttctgattttgggttccggcgggttgagcattgggcaggctggcgagtttgactactccggatcgcaggctgtcaaggcgatgaaggaagagaacgtgaagaccgtgctgatgaatcctaacatcgcatcagtccagacaaacgaggtggggctgaaacaggcagacacagtttactttcttcctatcacccctcagttcgtcaccgaggtgatcaaagccgaacaacctgacggactcattctgggaatgggcggccaaactgcgctgaactgcggcgtcgaactgttcaaacgaggggtgctaaaagaatacggtgtgaaggttctagggaccagtgtggagagcattatggcaacagaggacagacaactgttttctgacaaactgaatgagatcaacgagaagatagcccctagcttcgccgtagagtctatcgaagacgccctgaaggcagcagacacgattggctatccagtgatgatccggtctgcgtacgctctcggtggtttgggaagtgggatatgccctaacagagaaacgctaatggacctctccacaaaggcttttgccatgacaaaccagatactggtggagaagagtgttaccggatggaaggagatagaatatgaggtggtgcgagatgcagacgacaattgtgttacagtctgcaatatggagaatgtagacgcgatgggtgttcacactggagatagtgtagtggtcgccccggcccagacattaagtaatgccgagttccaaatgctgcgacggaccagcataaacgttgtgaggcacctcgggattgtaggggagtgtaatatccaatttgccctgcatccaacctctatggagtactgtattatcgaggtgaacgcccggttgtcgcgcagttctgccctggcatctaaggctaccggctacccgctggcttttatcgccgcaaagatcgccttgggaattccactaccagaaatcaagaacgtagtgtccggcaagaccagcgcctgttttgaaccttccctggactacatggtcactaaaatccctaggtgggatctcgatcgctttcacggcacatcatcgagaattggatcaagcatgaagagcgtgggagaggtaatggcaataggaagaaccttcgaggagtcattccaaaaggcccttcgaatgtgccatccgagtatcgaaggattcactccacgcctgcccatgaataaggagtggccatccaatctcgacctgagaaaggagctctccgagccaagtagtacgcgaatatacgccatcgcgaaagcaatcgacgataatatgagcctggatgaaatcgagaaacttacatacatcgacaagtggttcctatacaaaatgagggatatacttaacatggaaaagacccttaaaggtctgaactctgaatccatgaccgaggaaaccctgaaacgggcgaaggagatcggattcagcgacaaacagatctcaaaatgcctgggactcacggaggcacagaccagagagttacggctgaagaagaacatccacccatgggtgaagcagatcgatacacttgcggccgagtacccaagcgtgaccaactacctctatgtcacatacaacggccaggaacacgatgtgaactttgacgaccatggtatgatggtgctcgggtgtggaccctaccacataggctcttccgtggaatttgactggtgcgctgttagtagcattcgcaccctccgccagcttggtaaaaagactgtagtggtcaactgtaatcccgaaacagttagcaccgattttgatgaatgcgataaactgtacttcgaagagcttagtcttgaacgtatcctagatatctatcatcaggaggcttgcggtgggtgtatcatcagtgtgggaggacaaatacccaataacctcgcagtgcctctctataaaaatggagtcaagatcatgggcaccagtccactacagatcgaccgagcggaagacaggtcgatattctctgccgtcctggacgagctgaaggtagctcaggcgccgtggaaagccgttaacacactaaacgaggcacttgaattcgctaagagcgtggactacccatgcctgctccgcccatcatatgtactgagtggaagcgcaatgaatgtcgtattttccgaggacgagatgaagaagtttttagaggaggccacccgcgtctcacaggaacatccggtagttttgacaaagttcgtggagggagcgcgagaggtggagatggatgccgtaggaaaagacggtagggtgatatcgcatgcaataagtgaacacgttgaagatgcaggggtgcactccggggatgcaacccttatgctccccactcagaccatttcccaaggggccatcgagaaagtgaaggatgccacaaggaagatcgctaaggcctttgctatcagcggccccttcaacgtgcagtttctggtgaaaggaaacgatgtgctggtaatagagtgcaacctgcgagcatcaagatcatttcccttcgtgagcaaaactctgggcgtggatttcattgatgtggccactaaagtgatgataggggaaaacgtggatgagaagcatctgcctaccctcgaccatcccatcattccagccgattacgtagcaatcaaagcccctatgttctcatggccaagactgagagatgcagatcccatactgcgctgcgaaatggcttccacaggcgaagttgcttgttttggggaagggatccataccgcgttcttaaaggccatgctttcaaccggtttcaagataccacagaaaggaattcttatcggcatacagcagagtttccgaccccggttcctcggagtagcagaacaactccataatgaggggtttaagttgtttgccacggaggcgacatctgactggctgaacgccaacaatgtgccagctacgcctgtcgcttggccttcacaggagggccagaatccaagcctgtcaagcatccgtaaactgatccgggacggttccatagatctggtcattaacctccctaacaacaacaccaaattcgtccatgacaattatgtcataaggagaaccgcagtcgacagcggcatcccgcttttaacaaacttccaggtgacaaagcttttcgccgaggcagtgcagaaaagtagaaaggtcgattccaaaagtctgttccactaccgtcagtactccgctgggaaagctgcc

SEQ ID NO: 8024 - DNA, 4500 bp, Artificial Sequence
  Description of Artificial Sequence: Synthetic coding sequence
atgactaggattctgacagcattcaaagttgtccggacccttaaaacaggtttcggcttcaccaacgtgactgcccaccagaagtggaaatttagccggcccggtataaggctgctgagcgtcaaggcacagacagctcacatcgtgcttgaagatggcacaaagatgaaaggctattctttcggtcacccatcctctgtcgccggtgaggtagtctttaatacagggctgggcggatacccagaggccattacggatcccgcctataagggtcaaatcttgacaatggccaatccaatcattggaaacgggggtgcaccggacaccaccgccctggacgagctgggactgtccaagtatttggaaagcaatgggattaaagtgagcgggctcttagtgttggattattccaaggactataaccattggctcgccacaaagtctttaggacaatggctccaggaggaaaaagtcccggctatctatggagtagacaccaggatgctgacaaaaataattagagataagggcactatgctgggaaagatcgaatttgaaggccagcccgtcgatttcgtggacccgaacaagcagaatctcattgccgaggtctcaaccaaggatgttaaggtctatggaaaaggtaaccctaccaaagtggtggccgtggactgcggaatcaagaacaatgtgatacgattactggtaaagaggggagcagaggtgcaccttgtgccttggaaccacgatttcacaaagatggagtatgacggtattctgattgctggaggcccaggaaaccccgcactggccgaaccactgatccagaacgtgcgtaagattctcgaatccgacagaaaagaaccattgttcgggatctctaccggcaatctgataacagggctggcagctggagccaagacttacaagatgagtatggctaatcgtggacagaaccagcctgtgctgaacattacgaacaagcaggcttttattaccgctcagaaccatggatatgccctggataatacactgcctgctggatggaaacctttgttcgtgaatgtgaacgaccaaacgaatgagggaattatgcacgagagcaagccatttttcgccgtccagttccatcctgaggtgacgcccgggcctattgacacagagtacttgtttgattctttttttagcctgattaaaaagggaaaggctaccacgattacatccgttcttcctaaacccgcactggtggcttctagagtagaagtgtcaaaggtccttatcttaggctccgggggcttgagcatcgggcaggcaggtgagttcgactatagcggctctcaggcagtgaaagcaatgaaggaggaaaatgtgaagacagtactgatgaatccgaatattgcatcagtgcagaccaacgaggtgggcctgaagcaagctgacactgtatattttctgccaatcacgccccagtttgttaccgaggtgatcaaagcggaacaacccgatggactgatccttggcatggggggacagacagcccttaactgtggcgttgagctgttcaagcgtggggtgcttaaggagtatggggtgaaagttcttggaacaagcgtcgagagcataatggcaaccgaggaccgccagttgttttcagacaagctgaatgagatcaatgagaagatcgcgccctcattcgccgtggagagtattgaagacgcactgaaagcagccgacaccataggctatcccgtgatgattcgctctgcctatgcgctgggtggcctaggcagcggtatatgtcctaaccgcgagacactcatggacctctcgactaaggccttcgccatgactaaccagatccttgtggagaagtcggttaccggttggaaagagattgaatatgaggttgtgagagacgccgacgacaattgtgtgaccgtttgcaatatggaaaatgtcgatgcaatgggggtgcatactggcgattctgtggtagtcgccccggcacagaccctctctaatgccgaattccagatgctcagaaggacatctatcaatgtggtccgtcacctcgggattgttggcgagtgtaatattcaatttgctctgcaccccacgagcatggagtactgcatcatcgaggttaatgccaggctgtctcggtctagcgcactggccagcaaggcgacgggctaccctctcgcatttatagccgccaagatcgccttaggaatacctcttcccgaaatcaaaaatgtggtgagtggcaagacttcggcatgttttgaacccagcctcgattatatggtcactaaaattcctaggtgggatcttgatcgttttcatggaacgtctagtcggatcggctcaagcatgaagtcagtgggggaagttatggccattggcaggacatttgaggagagtttccagaaggccttgcggatgtgccatccttccattgagggtttcacccctcggctgccaatgaataaggaatggccttcaaacctcgatttacgcaaggagctgtctgagccatcctctactcggatatacgcgatcgcaaaggccatcgatgacaatatgtctcttgacgaaatagaaaaactgacgtatatcgacaaatggttcctgtataagatgagggatatactgaatatggaaaaaaccttgaaagggctgaatagtgagtctatgaccgaggaaaccctcaagagggctaaggagattggcttttctgataaacaaatttcaaagtgtctgggcctcacagaggctcagacacgagagctcaggctgaagaaaaatattcatccatgggtgaagcagattgataccctcgcagcggagtatccttctgtcaccaactacctgtacgtaacgtacaacggacaggaacatgacgtcaactttgacgatcatgggatgatggtgctcggttgcggcccttatcatataggcagctccgtcgaattcgattggtgtgcagtctcctcaattaggactctccggcagcttggtaagaagacggtggtggttaactgtaatcctgaaaccgtttccacagacttcgacgaatgcgacaagttatacttcgaagaattgagcctcgaacggatcttggacatatatcatcaggaggcgtgtggcggctgtattatttctgtcggaggacaaatccccaataacttggccgtgccattgtataaaaatggggtcaaaatcatgggtactagcccactgcagatcgatcgggctgaagaccgctctatcttctcagccgtccttgacgagctaaaggtcgcccaggccccctggaaggccgtgaataccctgaacgaagctctcgagtttgcaaagtcagtcgattatccatgtctcctgaggcctagctacgtgctgagcgggtccgccatgaacgtggtgttttctgaagacgaaatgaaaaagtttctcgaagaggcgacccgggtgtctcaggagcatccagttgtgctgacaaaatttgtggagggagcacgggaagtggagatggatgccgttggtaaggacgggcgggtgatctcccacgccatttccgagcacgtggaggacgcaggggtgcatagtggcgatgctactctcatgttgcccactcagacaataagccagggggccattgagaaagtaaaagacgctacaagaaaaatcgcgaaggcatttgctatcagcggtccttttaacgtgcagttcctcgtgaagggcaacgacgtgctcgtaatagaatgtaacctccgggcgagccgctccttcccatttgtttccaagacactgggagtggatttcatagatgtggcgacaaaagtgatgatcggcgagaatgtggacgagaaacaccttcctacattggatcatcccattattcccgccgactacgtcgctatcaaagccccaatgttttcttggccccgcctgcgagatgcagatcccatcttgcggtgcgagatggcctcaaccggggaggtggcctgcttcggggaaggtatccacacagcttttctcaaggcgatgcttagtacaggctttaagatcccccagaaaggaatcttaattggtattcagcagtcctttcggcctaggttcttgggcgtggcggaacagttgcacaacgaaggattcaagttgtttgcaacagaagctaccagcgactggctgaacgcaaacaacgtccctgcaacacccgtcgcgtggcccagccaggaagggcagaatccttcactctcaagtatcagaaaactaatacgcgacggctctatcgacctagtaattaatcttcctaacaacaacaccaagttcgtacatgataactacgtaattcggaggacagccgtggatagcggaatacctctcctgaccaacttccaggtaacaaagctgtttgccgaagccgtgcagaagtccaggaaagtcgactccaagtctctttttcactatagacaatattcggcaggaaaggctgca

SEQ ID NO: 8025 - DNA, 4500 bp, Artificial Sequence
  Description of Artificial Sequence: Synthetic coding sequence
atgacccgcatcctgactgccttcaaagtggttcgcactctcaaaactggcttcggattcaccaatgtgaccgcgcaccagaaatggaagttttcccgccccggaattcgcctgctgtcagtgaaagcccagaccgcacacattgtcctggaggacgggacgaagatgaaaggttactcattcggtcacccgtcctctgtggctggagaagtcgtattcaacaccgggctgggtgggtatccggaagcgattactgaccctgcttacaaagggcagatcctgaccatggccaacccaatcatcggaaacggcggcgcgcccgacaccacggcactggacgaacttgggctctcaaaatacctcgagtccaacggaatcaaggtgagcggtttgctggtgctcgactacagcaaggactacaaccactggcttgcaactaagtcgcttggccaatggttgcaggaagagaaggtgccggctatctatggggttgatactaggatgctcactaagattatccgcgacaagggcaccatgctcggcaagattgaatttgagggccagcctgtggatttcgtggacccaaacaagcagaatctgatcgccgaagtgtccaccaaagacgttaaggtctacggcaaaggcaacccgaccaaggtggtggcagtggattgcggaattaagaataatgtgatcagactcctggtgaagaggggcgccgaagtgcacctggtcccgtggaaccacgacttcaccaagatggaatatgacggcatccttatcgctggtggaccaggcaacccggcattggccgaaccgctgatccagaacgtgcggaaaatcctcgaatcggacagaaaggaaccactgtttgggatctcgactggaaatctgatcactggactggcggccggtgctaagacttacaagatgtcgatggccaaccgcgggcagaatcagccagtgctcaacatcactaacaagcaggcctttatcactgcacagaatcatggctacgctctggacaacaccttgccagcgggttggaaaccacttttcgtcaacgtgaatgatcagaccaacgagggcatcatgcatgagtccaagcctttcttcgcggtccagttccacccggaggtgactccaggaccaatcgacactgagtacctgtttgactcctttttctcgctgatcaagaagggaaaggcgaccaccatcacttccgtcctgccgaagcccgcgctggtggcttctcgcgtggaagtgtcgaaggtcctcatcctgggatccgggggtttgtccatcggacaggcaggagagtttgattacagcggttcccaagcggtcaaggctatgaaggaggagaacgtgaaaacggtgctgatgaacccgaacatcgctagcgtgcaaactaacgaagtcggactcaagcaagctgatacggtttacttccttccgatcaccccgcagttcgttaccgaggtgattaaggccgagcagcctgacggcctcatcctcgggatgggaggccagaccgcactcaactgtggagtggaactgttcaaaagaggcgtgctgaaggagtacggtgtgaaagtcctgggcacctcggtggaaagcatcatggcgactgaagatcgacaactgttcagcgacaaacttaatgagatcaacgaaaagatcgcccccagcttcgcagtggagtcaatcgaggatgcactcaaggcggcagatacgattggctacccagtgatgattagatctgcatacgccctcggaggacttggctcgggtatctgcccgaaccgcgagactttgatggacctgtctaccaaggcctttgcaatgacgaatcagattctcgtcgagaagtccgtgaccggatggaaggaaatcgagtacgaagtggtgcgagacgccgatgataattgcgtcaccgtgtgtaacatggagaacgtcgatgccatgggtgtccacactggagacagcgtcgtcgtggcgccagcgcagactttgtccaacgcggagttccagatgctccgccgcacctccattaacgtggtgagacacctgggcatcgtgggagaatgcaatatccagttcgccctgcatcctaccagcatggagtactgcatcattgaggtgaacgcccggctgtcacggtcgtccgccctggcctccaaggctaccggctacccgctggccttcatcgctgcgaagattgccctgggaatccctctcccggagatcaagaatgtggtttccggtaagacgtccgcctgcttcgaaccgtcgctggactacatggtcactaagatcccgagatgggacttggaccggttccatggtacctcgagccggatcggctcgtcgatgaaatcggtgggcgaggtcatggccattgggcggacgttcgaagaatcattccaaaaggcgctgagaatgtgtcacccatcgatcgagggatttaccccgagactgcctatgaacaaggagtggccctccaatcttgacttgcgcaaggaactgtccgaaccgtcaagcactcgaatctacgccatcgctaaagcgatcgacgacaacatgtcgcttgacgaaatcgaaaagctgacttacattgataagtggttcttgtacaaaatgcgcgatattctgaatatggaaaaaactctcaaggggctcaattccgaatcaatgacggaagagactctgaagcgcgcaaaagaaatcgggttctccgacaagcaaatcagcaaatgcttgggtcttactgaggcccagacccgcgagctgcggctgaagaagaacattcacccctgggtcaagcaaatcgacactcttgcagccgagtacccgtccgtcaccaactacctgtacgtgacctataatgggcaggagcacgacgtgaatttcgatgaccacggaatgatggtgttgggatgcggtccataccatattggatcctcggtggaattcgactggtgcgccgtctcatccatccggactttgcggcagcttggtaagaaaaccgtggtggttaactgcaacccggaaactgtgtcgactgatttcgacgaatgcgacaagctgtactttgaagagctgtcattggaacggatcctggatatctaccaccaagaagcctgcggagggtgcatcatctccgtcggagggcaaattccaaacaaccttgcagtcccgctgtacaagaatggcgtcaagatcatgggaacctcgccgcttcagatcgaccgggctgaagatagaagcatcttcagcgccgtgctcgacgaactcaaagtggcccaggctccttggaaggcggtgaacactctgaacgaggccctggaattcgcaaaatccgttgattacccctgcctgctgcggccttcgtacgtgcttagcggctcagcaatgaatgttgtgttttccgaggatgaaatgaaaaagttcctggaggaagctactcgggtgtcccaagagcacccggtcgtgttgactaagtttgtcgagggagcacgggaggtggagatggacgcggtgggaaaggacggtagggtgatctcgcatgccatctcggaacacgtggaggatgcgggggtgcactccggcgacgctacgctgatgttgccaactcaaacgatctcccagggtgccatagaaaaagtgaaggatgcgacccgcaaaatcgccaaggccttcgccatctccgggccattcaatgtccaatttcttgtgaaaggaaatgacgtgctggtgattgaatgcaacctgagagcctccaggtcgttcccgttcgtctccaaaaccctcggagtggactttatcgacgtggcgactaaggtcatgattggagagaacgtggatgaaaagcatctcccaaccctggaccacccgatcataccagcggactacgtggcgatcaaggcccctatgttcagctggccgcgcctgcgcgacgcagatccgatcttgcgttgcgaaatggcttcgactggcgaggttgcctgctttggagaaggaatccacactgcgttccttaaggcaatgctgtccaccggattcaaaataccgcagaaaggaatcctgataggaattcagcagtccttccgcccgcggtttctgggagtcgccgaacagcttcataacgagggtttcaagctgtttgccaccgaggccacgtccgactggctgaatgccaacaatgttccggcgactcctgtcgcatggccatcacaggaaggacagaacccgtcgctttcctccatccggaagctgatccgggacggctcaatcgatctggtgatcaacctgccgaacaacaatactaagttcgtccatgataactacgtcattaggcgcactgccgtggattcagggatccccctcctgacgaacttccaggtgactaagttgttcgccgaagccgtgcagaagtctcggaaggtggacagcaagagcctcttccactaccgccagtactcggccggcaaggcggcc

SEQ ID NO: 8026 - DNA, 4500 bp, Artificial Sequence
  Description of Artificial Sequence: Synthetic coding sequence
atgaccaggatcctgactgcttttaaggtggtgcggaccctgaagactggctttggtttcactaacgtaaccgcccaccagaagtggaagtttagccggccgggcatccgcctgctaagcgtcaaggcacagaccgcccatattgtgctggaagacggcaccaagatgaaagggtattcgttcgggcaccccagcagcgtggccggcgaagtggtgtttaatacgggcttgggcggttaccccgaggcaatcactgaccctgcctacaaggggcaaatcttgacgatggctaaccctattatcggcaacggcggcgccccagacactaccgcactcgatgagctagggctaagcaagtacctggagtctaacgggataaaagtctcaggcctccttgtcctggattactctaaagattacaaccactggcttgccacgaagagcctagggcagtggctgcaggaggagaaggtgccggctatctacggcgtggataccaggatgctcacgaagatcatacgcgataaggggaccatgttaggcaagatagagttcgaggggcaaccagtggattttgtagatccgaacaagcagaacctcatcgcagaagtatccactaaagatgtgaaagtatatggtaaaggcaatcccaccaaagtagtagctgtggactgtggcattaagaataatgtcattcggttactcgttaaacggggggcggaagtgcacctggtgccgtggaaccacgactttaccaagatggaatacgatgggatccttattgctggaggtcctggcaaccccgccctggcggagcccctaattcagaatgttagaaaaatactggagtcagatagaaaggagccactgttcggtatctcaactgggaacctgatcacaggattggcagccggggccaagacatataagatgagcatggcaaatcgcggacagaatcaacctgttctgaacatcaccaacaagcaggcatttatcaccgcacaaaaccacgggtatgcattagataataccctccctgctggatggaagcccctgtttgtgaacgtgaatgaccagacaaatgagggtattatgcacgagtctaagcccttcttcgcggtacagtttcaccccgaagtgacaccaggtcctatcgataccgagtacctgtttgactcttttttttccctgatcaagaagggaaaggccacaacaatcacatcggtccttcctaaaccggctctcgtggcgtccagagtggaagtgtccaaggttctcatacttggaagcgggggcctttctatcgggcaggcgggggaattcgactatagtggcagccaggcagttaaggccatgaaagaagaaaacgttaaaactgtcctgatgaaccccaatatcgccagtgtacaaacaaatgaagtgggcctaaaacaggccgataccgtgtactttttacccatcacacctcagttcgttactgaggtgatcaaggcagagcaaccagatggactaattctcggaatgggagggcagactgcgttgaactgtggtgtggaattgtttaaaaggggcgtcctaaaggagtatggagtaaaggttttgggcacatctgtggaaagtataatggccactgaggaccggcaactgttttccgacaagttaaatgaaatcaatgaaaagatcgccccaagcttcgcagtagaatcaattgaggatgcccttaaggctgcggataccattggttatcccgtaatgattcggtccgcttacgcgctcggcgggctaggatcagggatctgtcccaaccgtgaaaccctcatggacttatcaacgaaagcatttgctatgaccaatcaaatcctagtagaaaagagtgtgaccggatggaaggagatagagtacgaagttgttcgcgacgccgacgataattgtgtaaccgtttgcaatatggagaacgttgacgccatgggagtccacactggggatagtgtggtcgtcgctccagcacagaccctcagcaatgcagaattccagatgctgcgccggactagcatcaacgtcgtgaggcatctgggaatcgtgggggagtgtaacattcagtttgcccttcacccaacctcaatggaatattgcataatcgaggtgaacgcgcgccttagccggagtagcgctcttgcaagtaaggcaaccggctatccactggccttcattgcagctaagatcgccctgggaatccccctgcctgagataaagaacgtagtctcgggaaagacgtctgcttgtttcgagccatcgttggactatatggtgaccaaaatccctcgatgggatttagatagatttcatgggacatccagtagaatcgggagttccatgaagagcgtaggggaggtgatggcgattggaaggaccttcgaggaatcattccagaaagctctccgaatgtgccacccctccattgaagggtttaccccccgcctccctatgaacaaggaatggccaagtaatttggatctcaggaaagagttgagcgagccctctagcactcgcatctacgcaatagcaaaggctatcgacgacaacatgtctctggatgagattgagaagctgacctatatagataagtggtttctctataaaatgcgggatatcctgaacatggaaaagactcttaagggacttaactctgaaagtatgacggaggagacactcaagagggcaaaggagattggtttttcagacaaacagattagtaagtgccttggattgacagaagcccagaccagggagctgcggcttaaaaaaaatattcatccgtgggttaaacagattgacactcttgctgccgaatatcctagtgtgacaaactacctttatgtcacctataacggccaggaacatgacgtcaatttcgacgaccatggcatgatggtcctgggctgtggcccttatcacatcggatcatccgtggaatttgactggtgtgcggtttcctcgatccgtactcttaggcagctcggcaagaaaacggtggtggttaattgtaatccagaaacagtgtcaactgatttcgatgaatgtgacaagttgtatttcgaggaactgtccctcgagcgcattcttgacatctatcaccaagaagcttgtggcggttgtatcatcagcgtcggcggacagatcccaaataacttggccgtgccactgtacaagaacggggtaaagattatgggcacatccccactgcagatagaccgggccgaggataggtcgatcttttcagccgtgctggacgagctaaaggtcgcccaagcaccgtggaaggccgtcaacaccctgaacgaagcactcgagtttgctaaatcagtggactacccctgtctgctacgaccctcatacgttctgtctggaagcgcaatgaacgttgtcttttcagaggatgaaatgaagaagttccttgaagaggccacccgagtgtctcaggagcatcctgtggttttaaccaagttcgtagagggtgcgcgggaggtcgaaatggacgccgttggtaaggatggcagggtgatcagtcatgctattagtgaacatgtggaggatgccggggttcacagtggcgacgctaccctgatgctgcccacacagaccatcagtcaaggagcgatcgagaaggtaaaggatgctacacggaaaattgccaaagcttttgcaattagtggaccctttaacgttcagtttctcgtgaagggtaacgatgtcctggtcatagaatgcaacttgcgcgcctcccggtcatttccgttcgtgagcaaaactctgggcgtcgacttcatcgacgtcgcaacaaaagttatgatcggcgagaatgtagatgaaaagcaccttcccactctcgatcacccaataatcccagcagattacgtggcgataaaagcgccaatgttcagctggcccagactgagagatgctgacccgatactacgatgcgagatggcttcgaccggggaagtagcttgttttggcgagggcatacatacggccttccttaaagccatgctatctaccgggttcaagattccccagaagggcatcttgatcggcatccagcagagctttcgacccaggttcttgggcgtcgccgaacagctgcacaatgaaggattcaagctgtttgctaccgaggccacctccgactggctcaatgctaataatgtgcctgctacacccgtggcttggcccagccaggaaggccagaatcccagcctgtcctccatccgcaagcttatccgcgacgggtcaatcgacctagtgattaacctgccaaacaacaacaccaagttcgtgcatgacaactacgtaatacggagaaccgcagtggactcaggcattcccctactgactaacttccaggtgacgaagttgtttgctgaggcagtgcaaaaatcaagaaaggtggacagcaaatccctctttcattaccgccagtactctgcaggcaaagctgcg

SEQ ID NO: 8027 - DNA, 4500 bp, Artificial Sequence
  Description of Artificial Sequence: Synthetic coding sequence
atgactcgcatactcactgcattcaaggtggtcagaacacttaagactggcttcggtttcactaacgtgacagcacaccagaaatggaagttttcccgccctggcatccggctgctgtccgttaaggcccagactgcccacattgtgctcgaggacggcacaaaaatgaagggctattcttttggccatccttctagtgtcgcaggcgaagtggtatttaatacgggcctgggtggctaccctgaagcgatcactgatcctgcctacaaggggcagatactgaccatggctaatcccattattgggaatgggggggcgcccgataccacggctctcgacgaattgggccttagcaaatacttggagagcaacggtatcaaagtttcaggactgttggtgctggattattcaaaagactacaatcattggctcgcgactaagtccctgggccagtggctgcaggaggagaaggttcctgccatctacggcgttgacacaagaatgctcaccaaaatcattcgagacaaaggcactatgctcgggaaaatcgagttcgaggggcagcctgtcgatttcgtcgacccaaataagcagaatcttatcgcagaggtgagcactaaggacgtcaaggtgtacggcaaggggaatcccactaaagtggtagccgttgactgtggcattaagaacaacgtgatccgcctcttggtgaagaggggagcagaagtgcatcttgttccctggaatcacgattttacaaaaatggagtatgatggcattctgatcgcgggtggccctggcaatcctgccctggcggaaccactgatccagaatgtgcgcaaaatcctggagtccgaccgcaaggagcccctcttcggaatcagcacagggaacctgattactggacttgctgccggtgctaagacttacaaaatgtcaatggcgaaccgaggccagaaccagcccgtactcaatataacaaacaaacaggcttttatcacagcccagaaccatggatatgcattggacaacacactgccggctggctggaagccactgtttgtaaatgttaatgaccaaactaatgagggcatcatgcacgagtccaaaccattttttgctgtacagtttcatcctgaggtcacgccaggacctattgacacagagtacttgttcgacagcttctttagtctcataaagaaagggaaagcgacgaccataacttccgtgctccctaagcccgcacttgtggctagccgcgtggaagtgagtaaagtgctgatcctcggctccggcggcctgagtattggacaggccggcgaatttgactatagtggctcccaggcagtgaaagcaatgaaggaggagaatgtgaagaccgttcttatgaaccctaacatcgcctctgtgcagactaatgaagtggggctgaaacaagcagatacggtttacttcctcccgatcactccacagttcgtgactgaggtcatcaaggccgagcagcccgatggcctgatcctcgggatgggggggcagacggcactgaactgcggggtagaactgttcaaacgaggcgtcttgaaggaatatggggtcaaggtcctcggtacaagtgtggagagtattatggcaaccgaagatagacagctgttcagcgataaactcaacgaaatcaacgaaaaaattgcaccctctttcgccgttgaatcaatcgaggatgccctgaaggctgccgacaccatcggttaccctgtcatgatcaggtccgcatacgccctgggtggtctggggtctggcatctgtccaaatcgggagacactgatggacctcagcacaaaagccttcgccatgactaaccaaattctggtggaaaagtcagtgacaggctggaaggagatcgaatacgaggtcgtgcgagacgccgacgacaactgtgttacggtgtgcaacatggaaaatgtggatgctatgggtgtgcatactggcgattctgtagtggtcgctcccgcgcagaccttgtcaaacgccgaattccagatgctgcggcgcacgagcatcaacgtcgtccgacatttggggatcgtcggtgagtgtaacattcagttcgctctccatccaacgtccatggagtactgtatcatcgaggtgaacgctcggctgtctcgatccagtgccctggcgagtaaggcaacaggataccctctggccttcatcgccgctaagatcgcactcggcatacccctgccggagatcaagaacgtagtgagtggaaagacttccgcctgctttgagccctccctggactacatggtcaccaagatcccaaggtgggacctggataggttccatgggacttccagtcgaattggcagctcaatgaaatcagtcggagaggtaatggccattgggagaacattcgaggagagctttcagaaagctctgcgcatgtgccacccaagtatcgaagggttcacacctagactgccgatgaacaaggagtggccgtctaacctggacctgaggaaggaactgtccgagccttcttcaacaagaatatacgcaatcgccaaggcaattgatgacaatatgtctctcgatgagatcgaaaagctgacgtacatagacaagtggttcctgtataagatgcgggacatccttaacatggaaaagacactgaaaggcctgaattccgaatctatgacggaggaaaccctcaagcgcgctaaagagattggattctccgacaagcagatcagtaagtgcctgggccttaccgaagcacaaaccagagagctgcgcttgaaaaagaatattcacccttgggttaaacaaatagatactctggccgccgaatatcccagcgtcactaactatctgtacgttacatacaatggtcaggaacatgacgtgaatttcgatgaccatgggatgatggttcttgggtgtggaccgtatcacatcggatcttccgtcgagtttgactggtgcgcggttagtagcatacgaactctcaggcagctgggtaaaaagactgtcgtcgtgaactgcaaccctgaaacagtgagtactgacttcgatgagtgcgataagttgtacttcgaagagctgtctctggaacgaattctggatatctaccaccaggaggcatgcggcggctgcatcatctctgtaggggggcagattcccaacaatctggcagtgcccctgtataaaaatggtgtgaaaatcatgggtacctcaccgcttcagatcgaccgcgctgaggaccggtctatattcagcgcggtgttggacgaactgaaagttgctcaagccccttggaaagccgtcaataccctcaacgaggctctggagttcgcaaaatctgtagattacccctgtctgctgcgcccaagctatgtcttgtccggtagcgctatgaatgtggtgttctctgaggatgagatgaagaagtttctggaagaggccactagagtgtctcaggaacatccagttgtgcttactaaattcgttgaaggagctagagaggtggagatggatgctgtaggtaaggacgggagggtcatttcccacgcgatctccgagcacgtcgaagatgcaggtgtgcactcaggtgacgctaccctgatgctgcctactcagaccattagccagggggccattgaaaaagtcaaggacgctacccgaaaaatcgctaaagcgtttgccatctcaggacctttcaatgtacaattcctggtgaagggcaacgatgtactcgtgattgagtgcaatctcagggcaagtcggagcttcccatttgtttccaagacactgggcgttgattttattgatgtagctaccaaggtgatgataggggaaaacgtcgatgagaaacacctgcccactctcgaccatcctatcattccagccgattacgtggcaatcaaggcacctatgttcagttggccgaggttgagagacgcggacccaatcctcagatgtgaaatggcttcaaccggagaagtcgcctgctttggagagggcattcacacagcttttctgaaagcgatgctctccacaggtttcaaaattccacagaaaggaattctcataggaatacagcagtcattccggcctaggttcctgggcgtagctgagcagctgcataacgaagggtttaagctctttgctacggaggcaaccagcgactggcttaacgcgaataacgtccctgccacacctgtggcttggccttcccaggaggggcagaaccctagcctgagcagtatacgaaagctcatcagagacggttccatcgaccttgtcatcaaccttcccaacaataatacaaaatttgtccatgataattatgtgattcggagaaccgcagtagatagtggcattcctctgctcacaaactttcaagtcacaaagctgtttgcggaggcagtccagaaatctaggaaggttgattccaaaagtctgttccactaccggcaatactccgccggcaaggcagct

SEQ ID NO: 8028 - DNA, 4500 bp, Artificial Sequence
  Description of Artificial Sequence: Synthetic coding sequence
atgactcgcatcctgactgccttcaaagtcgtgcggaccctcaagactgggtttggatttactaatgtgaccgcgcaccagaagtggaagttctcgcgtccggggatccgcctcttgtccgttaaggcccagaccgctcatattgttcttgaggacggaaccaagatgaaaggctactccttcggtcatccgtcgtccgtggccggtgaggtcgtgtttaacactggactgggaggataccccgaagccatcacggatcccgcgtacaagggccagattctgactatggcgaatcctatcatcgggaacggaggcgcacctgacactactgccttggatgagctgggtttgtcaaagtacctggaatcaaatggaatcaaggtttcggggcttctggtgctggattacagcaaggactacaatcactggctcgcgaccaagtccctgggacagtggttgcaggaagagaaggtgccggcgatctatggagtggacacccgaatgcttactaagattattcgggacaagggcaccatgctggggaagatagaattcgaaggccagcctgtggacttcgtggatccaaataagcaaaacctgattgcagaagtcagcacgaaggatgtgaaggtgtacggaaagggaaacccgaccaaggtcgtggctgtggattgcggaatcaagaacaatgtcattcgcctcttggtgaagcgcggggcggaggtgcacctggtgccttggaatcatgattttactaagatggagtacgacggaattctcattgcaggcggaccagggaatcctgcgcttgctgagccgctgatccagaacgtgcgcaagatcctcgaatcggacagaaaagaaccactgttcggtatctccacgggaaatctcatcaccggactggctgcaggggcaaagacgtacaagatgagcatggcgaaccgaggacagaatcaacccgtgctcaatatcaccaacaagcaagcgttcatcactgcccaaaaccacggatacgcactcgataataccctgccagctggatggaagccgctgttcgttaacgtgaacgaccaaaccaatgagggcatcatgcacgagtcgaagccattctttgccgtgcaattccacccagaggtaactccgggccccatcgacaccgaatacctgttcgactcatttttcagtctgattaagaagggaaaggccactactatcacctccgtcctgccgaagccggcgttggtcgcttcaagggtggaggtgtcgaaggtgctgatcttggggtcagggggactgtcgatcgggcaggccggagaattcgattactcgggtagccaggccgtcaaggcgatgaaagaagagaacgtcaaaaccgtcctcatgaacccgaatatcgcctcggtccagactaacgaggtcggactcaagcaggcagataccgtgtacttcctcccgatcactccgcagtttgtcaccgaagtcatcaaggcggagcaacccgacgggctgattctgggaatgggtggacagaccgccctgaactgcggcgtggaactgttcaaacggggtgtcctcaaggaatacggggtcaaggtgttgggaacctccgtggaatcgatcatggccactgaagatcggcagctgttctcagacaaacttaatgaaatcaacgagaagattgccccatcgtttgcggtcgagtcaatcgaggacgcacttaaggcggcagacactatcggctatccggtgatgatccgctcagcctatgcgcttggaggattgggctccggaatctgtccgaaccgggaaactcttatggacctctcgacgaaagcctttgctatgaccaaccaaatcctggtggaaaagagcgtgactggttggaaagaaattgaatacgaggtcgtgcgggatgccgatgataactgcgttaccgtgtgcaatatggagaatgtggacgcaatgggtgttcatacgggagactccgttgttgtggccccagcccagactttgtcaaatgcagagttccagatgctgcggcgcacttccatcaacgtggtgagacacctgggaatcgtcggggagtgcaacatccagttcgccctccacccaacctccatggaatactgtattatcgaagtcaacgcccgcctgtcgaggtcgtctgcgctggcctcgaaggcaacggggtatccgctggctttcattgcagctaagatcgctctgggtatccccctgccagagatcaaaaacgtggtgtcgggaaaaacttcggcttgcttcgagccatcgctggactacatggtgacgaagatcccgcggtgggacctcgatcgcttccatggaacctcgtcccggatcggttcatccatgaaatctgtgggagaagtcatggctatcggtcgcacctttgaggagagcttccaaaaggccctgcggatgtgccacccgtccatagaaggcttcacccccagactcccgatgaacaaggaatggccatccaacctggatctccggaaggagctgagcgagccatcctctactaggatttacgctattgcgaaggccatcgacgacaacatgtcactggacgaaatcgaaaaactgacttacatcgataaatggttcctgtacaagatgcgggatatcctcaatatggaaaaaacccttaaaggcctgaactccgagagcatgactgaagaaactctgaaacgggccaaggaaatcggtttcagcgataaacagatcagcaagtgcctgggcctcactgaagcacagaccagggagctgagactgaagaagaacatccatccatgggtgaagcagatcgacactctcgcggccgaatacccatcggtgactaattacctctacgtgacttacaacgggcaagagcacgatgttaacttcgatgatcacggaatgatggtcctcggatgcggcccgtaccacatcggttcgtcggtggagttcgactggtgtgcagtgtcatctatccgcactctccgccagctggggaagaaaactgtggtggtgaactgtaatccggagactgtgagcactgactttgacgaatgtgacaaactctacttcgaggaactgtcactggaacggattctcgacatttaccaccaagaagcgtgcgggggatgtatcatctccgtgggtggacaaatccccaacaacctcgctgtgccgctgtacaagaatggtgtcaagatcatgggaacttcgccgcttcaaatcgaccgagcagaggacagatccatcttttcagcagtcttggacgaactgaaggtggcccaggctccatggaaggccgtgaacaccctcaacgaggccctggagttcgcgaaatctgtcgattacccttgcctgttgcggccaagctatgtgctcagcggaagcgcaatgaacgtggtgttctcggaggatgagatgaagaaatttctggaagaagcaactagagtgtcgcaggagcaccctgtcgtccttaccaagttcgtggaaggagctcgggaagtggagatggacgcggtcggaaaggatgggcgcgttatctcgcacgccatatccgaacacgtcgaggatgcgggtgtccatagtggagatgccaccctcatgctgccgactcaaacgatctcgcagggcgccatcgaaaaggtcaaggacgcgactcggaagatagctaaagcattcgcaatctctgggcctttcaatgtccaattcttggtgaagggaaacgatgtgctggtgatcgaatgcaacctgagggcgtccagatccttcccgttcgtgtccaagaccctgggggtggactttatcgacgtggccaccaaagtgatgatcggagagaacgtggatgaaaaacatctgccgactctcgaccatcctatcatcccggcggactacgtcgccattaaggcgccgatgttttcctggccacgcttgcgcgacgcggacccgattctcaggtgcgagatggccagcaccggggaggtcgcttgcttcggagagggaattcacaccgcgttcttgaaggctatgctgtcgaccggattcaagatacctcagaaaggaattctcatcggaatacaacagtcattcaggccacgctttctgggcgtcgcggaacagttgcacaatgaagggttcaagttgtttgcaaccgaggcgacctccgattggctcaacgccaacaacgttccggcgactcccgttgcgtggccgagccaagagggacaaaatccctcactgtcgtccattaggaagctgatccgcgacggctccatcgacctggtgatcaacttgccgaacaacaacactaagttcgtccatgacaattacgtgatcaggagaactgctgtggacagtgggatcccattgctgacgaattttcaggtgacgaaactgttcgcagaagcggtgcaaaagtcacggaaggtggactcgaagtcactgtttcattaccgccaatactcggccggaaaggcggcg

SEQ ID NO: 8029 - DNA, 4500 bp, Artificial Sequence
  Description of Artificial Sequence: Synthetic coding sequence
atgacccgcatcctgaccgctttcaaggtggtccggactttgaaaaccggcttcggatttaccaacgtgactgcacatcagaagtggaagttttcaagacctggtatacgtctgctttcggtcaaagcacaaactgcacacatcgtgctcgaagatggtaccaaaatgaaaggttactcgttcgggcacccttcatccgtggcgggcgaggtcgtgtttaacactggccttggtggctacccagaagcaattaccgatcctgcatacaaaggacagattctcaccatggcgaacccaatcattggtaatggaggagcacccgacactactgcgcttgatgagctgggtctgtcgaaatacctggaatcgaacggcattaaagtgagcggcctgctcgtgctggattattcgaaggattacaaccattggcttgcgaccaagtcgctcggacaatggttgcaggaagaaaaggtgcccgccatatacggcgtggatactcgtatgcttactaaaatcattagagataagggaaccatgcttggaaagatcgagtttgaagggcaaccagttgattttgtggacccaaataagcaaaacctgattgcagaagtgtcgacgaaggatgtcaaggtctacggcaagggaaacccaaccaaagttgtcgcagtggattgtgggattaagaacaacgtgatccggcttctggtgaagcgaggcgcagaagtgcacttggtgccttggaatcatgactttaccaagatggagtacgacggaattctcatagcaggtggacctgggaatcctgcgctggcagaacctcttattcaaaatgtgaggaagatcctggagagcgacagaaaagagccgctttttggtatctcgaccggcaaccttattaccggactggcggcaggggcaaaaacctacaaaatgagcatggcaaacagaggacagaatcagcccgttttgaatatcaccaacaaacaggcattcattactgcacaaaaccatggttacgcactcgataatactcttcctgcagggtggaaaccgctttttgtcaacgtgaatgatcaaaccaatgaagggataatgcatgaatccaagccctttttcgcggtgcagtttcaccctgaagtgaccccaggaccaatcgacaccgaatacttgttcgattccttctttagcctgattaagaaaggcaaagcaactacgattacttccgtgcttcctaagcccgcgcttgtggcctcaagagtcgaagtctccaaggtgctgatcctcggatccgggggcctgtcaatagggcaagcaggtgaatttgattactcgggatctcaagcagtgaaggcaatgaaggaagaaaatgtcaagactgtgctcatgaacccgaatatcgcatcggtccaaaccaacgaagtgggtctgaagcaggccgatactgtctacttccttccaatcaccccccaatttgtgactgaggtcatcaaagcagagcagccagatggacttattcttggaatgggagggcaaaccgcacttaactgtggggtcgaattgtttaagagaggagttctcaaggaatacggcgtgaaggtcctggggacctcggtggaatccataatggcaactgaagatcgtcaactgttcagcgataagctcaacgagataaatgaaaagattgccccttcatttgcagtcgaatccatcgaagatgccctgaaggccgccgacactatcggttacccagtgatgattcgatcagcatacgcacttggtgggcttggctccggtatctgtcccaaccgcgaaaccctcatggacctgtcaactaaggcatttgcaatgaccaatcagatcttggtggaaaagtcggtgacggggtggaaagaaattgaatacgaagttgtgagggatgcagacgataattgtgtcaccgtgtgcaacatggaaaacgtcgatgcgatgggcgtgcatacgggagattccgtcgtggtggcaccagcccaaactctgtcgaatgcggaatttcagatgctgagacggacttcgattaatgtggttcgacacctcggcatcgtgggagaatgtaacatacaattcgctcttcaccccacttccatggagtactgtatcattgaggtcaacgctcgactgtctcgatcaagcgcactcgcatctaaggcaactggatacccgcttgccttcatagccgcaaagatcgcactgggaatccctctgccagagattaagaatgttgtcagcggcaaaacctcggcgtgcttcgaaccaagcctggattacatggtgaccaaaattcctcggtgggaccttgatcgcttccatgggacctcctcgcgcatcggatcatctatgaagtccgtcggtgaagtcatggccattggtaggacctttgaagaatcatttcagaaggcgctgcgcatgtgccatccttcgatagaaggtttcaccccgagacttccgatgaacaaggaatggccaagcaacctggatttgcgtaaagaactctcggaaccgtcctccactcgaatctatgcaatcgctaaggctattgacgacaacatgtcgctggacgaaatagaaaaactcacctacattgataaatggttcctctataagatgcgcgatattctgaacatggaaaaaactctgaagggtctgaacagtgaatccatgaccgaagaaaccttgaagcgggcaaaggagatcggattttcggacaagcagatttccaagtgtcttggactgactgaggcacagacccgcgaactgaggctgaagaagaacatccatccttgggttaaacagattgacactctcgcagcagaatacccatcggtgaccaattatctttatgtcacttacaatggacaagaacacgatgtgaactttgatgaccatggtatgatggtcctgggatgtggtccctaccatattggatccagcgtggagtttgattggtgtgcagtctccagcatcaggaccctcagacaactcggtaagaaaaccgtggtcgtgaactgtaatccagagactgtctccaccgattttgatgagtgtgataaactgtactttgaggagctctcgctggagcggatccttgatatctatcatcaagaagcgtgcgggggatgtattatctcagtggggggacaaattccaaacaaccttgcggtgcccctgtacaagaacggagtcaagattatgggaacctcccctctgcaaattgatagagctgaagatcgttccatcttttccgccgtccttgatgaacttaaagtggcacaggccccttggaaggcagtgaatactctgaacgaggctctggagtttgcgaagagcgtcgattacccatgtctccttcggcctagctacgtgctttcgggttcggcaatgaacgtggttttttcggaagatgaaatgaagaagtttcttgaagaagcaacgcgtgtctcgcaagaacatccagtggtccttaccaagttcgtggagggcgccagagaggtcgaaatggacgccgtggggaaggatggcagagtcatttcccacgcaatttctgagcatgtcgaggacgcgggagtgcattcaggtgatgcaacgctgatgcttcccacccaaacgatctcccagggcgcaatcgagaaggtgaaagatgcaaccagaaagattgcgaaggcatttgccatctcaggaccctttaacgtgcagttcttggtgaagggtaacgatgtgcttgtgatcgagtgtaacctgcgcgcatcccgttcatttccatttgtctccaagaccctgggtgtggactttattgatgtggcgaccaaagtgatgatcggcgaaaacgtggatgaaaagcacctccctactctggaccatcctatcattcctgcagattacgtggctattaaggcacccatgttttcatggcctcgcctgcgtgatgcagatccaatcctccggtgtgaaatggcatcgaccggagaggtggcgtgttttggcgagggcattcacactgcatttctcaaagcaatgctgtccaccgggtttaagatccctcaaaaggggattctcattggtattcagcagagcttccgacctcgctttctcggagtggcagaacagcttcacaacgaaggatttaagttgttcgcaactgaagcgacctcagattggctgaacgcaaacaacgtccctgcaactcctgtggcctggccttcgcaagaaggacaaaatccctccctttcgtcgattagaaaactgattagggacggtagcattgacctcgtgattaaccttccaaacaacaacactaagttcgttcatgacaattacgtcattagaaggaccgcagtcgacagcggcattccgctgctcaccaactttcaagtgaccaagctgtttgctgaagccgtgcagaaatcaagaaaagtggacagcaaaagcctttttcactaccggcaatactccgcagggaaggcggcg

SEQ ID NO: 8030 - DNA, 4500 bp, Artificial Sequence
  Description of Artificial Sequence: Synthetic coding sequence
atgacccgtattctgacagctttcaaagtggtaaggaccctgaagacggggtttggctttaccaacgtgactgcacaccagaagtggaagttttcccggccaggaatcagacttctttccgtcaaggcccaaacagcccatatcgttctggaagatggcacaaaaatgaaaggatacagctttggacacccttcctctgtggcgggcgaagtggtgttcaacacaggcttgggcgggtaccccgaggccatcacagaccctgcgtacaaaggccagattcttactatggcgaatccgattattggcaatggcggcgcccctgataccaccgccctggacgaactcggcctctctaaatatctggagagcaatggcataaaggtgagcggtttgttggtcctcgattattcaaaggattataatcattggctggcgaccaagtctctcggtcagtggttacaggaagagaaggtccctgccatatatggcgttgatacaagaatgctcaccaaaataatccgcgataagggaaccatgctcgggaagatcgaattcgaggggcagccagtggactttgtggaccccaacaaacagaatctaattgccgaagtgagcacgaaggatgttaaagtttacggcaaaggaaaccctactaaagtggtcgcggttgactgtggcatcaagaataacgtgatccgcctgctggtgaaaagaggcgcagaggttcatctggtcccctggaaccacgattttactaaaatggagtacgatggtatcttaattgcgggcggccctggcaacccggcgctagcagaacccctgattcagaatgtacgaaagattctagagtccgacaggaaagagcccctatttgggatatccaccggcaacctgatcactggccttgcagctggcgcaaaaacctataagatgtctatggccaatagagggcagaaccagcctgtactgaacattaccaacaagcaggccttcatcactgctcagaatcatggttatgcactcgacaatacgctccctgccgggtggaaacctttattcgtgaacgtcaacgatcagaccaatgagggcatcatgcacgagagcaagccgtttttcgcagtccagttccacccagaagttacccctggtccaatcgatacggaatacctttttgattcattcttcagcctgatcaagaaaggaaaggcaactaccataactagtgtgctcccaaaacccgccctcgtggcctctagggttgaggtgtctaaggtgctaatactggggtcaggaggtctgagcatcggtcaggccggagagttcgattactcgggctctcaagcggttaaggctatgaaagaggagaacgtgaagacagtcctgatgaaccctaacatagcctctgtccaaactaacgaggtgggactcaaacaggctgatacagtgtacttccttccaatcacaccgcagtttgtcaccgaagtgatcaaagctgaacaaccggatggacttattctgggaatgggaggccaaacagccctgaactgcggcgtggaacttttcaagcggggcgtgttgaaggagtacggagtaaaggtgctgggaacctcagtcgagtccattatggcaactgaagatagacaactttttagtgataaactaaacgaaattaatgagaagatcgctcccagttttgcagtggagtccatcgaggacgctctaaaagcagctgatacaatcggttatcctgtcatgattcgcagcgcttacgcacttggcggactaggcagtggcatctgccccaatcgtgaaactctgatggatctgtctacaaaagcgtttgctatgacaaatcagatactggtagaaaagtccgtaacaggctggaaggaaattgaatatgaggtagtaagagacgccgatgacaattgcgtgaccgtttgcaacatggaaaacgttgatgctatgggcgtgcacacaggggactccgtcgtagtcgcccccgcccaaaccctgtcaaacgccgaatttcaaatgctacggagaacctctatcaacgtggtacgacacctcggcatcgtgggcgagtgtaatattcagtttgcactgcatcccacctccatggagtactgtattatagaggtgaacgctcgcttgtcccggtcttctgctttagccagcaaggccaccgggtatccccttgcttttatcgcagcaaagattgctctgggcatccccctacctgagattaaaaatgtggtctctgggaaaactagcgcctgttttgaacccagcctggactacatggtgacaaaaattcccaggtgggatctagatagattccacggtacatcctccagaattggttcttccatgaagtctgtaggggaagtaatggctattggacggacctttgaagaatcctttcaaaaggcactgcggatgtgccacccatccatagaggggttcaccccacggctacctatgaataaagagtggcctagtaaccttgatctgcggaaagaactgtccgagcctagttctacccggatttacgctatagccaaggcgatcgatgacaatatgtccctagacgaaattgagaaactgacatatattgataagtggttcctgtacaaaatgagagatatcctaaacatggaaaagacactcaagggtcttaattcagagtccatgacagaggagaccctgaaacgtgcaaaggagattggtttctccgacaaacagatcagtaagtgcctggggctgacagaggcacagacacgggagttgcgcttgaagaaaaatatccacccgtgggtgaaacagattgacacgctagccgctgagtacccatctgtcaccaactacctgtacgtgacctataatgggcaggagcacgacgtgaatttcgatgaccatgggatgatggtgcttggctgcgggccataccacatcgggtcatcagttgaattcgattggtgcgccgtgtcctcaatccgtacacttagacagctcggaaagaaaaccgtcgtggttaattgtaatcccgagacagtatcaaccgacttcgatgaatgtgacaaactgtattttgaggaactgagtctggaaaggatattggacatataccatcaggaagcctgcggaggatgcatcatctctgtgggtgggcaaatcccaaataacctagcggtgcccttgtacaagaacggagtcaagattatggggaccagtccgctacagatcgaccgggccgaagataggtcaatcttctccgcggtactcgacgagctgaaggtggcgcaggctccttggaaggccgtgaataccctgaacgaagctctcgaatttgcaaagtccgttgactacccctgtctgttgaggccttcatacgttttgtctggaagcgccatgaatgtcgtttttagcgaggacgagatgaaaaagttcctagaggaggctacaagggtgtcccaggaacaccctgtggtattgacgaagtttgttgaaggggctagagaggtcgaaatggacgcggtagggaaggatgggagggtgattagtcatgccatttcggaacatgttgaggatgccggggtgcacagtggcgatgcaaccctgatgctgccaacgcagaccatcagtcagggggcgatcgagaaggtgaaggatgccactagaaaaattgcaaaagcattcgccatctccggaccatttaacgtccagtttttagtcaaaggcaacgatgtcctggttatcgagtgcaacctgagggctagtaggtcctttccattcgtcagtaaaacactgggcgtggattttattgacgttgctaccaaagtgatgatcggggaaaacgtcgacgaaaagcacctccccaccctcgatcatccgatcattcccgctgactacgtggcaatcaaagcgccaatgttcagctggcccagacttagggacgcagatccaatcctgcgctgcgagatggcaagcaccggcgaagtagcctgtttcggggaaggaattcatactgctttcctgaaggcaatgctcagcactggatttaagatccctcagaaaggaattctcattggtatacagcaatccttcagaccccggttcctaggagttgctgaacagttgcataatgaaggcttcaagctcttcgccaccgaagctacgtccgactggctcaatgctaacaatgtaccggccacacctgttgcatggcctagtcaggaaggtcagaaccctagcctttcaagtatccgaaagttgataagggatggttctatagatctagtaattaacctgccgaacaacaacactaagtttgtgcatgacaattacgtcatccgcaggacggcagtggactccggtattccattattaactaatttccaggtgaccaaactctttgctgaggctgtgcagaaaagccggaaagtggactctaagagtttattccactaccgacagtactcagccggcaaagctgcc

SEQ ID NO: 8031 - DNA, 4500 bp, Artificial Sequence
  Description of Artificial Sequence: Synthetic coding sequence
atgactaggatactgactgcttttaaagtggtgcgaacactgaaaaccggctttggcttcactaacgtcaccgcacaccaaaagtggaagttttctcgcccgggtatccgcctgttgagcgttaaagcacagaccgctcacatcgtcctagaggacggcacaaagatgaaagggtacagtttcggtcacccatcttcagtggccggagaggtggtctttaatactggattaggcggctatccagaggctatcaccgaccctgcgtacaagggacagatccttaccatggctaacccaattatcgggaacggtggtgctcctgataccaccgcgctggacgaactggggctgagcaagtatctagaaagcaacggtattaaggttagtggactcctggtgctggactatagtaaggattataaccactggcttgctacaaaaagtctgggccagtggctgcaggaagaaaaagtcccagctatatatggagtggacacacgtatgttaacaaagattattcgcgataaaggaaccatgctgggaaagatcgagttcgaaggacaacctgttgacttcgtggaccccaataagcagaatctcatcgcagaagtgtctaccaaagatgtcaaagtgtatgggaaaggtaacccaacaaaggtggtggcagtggattgtggcatcaaaaacaatgtgataaggctccttgtgaagcgcggcgcagaagtgcacttagttccatggaaccacgattttaccaagatggagtacgacggcattttaatcgctggcggccccggcaacccggctctggctgagcccctgatacaaaatgttcggaaaattcttgaaagcgatagaaaggaacctctgttcgggataagcacaggcaaccttattacgggcctcgcagccggagctaaaacatacaaaatgagtatggctaaccgtggacaaaaccagccagtcctcaacataacaaacaagcaggcattcatcactgctcagaaccatggatacgctctggataacacactcccggccggctggaagcctctgtttgtcaatgtgaacgatcagaccaacgagggcataatgcacgagtccaagcccttcttcgccgtccaattccatccggaggtgactcccggccctatcgacaccgagtacttgttcgatagctttttcagcctgatcaagaaagggaaagccaccactattacttctgtgctgcccaagcctgctctagttgccagcagggttgaggtgagtaaggtgctcatcctgggcagtggcggcttatcaataggacaggctggcgaattcgattatagcggcagccaggcagtgaaagctatgaaggaagagaacgtcaagactgtcctgatgaatccaaacatcgcttcagttcagactaacgaagtggggctcaagcaggcagacactgtgtacttcttgcccattacccctcagtttgtgaccgaggtaatcaaggccgaacagcccgatggcctgattctgggaatgggcgggcaaacggcactgaactgcggggtggaactatttaagaggggggttttgaaagagtatggcgtgaaggttctgggaacttctgttgaatcaatcatggcgaccgaagacaggcagttattttctgacaagctcaatgaaatcaacgagaagatcgcaccttccttcgctgtggagagcatcgaggatgctcttaaagcagcagatacaatcggctatcccgtgatgattagaagtgcttatgcactgggcggattgggcagcggtatctgccctaatcgcgaaactctgatggacctgagcaccaaggctttcgccatgaccaaccaaattttagtggaaaaaagcgtgactggatggaaagaaatcgagtatgaggtcgtccgcgatgctgatgacaactgcgtgaccgtgtgtaacatggagaacgtcgatgctatgggagttcatactggagatagtgtggtggtagcccccgcacaaacactttctaacgccgaatttcagatgctgcgccggactagtatcaatgtagttagacatctcggaattgtgggagaatgcaacatccagtttgctctgcacccgaccagtatggagtattgcattattgaggttaacgcgcgcttgtcaaggtcttctgcattagcgagcaaggcgaccgggtacccgttggctttcatagccgccaagatcgctctgggcattccattaccagaaatcaaaaacgtcgtgagcgggaaaacctcagcgtgtttcgagccaagcctcgattatatggttaccaaaatcccaaggtgggatctggataggttccacgggactagcagccgtattgggtcctctatgaaaagtgtgggcgaagtcatggccatcggacgaactttcgaggagagcttccaaaaagccctcaggatgtgccaccctagtatcgaaggtttcacccctcggttgccaatgaacaaggagtggcctagcaacctggatttaagaaaggagctcagtgaaccatcctcaactagaatctatgccattgcaaaagccatagatgacaatatgagtctcgacgaaatcgagaaactgacgtacattgataaatggttcctatataaaatgcgggatattctcaacatggaaaagactttgaaaggacttaatagcgaaagcatgactgaggagacactcaaaagagcaaaggagatcggattcagcgataaacaaatcagcaagtgtttgggccttaccgaggctcagaccagagagttgcgcctgaaaaagaacattcacccctgggtgaagcagatcgacaccctcgctgctgagtatccgtccgtcaccaactacctttatgtgacctataacggccaagaacacgatgtcaatttcgatgatcacgggatgatggtactgggctgtggtccataccacattggcagcagcgtggagttcgattggtgcgcggtgtcttccataaggaccctgaggcaactgggtaaaaaaaccgtcgtagtgaactgtaatcctgaaactgtgagcaccgacttcgacgaatgtgataagctgtattttgaagaactgtcccttgaaaggatcctggatatctaccatcaggaagcctgcggaggctgtatcatctccgtcgggggccagataccaaacaaccttgccgtgcctctttacaaaaatggggtaaagatcatgggaactagcccactgcaaatcgaccgggccgaggatagaagcattttttccgccgttctcgatgaactcaaagtggcacaggcaccctggaaggccgtcaacaccttaaatgaagcccttgagtttgctaagagcgtagattacccctgtcttttgagaccctcttacgtgctgtcaggcagtgccatgaatgtggttttttctgaagacgagatgaaaaagtttctcgaggaggctacaagagtctctcaagaacatcctgtcgtgctgaccaaatttgtggaaggtgcaagggaagtggaaatggatgctgtaggaaaggacgggagagtcatttcgcatgctattagtgagcacgtcgaagacgctggagtccacagcggggatgctacgctgatgttaccaacccagaccatttcccaaggagcaatcgagaaggtcaaagatgcgaccaggaaaatcgctaaagcttttgccatcagcgggccttttaacgtgcagtttctcgttaagggaaacgacgtgttggtaattgagtgtaatctgagggcgagcagaagctttccatttgtgagtaaaaccctcggcgtggactttatcgacgttgctactaaggtcatgatcggcgaaaatgtagacgagaagcatctgccaacccttgaccaccccataatcccggcagattatgtcgctattaaagcccccatgttttcttggccaaggctgcgggatgctgaccccattctcaggtgcgaaatggcgtccactggcgaggtcgcatgctttggagaaggcatccacactgcttttctcaaggcaatgctgagtactgggttcaaaatcccccagaagggcatcctgattggcatacagcagagttttcgtcccaggtttctcggagtggcggaacagctgcataacgaagggttcaaactgttcgccaccgaggctacctcggattggcttaacgccaacaacgtgcctgccactccggtggcatggcccagtcaagaaggccaaaaccctagtttgagctccatcagaaaattgatccgcgatggctctattgatctggtgatcaacctcccaaacaacaacacaaagttcgttcacgataactacgtcataagaaggaccgctgtggatagcgggatccctctgctgactaattttcaagtcactaaactgtttgccgaggcagtgcagaagtctagaaaggtggatagcaagagcctctttcactatcgccagtatagcgcagggaaggcggcg

SEQ ID NO: 8032 - DNA, 4500 bp, Artificial Sequence
  Description of Artificial Sequence: Synthetic coding sequence
atgaccagaatacttacggccttcaaggtggtgaggactctgaagacggggtttgggttcactaatgtgaccgctcaccaaaagtggaagttcagcaggcccgggatacggctgctgtccgtgaaggcccagacagcccacatcgttttagaggatgggaccaaaatgaagggctactctttcggccaccccagttctgttgccggcgaggttgtgttcaatacagggctgggtggctatccagaagccattactgacccagcctataagggtcagatcctgacaatggcaaacccgataatcggaaacggaggggcgccggatacaacggctctcgatgagctcggtctctccaaatatcttgagtctaatggcatcaaggtgtccggcctattagtactcgattatagcaaggattataatcattggctggccacaaagtccctaggccaatggttgcaagaagagaaggtgcctgcgatctacggcgtggataccaggatgctgaccaaaattattcgggataaaggcacaatgcttggcaaaatcgaatttgagggacagcctgtggacttcgtggatcctaacaaacaaaacctaattgctgaagtatccaccaaagacgtgaaggtctacggtaaagggaacccaacaaaagttgtggctgtggactgtggcatcaaaaacaatgtgatacgcctccttgtcaagaggggtgccgaagtccacctggtgccttggaaccacgatttcacgaagatggaatacgatgggattctgattgctggaggtccaggaaaccccgcgctcgctgagcccttgattcagaatgtgcgaaagatcctggagagcgacagaaaggagccgttgttcggcatcagtactggcaatctcattactggtctggcagcaggcgccaagacttacaaaatgtccatggcaaatcgggggcagaaccagccggtcttgaatattacaaacaagcaggcatttatcaccgcacaaaatcacggatacgcgctggacaatacactccctgctggatggaagccattatttgtaaacgtgaacgaccagaccaacgaagggatcatgcacgaatcaaagccttttttcgcggttcagtttcacccagaggttactccaggcccaattgatacggagtaccttttcgactcgttcttttctctcatcaagaaggggaaagctactacaattacatctgtcttgcccaaacccgccctggttgctagccgagtggaggtttcgaaagtacttattcttggaagcggaggactctcgatcggacaggctggcgagttcgactattccggcagtcaggcggttaaggccatgaaggaagagaacgtgaagacagtgttgatgaaccccaacattgcatctgtgcagaccaacgaggtgggcctcaaacaggccgacactgtgtactttcttcctattacaccccaatttgtaactgaggttatcaaagcagagcagccggatggcctgatcttgggaatgggcggccaaaccgccctgaattgtggcgtcgagctattcaagcgcggggtgctgaaggaatatggggtgaaagtcctggggaccagtgtcgaaagtatcatggctaccgaggaccgtcagctcttcagtgataagctgaacgagatcaacgaaaaaatcgcgccttcatttgccgtggagtctatcgaagacgctctgaaagccgccgataccattggttatcccgtaatgattcgatctgcatatgcacttggtgggctgggtagtggaatttgtcctaaccgcgagacacttatggacctctccacaaaagcctttgctatgactaaccagatccttgtcgaaaagtctgtgactggctggaaagagattgaatatgaagttgtgcgagatgcagacgataattgcgtgaccgtgtgtaatatggaaaacgtggacgccatgggagtccacacgggggattctgtcgtcgtggcccccgcccagacactttccaatgccgagtttcagatgctgcggagaaccagtattaatgtagttcgtcacctgggcatcgttggcgagtgcaacatccagtttgcgcttcatcctacttccatggagtattgcatcatagaggtgaacgccaggctgtctcggtcaagcgccctggcctctaaagccactggatatccactcgcctttattgcagccaagatagcactggggatccctcttccggagattaagaatgtggtgagcggcaaaacatcagcatgcttcgagcctagtctggattatatggttactaaaattccacgctgggacttagacaggtttcacggaacgtcttcccggattggtagctcaatgaaatccgtgggcgaagtgatggctattggacgaacctttgaggagtcatttcagaaggccttgcgaatgtgccatcccagtatagagggattcacaccgcgactgccaatgaacaaggagtggccaagcaaccttgacttgcgcaaagagctgagcgaaccatcttctacacggatttacgcaatagctaaagctattgatgacaatatgagccttgacgagatcgagaagcttacctatatcgataaatggttcctttacaagatgcgcgacattctgaatatggagaagaccctgaagggattaaactcagagtctatgacagaggagactttaaagagggcgaaggagatcgggttcagcgataagcagatttcaaaatgtctgggtttgaccgaggcccagactcgcgaactccgcttgaaaaagaacatccatccctgggtgaaacagatcgacacactggccgctgagtaccctagcgtcactaattacttgtatgtgacttataacggccaagaacacgacgttaactttgatgatcatggcatgatggtcctaggctgtggcccttaccatatcggatcctctgtagagttcgactggtgcgcagtgtcttcgatccgaacccttcggcaactcggcaagaagaccgtcgtggtcaactgtaaccccgagaccgtttcaactgactttgatgaatgtgataagctgtacttcgaggaactgtcactcgagcgcatccttgatatttatcatcaggaggcctgtggcgggtgcatcataagcgttggagggcaaattcctaataatctagccgtgcctctgtacaagaacggcgtgaagatcatgggtacgtccccgcttcaaattgaccgcgcagaggatcgcagtatattttccgctgtgctcgatgaactcaaagtcgctcaggctccatggaaggctgtgaatactctcaatgaggccctggagttcgccaaatctgtggactacccctgtttactgaggccgtcttatgtcctctcagggtctgcaatgaatgtggtgttcagcgaagacgaaatgaaaaaattcctggaggaggctacaagagtcagccaggaacaccccgtagtgttgacaaagtttgtcgaaggagcccgggaggtagagatggacgccgtgggtaaggacgggagagtcataagccacgctatctctgagcacgtggaggacgctggtgttcacagtggggacgctacgctgatgttgccaacccaaacaatcagccagggggctatcgaaaaagttaaggacgcaaccaggaagatcgcaaaggcatttgctatctccggaccctttaatgtccagtttctcgtgaagggaaacgacgtactggtgattgaatgcaacctccgggctagcaggtccttccccttcgttagtaagacactcggggtggattttatagatgtggccacgaaagtgatgatcggcgagaatgtcgacgaaaagcatctccccactctggatcaccccatcattccagctgattacgtggcaataaaagccccaatgttcagctggcccagactgcgcgacgccgaccctatcctgagatgtgagatggcctctacgggggaagtcgcctgttttggggagggcattcacacagcgtttttaaaagccatgctatctaccggcttcaaaataccacagaaaggcatcctgatcgggatacagcagtcttttagacccaggttcctcggagtagcagagcagctgcacaatgagggctttaaactttttgcaaccgaggccacaagtgactggctgaatgcaaataacgtgccagcaacccccgtggcatggccgtctcaggaggggcagaacccatccctgtcatctatcaggaagttaatccgtgatgggagtatcgacctcgttataaacctccccaacaacaatactaaattcgtacacgataattatgtcatcaggcgcacagccgttgatagtgggatccctctcctcaccaactttcaggtgacaaaattgtttgccgaagccgtccaaaaatcccgcaaggtagattctaaatcactgtttcactataggcaatactcagcgggcaaggccgcc

SEQ ID NO: 8033 - DNA, 4500 bp, Artificial Sequence
  Description of Artificial Sequence: Synthetic coding sequence
atgacaaggatcctcactgcttttaaagttgtgcggacacttaagaccgggtttgggtttacgaacgtcacagcccaccaaaaatggaaatttagccggcccggcattaggctcctcagcgtgaaggcccagaccgcccacatcgtacttgaagatggcaccaaaatgaagggttacagctttggacacccatcatcagtggcaggcgaggtggtctttaatacggggctgggcggatacccggaggccattacagacccagcctataagggccagattctgacaatggcgaacccgataatcgggaatggaggcgcgccggataccacagcacttgacgagctggggctcagtaaatatctcgaaagcaatgggatcaaggtgtctgggctgttggtgctggattactcaaaagactataaccattggctcgctaccaagtctttgggacagtggctgcaggaggaaaaggtaccagctatttatggggtggacactcggatgctgacaaagattatccgcgataagggcaccatgctggggaagatcgagtttgaaggacagccagtggactttgtcgacccaaataaacagaatctgattgccgaagtttcaaccaaggatgtgaaagtctacggaaagggtaatcccactaaggtggtggctgttgattgcggcattaagaacaacgttatacgcctcctggtgaagcgcggggccgaagttcacctggtcccttggaatcatgattttaccaaaatggagtacgatggaatcctgatcgccggtgggccgggtaaccccgctctcgcggagcctttgattcagaacgtccgcaaaattcttgaatccgatcggaaagaacctttgttcgggattagtactggcaatctcattacggggctggctgctggggccaagacctacaagatgtccatggcaaaccgcggccaaaatcagccagtcttgaacattactaataagcaggcctttattactgcccagaaccacggctacgcccttgataataccctgccggctggctggaaaccattgttcgttaatgtgaacgatcagacaaacgaggggatcatgcacgaatccaaaccctttttcgctgtacagtttcaccccgaagtgactccgggtcccatcgacacggagtaccttttcgactccttcttttctctcatcaagaaaggcaaagcgaccactattacatctgtcctcccaaaaccggctctggtagcgtctagagtggaggtttccaaggtccttattctgggcagtggcggtctcagcattgggcaagctggcgagttcgattattccggatcacaggcagtcaaagcaatgaaggaggagaacgtaaaaacagttcttatgaaccctaacatagcatctgtccagactaatgaggttggactcaagcaagcggacaccgtttacttcctccctataaccccgcagttcgtgacagaagtcatcaaggccgagcagcctgatgggctcattctcgggatgggcgggcaaaccgcactcaactgtggagtggaactgttcaagcggggagtcttgaaggagtacggggtaaaggtacttgggacgtccgttgaaagcatcatggcgaccgaagatagacagctcttttcagacaagctgaacgaaattaatgaaaagattgccccctcctttgccgtggaatccatcgaggacgctctgaaagcggccgacacaattgggtatcccgtaatgattcgcagcgcctacgcattgggagggcttggcagtggaatctgtcctaaccgcgaaactctcatggatctcagtactaaagcctttgcaatgacaaaccagatactggttgagaagtctgtgacgggatggaaggagatcgagtacgaagtagtgagagacgctgatgataattgcgtcaccgtctgcaacatggagaatgtggacgccatgggtgtgcataccggagactccgtggtcgtggctccagcacaaaccttgtctaacgctgaattccagatgctgcggagaactagcattaacgttgtaaggcatctcggcatcgtaggtgaatgtaatattcaattcgccctgcacccaacctccatggagtattgcattattgaggtaaatgctcgcttgagccgcagcagtgctcttgcttccaaagctaccggttatcccctggccttcatcgccgccaaaatcgccctcggcatccctctgccagagattaagaacgtggtctccgggaagaccagtgcctgttttgagccttcactggattacatggtgacgaaaatcccgcgctgggacttggatcgctttcatgggacttccagccgcatcggttcttctatgaagtcagttggggaggtaatggccatcggcagaactttcgaagagtccttccagaaggcgctcaggatgtgccaccccagcatcgaagggttcacgccgaggttgccaatgaacaaggaatggccatctaatctcgacctgaggaaggagttgagcgaaccatccagtaccaggatttatgctatcgctaaggctatcgatgataacatgagcctcgacgaaatcgagaagctgacctacattgacaagtggttcctgtataaaatgagagacatcctgaatatggagaaaacgctgaaggggctcaattctgagagcatgactgaagaaacactgaagagggccaaggaaatcgggttttccgacaaacagatatctaaatgccttgggctgaccgaagctcaaacacgggaattgaggctgaaaaagaacatccacccctgggtgaagcagatcgacactctcgcagccgagtacccaagtgtgaccaattatctgtatgttacctacaacgggcaggagcatgacgttaactttgacgatcacggcatgatggtgctggggtgcggcccctatcatataggatcaagcgtcgaattcgactggtgtgccgtaagctctattagaaccctcaggcagctgggcaagaagacggttgtggtgaactgcaaccccgagactgtgagcactgacttcgacgagtgcgacaagctctatttcgaggagctgtcactggagagaattctggatatatatcatcaagaggcttgcggtggatgtatcatttctgttggtggtcagattcccaataatcttgccgtgcccctgtataaaaatggagtcaagattatgggcacttcaccgctgcagatcgatcgggctgaggatagaagcatattttcagcagtgctggacgaactgaaggtggcccaggctccttggaaggccgttaacacacttaacgaggccctggaattcgccaagtcagtggactatccctgtctcctccgcccctcatacgtactctccggctccgcgatgaacgtggtattctctgaggacgagatgaagaagttcctcgaagaagctacccgcgtgagccaggagcatccagttgtgttgaccaaatttgtggagggagcaagagaggtcgagatggatgccgtgggcaaggacggccgggtcataagtcacgccatctctgaacatgtagaggacgccggcgtgcactctggcgacgccacactgatgctcccaacccagaccataagtcagggtgcgattgagaaagtcaaggacgccactcggaagatcgccaaggcctttgccattagtgggccgttcaatgtacagttcctggtgaaaggtaacgacgttctggttattgagtgcaacctgagagcctccaggagttttccattcgtcagcaagactcttggcgtggactttatcgatgtagccacgaaggtcatgatcggagagaatgttgacgaaaagcacttgcctacactggaccaccccatcattccagctgactacgtcgccataaaggcccccatgttctcatggccccggctgagggatgccgacccaattctgaggtgtgaaatggcctctacgggggaagtggcttgtttcggtgaagggatccacaccgcctttcttaaggcgatgctctcaacaggatttaagatcccccagaaagggatactgatcgggatccagcagtcctttcgcccccgctttctcggtgtggccgagcagctgcacaacgaagggtttaagctcttcgcgactgaagctacgtctgactggctgaacgcaaataacgtgcctgccactccagtggcctggccctctcaggagggccagaacccaagcctgagttctatccgcaagctgatccgcgatggcagcatagacctggttatcaacctccccaacaataataccaagttcgtgcacgacaactacgtgatccggagaaccgccgtggattccggcatcccccttttgacaaactttcaagtgaccaaactcttcgccgaagccgtacagaaaagtcggaaagtcgactcaaaatctctgttccactatcgccagtacagtgctggcaaagccgcc

SEQ ID NO: 8034 - DNA, 4500 bp, Artificial Sequence
  Description of Artificial Sequence: Synthetic coding sequence
atgactcggattctgaccgcgtttaaggtggtcaggaccctgaagaccggattcggatttacaaacgtgacggcccaccaaaaatggaaattttcgcgccctgggatcagattactatcagtgaaggcccagactgcgcatatagtattagaagatggaaccaagatgaagggctattcctttgggcatccaagcagtgttgcaggcgaagtggtgttcaatacaggactcggcggatacccagaagcgatcaccgaccctgcctacaaggggcaaatattgacaatggccaacccaataatcggcaatggcggcgcccctgacaccactgcgctcgacgagctaggactttctaagtacctggaatctaatggcatcaaggtttctgggctgttggtgctggactacagcaaagactacaatcactggcttgctacaaagtcgctgggacagtggttacaggaagagaaggtgcccgccatctacggtgttgacaccagaatgttaaccaagatcattagggataaagggacaatgttggggaagatcgagtttgagggtcagcctgtggacttcgttgatcctaataaacagaatctgatcgcagaggttagtaccaaggacgtcaaagtgtacgggaaagggaaccccacaaaggtagtcgccgtcgattgcggcattaaaaataatgtcatccggctgcttgtcaagcgaggagctgaggtacacctcgtcccctggaatcacgacttcactaagatggagtacgacggaatccttattgccggaggcccggggaaccctgcgctggccgaacccttgattcagaatgtacgaaagatactcgagtctgatagaaaggaaccacttttcggcatctctacaggcaatctgattacaggcctcgcagctggtgccaagacctacaagatgtccatggcaaacaggggccagaatcagccggtcttgaacatcacgaacaaacaagccttcatcacggcccaaaatcacgggtacgctctcgacaatacactgccagctgggtggaagcccctgttcgtgaatgtgaatgaccagacgaacgagggaataatgcacgagagcaagccattttttgccgtccagtttcatcccgaagtgacgcccggacctatcgacaccgagtatctgttcgactctttcttcagcctcattaaaaaaggtaaggctaccaccatcacatctgtgctccctaagcccgccctggtagcaagtcgcgtggaggtgtctaaggtcctgatcctagggagtggcggactttcaattggtcaggcgggggagtttgattatagtggatcacaggctgtgaaagccatgaaggaggagaatgtgaagacagttttgatgaatccaaatattgctagtgtacagacgaatgaagtggggcttaagcaggccgatacagtctatttcctacccatcactcctcaattcgttacggaagttatcaaagctgagcaaccagacggcctgattctaggaatgggtggtcagacagctctgaactgcggcgtcgaacttttcaagaggggcgtattgaaggagtacggcgtcaaagtcttgggtacatcggtggagtctatcatggccacagaggatcgtcagctcttctcagacaagcttaacgaaattaatgagaagatcgcaccatcattcgcagtggagtctattgaggatgccctaaaggccgccgatactatcggatacccagtgatgatcagatcggcctacgcactgggaggtctaggctccggtatatgccccaaccgcgagacgctgatggacctctcgactaaggcttttgctatgacaaatcaaatactggtcgaaaaatccgtgaccggatggaaagagatcgaatatgaggtagtgcgtgacgccgatgacaactgcgtcacggtctgtaatatggagaatgtggatgccatgggagtgcacaccggtgactccgttgtcgtagcccctgcccagacattgtcaaacgctgagttccagatgttaaggcgcacttcaattaatgtggtccgccacctagggattgtcggcgagtgtaatatccagtttgccttgcatcctaccagtatggaatattgtatcatcgaggtgaacgctagactcagtcggagctctgccctggctagcaaggcaactggttaccctttagctttcattgcagcaaagatcgctctcggtattccactacctgagataaagaacgtcgtgtccgggaagacaagtgcttgcttcgaaccatctctggattatatggtcaccaaaattccgcgatgggacctagatcgcttccacgggacctcctcacggatcggttcgtcgatgaagtcagtaggggaagtcatggcgatcggcagaacatttgaggaaagctttcagaaggctctgcgtatgtgtcatccgagcatcgaaggatttactccccgtctgccaatgaacaaggaatggcctagcaatctggacctgcgtaaggagttgagcgagccaagctccacaagaatctatgccatagctaaagcgatcgatgacaatatgtctttggacgagatcgaaaagttaacctacattgataaatggtttctgtacaagatgagggatatcctcaacatggaaaaaaccctgaaaggattgaactccgaatccatgactgaggagacactcaagcgggctaaagagattggtttttcggacaagcagatcagcaagtgcctgggactgactgaagcccaaacccgagaattgagacttaaaaaaaatatccacccctgggtgaagcagatcgatacactggccgccgagtatccatccgtcaccaactacctctacgtcacctataacggccaggagcatgacgtgaacttcgatgatcacggtatgatggtcctgggttgcgggccctaccacataggctcttccgttgagtttgattggtgcgcggtgtcctcaatcagaaccttacgtcaattgggcaagaaaacagtggttgtgaactgtaaccccgaaaccgtctccacggacttcgatgagtgtgataagctgtactttgaggagctttctttggagaggattctcgatatctatcaccaggaggcgtgtgggggctgcataatcagtgttggcggccagatccccaacaacctggccgtaccactctacaaaaacggagtgaaaatcatgggaacgtccccgctccaaatcgatcgcgcagaagacagatcaattttcagtgctgtactcgatgagctgaaggtggcacaggcgccctggaaagcagtcaacaccctgaatgaggcactggagttcgccaaatcggtcgactatccctgcctattaagacctagctatgttctgagcggatccgctatgaacgttgtttttagtgaggacgagatgaagaaatttctcgaagaggccacccgcgtgagccaagagcatccagttgtcctcactaaatttgtggagggagcccgcgaggtggaaatggacgcggtgggcaaggacggccgcgtgatatcacacgctatcagcgaacatgtagaagacgctggggtacatagcggcgatgcaacactgatgctgccaacacaaaccattagtcaaggtgcgatcgagaaagttaaagacgccacaagaaaaatcgcaaaagcattcgccatatcggggccatttaatgtacagtttctagtgaaaggtaatgacgtgcttgttatcgaatgcaatttgagggccagcaggtctttcccatttgtgtccaaaacactcggggttgattttatcgacgtggctactaaggttatgatcggcgaaaacgtggatgaaaaacatctaccaacgctcgatcatccaatcattcctgccgattacgtcgccattaaggcacctatgttttcctggcccagacttcgggatgccgacccgatcctacgctgtgagatggcttccacaggcgaggttgcatgttttggcgaaggaatccatacggccttcctcaaagccatgctaagtactggcttcaaaatcccccagaagggcatactgattggaatccagcagagctttcgcccccgatttcttggagtagctgagcagctccataatgagggattcaaactgttcgccacggaagcaaccagcgattggttgaacgcaaacaatgtgcccgctaccccagtggcctggccctcgcaagagggccagaatccttccctgagcagcatccgcaaactgattcgggatggaagtatcgatttagttatcaacctaccaaataataataccaaatttgtccacgacaactacgtgattcgtcggacagctgtggattctgggatcccgttgctaacgaactttcaggtcaccaagctttttgctgaagcggtgcagaaaagccgaaaggtggactccaaaagcctgttccattatagacagtattcagcaggaaaagctgct

SEQ ID NO: 8035 - DNA, 4500 bp, Artificial Sequence
  Description of Artificial Sequence: Synthetic coding sequence
atgaccagaattcttaccgcatttaaggtggtaagaaccctgaaaaccggatttggtttcaccaacgtgactgcccatcaaaagtggaagttcagccggccaggcatacggctcctgtctgtgaaggcccagacagctcacatcgtgctagaagatggcactaaaatgaaaggttacagcttcggtcatccctcgtctgttgccggagaagtcgtctttaatacagggctcgggggatatcccgaagccattactgacccagcttataaaggccagatactgaccatggctaatcccattataggcaacggcggcgcccccgataccacggcacttgacgaacttggcctgagcaagtatctggagtcgaatggaatcaaagtgagtggtctgctggtgttagattacagcaaagattataatcactggctcgcgacaaaaagtcttgggcagtggctgcaagaggagaaagtgcctgccatatatggagtggacaccagaatgctaactaagatcattcgtgacaagggaactatgttagggaagattgagtttgaggggcaacctgtcgacttcgtggatcccaacaaacagaatctgattgccgaggtatcaaccaaggatgtgaaagtctatgggaagggtaaccccaccaaggtcgtggcggtggattgcggaatcaagaataatgtcatacgactcttggtaaaaagaggtgccgaagtgcacctcgttccgtggaatcatgatttcactaaaatggagtacgatggaattcttatcgccggcggccctggaaatcctgccctggctgaaccactaatccagaatgtgcggaagatactggagtccgaccggaaggagccactgttcggcatatccactggtaaccttattaccgggctagccgcaggcgccaagacttataaaatgagcatggcaaatcgcggacaaaaccagccagtgctgaacattactaataaacaggcctttatcaccgcccagaaccatgggtacgcgttggacaacaccctgccagccgggtggaaaccactgttcgtaaacgttaatgatcaaaccaacgaggggattatgcacgagagtaagccatttttcgcagtgcagtttcatccagaagtaactcctggccctattgataccgaatacttgttcgattctttcttttctctgatcaaaaaaggcaaggccacaaccatcacttccgtccttcccaagcctgcactggtagcatctcgggtcgaagtcagcaaggtgttaattttaggctctggtggtctcagtattggtcaggctggagagttcgactactcaggctctcaggcagtgaaagcgatgaaagaggaaaatgtgaaaactgtgttgatgaatcccaatatagcgtctgtgcagaccaatgaggtgggtttgaaacaggctgataccgtgtatttcctgcccattactccgcagtttgttaccgaggtaataaaggctgaacaacccgacggtctaattctgggcatgggtggacagaccgccctgaactgcggggtcgagctcttcaaaagaggcgtccttaaggagtatggtgttaaagtattagggacttctgtcgagagcatcatggctaccgaggaccggcagctgttttctgacaaacttaatgaaataaacgagaagatcgccccttcttttgcggttgaatccatcgaggacgcgctgaaagccgcagatacaatcggctacccagtgatgataaggtctgcctacgcacttgggggactgggctccggtatttgtcccaatcgcgagacactcatggatctgtctacaaaggcgtttgcaatgaccaaccagattctcgttgagaagtcagtgactggatggaaagaaatagaatacgaagtggtgcgtgatgcagacgacaattgcgtgacagtgtgtaatatggagaacgtggatgcaatgggcgtgcacactggcgatagcgtggtggttgctcccgcccagactttgtcaaacgctgaattccaaatgctgcgcagaacttctataaatgtggtgagacatctcggcatcgttggggagtgtaatatccaattcgcactgcacccaacttcaatggagtactgcatcatagaggtaaacgccagactcagccgctcgtctgcccttgccagtaaagccactggctatccgttggcttttatcgccgccaagatcgcactcggcatcccactgcccgagatcaaaaacgtcgtgagcggaaagacgtctgcttgctttgagccgagcctcgattatatggtaactaagattcctaggtgggatcttgatcgtttccatggcacttcatccagaataggatcctccatgaagagtgtgggagaagtcatggcaatcggcaggacattcgaggaatcttttcagaaggctctgcgcatgtgccatccctcaattgagggatttacccctcggctgcctatgaataaagagtggccgagcaatctagacctgcgtaaagaattgtctgagccttcttccacccgcatctatgctatcgctaaagctattgatgacaacatgtccctagatgagattgaaaagctaacatacatcgacaaatggtttctttacaaaatgcgcgacattttgaacatggagaaaaccctgaaggggctgaactcagaaagtatgacggaggaaacattgaaacgggctaaagagataggattcagcgataaacagataagtaagtgcctcggactgacggaagcacagaccagagagttgcggctgaaaaagaatattcacccttgggtcaagcagatcgacacgttagccgcggagtacccttcagtaacgaactacctgtacgtcacctacaacggccaggaacacgacgtgaacttcgatgatcatggaatgatggtgctgggttgtgggccttatcacattggctcatccgtcgagttcgattggtgcgccgtatcttcaattcgaaccttgcgccaacttggcaaaaagacagttgtggtgaattgcaaccccgagactgtgtccaccgattttgacgagtgcgacaagctgtacttcgaggaactaagtttggaacggattctggatatttaccaccaagaggcttgcggaggctgcattattagtgttggaggacagatccccaacaatctcgcagttcctctgtataaaaatggagtgaaaatcatgggtacatctccgcttcagatcgaccgcgctgaggatcgcagtattttcagtgccgtgctcgatgagctgaaggtggcccaagctccatggaaggcagttaacaccctcaacgaagcgctggaatttgccaaaagtgttgactacccatgcctgctgagaccctcttacgtgctctcaggctccgcgatgaacgtggtgttcagcgaagacgagatgaaaaaattcctggaggaagccacacgagtctcacaggagcaccccgtggtgctgactaagttcgtggaaggcgcgcgtgaagtagagatggacgctgtgggaaaagatggaagggtaatatctcacgccatctccgaacatgtggaagatgctggcgttcatagcggtgatgccaccctgatgctgcctacacagaccatctcacaaggcgcgattgagaaggtgaaggacgctactcgaaagattgccaaggctttcgccattagcggtccttttaatgtgcagtttctggtgaaaggcaatgatgtactggtgatagagtgtaacttgagggcgtcccggtcctttccctttgtcagcaagacgctcggcgtggacttcattgacgtggcaacaaaggtgatgattggagagaacgttgatgaaaaacaccttcccaccctggaccatcctatcatacctgctgattacgtggctattaaagcaccgatgtttagctggcctcggctaagggatgccgatcccatattaaggtgtgaaatggccagcacaggcgaggtggcatgttttggggagggcatccatacagccttccttaaggctatgctgagtactggtttcaaaatccctcagaagggcatcctgatcggaattcagcagagtttcaggccaaggtttctgggagtcgcagaacagctgcacaacgaaggttttaaactctttgctaccgaggctacatctgattggcttaatgcaaacaatgtgccggctacacccgtggcctggccctcgcaggaggggcaaaatccctccctcagtagcataaggaaacttattcgcgatggaagtatcgatttggttatcaatctgccgaacaacaacaccaagttcgtccacgataattatgtcattagaagaacagcggttgatagcgggatccccctcctgacaaatttccaggttacaaaactcttcgcagaagcagtgcagaagtccagaaaagtggactccaagtctttatttcactatcggcagtactccgctggcaaggccgct

SEQ ID NO: 8036 - DNA, 4500 bp, Artificial Sequence
  Description of Artificial Sequence: Synthetic coding sequence
atgactcgcattctgaccgctttcaaggtagtccgcaccctaaaaaccggctttggcttcactaatgtgaccgctcatcaaaagtggaagttcagccgccctggtattcggctgctaagcgtgaaggcccagaccgctcacattgtcctagaagatggtaccaagatgaagggctactcctttggtcatcctagctccgttgccggagaggtggtctttaataccggtctgggtggttatccagaagcgattacggaccctgcctataagggtcagatccttactatggccaacccaattatcggtaacggtggcgcacctgacactactgcactcgatgagcttggcctgtcgaagtatctcgagagtaacggcatcaaggtcagcggtctgttggttctggattattctaaggattacaaccattggttagctacgaagagcctgggacagtggctgcaagaggaaaaggttcctgcgatctacggcgtggacacgcgaatgctgactaagatcattcgcgacaagggcaccatgctgggtaagatcgaatttgagggacagcctgtggacttcgtggatccaaacaagcaaaacctgattgcggaggtgtccaccaaggatgtcaaagtttacggtaagggcaatccgaccaaagtagttgccgttgactgcggcattaaaaataacgtgattcgcctgctggtgaagcgcggcgcagaggttcacttggttccgtggaatcacgactttaccaagatggagtacgacggtattctgatcgcgggcggcccagggaatccagcactggcggagcctttgatccagaatgttcggaagatcctggagagcgaccggaaggaaccactgttcggaatttccaccggaaatctgattaccggtctggcggccggcgcaaagacctacaaaatgagcatggccaatcgcgggcaaaaccagcctgttctgaacataaccaataaacaagctttcatcaccgcgcagaatcacggttacgcgctggacaacaccctgcctgctggttggaagccgctgttcgtgaatgtcaatgaccaaaccaacgaggggatcatgcatgagagcaagccattttttgccgtccagtttcatccagaggtcacgcctggtcctattgacaccgagtacttgttcgatagcttcttctcactgattaagaagggtaaggctaccacgatcacgtccgttctccctaaaccagccttggtggcgtctcgtgtggaagtgagcaaagtcttaattctgggtagcggcggcctgtccatcggccaggccggtgaattcgattatagcggatcccaggctgtcaaggcaatgaaggaggagaatgtgaagaccgtactgatgaatccgaacattgctagcgttcagaccaatgaagttggccttaaacaggctgatacggtgtacttcctgccaattactccccagtttgtaacggaggtgattaaggcagaacagccggacggtctgattttggggatgggtggccagactgcgttgaactgcggcgtagaactgtttaaaaggggcgtcctgaaggagtacggcgtcaaagtgctgggtaccagcgttgagagcatcatggccactgaagaccgccagcttttttcggataagctcaacgaaattaatgaaaaaatcgctccttccttcgctgttgaaagcatcgaagacgcactcaaggccgcagatacgatcggatatcccgttatgattcgctcagcctatgctctcggcggtctggggagtggcatctgcccgaatcgcgagacgctcatggacctgagcaccaaagcctttgcgatgactaaccaaattttggtggagaagagcgtgaccggatggaaggaaattgaatacgaagttgtacgcgacgccgacgacaactgtgtcacggtgtgcaatatggaaaatgtcgacgccatgggtgtgcatactggcgattctgttgtggtggcccctgcccagacgctgagtaacgcagagtttcagatgctacgtcggacgtcaatcaacgtggttcgccatttgggcattgtcggcgaatgcaatattcaattcgccctgcaccctacctccatggagtactgtatcatcgaggttaacgcgcgcctgagcagaagcagcgcactggcatcaaaagccactggctatccgctagcctttatcgccgccaaaattgccctggggattccattgccagagataaagaacgtcgtgagcggtaagactagcgcatgctttgagccatcattggactatatggtgacaaagatccctcgctgggacctggatcgttttcacggaacctctagccggattggctcttcgatgaagagcgtgggtgaggttatggcaatcggccgcacgttcgaggagagctttcagaaagctctgcgtatgtgccatcctagcatagagggcttcaccccgagattgcctatgaacaaggaatggccatcgaacctggacctgcgcaaggaactgtccgagccctctagcaccagaatctacgcgatcgccaaagccattgacgataacatgtccctggatgaaatcgagaagctcacctatatcgacaagtggttcctttacaaaatgcgcgacatcctcaacatggagaagaccctgaagggacttaatagcgagtcaatgaccgaagagaccttgaaacgcgcgaaagaaattggattcagcgacaaacagatctctaagtgcctgggtctgacggaagcgcaaacccgcgaactgaggctgaaaaagaacatccacccatgggtgaagcagattgacacactggctgcggagtacccaagcgtcacaaactacctgtatgtcacatacaatggtcaggagcacgacgtaaatttcgatgaccacggcatgatggttctgggttgtggtccgtaccacatcggtagtagcgtggagtttgactggtgcgcggtgagtagcatccgcaccctccgtcagctgggcaagaagactgttgttgtgaactgcaacccagagactgtgtctacggacttcgacgagtgcgacaagctctacttcgaggaattgagcctggaaagaattctcgacatttaccaccaggaggcatgcggcggttgcattatctcggttggcgggcagattccgaataatctggcggtgccgctgtataagaacggagtgaaaattatggggaccagcccgctgcagattgaccgtgcggaggatagatcaattttttccgcagtgctcgatgaactgaaggtggcgcaggccccctggaaggcggtcaacaccctgaatgaagcactggagttcgcgaaatctgtggattacccatgcctgttacggcccagctacgtgttgtctggttctgccatgaatgtagttttctcagaggatgagatgaaaaagttcttagaggaggcaacgcgcgtcagccaggagcacccagtcgtcctgacgaagttcgtggagggtgcccgcgaggtggaaatggacgcagtgggaaaggatggcagggttatttcccacgcaatcagcgaacatgtggaagatgccggagtgcattccggtgacgcaaccctcatgctgccgacgcagacgatctcgcagggcgccatagaaaaggtgaaagacgccaccaggaaaattgctaaggcctttgcaatctccggtcctttcaacgtgcagttcctggttaaaggcaacgatgtgctggtgatcgaatgcaacctgagggcgtccaggagctttccgtttgtctctaagactctgggtgtagacttcatcgatgtcgctaccaaagtgatgatcggtgaaaacgtcgatgagaagcacctgcctactctggatcatccgataatcccggccgactacgttgccatcaaggccccgatgttctcttggccacgtttgagagacgcagaccctattctgcgctgcgaaatggcctcaacaggggaggtggcgtgctttggtgagggtatccacaccgcattcctgaaagcaatgctcagtaccggcttcaaaatcccacaaaagggcattctgatcggcattcagcaaagcttcaggccacgctttctgggcgtcgctgaacagctgcacaacgaaggctttaagcttttcgccacagaggcaacttccgactggttaaatgccaacaacgtgcctgcaacgcctgttgcgtggccgagtcaggaaggtcagaacccttccctgtctagtatccgcaaattgatccgcgacggctctattgacctggttatcaacctgccaaataacaataccaaattcgtccatgataactatgtaatacgccgcaccgcagttgacagcggcataccgctgctgaccaatttccaggttaccaaactttttgcggaggccgtgcaaaaaagccgtaaggtggactctaaatccttatttcactaccgccagtactccgccggtaaggccgcc

SEQ ID NO: 8037 - DNA, 4500 bp, Artificial Sequence; identical to SEQ ID NO: 8026
  Description of Artificial Sequence: Synthetic coding sequence

SEQ ID NO: 8038 - DNA, 4500 bp, Artificial Sequence
  Description of Artificial Sequence: Synthetic coding sequence
atgactagaattcttaccgcatttaaggtggtgagaacgctcaagactggttttggatttaccaacgtgaccgcgcatcagaagtggaagttcagcagacctggaatccggttgctttccgtgaaggcacagacggcacatattgtgctggaggacggtaccaagatgaagggttactcctttggccatccctccagcgtggcgggtgaagttgtctttaacaccggtcttgggggttaccccgaagcaataaccgatcccgcatacaagggtcagatactgaccatggccaatcctatcatcggtaatggtggtgcaccagataccaccgctctggatgagcttggtcttagcaagtacttggagtccaacgggatcaaggtcagcggtctgcttgttctggattactcaaaggattacaaccactggcttgcaacgaaaagccttggacagtggctgcaagaggagaaggtgccggcaatttacggcgtcgacaccagaatgctcactaagatcatccgcgataagggtaccatgcttgggaaaattgagtttgaaggtcaaccggtggattttgtggatcctaataagcaaaatctcatagcagaagtgtctactaaggatgtcaaggtctacgggaagggaaatcctacgaaggtggtggcagtcgattgtggtatcaagaataatgtgatccggctgctcgtgaagagaggtgccgaagtccaccttgtgccatggaaccatgatttcaccaagatggagtacgatggtatcctgattgcagggggtcctggaaaccctgcactcgccgaaccgctgatacagaacgttcgaaagattctcgaatcggatagaaaagagccactgttcggaatctcaactggaaatcttataaccgggctcgcggcgggcgcaaaaacgtacaagatgtccatggcaaaccgaggacagaaccagcccgtgcttaacattactaacaagcaagcgtttatcaccgcacagaatcatggatacgcactggacaacacgcttcctgcgggatggaaaccgctctttgtgaacgtgaacgaccaaaccaacgaaggaattatgcacgaatcaaaacctttctttgcggtgcagttccacccagaagtcactccgggacccattgacactgagtacctgtttgattcattcttttccctcattaagaagggaaaagcaaccacgataacttcagtgctgccaaagcctgcgcttgtcgcgagccgagttgaggtgagcaaggttcttatccttggttcaggtggccttagcattgggcaagcaggagaatttgattactccggatcccaagccgtgaaggcaatgaaggaagagaatgtcaagactgtcctgatgaacccaaatatcgcatctgtgcagaccaacgaagttggtctgaagcaagctgataccgtctactttctgccaatcacccctcaattcgtgactgaggtgatcaaggcagaacagcctgatggactgatattggggatgggtggtcagacggcgctgaactgtggcgtggaactgttcaagaggggagtccttaaggagtacggggtgaaggtgctgggaacttctgttgagtccatcatggctactgaggatcgccagctgttctcagacaaacttaatgagattaatgagaagatcgcacccagcttcgcggtggagtccatagaagatgcacttaaggcagcagatactattggctatcctgtcatgatacgcagcgcatacgcacttggaggacttggctcgggaatttgtcctaatcgggaaaccctgatggatctgtcaactaaggcatttgccatgactaaccaaatcctcgtggaaaagtccgtgactgggtggaaagagattgaatacgaagtggtgcgcgatgccgacgacaactgtgtgaccgtgtgtaatatggaaaacgtggatgcgatgggcgtgcacactggtgattcggtggtggtggcaccagcacaaacgctttcgaatgcagaatttcaaatgcttcggcgcacttcaattaacgtcgtgaggcatctcggtattgtcggggagtgcaacattcagttcgcgctgcatccaacgtccatggaatactgtatcattgaagtgaatgcgcggcttagccgctcatcggcacttgcatcaaaggcaaccggatacccacttgctttcattgcagcaaaaatcgccctcggtattcctctgcctgagattaagaacgtggtgtctggtaagaccagcgcctgcttcgaaccatctcttgattacatggtgactaagatcccacgatgggacttggatcggtttcatggaacttcatcacggatcgggtcatcaatgaagtcggtgggtgaggtgatggccattggcaggacttttgaagaatcctttcagaaggcactgagaatgtgtcacccgtcgatcgaaggttttactccccgtctgccaatgaacaaagagtggccctcaaatctcgatctgaggaaggaactgtccgaaccttcgtcaactcggatctacgccatagcaaaagcaattgatgataacatgtcgctggacgaaatcgagaagctgacttatatcgataagtggttcctctacaaaatgcgagatattctgaatatggaaaagaccctcaagggtctgaactcggaatcaatgactgaggaaaccctgaagcgtgccaaggagatcggcttttccgataaacaaatctcgaagtgccttggactcaccgaagcgcagactcgcgaactgaggcttaagaaaaacatccatccttgggtaaagcagatagataccctggcagcggaatatccatcagtgactaactacctgtacgtcacttacaacggacaggaacatgatgtgaacttcgacgaccacggtatgatggttctggggtgtggaccgtaccatattgggtcgtcggtggaatttgattggtgcgcagtctccagcattagaacgcttcgccagctgggaaaaaagacggtggtggtgaactgtaatccagaaaccgtgtcaaccgattttgatgaatgtgacaagctgtactttgaagaactctcactcgaacggattcttgacatctaccatcaagaggcctgtggtggctgcataatctccgtgggcgggcagatccctaacaacttggccgttccactctacaaaaatggagtcaagatcatgggaacttctccactgcaaatcgaccgggccgaggatcgctccattttctctgcagtccttgatgaactcaaagtcgctcaagcaccttggaaggctgtgaacactctcaacgaagctctggaatttgcaaagtcagtggattacccttgcctgttgcggccttcctacgtcctgtccggaagcgccatgaacgttgtgtttagcgaagatgagatgaagaagtttcttgaggaagcaacccgggtcagccaggaacatcctgtcgtgctcaccaagtttgtggagggtgcaagagaagtcgagatggacgcagtcggaaaggacggacgagtgatttcgcatgctatcagtgaacatgtcgaggacgcaggagtgcacagcggcgacgccacccttatgcttcctactcaaaccatcagccagggcgcaattgaaaaggtcaaagatgctacgaggaagatcgccaaggcatttgcaatttcgggtcccttcaacgtgcaatttctggtcaagggaaacgacgtcctcgtcattgagtgtaacctgcgcgcatccagatcctttccatttgtgtccaagacccttggagtggactttatcgatgtggcaactaaggtgatgatcggggaaaatgtcgatgaaaagcatcttcccaccctggatcatcctatcatccctgctgattatgtcgccattaaagcgcctatgttttcctggcctcgcctcagagatgcagaccctattcttagatgcgaaatggcctcaaccggggaggtcgcgtgttttggagaaggaattcacacggccttcctgaaagcaatgctctcgaccggttttaagattccacaaaagggtatcctcattggtatacaacaatcgtttagaccaaggttccttggtgtggcagaacaactgcataacgaaggctttaagctctttgctacggaagcaactagcgattggctgaatgccaacaacgttcccgccacccccgtggcctggccatcgcaagagggacagaacccaagcctctcatcgatcaggaagctcattagggacggctcaattgaccttgtgataaacttgccgaacaacaataccaagttcgttcatgacaattacgtgattaggcgaaccgcagtggattccggcattcccctgcttactaacttccaagtcactaaactgtttgccgaagcagtgcagaagtcccggaaagtcgactccaagagcctgtttcattaccgacaatacagcgccggtaaggcggcc

SEQ ID NO: 8039 - DNA, 4500 bp, Artificial Sequence
  Description of Artificial Sequence: Synthetic coding sequence
atgactcgtatccttaccgcattcaaagtggttaggactcttaagaccggattcggcttcactaacgtcaccgcccaccaaaagtggaagttcagccgcccagggattagactgctatcagtgaaagcgcagacagcacacatcgtcctggaggacggtactaagatgaaggggtacagcttcggtcacccttctagcgtggccggtgaagtggtgtttaacaccggacttgggggatacccagaggccattaccgatcctgcgtacaaaggacagattctgacaatggctaatcctatcatcggcaacggaggagcccccgacacgacagctctggatgagttgggcctgagcaaatacctagagagcaacggtatcaaggtttccggtcttctggtgcttgactacagcaaggattacaaccactggctcgccaccaaatccttgggacagtggctacaagaggagaaggttcccgccatttacggagtagacactcgaatgctgactaaaataatcagggacaaaggtacaatgctaggaaaaattgagtttgaagggcagccagtcgatttcgtggatcccaacaagcaaaacttaattgccgaagttagcactaaggatgtgaaagtttacgggaagggcaatcccactaaggtggtcgcagtcgattgtggcattaaaaacaacgttatcaggttgttggtaaaaaggggggccgaggtgcaccttgtgccatggaatcatgattttaccaaaatggaatatgatggtatactaattgctggaggccccgggaatcctgcactggcagaacctctgattcagaacgtgcgaaagatcctggaatctgatagaaaggagccactgttcggcatttccacagggaatctgatcaccggtttagccgccggagccaagacttacaagatgagcatggccaatcgaggtcagaatcagcccgtgctgaatataacaaacaagcaagctttcatcacagcgcagaatcacggctacgcattagacaatacactgcccgcgggttggaaacccctcttcgtgaacgtgaacgatcagacaaacgaggggattatgcacgagtcgaagcccttctttgccgtccagttccaccctgaggtgactcctggccccatagacacagagtatctgttcgactcttttttcagtctaattaaaaaaggcaaagccacaacaatcacctccgtgctgcctaaacctgctctagtagctagccgggttgaggtttccaaggtccttattcttggcagcggggggctaagtattggccaggccggggagtttgattatagcggcagtcaggccgtaaaggcaatgaaagaggagaacgtgaaaaccgtgctgatgaatccgaatatagcttctgtgcaaaccaacgaagttgggctgaagcaggcagatacggtatacttcctgcccatcaccccccagttcgttacagaagtcatcaaggctgagcagccagatggtctaatcctcggaatgggtgggcagacggcactcaattgtggggtggagttatttaaacgcggggtgctcaaggagtatggagtgaaggtccttgggacatcagtggaatctatcatggccacagaagataggcagctcttcagtgacaagcttaacgaaataaatgagaaaatagccccctcattcgctgttgaatctattgaagatgcgcttaaagccgccgatacaattggctaccccgtgatgatacggtcggcgtatgctctcgggggccttggttctggaatctgcccgaacagggaaaccctgatggaccttagtactaaagccttcgcaatgaccaaccaaatcttagtcgagaagagcgttacgggatggaaggaaattgagtacgaggttgttcgggacgccgacgataattgcgttacagtatgtaacatggagaatgtggatgccatgggtgtacatacgggagattctgtggtcgtcgcacccgcacagactctcagtaacgcagaattccagatgctacgaaggacatctattaacgtggtgcgccatttagggatagtgggtgagtgcaatatccagtttgcgcttcatcccactagcatggagtactgcattattgaggtgaacgcacgtctgagcaggtcgtctgcactcgccagtaaggccacgggctaccctcttgctttcatcgcagccaagatcgcactgggcatcccccttcctgaaatcaagaacgttgtctctggaaagacatccgcatgtttcgaaccatccctcgattatatggtgaccaagattcctcggtgggacctcgatcgctttcacggaacgtcctctcgtataggatcctctatgaaatctgtgggtgaagtgatggctatcggtaggacgtttgaggagtcatttcagaaagctctcagaatgtgtcaccccagtatcgaggggttcaccccacgtctgcccatgaacaaagaatggcctagtaacctcgaccttcgaaaagagttaagcgagccatcctcaacacgtatctatgcgattgccaaggccatcgacgataatatgtccctggatgagattgaaaagctgacttacatcgataaatggtttctgtacaaaatgcgggatatccttaatatggaaaagactctgaagggcctcaactcagagtcgatgacagaggagactctgaagcgcgctaaagaaatcggcttttcagacaaacagatcagcaagtgtctcggactgacagaggctcagacccgggagctgagattgaaaaaaaacatccacccctgggttaaacagattgacacactcgccgcggagtatccatccgtgacaaactacctttacgtgacatacaatggtcaagagcacgacgtgaattttgatgaccacggcatgatggtcctgggttgtggtccataccatatcggctcgagcgttgagtttgattggtgtgcagtcagttcaatacgcactctcagacagcttggcaagaagactgtcgtggtgaactgcaaccctgaaacagtgagcacggattttgacgaatgcgacaaactgtactttgaggagctgtccctggaacggatcctggacatataccatcaggaagcctgcggcggatgtattattagcgttggcggccagatcccaaacaatctcgcagtacccctttacaagaacggggtcaaaataatgggcacgtcccccctacagatagatagagcagaggatcggtcaattttttctgccgtgctcgacgagttgaaagtggcccaggccccctggaaggctgtcaacaccctaaacgaggcccttgagttcgctaagtcagttgattatccctgtctgctgcgcccttcatatgtcctgagcggttccgccatgaatgtcgtcttcagcgaagatgaaatgaagaaattcctggaagaggccacgagagtttcacaagaacatccagtggtgctaacgaaattcgtggaaggggctcgggaggtagagatggatgctgtcggaaaggacgggcgagtgatttcacatgccatttctgaacacgttgaggacgccggagtgcactcaggtgatgcgactttgatgctgcctacgcaaaccatcagccaaggcgcgattgagaaggtgaaggacgccaccaggaaaatcgcaaaagcgttcgcgatcagtgggccctttaatgtacaatttctggtgaaaggaaatgatgtgctggtgatcgagtgtaatctgcgcgcctcaaggtcatttcccttcgtctcgaagactttgggcgtcgattttatcgatgtggcaaccaaggtcatgatcggagaaaacgtagacgaaaagcatctcccaacattagatcaccccattatacccgcagactacgtcgcaatcaaagcacctatgttctcctggcctaggctgagagacgctgatcccattctccgctgcgagatggcttccaccggggaagtggcttgcttcggtgaagggatccacaccgcctttctgaaggcaatgttgtcaacaggtttcaaaatcccgcagaagggtattctgataggaatacagcagagtttcagaccacgttttctgggagtggccgagcaactgcataacgagggtttcaagctgtttgctactgaagccacctcagattggctaaacgctaacaatgtgcccgcaaccccggtcgcttggccaagtcaggaggggcagaatccgtccttaagctctatccgtaagctcatcagggacgggtcaattgatcttgtgatcaatcttccaaataataataccaaattcgtccacgataactacgtgatccgtcggacagctgttgattcgggaatacctctcctgacaaactttcaagtgactaaactgtttgccgaagccgtgcagaagagcaggaaagtggactccaaatcattgttccactatagacagtactctgcagggaaagcggcc

SEQ ID NO: 8040 - DNA, 4500 bp, Artificial Sequence
  Description of Artificial Sequence: Synthetic coding sequence
atgacaagaattcttactgcattcaaggttgtccggaccctcaaaactggctttggtttcactaatgtcaccgcacaccagaaatggaaattcagtagacccggtattagactgctgtcggtgaaagctcaaaccgctcatatagtgctggaggacggcacaaaaatgaagggatatagcttcggtcatccctcatctgtggctggggaggtcgtgtttaatactggcttaggcgggtaccccgaggctattacagatcccgcatacaaagggcaaatcttgacaatggccaaccctattatcggtaacggaggagcccctgatacaaccgctctcgatgagttgggtctgagtaagtacttagaaagcaacggcatcaaagtgtcagggttgcttgtgctggattacagcaaggactataaccattggctggccacaaagtctctagggcagtggctgcaggaggagaaagtccctgccatctacggtgtagatacgagaatgctgaccaagatcatcagagacaagggaacaatgctcggcaaaatagaattcgaaggacaaccggtggactttgtggatcctaataagcagaacctgattgctgaggtgtctaccaaagatgtgaaggtgtacgggaaggggaaccctaccaaagtagtagctgttgactgtggtattaaaaataatgttattaggctgctggtgaaacgtggagccgaggtgcacctggtcccctggaatcatgactttaccaaaatggaatatgacggtatcctgatcgctggcggccctggaaatccagctctcgccgagccactcattcagaacgtaaggaaaatactcgagagtgatcggaaggagcctttatttggaatatctacgggaaacctcattacaggcctggccgccggagctaagacatataaaatgtctatggcgaacagaggccagaaccagccggtactaaacatcactaacaagcaggcattcatcacagctcaaaatcatgggtacgccttagacaacacacttccagccggctggaaacccctgttcgtgaatgtgaatgaccagacgaacgaaggtatcatgcacgagtcaaagccctttttcgcggtccagttccaccctgaggtgacccccggccctatcgacacagaatatcttttcgacagcttttttagtctcatcaaaaagggaaaagcaactacaatcacgtcagtgctacccaagccagcactggtcgccagcagggttgaagtgtcaaaggtgctcatcctgggctccggcgggctgagcatcggccaggctggggagtttgattacagcggctctcaggcggtgaaagccatgaaggaagagaatgtgaaaacggttctcatgaatccgaatatagcttcagtacagacgaacgaagtgggacttaaacaggcagacacggtctacttcctgcccattaccccccagttcgtcacagaggtaattaaggcggagcagccagatggcttaatactgggaatgggcggtcagaccgccctcaattgtggggtggaactatttaagcgaggcgtacttaaggagtacggcgtgaaggtgctgggaacctcagtcgagtcgataatggcaacagaagacagacagcttttctcagataaattgaatgagattaacgagaaaattgctcccagcttcgccgtagagtccatcgaggacgctcttaaggcggcggatacaattggctatccagttatgattaggtcagcctacgctttgggcggattgggctcaggcatctgccccaatagagaaacgctgatggacttatctaccaaggcattcgccatgacgaatcaaattctggtcgagaagtccgtcaccggctggaaggaaatcgagtacgaagtcgtaagagacgcagacgataattgcgttacggtctgtaacatggagaacgtggatgccatgggagttcacactggggattccgtggtagtggcacccgctcagacactctctaacgctgaattccagatgttgaggaggacaagtatcaacgtcgtccgacacctgggcatagttggcgaatgcaatatccaattcgctctgcatcccacctctatggaatattgtataatcgaagtgaatgcgaggctcagcaggtcgtccgcactcgctagcaaagccaccggctaccccttagctttcatcgcagctaagatcgcgctcgggattcccctgcctgaaattaagaacgtggttagtgggaagacaagtgcatgtttcgagccctccctggattacatggtgacaaagattccaaggtgggatcttgataggttccatggtacctcttctagaattgggagttctatgaaatcggtaggggaagtaatggcaatcgggcgaacttttgaggaatcttttcaaaaggctctgcgcatgtgtcatccatccatcgaaggattcactccccgcttgccaatgaacaaagaatggccatctaatctggacctcaggaaagagctgtcagaaccgagcagcacccgcatttatgccatcgcaaaggcaattgacgacaatatgagtctcgacgaaattgaaaaattaacatacattgataagtggtttctatataagatgcgcgacatcctcaacatggagaagactctcaaggggctgaatagtgagtcaatgactgaagaaactcttaagcgagccaaggaaatcgggttttccgacaagcagataagtaagtgcctcggcctcaccgaggcccaaaccagggagctaaggcttaagaagaacatccatccatgggtgaagcagatagataccctggccgcagaatacccttccgtcaccaactacctgtatgtgacgtacaatggacaagaacacgatgtcaattttgatgatcacggcatgatggttctcggctgtgggccatatcacatcggcagctcggtggagttcgattggtgtgccgttagctcaatcagaaccctcagacagctaggtaagaaaaccgtggtcgtgaactgtaaccctgaaaccgtgtccactgatttcgatgaatgtgataagctttacttcgaagaactgagtttggagcgaatccttgacatttaccaccaggaagcttgtggcggttgcatcatctccgtgggcgggcagattcccaacaaccttgctgtccccttatataagaatggggtgaagataatggggacctcacctctgcaaatcgacagagcagaagaccggagtatattcagcgcagtgttggatgaactgaaagtggctcaggccccttggaaggctgtgaatactctcaatgaagcgctggagttcgccaagtcagtggactacccatgcctgctgcgaccatcttatgtgctgtcaggatccgccatgaacgtcgtgttttctgaggacgagatgaaaaaatttctggaggaagccacccgagtaagccaagagcaccctgttgtgctaacaaaatttgtggagggtgctagggaagtggagatggacgctgttggtaaagatggaagagttatatcccacgctattagtgagcatgtcgaagacgccggcgtacattcaggggatgccaccctgatgcttccaacccaaaccattagccagggcgcgatcgagaaggtgaaggacgctaccagaaagatcgctaaggccttcgcaatttctgggccgtttaacgtgcaatttttggtcaagggaaatgacgtgctggtaatcgagtgtaacctgcgagcatcacgttcgttcccatttgtatctaaaactctgggtgtcgactttatcgatgtggcaaccaaagtgatgatcggagaaaacgtggatgagaagcatctgcccacgcttgaccacccaatcattccggccgactatgtcgccatcaaagcgcctatgttctcctggccgcggctgcgtgatgcagatccgattctgcgctgtgagatggcgtctaccggcgaggtggcatgtttcggcgaaggtatccacactgccttcctcaaagccatgctgtcaaccggttttaaaatcccacagaagggaattttgatcggaatccagcaaagcttcagaccacgattcctcggcgtcgccgaacagctccataacgaagggttcaaactgttcgcgacagaggctacatctgattggctgaatgccaacaacgtacctgcaaccccggtggcctggccatctcaggagggacaaaatcctagtttatcttctatcagaaaactgataagagacggtagcatcgatctggttatcaacctgcccaataataatactaagttcgtccatgataattatgtgatacggaggacagctgtggattctggaatccccctcctgacgaattttcaggttactaagctgtttgcagaggcagtccagaaatctagaaaggtggactctaagagcctgttccattacaggcagtattccgcaggcaaagccgct

SEQ ID NO: 8041 - DNA, 4500 bp, Artificial Sequence
  Description of Artificial Sequence: Synthetic coding sequence
atgactcgtattctcaccgcctttaaagtggtgcgcaccctcaagactgggttcggatttaccaacgtcaccgcacaccaaaaatggaaattcagccgtccaggcataaggcttctgtcggtgaaggcgcagactgcacacattgtgctggaggatggcaccaagatgaagggttacagcttcggacatccctcatccgtggctggtgaagttgtgttcaataccggccttggggggtacccagaggcaatcactgatcccgcatacaagggacagatccttactatggcaaaccccataatcggtaatggtggggcacctgatactaccgcacttgatgaactgggactttcgaaataccttgagtccaacggcatcaaagtgtccggactgctcgtccttgactactcgaaggactataaccattggcttgcgactaaatccttgggtcaatggctgcaagaggaaaaggtccccgcgatttatggagttgatacccggatgcttactaagattattcgagacaagggcaccatgctgggaaagattgaatttgagggccaaccagtcgactttgtggatccgaataagcaaaacctgatagccgaggtgagcactaaggacgtcaaagtgtacggtaagggaaatcctaccaaggtcgtggccgtcgattgtggtattaagaacaacgtgattcgactgcttgtcaagcgcggggcagaagtgcacctcgtcccttggaaccatgattttaccaagatggagtacgatggtattctcattgccggtggacccggcaaccccgcattggcagaaccactgatccagaatgtgcgcaagatccttgaatccgacagaaaggagcctctgtttggtatttccaccggaaaccttattacgggtctggcagcaggggcaaagacttacaagatgtccatggcaaatcggggtcaaaatcagccggtgctgaacattacgaataaacaagcgttcattacggctcaaaaccacggttacgccctggacaatactctgccagcaggctggaagccactttttgtgaacgtcaacgaccaaactaacgagggaattatgcatgagtccaagccatttttcgctgtgcaattccaccctgaggtgactccaggtccaatagataccgaatacttgtttgattccttcttctcactcataaagaaaggtaaagccactaccattacttcggtgctgcctaagccagctcttgtggcctcgcgtgtggaagtgtcgaaagtccttattctgggatcgggcggtctgagcattggccaggcgggagagtttgattacagcggctcccaagcagtgaaggccatgaaggaagaaaacgtcaagactgtcctgatgaacccaaacatcgcatccgtgcaaaccaatgaagtgggtcttaaacaagcagataccgtgtacttcctgcctattactccccaatttgtgaccgaagtgatcaaagcagaacaacctgatggtttgatactcggtatgggaggccagactgcactgaactgcggagtggaacttttcaagaggggagtgcttaaggagtatggagtcaaggtgctgggaacgtccgtggagtccattatggcgactgaggatagacagctgttttcagataagctgaatgagattaatgagaagatagcaccatcatttgcagtggagtcgatagaagatgctctcaaagcagcggacacgatcggctacccagtgatgattcgcagcgcatacgcacttggtggtcttggatctggcatttgtccaaaccgcgaaaccctgatggatctgtctacgaaggcctttgcaatgacgaaccaaatcctggtcgagaagtccgtgactggatggaaggaaattgaatacgaggtggtgcgcgacgcggatgacaactgtgtgaccgtgtgtaatatggagaatgtcgatgccatgggtgtgcacacgggcgattcagtcgtcgtggcacctgcccaaacccttagcaacgcagaatttcaaatgcttcgcagaacttcgattaacgtggtgcgtcaccttggcattgtcggcgagtgtaacattcagttcgcattgcacccaacctccatggaatactgcatcatcgaggtgaacgcccggctctcgagatccagcgccctggcatccaaggcgaccggataccctcttgcattcatcgcggccaagatagcgcttggaattcccctccctgagattaagaacgtggtgtcgggtaagacctcagcgtgtttcgagccctcacttgattacatggtgaccaaaattccgagatgggatctggaccgctttcatggcacttcatctcgaattgggtccagcatgaagtccgtcggtgaggtcatggccattggccgtacttttgaggaatcatttcaaaaagctctgcggatgtgccatccctcaatagaaggttttacccctagactccctatgaacaaagaatggccatctaatctcgatctgagaaaggaactctcagagccaagcagcacccgcatttacgcaattgccaaagccatcgacgataacatgtcccttgacgagattgagaagttgacttacattgacaagtggtttctttacaagatgcgggacattctgaacatggaaaagaccctgaaggggctgaactcggaatccatgactgaagagactcttaagcgggcaaaggaaatcggcttttcggataaacaaattagcaaatgtctgggcttgaccgaagcacaaactcgggagcttcgcctgaagaagaatatccatccgtgggtgaagcaaatcgacacgctcgcggcggagtacccgtccgtgaccaactatctttacgtgacgtacaacggacaggaacatgatgtgaattttgatgatcatggaatgatggttctgggttgtggtccttaccatattgggtcaagcgtcgagttcgactggtgtgcagtgtcgtcgattcggaccctgaggcagctgggaaagaaaactgtggtcgttaattgtaacccagagactgtctcgaccgattttgacgaatgtgacaagctgtactttgaagagctgtccttggaacgaatcctggacatttaccatcaagaggcatgtggcggatgtataatcagcgtgggaggtcaaattccaaataaccttgccgtgcctttgtacaagaacggagtgaagataatgggaacgtcaccgcttcagattgatagagcagaggatcgctcgattttctcggcagtcctcgatgaactgaaagtggcgcaagcaccttggaaggcagtgaacactcttaacgaggcactggaatttgccaagtcagtcgattacccttgtctcctgcggccttcgtacgtcctttccggatcggcgatgaacgtggtgttctccgaggatgaaatgaagaaattcctggaagaggcgactcgagtatcccaagaacaccctgttgtgcttaccaaatttgtcgaaggcgcacgggaagtggaaatggacgccgtgggaaaggatggtagggtcatttcacatgcgatctccgaacacgtggaagatgccggagtgcattcgggggatgccactttgatgctccctactcaaactatttcacagggcgctatcgagaaggtgaaggacgcaaccaggaagattgctaaggcgtttgcaatttcaggcccctttaatgtgcagttccttgtgaagggtaacgacgtgctcgttattgaatgcaaccttagggcaagccgctcgttccctttcgtgtccaagactctcggagtggactttattgatgtggcaacgaaagtgatgatcggggaaaacgttgatgaaaagcatctgccaaccctcgatcatccgattatcccggcagattacgtggcaattaaggcacctatgttctcatggccccgcttgagagacgcagatccgatacttaggtgcgaaatggcaagcaccggagaggttgcttgtttcggtgaaggtattcatactgcttttctgaaggcaatgttgtccaccgggttcaaaatacctcaaaagggtatacttataggtatccaacagagcttccgcccccgctttttgggtgtggcggagcagcttcacaatgaaggattcaaactgttcgcaaccgaagccacctcggactggctcaatgcaaacaatgttcctgcaacgcccgtggcctggccatcccaggaaggtcagaacccatctcttagcagcatcagaaagctgatacgagatggttcaatagacctggtcatcaatctcccaaacaataacaccaagtttgtgcatgacaactacgtgattcgccggactgccgtggacagcggtattcctcttcttacgaattttcaggttaccaagctgtttgccgaagctgtgcagaagtcgagaaaggtcgattcgaagtccctttttcactacagacagtactctgcgggcaaggccgca

SEQ ID NO: 8042 - DNA, 4500 bp, Artificial Sequence
  Description of Artificial Sequence: Synthetic coding sequence
atgacgcggattctcactgccttcaaggttgttaggacattgaaaaccgggtttggctttactaatgtcactgcccaccaaaagtggaagtttagccgacccgggattagactgttatccgtaaaggctcaaacggctcatattgtattggaagacggaacaaaaatgaaaggctatagcttcggccatcctagttccgtggcgggggaggtggtgttcaataccggcctcggtgggtacccggaagccatcaccgaccccgcatacaagggacaaattttaactatggccaaccctatcatcgggaacggaggcgctccggataccacggcgctggatgaactcgggctttctaagtatctcgaatccaacggcataaaagtgagtggtctactagttctcgactattctaaggactacaatcattggttagcgactaaaagtctcgggcaatggctgcaggaggagaaagtcccggccatatacggcgtcgataccagaatgctgactaagatcataagagacaagggaaccatgttaggaaagatcgaattcgagggtcagcccgtcgatttcgtggacccaaataagcaaaatctgatcgccgaggtatctacgaaggacgttaaagtatatggaaaagggaatcctactaaggtggttgcagtcgattgcggcatcaagaacaacgtgattcggctgctggtgaaacgaggcgccgaggtgcatctggtgccatggaaccacgactttaccaagatggaatatgacggaattctgatcgccggagggccggggaaccccgctctggccgagcccttgattcagaacgttcgaaagatattggagtcggaccggaaagagccattgtttggaatctctacgggcaatctgatcactggtttggcggcgggcgccaagacctataaaatgtcaatggctaacagagggcagaatcagcccgtgctcaatattaccaacaagcaagccttcataacggcgcagaatcacggatacgctcttgacaacacactacctgccgggtggaagcctctgttcgtgaacgtgaatgatcagaccaatgaaggcatcatgcatgagtccaaacctttcttcgcggtgcagtttcacccagaggtcacccctggtcctatcgacactgaatacttatttgactctttcttctctttgatcaagaaaggaaaggctacgaccattacatcagttctgccaaagcctgccctggtagcttctcgcgtggaggttagtaaggtcctgattctgggctcgggcgggctatccataggccaggcgggcgagttcgattattctgggagccaggcggtgaaagcaatgaaggaggaaaacgtaaaaaccgtccttatgaatcctaatatcgcgtccgttcaaactaatgaagtgggcctgaagcaggcagacaccgtatacttcctgcccatcacaccacagttcgtgaccgaggttattaaagccgaacagcctgacggcctcatcctagggatgggaggtcaaacagcactcaactgcggcgtggagttgttcaaaagaggggtgctaaaagagtacggcgtgaaggtgttgggcacctccgtcgagtccatcatggcgactgaggaccgacagctcttctcggataaactgaatgaaatcaatgaaaaaatcgctcctagcttcgcagtggagtccattgaggacgcccttaaggccgccgatacaatcgggtacccagtgatgattagatctgcttacgcccttggcgggttgggaagcggcatatgccctaatcgggagacactcatggacttatccaccaaggccttcgccatgacaaatcagattctggtggagaagtcagtgactggttggaaggagatagagtatgaagtggtgcgggatgcggacgacaactgcgttacggtctgcaatatggagaatgtggatgccatgggtgtgcacacgggggactctgttgtagttgctcccgctcagacgctgagcaatgcagagtttcagatgctacggcgtactagcattaacgtggtacgccacttgggcatagttggcgagtgcaacattcagttcgcgctgcaccctacttctatggagtattgtatcatcgaagtaaacgcaaggctgtcacgctctagcgcattagcttctaaggctacagggtacccccttgcttttattgccgccaagattgcactcggcatacctctgccagagataaaaaacgtggtcagtggaaaaacaagtgcttgctttgaacctagcctggactatatggtcaccaaaatcccccggtgggacctcgacagattccatggcactagttcccggatcggttcctcaatgaagagcgtgggagaagttatggccatcggacgaaccttcgaggagtccttccagaaagccctgcgtatgtgccacccttcgatcgagggatttacacctaggctgccgatgaacaaagagtggccaagcaacctggacctgcggaaggagctttccgaacctagcagcacgaggatatacgctatcgccaaagccatcgatgataacatgtcgctggatgaaatcgagaaactaacctatatcgacaagtggttcctgtataagatgcgggatatactcaacatggaaaagactcttaaggggctgaactcagagtctatgactgaggagacattgaaaagggcaaaggagattggattctcagacaagcagatctctaaatgtctgggtttgacagaggctcagactcgcgagctacgattgaaaaaaaatattcatccttgggtgaaacagatcgatacactggctgccgaatacccatctgtcaccaactatctatacgtgacgtataacggacaagaacacgacgtaaattttgatgatcatggcatgatggtgttgggttgtggtccataccatatcggaagcagcgtagaattcgactggtgcgccgtgtcctctattaggactctgcgccagttgggtaaaaagacagtggttgtcaactgcaaccccgaaaccgtctctactgattttgacgagtgtgataaactttacttcgaagagctctcactggagagaatcctcgacatataccatcaggaagcctgcgggggctgcattatatccgtcggtggtcagatccctaataacctggctgtacctctatataaaaatggcgtcaaaattatgggtacatcaccactgcaaattgatcgcgcagaagataggagtatcttctcagcagtgctagatgaactaaaggtggcacaggccccatggaaggcggtgaatacgctaaatgaagctcttgaattcgccaaaagtgttgactacccatgcttgctccgtccatcctatgtgctgtctggctccgccatgaatgtggttttctctgaggacgagatgaagaagtttctcgaggaagccacgagggtgagccaagaacatcctgtggttctcactaaattcgtagagggcgcccgtgaagtagagatggacgccgttggcaaagatggacgggttatctcccatgcaatttctgaacatgttgaagacgcaggagttcactctggtgatgccaccttaatgctcccgacacagacgatcagccagggggctatcgagaaggtcaaagacgctacacgcaagattgcgaaggcttttgcaatcagcggaccattcaatgtgcaattcctggttaagggcaatgacgttctggttatcgaatgcaatctcagagcgtctagaagttttcctttcgtcagtaaaacattgggagtagacttcatagatgtggcaaccaaggtgatgatcggagaaaacgtggatgaaaagcacctgccaacacttgatcaccccattattccagctgactacgtggccattaaggctcctatgttttcctggcccaggttacgcgacgctgaccctattctgaggtgtgaaatggcaagtactggagaggtggcttgctttggggagggcattcacaccgcatttcttaaagctatgctgagcaccggcttcaaaatcccacagaagggcatcctgatcggtatacagcagtcatttagacccagattccttggagtggctgaacaactgcacaacgaaggattcaagctgtttgccaccgaggccacttccgactggctcaacgccaacaatgtgcctgctaccccagtcgcatggccttctcaggagggtcagaatccctccctttcctcaatacggaagctgatccgggacggcagtatagaccttgtcatcaacctgccaaataataatacgaagttcgtgcatgacaactacgtgattaggcggacagctgtggacagcggcatcccgttgcttacaaactttcaggttaccaaactgttcgctgaggcagtgcaaaagagcaggaaggtggacagtaaatctttatttcattataggcaatattcagccggcaaagccgct

SEQ ID NO: 8043 - DNA, 4500 bp, Artificial Sequence
  Description of Artificial Sequence: Synthetic coding sequence
atgactagaatcctcactgccttcaaggtggtgcgaactcttaagaccggatttggattcactaatgtgaccgcacaccagaaatggaagttcagcagacctggtataagactcctgtccgtcaaagcacaaaccgcccatattgtgctcgaagatggcacgaagatgaaaggctactcgtttggtcatccatcatcagtggcaggtgaagtggtgttcaatactggtcttggaggataccctgaagcgattactgaccctgcctacaagggacaaattctgacgatggcgaatccgatcatcggcaatggtggagcccctgataccactgcccttgatgaacttgggctgtcgaaataccttgagtcgaatgggatcaaggtgagcggtctgcttgtgctggattactcaaaggactacaatcactggctggcgaccaaatcgctgggccaatggctgcaggaggaaaaggtcccggcaatttacggtgtggatactagaatgctgaccaagattattcgcgataagggaacgatgctggggaagatcgaatttgagggtcaaccggtggattttgtggatccgaacaagcagaacttgatcgccgaggtgtctactaaagacgtcaaagtgtacgggaagggcaaccctaccaaggtggtggcagtggattgcggaatcaaaaacaacgtcatccgcctcctggtgaagaggggcgccgaagtgcatctcgtgccgtggaaccatgacttcactaagatggagtacgacggtatccttatcgcaggcggccctggcaaccctgctctcgcagagcctcttatccaaaatgtgcgaaagattctggaatccgataggaaagaaccattgttcgggatttcaactggtaacctgattacggggcttgcagcaggtgcaaagacctataagatgtcaatggctaaccgtggtcaaaaccagccagtcctgaacattactaataagcaagcatttatcaccgcacagaaccacggttacgcccttgataacaccctgccagccggatggaagcccctctttgtgaacgttaatgaccaaaccaacgaaggtatcatgcatgaatcgaagccttttttcgcagtgcagttccatcccgaagtcactcccgggcctattgataccgagtacctcttcgattcctttttcagcctcattaagaagggtaaggcaactacgataacttcagtcctccccaagccagcattggtggcatctcgagtggaggtttccaaagtcctgatactcggctccggtggcctgtcgatcgggcaagccggcgaattcgattactctggatcccaagcagtcaaggcgatgaaagaggagaacgtgaaaaccgtgttgatgaacccaaacattgcatccgtgcagactaacgaagtggggctgaagcaagcagacaccgtctatttcttgccgatcactccacaatttgtcactgaggtgattaaggcagagcaaccagacggtctgatccttggtatgggtggccagactgctcttaactgcggggtggaactgtttaagcgtggggtccttaaagaatacggggtgaaggtgctggggacgagcgtggaatcaattatggcaaccgaggatcgccagcttttctcggataagttgaatgagatcaacgagaaaattgcgccatccttcgctgtggagtcgattgaagatgcactgaaagcagccgacactattggatacccagtcatgattaggtccgcatacgcacttggaggcctgggatccggcatttgtcctaaccgggaaactctcatggacctgtcaactaaagcatttgccatgactaaccagattctggtggaaaagtcggtcaccggatggaaagaaattgaatacgaagtggttcgtgacgccgacgacaactgtgtgaccgtgtgtaacatggaaaacgtcgacgcgatgggagtccacaccggagactcagtggtggtcgcgcccgcacagactctttcaaatgctgaatttcagatgctgagacggacgtcgattaacgtggtcaggcatctgggcatcgtcggagagtgcaatattcaatttgctctccatcctacctctatggaatactgtatcattgaagtcaacgccagactgtcccggtctagcgcactcgctagcaaagcaactggttaccccctggccttcatcgcagctaagattgctcttggaattccactgcccgaaatcaagaacgtggtgtccggcaagacctcagcttgttttgaaccctcgttggattacatggtcactaagatcccacggtgggacttggatcgttttcacggcacctcgtcccgcataggaagctctatgaaatccgtgggtgaagttatggcaattgggaggacttttgaagaatcatttcaaaaggccctccgaatgtgtcacccctcgatagaaggatttactccaagactcccgatgaataaggaatggcccagcaacctggatcttaggaaagaactgagcgagccctcaagcactaggatatacgccatagctaaggcaatcgatgataacatgtccctcgacgagattgaaaagttgacctatattgataagtggtttctgtacaagatgcgggatatcctgaatatggagaaaactctcaagggacttaattcggagtccatgactgaagaaactctcaagcgggcaaaggagattggtttttcggacaaacaaatcagcaaatgtctgggcctgaccgaggcacagacccgggaacttcgcctcaagaaaaacattcatccttgggtgaagcagattgacactctcgccgcggaatatccgtccgtgacgaattacctgtatgtgacgtacaatggtcaggaacatgacgtgaattttgatgatcatggaatgatggttcttgggtgtggtccttaccatatcggaagctctgtggaatttgattggtgtgcggtttcatcgataagaaccctgcggcaactgggtaaaaagaccgtcgtggtgaattgtaatccggagactgtctccaccgatttcgatgagtgcgacaagctctactttgaggagctcagcctcgagagaatccttgatatctaccaccaggaagcatgcggaggatgcatcatttctgtcggtggccaaattcctaacaatctggccgtccctctgtacaaaaacggcgtcaagatcatgggaaccagcccactgcagattgatagagctgaggataggagcatattctcggccgtgttggatgaacttaaggtggcacaggctccttggaaagcagtgaacaccctgaacgaggctctggaatttgcaaagtccgtggactacccttgtctgctcagaccttcatacgtgttgtcagggagcgcgatgaacgtcgtcttttccgaagatgagatgaagaagttcttggaagaagcaacccgtgtctcacaagagcatcctgtggtgctgaccaagtttgtcgagggcgcacgcgaagtggagatggatgcagtgggaaaggacggacgcgtcatttcgcatgcaatctccgaacatgtcgaagatgcaggagtccactccggggatgccactctgatgctgcctactcagaccatttcgcaaggggcaattgaaaaggtcaaggatgcgactcgcaagattgcgaaggcgtttgcgatctcgggccctttcaacgtccagtttctggtcaaaggaaacgacgttctggtcattgaatgtaacttgagggctagcagatcatttccctttgtctccaagactcttggagtggactttatagacgtggcgaccaaggtgatgattggtgagaacgttgatgagaaacatcttccaacgctggaccatcccataatcccggcggattacgtggccatcaaggcacctatgttctcgtggcccaggcttagggatgcggacccaattcttcgttgcgagatggcatccaccggtgaagtcgcctgttttggtgaaggtatccataccgcatttctcaaagccatgctttcgactggatttaagatcccccaaaagggcatactgattggtatacaacaatcatttcgacctcggttcctgggcgtcgctgaacaacttcataacgaggggttcaagctgtttgcaaccgaagccacttcagactggcttaatgcaaacaatgtgccagcgaccccagttgcatggccctcacaagaaggtcagaatccatccctcagctcaattagaaaacttattcgggatggatcaatcgatctcgtcataaatctgcccaataacaatacgaagttcgtgcacgataactacgtcattcgcagaaccgccgtggattcaggaattcccctgttgacgaacttccaagtgaccaagctctttgccgaagcggtgcaaaaatccagaaaggtggactcgaagtccctcttccattatcgccagtacagcgcaggtaaggcagcc

SEQ ID NO: 8044 - DNA, 4500 bp, Artificial Sequence
  Description of Artificial Sequence: Synthetic coding sequence
atgacccgcatactcactgcatttaaggtggttagaaccctcaaaaccggattcggtttcaccaacgtgaccgcacaccagaagtggaagttttcacggcctggaatccgccttttgtccgtgaaggcacaaaccgcccatattgtcctggaggacggcaccaagatgaagggttactcgtttgggcatccgagctcagtcgcaggcgaagtcgtgtttaacactgggctgggagggtaccctgaggcgattactgaccctgcgtacaaaggacagatcctcactatggctaaccccattatcggcaacgggggagcccctgataccactgcgctggatgagctgggactctcaaagtaccttgagtcgaatggtattaaggtgtccggactccttgtgctcgattacagtaaagattacaaccactggctcgcgacgaagagcctgggtcaatggcttcaggaggaaaaggtgcccgcaatttacggagtcgacaccaggatgctcaccaagattatcagagacaaggggaccatgctcggtaaaatcgagtttgagggtcagcctgttgactttgttgacccgaacaagcaaaaccttattgccgaggtgtccactaaagatgtcaaggtgtacggtaagggcaaccctaccaaggtggtggcggttgattgtggcattaagaataatgtgatacggcttctcgtgaaacggggagcagaagtccatcttgtgccctggaatcatgactttactaaaatggagtacgacggcatcctgatagcaggggggcctggtaatcccgcactcgccgaaccacttatccagaatgtgcgcaagatacttgagtccgatagaaaggaacctctgttcggaattagcactggcaacctgattacgggacttgcagccggtgcaaaaacctacaagatgtccatggcaaacagaggtcagaaccagccagtgctcaatatcactaataagcaggcattcatcaccgctcaaaatcatggctacgccctggataacactctgcccgccggttggaagccactctttgtgaacgtgaacgatcaaaccaatgaaggcattatgcatgaatcaaaacctttcttcgctgtgcaatttcaccccgaagtgaccccagggccaatcgataccgaatacctttttgatagcttcttttcgctgataaagaaaggaaaggcgaccacgattacctcggtgctccctaagcctgcactggtcgcgtcccgcgtcgaggtgagcaaggtcctgatactcggttcaggtggattgagcataggacaagcaggtgaatttgactactcagggtcgcaagcagtgaaggcgatgaaggaggagaacgtaaagactgtcctgatgaatcccaatattgcctcagtgcaaactaacgaagtgggactgaagcaggcagatactgtgtattttctgcctattacgccacaatttgtgaccgaagtgattaaagcagagcaacctgacggccttatactgggaatgggagggcagactgcgcttaattgcggtgtggaactctttaagcgtggagtcctcaaggagtacggtgtcaaggtccttggaacctcggtggaatccatcatggcaaccgaagatagacaactcttcagcgataagctgaatgagattaacgagaagatcgcaccttcgtttgcagtggagtcgatcgaagatgcattgaaggcagcggatactatcggataccccgtcatgattaggtcggcatacgcacttggcggccttggttcggggatctgtcctaacagagaaaccctgatggatctctcgactaaggctttcgcgatgaccaaccaaattcttgtggaaaagagtgtgaccggatggaaggagattgaatacgaggtggtgcgcgacgcagatgacaattgcgtgactgtctgcaatatggaaaacgtcgatgcaatgggcgtgcacaccggcgactcagtggtcgtggcaccggcacagaccctttcgaacgccgagttccaaatgctgaggaggaccagcataaatgtggtcagacatctgggtattgtcggcgagtgtaacatccagtttgcactccaccccacctcaatggaatactgcatcatagaagtcaacgccaggctctcccgctcgtctgccctggcgtcaaaggctactggttaccctcttgcattcattgcggccaagattgcactcggcatcccccttccggaaatcaagaacgtcgtctcggggaaaaccagcgcctgctttgagcctagccttgattacatggtgactaagatccctaggtgggacctggacaggttccacggcacgtcctcccggataggcagcagcatgaagtccgtgggtgaagtgatggcaatcgggcggaccttcgaagaatcctttcagaaggccctgcgcatgtgtcatccttcaatcgagggatttaccccgcggcttccaatgaacaaggaatggccaagcaacctggatctgcggaaggagctgtccgaaccatcttccaccagaatttacgcaattgcaaaggcaatagatgacaacatgtcgctggatgaaatcgaaaagctcacctacattgataagtggtttctgtataagatgagggacattctgaacatggaaaagacgctcaaaggccttaattccgaaagtatgaccgaagaaactcttaaacgcgcgaaagaaattggtttctcggacaaacagatttccaaatgtctgggcctgactgaagcacagactagagagttgcggttgaagaagaatatccatccctgggtgaagcaaatcgatactctggcggccgaatacccctcagtgactaattacctttacgtgacctacaatggacaagagcacgacgtcaacttcgacgatcacggcatgatggtgttgggatgtggaccttatcacattggctcgtcggtggaattcgattggtgtgccgtgtcgagcatccgtaccttgagacaactcggtaagaaaaccgtggtggtgaattgtaaccccgaaactgtctcgaccgattttgatgagtgcgataaactttacttcgaggagctttcgctggaacgcatccttgacatatatcaccaagaagcatgtggcgggtgtattatctcggtgggtggtcagattcccaacaacctggccgtgcctctctacaagaatggagtaaagattatggggacttcgccccttcaaattgatcgggcagaagatcgatccattttctcggcagtcctggatgaactgaaggtcgcacaagcaccatggaaggcggtgaataccttgaacgaagcactggagtttgcaaaatcggtggattatccctgtctcctcaggccttcatacgtcctttcgggatcagcgatgaatgttgtgttctcggaagatgagatgaaaaagtttctggaggaggcgacccgagtgtcgcaggaacatccagtggtcctgacgaagttcgtggaaggagcacgggaagtcgaaatggatgctgtgggaaaggatgggcgggtgatcagccacgctatcagcgagcatgtggaggatgcaggggtccattccggagatgcaacgcttatgctcccaacccagacgatttcacagggggccattgaaaaagtcaaggatgccactcgaaagattgctaaagcattcgccattagcggcccttttaacgtgcaatttctggtgaagggcaacgatgtgcttgtgattgagtgtaatcttcgtgcctccagatctttcccgtttgtgtcgaaaacgctcggcgtggactttatcgatgtggcaaccaaagtcatgataggcgagaatgtggatgaaaagcatcttcccactcttgatcatccaataatcccggcagattacgttgcaatcaaagctcctatgttttcttggcctcgcctgcgggacgcggatccaatcctgcggtgtgaaatggcgtcgaccggtgaagtggcatgttttggagagggtatccatactgcattcctgaaagcaatgctttccacgggattcaagatcccacagaagggaattctgattggtatccagcagagctttagaccaaggttcctgggtgtggcagaacaactgcataatgaaggattcaagctgttcgcaaccgaagcaacctcagattggcttaacgcaaataacgtgccagcaactcccgtcgcatggccatcgcaggaaggacagaatccgtcccttagctccattagaaaacttattagagatggatcgattgaccttgtgataaatcttcctaacaacaacaccaagtttgtccacgacaactacgtgatccgacgcaccgcggttgattcaggaattcctcttcttaccaactttcaagtcacgaaactgtttgcggaggcagtgcagaagtcaagaaaagtggactccaaatcactgtttcattacagacagtactccgccgggaaagcagcg

SEQ ID NO: 8045 - DNA, 4500 bp, Artificial Sequence
  Description of Artificial Sequence: Synthetic coding sequence
atgacccggatcctgacggcgttcaaggtcgtccggacccttaaaactggctttggtttcaccaacgtcactgcgcatcagaaatggaagttttcgcggccggggatccggctgctgtctgtgaaggcgcaaactgctcatatcgtgttggaggacggaaccaagatgaaaggttactcgtttggacacccatcgtcggtcgcaggtgaagtggtgttcaacaccggactgggtggataccctgaagccatcactgatccggcttacaaggggcaaatcctgaccatggccaacccgatcattggaaatggaggagccccggacactactgcactcgacgagctggggctctctaagtacctggagtccaacggaatcaaggtgtccgggcttctggtgctggattacagcaaggattacaaccactggcttgcgacgaagagcttgggacagtggctccaagaagaaaaagtgccggccatctacggagtcgatacccgcatgctcactaagatcatccgggataagggcaccatgttgggcaagatcgagtttgaaggacagccggttgatttcgtggacccgaacaagcagaatctcatcgccgaagtgtcgactaaggacgtcaaggtttacgggaagggaaacccgacgaaagtggtggctgtggattgcggaatcaaaaacaacgtgatccgcctgcttgtgaagcgcggcgccgaagtgcacctggtgccgtggaaccacgactttaccaagatggaatacgatggtatcttgattgcgggaggaccaggaaacccagctttggccgaaccacttatccaaaacgtgcgcaagatcctcgagagcgaccgcaaagaacctttgtttggcatctccactggtaatctgattactgggctggcggcgggagccaagacctataagatgagcatggccaaccgcggacagaatcaaccagtgctgaatatcaccaataagcaagccttcatcaccgcccaaaatcatggttacgcgctggacaacacgctccctgcggggtggaagccgcttttcgtgaacgtcaatgaccagaccaacgaaggaattatgcacgaatccaagcccttcttcgcggtgcagtttcaccctgaggtgactccgggcccgattgacactgaatacctgttcgactctttcttttcgctcatcaaaaagggcaaggcaactacgataactagcgtgttgccaaagccggcgcttgttgcatcccgggtagaggtgagcaaagtgctgatcctgggaagcggaggattgtcgatcggtcaggcaggagagttcgactacagcggatcccaggccgtgaaagctatgaaggaggaaaacgtaaagactgtgctcatgaaccccaacatcgcctcggtgcaaactaatgaagtcggcctgaagcaagcagacactgtgtatttcctgccgatcactcctcagttcgtgaccgaggttatcaaggccgaacagccggatgggcttatcctgggaatgggaggtcaaaccgctctcaactgcggtgtcgaactgttcaaaaggggagtcctgaaagagtacggagtgaaggtgctgggcacttcggtggaatccatcatggccaccgaagatcgacaactgttctcggacaagctcaatgagatcaacgagaagatcgcgccttcattcgccgtggaatcaatcgaagatgctctgaaggctgctgacaccatcggttacccggtgatgattcggtcagcctacgccctgggtggcctgggctcggggatttgtccaaaccgggagactctgatggaccttagcactaaagcctttgccatgacgaaccagatcttggtcgaaaagtcagtcaccggctggaaagaaattgagtacgaagtggttcgcgatgcagacgataattgcgtcaccgtgtgcaatatggagaacgtggacgctatgggcgtgcacaccggagactccgtggttgtggcaccggcacagaccctttctaacgctgaattccagatgctgcgccgcacttccatcaacgtggtccgccatctgggaatcgtgggtgagtgcaatatccagtttgcactgcatcccacgtccatggaatactgcatcatcgaagtgaatgcaagactgtcgcgcagcagcgctctggccagcaaggcgaccgggtaccctctcgccttcatcgcggcgaagatagcactgggcatccccctgccagaaatcaaaaacgtggtgtcgggaaaaacctcggcttgtttcgagccatcactggactacatggtgaccaagatcccaagatgggacctggatagattccatggaacctcgtcaagaatcggatcgtcgatgaagtccgtgggcgaagtcatggccatcggacggactttcgaggaatccttccagaaggctctgcgcatgtgccatccgtcgatcgagggcttcactccccgccttccgatgaataaggaatggcctagcaatctcgatctgcgcaaggaactctcagagccgtcgtccacccgcatctacgccattgcgaaggcaatcgacgacaatatgagcctcgacgaaatcgaaaagctcacttatatcgacaagtggttcctgtacaagatgcgggatatcttgaatatggaaaagacgctgaagggactgaactcggagagcatgactgaagaaaccctgaaacgcgccaaagagatcggtttttcggataagcagatctctaaatgtctggggctcactgaggcccagactcgcgagctgcggcttaagaagaacattcatccttgggtgaaacaaatcgacactttggcggcggagtacccgagcgtgactaactacctgtacgtgacttacaatggccaggagcacgatgtgaacttcgacgatcacggaatgatggtgctcggatgtggaccgtaccacatcggctcctccgtggagttcgattggtgcgcggtcagtagcatccgcaccctgcggcagctgggaaagaaaactgtcgtggtgaattgtaatccggaaacggtgtcgactgattttgatgagtgtgacaagctgtatttcgaagagctgtccctcgaacgcatcctggacatctaccaccaggaagcgtgcgggggatgcatcatctcagtcggaggacagattccgaacaatctggctgttccattgtacaagaacggagtaaagatcatgggaactagccccctgcaaatcgaccgggctgaggaccgctcgatcttcagcgccgtgctggacgaactcaaggtggctcaggccccgtggaaggccgtgaacaccctcaacgaggccctcgaattcgccaaatcggttgattacccgtgcctcctcaggccctcctacgtgctgtcgggatctgcgatgaacgttgtgttctctgaagatgaaatgaagaaattcctggaagaggcaacgcgtgtgagtcaggaacatccagtggtactgactaaattcgtggagggagccagagaagtggagatggatgcggtcggaaaggatggacgagtgatctcacacgccatctccgaacacgtcgaggatgctggggtccattccggagatgctaccctgatgctgccaactcaaactatctcacaaggagccatcgaaaaggtgaaagacgccactcgcaagattgcaaaggcttttgccatcagcggaccgttcaacgtccagttcctggtgaaggggaatgacgtgctggttatcgagtgcaatctgagggcgtcgcggagcttccctttcgtcagcaagactttgggcgtggatttcattgacgtcgcgactaaagtcatgatcggggaaaatgtggacgagaaacacttgcccacccttgaccaccctatcattccggcggattacgtcgccattaaggcgcctatgttcagctggccaagacttcgcgatgccgacccgatcctcaggtgcgaaatggcctccaccggcgaggtggcctgctttggagaaggaatccatacggcattcctgaaggcaatgctgtcgactggcttcaaaatcccccaaaagggaatcctgatcggaattcaacaatcctttaggcctagattcctcggagtggccgaacagctgcacaacgaaggatttaagctctttgcgactgaggcgacttccgattggctgaacgccaataatgtcccggcgaccccggtggcctggccatcccaggagggtcaaaatcccagcctgtctagcatcagaaagttgattcgtgatggcagcatcgacctggtgataaacctgccgaataacaatacgaagtttgtccacgacaattacgtgatcagacgcaccgcggtcgatagcggaatccctctcctgactaacttccaggtcaccaagctgttcgccgaggctgtccaaaaatcacgcaaggtggactccaaatccctgtttcactaccgccaatactccgcaggtaaagccgca

SEQ ID NO: 8046 - DNA, 4500 bp, Artificial Sequence
  Description of Artificial Sequence: Synthetic coding sequence
atgacccgtatacttactgccttcaaagttgtgcgcacgcttaaaactggtttcgggttcactaatgttacggctcatcagaagtggaagttctcaaggccagggattcgactgttgtctgtaaaagctcagaccgctcatattgtactagaagatggaacaaaaatgaagggttactccttcggacacccatcttcagtcgccggtgaagtggtcttcaacactggtttgggtggttatccggaggctattacagatccagcttacaaaggtcagatattaaccatggctaacccaattatcgggaatgggggcgctccagatactactgctttggacgagttgggactctccaagtatctcgagtccaacggtattaaagtctctggcctgcttgtgcttgactatagcaaggattataatcactggctcgctactaagtcgctcggacagtggctacaagaggaaaaggttcctgccatatatggtgtggatacccgtatgcttaccaagataatccgtgataaaggtaccatgctgggaaaaattgagttcgagggtcaaccggtcgactttgtcgatcctaataagcaaaacttgattgctgaggtttccactaaagatgttaaagtttatgggaaaggtaaccctacaaaagttgtagctgttgattgcggcatcaaaaacaacgtaataaggctgctagttaagcggggagctgaagttcatcttgtaccttggaatcacgattttacaaaaatggaatatgatgggatccttatagctggtggacctgggaaccctgctctagcagaaccacttattcagaacgttaggaagatccttgagtcggacagaaaggagcctcttttcgggatttccacaggtaacttaattactgggctcgctgctggtgcaaagacttataagatgagtatggccaacaggggacagaaccaacctgtgttgaatataaccaacaagcaggcctttatcacagctcaaaaccacgggtacgctttggataacactcttcctgccggttggaagcctctctttgtgaatgttaacgaccaaactaacgaagggattatgcatgaaagcaaaccattcttcgccgtgcaatttcatccagaggttacacccggtccaatagacaccgaatacctatttgactcattcttttccctcattaagaagggcaaagccactacaatcactagtgttcttccaaaaccagccctcgtcgcctccagggtggaagtgtcaaaagtcctcatcctaggcagtggggggctctctattggacaagctggagaatttgattactctggctcccaggctgttaaggcgatgaaggaagagaacgtgaaaactgttctaatgaacccgaacatcgcttcggtgcaaacaaatgaggttggtctgaaacaagctgatacagtctacttcttgccaataacacctcagtttgtgacagaagtgattaaggctgaacaacctgatggtctgatactaggtatgggtggccaaactgctttgaattgtggggttgagttatttaagcgtggtgtgctgaaggaatatggcgtaaaggttctgggtactagtgttgaatccataatggccacagaggatagacaacttttctcggacaagcttaatgagatcaatgagaagattgcacccagttttgctgttgaatccattgaggatgcgctgaaggctgccgatacaataggatacccagttatgatacgctctgcttatgccttaggtgggctaggttcaggtatttgcccaaatagggagacattgatggatttgtctaccaaggcgtttgccatgactaaccaaattcttgtcgagaaatctgttacaggatggaaagaaatcgagtatgaggtagtgagggatgctgatgataactgcgtcacagtttgcaacatggaaaatgtcgatgcgatgggagtccacactggggactcagtggttgttgctcctgctcaaacgctatcaaatgcagaattccagatgctcagaagaaccagcattaatgtggtaagacaccttggaatagttggggaatgcaatattcagttcgcccttcatcctacttccatggagtactgtataattgaggttaacgccaggctttcgcgaagcagcgcccttgcaagcaaggccactgggtatccacttgccttcattgcggctaagattgcattaggcatccctttacctgaaattaagaatgtcgtgtccggtaagacttcagcttgtttcgaaccaagcttggactacatggtcactaagatcccacgttgggatctggataggtttcatggaacgtcgtcaagaatcggttctagtatgaagagtgtgggggaagtcatggctattgggaggacctttgaggagagctttcagaaagctcttaggatgtgccatccaagtatcgagggattcacgcctagactaccaatgaataaggagtggccttcaaatcttgatcttaggaaagaactttctgagccttcttctactcgcatctatgctatagctaaagctattgatgataatatgtctcttgatgaaatagaaaagctgacttatatcgataaatggtttttgtataaaatgagagacattctgaatatggaaaaaacgctcaagggtctaaattcagagtccatgacagaagaaaccctgaagcgcgcgaaggagatcggattcagtgacaaacagatctctaagtgccttggactgaccgaggcacagacgagggaactaagactcaagaagaatatacatccctgggtgaagcaaattgatactctagctgcagagtatccgtcggtgacaaattatctttatgtgacgtataacggtcaagagcatgatgtgaacttcgatgaccatgggatgatggttcttggttgtggcccttatcatattgggtcgtcagttgagtttgactggtgcgccgttagtagcatacggactttgcggcaactaggaaaaaagaccgttgtagtcaattgtaaccctgaaactgtcagcaccgatttcgacgagtgcgataagctatacttcgaggaactatcactagaaaggattctggacatttaccaccaagaggcctgtggaggctgtattatatctgttgggggtcagatccctaataatctcgctgttcctttgtacaagaacggagtcaagatcatgggtacttctccattgcaaatcgacagagcggaagatcgttctatcttttctgcagtgttagacgaattgaaagtagcccaagctccttggaaagctgtcaacactcttaacgaagctcttgagtttgcaaaatcagtggactacccatgcttgttgaggcctagttatgtcctgagtgggtctgctatgaacgtggttttcagtgaagacgagatgaagaaattcctagaggaggcaactcgagtgtcacaagaacatcctgtggtgctcactaagtttgttgaaggcgctagggaagtagagatggatgctgttggtaaggatggcagggtcattagtcacgctatttcggagcatgttgaagatgctggggtgcacagcggtgatgctacgcttatgttgcctactcagaccatctcacagggtgccattgaaaaagttaaggatgcaacccgtaaaattgctaaagcctttgcgatttcagggcctttcaatgtgcaattcctagttaaggggaatgatgtccttgtcattgaatgtaatttgagggcatcacgttctttccctttcgtctctaagacgttgggtgttgatttcatcgatgttgccactaaagtcatgatcggtgaaaacgtcgatgagaaacacctccctacccttgaccatccaatcataccagctgactatgttgctattaaagcaccgatgttttcatggccgagacttcgagacgcagatccaatcttaagatgtgaaatggcctccacgggcgaagttgcatgctttggcgaggggattcacactgcttttcttaaggctatgctttcgacgggttttaaaatcccacaaaaaggtatcttgattggaattcaacaatctttcagacccagatttttgggtgttgctgaacaacttcataatgaaggtttcaagttattcgcaaccgaagctacctccgattggttgaacgcaaacaacgttcctgctacgcctgttgcttggccttctcaggagggtcaaaacccatccctctcatctatacgaaagttaattagggatggatcaatcgatttggtgatcaatctccccaataataatactaagtttgtccacgataactatgttatacggaggaccgctgtcgacagcgggattccccttctgacgaactttcaagtaacgaagctgttcgccgaggcagtccaaaaatctcgtaaggttgattctaaatctttgtttcactacagacaatactctgcaggtaaagcagcc

SEQ ID NO: 8047 - DNA, 4500 bp, Artificial Sequence
  Description of Artificial Sequence: Synthetic coding sequence
atgacccggatcctcacagcatttaaggtggtgagaacactgaagactgggttcggatttaccaacgttacagcccatcagaagtggaagttcagtcggcccggcatcagactgctgtcagttaaagcccagacagcccacatcgttctggaagatgggaccaagatgaagggttattcttttgggcatcccagctccgttgcaggcgaggtggtcttcaataccgggctaggcggctaccccgaggcaatcactgatcctgcgtataaaggtcagatcttaactatggccaatcccattatcgggaacgggggcgcaccagacacaaccgcactggacgaactgggactgagcaagtacctcgaatctaatgggatcaaagtgtccggactcttggtgcttgactactctaaagactacaaccattggctggcaactaaaagtttaggacagtggcttcaggaggaaaaggtccctgctatctacggcgtggacacgagaatgctgacaaaaatcatcagagataaagggactatgctcggaaagatcgagttcgaggggcagcctgtggattttgtcgatcccaataaacagaacctgatcgctgaggtgtccactaaggatgtgaaggtgtatggcaaagggaacccaaccaaggtggtggccgttgattgtggaatcaaaaacaacgtgatccgactgctcgtgaagcgcggcgctgaggtgcatctggtaccatggaaccatgacttcacaaaaatggagtacgacgggattctgatagccggggggcccgggaatcctgctctggcggaaccgctcatacagaatgtgcggaaaatactagagtccgatagaaaagaaccactattcgggatcagcaccgggaacctgatcacaggcctggccgcgggtgccaagacttataagatgagcatggctaacagggggcagaatcagccggttttgaacatcaccaacaagcaggccttcattactgctcagaatcacgggtatgccctggataacactctaccagccggttggaaacctcttttcgtcaatgtgaatgaccagacaaacgaagggattatgcacgagtcaaagccctttttcgcagtgcagttccatcctgaagtgactcctggcccaattgataccgagtatttgtttgacagcttcttttcccttattaagaaggggaaagcgacgacaatcacatctgtcttgcctaaacctgcccttgtggcatctagagttgaagtgtccaaggtgttgatcttgggaagtggcgggctgagcattggacaagctggcgagttcgattatagtggtagtcaggcagtaaaagcaatgaaggaagaaaatgtcaagaccgtgctgatgaatccgaacatcgcatcagttcagactaatgaagtgggactgaagcaagccgataccgtctactttctcccaatcaccccacagttcgtgacggaggtgataaaagccgagcagcccgacggccttatcctgggcatgggaggccagacagcccttaattgcggcgtcgagctgttcaaaaggggggtgttgaaggaatatggcgtgaaggtcctgggaacttctgtagaaagcatcatggctacagaggatcggcaactatttagcgataaactgaatgaaataaatgagaagatcgccccttctttcgctgtcgaatcaatcgaagacgcacttaaggcggccgatactatcgggtaccccgtaatgattaggtctgcatatgcgctgggaggactaggctccggcatctgcccaaaccgagagacattgatggacctttccaccaaagccttcgctatgactaatcagatcctggtggagaagagtgtcaccgggtggaaggagatcgagtacgaggttgtaagagatgccgatgacaattgtgtaaccgtgtgtaacatggagaacgtcgacgctatgggagtccacaccggtgactccgtggtggtggcgccagctcagacattgtctaatgccgagtttcaaatgctcaggcgcacctcaataaatgtagtacgccacctcggaatcgttggagagtgcaatattcaattcgccctccatcccactagtatggagtactgcattattgaggtgaacgctcggttgagtcgctcgtcagccctggcatctaaggcaaccggctacccgctagccttcattgctgcaaaaattgccctgggaataccacttcctgagatcaagaacgtggtgagcggaaagacttcagcatgctttgagcctagtctggattatatggtaactaagattccccggtgggacctggacaggttccacggcacttccagtcggatagggtcctcaatgaagtcagtgggcgaagttatggcgatcggcaggaccttcgaagaatccttccagaaggcgctgcgaatgtgccacccttctatcgagggttttacaccccgactccccatgaacaaggagtggccctctaatctcgacttgaggaaggaactctcggaaccttcgtccactcgcatctacgctatcgccaaggctatcgatgataacatgtctctggacgagattgaaaagctgacttatattgacaaatggttcctatataagatgcgcgatatcttaaacatggagaaaacgctgaagggcctcaatagcgagagtatgaccgaggagactctcaaaagagcgaaagagatcgggttttccgacaaacagatcagtaaatgtctaggtctgactgaggcgcagacaagggagctgagactcaagaaaaatattcacccttgggttaagcaaattgatactctggcggcagaatacccgtctgtcactaactacctgtatgtgacatataatgggcaagaacacgacgtcaatttcgacgatcacggaatgatggtgctgggatgtggcccctaccatattggttcatctgtcgaattcgactggtgcgccgtgagttcaatacgcacgctcagacagcttggtaagaaaaccgtggttgtgaattgtaacccagaaacagtgagtactgatttcgatgagtgtgataagctctatttcgaggagctgtcactggagcggatcttggacatttaccatcaggaggcatgcggcggttgcataatttcagtgggcggccagatacctaacaatctggcagtgccgctgtataagaacggagtgaagattatgggtacctctccactgcaaatagaccgagccgaggaccggtctattttctcagccgtgcttgacgagctgaaagttgcacaggcaccttggaaggccgtgaacaccctcaacgaggcattagagtttgcaaaaagtgtcgattacccttgtctgttaaggccctcttatgttctctcaggcagcgcgatgaatgttgttttttccgaggacgagatgaaaaaattcctggaagaggccacaagagtgagccaggagcaccctgtggtcctcaccaaattcgttgagggggcgagggaggttgagatggatgctgtgggaaaggatggccgggtgatcagtcatgccatatcggagcacgtggaggatgcaggggtacactctggagacgctacactgatgttgcccacgcagaccatttcccaaggagcaattgagaaagtcaaagatgcaacacgcaaaatcgcgaaggccttcgctatttctggacccttcaatgtgcaatttcttgtgaaaggcaatgatgtcctcgtgatcgaatgcaatctacgagcgtccaggtcctttccttttgtgtcaaagactctcggagttgattttatcgatgttgccacaaaggttatgatcggagagaatgtggatgagaagcatctgccaaccctggaccaccccattatccccgcggactacgtggcaattaaggcacccatgttctcttggccacggctccgcgacgccgacccaatcctccggtgcgagatggcctctactggggaggttgcctgctttggagaaggcatccacaccgcgttcttgaaggctatgctcagcacggggtttaagataccccagaagggtattcttattggaatccaacagtcttttaggccccgttttttaggagtggccgagcagctacataacgaggggtttaaactcttcgcgaccgaagccacgagcgattggctgaatgccaacaatgtgccagcgacccccgttgcctggccaagtcaagagggccagaatccctcactgagttctatcagaaaactcatccgcgacggatccatagacctcgtgatcaatctaccaaacaataataccaaattcgtgcatgacaattacgtgatcagaagaactgccgtagactccggtatcccattactgacgaactttcaagtgacgaagctgttcgctgaagctgttcagaaaagtagaaaagttgattcaaagagcctctttcactatcggcaatatagcgctggaaaagcggcc

SEQ ID NO: 8048 - DNA, 4500 bp, Artificial Sequence
  Description of Artificial Sequence: Synthetic coding sequence
atgacccggatcctgactgctttcaaagtggtgcgcactctgaaaaccggcttcggattcaccaacgtgactgcacatcagaaatggaagttctcgcgccctggcatccgcctcctgagcgtgaaagcccagacggcccacatcgtgctggaggacgggactaagatgaagggctactctttcggacaccctagctcggtggcaggcgaagtagttttcaacaccggcctcggcggctacccggaagcgatcactgaccctgcgtataagggacaaatcttgaccatggcgaacccgattatcggcaacggaggcgcaccagataccaccgctctcgatgaattgggactcagcaagtaccttgaatccaatggaatcaaggtttcaggcctgctcgtgctggactacagcaaggactacaatcactggctggccaccaagagcctgggacagtggctgcaagaggagaaggtgcctgccatctacggagtggataccagaatgctgaccaagattattcgagataaagggaccatgcttggcaagattgaatttgagggccagccggtcgacttcgtggacccgaataagcagaacctcatcgctgaagtgagcactaaggacgttaaggtgtacggaaaaggaaacccgaccaaggtcgtggcagtggactgcgggatcaaaaacaacgtgatcagactccttgtgaagcgcggagccgaggtccacctcgtgccttggaaccatgacttcactaagatggaatacgacggaatcctcatcgccggaggccccgggaatccggcactcgccgaaccactcatccaaaacgtccgcaaaatcctcgaaagcgacagaaaagagccgctgtttgggatcagcaccggaaatctgatcactggactggcagcgggcgcaaagacgtacaaaatgtcaatggctaatagggggcaaaaccaacctgtcctgaacatcacgaataagcaagccttcatcaccgcccagaatcacggatacgccctggacaacactctcccggccggatggaagccgttgttcgttaatgtgaatgatcagaccaacgaaggaatcatgcacgaaagcaaaccttttttcgccgtgcagtttcatccggaggtcacgccgggccctatcgacactgaatacctcttcgattccttcttttccttgatcaagaagggaaaagctactaccatcacctcggtgctccctaagcccgctctcgtggcctcccgggtggaagtctccaaagtcctcatcctcggatcgggcggacttagcatcgggcaagcaggagaattcgactactcgggttcgcaggccgtgaaggccatgaaggaagagaacgtgaaaactgtgctcatgaatccgaatattgcgtccgtccagaccaatgaagtcggtctgaaacaggctgacactgtgtacttcctccctattaccccacagtttgtcactgaagtgatcaaggcagagcagccggacggactgatcctgggtatgggcgggcagaccgctctgaactgtggtgtggaactgttcaagagaggagttctgaaagaatacggagtcaaggtgctcggcacctcggtcgagtccatcatggcaaccgaagatcgccagttgttcagcgacaaactgaacgaaatcaatgaaaagatcgcaccttcgtttgcagtggaaagcatcgaggacgctctgaaggcggcggataccattggataccctgtgatgatccggtcagcttacgctctgggaggactcggatctggaatctgcccaaaccgggagactctgatggacctttcgaccaaggccttcgctatgaccaaccagattctggtggaaaagtccgtgactggatggaaggaaattgagtacgaggtggttcgcgacgcggacgataactgcgtgacggtctgcaatatggaaaatgtggatgcaatgggagtgcataccggagacagcgtggtcgtggcccctgcacaaactctgtcgaatgccgagttccagatgctgagacgcacttccataaatgtggttcgccaccttggcattgtgggagagtgcaacattcaattcgccctccatccgacctccatggaatactgcatcatcgaggtgaacgcccgactgtcccgatcctcagctctggcctcgaaggctaccgggtacccgttggccttcatcgcggccaagattgcgctgggaatccccctgccagagattaagaacgtggtgtccggaaagaccagcgcatgttttgaaccgagccttgactacatggtgacgaagatcccgaggtgggacctggacagattccacggaacgagctcacgcatcggctcctcaatgaagagcgtgggtgaggtcatggcgatcggccgcaccttcgaagagagctttcaaaaggccctgcgcatgtgccacccctccatcgagggtttcacgcccaggctgccgatgaataaagaatggccatcaaatctggatctgcgcaaggaactctccgaaccctcatcgacccggatctacgcgatcgccaaagcgatcgacgataacatgtcactggatgaaattgagaagctgacctatattgataagtggttcctgtacaagatgcgcgacatcctgaacatggaaaaaacccttaaagggctgaacagcgaatcgatgacggaggaaactctgaagcgggcaaaagagatcggcttctcggacaagcaaatcagcaaatgtctggggctgacggaagcgcagactagggaactgaggctcaaaaagaatatccacccgtgggtgaagcagatcgatactctggcggctgagtacccgtctgtcaccaactacctgtacgtgacctataatggacaagaacacgatgtgaatttcgacgaccatggaatgatggtgctggggtgcggcccttaccacatcggctcatccgtggaatttgattggtgcgctgtgtcgtcaattaggaccctgcgccagctgggcaaaaagactgtggtggtcaactgtaaccccgaaaccgtctccaccgatttcgatgaatgcgacaagctctacttcgaggaactttcattggaacggatcctcgacatctaccaccaagaggcctgtggggggtgcatcatctcggtgggtgggcagatccccaacaacctggccgtgccgctctataagaatggggtgaagattatgggcacgtcaccgctgcagatcgatcgcgcggaagataggtcaatctttagcgcggtgttggacgagttgaaggtcgcgcaggccccatggaaggctgtgaacacgctgaatgaggcactcgaatttgcaaagtcagtggactacccgtgcctgcttcgcccaagctacgtcttgagcgggagcgccatgaatgtggtcttttcagaagatgagatgaagaagttcctggaagaagccacgcgcgtgagccaggaacacccagtggtgctcacgaaatttgttgaaggtgcaagagaagttgaaatggacgcggtgggaaaggacggtagggtgatctcccatgcgatcagcgagcacgtcgaggatgcaggtgtccacagcggagatgctaccctgatgcttccgactcagactatctcgcagggtgctatcgagaaggtgaaggacgcaaccagaaagatcgcgaaggcttttgcaatctcaggcccctttaacgtgcagttcctcgtcaagggaaatgatgtcctggtcatcgagtgcaatttgcgcgcttcccggtcattcccgttcgtcagcaagaccctcggcgtagactttattgacgtggcaacgaaagtcatgatcggagagaacgtcgacgaaaaacacctgcccactctcgatcacccaatcatccctgcggactatgtggccattaaggccccgatgttctcctggccgcgacttagggatgctgatcctatcctccggtgcgagatggcttcgactggcgaagtggcttgcttcggagagggaatccataccgccttcctcaaagctatgctttcaaccggattcaagattccacagaagggaatcctgatcggaatccaacagagcttcagacctcgctttcttggagtggcggaacaactgcataatgagggattcaagctgttcgcgaccgaggccacttccgactggctgaatgctaacaacgttccggctacgccggtggcctggccgagccaagagggccaaaatccatcgctgtcgagtatccggaagctgattagggacggaagcatcgacctcgtgattaatctcccaaacaacaacaccaaatttgtgcacgacaactacgtgatccgccgcactgccgtggattctgggattccgctgctgaccaacttccaggtcaccaagctgtttgctgaagccgtgcagaaatcacgcaaggtggattcaaaatccctgttccattacagacagtattccgcagggaaggcggca
